United States Patent 9,328,346 (POLYCOMB-ASSOCIATED NON-CODING RNAS) - sequence listing, part 101

SEQ ID NO: 18981 - RNA, 450150 nt, Homo sapiens
gcgcccuguguagagcggcugcgagcgggcagcugggcucggcugccgggagccaccgcgcgggcuccgcacccuccucucgcacugccuucgcccgguccccgcgccgcggugccccaguggcccccgccgcgcuccacgccgcgcccccgcaccccgccggcuaccggccgcacaaccgccaccgcccccuggccgcgcggcucgccucgccccgccccgucccuccucgccccgccccaccccagucagccccgcccugccccgcgccgccaagcgguucccgcccucgcccagcgcccagguagcugcgaggaaacuuuugcagcggcuggguagcagcacgucucuugcuccucagggccacugccaggcuugccgaguccugggacugcucucgcuccggcugccacucucccgcgcucuccuagcucccugcgaagcaggauggccgggaccgugcgcaccgcgugcuuggugguggcgaugcugcucagcuuggacuucccgggacaggcgcagcccccgccgccgccgccggacgccaccugucaccaaguccgcuccuucuuccagagacugcagcccggacucaagugggugccagaaacucccgugccaggugaggaggggucccuugagcgugccuagcgcccagcggggagcaaggcgcgcgugguggcuguacccugagcgcgcuagccccgccgggcuguagucgugcgcccugcagcugggcacuugggaguggucggugugccuggggccuggcugggucuacugagggagggagagaggguguguguggacggagcccacaucccccagucucacgcugcugucagggaaggugugagcgggaggaaccguggggaucgccuucucgugagcgcccguuuuuuggaagggcgagaaggugggagcuauuuucccgggucucugcgaacuggcgccccacagccgagcuggugccucaugaauuugccauccuugcucgcacauacgugucagaauuucagccuuagcuggaccacagcuccagccaucccuuccccaacguacccccaccccccgccgccuuuacccagccuggguuuccuaagcucacgggcccaagugcaagcaaaguugaggacagauuucugagucugcaguggcgggugaagacacacugaggcaaacuuuugaguaagaggguccccaaaaugaggagacugaaccuuuuccuucaaaacagcaucccuuauauagguuagcgaaaucgcuuuaaaaccggugcugcuggcccagggagcaggaguccaaagauauuuaacuccucccccucccaaauucaucugccuucuugacaggcuggauccuaaaggggagaugauuucagguggaggaaaguuucugaacgccugccuuuuguucugcacaaucagaucgugccguaacgacguauuuuaacaucagccgagggcugccgcugucaacagaugaauauuaauggcccugcgugauugacuguccagcgguugggcuccuaacgcccgccuuagaauccaauuagaccaaauugcuacacugacaaugcggacaagaagagucgguuucaaacagguuaauuugucaggggugcacugagaagaaacggccaguuguauuccguaaccgugagacguuuguggccuccagggucucuucucaacucaggcauccagugaggcgcgcgucccgcgcuuccgagggaucggggagcagcccuagccaaaacuuggcugguggcucucaacaagucauggaggcgggcccgaugguuggaccaaguugugaaugcggaugcgcaccccgugggcgcugccagccaggguucacugguaggagguuaccuaggcagccagcgcgcccucagccuuuucuuuagguugaugaaaagagccgagugagccugcuguuuaguugcaaagguaauuggucacccuuuuuggugacugaaaugcauuugcgcauauguuaaauauugcuuugcaggauuucgcucuaagggagggucgaacuaccucauccccuguuaaguguuaauaauguaccacgugggcaugugcaggagcuguaaggggcaaccuaugaaucaguuccacagaacugaaacaacuggccaaucucucuccccuggaagugccaugguaauuagauuguuaaggcuagagaacaugcuuuuguugguaauguaaaaauugguccucacaggcugagcacccacaagaugaauggguccaggguugggguuggggccacauuuggcugauucgaagccaggagguaaagguggugcccaaaagaagaaaaaggccagaagaaagcacagauagucauuuagcaaccccccucuacacacacacuccugcaggcacucgcccucccuugcucucccccagcucucuggcugccugccucuuugcagcaucuguauaaaaguauugggagggcccacacgcuguguguaugagauuuggccugggcuccuucccucccuugaggccuagggauggccauacacuuauagagaagagggacuuguaauaaagauuuuucauuuuccucuacuauuucacaaacucuauaggagaaaucacuuuucaaggguuuucaucauauaaacccaacguucccugcuuuaguucuauuuaacaaacacaaacacuguugagcaucuucuacauggcaggcacuguccugacuugcacuggagccaagccaaacuucaaauauggugauccccauacagcuaccauuauauauccuggauuuuccgggggcagugcagguuucuaauacucuguccuggcaugaaacugcguguccugaauuuuagugggacaaauauggucacuguagauauggaaaacaugaaaauccuaauguucguguguggaaagagcucaucaguauuuuagggaagagacaauaauggcagacuaaauacaaugguaaguguauaauuucaaagugaauaaauguauaauuugcugcugucguucagugguuggaaauugaaagagagcugaaaauuauuugguaguuaugaaccaucaugaugaccgcuugacuuuccccccucugcauccauauuuuaagccauguucaguuugccugcugcacuauauuaacugcauuaaagcuuucuuugucccagaucaaaugagauucagucacaguaaggagaaauccucaagaauguccuguuucacuuagggggagcauuugggauugacugcuaacuucagccauuagcagaauuggguuagccugaauaagguacauuucuuaugcuaauauggaugagacuaaauggcauuugagaucagccagccuaaaaaauaaaucacuggugcugaaggacuacacuagacuuccacaaagcugaucuaaagccuuacaaucucauguucccauuucuuuuggaguguucaagucacaggauagcaguucuaaauagcauguccccaaaauccauagaucucuucauaccccacuuauuuuuuuaaggauuuguaacuuggaaagcaccacagauggaaaccaggcgcacagaguuagcauuuggcagaaaaauccauauaacugacuuucaguacagcucuuuugcccuuauuuaauuuagaaaaauucagaaaaaagccaaugagcucauaagucuagauguuuauuuuguuuugcuuaaccuacccacaggcgcaaucaagaauggauacaauuuuaggcaaggaaagugagcuaguaaucagacaaugauguuuccaauugucucaagggaauguuacagaagucuggaaaaaaauuccucuaaacaaaaaucaaguguaauucacuuuaugaaugccauacaccacuuuugucgggggagggggguaguguaagggauggauggaaaugagaaaaucaaacaaaccgugguaguguugcaacucccaaaagauugagggaucuugccuuggaaggccuuggaaagugcgagaaccaauccagaaggccaaaugccuguauggguaaaaggcagucuugaacagccaaaauugacuuggaguuucuugaaauagaugaaacaacauaaaaauaaaaagcaaugugcuugaaacaaagagauaguuugguauuuguuuuuguuguuuuuacugugagaacuagccuccguaucuggguugccagcugcgguuccccaauuaguuugaagcaguuagcgguccuaauguccagagagagaauaauaagugagguguggaaggguuuuuucucuucugagauugcacgagacauuugggugaccaggugauuuguuaaaacuuugaaacuuugaacaauacaaaaaacucuguauugugugcuacuuggaacaguuagagaauucuuucaaauguggucugaauaguacacgaauccugauacugauaccaagcugugcuuagagggagccaucaaucugauggaggacauggcugaugauugguggggcaccuugggcugaaaggagucuaacacugccaacuccuuggcagccucuguaauaggugcugggguugcagagaggagugagacacaaucccuuuugucaaggagcucacagucuaguggggaagcauacaaguaaacaggcuucccaggaaacuuguaggauuaaaaagggugaaaagggcuagaaaauaccuccaggaaauuggcugaaauggucacaauagccagccugggcaagggaaaagaacugaagagaugaagugggagauagggagaagucucuuaauagggccgccaucuuaaaaagaguuucuuaauucuuggagcaaauuccauuuuggaagcauuaggaaauacagacauaagaagaauuuuaaugguugcuaaaugacgcagauggcgucaguuuugcaauguguuuuuuucuuaugggcugguagguuguauccaauauuuugaugcaauauuuuugagcauucugcuacuuccaucuuuagaguugcaauguuugcuguucacuguagccuagaaaaaggcggcuuauuacugaucugggggaaaagaguccuggauuugucugguaugagacaagacagaaaauauguuuucucccuaaaugacagcuaucaaugaccacgccaacuucaguguuugaugcauauacaaaagcaugggucuuaagaguuaucuuauuacucauuucuaagaaaauugaagauaaucacuuauaacuugugcacacgauacaucauuuggaaagaauuucacuggggaucauguugcucaacugaaaaguucuggcaugcugaauuuguacauuuuuuugugaaugcuuccuuuuacucugaucucuagcuuuuuuucugcauaugguuauuuguauguuuuagauuauaagccucuuaaagggaaaacacugcauuugagcaguguugagcacaaggccauacagcauuuaguaaauaauuuacaaaaacagaauuucuagaucauuauguguucccuaugaacucucacauacuuucuuaagccauaugucaucuuacauauuuuaaaagccuaaguccaaauuguuacgauacauuauuggggcauguagacaaacuuuucagccuacauauauuuuggcuggagacagaugcaggcuuaccucaguuagcuggcaacucuuaccaucaguagggcuuauuaaauuuugaguacccaaauaacaaauugaaauuagcagcauuguuaugacuggcuuaguaucauuaacgaucaacaauuauuacagcacauaaauuguaggacaucucuuaaaucaagcccucuuugauuuauugucagcuagaccuuucuugcuaagguugauauuaccauauuugggaguugagcuauauaacacaugcauggaccuguugaaguaccucacagguuuuuguaaccugggaucagaacucguguacagacucaauucaagagccuauuccaggagccaaugucuauucaguccuagccaaucuuguaaauggguuagauguuuuugguaaucugcgaucuaagggacagugugggcagaaaaaucucccacucaucugcccauauuuagcaaauugucuggcuugaaacaggaucccuggcacuccauuaggaaaugagcaucagaaaauagaauccaaguuacaggccccagacuggcuuuagagacagcauaaaguaaugggaauuuaccuucugagacauaaugacagggagaaugcuguucaaaaaucaaggugaagguggguauaucagcagagaaaaugcguguuuugaaaugcuacguguaucagggggugguggugagaaugcucauuggaacauuguagccuuacuugaauaucuuguugaauauacaaaguaaagaagauuuaguucuguacuucuaauuagggcaauucaagaucaauuagacaaguguuaauuauuagaaauacuuguuugcaauuuaaaaaaaugaaucaagauugauuacuaagagauucauuuuucacuuuucccucuuuuuguguguagcuggacaaagccuaauuugagaguuuguauuuuuccucaugaauaaaaggaagucaauguuaugaccaaagugcauugcuaguguuccgaacaguuaauuacuucuaguagcugaaauuguauuuauaugcuagauuaguaaaucuacuaagcucuuugaagcguacuuaauaggcuuauguugauaaauaauugauaggaaggagauaaaauacaaguggaaguggcaauaagaagggaagucaaaagcuguuauaaaagaaacuuccaccguccagccaucugaaagcugaaaaauguacaugucucaguagaagugauguuuuugaaaauauucuguauuuuucaaaauuuccacagugaagcauauauuuauuccuuauaaauccaggagaagguacaauuuuagaguaaaauuuuacauggccuuuuugucugccuuuugcaacuaaguuuauuacuggaaaauuagaaguccccauuauggcaacuuugaaguucauguuucuaaugauaucuucccuacuagacugugaucaucuugagguuagcggcuauauuuuauucaucuuuguaucccagugucuagcacaguacaggguacaaauaauagguacucaauauguauuuauagacugaaugaaugaacggaguuagaaauguauuacaaacauaaaauuuccauaaagucaauauuuaaguaguugauuuauuuuuaccaauauacuaagguuuuuaaaaaaguaaccaguuuuuuuuuaggucaaaaauccauuuguuuucuauagguaagugauaaaggauauuaguuuaauucauuuggcuauacuauaacucucuggaagaaguagacuaguuaaaucuuauaagagguaaguauuuugugcuuguuuauaaggauauuauaaguaauuucaagacaaauugaagauauauuauacauguauguauaaaugcauaugcuuaucuucaccuuacagaucugugguauuuagguuugugaaaauaaugcaacuuggugccaguuacggaaacauacacugaauguauguaaguuuuuccucaguguucggcauuucuuaccuaaggcaucaagcuucauaaauguacauuuaaaaggacauaauccaggcugggcauggugucucacaccuguaaucccaacacuuugguaggccgaggcagggggauugcuugaggccaagaguuccagaucagccuggccaacauggggaaaccccaucucuacuaaaaauacaaaaauuagcuggacauagugguacauaccuguaaucccagcuacucaggaggcugaggcaggagaaucgcuugaaccugggaggcagagguugcagugagcugagaucauaccacugcacuccagccugggcgacagaggaagacucugucucaaaaauaaauaaauaaaauuuaaaaaaggacauaauccaaagugaauuuuccgccauggaaauuucauuuggguaggauaaagggccucaugagaguucucuuaauuucugucugcauuaggccaaacuuucaauuaguugccuagguaaacuaauugaaaguugaugggaaguucuuucaaauauucaaauagaggcccaaguaggaaaaaggauaaaaaacgaagggaugauguucauuugaaaacaaaaaucagaauucuauuugcauacucuucuccuuaauuauggcucugcucccucucucccaaacccugcauaucaguacuuacaguguguaucaugucacccugggauucuucauugcucuuugucaaacuuugguuugaaugauugaagcugauggaaacauggugaagggagaaagaguuagagugacagauauagggaggaguuuaaaagccuucacuugguauauauuagaaaguuagcuggcauacgacagauggaaaggauuggaaaauauuugaguauggaaauuugcaugugugcagagagaauacagaaggaugucccaauugcauuugguucagagaaauacuuuaucuguacuucucacuuauuauccauguuuuuugaaauauguagcuuauucauggccucuuccagacccuaugcuuauugaaugcagggaccauguuugauucaucaugauauccucuagaguggugaguagagugccuuguacagaguuuuuaauggauugauuaauuaguuggaaugaauguaagaauaaacaccuaaagacauagucuagagagcuugaccacuguccagugagauccugggguggcauauaacuauagaacauugauucucugaauguaucauugucuaaacuaauuugcagcagagacagaagggguggugaauuugaagcauauuuauuuauucucauuggcccugggagccuuguugccccucauuuauuuauuuauuuauuuauuuauuuauuuauuuauuaucauuuuuugagacagagucuugcacuguugccugagcuggagugugguggcacaaucucggcucagugcaaccucugcuucccagguucaagagauucuacugccucagcuacccgaguagcugggauuacaggugcccaccaccacacuuggcuaauuuuuguauuuuuaguagagauggcguuucaccacguuggccaggcuggucucgaacuccugaccucaggugauccgccugccucagccucccaaagugcugggauuucaggugugagucaauuuugcucccuggcgaguugccccucuuuaaaacuuacgauugaagaggagaugacaaguaaagaaauauuuuuuaacuauagcuuuaccuaagugugguguuuggauauguuuuauguauuuauauucauagauuuuauguauguauagaacgauuucuauuauuuagacagcaauaauuaauaaauauuucuguuauuuaaacuguuugaaaguuaauuguuacucuaagcaguaggugguauuucacagucauaccuuacauuugucucaugaaagccuugcuuucauauaucucauguacacacaaggcaaccacucauaaagugucugucacuucugacuuccagcaaccugccugguuccagcacacauacacacacauauuuguacacucauauacacauauauaauaucccuacaucuuuaugccuuuaauaaucuagagacuaagccuaauuuuucugggggagagcuaguggguacagcuuucagagauugaguaaaccauuuucaguuggauuggccugaaauuguagcagagcuaaucgucacugauaucauagagcuaccacucuuaaaaucaaguuccaucauuuccccaaguacacagauguuauccuuguuaaguagugacagucaccaauaaugcuaauuuggcccacuuuggagaacuacuucuagcacuggcagcuuugcauguugagugccauagaaaugagaaugugacccaagaagcaguuuccagguuagguuucauggagugauugcacugaggaccacaguuaucuguuuuggaaaacagauggaaauuugcagaaaaggaacucacuaauaaugaacuuuauaugccauuucugcauaaauauuuaaaaguuuuuaaaauuuauucuuacuucaaccaacauuuauugagcacugauacuaugccagguacugagcuaggagcugaugaacaagauaaaaucacugccagcaaggagcucccugccuagagagggauccaggcaaggaaaaacauagaugccaaggcagcaugacuguggccugcuauagagcugggcaccauguggaggccugagggcucuugagcuauggaggaauuugccuaguugucuuaagagggcugaguucaaggcugcagugagcuaccaucauaccaccacacuccagccugggugacagagagagacccugucucaaaaaaaaaagagggggcuuucauguaaagcauguacaaagguacagaauuaagaggcaaaaugacacaugacacauuuguuggacuggaauaguugggauuucuuggagcacagauguggaaguggagugaagaugaauuagaaaaauaggaaaugcugaggaguuuggguuauacccaaggaugaugaggagccuugaaaacauuuuaagaagggaaacauuauucaguuggaggaugacuggagagugagcgguggcagggaguuuuaguaacacaggugauagggcaggggaccauaaauaggagaauaaaagcuaaacuugagagaauagagggaguagaauagacaugacuuagugacuggauaugaggacagaagggagaaucuagaacuuuugguuuuucugggugguggugcuguggcacauaauaggugcuugguaaauauuuguugaacaaaugagugugcuugaaauauaggaggaacauguuuuuaagggcugaaauaaucaguuugguuucaaacagauugaguuugaaagguccuuugaugauggagguagaaaaugucugcuagguaguucaaguugcguuuuggauuacaaaagagggagaaaucagggauggagauauauacuuggaaauuaucagcauauagaugguaauugaagcccugggaacagaugaguucacugggaaagaguguauauauucuucuggaguuaaggagaagcacauaguugggacucaucagcauauaggcuuaaguuggaagucgugaguguggaugauauuuuccaggcuuuugcauguggcauguauuaaaauguauuuugccaacaucugaugauuuaaaaaaaaaaccugccaaagacuucaagaacccucuugauuaagagaaaguaugaguauauguugucaugauccaagacucugcaaauaagauaauguacuaccaaacacacacacgugcaugugcacacgugcauacacacacaucucuauguagaggaauauauuagaaucaaagaaucagacuucuauuauucuugauaguaauaaugaauaauuaugcauguuauuuaaauggaaaggcuggacaugguggcucacaccuguaaucccagcacuuuugaaggcuaaggugggaggacugauugagcccaagaguucaagaccagccugggcaacauagugaaacccugccucuucaaaaaauagaaaaauuagcugggcauaguggcauguaccugcaguuucugugacucaggaggcugagguuggaggauugccugagcccagaggcagagguugcagugagcugagaucacggcacugcacuccagccugggugacagagugagacuuugucucaaaaacaaaacaaaacaaaacaaaacaaaaaaaacgcugaaaguuauuagcuguuacucuuagcaguaggugaucuuucacaaucacacauuacauuugucuugugaaagccuugcccucauauagcucacguacacacagugcaaccacucguaaagugucuguagcuucugaguuccagcaacuuuagugguuccaacaugguggcuccucugucccucccccagggcaguacuuucccaauguaaagaaugaaaacuguaacaauauguagcuuuuggagcucuggucuguauucugcuucagacuuggcccugauggcuggucucugaaacaugugguuccaaguaaacgcuaggaauacuuguguaauugggcugaucuuucauaagugucuauggagauguauuauuuuuugguuuagggguuggggaggguuguauaauuuucuguuucucuggcauaaaugguuucuuucauuucucuguuguuuaagagauugccuucaucaguguuucuuucaacauaagcuugaaacuccuuguauuccaguugauuuuuugacaccacuuucagguugguggaauaguuuagaaggaccacgagggaagauuauggaaauuaaucuuuacugagugccuacuauaugucaauuacuuuauauuuaaccucucauuuaaucaacacaggaaaccugaaagguagguggugucagcuccauuuuacagaugaagaaacugaggcucagaaagguuuacuuacccaaagguuguguaaguggcggagccggaauuuucacccagguuugucuuacuccauagcucaugcuguuuccagaauaccuacuggaguaugagaggaagggauauagucuggauauaaaguauuugacuuaaauucccauacucugucaacuucugugacacuguguacucuggguucccuuccuacucgcuucagucuuugcuuguuugcccucuuccuccuacacuuuggauguaagugucccaguaguguuugucuuuugcccuuuccguucucucuuugcuuauucccacauccauucccaugacuucauuaucuuugcucuuugaaugauucaaccugaccucuuccuugcucuucagcucaguauuucccaguugucugcuggacauguccaucuggaaguccugccagugcuucauuuucaacagagccaaaaauuaguccauuauuuucuuuucccauccacacaaaccugccucuccuuaacguucuauauuucuggugaugguaucucugucuggcaccaacucgaaaccuugaaauugucuuugauuucuccuuuuacccaucccacacccaaauuaagugacuaaaucuugcaagucuaccucugucuauuaugucucucacucuuauggccuuggcgugcaugcccucuauuuaaguauaacagacugagccaaugaaugagaaugugauauugaaugggcuagggagagccaguaggaucucugcucaguggcuaauaauuuguaacuaguuggaaaguacugccuuugcugccuuagauggguagaaccucuagucuuggccuuggcuuaauuuaaugugaccagaggcagcuaucuccugagaucauuuggcucuucccauagggaacuaaugguuucccacuuuuucuuuugcuggcauucugggguauaucuuacuuggccaucuccagaagucagaguggaacuauugaagaguuucaaagagcuguggaagaacugugcucaguguuucaaauaguccuuucuguuuucagaaacagguuuucugcuuuguuuucaaacuucaaaguuuauuucugaaauaaaggauuauuuuccccaugguauucugaagguuuuauacaaguguuaauuucuaaaaccuaagucauuucuuggcuuuaaaacuucagugcugugggucaauuuaauaacguugccugaaggguuuuuuggccuucaaaagcugucagauugcuuuuucuuuguucuuugagaguguaagguugccucauuuaugaagcuugaaggagauguuggaaccagcauuuauucaaucauucagagucuuuucccaacaauauccaguuuuagcuucaaauuagauccuagugguaaugaaauuuacuaccaacuaauaauucgggguaaaauggguaagauucuugaaaagcuccucaacauuucauagaguagugauaagaaguagccuagguuacucuaacacccacaguuaaggggaacaacggauguucugugcacucucaucacagcccuccuggggcucaauauaccucugaagcuacugagggcccuccuucugucuguuggacuguucuccgcaucuuccuuucuccccuuccuccuacccucacacccucucucaacugauuauaauuuagaacagaaggugcuuuaugguuuuuuauauuuauuaaaugguuuuguuucuuguucucucuuaaaaaaaagaugaguggaauguuuuauauuuuccucugcauuuuaguuuuaagcuguguuuccuuuccccguagcuucugauuuccaucucuccucucucuuccuccauuuuccucugccuucuccacuucugucuguccucaauggagagaaaacaggcuuucaauuucugcccacauauuuuauuuggguaccugguuuacuuaucuugagauauuguaaaauacuauucuuuaguuugaaaaugaagagcccuaaaauauacaccaaugaauuuacauuccauuuucuaagaacugaguauuuaaaaagcuuucuauacagauagaacaaggcuagaugaccugacuuguguaccucagaucauugcuauguaguuuacauucugucucaccuugucauaacucucaauaaaugaaaauugcaucuuuguucuuagaaaucucuuuucuuacauugaaugcuuuccuuuuuucugaagauaagggagccccuuugaaacagcgcuaguguggguuaaaacugacaccuaccuuguaagcuaaccaaauuauaaccugcuuuucccugaugaaguuaucacacuucagggacauuguuuugcuugugggguuuuauugucccaguuucaauuuugacugcagguuagagauuguauuccaauuggacuauuccuugguauuuuuucucuuugucuuuauacuuauggggcucuguuguuuguccuguaucuauuaucucuuccaagcuuggccaagguuguuagguuaugcacuuauguauaaauauuuaacaagauaaguuagacaaaaugugcuugaagacauuuaagcccuguuccccaccuucccaccaccccaccccccagcucauuuuuuugcauagagucgcagauaguugcuuuaucucagauguuuagauuuggaggacauuccuuugcacuuugcuugauggacacaauuaaauggaagccuuuuagucaaucuugacuaccaaaauaguagcaccaaguaacagauaacauuagguucuucuuccuauuuuuuuuuuuuucuaacugguuauccaaacucccuuaagccagagaguuuuagguaugagauuguguguuuuuuaagaaaauauuacggauaaagacuaauguucucaagucaggaauaacaauuaguaccauucauuaaucaggaggcauguuuugacucuggguccuggcuaggaaauauaaacugugaaagucacacauauauaugaaccucaagcaaauuuaugacuugucagccuuuuaagguuaaauucuuaaccccagaucggagcuggcuuuauauguggagcccggcacauuccucugggccacugagcacgccccuccccagcccuuugcuuaacagcagcuaguggccuaaugagcaagaaggauuucugucucuuaucagcugccuaaacagcaacaggaaggcugauauacggaguacaggucaaaaccugaguucuugaaccaaaaagcuacaaggucaguuuaaaacucuagauaugugguaccgcuauagucaucaauaccugucaguaaaggaguuagacacuugaguucaaacaaauaguaauaguugucaaaaguaugaaucgucuaauuaauuuugcuaauaguucuuuccuucuuuguuuaguucuuuuagaaauagccuucauauacucuuuaaugagcuuuuaguuugugccuggagguuguuauggucguguaggaguguuugauugucaucuagugaugaugauggaggcgaggauauuuauauuuuggcccagauuuuggaaggggcugccaaauaaagguaaauagauaucuacuacuauuuuuauuucuuuuuaaacugggguuuuuuugcauaugcauucaacuugccauggagucagagaaaccuuugugccuccucauauugcacucagauguuuuuuuuuaaaggagaaauccucauugccuguuucuuagaugcacuuggaauccaggcucagauucacguagaauaaauauuuuaggguauucagugcccaucauagugaaagccccuugacuuucaucuucugcauuugcauguuuucagagacaauaaugaaaacuuuuuuucagauucuguuguguuauugaaaauccuauuuacauaaacaggcauuguuguggcuuagggaagaauguggggucccauucuuuagcuccuuguauaucuuugcuaaggcucgucuaaauagaaguaaugacgcuuuagucuaagcagcuuuucucauuuagguaagcagggugguuugaaauuucaguuuacuggauaauugagucucuucuucuuaauuauuucaggcaugcagguugcucucuuuauaguaaagacccuaaaaaucuaguaaucuccucaggcauccauuugguaauaaaguccugugcauuuucagggguuaauuuucaugacaauuguguguugccgcuccacccccaccccugaagaaauucugcuguuuuagagccuuggucuccucacaguugcaaaaacacacuuaaaaauauauuaggauguugcuggaauuacuggaucuagaggacauuuaaauguauucagauucaugcucauuauacaaauuuaauuuaggguuuuuaauagccuuguuauauuucuuggaaaaucaugugccugacuuugccagacuugguuuucugcccugaaugaaaaauggguaucagugcaaaagugcagccuaaguauccccuauucuauccuuuuucucuucuuaaaaaacaaaaacaaacagaaaaaacauucacagaggucaucuggugcagugaggugggaaaaacuaaaaaggaaaaaaaaaaaaaaagccuagguugccuucacaucugcuagucauucccacuagugugacuucaauucagcaaguuuuuauugagcaccugugaugggggcggugcuaauaaucguuaacauuuauugagccaggcacugugcuaagcucuuuaugggcaacauccuacuuaauccucacaacagcacuaccagguggauagcauuguuucccccauuuuacagaugaggaaacugaggcuuagagagguuuaaugacuuguucaagaucaaauagcuaugaaauuaaucaaacccaguuagucugguuccagagccauguuccuaaugauuacucuugugauggguucagcauuuguaggaauuacuccucaauucaguuuugagaacccaguaugugugagaugcuagggauucaaauucaaauacuccccucucccugcucuugguaggagaagcagacauguagacagacgacggccauguauggagugguccccacguugauugagggggaaagaggaagaaaugggaagaccaguggcuugaaccugugggaaugcuacgucacgaaggcagcccagcagccugggguuauagguauuucuuuuccuguuuggugaaggucauccuuugaguugaacugccucaaugauuguaucaaccuguuuccaucauugccucaacccaguguagcaucagcuaccuugaacccagcacuccuaagacaugcauggucagcacaguuugggccaacuggccucauagugucaccauuucccuuucaguuuucccuuaaaaaguaaaaagcaggcuggacacgguggcucaugccacccagcacuuugggaggcugaggugggcagaugacuugagcucaggauuucaagaccagccugggcaacauggcaaaaccccccaucucuacaaaaauaaaaaauaaauuagcugggcagggugcugugcaccuguaaucccaguuacuugggaagcugaggugggaggaucgcuugagcuugagagguggagguugcagugagccaagauugcaccauugcacuccagccugggcaacgggaguaaaaucuugucucaaaaaaacaaaacaaaacaaaacaaacaaacaaaaaaacuaaaaaauaaaugaggcagauauuccugaaccaaacugcuguccucucaagagcuggugguuuucugaagacaaguuauauaagacuggcaagccacagggagacucuggauccaggcuugguucauuccgcuugaucuagagcccuccuggugcuaccucuuggagcccacacugggaucuggagaucucugugucugaaucacccacgauuugaugggagaaugaaguuacucuuaacuguuuuugaguuuuucacuaaaaucauaggaauggaagggaaaucuccaaaucaccuguuuggauaauuuauuuguguuuuucauagcuccugaagaaagcaaggaguaaaaaaguuauuacugagcaucauugaaaaaucuuuuauguguugcauucauaaccuaauauuucccucaauuuuaggaaacauuugguucagagaaaagugaauucacuaauguacguguggguguuuuggaaacaauguccucuagcuuccagugucagcuuaccaagaacucuugugucuccaaguuucuuauaguugcucugcagugcuuugcuugccaacucuacuccugugcacuuucuccuccauuaaaucucuuccacagcaaaggguugccaccaagucuagacuuuaguaacaugcagaaggagggugaauuagugaggauucugauuugcauuacaugaggguaggagaaggaggaaaaucuauccuucccaguccuucagauacucaaguucuaacacaacacuauguugaagauguauaaaauuacuggagcauuuacacagcuauuccccaagauggcauaaaugccacagcacuagagcacguuaguauagacacucggauaagcugaagaaugggaaaaaggaaaagaucaauaacagcgcuucucacucggggaucaagagugaguguuugauuuucuuuugguugcauuuugcucaggugcaguguguauguuguacuaacaaggcaacugauuccuuuuuccacagguuccuaucauagggaaaggggaaagauauaauagagggcacggauuauuuacaguggccgagaauguaauuacaaggcgcaauggcuugaaacugaaauuuaaguuagcuauuagagcugggagaagcaucuuaacaguaagggcaguugggcauuggaaagauuugccugggagcuuguuaaacaacaucuccaggaaugcugaagaccaggaugggggaaugugaagaaaagcucauaucaaauucagaguugugcuggaggcccagacugaucugcaucuuucauuauugccuagcucccuuuaugauuauucaauugcuaauagcuugaaacaauuuuuuucauguauucaaaauaugccuaauuugguaagcauaacaaaagaaaugccuuugagcagugagaaugaggcuuuuagacuggucugagcauucuucuaacagacuuucuggaauaugggccaacaacggagacaauauuauuaguauuuuuugcuucugcaagacuuuuuccuucuuauuauaugggacuauugcuguuaaaguaguauucggccucuauuaauauuacuucuucaaagcugaccuuacagaaaauuugguuuuagucccuguuuaucuuuuucuugaucuuuccccccuuuuuaacacuucuccaguacuauccagguguucuggguugccucucuccccccuacuccuucuauccugugcuagaggaagauuccuaguaaagucuuuagcccugagguaugagggcauuacucacagagugcuauacaugaagacaacacgugaugaaauggcuuaaccaaaguaguaacucaccaaugaugaaacauuuagauauuauuaggcagaaacauuuagguuggguagaggaggaaagagaguguauuaguuuccuagggcugccauaucaaauuaccucaaauuggguggcuuaaaacaacugaaauuuauucucucacagcccucauggucagaaguccaaaaucaaugggucagcagggcugugcucucuucauagauucucagagagaaucauuccucgccucuuccggcuucugguggcuccaggcauuuuucgguuugugguuguaucauuccaaucucugccuccauccucacauggccuuuuacucuucuugugucucuccucugugugucucuuauaagggcacuugucuuuggauuuaggauccaccuagauaauccaggaggauugacaccucuccaguccaguccuauccagguguucuggguugccucccuccccacuacuccuucuguccugugcuggaggaagaucucuagccugauccuuaauuacaucugcaaagacccguuuuuccaaauaaggucacauuuacagguuccaggguuuaggacauggacauauauugggggugggggggggugacaccauucaacccaccauauagaggagagcuuucuggggccuucugaaucauaccaguuuaccagaacucucuacuguaaggaggaacuuguuugaagaaaucuuaaaguuaguuguaaagugucagaaaugucagugcgcuuccugagagggauguggguggcaacuacuguuaacucauuuuuuaaaugguuaaauugaggaccugggaaauaaaaugacuuaaaguuaguuguaaagugucaaaaaugucagugugcuuccugagggggauguggguggcaacuacuguuaacucauuuuucaaaugguuaaauuaaggaccugggaaauaaaaugacuuacccaagucacuggaucagaagaagaguucugaacaagaucagaaaaagaggucugaaacaaugagucuuacccaagucacuggaucagaagaagaggccugaaacaagacagaucuacuucuggccaccagagcugugagagaauaaauuucaguuguuuuaagccacccaauuugagguaauuugauauggaagcccuaggaaacuaauacacucuuucccccuuuaccugaccuaaauguuucugcccaauaaugucuacaugugucaucauuggugaguuacuacuuugguuaagccauuucaccaugggcuuuaggucuuaccucaucauucuuguugaacuuuuuuccugaaaaaauauaauauuuuuucuaagcauuuuugccacgggaaggcaauuguugcuuauuaugcaccugaaaaaccuuuuugcaggaucuguaggaucaaggcaguggugcacuugcaaucuacugcagcuuuccaccuggucuuugugguuugcugaaagaucagcuacagggaauuuuagaagccagaacaucugugaagcaaaagccuuccuuuuuagauucaggcauacugaguuuuagguacaacuugcgugcaaagugguaaauauaugguuuucacagaugagauauucucugaagaaaugcugucacacuuguuuaugacaaaaagaccaguucuaacauuuauggcuguggggcaucucuccucugaugcauuaucagagcauaccagugacaacuguggugugucaagagauuagugaguuagaguguggccuucauggaaacagagagaaaggaacccugggggucaccagauucagccucccuccuaccuaguguaggaguccauucugugguauaugacauugcuacccaaauuaugccugaaugccucaagagacagggagauuacuauguauaggaaguaggcugucauuguugacuaauauuuguucauuaauucagcaaccauuuauugaguguguacuauguacuggacacuaggccaugucagggaauacagagauggccaaaauauagcucuugcccacagaaaccuauaacuuaauaguagggauaagaaagguauaccaaugacuacaaaaccuagauugcaaaacacauuguuagagaaguacaaaaugaacagaaaauucugagagauaacagcucaaagaguucauuuggagaggaggggagaaacaugaaagacaccugagagagaccuuauggaugagaauauuuuaauagcugaagcuagggaaagagugcuucagagacaggaaaagcaugagcgaaacagggaagcaggaaauggaggcauguguuuggaaaacauuaaauaagaguuuaauuuaauucucacaacgaccuugagaguagguguuauugucuccauuuuauagguaaggaaacugaggcucagagauuaaguaacuugccuaagaucacacagcuaaguggauggccaaguugagguucacauucuggucugucugauuucagaguuuuucccuuugccacugcaugccauccaucaggaggauaucugccauuaguuggcuucuggagauacaggggcauauauguaaaaggacaugugguuauuacuugggauacaaugcuauaaaggccaacuuguuggucuuugccuuagccccauauccguauucauguaucuucaagugauauugacaaagcguuccuaaaagggcgaaagcaaguccuuugcuucuuuuguguccucccaaugcccgguugagaaugggcucagugaauauugauuacccuacaauugggaaacuuagauuugcuaguccaaucccuuugaggaaaacaggcccagauuugggaacacacuugauaaagucacacagcugauuugguagcagagcagauaauaacauuuuagcuuugauagggaagagcucuuuucccucugaugugauuucauacauguuggggagggaccuagcacuuagauugggccuaggguguugaaauucucagcucugccucaggucugcguauuuaaagauuguaucugaaaaauaaaaauuaaacaucuucugaaagacagggucucagcuacuuaucugaguagaauaacaauuagugaagaagugacuaggggaggcaggaaaauuaccucaguuuagucccucuggcagaauucuaaacuagaagauucugcaucccaacuccagcauagcuggcauuguucuccaacccaguuuucuuuuuauuaggguguuuccccucaucuaaauaaucaaugaugugcguguaugugugugaauacuuucgcuuuucuaaaaguugcucuaguagcaucaauuaaucugacccaguuccuuuaaaacugaacucucuugaaauucugacauuaccuccaagugaaaggggagaacaucaagcccaaacuacaaugggccccuugagacacaaagaugaaucacucaaggguccuucccucaaggaacuuaaaucuaguggaaauaaggcaugcauauauaacuuuguugcaauauggagagugugagaagugucuuuauaaagacuggagaguuccgugggaauucaauggauagaaagcuuuuggaguucaucuccuucugcucccauaaacauucuuucccaugggaauccaguccaaagauaacgaguagucaucuuauagcaggguucacauagcuccuugucaucuggcuucugccacucuccaccacuucaauuuucccuuuagccuugccagguuccuuggcagugccugaagaugccacccacuuucacaccccugugcccuuacuccauuuucuuggagguuuuuaaagaaguagaaugacauaaucagauauguacuuuagaaauauuucucugggacuuggguggagaaggguauagaggcaggaaggccaguuuggaggcuguuguuaguuguccaagugaaagaaggugaggugaugagggagcaauggaaaggaggggaaugauuacauuuagaaagcaaaaucaguagcauuuggugacauuuggcuauagcagaugagggugugagugaaguauccagaaugagugaaagguuucuaguuaauuugagaguccauuuucuauaccaauucaugaacucuggugcagggaccauguccuguucauuauuauauuccuugggcugggcauaguccuuggcauaaaguaggcauucaguaaauguuggaugaaugaauuguucaccacuuuggcaagguggauauaauccgugaauuuguauucucagagcacauguugaccacugguugguaaagugguccaggaagaaccucuuuaugggagaguguagugaucuggggauucaaccuuuacugggcaugaaaugauaggcaguuaauugacaguuggcaguagagauaaagguaauucuuucuuuaauuuucgggcuuagagaauggcuuaucuccacgguugcuuuaaacucccaguacuccagugugguagugacauuuuggccugccuuuuacagaggcagaguccaugguggccccaggcacggucuuugauuuaaagucugagcuccugauacccaggugcgcccucugcaaagucauguucuuucaggcuaaauaacagaaggguaaccuucagcuggguucccuaagaugauuucuuucgccagcaaucaucacuuuccccaccgguuuuuaaugcagccauuucuuucaucuguauuccuaucuugauuugugagaaauuaaaugagcauguaagaugugguuuagauaaugauuaauuaggggaaaaggcgucauuccaauagcaagucacuauuauaugcuaaggaaauuaguucauauuuuuggauggcaaauugacuuguccugcauuuaaaaagauaccuuuuaaaaaaugccuguuauggcuuuuuuugguucauuaguagagcaaccugcacuuaauccuuuggaugauuuuaauaggcaucuauuauuuucccuacaagucaugaagcaaccaguuugggauaucauuaauucuuuuguuuaauauuaauuuaaugauaaugcauuauuauuuucagcacaaaguacuuuuguuagcaaaaaaaaaaauaaucugccauucauaaagcagaccuuggcaaugaaaugugucaaaucaucauauauauauauagaaaagauuucaauuuucauuguuacugagcccugaugauucauucucuucuguugcuguuugaauaugcuuuaucugcucuuagaaaaguguaaggaucaaggucuacauuaauauuuuuucuguucuuuaaugugauuuuugacaauuuguaguuauuaacuaaaauugcagucuaguaaaauaaccaacauauagaacaugauaaagguaauuagagaaucagagaccuggaagugaccuugagggauuauuuaguccauuucccaauuucaagguguauggcuaaucuuccuaaacagcacucuucaucauauuaugucucugcuugagaagcuccagugguccauuacugccuaggagucaagcccacaggucucugccugcauucaaggcccuucaaauuugggucugucuuaccugauaagcuauuacgccccagggucuagccagucugcaguuauguuagcuuugccccguuauuccacuguuuccaaacacauuucacccauuggccucuccacaucuuuuccauucuguauggucuaccucaagccucaccuucuccuggaagucuucuuugacuccuagagccucuggugagcauucccuuauccagcaaauguugucuauaucacauauuuuaaaagucaacuuuauugagauauaauuuacaaacaauaagaugcacucauuuuaagugaagaguuugaugaguuuugacaaauguguacacccauguaaccaguaaccuaauuagaauguagacuauuucuuccaccucagaaaauacacugcauauuuugucacguaaccguauaccaacuuucacuguucucuagcuauuauuuugugugaaagucuagucucucagcaugaauuuaucuuugguuuacuuuuaauuaaugcauauugaauauuuacuuuguaucaaaaagacuaagagcuucacaugcauaaucucacuuaauuuuuguaauaacuaaguacuauugaugaucccauguuauagauaagggcaaaaaguuagguagagguugaauaaccuacccuugcuugugcagcuagcaagugauagggcuaggauuaaauuguaaacaacuugaccugaggaaucauaaguguuuuguuauuugcugcccacuagugccugugaugauacugaccucgaagccauuaaugcugauuuggaauaaaaauccaauagaacugacacauugaaacagcccuauacacacuguuggcuuuccucuuccaaguauggacagggauuaggccuggaauggggucuccaagugaaugugguaagcauaggacuucauagcaaagagaagcugaagucccacuccugggggaggugacuaaagaaaaccaggagcagucuaaaaggucagauauuuaaauggagcuaacaaagagcgagaagugggcccaaaggaaagagucugugauggaggucaagaaggccaagccacagguagccaggccugaaaagaucuccugucacaagaguaugccucagaagaaagccuucuguggaccaucugugguuagccucuaggaguggaguaaucccccagaagaaaagcuuccauagcucaaauauccccuuuuacuuguaugacuggacccaaugugcgagaaguugucuuaaaauaauuaguaauaaauuacuucauaguucauucaacugaaacaucuauuuauuguaucuucaagauguuuggaauuuuuuuuuuuuuuuuuucgagacgaagucucacucugucucccaggcuggagugcaguggcacgaucucagcucacugcaaccuccgccuccuggguucaagcgauucucgugccucaaccuccggaguagcugggauuacaggugugugccaucauugccuggcuguuuuuuuuuuuuguuuuuuuuuuuuuucaguagagaugggguuucgccauguuggccaggcguugguaguuuacuuuuuugguauuuuaaaauauuuuuccaagauccaaguuaaguguacagauguaacguuuucagggucaucugccuccccuugaucuuuuuucuuuuuuaucuuuuuuuuuuuuuuuugagacugggucucacucuguuguccaggcuggagugcaguggugccaucauggcucacuauagccucgaccucugagcccaagugauccucccuccucagccucccaaauagcugcaaccacaggcaugcacuaccaugccuaguuacauuaaaaaaaaauuuuuuuauagagacggggucucacuauguugcccaggcuggucucaaacuccugggcucaagggaugcucccaccucagccucccaaagugcugggauuacaggugugagccaccaugcccagacuccacuugcucuucuuagauauagacagacacaaaguucuuuguuaguauucucaaucugcagcccucauuaauucaacacuacguguacagggcugaaugggagugaaggaguaucccaaaggagaugggagucauucucugcucuucaggaacuuacaguuuaggagaggagauuauaguaugaagguacuuuuuaauccuucaauauaaaugggaacuagcagcccuguaaugacuucaguuaauuuuuuuagcgucugggaaugcaaguuauuaagcccuaaagagcugaaccuuucuggcucauuugaauagucaauugcuaagucuucuccuuaucuccaucccaggcuauauugcuugucuccauuccuuuuucccagcugaauuccauuuuuacaaaaaaaaaauaauaauaauaaagugagaacuccucuuugauagcugggcuucacgauuacuugucccuuauaucuaauaaagggguuauuuucuuuuaauuuuccuuugucccucauauauuuaaagagugcuuuuguauuuaguaugucuuuuguagguggcaucuuauuucuugaauuuacauuucugcuuuuauucaugcaaguacguaccaguucuuggcuuaucuccuuagucaucugcuuuugguuuuaguuuuucuucauuccauuugggauucaguucccagguuaauucuuuguuuacuugaugagaauucccucuaaauucuuuuucuguuucuuucuguuuucuguguucuuucuguuuuauuuauuucaugcacauguccauacauugaaauaguuauauuucauuauugucauuucauuuaggcaugccuagcucaccuaggcuucuuccucaugcugucuugugauggggcuuuucuuaaaagcuggucugugaaauuuacugaaauuuauaugaaauuuacuuaauacaaaauaucuuuuccuuuggcauguauuucucuccuuccugguuuggaaauucugaauucuuaaucaguuuauggguguuuuauuuccuuaaaucuauagcuaacuuuuagcccauagaucaauuauaccaguucacucauuaaccaagcaguaauaacugggagggaggguaaauauugcaacauauccacuuauauuuggauaucauauauaccuuucuucaggacaucugacauguuuucccaaaaguucucauuugaaauuuuauucuuuuaaagauuuuuggcuuaccugauucuucagguggugggaguuuauaaaaugaugagacuuggccaacucagggaagggacauacuguaugcaagcucuaaauuacuauaugaauuaucauaucaaaggcaaaucaaacuggugucaugguaguucaaagagucauucccggacccauguagguacaucaagcaacaauuuguuaccaucuaagaucugaaccacucauagcacuucacugagaaaagaucugagcccuuuuauuugauaacucccacuaccuagagcuggugggaauaggaccaguacuaacagucacccugccaaauaaacucaaccauuccugaaaacuggaagugauugucaaugcaaauuuagaaacacaaaggauuuuaucuauaaugauuaauuuuaugaacuuauuuaaauaugauauuuugaacauguacuacuuaggcaucaguuuaucaagaaaguaaauaaagccuugcuagaugaacaggaacuuuguaugugaaaguaccugccacauaggauuuuucaugucuacauaugugucccaaccagcauuguuuaaauuuagauuagcuacucuuacccaaggagacucuuucccuucuugguccaguaaacugcaucaguuccuauuccuagaauagcauuacauuuuguaacuucauguaguaagaacacagugagcuagaacuagcuguuucuuuacuuuuucugaagauaaucauaaagcuuuaagcuuagaccauauugaaaaucagucuaaggcuuguauaugagauugaaauuuauaggagauaaaucugaacucuaugucugcagaccccaaaugguauuuugacauuaaauaucaccuuuccaucuaguacuauaaauuacagugcuggguucaguuuggugauauguauuaucuguguucuccuuuacugcuuuugucagcagcucccuugagaagggugaaguggagagcuuggagucaauacccuggaccccagcagugaugucaugugaggcaaaacuugaugaauuucauuccuaaauuaagaaaaucuggacacauaaguuaaggacaugaucaacugaaauuccuagggaaauaagauguuguaauaaaaauaaauuuucuggugacuuagggcuaacuagucuccccucauuuuuuaaaaaaauaaaacauccaauuauugaaaaacugucuaaaaugucugaauaugcuuucuaguaugacuucaguaagauuucuugaaacuugcuuuucugaggaccuuguaaaacuuuaggggagucauccuuauaucccauauacacauuuuuuuuucauucuaccuucuuaguuugcuuuauugcacucauuuacuaugcaguagcuauuuaucucugcuagucccuuuagacggugaacuucuuuggagaagggauuaaauuucucuuguucaaagucguaccuccagcauguagcacagugccuggcauauagaagguauguuagacuggguucucugagaagcagaugccaguuggauucauaucuaauccaauauggaauagaugugcaagggauuuauugggggaaaacacuuaugaaggaaaaugaggagggagcugaaggaggccggaaaagccaucagaccauggugcaggucugacccuuguggaagagagaggaaaggaaggaagguugaguaggaggaaucuuagacugcagugccguuuuaagaaaguuuggcaaggucaauggggaguccucaagccaaaguccccugugagcaaaguccuggguuacaggacuuaguaucuuugccaugcucagucauuggcugggagcagcccccagggaauguggcuuaggaacaaugugguggugaauucaaagggcagcagcugggaccauuagucaauuacauuccccacaguagaagaucugagaugcccauauucacagccaccacagaaggagaucaacaaaugcuaauuggagaaagagucuggcaguggcucaugccuguaaucccagcacuuugggaggccgagguggauggaucaccugagggcaggaguucgagaccagccugcccaacauggcgaaaccccaucucuacuaacaauacaaaaaauuagccaggcgugguggcagaugccuguaaucccagcuacuugggaggcugaggcaggagaaucccuugaacccgggagguggagguugcugugagcagagauagcaccacugcacuccagccugggcgacaagagcgaaacuccaucucaaaaaaaaaaaaaaaaaaaaaaaaaagagaaaguuugaguaagacagaaguugaagagaggaaggagauuggucuuaauauucacugagcccuaauauuuguuaguauugguggaggauauaaaaucaucagauucacacucaccuuccucaucucuccucaaacguuaccuuauggaagaugccuucucugacuaccauaugcaaaacagaauagucuccacaaucaucacauucuguaucucccuuacuuuacuuuuuaaaaauuaaaaacaagcugggagaaucgcuugaacccaggagguggagguugcagugagcugagaucgcgccacugcacuccagccugggcaaugagagugagacuccgucucaagaaaaauaaaaaauaaaaauaaauaaauaaaacaauugacaccuuuauugaggcauaauugauauauaauaaacuacauauuuuaagggugcaaguugauaauuuugacaugcauauacacccgugaaaccauuaccacaauaaaaauaaugaacauauccaucacuccccagaguuucuccacuacucuuuauaaacccuuccuccuaccccuccugcccaccaucucccuuaacaacgacugaacugcuuucugucacucuagauuaguuucuguuuuuuagacuuuuguauaaacggaaccauagaguaugugcuucuuuuugaucuggcuucuuucacauagcauaauguuuuugaguuuugucccuccaguaguaugcauuaaugguucauuccuuuuuauggcuaaauagaauuccauuuuauagauauaccacaguuuguuuuccuuuccuuacuuuguuuuacuuucucuauaguauuuaucaccuuuugacauuauguuuauauuuuuguuuguuuguuaucucccagaauguaagcuccaugagggcggggacuuugcuuuguauacuguuacaaccacagugcuuggcauauaguaggcaccuaauaaauauuuguugaaugacuuguaucuugcuucagaccuuuaguuaaaacaacaacacagcuuugauaugauauugauguuuugaucauuuauccugaaaagcaguauuggguuggccagacauacauuucauuuggaaaucauaacuggaauuuugaaaauuguuucuugguugucuucucauucauacauuauaaucaggaaaaauaaauuauaggagugaagauugaucuuuuaaaagacaaacuaaauaucgguguucagugauguguuuuuggugcuauaaauuaguuuaugcagaauuuaugagucaaaccuaggcaauuaauucugaugguuauucaaaaagagucagccauaaggacaauugggagaaagcagggauuaguuaagaugaaacguaauuuugaauaaucaaaauuuuacuguaucucaaaagaaaugcauuguuugcccuguuugccaugugugaguguguguguaggggguggggguggugugggugugggugugugagagagagauccugcuuacugaaacaugaaaaccuuguuuguuucaggaucagauuugcaaguaugucucccuaagggcccaacaugcugcucaagaaagauggaagaaaaauaccaacuaacagcacgauugaacauggaacagcugcuucagucugcaaguauggagcucaaguucuuaauuauucagaaugcugcgguuuuccaaggugaguucuggggauuauuuuagaugugcugcuuaguggcaucauuauuugggcacugggcuuucaaauacuaaguauaauuuauaaauuaccauuccagcauuaaugcuugcuauuaaaaaccucccagugagaaauucugguuuaaaaaaacacauuuucagagaagcuucauuucaaucuuuggaaaggugaguauugucaaaaaaucauuguccaaggacauucuauuuaccuguauauaaagguuauaaaucucuacagaaagaauaaauaauauuuucucucagcuugauucaaaaacaaaaaaguucccuuaaauacugagcccaguuuucuccaggaaugaguuagaugcuugugggauacauguggacuccuucugaccacuaggaccauuuccauuuaagaggcagacacuggcuuguuggcccaggauuuucccauuggugugaguggugaccucuccucucuuugugacucucacuucuuaccaugccugugaaugauugcaagagaagcuguuguggcauugccagaacggguaggaaaugacacuucuccuugcuaacuuaguaggacuaucauagcaggauggggaguaccuccuucaauucuaacacccagcuaggaagaugaugaugaugauggaggugguggugguggugaugauagcagacacuuauauggcaccaugugcuaggugcucuuuuaagugguuuacauguauuaauucauuuaauccucacaauauaauuaugaguagauguuaguauccuuauuuugucgauggaaaucuaaggcacagaaugauuaaguaacuugcucaaggccacaaaauuaauaaauaaauggugaaggcaggauuugaacccagauggcauggcucuuagagucuauucuuuuaacuauccccauaggcugccuccuguaacugggaaaauuaauuauggguauucacaauuaauuaguaauuaauuaauuaucagucuuucuucuauccuuccucaagcagagggaaucagccaccuuuuucuugccucaccaagagaggaucgaggucagauagaaaaauaacacuucugacugcuugacauugcaaagcuugagauuuauggcacuguuacaagaauuaaccucugaauuguaagguguguugauuauagcuuauuuuguguauuauaaugaaaucuuuagaauuagcuaagaaaauuguucagauuaguuaauaaagccuacauucacaacaguuucuugggucaaagccucaggggguauuagguugauuauaugaaguauaauauauaagcuugaaguauuuguuaaacuauuuaugcagucagacucuugugaagaguuuguugagacuaacaauuuggugauagaaugaauaauuuagacagauuuuaaaaauacauguagcauucaugaacuucuuagauugguuuuggaguugaucuguuggaugaaaguggggugagaagaaaugaugugacaugagaauuggguugaagcagagagcugaaucuuacucuuuggggcaucaaggucccuuuuuagaacagaguauuagugauuuguuuaauucccagaauauccaagcucacagauguuaccuuacaauccuugucugguuggaggggagugguagagugaucauacuggcauuuuaacauuuacaguagcugacauggcuauguaucugagggcccgggucgucagcauuuacaccucuguccaguucugcacuuugcccacuguguuuucuagaucugcaaaaaugugagacuaggagagaaaaaaaguucugacaagauuuugguuggauuagcuuccagauaagccugcuauagcuuggaggcugaauacuagucaugugaacagaggguagaaaaugggggcagcaucuacuaauuguaucucucucucccuuucucucugucucucuuucacuucacacacacacacacacacacacacacacacacacacacacacacacuuucuugaauuguggggauagacagaaggacaacccuagcaaaggaacauggagacaaugaaauuaugucugagcuaauuauugcuagugcccuuuaccuugucaccaucgguacucauucuuuaucuuguuucacucccucuucucauucuuuuccugccucacuuuuagaaaaaauaaacccaacaaggaaaaauaaaccaugaucccagaccucaaggcacuuguacaauguuucagaagacauugccccuaaauccuuuuguaacaaacauuuggagagacaagacuucaaacuggggaccacuacaagauaauguauuauuaauugcuaagaaaaagagagcauccacuuuuuuucuuucuuaugaccguuuauuauuccauugaauugaaauuaggagacacaauuguuuuuccccuaaaauacauccccuccccaauauucugguagaccaaauuagugagaaaaccaucccaguacuucacucaugugaaauuugaugugacggcuuuugcuagcuauuuucuccaucacaugaaguugaagaaagcucaucuugaucuuggccuagauccacaaucucuuugguauuccuucacuaguccacauuggggguauuuaagcagugagugcuuucugcaaauaugugcacaguuccacgagcaauccuuacugccucgauuuggauuuuaugucuucauuugcaggaagccuuugcccucauaaaugagccuggggcccuuugcuacagugguuggagugcucuauugcuaauguuguuuugauaaugauugaagcauuuaaaaaaguuguucuuuauucucagucuuugcauugccucguuuccuaaauuuaauuuacuuagaugugcuuaguaaaauggggcagcacaauugcuuuuuguuucugcuuaauuaauucuuucugaaaaacuccacuaaaaguagacuuuccuuucucuuuuucuuuuucuucuccccuaccuuauaauaguuaugaugauaacaauagugaagauuuauuaagugccuacuauaugaugcugacuuuuacauaauuaucucauuuaauuuucccaacagcccuaugaggucuguacuguaauuaucuccauuuuacagaugaggaaacucauugaugccacagcuucuucugagccaucacgugacauggcuuuccuuguucuuaauguccuugagguaaaacaaaauugagaaguuggauuugugguucuugugaagaaaaauggaauagaauucugaauuuuucgucaucucacuaccaccucuauaccuuuaaaccuugaguucuauuuucuuuguagaauuuuauuaugauuuucagccuuguacuaucaagaaauauuugggguacauccaggucuuuucuagauguuggauaauucuagauuuccccaagauaccacugacuuugagugauaauagacucuuuuauaugcagcaauaccuuguuuuuucuggaaguugccuauuccacaacuugaacucucuucaucagaaaggaaaaauaguggucgagcaggaaaucaucucaucugaaagguuuuugaguccuugcuuagagccuacuacuguuccauguuuaugcguagucuuggcacacuugauuuucuggcuuucuagggggggauccaagaacucacuaaauguggcacuuggggacauuuaauagaggacuauacuccuacaggccacaguggcuccuguauuacguuagguccaagugauguucacaaugugguuacaaguaaauaaggaaaguccaacuuacauucacuguccuuuucuuaauauuuccauuuuaaauggcuaaaaugaauuuccucagugcuuaagaucagcgaaagaaacacuggacuuggagucagaaaauccaaguucaaauucuagaucugcauuuaugagcuuuauauuuuggggcaguuauuuagacuccaguagccucaguuuucuuaucugcaaaaugggcauaaaaauugcaguccugcuuacuuuuguaaaguagaaauaaugaaugugaaaguaucuugaaaacuguaaaacaccauaugcaugcauuaucuagacagcucauuuauguggaccacuuuaccccagguggugccaaauaaaugaugcauuaucauuacagacauuaaccucgacaaggcuggaguucaugauguauuucaacaacuuuugccacuuauugaugauauauaugcaaacagcuccaguguacagacaaaagaguacuuaggcaaaagacucuuugggaaagggguuuauuuuaugcacucuuggaugugaggcuguacuguuugaagugucaauacugccaggagcaauccuuuuuucagcuuccugaagcuucucuucuggcuaguaucugguguauuucauauaugaauaagcagcuagaucaggagagguuugucgguucaggccauauuuuaauugcauuuuuugguccacacuauuauggcagagaggagaaaaagguugguauaagucuagagaucuucaguugauccucacucaguauuggcaagcuugcuuucuucuaccugcuuucuguggagaugaaaaagacaucucugaaugggggggagggcagcguuucugugcuucuucuguuguuucucucccuuauuuucuguuuucaucagcucuuggcaguuuuuagacucucuucugucagauuccugucucucccacucccccuaaauaaaauugaccuugguuagaauacccuuuucugucagcucacagcaauuucuccagucauuucugcuugaaauaacuguuuagggacauuauucaagcaaagcuuuuuuccuucacaguuaauaugugacucaauaauugcuugaauguugauaaacauguuuuugagauucaaucauuugcuaauuuaguuuuuauuauguaguggggguuuuaagugaguacugagccauuuuucuccauuucacaauucuuucccccugacuagccugacaguucugcccgcacuccagcucugugcaggcugagccccauugcauccccaacucuaacuguccgccagucugucacaaccccuuucuugguuaaaaauaauguaugggagagaauaauuacacugaugucuaaucaaaacuuaauucauuugccgaggcuaaauacaauagcauuaaacugaauaggauaauuuuaggaacucaaaccauggccaugagugaaguuauauauccucaaaaauguaaauuauuaaucaaaccgcucaucuguacagcaaagcucuaguaaucccauuauaaaagggugaauuucucauuagagcccagaagaugcuggcauuaauuaguggacuuucauggcaccaacucaaaggcauauuuugguuacaaaguuuuuaaaaaugcaauucuuuaauuauuagggcaauuggaaaaccaacuggaaacugaguguuuaaagccauuucaguuuuaaaguaaaacuuuuggauucaaucgggucucaaaauucuguggcuuuaguagagccagaggcugggggaguuauaaaccuuuccugggcccuuuauugauuuagaagucagucauuaggcugaaaacuguuuaaugaaaagagcuuagaaaaacgacucaauaugcagccagagaccauucuggggccaaccaugaggugaggagauuaugcagaugaacucuuuuaccccaggccaucgcccuugauugaacaagguccugaacucaugcccuugauuuaacagggcucugaacucaccuccucuugcugucaucaucacugcccaccuuucucacuagugggcucaacaaagcacauuaaaggacauugucccugcccucuagaagcuuccaggaaaaacaccacuuuugccuagagugcuuacucuccaccuccccaccagcccccaaacuggaauuuguuuacuuucugaaaacauauguuccuccucuucuuucugucucacugaguugcaguaccugauauuggaguaaugaagcauauguuugagagauuugaauucucuugucaguagaguggagguagaaacaauuucccucuaagcuggaaaugguaacauagaaauuaaaagccccuucccuucuauugacugugagauacuuccagggacugaggcaccuguauugcuccuuuuccuucauugcacuuuucagucaccaggucucauuucuuccugcauccuucuucacaucauuuuccuacauuccaacugagaccccaucggucucaguugucucauuuaucauaugcagauggcuuuugauuuuaguuccucucugauuucaguuccaggcuccaucagcuaacaucuagacuaccagcaaaugcaccccuggguuucaugccuuuagccucccuugcuucccaguucagcaauggaguguaaugauuaagagugcaggcucuagggggcauucugacagggugugaaugagucugggugggguaggcaggcugguauggagagaagaaaguugagggcuugggugaggauuagagaccuccuuucugaaaguguacuguauuggagagagaugaauaaaaaauuuccucuucucaaguguuuuacuuaucucauuuaaaccucauaacaacccuaggagguggguacuuucauuagccucauuuuaucacugacaaaauggaggcuuaaagagauuaggugacuuguuuaaaguagcacccaauagauggcagagacaagaauugaacgcaggaaguacagcuccauagccugugcccuuaaaacagugcuauaugugugauacagccucuguguauuucaucucauggucauaagcagucuccucaauucuaacuuuccuccuugcaagggaacucuauuguauuuaauuaaaaaagcauuggcugagcaacuggauagcaugucuaaaggcagguacugugggggauucaaagagaaaaacuaccucauggcuaccuucaaguagaucaaaauucagaaaccaggacauuuguauacaaauaacuugggugcaaggcauccuaagaaaaauguaagaaaaaaccuuugcaguuuuccaaggggaguagagguggauccagguuuuguagugcucaaaacuuauauaauugggggaccuucuuuaagaaaaagaagacaaaauaaaaaauacaaaaugccuauggcucuucugugagagggugugcaagugcagggucccuguagcuuaaguuucauuguuuaacagaaaaauaacuuuucuuuucuuuucuuuucuuuuuuuuuuuuugagacggagucucucucugucacccaggcuggaguacaauggccugaucuuggcucacugcaacauccgccuccuggguucaagcgauucuccugcuucagacuccugaguagcuuggauuacaggcgccugccaucaugccuggcuaauuuuuguauuaaaauucacuucuuuaugguagugugggguuggaagagauuaacuccaaccagaggguagagguuccuggaggagacuggcuguaugaaaucuccagauagacaugcuguugaucaaagagaagaacacaugagggaguuggguaaaucagugcacaucuuuuucucaauuaaacucaaacucaaauuauuauuauuauuauuugagacagauucucgcucuguugcccaggcuggagugcaguggcacuaucucagcucgcugcaaccuccgccucccgggcucaagggauccucccaccucagccuccugaauagcugggacuacaggaaugugccaccacacagggcuaauuuuugcauuuuuuguagagauggaguuucgccauguugcccuggcuggucucaaacuccugggcucaagcuaucugcccgccucggccucccaaaguguuaaaauuacaggugugagccaccaugccuggccaaauucaaauuauuaauugccuauuagauacuagccuuucuggacuccuugucuauaccuguagucucucacuuagacuucccucuuggaaggggcaaacaccuaggaggcagcaaagggcauagugugauggcuauguggucuggcuucaggcagacuggugucuaagucccaauuuugcccuuuccucucuuugugaccaagggcaggccacuucucucugagccauucauuaaacaaaauuaaaucagaugagugcugugaagaacucagcucuaugcuggcccauaggaauaaaaugcaugguagccauuguuuuuauuauucccucuugugcauuuauaagcauauauauguaugaaauauaauaucuuugcuuugcaguaaugaaugucacauaucuggcacauauacauuuuuaaauaauuuuuuauguuuuaauauaauuaaugucaaaaugcacuaaauacccacucauaauccucucauucagagauaaccacuuguaacauuuuuguguguuuucuuccuuucccuuucuguguguauguguauauuuaaaaccguacaauauacaguuucuaaauggucccguaguggucugaaugaguuaaaguagccucuagaucuacucagcaaagggagacugauuccacuggauuacauuaagaaaagaaggagaacaaaaauguugaaaggaaauuggaaugcuuaugacacuccucuccuuuggucagaguucuuuagcauauaguucugaacccaauuaacugaaaugucauuauuggauugcauuucuucccucuccugggaaccugugcuuuuccuuucuagcacucaucagguugcagugguuacaggaguauguaugguuauuugauuaacauggguauccuuuacuaaagaaugagcuuucuguggauagggcuugugucuauucuaccauaucccucuguccccaggugagacaguaaacuuucaguaaauguuugaaugaacacacacacauauauauauauauacauacacucucacacaaaauuagaauaaguaguauugauagaaauagauuucuaacuguuccccuuccccugcaacaguaugaccaaacagaaaagaaaagauagauccuguugccugcagcauuuacuucuagguuuuaaaagcugcuuagauauaagaucuuaaaagucuggauaaugggguuuugcucgcccauugagauggaacaucuguuucucuaagccucugccucagcuucuggccccauaacucugaggcuggcugguugucuuuucuuccagcaugaccuaggcucuucccagaacacugugaacaagauucagugccacagauuugcaccuugugaacaagaaccaugagaauggugacaccugucagcuuguccaaauacauucuuguguguccuaccacccuuucacaaggaccugaagggaagagaagcucccuuuucuugaaagccuuguagcaggcagacauacuuguauuuauuuggaccuugccagcuucccuucaaaaaggugguauuaaucccauaaggagacuaaaacuaggagaguuugguaauguaggcaaguuaacccaaugcuaaauaauugaguugcuagacccaagacugcugaauuuaaauugugcuauucucuuauaaugcuauguguucucucucaauauuguugcuagugcaucaaauuuggagacuauucacauaaccuuaccuuuccuuagaguuuuauauuugauauuuuaguggaaggcacaaugucagaauagauagucuuuuaagucaaauaguccuguauucaaauacucuuguuacucacuaguuacguaacccccuuuuacaaaaugaggguaauaauuacaaccuuacagcacugcugugaaagugagccauaaauuauguaaaacauguauaccauauugcuugguauagaauaggugcuuaauaaauggcaacuauugauacucuucaaaguuaaagauuaagguucucauucuuucuuauaucuguuuauaguuguucuuccuuuaucaacucuaauaaauugggauuugacguggguguaggaauuugaucagacacaggugggacuaagguugacucaaguuuaaaaaaggacuugucaaauaaaugaauaguuuaaacgaauuguagagaggaaucauuaacugauuuaaaagaauaauuuuuaaaauaaaaauuuuagugugcauuaaaaaaucaauaaucauagguucauuagaaagaauuguuaucuauuuguuaaggcagguuucuagagaccaauggauuauuuauuuauuccugauuaugugagaccuugaaaguaauacagcaguauuuauuucaggauaaucuuuuuuuaaaacaaguuuuugcuacacaaauaaguauuucuuuuuuaauuagagaaaaugaaaaaaccacaaagaaauaaaaaaguggaaaauaaaacgacccugauucuacccacuagaggauagcuacuguuaacauuuugacauaucgucuugcauacuuuuuauucauacauagguguauguauaguuuuucaaaaauugacuauacugcuuuuucauauagccaucuuuccaugucaauaauguacuucuguaacacaauauaaauauaguaucuaggggcuacccuuuacuuacuacuguggauauuucacauguuauuaauccaacccucucuauuguuggaaaugaagguugcuuucaguaagccacagugaacuaaauaauguccguguaauuaaauauuuaugcacauccuuaaugauuuccucaggauaaauuccuggaaguggaauugcugggucagagacuaugcaguuuuuaagauuucucacauuuauugccuauuugauuuccauaaaguuuguaugugcuuucacuuuacuucuuuuuaaauacuuuaacuuuuaauuuuuguggguacauaguagguguauauauuuaugggguauauuagauguuuugauacaggcauacaaugugaaauaagcacaccauggagauuagcaauguaagaauguccauuuuccugucugccccuugccauuuuaucauaaucccagcgugggugaaaaaaauaguacucuuugguugccagugagauuuguugaucauuuguaccuuuuauuuugugauuuuucucacuaauauucuuucaucauuuggaaaaauuuaaguauaacuugucccuuacuaguuguccuuuucuuauugauuuguaacaagcagcucuuuguauauucagaaugcuagcccauuuuguauaaguugcuuuaacugauuuguuaauucaaguuuucuuuuuuuguggggguuuaaacauacuuucagucaaaugugucaauaucuuaauuugguuuccaauauauucuuugauucuuuacuaauugauauuggccuuagcaugaaucaaagauguguucuauuuccuguucugacaccagcuguguggaaauagguagguaauucaaagucucuaaguuuguuuucuuauaugcaagaugguaacaccugaccugccaaccugcuggagcucuugaggaucaaaagagguaauauauaugaaaauguuuugaaaguuuaagugacuaguguaguuguuauucacuugucccuuggcacuuaucagucuguacuauaucagaauugccuuucuuccucuggaucugaaaccuuucuggccuuuuaauaggaaguaauuuuggucuagaaaugcacuggagccugugcccugguagcuggaaaggugcucuagagaguggugaaauguagccugccaccaggcucugccuggaguguggauucuggacauccuucccaguuggggaaaugggcccuggaacuauucuuugauguaguauguguguuuacuccuacaugccccaguccuugaaggguagcuuaagaaacccagccagugaggccaaagugcuuguucuaccaacagaguaguaggugggggaaaaccccaaagauugcuauccacacuccucuucuuuggugccuggaaaaacaguacucuuucuagcaauuaacauuugaaacagauauacuggccugucagauaaaucaguggcuuagcauuguuuugugguacaaauucuggaaagaguuguuuauuaggaaaaccuucuuaaaaaauugugagaugaccauaguucucccucucuaaaugccagauuaaaaaagaaaaaacagagagacaggaaaaacaaaguaucucaugcaucaaaguaaucauuaguggaaaacaaaguauguucuuucuggcaaucucugccagaugguugagauggcuuacaguggaagaagaggcuuaaaugaugcacauauuauuucaaauauaaccuugagguuuuuuguuuuuguuuugaugggaggggaagauaguguaaacuugcaaaaaauuaagccuucuugaaggucagagaccucuggaagguuggugagguuagacauuugaacuuaccgggauuacuuaagugaaggagaaauaaaguuaacuaaucuuacuaaaaguguacuaugugcuagacuugaguaaucuucauaaugguaauaacaccauuagguauuauuauccccauuuuacagauguggaaacugggauuaagagcuauuaaccaauuuguccaaggccauguaaccagcaaguggcagcauuaaguugcuaacuucaaagucauugcccuuuucauugagccacacggucucccuuggagcuagaagauaaaaauaagcuuuaaaacuuauugaaaugaucauagaugguuuugaaaaauagaaagugcuguuaggaaucuguacaguaauggagaaauaaacaaaacaccccaagaaugaccccaaacuuuuauuuggcagaaggcuucaaauuccauugauaugaaacaauucucuguagggacauacuagggugaguuaauuguacccugaguauucuauggcaggguggcagccuuuccuauugccucauaaagaaucgcacacacacucuucagaguucauuuuaguacuuuucagccugacaucuaaaggggcugcuacccugacaaacacaaucuggccagauguuauuauuuugcacuacauuuaauuucuuccugccaaagauuuaggcuucuuuucccugauaaagaucaggggaaauugucugguauuuacaaaaucccauccaggcauaucuguuacaauguucacuuagcaaaguuuauuagauuauuagggcuuuaaacccuugggcucuuucauuauugaaauuaaaaaaagaaaaacccaaacaucuucaacaaauuuaagugguauaauuagacccuggacuugucuuacaggcauuuuagaauuaugaaaaugauuuaaauaguauuugcuuccugagaaacuugcugcauucgacagggaugaaaggaaagcaguuaagcuccuuuggucuccugaguuaauggggaaagugauaucuggaacugaaauaaauuugcuauaguuguauggugaaauuacucccauaaguaguuagccauaccacacagggccucucuuucuuggccuaguuaaaauguagccacuguaguguuagaggaacaugugggucugucauuuccuugcucaugaagucuucuuagaguaaacacugaacuagacuccugaagcucuaauuuuugcuuauauacacuauacuagacauguaaagaagacaguaauagaaauauuuucaagguauaaucaacuaugauuuauauacacugcaguuuuccuuaaaggauuucaaugugacuugcaugcaguaauuguauuuucaaucaucuccaguugaaaguugguggcacgauuguuauuuucucuacugucugaauguagacauggaagaauuuagacagugucuugacuucaucaacauaaggagccaguagcuggucuggaacuugagcuaguaggauguacaugagagaggcaaucuaguagaaagcaauguaauuaugcuuauuuguuuuggggagugaggugggguagcuacuaauucaggcacccaaauccuguaacauuaaacuuugcuuaagaaagaaggagaauuauuuaagaaaauugaauggaaguuuuugcuacaugugccaacuugaguauuuucuucuauuguacauuuacuuggugccagaugagguuuucaacaaauugugaaagcccagaucuuuagagacuauguuagaaaugucucacaauuaagcaggaccauaguuggacuuuuucuucuuauuuugaaggcggucagaagucuuuuaugugaaaacuguaacagugcaaacauauguuuguacauuaacuauacaggcaauaaaugcugaaauggcagaagugaacucaaggcagaagguaaauauuuuguaaaaauuaaugaucuagagugaacucucauuaacuugggcucuguuaauuugaauauugugauaguuugacuugggcugaaguuuacuuucaucccauuuaugaagaaagaaucugcuaacaaauuaauaguguauauaagauugcaggaagucauguuuaacuugcuugaaggacuugagcaagcccauuaauugaggcugcuaauuacaaugagcuuugccuauuaaagcaaaccugauagaaccucuacuuggaaacacuuuauuagcagugaguuuaaguuacucuagguauggaaaaauaauaaaaggcaguguaguguuuaagagaacggauucuggaauaaauugacuuggguuugaaucuuguuaccugggggagucuaccaaaccucucuaacucccaauuucuucaucucuaaaacaauaauaggaccuaaccuuacaugguuuuugugaggaauaaaugauaugaugcauauaaaacuuaauuuaggguggugccuaguauauagugagugcucaaugaauguuagcuuguguuuguuaauuuuggaaaguaguuauaaaucacacuucaccauccuuccccuucaucaauuuggcuuagugaagauccaggaaaacauccuauuuguugagcuaguuguuccugaauuugaaugagcagccaucuggggacaguaacuucauaaaauggccuaccuguucuaugggccaaauaugcacauggaaagagaugaucauuggaucuauaagucuuuucaguuucccaggagggaaauucgaauugaacauguuuuauguuauaagcuuaguugaccaugaguugauauugugaaguuauuauggagccugaaaaauaucaagaguuuauaugucugaauauuuuauuacaacauuucuaauauuguuccucuucugcuguccugcugauaaggacacuuuacuacauaaauaauagguguucguuuuagaagagaaguuacuaaguucugauaaauauaaaauagaacauaaaaaucacccagaauccuaacauccagagaucacuguggugagcauaggcuuucucauuuuuuuccugcauauuucacacguguagguuuuuuuuuuuacaaaaauaaaauuguacuguacacauucaaagcaaugcuggugauaaaccaaagagugugcaugcucucuacaguuauguucagaugugguuuaaaauagggguauuaauuuguaaucacaagauggacuugaaguugaaaagcugcauacaauuuuauaucucagagucugccucaaaucuauuucuauugacaccaauagaaauuuagcccagagaauauagcuucaauuaucuuuguagguuuauuauaauuaagaauggaugcguaugugugugucuuugugugugcacaugugcugcgugugucagguggagacuuuucccuguuguggagucuggugacaagaacauuagacuaggaguaacaggacauggauuguggccccgaugccaucaugacucacuggaugaccuugggcaaucaauuucauuucucugagcuuuaguuuucccauauauaagauguaggguuagaccagauaauuucuacugccccuugcagcucaaagagucugaguguuaaaaaaaaaaaaucaaaccugucugucugucugucugccuggaagaacccgaggcucuguggauaucuuccuaaggagaggaggggugaugaauuuaaacaguuucuuuggcgccagauagaccaaaggcuguaauuuuuagccuaucaggcguuugacuuuugcaagugcuaaauucuccauuaggaauaaauguggaagcuccagguuauuuauuguuauuuacacuuuccauucauaacugucagugucagaggcucugucaacauaacugcgucaaucagguuagcuuuaaucaguuuagugguggcuaagucacaaauauaucaaauagccaaucaaaaugcaggagcccucuaaagccugacugaauuauuuauuuuguuaugaugaaaaugucugggcuuuauuggguuuucuuugaagaacuugauucagcuugaagucuagaagauaaaagaucagugauugucucucagauuuuuauucugccuuccuucaaggcuuuucauuuuucacaagccguuguuagcacuucuaagucaaggugagagagcugugauauguuuuauccuagggguuuaggcacguguggaaaacuuuuaccuuugauuucuuguccuguuuaugucauguggaaggugugugaccuugagcuaaccacuuaaccugucugagccucauuuucuucaucuauauaauggggauaauucuaaucuuaccuaaaucucaaauuguuaugagacucaggccgggcaagguggcucacuccuguaaucccagcauuuucuuucuuuuuuuuuucacuuuauuauuauuauuauuauuauuauuauacuuuaaguuuaaucccagcauuuucugaggcugagguagguggauugcuugagcucagaaguucgagaacagccugggcaauauggcgaaacaccaucucuaucaaaauaaugauaauaauaauaauaauaagcugagcacaguggcauauuccuguagucccagcuacuugggagacugaggugggaggaucgcuucagccugggagguagagguugcagugagucgagaucacgccccugcacuccagccugggugacagagcgagaccccgucucaagaaaagauuguuaugaaacucaaauaagauaaugccuuaguugucauauaagcaugagguuuuauuauuaucauuagcacuguuauuuaggccuuauguagguaggucugacauaguauaacauauauaguccugaaaaguuaguuggaagucaguuuuguaaaucaaaacucuucugugccuuacaugauacucucauauauuaucacagaaaauuauauccucuagacgucaugaaaaauuaaagcauucaacaaacuuuaaaaaaucauauucaacugaaaaacgaaugauuuucaaauauaacgugagcacugcaaaucauuaaauacaaugcuuaagaaaauagcucuagagacucugaaaagggaaauaauucaucuugcuuccaaaaugcucagggccuuuuggggguagaauggaugggggagugggcggcuggcagugggaggucagagagagaagaagacagaagaaaaagacauuuaaaauauagcuguccugcacaauucuuucugugucaguccaaguagcuguuuccaacccccgccacacacuuauuauuccuuucccagacaucuuuaauacagacggugaaacuguaguagaaaugugccuuuguacuuacaagaaaguuguauggccccucuaagaaucacuuuuguuuucuuuauucugccgagccauucagaggcccugauuaccagcauagcaggaaagaaaagagauaaauaccuagcuccaaagcaaaacacaaaggaagcaagauuagaaaauuaaguguggagggggaacauuugaguauaguaacauggucacuaguaggaaggaaguguuucggauuuaccuacugaauuaucucauguuuaaguugagucauggcuaauuaacuuucaugugcuaaagcaaauuuguauguacugagcauguucugagagugacuuuuauugaaaauggaagagcuagacauuuucuauaauauuccugaugugauugaagcugugucuccaggagugauuuuucagccccgucuaguugcgaggcuguauuaggucauucuugcauuacuauaaagaaauaccugagacuggauaauuuauaaagaaguccaggcaugauggcucacgccuguaaucccagcacuuugggaggcugaggaggaggaccacuugaacccaggaguucgaagaccagccugagcaaugaggcgaaaccccgucucuauaaaaaaaaaaauacaaaaaaaaaaauuagcugagugugguggcacaugccuauagucccagcuacuggagaggcugagguaggggauccccugagccugggaggucaagacugcagugagcugugaucaccccacugcacucuagccugggcaacaaagugagauccugucuuaaaaaauauauauguauauauauauaaauaaaguuuggcuggucuugguggcucacaccuguaaucccagcacuuugggaggccaagacggguggaucaucugaggccaggaguuugagaccagccugaccagcaugaugaaaccccaucucuacuaaaaauacaaaauuagccaggcgugguggugcgugccuguaaucccagcuacuugggaggcugaggcaggagaaucgcuugaacccaggagguggagguugcagugagccaagauugcaccaugcacuccagccuuggcaacaagagcgaaacuccaucugaaaaaggaauaagaauaauaaauaaaaauaaaauuuauaaaggagguuuaggcugggcucaguggcucacaccuguaaucucagcacuuugggaggcugagguggguggaucaggaguucaagaccagccuggccaagguggugaaaccccaucucuacugaaaaaaaaaaauacaaaaaauuuagccgggcaugguggcacacgccuguaaucccagcuacucgggaggcugaggcaggagaacugcuugaacccaggaggcugagguugcagugagcugagaucgugucacugcacuccagccggggcaacagagugagauuccaucucaaaaaaaaaaaaaacaaaaaaaaaaagaaaagagguuuaauuggcccacaguuaugcagacuguacaggaagcauaguacugacaucaguuucuggggaggccucaggaagcuuuuacucaugguggaaggugaagcaggagcuugcaacaucacgugccgaaagcaggagcaggagagagagagugagggggagaagggccacacacuuuuaaaugaucagaucuccaaagaacucgcuauugugaagacagcaccaagccaugagggaucugcccucacaauccaaaugccucccaccaggccccaccuccagcauuggggauuacaauucaacaugagauuugguccgguacaaauauccaaacuauagcaaaggccuuugggaagcucagcccauagggaagucuuagaauacuuagauugcaguuccuaguuggucauuuucaggcucuggauccugcaacaagcugucugaacaccuuagggauccuuuucuaaaccugcaggugaggcuaggucuccuugcaauccucccuaguccccaucccaccugccccacaccauguucccuugcucauuguuggcaucucuagguuucuaguaaccuagaaaugaugugcucuggauaggguggagaaugucuguccccuugacaggacugaaagcaacucaaggguccguuuugaguucaucucuguaucucugcccccuuacucaguguugguagguagauauauaugguagauuuucuaaauguuuguugagcuuuaauuucccaaaaccuuggauuucuaaccuauaaaauggagcuauuacaugucuaguccauauucuuauauuaguuauaagaauaagaagauguauauguaaaauugcauauuaaaccaaauagcgcuauaugcacacuuauauaaggggcucuuauuaauuaggguuauuauguguaauucacauuuuaaauauaaggcuguuuuccaacaggaaaucaggcaaauuaauuuucuuugucuguccaaagagaugaagagacuggcacauugguucuuaacugggguccauuaauagguuacagugguuccuugaagccccugaaauuuuauguaaaauuuuuuuguauaugugacuuuuuuucugaagagaaagcacagaguuuaagucagauacguaaaggggucuaugccucccaaacaguuaaggaccacagggcuagcuaaucucuaaaacuccauuccacucuaauuugguuuuaugaaaaaucccagucugaacaaauagauucaaauuauuauuauuuaauggacucaaauaagcagucucaguuauuuuaacagcaguaaacucaggauucuuagauuuaauaauauccauuuggguacugauugcuggcauauucugcuaccauucagauuucuaccuggcuugagggaagaacuauuauuuuacauguugccucccauguccuuucucaaacauaguuauuuugaucucaccuauguugcuuuuaagagggacuaguuuggggccugcagaauuagaagcuuuacccuuaugguuuucaacugaguauaauaaacaucuuuuaaagaaaccaaacaacaauagcaaagcuauagcccaguggaggcauuaagggaguugcaccauuuagaaauccagcuguguuuguucugauuauaaucaggcuacugucuaccauuuaguucucuugggaggugauacaguuaaaaucccagcaucuguagaaauagcaaguuuauccacucaguuauauacacugagcuuucuguuuuaauaaagagaggugggguacaaugaucagauuaaggaguaugggcaauuuuuaccuugagcagaaggaagcaguccuccaguguguuuuagaauccuauucauugcugacacugggagaagacugcugacaauauggguaagcucaccuugaucuuuuggaggggagccuccuccaaccauuuagaacaguacagugggaggaaaacaaaacaaaacaaaaaaaacauaccacagaguaggagguggaauauagaguuuauauucauggcucugcuaugaagccaauaguguaacaccaggcaugucuuuuccugaugcugagccuugugggcuagcugucauuuagggcuuaguccuuaguccuuccagggcuauuguaauuguuguuaauaauaaucaggaauaauagugagaguuuccauuuauugucuacuaugugccacuaugcuagaggguuuuaauacauuuauuuaaucccugcaguaauccuguuaaauagguagcauugucuucauuugauguaugagggaaauggaagcucagagaggguaagcaacuuguucauguccuaucuucugcccccuccuuccuggguccuucuuuccccauagccaguggucaccaaguccuguugguuaucacugcccugguuucagcccucagcucuauccugaggauuuaaucgcuuucuaaccagccucccugccucaaguuuuauaccuuuccuuuaacaucugucagguuuuaagauguaacugaaguaccacguucuccaggacaccuucccugacuacccccuccacuggauuagguuacccuccuuugugucucauaauaccuuguauaucucuagugugcuucauuaaaaauaacaauagcaaauauuuaaugaguauguacuauguaccgaguaucguuagaagcucauuauauacauuaacacauugaauccucacagcaacccuauaaaguagauacuguuaguaccauguuuuacagauguucaguaccuugccaugacuugaacuccagacacucuuauuugagugccuggucucucagucucugcucgauacuaucuguugccucaaguacuauuuucaccaggaagaugucuauggcucauuucuaaauuacuuuaaaaaauaauuuguggccgggcacgguggcucaugccuguaaucccagcacuuugggaggcugaggcggguggaucaugaggucaggagauugagaccauccuggccaacauagugaaaccccgucucuacuaaaaauacacaaaaauuagccaggcguggugacacgcgccuguagucccagcuacucaggaggcugaggcaggagaaucgcuugaacccaugaggcagagguugcagugagccaagaucgcaccacugcacuccagccuggugacagagugagacuccgucucaaaaaagaaaaaaaauaaaauuguauuuguaaaacuccacauuaaaguuugaagcugaaaaugaucaguucucaggcauuucuuauagacuugaaguacuaaaaaauaaugguaagaucagauaaucccacacuuacauuaaacuaaauacuuuaaaacauuucugcuuccaugagacacauagucccuauuuuccaaguaggaaaaccaaggauagagagaugagaagugauuugucuaaagcaggguuuuucaauauuggcauuaugaacauuugaacauuugggacaagguaauucuuugucauggagguuguccugugcauuguagaauguuuagcagcaucccuggccucuacccacuagacgcaggaguaccucucuccaguugugacaaccaaaaauguugucaaaugucccugggccuggggcaguuggggggagcucaaauucaucuuccauugagaaccacuggcaugaagucuuguguuggcaagucacaguuugaaaacuggccuucuagcucuaaaucuaguucucuuuaauuuuucugaguuggcucacauucucauucugauggggaaaacugguccaugaggcauguuuguacaugaaccuuuuuuucauggaaugcucuuuguauagugugggaauuauuuggugacuaaccaaagaggaguucacaagugguuuacaggaguauuuuguugauugaaucuaguuauucaauguugcccgauuuuguuuuccuaaacaacuuuugugugugcaugguaucugaauggauuugauagaaaagaacaugugugccaagguuuuuauugucuuuaggcuuaugugaaucagcacuuuuacuuuacuaaguuucuguuugccucaaaugccauguuuucuccaucagaaguauuuggcacauagauuguauaguuuuacuagugggcacugcugcuguuucuuaugagaaggcuuugaaaagauuguugcuucucccaggguuuugaacuucugagagaauugcuuguuaauaaauuaucucuccauuuagggcaauguacuacccuaagaacuagucuccuugcaaccugugaccaccugccaccaaaaagaaagaguaaaaaugucuuguauggagcaaggaaagcagggaagcuaagcaggccuggcuggacuacuucaccuagucacucuguggauucccaggaggcugggugaaaggguagggguuucuuccuuuuccauuuuugauauuuuuuucaaauuacaaagguaauuuucuaagauggagaaaugcauacaguauuuagacaugcuuaaugaaaaaacaaaaagaaagaaacaauacagaacuauauggaaaaccaguggaacagaaucaagaacccaaaaaugaacccaaacauauguggucaacuaauuuuccacaagggcaccaaaaaggacacaauggagaaagaauagucuuuucaauaaauggugcugagagaacaggauuuccacaugcaaaagaauuaaauuggacccuuaucuuauacuguacauaaaaaucaacuuaaaauggaugaagaccuaaaaguaagaccugaaaccauaaaccuuuuagaagaaaacauaggggaaaagcuccuuggcauugaccuuggcaaugauuuuauggauaucacaccaaaagcucaggcuacaaaagcaaaaauaaguaaaugggacuacaucaaacuaaaaagcuucugcacagcaaaggaaacaaucagcaaaaugaaaaggcaaccuacagauugggaaaaugguugcaaauauuuacaaaccuuauaucugauaagggguuaauauccaagauuuauaaagaacucauacaacucaauaggaagaaaacauauaacuugauuuaaaaaugggcaaaggacuugaauagauauuucuccaaagaugacauaaaaauagccaacagguaccugaaaaaaugcuaaacaucacuaaucaucaggaauugcaaaugaaagccaccaugagguaccaccucacaccuguuaagauagcuguuaucaaaaagacaagagauaacaaguguugacaaggguguagggaaaagggaacccuugcacacugcugauggaaauguagauuggugcaaccauuauggaaaacaguauggagguuccuaaggaaauuaaaauuaggacuaccaugugacccauaugacccagcaaucccagcaauuuuuagcacguauauaccccucaaaaugaaaucagucugucuaagagauaucugcacucccaauguucauugcugcauuauucacaauagccaagauauggaaacaaccugguuguccaaauggaugaauugauaaagaaacuguuucaugaauagaaacaugaauagaaaauguuucaugcaacauuauucagccuuuaagaaaaggagaccuuccuuuugccacaacauggauggaccuggaggacauuaaaggggaaaaaggucaaauauacagagauauacagagauagagaauaaaacaguggcuaccaagauuggggcaggggaaaggaaauggggagauguaggucagaugauacaaaguagcagauauuuaggaugaacaagucgaaagaucuaauauauaauacaugaggacuauaguugauaauagcauauuguaugcaggauuuuuacuaaaugaguagauuacagcuguucuugccacaaggaaaguggggaauguguaugugagaugauggaguuguuaauuuguuccacuauaguaaauauauauauauaauauauauauauguauauuuauuacaucacauuguauaccuuaaauauacacuguaaaauuuauuuuauaaaagaaauauagagaguaaaaagugaaaguagccaggcaugguggcucacaccuguaauucugacacuuugggaggcuguggcagauggauugcuugaggucagaaguucgagaccagccugggcaacauggcgagacccugucucuacaaaaaauacaaaaauuagccauguuugguggugcacaccuguagucccagcuacuugggaggcugaagcaggaggauuaccugagcccagggaggaugaggcugcagugaaccaugauugcaucaaggcacuccagccugggugacagagggagacugucuagaaaagaaaaaaaaaaagugaaaguccccccuuuaucccucacucuaucuuauuuauauugucagcugcauacacuguaaagaguuugauguguguauccuucugaacuuuuccccauguauuucuguauaaauaugcacacacucacuacucauacaguuuuuuuuccuacauaaauggggucauaccauauauacuauuugguaacauaccuuuucacuuuauacaucucuggcaucguucaaaacaaguacuuaaauacuuuguacuuuaaaaaaaaaacagcugcauaauauucccacccaucugcuucccuauuggcaaacauuuagguauguucuuuauuuuuucuuuucucuuacagugccaaagggaauauuuuaauuccuguguuucauguacuggagcggaaccccuuaggguuuccagggacaacaggccagaauugcacucucugcugccucccaaugugcagaaagagccaguccuuuccguaguucacuagggaagugaguguaauuggugguuccagaggagugacccugagcagucugccuaggaaauuguguucucccuuucagcguuccagaggucaaggaacaccaagcuccaggcccagucugguuaagcuaccucaaacaaaagaccugaauccugcugucauauugcaggcuugaauuugccgauuugccggggcgguggcaggggggcggaggggggacgguauuuuugguuagaugccucaaacacuuuaauuuuucuguuacugucagccagcuauuuagugagcacuuacugugugucaggcacugcuggguaguuucagacaugcacaugguagucuauucagcuaaauuccucaaacauugacgucagucugucuauggacaugaucuccguguuauuuuuauuucucaauuaagggcucauggaagaaaugcuuugcuuuagauuguguuucaauuauauuucacaaauaauccacauuuggagugugguuuaguucauuguuuuguuuuugucccuauccauauaaaucacucuauagaaaaacaucagauucuguuuucacagaagucagggaaauaaguuguuuacacaucaccauuugacucccuucaccccuguccucauuacaaacaucucagccacccaaugaaguuuauuuaaacucccaagccauccaugcaaauaagaccccuacagcuacggaguuuggaggaagaaaggacuaggauugucugccacuuccuuauucucucuacuggguucagaacauuucuuuucaugaguuaauuuacuacccagaggcuuggcuuuaguuguguguccuuuuucaguuuuguaaauuagggaggugguuccauagaaucacagcauaucagaguugucagggagcuuuagaaacaccaucaaaugcaacccucauaccucugugugacuccucuguacaacauauuuugggugaguggucauuugguuuuggagugaaaaccucuucugaucaagaacucccuccccuaagaggcagccguuuaauuuuugguuagcuuuaguugcuaguucuuauguuuguuggcccacaauccaucuccauguaacucuuuuaccauaccaguugcuuucauguggcuucuacucaaguagguuucuacuugguuguuauccuucuaaauugugguacucggaauugcccagugugaugcacaggguagcaauuaccuccuauuaucuacauaguauuacuuuuauugaggcaaccaauuuaacagccacucaugguugaguuagcaaguguuguauuuauaaucaagcaaaauucuccaaacuuuuaucacuggccuucauuucaccuuuggggauuugguccuguauugauaugacaucuuacuaaauuugagcccagauuuuaggguuucaaaauuaguuaacgguucuuccagcuuuaguaauuuguaaauaugaucagugcaucauuuaugccaucacaccagucauugauuaaaaauauugagcagagaagauaccuuaaaauccugauuagagacuuccuuuucaguugacauuaaucuauuaacuagcaccuuuaguacugccauuaaaucagugagggaaccagccagugguguucuuugcaguccagagcagucucucuuggacauuacucuucacuuuguccaaggcccucuugaaauccagaaucaguauauccacuggauuucucugguuuucagcccaguaccccuaucauaaaagggaaugagguuacucugccaugacuuguucuuauaaaacugugccaguuucuuuugaaugccucuuccuuuuugaaaugcucacacaucuucugcuugaugacauguucuaaaauccuguuggggauugauguuagacuggugugauuauuauuugugacagccaccuucuuuuccuuugagacagggucucacucugucgccaggcuggagugcaguggugugaucuuggcucauugcaaccucugccuccuaggcucaaaugaugacaggcacauucuuuuccucuuuaaggaauauggaaacuagaugggcuuuguuuucacucaccuuacccaccucuucuacaccucuguuuccacgaauacuuuucucuuugucaccuuucccagaaauggacugacucucuccuucccauucauucagaacacugcccucaguuuuccuaggugagagcuacuucgugugguaauagguccuaaugggcuaacauguuuuugacaaugaguuucuuuuuccuauucacuuuuugagcagggccuaagucccaaugugugauuagaauggugguaauuugggacaccauggcagguuauuaauguaguguggauggugaaaaccuuucucucaaauagguggcugcccauuucgacuucauauauggcuuucugccaauuguguugggggcgauuucaagucagauugauuggcuaauugcuuguggucaucuggcuuuuuagcugcuuguauagcauccguggagguaauuagcacuuccagaauugggggugaauuggaguuauucauggucauggcuuuuggagugggagcaggggcugcacucgcuucuaguuaugagugaaucauuuuuacuuuaaaaugauuacugaggauugaugaguuucuuuaacaauuaaaaaaauccauuauggaggaguuugauauacaauugccuucuagagccauuuaaaguggccaguuggguucuauauauugugcgauaaacucauugguaggaaauagcuucaaaaguguugagcauuuucuaaaagcgacuggaauuucaauugcagcccuguaccagcacacauaguggaauauuuuucagccaaguguuaauguuaaagaauauauaauacauuuuucauuuaaaaauuucuucauauguaaaugucauguaaaagccacugguaucugacagugauucccaaauuuagaaucaucagaaugucaaggugauuucucccuuuuaaaaacaauguuccugggcgauuuauaggacggagaacaaccaagcagaacaucucaggacugccauuuccucacguaccuggcauuugucagugucaaucaguacugaaauucaaccuguggcaguaaagcaaagccgagagucaucugcuuauuuugacuguuccuuuuucauaauuaaaugggagcugauguuaucaucuuuggaagauccagcuugagggugacuugcuuuugcaaugcaaauaaacaguaggccugggccacugccgagccuagggcugagaagccuuggcccaaccagcuguuguaauccaguuguucccaugcuguucagggugguccuccaauccuuugaccugcuggcuggguuguacagcccucaucuuagagguucuuccaguuuucccucuuucuguguuagauucucagccuugacuaauggcuggaauuuauggaaggcuagaagggaaaggcaauaauuucucuccucugucuucccagugaucaggaagaccuaccgucuauuucaggaugggggugggguggggauuuagggaggacauguuuuagauuauucucucuugaauucuugcuuuagggcuucucauaaaggagggagcagugucugagaccuaccauguccuaucucucugaucagagcuuccagccugccuccuccacuuccuguguuuagcaaguuugauuuuuacuuucacuugcuuuucucuucucagccugucuccucucccugacuaaauggguccgauuuuguuuccuaaaaggagauuaaauugcucuuugcuggaaaagagaaacaaacagucgcuugggaugcuguguguguguguguguguguacacgcguguauguguugguaaagggugcucagauggggaauguaaggcuucuuguuggaagucuguuuucaauccuaauggcucuuuucauccuaaaacuguuuggguucaaauccuggcucugccucuaugugaccuugggcaagagccuuauccucuuagaccuucauguuccccgucuuuaaaauggggcuaauagaagacucuaccucacauagcuguagucaggaucaaguaaauaagcugggaaaaggugggauggaggugguggcagugguaccuuuauugucaccccugucauccuuaccagcagacagaacugagggaaguuguuuuuguuuuuguuuuuguuuuuccugaggauccaguauuugauccagaggaaguugcacaaccuaucuaagcccaaacuguuucugucccuggagaccaagcuagaucuucugggggcggggggcaagggggcgguugguggugaaucaaucaaagagcugucuucaggagugggaagugucaugagaauaaacagcugcuccuuccacccugcacccacuccugcugcuaaauuacucuagggaagaggaaaccagucaucaaaggcuucugccaccugugcacagcugguaguuccugaggucacccuuauaguggcuagaggaguuuagaaaguauccacugggucaagacacugauauauccauuucccaaaggcccaaggacuugcugcccccuccauccuccauucucagagcuggaaagcuccuuuguaaggugggaccacaacuaguacaaacacacuuuguaaguuggacacacaaggucuuccacagugccauuuugggaacaguaucccuugagagauucucagugggaaaggcguaggaccagucuuucuuccuccuuucccucuagccuucucuuaaaaaggaagaagagaaagucauucuucuugagcuacuugcugccaagugucauucucccagggaauccaggcuguuucagccagacuucccuuuuccuggcuuuaagguuaccaagccaaguggaaguauacaaggcccaaagguaaaguuccuguuccagauggggcagaguagccggcgacugcuagagggcagcagagggccaggagcaggucuagaacugcuuaauggccagauggcaaccagacuacugccagagcaaaagacgucagaggucccucauuguugcggggagaaagaaguaggauggucccuaaccaggagagacaggcacauccaggaaauguuaacauaacauggcggagacacaucacagagcaggcaacuggguugguauacagugcaacauaucaggguaggcagggccaacguuuuaguaaaagaagaaagaaagcauauuugccauaaagaucaagucagaaccagugcuacggucaaaguucaagucaagguugaaaaaaucaaggcucaaaagcuagaauuggacugauucagcucaguuauuuauugaguaucuuucaagaaaggcacaauaauggaauaguuaagaucauagacuuuggaaucacauaggaacugggguuugaaucacugcucugccaucuauuagcuaaaugacuuuuugucaaguuacucagccugucugcaccacuuugaaaucauauguacagaugcuaaagaaauguuugcugagcaaaucacuuuuauccagagguguuucuagaaggauugggguuacugauuguagcuccccaccucaaaguucuauuccauuugguuuaguacuuguuuuugucccuuguuuaagaugaguggaguggcuaccggugcugccuugguucccagccagcaaggaccugauugguaguggggcaugaauagagcuaagaggggcccggagaccagaggagagaaacaauaccaaaguuucugggaagaauucugagaucaguuaauucaugugcaaaucaggaagacagaauauucugacuuauucuaaaaugguauuuucucuauauuuucauaaccuuguaauagaaauagcuaagcuaaaagaaaaucugauuaaaugaaauggcauuuuaugagucuugagugaggcaaaaauuuggauuaucuuguuaaacuuaagugagcaaguaaaugcaaugugguauugugaauuagagccugggacagauaaaggacauuagugggaaaucuggggaaauccaaauaaaggugguaguucaguuaaucauguuauacccauguuuauuuuuaaauuuugacaaauaauccaugguuauguaagguguuaauauuagggggagcuggaugaaacuaauuuugcaacucuuauguaaauuuaaaauuauuuuaaaauaaaaaguuuuaaaaauuaaguagccgaaucucuuaccaucaacagugauuagcucuguuuugguuuuuauuuaauugcacugugucugaagacguuuugaaaauacauaggauugggauagggauuagcauauuucuacuauauacucaguuuugaacucugcccuuuuuccucuuaacaauauacauguguauuuucauauuccaauaaaagcucaccuaaaugugauuguuaauauguauaauguauuuaaccagccccuuauugauauacauguagguuguccccaauuuuaugcuaguguaaauaaugccacaguuaucaccuguguacacauauuuuuaugcucauuucuaauguuuccuugaggguaaagaccuaaaaguaaaauaauugaggaauaugaacuuuuaaaaagaucuugaugcuuaauguuaaaucauccuccagaagaauuugaucaauuuauauaccuaugagcaguguguggugucugugccacuaccuccuuuuuccuaauugagucuauuaggaaaaagcaucuuucugcuucauguacuugcuuuuaacuuagcuccuuucuaggaauuucaguuucuuucuuuuucuuuuuuuuuuuugacaggaucuuacucuguugcccagacugggguguaguggugugaucaagcucacugcagccucgaucuccugagcucaagugauucuccugcuucaguuuccuaaguagcugggacuacaggcaugugccaccaugccuggcuaauuuuuuuuuuuaauuuuuaguagagaugaggucuugcuguguugcucaggcuggucuugaacucccgagcucaagcaguccuccuaccucagcuuccaaaagugcugagauuacaggugugagccacuguacccggcagaaucucaguuucaacucagauuuuuuuuuuuuuuugagacaggaucuugcucugucacauaggcuggagugcaguggcaugaacacacacaucgaggucgaggcucacugcagccuugaccucuugagcucaagcaguccuccugcaucagccuccugaguaggugggaccacaggggcaagccaccuaugcuuggcuaauauuuuuuuuaaauuuucacagagaugggaucucccuguguuacccaggcugaucucgaacuccuuggcucaggcaauccucccaccuuaaccucccaaagugcugggauuacaggugugaaccaccaugucuggccaacccagacuuagcccucucuuccuuuacccuuuuaccauuuuuauauguaauuccuuaacgugguagcuaugugggauauuaucuuuuuaaagaauauaucuuacugacauguaacaggagauucucuuugucuuuuacauuauuucugguaauauuaugaaauucacagacaauguuuuuauauuuacauauacacacuuuaaugucaccgaagggaagggguugugaaaacaagugaaaguugaaguuuagggaaucacuaccuacuggaguuggagagcaccaacuuggcaugacuuggauuuacuaaauguaccauugccuagcacuguacuccucacagguaguaaguaccuucucaauaaacaggacgaacagcugaaaucugcaguggugcaauggaggcaaaagggucuagaauguucuugguggugggaaugccauuucugcuccuaguucacuguguugggucucauuugaauucagggaccuugcuuagcaccugugcuucuggaggagaguauccuagcuggguugcuggccucuucugcagcagggacugcucugucagaaaaugagcugccacugcaguggaggugguucuuuccgcuucugucgcccuucacagucucagcuccucucguauuuauaagacugcuuuaauagucuugucuuguaauuacaucuggagacaggagacagcaucuuuugauaguucaaguccuaacgcauuuaaauugcccuccuaaugcuauaaaagagucaaauuauauauucugguuuguacuagauagcaauaaaugucaaggugccauccacucugguauuuaacuccuugcugccaucuguuuuggugcucuucacauggaccauacacuaguguuuuccuaucuccuggcacgaaaggaucaaguugggagauaaaucucacuauucaaaauauauuaaaaggcagaggcaguuuguaaacauugcuuuggaaagcuaggcguagcaauaaagucaaggacaggaaccugauuuaguaaaggaaacauuucacuagauugucauccacuuuauuuuuaaagcugcaauaagauguaacgauaaaaaggccaaugaugcauuucagccaagugauaugaacucuugcuaaaccaauuaaacugucaguauacuaugguuucaguuucuauaacauacuaggucaccuuagaauacuuagucacguaugacuuuuuaccacugaugcaaaaucaauuuggcaauuuauaaucuuacauuucauuaugaaaguauauuauucuacaagaaagcugcuggaaaaaugagauauuucugaagcccauucacuccucuccugcuuaaguagucauaaaagaauaaaaccaaucauguuaucugauguuuugagaauucuagguaguuuuuuauuuauaugauuuuuuuaaaaagauauacgaaguauacaguuucuaacccuggauacaauuuugaauguuggauaaaauuguggacauuaaaaaguaaaaauuuugauuaaagagcucacuuuuucaccuacguuuuucaauuuuguaguguguggacagaaagaaaacuuugcuuaaguaugccagagggugggcuuuuuuaguguccuauauuugagguuuugagcuccagcucuccucaaagggauagagcagcugguuauucauauuuaauaccaucacauuuuucaauuuugguguuuggaaauucugaguuauagaaugaugaaccagcaguauuugagaggugguggggaaacagaaaaaggaagaguuggagacuuuuauuguuauuacuguaauuuuuuaaaaaaauaucuucccuuuuucucucuaggacaaauguaacacugcuuuuugaaaaaccaaugacagucauaaaacacacaugacagauccuuaguuuuaggugcucauuaguacaguaggggacagaucuguucuuauacucucauauagcaaacaagaacauaauuaacauugacuguauagcccuuuacuucugcuaugagcucagugaggauuuucuuuaacugcauuaacacuggaccauuuaaacuugagguuuucaucuuuuucaguuuaagucaugguuacagaguuggcagggguaucuacuauauuaauuuagauucaguugggaucaaguaugucuaauuuacauaugauacaaggacugugggccacucaggcauuugccugccuccauuguuucagguaauuccacugucauugguguaucuccuauuuguauauucuuucucagacuccagucugaacacauggaacacauugaacaaaaagagaaacacagagcaggaauugacuaauugaaaugagacucauuucacacuuucuuucuugcugagaaagguauuagaacgacuuucuguguguuaaguauggagauaggcauuugcaccugcacugucucauuuaaacucacaacaacucuuuagcguagguaauauuauucucuacuuuagagaugaggacugaggcucagggagauuaaggaauuugccauggacauaaugcuaggaaaugguagaguuuaguuuccaauucaggacuuucacucuaauuucaguguucuuuuggcuccauugggguuauuuauuauuauuauuaucaucaucaucauugagacaggaucucacuuugucacccagguuggagugcaguggugugaccauggcuuauugcagcuuugauuuccugggcucaagugauccuccuaccucagccuccugaguagcugggacuacaggcaugugccaucacacuuggcuaaauauuuuauuauuuguagaaauugggucuuccuguguuacccaggcuggucuugaacuucugggcuccagugaucucccugcuuuugccucccaaaguccucggauuacggaugugagccaccaugcccagucuauuuauuauuguugauacaaugaagucuugauaagccagacuacuuagggaaugguaauauacccuauggggggguuagacagugggaaaauuaacaauuuuggcuguuuuuaaaaaauuaauaauguauugguauaauaccuguuaacuuuagaaaauugaaaaacacagauaagaaaauuauucacccauaauacuaagaccuagagauaacuacucauaacagcuuaguuaacagacuuuuuaauagaaaaaaguguauauauacuuuuuaaaaagucuuguaguauacauaccauuuuauacccugcuuuguaaacaaccuaacaauauauugugaacauuuuuuccguauuauuauguggaugccaaugccauuuuaauggcuaugcaauauuguuugaguguacugucauauauuuaaacaauccuuuuuuuuuuuuuuuuuuuugagacagagucucacuuugccacccaggcuggggugcaguggugugaucucggcuuacugcaaccuucgccucccagguucaaucgauucuccugccucagccucccaaguagcugggauuacaggugugugcuaccacgcuggcaauuuuuuuguauuuuuaguagagacgggguuuuaccauguuggcuaggcuggucuugaacuccuggccucaagugauccacccaccucccaaggugcugggauuacaggcuugagccacaaugccuggucaaccaauccauuguaacuaucuuaaugagaaucagucugcugguuugagaguaucugucugaugucacaaugucugguaaaguaguggcuucuuaaaauguucagaauaugcauuucauuauuagguagcuaugauugaauguacauaauguugcagacuucuuuuucaagaugcugguuuccuaggacauggcccaaaagccuaacuuuugaaacuuuugcuuagacauccacagguaacacuaagccagaaaccccugauggggaguuaaaugcaugaugaccaaacauaauguauguauuaggggaaacagaaacacuuuuuucucuugaauuuucauuggaaguguccucuggguugaaguacuaaagauucagguuaaaagacaauuaugaccaggcaccguggcucacgccuguaaucccagcacuuugggaggcugaggcagguggaucaccugaggucaggaguucaagaacagccuggccaacauagugaaacccugucucuacuaagaauacaaaaaauuagccaggcgugguggugggugccuguaauccuagcugcuugggagggugaggcaggagaauugcuugaacccaggaggcggagguugcagugagcugagauugcgccauugcucuccagccugggcaacaagagcgaaccuccaucucaaaaauaaauaaauaaauaaaaagacaauuauuuuuguuaaauugguguugugacuguuaaucaaucaugguacauccauacaauggaauauuaugaugcuguuaacaauuaugcuuucaaagaauauuuuaugguaagaaaaaaugaucuuuuaugagccagaugaugauacuuguuaaaauuuuauaaagaaaagaauauaaaacuuuauauauauauauauauauauauauauauauauauauuuccaguuugaugaaaaaauacauaagcaucuaugcugcauuaucugguuguuuuuuuuuuuggcauggugggcuaagaguuaauuuuuguuucucuuuuuauuuucugaauuuuucaaaaaauuauagugauauauaucuuuugcuacaaaaaagaaauaaucauauuugagugagggaaauaugaaaccauuacuuaaugcuaaaacuuuuaaaaaguaacauuuuugauuguuaacuaagugcuaacuauacuguacuagcauauuagucuuuacagcaccucgaggaagguaccauuauuguccauuugaggaagucauuugcucaagaccacacagauuggauggggcagagucaggauuucaacuugggucuguuuauuuccaaagacugugugagauaaaauauaauggggucaagagacaggaggcuuauuuuuucuuaaccaguugcaaaccgagcagucuaagcaguacugggacgagaaaguacaaauugagagccaggguauagguauagggcauuuaugcuggugaaaccugggagguccuugggugccagagguuagcccaggggcucugaaucccuggggcugauaauaucuagccucauagcucuauugugaggauuaaaugagacaauucauguaaagggcacaugauacaggcuugcucaauaaauaguagcuaguauuauuauuucucuuauuuaggaccuugcuuguuauagggauuagagacucccagaagccugaggcaagacauguuuacccuagugaauccugucacaucuuaauaguccucaaacauuccucaccauugaaaugccuuuuauuugaaccuuucaaauaaacaagccuuaaucagcuuugugggcccuaccagcuuuuuuagaaaaccucucugcuuuugggguggggcgguauuuauuuacucacugaaaauagggacuuuguguaauacaagggaagcaggaggugauugguuuggaguuaauaggcaagcuuuuuuuuuuuuucucuuuaacuugaggaggcuugauuggguuaugcucccuaaagacucuuggagagucugggaauuuugagaacaaaagcucugcagggaggccaccaaagagagcaggcucuccaccaaucuuuguauguucuuaaauuuuucauucuauuucuuuccucucuucagucccuagaauagaguggcuuuaucuugaagccauggagauuuacgaaacaaccaagguuggccucccuuuguugagcuuaugaaagccauauuuagauugaggaggaauguguuuuucccuugggaggccccucuauaccugcagccaucagaaauuccauauuaaaaucccacguuuaagucuuuacagcuaaagucuguucuugcaugucuggaccagguccagcugucagacugagauauuauugacuuuuucuucucaagugagugguuuacaucuguuggcuccauuucuuuaccacuaauucugaaacaccuuguaaucugacuucugccacugccucucugcuaaaauuuugcccuugcagguuaccagcaacugacuuuuugcuaaauucauuggcacuuauuuuuccucaucccuuucuucuccauggauguuucucuucccuugguuccagacacuacaugaauuuaacucuccuccuaccuuucugaguauuccuucucuccuuugugauggaaagucuucuuccucugccucuccuaugcaaaugugauuguuccccaaaggggugcagugcucccuugucucucuacucuucauucauucucagagcuucaacugcuuccucaaugcaguuaacuucuccaguucugacuucuuacccaugccuaguccuauuuuuuuuuuuuuuuuuuuugagacggagucucccucuguugcccaggcuggagugcaguggcacgaucucggcucacugcaaccucuaccucccggguucaagcaauucuccugccucagacucccgaguagcugggacuacaggcgugcaccaccacgcccggccuaguccuauauuucuuacugccuaauaguaauuaaaacuaucuuuuaugagccagacauugugauaugugcuuuauauacaucaucuguaauccucacaacacucuucaaagcagauagucuuaagcccauguuauagacaaggcagccaguucaaauaaguuauaaaaguuuuuauuuuuccauuucaaucucuuaacauuaauugaaacucagcaaguccaaaagagaauuccucccucucuggguccuaacuagcuguccuucucacuuuaaggcagugucauucucccaccuucuguuauaucacucacaggcugagaggauugaaaaucagucaggcaauugcuuuggaauaacacgcaccccccuucccccaccaaaaaaaaaaaaaaacccaauuccuucaaaaucucccaagcccaauucauugcaaccccaaaucuugaaaauuaaaguuuaagcuaucauacagugagcaauccucaaccauuaugagagcuaaaucugauagcuuucacauacugcgugcucugggcugccuaggguuaagcauaauucucaggauuuagcugugcuuucuucaauccuuaggacuugcucuucccaaacgggaccuucccauaggcggggcugcccuagguucuguguaguucgccuugcacaggcaguaaucccaccccuccuguguagaagcuagaaagccuauugaaaugugagugauuuagcaaugguauuucuauauaaaggugugacuuucaauucacuuuuuuuuguaaagaaaauuacuuacaaaugaugguaguuaguauucauaacagcugaugcagaacacuuauucacagcugaucuggacauaccaauguguugagacaaugauuuugaaaaccacuuccacagauuauuagggaaggcccaaaugcccaucagugagggucagcuuucauuucuguguggcauauuugccuaaugcuacaaaauuuuaaacuugauacuacucaagaaucagagaauugagaaacugagcauuuuuugaaggcugugacaggaucaccaggugacaacaucucauugagauguugcacaugccaaaccaaaugcuuuacuugggcuguuuuuacuccacuagcaucucugugacuccuucauuuuuuaaagcggaaaucuaccauagcugccaucauuuucaaugggaggaguacagaaggucaaaaguucaguuauauacuguucuugugaagucaagcuacaaggaaguauagccccauugggaaauuucgguuaucuauuugguaugucaguuucuucuauuaguaagguaucugugccccaaauuguagugacacuacuauuuaaucagacuugacuaggauggcagcauagaguugaaagagaaacucagauuagccuuuggugacuugucuucuuaauaaggaaauuagaacauaccuuuuaaaaaaaaucugagcgccuggauauuuaaucacugucaugaaaggaagauaaaaggcugauguguuuuccaggauguuaaccuguaucgaguugaacaaauguguaaauuaguccuauauguacugcauauagacgugaucuguucacaacuagcacaguaccuagcauguauuugaggcucaaugaaaauuuguagaauguuaauuuguuacuuuagcaaaacaaagauuaaaaaguacugaauuauuaagaaaugucucccauaguaguuagcauaaauaaaaguuugaucagagcaaaaucuaauuugcaaagaaggucacagaaaugcuuauguuuuaaggaaagcuuuaugcuaaaauguaaaauauuaacaguaucuuacagggcacuuuuuuucuuccugaacauaguacagagaguguuuucacauuuagcacauaccaauuggaugaaagacaguggggaggaggugagguugaacacagggucgcuuggaagcaucacuccaucuggacacagaucauggaggaccuugcaucagauucauuuggggacucaauauucucuugggcuguuccugaaauucuuguccuucaaacaaagaguuaggccugaugcuaguuagaaucugaucagcaacuaggguuacaugugauguucuaugcuccucagagaaaaguaauugaauagaagccuacuaacaacuagcuuuccccauaaauugguagucaaugcaauugacagaugguuguaagugccuucuuugugcuuagauugugugaugccuucugugaaaguuugagaugugguccuugucgcagagaugcuuaaaggcaagauacucacaaaugaaauaguuaaauaacaguacaagguaguuugagaaucauaguuugagaaggaacuaugaagaucauuuaguccaaaauuuccauuuucaaaaaaguuaagcucagauuaggaaguagaauuucccagggucuggaagacaauugguaaaagcuggaacuagcacucaagucugccuuuuuuuuuccauucuguuauauacaugguuauaugauguuuugacaugcuuauauugaucugccauuuugaugcugggaacuuucugaugagacuguuuugauaugggggugcuucuacaacagcugcaaaacaaaccaauaaaacauuccacuacuuuuuuuuaauuuuuuauuaccaaguaaugugcaaaacagacagacaugccccagcccucaguuucaccucaucccccagccaugaggauggagaucagggauaaggugggaguaggggucaaaaauggaaugggugucauggauggggugaaucucagagaagagaugaaggauggaguagggggucaggcaccaucuggcaagcaaagcacacaucuccaggagccauauguuucccacacuugcucaucuuugaaaggccauuaaucauuuugggcauaguaucugcucauucucugagaauucucuuauuucuugaauagucugugucuuaaaauuucugauuccaaaccuucaagagacaagauucuagaguagaggaguauguuugcgucauaguauggucucauauacucagauccaggcuucacugggaguccuugagucaaugucugucaguucugucauuaauauucccuguaaaaccccaugaaaaaauaauaugcaucuguuauuuuuaaaaucguaaaacuucgauauucugaugguuugagggaauagguuuauuaggcucuuuagagguuuaucuuuuuuuuaauaccaaacaaacuuaaaaauacaucuguuuccugauuauacauauaugaauuuuucacuuccucaaggcaguuuuucauaugaaauuauucuuuaaaauuuacuucugaaauauggagaaucuaaaggcaaaaaggaaugcguaaucuaaaacauucauauugaagaaaguagaaagugagaguucccuguaauuuggauaaggguugaggaaaaaguaucagacagguaaaugauaaacagcuccuaguagucuguuuuuaucauggcugcaucaugauggcugaaucagaacaaccaugccagaaugucaaauauaaauaugucuugauuuuagcagaacauuugagagucuucuguaauauccuugugcauagauugugaaauuugacugcauaacuaguaauuaggcagauucacagcugguugaucagcggauucaaugucaaccuggaagaaaauguuuuuagugaagggccacaggaacuguuuuuuggcucugcccaaauauucguuuauuuaacaaauaacagacacuuacuauauagagggcacccuacuaagcacugugaggaauacacagcuguccagaucagggccccugcccuaaagaagcagauuguugaucauaauugaucacaaagacaggcuuuuugcauugcagauaucgcaaagcuggguggcguaguucaauauauaggaugacagacuccagauuuaaaaugaucucaacuuguaggaacucuaggucaaaacuuacaagacgaaaguuaacagugauagauguaaagucuugaauuuagguuaagaaaauugcauauguacaggauaugagagaugugacuuggcagcaguuuauguaaaaaguucuuggggauuuaguugaucacaaguuuaauaugagccaacaaugugguguagcuuauuuuuuuuuuuaagcaaaaacaauuuuaggcuguauuagaagcaugugugcugcucagaccacaucuggaguauuauguucaaguauagucaccacauuuuaugaacauugacaaaguugaauguauccagaagauagugaccaggaugggucugaaaaucaugucauaugagaaaugguugaaagaaagaacuggggauaauuagcuuuuacuuuaagccucgguuuagacccuucaagucuugguuagguucccuugcuaugugcuccacaguccucugaacaagccucaugccuuccccacuagaccaaggacuuuguuagggcaggguaggggcucugugaggacuuuguuagggcaggguaggggcucuguguucacuaugauauccacaagaccuagcaugggacaggauguguccucagcaauggucagagaaugagugagugaaauuuccaauugugagggccuuacguaaaaaugauaaagaacuguagugccuggcaucuauagucauuaaauuaaaaaacgaacaaggaacuuagaagagguccuaaaaguuuuugaauggugcuuuuuguuuuuuggccucucugacuuucuuuugaccuuugauaguacuugauacuagacuugcaugucugguuuaacaggaaucuuaaaaagucaucucuccgaaaggagcauuuuuuuaaaauaggagaaaguucuggcacuaguaucaaggagaugcaaaaacaaugggauaccauuuuuuacucgaaaauuagcaaaggaauauauauauauauguaacauauauaaauauauaaauaucugcuaucaguaaggauuuagucaaauggacacauuuguacauuucugguacaacccuuuuggaacagcaauuuggcaaucuguauuaucaagggccuaaaaauauucauuguuugauccaagaauuuuacuucugggaacuucuccuaagaaaagucauccugaauacaggggggagaaaagcuuuaugaacggagguguuuuaggaaaacaaaaaauuggaaacaaucaaaauguuccauaguagaggagugaaugguuauauaaacuaugauauguccauuugauagaauguuauaaagcuuuguaguuuguaguuucagaagcauauaaagcuguguauauaguaugauauaacugugugaaaacaaacaaacugaaaucuguacauagauaaaauucuaugaagucuuauaccacaaugugaacaguagcuauuuuucaguggugagaugaucaauuauuuuugcuuuuuuuuuccuauuuucuaaauuuuucauuuaaaagauuuuauauugaagacaaauuuuguagugugcccuauugugucuagaaauaaaccuuguaugguuuugaauuucuaguucaggucuucaacauuccuguauauuuccaguuuauaugaagggacuuaugaaauugugaggaaaaaacaaacccaaacaucuucagggcaaaauugauuuuaauucuaaaguuaauugaaauuaauuuuaauucacuuuaauuuaaaacauauauguaaacguaugucaugaacacuuuuaggucagggguauguuaaggaaucucacgaauaaaagacuacaacuuuuuuuuuuuuuuugagauggagucucacucugucgcccaggcuggagugcaguggugcgaucucggcucacugcaagcuccgccucccggguucaagcgauucuccuuccucggccucccgaguagcugggacuacaggcgcccgccaccacgcccagcuaauuuuuuuguauuuuuaguagagaugggguuucaccguuuguuagccaggauggucucguguuagccaggauggucucgaucuccugaccuggugaucugcccgccucggccucccaaagugcugggauuacaggcgugagccaccgugcccggccaacuuuuaaaaauaaaaaaguaaucauaccagauucuagagagccaggcaccuuuugcagacggaaaugaaaacgugccuugcagguagcaggcacuuaauacaguuuugaauggcuagcuccuagaggugaguagggaagaaugagagcuugacuguaaauggauacaacugaguggcuguauguauacuggaagaaucuggaaaucagguguuaccuuauuacaucaaaucuguuuuaauggauauuuauauauugcucagauauaucaaaguucuagcugucagaccucuguugacugugaaaaugcaucuauuacaaguaauuugcacuaaccugugacucuggacauuuaaucgaguucaauuuaccucuuuuaucaaaauuacaaguugccuuuuuaauaucuauauuuuaauuuaauacacaguuuaccuccuacauguagaaggcauguucacaggcacauuugaugcaaacuuaauuucuuauguuuugaagucaauuuugggcugcauauuaaugcagccuauccucccuucuuucccuaauaauggcagagauaucuugauucuugucacuugcauuuuuuuucuucuuuaccacuuagaaaaagaacacugcagacuuuaggaaauagaaugguuuugaguuuuguccgugauguuguggguaucagcauucuaguagggguacagccagaauagaucugguuucauuaagaauguguggagacaaucuagguuugaagaaaguagaguuuuuauacauguucacguugcaugucccuggucuuugugaguugcaguucugcuuagcauguagaucuaucucuaugaaauuaauuuucuccucuguuuucauguuuaugacauauuaagguuauugcagacaguacuauuaagaggaugaauuuaauaagaacgauuucuguuucuuaccuacuuuuugccuuuuuucucuccuuguccacccuccauuuuguuuuaaauauauucauucaucuuuucuuguaucaccuuguuucugucucaacaggaagcaaaccauucuucagaacuggucaaauccuuuuuuuuuuaaccccaaauccccacuaaaugaaaaguuucauacgguauuagauugacauuucuacaaagccaaagaaaggagaaucucugggaacagauuugacauccauuuucuuuuaagaugucuuagacuaguguucugcagauucaguugacugagagauuuuuccacaugauaaccugaaggugugaucucccggggauggguauucuuaaacgggggaucuggacaacuugaaagaaagcugugaacuucaaagcuccuuacaccuccaccacaguuaacuuuauagugucacugcucuggcaaauguuaauagcuugaucauuugccugcagauaacuccauuggaaacuguagaguauuucaguggggaauagccaguaggucuuugaucuccauauagauagagauagaauaauucagaaagaauucuuuuggagugauuuauggcagaggcagcacaauuuuaugaauguuucccuccaguauguccaaaauaucuuggcaaauaucaguacaagauguacucuuuccaugguuucaacuucucuuaugaaaugggguucuugauuauaugguuuuccaaccgcucuuuuuucuuuaauacaaugguuuuaagaauaaguacugacaguuaaacauguaaacuguuggugcuuggugaggggagacuuacuuugaaaagagcagaugguaccccgugggguggagacgaugugguaaauuugcuuucuuugcuguguccauaaggucauguacaaauggccagaaagcaaaugaagguacccuugaagccguuugcacuuagaugucaacuuucuuucaggaaagacuauuuuucuuuauuuuugcuuuuauauagaucuaggccucaauguuguuuguugguuucucuuuuuuauugcuacuuauuuagugcugccucaucaaugacuuagguuucucuuugaaguggcugaguaccaccucuauaguucaguuucuuaaggacuccagugauaaacuagacuugaaccaguaaccuagucagcauauuuuuccuaaaugccuccugccuucucaucaacauuuuaaucugugagaggacacaugcuagaauuacuauugacggggauguauuuucuccuaaguggcuuuguugguuuugggaaucuuuccucucucucuggguagcuaaagacuacccaucuucacagcuaaguccuaccuccuccucuccauuucaaacuggccucagucccauuucugaccucucagagcacuaacugccagccugauaauaguuuuagcacuccauuucauuauuccuugguucuuucugguguuuuccuuuuuacuucccaauuuguuugcggggcucugagggagagaccuuguuucacagaauuauuccuuuauuaacaugagguauaugguccagugacccacuuuguugucacacaguuugugaccagaggaagaaaugauguaagaaacacagggcucccagauuucaaagaaaaaaaaugaugagagagugaacggguuggcacuaagcucucucauuacguaugaacuaaaaucaugucagauauaucagaaaacaucaacuggauauugaugagaauguuaauguacacugaguuauuugaaacacuucagcuauccuucuacacuguccucuagauuguauugaggaucuguaccucgguacuggcacggcuguugcucagggcucagcaacuaccuggaugaagcucuuguggccccauugcuacccugagccaggguaccugugggccagguauuuggcgacuuuccugcuccuccaaucacagucuugugugccuuugccugucuccucagcuauuucugcucaguacaucucggucagggucgaucagaaaccagacccagauuuaggucaguaagggagaggaagacugagugccauaaaggcaagcaagaaaggggaggagugggaaugauacaagucagcucccacuuggcuccuaacaguauuccccuuuccuucucugccaguggcuugcugcaaaggaaauacaagucucuguucagucaaagagauguacauaaaaauguauuuauuuauuuauauuuuauuuguuuguuuguuuguuuguuuguuuucagacagaguuucgcucuugucgcccaggcuggagugcaguggcacggucuuggcugacugccacuuccgccucccggguucaagcaauucuccuaccucagccucccaaguagcugggacuacaggugcacgccacugcgccuggcuaauuuuugcauuuuuuuuaguagagacggggucucaccauguuggccagacugaucucgaacuccuagccucaggugauccaggcaccuuggccucccaaauugcugggauuacaggcaugagccaccaugcccggccauaaaaacauauuuauaaggggguuaacugcagcauuguuuaugcaguaagagcaaacaauuggaaaacagucuaaaugucugaacauaggggaaugguuauguagaggacacuaugauaaagccauuaaaaugggugauuuuuuuuuuuuuugagacagagucucacucuauugcccaggcuggagugcaguggcacaaucucagcucacugcaaucucugucucccagguucaagcgauucuccugccaggcuggucuugaacuccugaccucaagugaucugcccgccucggccucccaaagugcugggauugcaggcaugggcuaccgcacccggccuaaaaugguguuuuuaaagacuuuuaaugacaguggaaaauauucacaaaauaauacaugggaagaagcaaaacaucaggcaauauaacuaaucucagaacugacuauaguauacagauagaaaaugcuauaaggaaauauacuagaauauuaauggagauuguuuuugugugguagaaucauggauaguuucuuuuuuguuuuacauauccuaaaauuucuuuuuuucuuuuucuuuuugagacaggaucuugcucugucacccagguuggguugcaguggugcaaucuuggcucacuguaaccucugccuccuggguucaagugauucucgugccuuagccucccaaguagcugggauuacaggugugcaccaccacgccuggcuaguuuuuguauuuuuaguagagacgagguuucaccguguuggccaggcuagugucaaaauccuggccucaagugauucccucgccuuggccucccaaaguucuggaauuauaggugcaccuccuaaaauuucuguaaugcagacuuaugauuuuuauaaucagaaaaaugagaagaaaauguucuuugccauaaucuucaaccuccaacccaagacaucucacaugccuagauguagauaauuauuuuuucugagaacaaaaguaauauauuugaauuauuaaaacuuuuuaaaaacauacaaaaauaugaaggaaaaauagcagugaauugucuuaaaguguccuucuuuaaauaaaacugauuucuuuuucagaaaagcuuauuugaaguaucacuguacuuucuguuaccuaauaaaauagcaaaggcucaaauauuugguuaauucaaaauauuuuaaagcagauucuuuuauuuagauggcaucuucauccaugauuuuuagaaauggaaaggacauuguauaucaucuggcccaaccccuggguaaaguucaagaguagguuuugacaguauucuaugucaggcacaguucuaacgucccugagacucagcgagucuaagugaccugcuucaggucacacagccagcucuagaaauugggagauaguacuuugcuccaucaguuguaauuccaacggggaaaaacguuuuugacauucugcagaugguagcauucuuaaaaacacauaccucaaaccucuuuucugaaauaagaaauuaccuuuuccccccucuucagguguauaacuuuaacucaaaaauauccagagauugccaggcgcaguggcucaugccuguaaucccagcaacuugggaggccgaggcgggcagaucgcgaggucaagagauugagaccauccuggccaacauggugaaaccccaucucuacuaaaaauacaaaaauuuacugggugugguggugcgggccuguagucccagcuacucgggaggcuaaggcaggagaaucgcuugaacccgggagguggagguugcagugagccgagaccgugccacugcacugcagccuggugucagagcgagauucugucucaaaaauaaaauaaaauaaaaaaugaaauaauaauaauaauaaaauccagagacaaguuaaaaagaaauauguguauguguauauguaugugauaugaaaugagcaaaguuuucacuuccaugaaaaaagguacuuguguuugagaauguuuucaaauuaaagaaaaaguuuaauauuaaguaaauauuugguauaaaaauucaccuagguuaaugucuuuuaagcuuuuuuggucuacccucuugcaaagaaauaguauuauuugauuuacaauuaacuucugaaucaaauguuaacauuucauaugccauuaaauacaucuauuauagaaaugguucuuuugaugaauuuuuauaguggcaugcugucguauuaaccagaaauacaacauuauuuuuauuauaucugcuucagaaacagaagugguuaguuugauucaaacagaaauuccuggaaaacccaugugguuuucuuuaugagcaauuuaaggacacguucuuccaaagagagagauggacaauauaaaacauaauccacuuuuaaaaauaaauucuacucugugaaaaaguucccccugaguggugcucaguaaacccuuugguaucaguaguuugucagcucuagcacaauuggagcuugugugggaagccauuucacucaguggugguugcucugccaccaccaagaagccagagaacaugggcuguaacugaggagaaggauaaccaugagagaaguaauaagcagaccuuagaaaaucuuugaaaugguccuagguaagaucucuuauccuggaaucagauuccccuuccuccuuaucauuuuguuggaggaacauuugagaaagaaauggauuuucaguugacuaggaaaauguaaauugauaaaaaaaaaaaguuaaagaagaugaacccuuguauugcuguguuguuuaauccucagaucuuccacauggaguaagaaauaaguaccugguauuuccucagggaccauagcuauucagucuggaugagcucugacucuuaagaaaaaguguguagaguugcugcuauguucuugcuaccaccacuugaugguacuucuuuauugaaaacccaucuguuuucucauggacuuuuugcacaaggcccucuaugugccaggcaaucaauaaauauuugauugauuguuaucuucuaaaugcaaauucaacauuuaacauucaaauauugaaguuucccugugccaaaaaacaaagggaucucugcuaggggguugccuacuugaauacuuugggccugcuccuauaggccaguuggccuguguuguguucuccuucugcgcuuuaguuuaaguugaauuuaaaaaccauuagaccggccgggcgcgguggcucaugccuguaaucccagcacuuugggaggcugaggcggguggaucaccugagcucagaaguuugagaccaaccugaccaacauggugaaacccugucucuacuaaaaagacaaaaauuagccaggcgugguggcgggcgccuguaauccuagcuacucaggaggcugacgcaagagaauugcuugaacccaggagguggagguugcagugagccgagaucaugccacugcacucuagccugggugacagagugagacucuugucucaaaaaacaaacaaauuaauuaauuaauuaaaugaaaauaaaaaccauuagaccauuggucaaaucacuuacaaccaccuagagauucagaauuuuccaauagcuggugggaaacuuggaauccuggaauucaguuaaacuguuuauugagcauuccuugagcuguagacuucuggguuggguagugguggagugugggaggcagaguuuacauacaauaaugauucagacuuagucccuguucucugggaucuuacagucuaguagaaugggauucauugaagaagacugaugauacgcaguuugaggaagagacgcuuugaccaccagaagaaauauguacuggaauugguugguaauagcugugaaugucaggauccuguggugcuggaacaagguagaugugugaguggagggaguaacaacaaaugauguagcaauaaaugaaaggagauguccggaggaagguagauguggccucagagaagcagggcucuguucuguaguaugugccaauguugaucagggauaucaugauguaaauauacacccagcucuguguccuacaccauaugagacugauguuccuuauaaugaaccagagccauuaaaugguuuauguuucauauacgguacuucauuuacagagacaaacaaauguaagaaauauccauacggcaauguguaaguauuuuaaaaguuacuuuuuauccagaagaucucaaucugcaaauacuuaacaaggucaggcaucaugggagauauuuaaaaaacaugugugugccuuugagccguuuacuaaguugagaccaaacauauacaaaugggaaguugacucucaguaccaggcaguacaggccaacugcuuauagacaguaacugcuguggacuucagggauggccagcuuccuaggaucuuagguaguccggaaaucuuuucagguucuugagcuggccuaagcaggauuuaggugggcucaacauaaugccagaucugcagaaacauugucuuuugcccuuugggaaguugcagugugugaccugcucucauaaacuccuccccaaaacaggcuuaugcacuuagcaguaauagauugaaccaucaacuccuuaaagcacaccugguugauaauuagcucaaucacauuguguuucggucauuacccuuggauuucccaaggaugaguuuaauucaucucccacauuaaagugagugccugcaugaccaaaacucaacagaauagaauuucugucucuauuaugucaauuuaaugcugugguaauuuuauugcaaaauagguaucgguuuacaauuugccacccaaauaucugcacagaaauuguuacuguaugcuguaaaaagaucuuugauggcaaaaggcucccguuuuuccuaaacaguacuucaucugaaggaagacagagggaaugagcugaaacucugauuugaggaauuugggguugauaagaucuaauauugcuuauucagagaugacuuacucugguuuuauagcuuauaaacguauugaugauagauacaaccccuugauuccaagauuuuacagaguuuauuuuguguuuuaaccacacucccuuugccucugaccuacugcuggaugugaagggauaaacugguggugcauaugcuauauuaccaaagugggaagggagagaggcaccuuuauuauaucggauuacugccagaugccuagaaugcucaaaucuacucacugguugcuguuuaaaagggaaaaauacaaaucuaaccacuucuaggaauggugccagaugucuguacuaaggcaacccaacuccagaaggcuauaaaaauagcccccaaguaguagguucugauuucccacugagcugaccaauaaauccaacaaccaguuaauuaaaaaugcugggagggaauguucauccuccauuacccaccuguccuugugaauacucaucgguuacaaaugggaggguaccacuuaguguuucaaugucuggauuaggaaacucuguccuucuuuuuccacagcaacccggagauauauauggccuugguggguugccugauaccccuacuugggugucaagguuuauuugaggcuaaagugauuugaggcuuccaaagaaguuauuuuacuugccuaggggcuuccuggcaccauccacgugagcauguuuggagagacuaccucaucucucccuuuuucaggcuuugaguuuuauuagucugcugaaaucugauagaaaagaaaacaccuugcugcccugacugcugcuauaggcagaauagcacgguauccuuauauacaaggggguugcuugaaguuggaucuuuuauuccuuuuaacaagaaauuucaacuugauuaaacuaaaaaaaaaaaaaucaguuugugaugcaagcaaaaacguggauagaauacaccaucaguaucauccucauuguuaaaaucauuaaaaggugcacaaagaggcugggcuugguggcucaugccuauaauuccagcacuuugugaggccaaaguggguggauggcuuguguccaggaguucaagaccagccugggcaacauagugagacccugucucuauuuaaaaaaaaaaaaaaaaaaaaaaaggccgggcacgguagcucacgccuguaaucccagcacuuuaggaggccaaggugggcggaucaugagguccggagaucgagaccauccuggcuaacacggugaaacccugucucuacuaaaaauacaaaaaauuagcugggcgugguugugggcgccuguagucccagcuacuugggaggcugaggcaggagaauggcgugaacccgggagguggagcuugcagugagcugagaucacgccacugcacuccagccugggcgacagagcgagacuccaucucaaaaaaaaaaaaaaaaaaggucacagaguaguagagagaguauuggaguuggagugaaaaguucuggguuugaauccuguagguacuagguguucucuaugaacagagcuccagcagcucaucuggaaaacagcuguaauagcaccuaccucagggaguuguugucaagaacaaaugagaucauuuguguggaaaugccugacauuuaguagauauuaaguaaauauugagucugauuuaauuuacggacuuaauauccuuuguugccuuagauagauacagaaagcauucauguaaagagagcucaaaggaggaaaaaguggugauggugggcaagggaggcccaaauucacugaguacaaauuugacuaccaggaaccuacuuuccgaagauaccauuacuaaugaauuauauuucucuugaugcuuuugccaacuuuugaaaaagaacuuagagacauuuugauggagaacaaagaaaagagauggaacuugaguuuuaguugggucugccaccuacaauggauguuuccuuucuuuuucuuucuuuuuuuuuuuuuuucugagacaaucucucacucuguugccuaggcuggagugcaauggcacgaucuuggcucccugcaaccuccaccucccagguucaagcaauucuccugcuucagccucccaaguagcugggauuacaggcgugugccgccaugccuggcuaauuuuuucuauuuuuaguagacgggguuucaccauguuggccagccuggucucgaacuccugaucucaggugauguaccugccuuggccucccaaaaugcugggauuacaggagugagccaccacacccagccuugacauuuucuuucuagggcuguuuccucuauccaauaaaaguuggacuggagaagcacugugauucuuugccaacacccuaaauucauggggacaguuggauuuugaguauguauuaauugggaaugaaaguuuuuauauagagugaaaaguuuggggagaggccgcugaguccaaggguggagaagcuuagcaaggacagaaauuuuucuugccugcgagggaacucucuucgguaaucagaaggccuucaguaaucaugauugauugggguggauauauagauugcuuuuauucaugcuuuugagaugugugugugccugugucuaugugugugugugcgcuguuuaaagacuuuucuaaagcugaagcucuuaugugauucgcugugcauuagcaggauaugaauuauuaauucugcuuauacuugauaaugaaggccacaaacugggacccuguuaucugagggccuaaugcauuccuuuuucuucaucaaaauagguuuguaaauugucaucagggcccugcuaccagcccacuaaauaacuccucuaucugcugcuaccuaugauuucuuuaauaaggaauggcagggauacucagaaucgcauucuaugaggaaacguugauggaaccgaaucucuuuaacuugggacgggggguggagauucaggguaccuugguggcuguuaucaaaaacaugaaggacucucaagucaaaguaacaauaaacuaauuuugguggcuuuagggugggaggaggcagacuuggaucaguagaggagagauaaaggaagacaucucuuucucaauccaggcaauaacuuuccaacaacguaagcugcccaaagagagaauaggcuacuccaaggaaguagugaaauucucaucaucaguccccauucacaguuguagcuggagugaaaaauuagucuauuugaguagaaucuggacucacuuuccuggaauagaccuauagggauucaguggucuggugauuccuucacuauacuaugaacacuucuagcaaacuguaucuuauuuguauccuuaacacuuagcauacagcuugaucauaguaggaucucagaaaauguuuguugauggaccaauuagcuaaaaaugcacuugaaaguaaacaaauagaugcuuuuggucccaggaucaauuguauuaaauuggcuuccauguaacuacagugucucacuuuuucuucauguguuucuuuuuucuuauuuugaggcagagucuugcucuguggcccaggcuggagugcuguggcacgaucucaguucacugcaaccuccgccuccuggguucaagcaauucuccugccucagccucccgaguagcugggauuacaggcacgcaccgcgaugcccggcuaauuuuuguauuuuuaguagagacgggguuucaccauguuggccaggcuggucucgaacuccugaccucaagugaucugccugccuuggccucccaaaguacuaggaccacaggcgugagccaccgugcccggccucuucagguguuucugugcauuuucagucacaccaaacugcucauuaacagcgaccuugucauuguuagagaacuuaaaccauucuguuaccaaaagacccuuccauauuaauauauagagauaaaacaugauuuuaauauuggauaagcauuaucagaguuauaugcaugugaaguaguacaaaaacaacuacaaaaucuggaaauaauuucacacacauucauacaaaaaaaguagaagagagaacaauuuaaaacuucucauuuucuugagauacaagaggaugcacauugugccugucucacuuauaccuuaggagagaucccugagcaaauucuagaaguauuugcauuuccaagggucagaggcacaugaacuugcauuguaaaaucaaaaggucaagacuuuuaaucaggcugggcacaguggcucacuccuguaaucccaggacuuugguaggccgaggugggcacaccacuugaguucaggaguucgagaccagccuggccaacauggugaaacccugucucuacuaaaaauacaaaaauaagccaggcuugauggcgggcgccuguaaucccagcuacuugggaggcugaagcacuugaacccgggaggcagaggucucagugagccgagaucguaccacugcacuccagucugggugacagagugagauccugucucaaaaaacaaaacaaagcaaaacaaaacaaaaaacaaacaaaaaacccacuuuugaucaggcauauuauguuauggagacauccuaaagaagggagggugaguaggcagggacuucccuccccaucaaaaauuucaucauugcacacuuacaucgucugacaugauuagacgguguguguccuucacaggauccucaagcuuccugaggguuaguucguuugugcagugaaacaucuucccuguaagaaugcuacuaccuaggagcuggaaaccugcauaucaucacuuuauugguugacucuaccauuauuauuuuuuuaaaugaaacacuuugaauguggccuuauuaaaaacagaauuaaauauuaguaaaucauaaauauaauuauguaaguuaaauucuaacgauaauaaagaauaaauaaaagacaaaaauuaaaaaauaaaaaauaaaaauagagugaagaugcugucaaaggaugaaauaggcuaaaucuaaugggaaaauugaaucucuuuccccaaauaccucacagcgcaauggcuuuagaaaccauugagaaaugacagacacuucaacaauauaaccuuacugagagcuuucucuuuuuugaaacggaguuuugcucuuguugcccaggcuggagugcaauggugcgaccucggcucacugcaaccucugccuccuggguucaagugauucuccugucucagccuccuaaguagccaggauuacaggugcccgccacuacgucuggcuaauauuugguauuuuuaguagagacaggguuucaccauguuggccaggcuggucuugaacuccugaccucagaugauccgcccgccuuggccucccaaaguucugggauuacagacaugagccacugugcccagcccgacugagagcuuaaaaaggugcgaugacucuccgaaagacugagacucagagauauuuggauaucuaauaaaguaauucaagaugcauauaaaucucugguuucuucuaauuagugucuuaugauuguggcuuuuacuuaaccuaaccugcacccugauugcaaagguuuuccugacuagccgguuguguggacacugccuguucaccuuccuuuaguccucuccaagguauguaaaguuccucacaggaacuuccgaaguauaucuaccccccuuccagcuugaccuucuuucccuuuugguguggagugacuugagggugucaccauaggaauacuguuuuagagccacccugaucacuauuuaguuaaaaaaaaacaaaaaacaaaaaaguccaagcauccuguuuggacagguuguaagcugugacauuagaccuuccugguaugcagaauggcuuucaucacucucccaccccauucagcaagguuaaaggucucaggaagguauuugacuuguggcuguaacuugcccugacugcugagcaaugaugggucuuuuccuugaaccacuuaggaggugcccacgggagcagcauaccagaaaggaguagugaaggagcaaaacugagcucauuacagcauuugaaacgaagaggucaccaagaggaaaguagaauguacaaugaaggguuugucgauaguuuugguuuuuugaaagcucugcuccagaaguaaaaugguuuucaugguguuuuauucaaagacagcagaaggaaguuggaaaaaaauguaacaugucuuagaugagaagacccucagaggcaaggacuacaucugaugcagcucuuaagaagggcuuugggcacagagacacugggcuaggaaauacucugcaugcauuuguuuaucuaacacggaguuucuauguuucaggcacuuguaauuauacaaucucauuuaauucucauaacaaccuggugaggugggggcccauuuuccagaugaagaaucuaaaguaccuaaucuucaaaguucucacacagauucgcuacuuagaggaagaucuuuaaaauuaauuuaaaaauuaauuuuaguuacuuuaaaaauaauuuuuuuacuucaaaagcuuaaaauuuuuagcaugccucagaauuuuuuuuuuuuuuuuuuugagacaaggucuuagcucugucgcccaggcuggagugucguggcaugaucacagcucacugcagccuccaccuccugaacuuaagcaaucuuucccccuuagccucccaagcagcuagaacugcaggcaugcacgacugugccuauuauuauuauaauaauuauuuauuuauuuauuuauuuauuuuuacuuuuuguagaaacagggucucucuaaguugccccggcuggucuugaacuccuggcucaggcaguccuucugccuuggccuuccaaaguguugggauuauagauguaagcucccaugccuggcccagaauuuuuaaaaugacaacuuuauugagauauaauucacauacuauaaaauucacccuuuuaaaauguacauacuauucaguguuguuaggauagucacaaaauuuuguagcuaucaccacagucaguuuugggauauuuuuaucaccucaaaaagaaacuauacacuuuagcuaaucacccucauaucuccccaucuccuucaccccuagcccugagcaaccauuuaucaacuugcggucucuauauauuucuguauucuagacaucucaucuaaauggaaucauacaauaugggggccuuuugugucuagcuucuuuuacuuagcauaauguuuucaagcugccuccauguuuuagcauguaucagaacuucauuccuuuuuauggcuauauaauauuccauuguauggauaccuguauauacauuuuauuuauuuuucuuuauuuuuuuuuaagagacagugucccucuaugucacccagccuggacugcaguggugccaucauggcucacuguaaccuugagcucuuggguucaagugauccucccaucucagccucccaaguggcuggaauuacacguaccaguaaccauacccaacuaauuuuuuuuuuuuuuuuuuugagauggaguuucgcucuuguuguccaggcuggagugcagugggaugaucucggcucacugccaccucugccuccuggguucaagcaguucuccuaccucagccuccugaguagcuaggacuauaggugugugccacuccacccaguuaauuuuuuuguauuuuuaguagugacagggugucaccauuuugggcagucuggucucgaacuccugaucucagaugauccacccgcgucggccucucaaagugcuaggauuacaggcaugagccaccgcacccgaccuuuuuuuuauuuuuauuuuugacagagacagagucuuucuauguugcccaggcuggucuugaguuccuaggcucaagggauccuccugccuuggccucccaaagugcugggauuacagguaugaaccaccaugccuggccuauauauuuuaucuauuuauucaucaauugauggacauuuggguuguuugcauauuuuugcacacccaggaauuuauccuaaggaaauaaucaagaugauauauaaagaauggauuauaaggaucuuuauugugcuaucaagaaaaugaaaaacuagaaauaaccacagucuccagcauuaagagauuaguuucauuaugggacaccuauaugauagaauacuguacagcucuuaaaauaguauuaugaaauaauucauaaugacauugaaaaaugcugacaacuuauuauuaagugauaaaacaguacauaaagugugauuccauuuuuauaaaaauguauuuauauacaucaaaagaaggcuagaggccaggugcaguggcucacgccuguaaucccagcacuuugggaggccaaggcagguggaucacaaggucaggagaucgagaccauccuggcuaacacggugaaaccccgucucuacuaaaaauacaaaaaaaauuagcgaggcaguggaguuuguagcgaguugagauugugccauuguacuccagccugggcaacagagugagacucugucucaaaaaaaaaaaaaaaaaaaaaagaaggcuagaaucguagguaauaggaaaccguggucuucucuagauggugagauuauggucggggggugggggugguuauuuucuucuuuuuuaucuguguuuucuaauuucucuagaaaguauugcauaauuacuuacugagcacauaguaugugacagacauuguuuaguauauauguauuguguaguaaaaaaaaaaauagaaaaaauaauguuauuguuaaaacaauccaaaaagggaauguaugggauuauguauuguauacacacauacacaugcaccaacuucugaggauguaacaggaucuugcaagcagcacuggaguguuauguuuuaacucgaaauagauuaagauuuacagaugacauauuuaucggauaagaaagacauugaauaacuuuuugggagugauucugugcauuucucccuucucaauggaaugucuagcuauucuuucccugcaggaagugauuggaaguggaaugcagaguuuauuuccacuuacauggucugacacuuugacauuuccuaaacugcaggauguuugagagcaaacaacuuggcuuuuacugaaaaauuaauuauacugccacuuucacauagugacaggccuuuguaagaggacaaagcuauucaaguggggaaaaaugagaugcuuaacaggaugacaguaacauaaaggucuugaguccggagaaaaggaccucauuaagcauugauuaucagcaugguguagacucuuucagaaaguguuacuacauuccaugccauuauugugugggguaaauuuaaaucuguguuccauuuacaucauaagugagauuuguguauucuaauaauaggcuagucuugccuucagcuacaucaguacacacaaauucaguucauugcuuucacuggcuugucauaucaagccauccagacagucaccagaagucagucacaaagagucaaauuaguuuguguguugacauacagccauucugacugccuguuuggagaucaagucagcuuggcccaacaugaacauguauaguuccuuaugaacauacaugaguuacuuuugugggcaggauauaguguuggauugaagcuaagaauucugucuggagacauuuaugcagccaacagauguauaaaaaaugcucaucaucacuggucauuagagaaaugcaaaucaaaaccacaaugagauaccaucucacaccaauuagaauggcaaucauuaaaaagucaggaaacaacagaugcuggagagguuguggaaaaauaggaaugcuuuuacacuguuggugggaguguaaauuaguucaaccacuguggaagacaguguggcaauuccucaaggauuuugaacuggaaauaccauuugaccaagcaaucccguuacugggcauauacccaaaggauuauaaaucauucuacuauaaagacacauguacacguauguuuauuguggcacuauucacaauagcaaagacuuagaaccaacccaaauacccaucaaugauagacuggauaaagaaaauguggcacauauacaccauggaauacuaugcagccauaauaaaggaugaguucauguccuuugcagggacauggaugaagcuggaaaccaucauucucagcaaacuaucacaagaucagaaaaccaaacaccacauguucucacuaauaagugggaguugaacaaugagaacacauggacacagggaggggaacaucacacacuggggccugucgugggguguggggcuaggggagggacaacauuaggagaaauaccuaauguagaugacggguugaugggugcagcaaaccaccagggcacguguauaccuguguaacaaaacugcauguucugcacauguaacccagaacuuaaaguauuaaaaaaaaaaaaaagaauucugucuggagaaaaaguauaugacauuggucuggucagugaguguuuggauuugaccucaaaaacucaggcaacaaaaacgaaaagagacaaauaaaauuaaaucaaacugaaaagcuucugcagaaagaggaaccaaucaacaaagugaagaagcaaccuacagauugggagaaaauauuugcaagucauaccucugguaagggguuaaccuauauauuugcuggagguugcaauuuuuuucugugaaaaaucaggcccuggcaaugacuuugaacaguaggauauaaauaacucccacaagcuuagcauuccaauaauggaacacuaggcauaaauggguuuuaauauccagaguauaugaggaacucaaacaacucaauaacaagaaagcagaucacccaauuaauucauaaaugggcaaauaaccugaauagauauuucuccaaagaagacauacaaauggccaacagguauaugaaaaaaaugcucaacaucacuaaucauuagggaaacacuuaguagaaucacaaugagauagcaccucacaucugucagaauggcuguuaucaaaaagaugaaagauuaguguuauugaggauguagagaaaauaaaacuucuauauacuguuggugggaauguaaauuaguacagccauuauggaaaacacuauggagguuccucaaaaaacugaagauaagccugggcaacaugguaaaacccuguuccuacaaaauauacacaaauuagccaggacugguggcaggcaccuguagucccaucugcucgggaggcugaggugggaggaucaucugagccugggaggucgaggcuacagugagccaugaucgugccacugcacuccagccugggcaacagagcugagacccuguuucaaaaagaaacaaaacaaaacugaagauagaauuaccauaugauccaccaauccuacuuccgaguauauauucaaaacauuugauauuaguauguugaagagauagcuguacccgcauguucacugcagcauuauucacaaaagccaggauauggaaucgaccuaaauauccaucagcagauuuaauagauuaagaaaaugugguacauauagaaaaugaaauaauaugcugccacacagaagagggaaauuauaucauuugcaacaacauggaugaaaccgaaggucauuacgcuaagugaaaugagccugauacagaaagacaaaaauaccacaugaucucacuuauauauggaaucagaacucauagaaggagagagcagaaugcugguuaccagacccugcggggugggacuuggaauggggagaugauaaucaaaggguacaauguuucaguuagacaggaggaauaaaugauaaguauuugaggugauggauauauuaauuagcuugacucaaucauucuacaguauauacauauaacaucacuuuguaccccauaaauauaugcaauuauaauuugucaauaucuaaugaauuuuuuuaaaaagaauucuaccucgugucagaccaaccugaguucuuuucuacuccccuaccuuuuuuuuuuuuuuuaaaauagggacaggagucucacuauguugcucaggcuggucuugaacuccugggcucaagcagccuucccaccuuggccucccaaagugcugggauuacaagugugagccacuacacccagccccgaaucugaguucuaaucucugauuagauugagacugucugagccucaauuuucuaucaauaaaauggggaugauaauaucuaucucacagaguugauugaaugaaguaauacuucaauuagauaauugaaugaagauugaauaaaguaauccuuuccauauguguagcauauuucaugguauauuguaagagcucaauaaaauuuggugcuuuuaaugggaaugcaagggaauuuaaaggggaaaauggagacaauuccuguucuuuuuucuucucuucaguacauuucacauuuccuugccuugauuuuuugucuaaaauggauuguuaaaauugcuaaaacucgaaauuuuaagucuagacuuuaagaauauuuuauauuacaauaaugaaauacugacauaggagcuacugguguguuacaaaacaaaaugcacaaauacaacauuuaaacccagcaaauccuguagcaaucaugaacccauaccuacuuauggucaucugaucuuucuauuuuuucuucccagucuuuguuuggacuuuuguaaugauaaacacauaucuagaucuuaauagauuuggccucuucaaauauaaggccuuuguggcuuuuucuguaauucucaucagaauacuguaagucuauuaauaacacuccacucucccucuaacuugcugcuuuuaaucuguugggggcuugaaaacuaguuuacaaaacuuauuuggauucuauugguaauacaaaaguauucaguuaugaaugaggccuugaguuggggagagagagguccccauuuuugcugccgagauaccuuuuccuuuauuauauucugauuguuaucuacauucuggacacuugaggaucauauauaagggaaauccaaauaauauuuuaaagauuaaaugugugacccugauagcauaugaaaagaauguucuuuuacucauuaaaaggaacuaaccaguaaacuacauguaguaauccuaugacaaguaacccagugcugcagugaauuguuacauuggguuaagcauuacgaaaauuaccagaaaguagcugaccaauagugauagauaggugauauggagccaaaugucuuggagagggggaucuuuugaaauuagguuaaaugacauguguuugcaagagcaaaauauuuagugccauggucauaaugucaucuugauagacaaaggagaaauauuuguauccaaaaugucuaguuaauguuugacaauaggaccaaugugcaauagucaagagugguggacuaauguuuugagaguaaacaaaaaauaccagagauuagucaauguagguuugaacaagguuuugacuuugugauuagucgugugacuuuccuaauuuaacauaaucaaucaauaguucauaucugguagacuuucuggugaauuuucugguaguauguuuuauguugaacauugauuggacugucaagugaaugccagaugcuagcuuugacguuuguauguuuaaauacaaauaacaucauuuucauucaggaaaauucuggucuguuaauauuccugaaguucucucuacagauacacaauuacaacauugaaacuagggcucuacagcuugugauuuggggcaaguuacuuaaucucaguguccuaauuuccuaguauguauaguagaaggaguaauaacuaucucaaacgguugcuaugaguauuacauaagauuaguaugugcaaagcuucuaguauacugcuuguacaucauauuaauucaaugacaaguuaauauuaccaccuaaagcuagacuuggcuuugaugacuggguaaggagacauccaauauuugagcuagcuaucuuuuucuugcaauuugauaaaucucuugaaggcccaggggcuuguugcagucuggaggaaugagacucuggaaguagagacgacuuguucacagaaaacugauagauaaucauaacggagaauucuugacucaccaaaaugaaaauuucuuagggcaauugguaaacgcaguuaaguggcugcacaucuuuugcucaugaaacuuugaaauuugguucucuuugucucucucucauccuuuagaugaucacccuuagaaacuuuucuugacucugggaucucaaugagcucuggacuauagacuuaauaaacuucaucuaugaaugagccaucauaaccauuauaaaagcucacuaauuacuguugaaagccacauguuaauaauugcauaaggauuauauaauauaauuucaggaacuaaauaauuaaagaaauuucaaagaccauucaacauaucuuugacaacgagccagaaaaaagaagacagcuuuacuuuaauaguuuaaagggauuuaacaauucaugcaacacauaucuaaagcaguuaguauauuacgguugcaguguugaagaauaacauuucuucuggacaaauggaauuaaguaaugaaagcuaaaacugaacacaaauaaaagaaggguagaguacuggggaaagaauaucaguaaugaguacuuuaaaguagacuugauaguauucagaauuugagugucuagauucuagaacauauccuggucugcuuuuaauuucuaccccaauagaguugcuuaaaggauuucuucagcuuaauugccuucuuucuugcuguuauccuucaacuuaaguucccauauucuauaaaacuugacuuuaaauuccccuacuuuauucuguguccuuuaguccauaugcauucaguauauauugcaaauaaaauucuauuuaauggcaggauggcaaaaaugacuauguuguauuaagaaucuuauuuaaaugucuacuacaaagccuacagaauuuugguuuggccaugcuaagcugggaacuguaaaugcucacagaaaagguauagaaaaaauuguacaaagggggcuauuuugcugauuccagagcagugguguuucugaguaaauaccucuaaccuucugcuguacuuguauuggaaagcaauagaagcagaaucuauaaguauugaaaggcccagaauaaaggcauaguaagaauaaagguauuuuuaaccuuuugcagguuuuuuaauuuguuaaaaaggugguuagggaaaagcucuauauacacauauaagcauucacacacacacacacacaaauauauuucuaaauauagaguggaggacugugaaggcauuuggggcaaaguucagaaucuaucuuuaaguaaaugaugcucaguuugaaguauuuugccggggcugcagggccuauuugagcacaagauggauaugaccuuaggccaucuggggaagggaaagugggagcagcugugggccaauuuauuuggaauucucugaccuacugagagucagauuggaaauaagauucucaagggauuggauagaucuuccuccaccgugccuccugccucugaccaggauaucuuuccauuuucucugcaucguucccuuccucuuugcagaaguuguucaaagucacagcacaaguuaauggcagagccagauuuuaaauucccuguaggcauagaguuggugaguaacuuuucucucgauuuggggcacaguugcaagggcaugcuucaaguuuccaguaaacucucugugacugguaccacaagggcaauuccuuguuaauucaacucaagguuaagccacacacacacacacacacacacaaacuguagaaaauaucugguggccauuuaaauagaaaucaagccaaaauuguguguuuuucauuuuagggggaaagaacaaugauacaucuaaacgguuauuucuaaagagcauauccaugguccagugucuuucaggagcaaaaauaggcaaauucaagcaggaccuaagggccauuugcucagcagcaccuagaaacaauuuuagucaggguccagauuuaaagaguuucuacucaggucaagcuagagauuaggaaagguggcagaugaaaaucgacucagggucuggcacugguuacaaaaggaagcaggucacuagguuguguuuauagaggaaagagaauggauugcaagauuguuaucgcuggaaucauugugggggaggggaagacccucauuugaagccuugguccuccgacuaaaggagcccagagugcuuuaaggacucacacauaauuagccauacauuccacaggaagaaguccugccucuggcuacaucccucugccuugaagcaacggaaaaggagggauaagggugggagcaggaggcacggcgcgaagggcccuucuggccuucugugaagaccuuucuaaagcaucuccagauuuucuagccuguuucauccuuuauauugaaaaccagcagaucuuuagaagccucagcuagcaacuuggggaagaguuuuuuacuaguaugucaguaaacaguggcaugugaaguuugugcaguucugguuuguuggagcucagugaucuccuugcucuuugacaaaaauguuuugugcugcuuuagaguuuacagcauauugucccugacccuagagggagggaaaaaaaggacuuaguucuucacuucacccuuuaagaauucagguaacagagugacaaauaaaaagcauguuuucaccaaccaaaagugugggguguaguucaccaaggugaaacauacaugaugaucaacaugaagacaaacugcuaaguaguuuucauuaguauccaauuaguaggugauuugguugauaaaugcguuugcuaauucauuaacaauuagguaaauuaaauuuaaugaaaaugauuuaaauuugaacauaaaacgccacauguauuaauuuuuacuuuguaaauugaaauccauuugcugccuccccccacaccccuucaaauuguguacaguacucagucaauuagagcacgcaggguggauuuuuuucucauuuaaaguaucucuccucucuggaaaucggucuuccaguggaccaugucugucugugucucuagaugagugucagcgacaaauggugcaugugcacauaauacugaugaggauuguggguacgcagugagagcaggaaaagcccuuugcaauaccaugagggauucaggaagguauuuuagaauuuggagggguuuaaggcuucauuccacugcugauauugaauugcagcaugaccaaaugauuaacaaacuuggcuuucuggaaauaucucagggcagagagguucucaaaugauugcaaauugguuaauuacuuuaaaaagcauguuacuugcuguaaacaaguaacuuugcuggguuuuucuaaacaacuggcuauguuuagaagauagcaauauagaccaauuaaagauauacagagcuggaaagcugauauuauuauuauuauuauuugguaaaucuuagaauaggcuuuguaguuuaggaugauguuuugaagacuacugccucaucuuauuuuaaauaacuucauuucagcauuauggucagugauuuuaaaagcugaaacacauuccuguuguuacaauuuguguuauuuuuauugucuuucugacuuuuuuccugaucuuuggauaaaucucauucacaauuuccuggagaaacaaccagucuuuuaccgugguggaucacauuauaugauuuuuuuccuuguuaucaaauagaagauugaaugagcaaagcuaaauaggugggcaagacaaacaucaauguggaauggucuuuuuaaaaaucaguauucaaauaggcaaaguggugguuguaaucucuucaguguauguagcugaaaacaauaagaugcugccucuagaucuuugaucuuuacuaugaaacgguaggagagaauauguggcccauuguguuugguaacuugccaggguagguucacauuucugaggcaguagcugcggucauauagcaacaucaguguuucgcuuucaacucauauuaauagguugaugaaaguucaagugaauguuguugagguugagugagugaaaaauuauuuaauagcaucuguuaaguauaagagaucauucacugcuggcuuccuucaggauaucuaauuucuccacgaggacuugaccugauuuuuuaucacaugaggguuggauuaccauuuaccucaaagucagcuacugugcucauaaaaguuguguuuauuuuuucucucucagauagguagccauaaacauugggauacaagaaucacuggauuuuugucuuccuuuuacagugcugucuccuaguggacuucuguuuucugccuucccauuauauucaguuuuaggggguuguauagaaaaauccucuuaaaaggaaaugguugaugaugucuuuuaaacaguuuaaacuauguaaaaagaaaaagccuuucagugaagcaagguagcaauagcugauucaaaaacuaauaaggguuuuaauaagaauugcaucuuuuuuuuuuuuuugagauggagucucacucuguugcccaggcuguagugcaguggcacaaucucagcucacugcagccuccaccuccuggguucaaaugauucuccugccucagccuccugaguagcugggauuacaggcacccaccaccaugccuggcuaauuuuuguauuuuuaguagagaugggguuucaccauguuggccaaggcuggucuugaacuccuuaccucaagugaucugcuugccucagccuucuuaagugcugggauuacaggugugagccaccacacccagccaaggauugcauucuuguuuuuuugguauauacugauuggauugucccuaucauuuccauucaucaacuuucuuaguugagcauuugacagacacaccucucaauaucacuaauuuuagaauuugcauuuagauguuacagaguuagucacuggguuguuugaguuuugcacauggaguauguuagguaacaucaagcacccuaacugcgcucuguggaaaccuggacucuauacauggaaugaaaccuuaaaagcuuaggauggaaauuuggguaaauuuuguuaucucccagguuacggaggugguggggaggcaagggacuuaacccuauguaaauaauuuacugguauacccugguuuccucaguuuuaaaaaucucucccuggauguacuaugacacuuucucucugaggcugauguaguccaacaaagccacaguaauccagcaaacacauuuuaacauucuguguuuuauaucucgauucccuauauuugucuuauaugccaccauguuccuguauuuucccaagcagacauucgacuuguacaguuuuccagcauuacucucuucuuuagcaguuuauaaauuccaagcuuguuugaugaacuggaagccuugccaaggaugagagagauagauacaugugcugcguccucauuuauuauacuuacuaaacagaugcuuuuugacuugaccaugucuuccuggcuuuucuuuuagcccuuauuugacucccaagacaacuggacauuuuagcuguguaucuaacugggcagaauaguggcacauccuuucucaccuuuuaaaaccaagauguggugcagcugaaacagcuaagaaguuugcagcaggcucugaccccuacuaucaguuacugaaguguauguaaaaaaacaaaaaagacaaaaacagcagaagcacguuuuggguguggaaaagucaauuaaggccaaaagaaucaaacuaauucagcacaguucuuuucagaaacacauuuuuuggucuuugcuccacacuuggauuauuuaauuuuugucuagugacagugagaauuuggaccucucuaacaaagauaauaugauuuuuuuuuuuugagacagagucucacucuugucgcccaggcuggagugcaauggcgugaucucagcucacuacaaccuccguuucccagguucaagcaauucuccugccucggccucccaaguaguugggauuacaggcaucugccaccaugccuggcuaauuuuuguauuuuuguagagacagaguuucaccacguuggccaggcuggucuugaccuccugaccucagguaauccacccgccucagccucccaaagugcugggauuacaggcgugagccaccgcgcccggccucaaagauaguaugaucuuaacucuuguaauauuaucucagcguuuacaaauauacauuuccaaauaucucauauaauuuucaaaauagagaaaaaaaguaaguuaaaauucuuuuuuucugauuuuaaauucaauauaugcuuuaaaagaaaauuugaaaaugcagaauauuaaaaaaaaacauaaaagucacucauaauucuccccaaagauaacagugguucaaugguuaauauguugguguauuucucuccagucuuuuuuucuguguguguuuguguauguauuauagucugcauuauguaauauguacugcuuugaaacucgcuuuucccacuauuuacugucaacacuauuuauugugaacauucuaguucaguaaauuuuuuauaaaaccuauuuuuuuauggcuguauagccuucguuacaugaauauagaguaauuuguuuugaguuaaucaucuuagauuguuucugacuuuugcaauuagagcucaugcuauaauuaacauucuggugcauaaauauuugggugcauuucugauucuuuuauuagaauaaauucuuagaauuucagcacuacuaggccacagaaacauguauaaaguuguaaaaauucuuugaugcauuuccaaauugcacuuugagaaguguuucuguuuagucccaauagcagggugugagaagagaaugguuggcauuauccuuguuuuauagaugcaaggguuuagguguagagagauucaagacuugucuaaggucacaugaugauauuacuuauccuuugguuuucugagccaguucuauauucuuuccacuuuaccacuguuguaguaaaacuuggugacagaucuauagugauuuaacugugagggaaaacuuaaugcaaccauggccuuaaaauaaauuuaccucuauuauuauuauuacaaacucuaauguguagaauuugauauauagugaggacucacuucccaaaggcauucuuuuauaucuucaauauguuuucugacucacaucuaaaauauccacuauagagguuauguuuaacugagaaauaauagccuaaagugauuuuguuguagcuuuuuggucaccaaaucugguuuacaguauuauuccuuauuaaguaauagucuuuccaguucagcaucaagacauugaaaagauuaguucugucaggauuaaauugcucucaaaccaucauaaguaacccuuaaugucuacaaaauggacugaaacuuuuguugacucucauuuuuuggaagaagaugaagguaaaaauauaguuuuaaugucaagacuccagaaugagaugggauauaacaauuaagggugauuuccuccaaugaaacauaaucaaaccaagugugggaaguaaaacaaacaucuaccccauguccccaaacaaaaacaaaacaauacugucaaaaggacuaaccacauuaguaguuuucauuucuuucacauagcacuuacuuaauucuuagaauaacugggcaucuuggccuuuuuugucugaggauagcccauucacaacuuccaggucaccagggagcccugucuggacucugcuaaaggccucuugcucuuugccuuagagaauaaaugugauaacauuguuuugcccuugauucccagguagauaggacauaaauuggaauuaaaacauucagauucugaaagccaagauaacacuuuaucuuauuugaggcugugcuuucuuuaguaucaccuuacccugggaacccuccuaaguguuuaauagguaccauuacuucugggguuaggagugcauugcuggaagccuucuuauuguauccugauaugccuuugggaaaaagaaagcccuucaaguguuaacagcguccguauucuguuuuaggccaaugccauuguuauuucaaaucauauuaucuuaaugaaauaggagucuauguaauaugaauuuuguuguguuugacaaaaauuaaaguugcauaagaauuaugaucauguuacaguaauugccuaaaaugugguguuaaaguuccucacuucaguuguuuuuuguugauugaacaaccuuuggguuagaugguaaaucucaauggcuuuaguaauaaagaucuaaauagucuaauaauauuucuaaaugaaucaguuuuucaguguuucaggaaaugacaauuuuuuuuaaucaaggcacuuauacugaaaucaaauagugauaauaguguaaguucuuauugcuuaacuguuuucagacagcagggacuauauuuugaaugagugcaucugcugaaauuagauucucaagaauguucauguuaugguaggcaucuugaaacagaugauugauggguuccaucaauccacagguauuuauugagcaucuacagaguaccaugcacuauguuagguacuguggggcuaauauauaagauccaauuucuacucacaagggaguguauaggcugagugacaaagaaaccaugaacauacuaucccuuuuugagcugagccuggaugguggggaggcuauugauaaaagaauaugagagacugggauauccauuguaaguagauauaauagucuaagcaaaaucuuaaagacaggaaaaaugagcuuggugaaugccaaaaaacuauuugagcuggaauaaaaagauuccuuaaaggaaauaguauaguggaagagaaaguugaaaaggcaggcgggggauacaauacucucauuuccauuugccagcuguguucuagggcugucugccuagaacuaaauaaauaugaauaaauuuaaaaauguguccaauuuaaagcaacacccaagaaacaaaaucucaaauuaauuuguacaacauguggcauuguaaaauaacccuucaggguguccaauuuaaacugccuccucuuucgucucuguguauaucaugugggccacccagugaugccaguuggaaaugagacacuaagauuagaaaauuuugccagagugauucagaucuuguuggaucaagcuaaccagcuuugugauuucaaacucacuacucucuaguuaaaugauguagugugcauuucuagauguuuggaaguaaaagucauugaucaaaugaucucauguaugagcccuucauaugagacacuccacuagccagugauagcccagaaucuguccuugacacauuaucuuguuuucucuuuuucugucuuggccaccaccuucaucugucauguucuuuuaaaagcaagacccuaaaacuuuaccuucuaaaucaauauucuaaggugaauuuugugaugcuuugaauuaauggcagagaaccagaaguauaggcaauugcaaauggaagaugaugaauaacucauuuauaugugaguuggaaagccuguuuauauuuacauuugacuaugggugagucuguuuuuuagaaauucacuuucaaacuaaauaaugaagucauacauaaaggucugacuugagcugcugagaggcuggcccaauuuccugcaaccugcugcaugcuggggagaguaaaaacaucgucuguuguccaaccuauuacugacauagcaucauccuaagugcuacugacauguguaacugaaauauuuuauucuguggcuuacagcuguuucuucuuagcuuguccucaauaaauauggaagggaucaucauggucaaaggacuuaaaaaggaaaaguaggaugguuguguacaggaaacuauagcaaaaauauauauaugugcauaaaauggaaggauuggggaucagugacauagacaaaucuuuaaagauuacaugaaauaaaggaggugaaguaaaaccaagauaacaucacaguuaaugcuaaagaaauuauuggucaaaccaaacagaaaaguucacacaaaaugagaaaaauacuuuaucugagauaaagaaaugagaugguuuaugcauuuccaaaauggaacugcaaaauguuugggagaccagguggcuaaagaacacggaaugggagaauuguaaaguuaaagcaggugagaauaaucuuuucccuuaacugacuuagacuuacaagaaggaagauaggauuuggugauuuuuuuuggugcaaguuggaucccagauaaaccuugggagcucuugggaacucuucguggguaccauaauuagaacuguauuguuucugugauuuccaguaaucuacuccugaagagcagaauaugguuugaaauuguucccauucaauaagccaucauagauuuaaaucuuaucaucacauugaacccuguuuuggugaaacuguguauuuucaacuauuagcaccucuuguuuugaguaauauagaguuccauauauuuaaaccagcuguuucccauaccacuacccauuuuaaucuguuuuaagcuuaucuuuguuuaguuuuaagaaguccuuaucuuuacuguauuaggauuuggugaauaaauucaguucacccugccaauauccauucuuauucggcaaacugauugcaucccuuuucaaacuuccucuguuuaaccuggagugucugagcucuguaauaugcccuuauauagauaguauuuccacccccaagaagauaacagcuaacuuucucaagcuuuguucugucucaucacccauggggccuagaauaguauguuguaacccaggaggaaaaguaccuugcuuaaacuccuggacaccacuuuguuuauuucaauaauuuguggauuauuuacaucucagcaacauucuuggggcuugggggauguggaauauauauauugggacuggcauaguacucugcauuuuucauuggcuggccugccuggaaaccugcagaguugucugugauaaucguucauuggcaaaagaaugccgaaggauaauguuuaugccuggcaccauuuuuaauucauuugccuugaguuuaacuuuuguaguaaacuucugggauggcagccuucuagggcccauuaaccagaguuuagaagacugugugguagaggucuuagccgucuguuaccuguacaguuccugccaguuagaugacuuucacuagggcuacuuuaugaggguauaaaaacuucuuaguaaauucggccuuuuauuaggcacugcauagccccuauuucaggaaaacggucuguaccaggaaauauaagggaaaggaaagacuuuuaagcuuucuuuguaggugccuuuuaaacauguuagccaucuuggcacuugccacuaagugagggaggcagccaucauucagaagagaugguuuuaacaucugugguuuggggacacaaaaugagacagcauaguaauaaauguccuaaccccaggucauuuaggucagacauguuucuucuagcauuggugcugguccugccugagacugcaggaaucaguggcaucaggagcuucuucagcccauauagaaaaauacaacuaaagggaaaaaaagagguagacuuugaagccaguagacaaauguucagucuaaguaauugugaaaacuuuuagaaacaauaucuguauguuccuuccuuccuccuuuccugucaucucuguuuucccuccauccccaucccucucaagguuccaccaaaggcccaaagcaauaugggggugagaaaaagaugguuggguggaaggaaaaaucauuuuauuauuugaguugcuuucucccuuacccaagcuccagcacuguuuguugcaugaacaguuugagcuccacaggaccguaaguuacacuuacaaaaacaggaaugugucuuuaaauaauauuaaauguuuuagugacaucaagaugcuuacagggcuagucaggcagguaagcauauaaccagcuuucuucuacaagaaguuuuauuugcaucuuuuaacauccccuugacauuuauauaccaagguagaaagcccgaaccucagagaaaaaaaaaauacaugggguuuaugaguacuugaaauaaaaaauugaacuuuuucuuccugucauguuccuuaaaauccuuugaggaaaaauguuguuaugaugugcccaaagacauuuaacauaaaagguaacuggugcuggaugugguggugcaugccuauaguccuagcuacuugggaggcugaggugggaggaucgcuugagcccaggaguucaaggcugcagugagcuaugauugugccacucuacuccagcuugagugacagagggacacccuaucucuuaaaaagguggggaggguggcugugguuaccugccaucaucuuuaaguuucuugggcauuaagcaagcuggaagccaguuuaauagcuauccuuaugucuuaugucuuacuuuucauccuuguggaucccuuuggaaggaacuaaauguguuggcaccauuuucacuaucauauaguuuucuuucugaaugugaggcgguaggauucuacuuaucauguacuguacaguugcacuacuugaggaugaugaacuuccacuauauaucaccuaaucacuucuuccauccuacuuuguaugugguuuaaaguguaucaucucuugccugguauuuuuaaauaauggcuuuuacauuuuuaaagggaaauucuuuuggggguaccaguuuguggugaugguugaaaauaucugucuagcaucauuuguaggaaaaggauaguauaaugaacaaauauuuauuguguaccugcuaugugagauacauuauguaaagcacugagcaugaugucucucacauagaagguaaggcaugaagaucuuaacuagggcuguagcaguggagauagggaaaagcuagaggucgauguaagaaacauugaggaaaagagaacugauagaauuugugacuauauggauggggaugagcaagaggaaggaaggaaauauuuuuuacuuucagagcuguuaguaacugggaaggagcagagugaugucaggaguagaaauaaggaaguugguugaagcaauaaggauugugggaugaucacuacaagaggcaaaaugaauuggauuuuggucauguugaguuuguaauacaggugaccugcuuacggggagcuguccaagagggagucagaaauacaggccuacagcucuggagagagauugagacuuauagagaaauccaggaauuauccacauaacucaucauaauggaaaucaugaaagcaggaaaauuuaccaaagaagauauuuuagaaaaaagacccagcaaagaaauagagcaugagaaugaaagccuugaggguauguucauguggaaggcagagagauugaagaagaagcaguguaaaauacuccauagggguggaaaaggauggagguuagacgugaccaucccauuuagcaacucuaaaagucauuggugacauuugaguaccaaauuucauuagagagauggguaugaaagucacauugauuggaguugaggaagaggauguugauuccucuuuuaauauauuuggggguagaguggagaagagugugguaauuugagacaggaaggaaggagagaucaagugaagagaaagaggcaggacaucauaggaaaucauguuuaagauccucauuuuaucagagaaauaucauucgcuaagagugaaaaggacaggauuggguuuaggacuuaggaaaugugggacaaauggaaaguaggaaagguuuagauuggcugcccugggaaaugacaaguagucagcaaaguauaaauaaaaaggcuuguuaaacaauaaccagggcucagcuaaaguuaagcuauacuguaaguuuauaccaucaaaauggcaaaauuacguuacuuucuccaguaacaguuggcacuuacuaaagaaaaaagucaugaaauugggaaugggagcagagaaaguacaugauuugguauuugucagcuugagaauaaagacacacagugaagaacuuuaggagacuaaugagagcauugaauauuuggaauaagaaaagugauaauuuaaaucaucaauuuuuugaccauucauucccuuugcagcaaauaagcucaauuuccuuccaaauaugucuugauuaacaacagcaacaaaagauucacuccacccccuaucuuauugcuguuagagugaugguugguacaucaucacuaaaaaaucagaguugaauucuugugugugagaauucauugaagccauaugaaacauaaaguggugauuucuguaguugcccgguacucuuuuauuuauuuauuuauuuuuuugagacggacucucgcucuaucgccuaggcuggagugcagaggcgugaucucggcucacugcaagcucugccuccuggguucaugccauucuccugccucagccucccaaguagcugggacuacaggcgcccaccaccgcgcccggcuaauuuuuuuuguauuuuuaguagagacgggguuucaccguguuagccaggauggucucugucuugaucuccugaccucgugaugugccggccucggccucccaaagugcugggauuacagguguaagccaccaugcccggccacccaguacucuuagaagcaaaauaaaaaaaguuacccuccuuucccauccuuggaaauuucauguuacuauucugugcucauuguuaaagcaggcuaugccacucaagcuugaaauauguucguguugccaugguuugugucaguaguccuuccucaucaugcuuauaguugcuugugcucacugaaccccaacaggugugugacuuaauguagaugcuaaagaaagauacaggaaaguaucuguuagcacuagauucugggugcgcuuucggugaaguuguacuugugauauuugcuauuacuuacuaggguugauuuugcaaguauuauguccaaaaccccuguguucuuccuaggcgccauguaucugaucuaagaugacucuuuuugugagcaacauaagaagauauuaaauguagucuauauuuucugaaguguagagugcugucauguuuaccucuagagacacccaguuuccuaugguaacuuuuccucuacaaguuuuaagugcaugaaagaaaaggaugggaacaaggaaagaaagaaaaguagguacugcugaauacuggaggaagacuugagcucagggaaagaaaaaggaauaucaggccuaauuucaucuucauuccacugaaaaucugugagagcuguuucuagagacuuuuucaguuucuuaccacuucucucuguguguuauuaaaccuugucuguucccuuuuaguuauuagcccuaaaaccccuuacaaaaccucaaaaggguuucugggcuuaaguagauacagauggggaggaggggaaacuauauagcuguguuccacuuggcaguggcccaagagaaagcagagucaaagaauaaguguuaucagcagaggaagggagggaggaggcccgcccauugaggagaaagugaggguugacuugagggacucuggaaagggcccaggggaggauacccuuuucaaauggcacauuaucaugaggucuuauccuuuucuucuggauggaagucauccucccuugcucuagacuuuaccuguaccccuuuaaaugagccuauuacuuaguauuaucuuguauuuguuguuguuaucuuguauuuuagcagcuaauugcaagcaugccuuaucuccccaaguagacugugagcuccuugaggggagauauccucuuuccugcagcuuuuguuccagugccuugcccauaguaacaacuuauuuuaacugaaugaacaagugaauguagccuauugucuaccauuuucugcauugauuccacaaguauuauuugagcucugcugaugaaauggaagaguucccugaucccccucacaggaccugugacagugguuuggcucaccacugcucaaaccccugacaggagggggagcaugcagacaggcaggagcaggagcuagggugagugcuuugggcucuggccccauaguaguaucuaggggugggugccugcagccucaguguuacaguguucuuuuaaccuugccauccacagaugguuuaaguguuaaccagcucaguggaccuuccgcguuuuugcaaagacagagggccagugugacagcuuuuuguaucccaagcuuuugccuagcaucccagaagaauugggucacacaugggcuugaagggugaauaugggguuuuauugagugguagaggugccucucagugggauggacggggagcuggaaaggggauggagugggaagaugaucuucccuggaguuuggcuguccaguggccaaacuacccucccacugccccuagcugaacuccucuuggcguuuagauguuccuucccuucucucuuucucugcgcaccauucugccauucaucugcuugucuccucagcucaucuccucgucugcuugucugcuccuggagccugggguucaggguuuauauggguacaagacggggguaugcugggccaaaaggcaacuuuuugggcacaaaaacaggaaugccuguccccauucagggccacaggucuucaggcuugaagauggggccuuugccagggaaccggccucuccgacccaguauuucccugucuccuuuuugugucaauauuauggggauagagaggauuuuugagauagaagccugcccuccagcagcugcauaucuaggugggaugaauagaugccaaagacugcucugcuugugauuccauaggccccauuggauucugcuagcggaugacuuguucaugugucuuucucauuuccccaguugcaauuuuaggaaauacucucuuugcucugaaaauuguuaucaauucuucuucagccauuuauuuucugggacuaguaacccaauaauucaaugucuaguucagugaagagucauugcuagaccugauagugaugguaacaaacuucuuccugggagccacucagccauuucaagacacaagggaaucuuagaauaaacaauuuuuuuuuuuuugagacagagucuggcucugucacccaggcuggagugcaguggcaugaucucggcucacugcaaccuucgccaccuggguucaagugauucuccugccucagccucccaaguagcugggauuacaggcgugcaccaccaugcccagcuaauuuuuguauuuuuaauagagacaggguuucaccauguuggccaggcuggucucgaacuccugaccucaaaugacccaccugccucagccucccaaagugcugggauuacaggugugagccacugcacuuggcuguaaaugaucuuauucaggugcuaaauggugggcuaggagccugagagagaauaauugguucuuuucucuguacgguuggucccauagggccacuuccaucucuuauuuaccuaugccuuuuuucuagucuugaugauugacuagagaaguuuggggggcauugcuugaucucuuccaaaaaaaaagaaaaaagccagaaguucuuugaaaaugacuuuaguuuuuucuuaaagaagcauaaaauaucagguuaguugggauaguuuuuaagcagggaagcuguauuuccuguauuugcuaagaauauuaugaaugaguuaacauguuacuguagguuaagauaaucuagaaauguaucuggaaaaucuauuucaauuaccuucugggugcuuuuagcaaaaauaauaaauuucaaagaauuaagagagucauaaaaagaaguguuaugaggggaguauaccucauuuuucaccuucaaaauuaaauauucacuguggaauuauguacugccagggucacugcauugcuuauaggcauuaauagcugccauagguaacugcugaaggaggugaaggggaccauuucccauaacacagagauuaaagcacgcaauuuacugaaaauccccuaaauaaauagcaaccuaaugcucaguugugcacuaaaagggaugcugcuucacauuuacaauuugcauauggauacccuguugaaacuugcauuugcauauauaagguauugauuuuggcuaauggaacaugaggucauuucucuuuaguuucccucaauuuaaguaucauuuucuuucucuccuuauugcucacauagaggaaggcagaaaaauagcuucagaugauugugucuggaaauaccagauauuguggucuauuuuuauuucaauuuuucauauuuaaauugucuguauaccauaguaaugucaguagcuggcuacugcuuaaaacuagaaauuuacaugacaaguaauaguuacuuuaaagagcuacuuaagcuguuugaaaaugccuccagacaucgcuguagcuuugucuacuaaaaccagugaggcccagcauucuuggucgacaugaaguggcuugguugaacuuguugguauacaauacagugaauugccugacccuccuaauugugcuucagacuuaaugccaaaauggugcauuaauuggaugugggcuucagguuuuuguuaacuaucagcuucguugcugaccaauuaccacauguaggaaaagauuagaaaauauucuauuuuacugagauaacaaaaucaaccgauuuacauauacccauacauuuuaaaguaagcaaacuuuguauagauuuuuguugcagcaaccaaaauccagauggauuuccccuucuaacaguguauuuuccugugugaaaugucucuugucauuauuuuccucccguuucauuuaauaagaacauacguagcucauuaugaaguagguacccuauggagaggauugccugugacuuuccaauaugaaaucacaauauuuuguuugcaucuauuuuauaaaaauugcaaaaguaauuuauuuggcaaaauaccaccugcaauaguauaaccuuaguuaaauuguuuuguugcuuauauguaaaaaaaggacucuuguugcuucccaguaccaaaaucacacaauguaauuaguuauucccuuuuagaaacuaugguugcagugauaggcuugaauuuuugaugacagagggagaaaacauaaauauuaaaauaucuuuauuuuugugugggauacaaauaaaagaacaucccacagauaacuguaauugcauuuuauugaaggaacagaacuuguaaauagggcaacagcuggacaugcuaaauuaaaaaaaaagagaacaauaucacauuuaaaguacgagugucuaagaggaaguuuauagugcaugccucacauuuuaaauucagcaagaaagaacagggacauccuuuuucucacuggcaaguuuguaaucuguguaaaacacuagguauguuuccauaagcuauuuaaaugcaagugacauucagaaagaagauccaggaugaacacuugucauaugaguuucauuuuauucacacuuugagaguuguguuucacacucauauuugaauaagaaaccuccuugcaucaugaaugaaauguuuucaacaacaaaaaagucacauguugguaaauuguaacacauuuuuccauaaauuuucaccacaacuuuagaauuguacucccaagaaaaaauacuguuaaauugggaaauacagccaaucugucaguuacacuugaguucaggacagacaaggcugcugggacaugugagcauuggguauucauagagauuaggcauggggcugagcagugauggggccagguggaaaggagaggugaugggaguugcagcuguuuguuucuacccaccaucaugauaugccaacagcuggagaaccaauuugguauaaauucccaggaccuuacugucaguuaaugugagccuuccaggaacacauaccaaauaauagcuuacuuuccuaauucuaugaugggaaauuucuucagagucaaucccugugaaaugggaucaggaacaguuuuagucaaaaccgugaagugcgcacaguuuggguuuccugcccuuuaaccuucccuucaucugucaucccuucuuccuccucccaaggugcucaguauccuaugccuuuaaaauauuaucucaacuguucuuauugcuuccuguccccucucuucccccaugccaccaccuuacugcacccuuuccagaaaauacucugugagcaagguuuugaaucuguuacuugacccuauucuuccuccacguaaagauaaccaaguauucuuauuuuuccagacaccaucugugggaagggaaauuugccaguaaucaaaaaggcguaguguguuaucucucuuaggaauauuuuuggccgggcgcgguggcucacgccuguaaucccagcacuuugggaggccgaggcggguggaucaugaggucaggagaucgagaccauccuggcuaacaaggugaaaccccgucucuacuaaaaauacaaaaaauuagccgggcgcgguggcgggcgccuguagucccagcuacucgggaggcugaggcaggagaauggcgugaacccgggaagcggagcuugcagugagccgagauugcgccacugcaguccgcaguccgaccugggcgacagagcgagacuccgucucaaaaaaaaaaaaaaaaaaggaauauuuuuauguuaacuagggguguguguguguguguguguguugauguugguggugguugcacagugcccuuaauacaaaggaaugaaacauaaaugauagcauuuauuaguucuguggccuucucagcacucuucaaauucuaucacuugagugccccuuucucugccugcuaaggcuaucucugaauaggugauguuuacauccauuuauuuacugccuaccaaaaccacaauuuaaaaauguuccuguugcccagugaagccaagaagaaacuuucaagauuaucaaaauguucauuccuaguuagagagagaaagauggcaucguucuucaaaauguuucuguuacuaugcuuaaagaaaauauuuuuuuccuuagagcauuaguuggaguauugagacucagauuuauggcuauucuauugacaagggguuauugcaaagauguuuuauuugcuguuucuaggggcuuaucaaaaauaauugacuagcugucauuuucuacaugagaccaauuacuauugacccagcuuugcuuauuguuuucauuaaugucuaacaaagaaugaaaauguuguugaauguucuuagaacugacaagagaaaagcagugcuaagaagugaguauguaucucuuggccuucccagugcugcuaagcagagccaaagcucgaugccaggauguugugugagcaacggcuucuacaguaugcaaacucaaaacuacccuacgugauguuugggagaauggaggauauggagagguagcagccugcuaugugcaguuguacagguugugcucugcacauucacauugugguucaugugaaaggcauucucuagaguugugcaaggcacgaccauauguggaagccugggaggcaguagaauaacuucugugucuucugugauaaguguagucaguauuauuauuauuauuauuauuauuauuuugagauggagucuugcucuguugcccaggcuggagugcaguggugcgaucucggcucacugcaaccucugccuccuagguucaagcgauucucccaccucagccugccgaauagcugggacuacaggugcccaucaccacgcccagcugauuuuuuuuuuuuuuuuguauuuuuaguagagacgggguuucaccauauuggccaggcuggucucaaacuccugaccgugugaucugcccgccuuggccucccaaagugcugggauuacaggcgugagccaccacacccggccacuauuuuuuuuuuuuuaaaggaagcaauacagccaugagauggcuaucauuuaugacuuggcaccuuauaaagguaaagguggccuguuuuaccuuuguuauguggucuauuggcugaacauuaaccacauauuuacgcaucuuucuguuggcauguaggaaugauugcauuucuguagugggaggagccugguaaaugauuuuuuuggcauaugcagauuagacagaaagacagguaugacuuaguaaauaaguguuccauucuucaagaguagaguagacaguaacauuccucaauuauugaguggcaaaaaaaaaaaauccccuuuuucuaaaauaccaagauuguacucaauaaagaggaaauggaaaugcaagcaccauaaucacaugcaaaacuaauuuaugauuuugguuuaaggagcuuauauuaggcuguucuugcauugcuauaaagaaguacucaagacuguguaauuuauuuaagaaaagagguuuguuuggcucguauuucuacaggcuguacaggaagcauugugcuagcaucugcuucuggggaggccucaggaaguuuacagucaugguggaaggugaagagggagcaggcacaucacauggccagagcaggagcaagagagagggagaggaggugccacacacuuuuaaacagccagaucucgugagaacucaguaucaacuaggacagcaccaagccauugagggauguguccucaaaacccaaacgccucccaccagggccuccaacacuagggauuacauuucaacaugggauuuggguaggcacaaauauccaaacuauaucagagcuaaaaacuuccuguaugaaauugggcuuuccaaacccuucaguuucuugaagcaucuccaaauauauuuaguauauuuggaguccccauuuaaauuaacacagaagacguaaccaaauuucaguugaucaaacuuuaggauuguuaaucuuggggaaaccauacccaaaguugaaacuuuacauaaaaucuggccagauucuagcuccuagaaucuaaauuccagauacuccugagucaguuucauucuugugacuuaaauuaaguggucccugccauagcaccucuucuuuugagagcccaguggccccaaguuaccauaaauuaaggguaaccaaacuagaugcagcuagaucacuuacuaggaugugauuaucuauaaguaaaauuuuaagucuaugcaguuuuauacguaugcugauaaugcaccuucccaauuggguuaaaauggauauucaauucaaucaauuuuuuuugagacaggaucucacuuugucacccaggcuggaguucaguggcaugaccacugcagauucaaccucccaggcucaagcaauccuuucaccucagccucccaaguagcuggaacuacaggcacauaucaccaugccuggcuaauuuuucuauuuuuuguagagacagaguuuugccauguuguccaggcuggucucgaacuccugagcucaggcgauccaccugccucagccucugaaagugcuaggauuacaggcaugagccaccgugccuggccaaucaauuuuuuaaaagaugacuuaccauaugugcuagaauaugaugaugguugagauacuccucaccauugauuccauaggaccuucuacagugaacuuuguaauuaacaacagaucuacugucaaagagauuugaguuagaaucauagcuccacucucuccuagcugaucagcucuagaguaaucaguucaucugucucaggcuuaguuuauucauuuuuagaaugagaauaaugauagagucuuccucauagaaauguuauuaggauuaaauaauauaaugcauucaaagcacuuagcacagagccuggacguaagcacucauuaaaugcuaacuguuaacaaguuuuuaguggucauaguuuuucacucgguguuccccgagugcuguucaguuuuguucucccucaagagggcugugaauacuuugaggaaaggauuuuuuuuucugccugauuccccuuuguauucuuaccuuagcccagugaguguuucgaagugggaauacugagccucaguuucaaaaucugggggaaaaaaacgguacuaauaauggcacuuaacaggguuguuaugaggauuuaaaguauuugcuaugauaacacaugaacgaaagccucagugauucacauauccuacgaugcagcgguuuggauaugauuuguuuggucccugccaagucucauguugaaaucugaucccguguuagaguugggccuggugagagguguuugggccauggggaaggaucccucaugaacaggcuuggugcuguccucaagauaaugagugaguuucauucuguuaguuuccagaacugauugcuaaaaagagcguggcaccacccuccuccucucucgauucugcucuugccaugugaucucuccuccccuucaccuuccacuguggguggaagcagcccaaguccccuugcagaagccgaugcugauaccaugcuucuuguacagccugcagaaccacuauccaaauaaaccucuuuucuucacaaauuacucagccuuuauaauaguacaaacagacuaacacacauaaguauuuacuuccccuucuuaacucacagaauugccaaggcuccaaugagaugauacugaugaugcuuugcaaacucaaaauccugacauagauuugugugaugaaugcggagaguaucuguaaaugucucucaaaauuuucucuuugucagaaaccugaaaccugcccagacucguccuuguuuguguaagucauucaccaccaucuauagcagcuggaacuuucgccuucaucucucccuacccacacacagcuaaagugggcccuggggucccugaagagcagauuuccuaggcaacaguuguuuuuucuucccaggugcaaauaugggccuucugagggaauucccagggagaccccaagccugggaauuuuagucuggaauugcuucacuccaggaauccuucccucagguccuaauagcucugccuuaggaaguccucuccaggaagacuggcucagcaccccuguaugguugggaaaguuccuagaaauggagccuugaauagaggaugagggcuucuggguaggauuccaugguuaacacauuugggaacuggugggucagacagagccuuaauucacuacugugugauuuuaaucucugagacagauaauauauaggguuugcuaaacuuauuagaucaaaggacaguuaguuuucuuuucuuuuuuuuuuuuuuuugagacagagucucacucugucgcccaggcuggagugcaguggcaugaucucggcucacugcaagcuccgcuucccggguucacgccauucuccugccucagccucccgaauagcugggacuacaggcggcugccaccaugcccggcuaauuuuuuguauuuuuaguagagacgggguuucaccauguuagccaggauggucucgaucuccugaccucgugauccacccgccucggccucccaaagugcugggauuacaggcgugagccaccgcgccuggccagacaguuauuuuucuaagaaguauucauaggacaaaauguuacauggaacuuucuuuugaaaauaugauuccccaccccccaacccaaaccaaaugagacucauucugguuucugucuucuaaaaugauauccuuuucauuaagaugaaucuggucccaauccaaagugcaaugaugacugacaguagugucuaguauaauuggagcagugauggagguggggcagguaaaugcaagaguggcagaaauuaaucugcagucagaaauuaaucugaccccagacuaaugcuggggcaggagagagagauauaugagagugccagaauaugguagauaugguagaugccagggcagggugaaggcauccaggugggagcugaaauccagccaggauacugcuagacaagcuguuuuucuuauuacuccagccacagaaaguaccuuugacaaucccuccaucucuuuucuagcuggauggcccagaguggggaccuuuuagcaccagcggggacgccuuuuccuaauuugcacaauagugcccuauguuuuaguagugaccuuaagggugguuauaggagaagguggaaagacaagagugucuauuugauguaaguguagggaauauuagugauaguucggaaauuucuccagauaauggcaagacacuccuuuagcagccccccuuuccugaguuucccauuguuccacuuauuaaacucugacauaugucaugcccuguguaccuggauauccauucauccugaucacaaccugaucucccacuuaccacaccaucucagaacauugucuggcagauuaaaauaucuccccagcucugcuaacccacucuuauaacaugacuagcuccuccuucccccuuuuaucccuuuaucuauaaguacuuuuuaaaacaagggcugacagcuuuauuguucaggaauaauugucaaaaggcuuaguggacuguacuugccaguaaaagguuauuugcuggcuuggggugugugcuccucagcuguccugugucauuccaauuauauugucauauggugagauuugugccugaugucauuguaggcaaggauauaguagaggcagcucauuuguauguuggugcuucccaguucuccauuuguugagaugcuuuuaucauucagaccuuugagacaauccaaccugcuuccuucaucuuaaaggugaggaaaugggcccagaaagggaaugugauuuaccccaaaucauacuauguguuggugaugggaccaagaugaaauccagcuccccaggccucuggcagggacuccugaacucauagcuuugggcacugaccucauggggugaaagggaagauuauauuucuauuugaauguuuucuaacacaugaaauuuauauagguaguuauaccuagcaggagccaaagaacaauaauuuuaaaauaguucuauaaacuucauauccaaguuaauuaaacaaacuuuuauugauuuaagagaaacugguuaaucaaguucaugauucauuaauaaucaauuuaaguugauaugaaaauauuugugguaugagcaaaagauggaggaaaaaggauccagagaacaggaagaauaggucagaagaagggggauuuagagagaaguguuacuugugugguggagagggguagauagaaauuugggagucgucuguagagagaugauaagaaaagaaaugagaaugggugagauugcuggggauaaucuaacagaaacauuacaugguagauaauuaaaauacccauuaccacuugcuguauaucuuucuuuccugaguucaaagccuuucaccaaugcuaucacauuuaccaucacaguauccauuagaagcacgcaguaauuauugauucccuaaagcacacacgaguuaagugaccugacccaaaccauaaggaguggagauagggccuaaaaguauugcaaagcucuguggcaguacaacagacucauuuaaauaauauaugcuuguucaccuuagucuuugcuacuucaugugauaguccaguuuugcuuaaucaaguuuuaguuuguagcuauaaaguuaguacaugucacucuacaaaauuguaaaaauauggaaaccauaacauaaaacucauaccauaauccuacuauuugaggaaaauugcuauuaacauuuuaguguagauuccuuuuucuaugcauuuuaauaccuuuuuauaauuacaaagauacacacuauuguagcagagaauguggaaaauucaaaaauauauuaaaaagagcaguaaaaucaccuguaauuuugauuacaggugauuuugauuacaucuagaugcuuaauguuaguucauucaccugugauuuuacuguucuuuuaaauguuuuuauuuuuuuuuaaauuuuggucaacagguauaugaaagguacucaacaucacuaaucauuagggaaaugcaaauaaaagucacugagauaccaccucauaccugguuaggguaacuaugauaaaaaagacaagagauaacaaguguugacaaggguauagaggaagagaaacucuuguauacuguuggugggaauauaaauuaguacauccauuauggaaaacaguauggagauuccacaaaaaacugaagauagaauuaccauaugacucagcagucgcucuucuguguauaugcccaaaggaaaugaaaucagaagguugaagagauaucugcacucucauguucauugaaauauuaucacaauagccaagauauggaaauauugacagacaaauggauaaagaaaaugugcugcuuguguguguaugauggaauacuguuaauauuuagccuuaagaaaggaagggauccugccauuugccacaguauggauggaccuggaggacauuacacggagugcaauaagccaggcacagaaagccaaauauuuuaugaucguauuuauauguggaaucuaaaaucuaaaggucaaauauguagagguagagaauaaaacagucguuaccagaauuggaguaguggggagaaaauggggagauguaggucagaggauacaaaguagcaaaccuguaagaugaaaaagucaaaagauccaguguaaaacauaaggacuauaguuaauaauaguguauuguacuuaggacuugugcugaaugaguagauuauaucuauucuugccucagagaaagaagguaacuaugugagacgauagagauguuaauuuguuccacuauagggaccauuuuacuauauauauauauauauaucuuguaacagcauauuguauaacuuacauguacacgauaaaauuuauuuuaaaaaaggaaaaucuggcuggguacaguagcucaugccuguagucucagcacuuugggaggcugaggugggcggaucgcuugagcucaggagugcaagagcagccuggacaacauguaagaccucaucucuacaaaaaauaauuuaaaaaauuagucggguguaggaacucaugcuuguagucccagcuauucaggaagcugaaacaagaggaucacuucagccuggaaaguugaggcugcagugagccaugaucgugccucugcucuccagccugggugacaaaacaggacccugucucaacaaagaaaagacaagagaagagaagagaagagaaaaagaacaucuggaauauccaccaaaauuaaaaggaaaaguaaaacuaccuguagcuacuccaucaaguaauaauuacuguuaacauucugauauauuuccuuuuaguauuuuuuccuaugcauucacaaagaaaaauguuuuauuaaaaugugauuaugcuguauauauauaguucuauacuugcuauuuucacuuaauauggcaucaugaguauuucaccauaucauuauauauaguuaaaaacauuaucuugaaugguugcauagaauucacuuguguggauauaccauaauuucuuauggacgcaccauaguuuauuucuuauuuucacuagcaguguauaagaggaccugugucacuacauucucauugucauugcauuuuaacuucuucugucucugccaauuugcuagaagaaugauggaaucucauuguuugaacuuucauuucuuugcuaaugagauugaacuuuuuuuuggaacaacucaguuuuugacauguggcuuucaacgcauacugaaugcacaacuucuagucaaaaccacauauacauguauaggacucauggcuccaguugugacagaacaaugauugccuugcuaauauauuuuauauagcacugggcucagugccacagccgcuaaauaaaucauaagcuccuugacaaccaggcccauaucuuaaucauuucugcaucccccauaacccccagccuauugccuaacacaguguaagcuuuaauaaauauuuguuaaauggauauggagguggagcuuuugugagggucaauguuaaguugcugaaauagcuuuugaaaucucuucaugugaaaaaagaaucccuggagucaaaauuuaaaaccauugcucaggcuucaaccuaucaucucauaugaccaggaacaaugaagaaacagaucuuuccauaaaagggaacuucuuuuugccaaaggauccuuuuucuagccaugguaucaaauccacaaacacagcaccauuaugauaggggagagucaaaaguaaagcuacuagaaaugagcaaauggcuacaaaggaaaaugaauggaugagaagaaauaugggggaaaaaagaaaaaaauaugccaucuagagcuauuuuuccuucacuuuucuacuugguaaauagagcaagaaagcugcaaagacuaguggaaaaauuuuuggauaaggaaacugaggcuuaaagaggugaacugacuugucuaagguuauguagcuucuauaagagcauagcuaggacugagaggagugucuuuuucaaugagauccuacuccuauccccuacaccucacagcagugcaucaaagcaguuuggauuucuccauucuccuugccagcucuauacuuuaaauaucuaucucuucuugcacuucuuacacucucuucuugcacuucuuaugcucuacuacaauuauuuguuuucauuuuugccucccucaauagauucuguucuucaagggcaggaacugaguccugaucucuauaacuucaauaucuagcauaacgcuugauucaucuagaugcuuaauguuaguucaugaaagauaucauguuaauuaccaaagcuguguuguuauguuuuggcauucaaaccugagcaucuggaaaucuuucuaguugaauaaauuugccaaguauauaguaacucccaauaauuucugcuaauuguuaggguuuugccauaaguaaggcuguacuuggagaggagagaaaugacuacuguagagaaaugacaacaggcuagggaagaggaauaugagggaaacagagcagauuagggaaaacugaggagacuagaggagggagauacuggauagaagaagaagauguuaugggaaauuagccauuaguguuaaccauaugcuuuugugguacguguucucauauacauacauaucucacaguaauucuuuguguaguaucacacccacuuuacagaugggacaacugagacauguuaacugauuugcccagagucacacaguuaggaaguggcagagaugaaaucuaaauucaugucugucuaauuucaaaaccuguauuuuuccuugugucuuucuaauacuccaugcugccucucacuggcauugaaaggaauaaaacagaagaaagcuuuuuuuuuuuuuuuuuuuuuuuuggaauuuaaaaauugcacgucaaauuaaccaaauauuaaugauauaccaugucuucuuuugaaacuuucuccuaaauuucccugauaguucuuuagccuacuuuauuuauguaacauuaccugugaaguacucuaccagauagggucaaguagaaguuauaggugguaaugguacuaaugaaagagaacagcaguauuugaaagcaccaaaguuauacauacauuaucuugccucaucauugaggggauaaaaugccagcgugugugcugcuguuggaagccuggccaccuucaguucaccuccugcacuuuugccacucucuuggcuuuacugaacuucccacaagcuccaugauucccacuucagcaugcugcuuaucuugugauuggcaaaauuccuauuuuuuaguuucccacaagcaauuggcagcucauuagaagugauuaguugcuuuccaggauuuuaaacguuuagaauguauuuaguuccccaagaaugaggaaaucuugacuggaucuucaaagaaucccauuuuagcugcguguuuucaaaaguaaaguuaauauccauagcaguuuauuguaccuaguugucuaaacaauguuccagauccaauaaagauuuucuaauuauucccauccuccuuucuggaggcagccugguaccagcuuugagaggaggcaggaagaugggucugucucaccccucuaccccucaaaggccuuaugaaguuacaaauuccaccuguucuggagaggaacucagacugaauaaaauauuaggucauuugguagaauaucuugacuugguuuugccuuaaugcauuuuaucauuauucuacaagaaucuaaagcuuucuuagaaaaguuugcaaaauacaguuagguugaccauguaagaucuaagaccuggaagggauauauauaagccguuuaauucgucccucugcuuagguacaucaauaccuaaaucauaaaugagcgaugguuuuuauccauuugaaaauauuucuaaaugcagguauuuugugucuucuuagucaguaguauguucugguguuuaagucucuggcauggucaagaaguucucccuaauguuugaauucuuuucuagcugugcuuuuaugcccaauugauaugagcaauuuagaaauccuagggagaugcaugacauugaaauuuccugaaaaguacucagaguuggauuacaguagaaacaaugaagaaucgcgccagccugcagagauauaagcagaauaugaaaauguauagcugauuucaucauggauuugcaugcaaauaaggaugaagcagucuaugggagggggaaaacaacagguagagaaaguagaacuuauacuaaugccauuggaaaugaaucaguagaggagaaaauuuuuagggcaauaaugggaaauaauuggaagagauagggcccacuucagagagauuugaggggauagauuuuuaaauagaaagaacaagauugauuguauaacccaugcaaucugcacuauaacaaguauauugggaaguagggaagggaaauagauacaggaaaauacugacugguuuaucaggaggguaagauggugguauaguaccuagagagcuaaguaauccacugauuuugaagcacaaguaaagaacaacucuggugaaaguguaauuggaaugaugugccuuuauaaggccuuggcacaaugagaaguuacauuugagaaguauccauuuugaguggguauucauguaggccaggauaaagauuuuccuagagaacagcugaauauaaauaaguaaaucuuugaggaguagauuuuggaauaguucauuuagacaaaugaaaguucauguuuauuauuauuauuuguuuguuuguuuuggagacggagucuugcucugucacccaggcugaagugcaguggcacgaucucagcucacugcaccuccaacucccagguucaagcaauucuucugccucagccucccgaguagcugggacaauaggcgcccgccaccacgccuagcuaauuuuuuuuuuuuuuguauuuuuaguagagaugggguuucucuaccccgugguaaccaggaugaucuugaucuccugaccuugugauccacccgccuuggccucccaaauugcugggauuacaggcaugagccaccagaaaguuuguguuuaauccugaauaugaucacuguuucacuucuaauuggagauucugccuaaggaaagaaguuagaguagguaaagacuauugucacccagaguacauucuugggacccuaagcggagaaguugccauuaaugaggaaggaugagcucaccaaauagauaugccuuguacauacuuaaaauugcaugaucauucugauaguuaugaaauggagcuugcaugauucugagcccacugccucagcuagcauuccuuuguacugguguuggaaguuucugaccaaggcuggcagccuugguagcaaggauuaccacguaaauacuauuucuguguuugguagugauauuagcuauugaucuucaccucccucagaaauuuggcaguaaugaucucuucucauucaucaugauacuucccaggcuuuggagauucugauaauugugugaaguucugaaacuacucuucaaaacauuuuaccagugacuguagagaagcuaaugagaaaccugugaauuugcuggguuugaacaguaaaguuugaauuuuucuuuuucaucuuaaacuguaaggaagagcucagcuagcuuuauuuaccaaaaaaaaaaaaaaaaaaacaaaacccaaaaaacaaacaaaaaaaauaccccacaaagucauaucguaaagaugaacauaucuaaugaacagaauuuuaguaucuugggccuuaaaguuauaaucucauggcuuaaagugaagguuauugauuucauccaucauaauauuuugcauaauaauccagacuuuaaaugaaagaaauagagaauuagguaaguucugaucagugaacuacugauaagguaacaguuucuuuaaacccagaagauggcuguaguucaacucauuaaacauuagcacucaggcaguuuccuuggagucagagggauccagagaugagucagccaugaucucugcccucaaaggacuucuugucugauaggaaggagaagcccaauaauaaucuaaaguugaauauguugaaugugguuaagagagguaaagacagcccucuggaauuuaggcuugguagagauuacaguugaguuggggcagggagaucaggugaggacuggaccaaaggaucaggugacaguuaaguggguccugucugcagcaaggaucaggcaggcugggcacaggaaaugagauuuuucuguuacuuuauuaccagguggaaaagauuugaaaguggucgaagggaagcuuaccaaaaaaacauaaauaaauaaauaaaaggaggcugaugaaauagaaaugguuaccucuucagcugaauacugauauuauggugaauuauggacacauuauuguuacaccuugacaggucaguauggguguaccuccauagucuauaaaauuuguauuugaauuucagaguucuuacuagaaucgaucaggaaguuauuauagcauuauggaacuucagugaacucauuuaaucuguuguccagccuaguuuguuauaauuaggugagaauacguuuuauuuuuaaaacaucuuuaguucauuagccgggcguguuggcgggcgccuguagucccagcuacuggggaggcugaggcaggagaauggcgugaacccgggaggcggagcuugcaguaagccgagguagcgccacugcacuccagccugggggacagagcgagacucugucucaaaaaaaaaaaaaaaaaaaaaaaaaaaagaaacuuuaguuuuccuuaguaaucuguucaagcauuugcuauuuaaccaaacucuuguaaacgguauuuuaucuuguucugucaucaguacagauggagaucagccauguuuauaauauccugcaagacuuauuaaauguuucccccauuuuaucuaggcuuacauagucccacugucauugccuguacucacaacccccuuacucuccauugcuuugaugaucuuucuuuuucucuaaaccucuauauucuaugcaucuuuccuuuauucccuuccucccagacauauuuagagagugggucagccacugugcuaagugcugcaacauaucagcccuccuucucccacaacacugauuuguaccuugcugguacugugcuuaugugacugcauggcccuuauagagacuauauaccauaaaggaagguugugccuuugaacuuuaugcuuuuaaugacuuucaugaaaaaaaaauuaaucagugucacuagaaaugcuagauuuguugucuauuuccaauugauuucaguuuccuaugggaaugugaccagcauugauauucuugcagucuaucagcaugcaugcuucaaugcugcuuuuguuugguauggccacuucaguugguuuaugugaagauuguguaucuccuaguucaucuuccaguccauuacccuucucuaucugugugcucuaugggaugaauuccacagaacguuuuaggaagcagggcuaugauggauuuauuuuaagguaaaaaauuauuucucuguuuuuuccuugaaccacucccccaacuccaaucucuuuucucagucucacucuauauuucuuuaccccccaaaacaagcauagagucaguaaccauaaagugucauuugucucugauuuagguuugagucugaacuaauuuugaauucuuggcuguaauggaugcuuucauaauaauuauuggcagcaccucuuuccaccuuaguuuuuauuaauacugacugaucuuguguaagaaauaugaaaaauauuucccuuuccucuaucacuucauguauuugaaaugacaucccuucucucuuccuucauugaaguggcagcauugauuuucuuuuguuaaucucugcuucuguuuucagaaacaacaaucagacacacaucccugcaaauagcuguucuuuugucucuucuaaauaguauuuuuaauacaaauuuauuuuccuauggucagcuucucuuguacauuaauagaagcaggcaccaguucucuuguacguuaauagaaacaggaaccagagaaauaacucaaaauauuagucaugauucugacucccacccaacaagucaggcacucugcauugcacuuauuuucuguaagugggcaaaacccugaggauuaacuaguucuaguuuggaaaacaguuaauucauauguuugagcaugacuuaugaaaaauuuccuguuuguagauacgugugugugcucacuguuguaaaagaucuuucuuucaaaucugaaagcccugagcuggagagcugucauggaaaaaaggcaauggaaaagucuccuaaaauuguuccaauuuaagucaacuugcuccauuuauaaaacuguuauauaggcagucggaugucugcuuucagcaagugcaugcgcagugggaccugaaauugagagcaugugaaauccgcaauucguaugauaagauauucuuccugaauaaugaaaauugcaguagggaaacaaaccuucaagcaggaaucagcuuuuuaagcauuuuuuuuuaaaaagauaucugugcccauuaugaaguaagagagcguaaaauguaccuuuuggcgagagaaacaaaaauacuccuuacuacagauggcaaacuguagacaaaugcccuguaugugguaucacauguaauuauaucauuuugucuugaaacauuuuaugaguuugccuugcuggaugucuguugucuuuaucuugucucauaugcauauacucaguuauauguauguauacauauaauuugauuggauaaauccaccuaaauuaacuacucuuggcuuuuucuuugccauguggcuggaggggucacauauuugagauuucaaaauaaagaacauuuaagguaucaguggaaaaaacuuaggaaaaaaaucuguuaucuguucuuauaaggagaaguucagguaauggaagauucagagugaauucuaugagcaaagcugguuuaggugaugaaguuucaauugauacaacuauaucaaagcuugugguagcaaaucuuagaauucuucaucuauaacuaacaggcacaaagacaauauaguaugcauuuauuaguacugauuaaacuacaaauauaagcuauucugguggcaguuagaaagcacaauguaaagaaaauaaaaggaacuacuuuuuuuuaggauuucagaaggaaggcaguuuuacagaacugagugaguucugccuuuucauguuggauaucguucugguucucauccagacuaguucaaaaguucaguauaauaaauuuaugaugacugugaaaccaaacuauuucuucaggucuuuggagagaaauauggaaagaguaguggggaauacuaauauguacuuucauuagcuaugucauguauaaaggagguaaauauuagaguauuugucauucacuucagaaggaugccauuagaaaaugaaacuggcaagaagucuucagcagcucccaaaagaaaaguuauguuuucgagguccaguguaucauuggagugggaagaggauuauuuccauaugugucaggguuaguuuguauuugagguuauuuaaaaagaaagaaguugaaccucauuaauucaguauucuguuaauuuguaaacaagauugccugagggagcuuuuaaacugcuuaaaagagcaaacuuuucaaacacuuuagagguagugccugguauacuaauuucaaacaguuauuugcaugugaggcaaacauccuugcugggcaacauuuuguucauuucacucuagcuaugguaugcacaguaauccuuuccuaagucugaauucccuuaaucaaaauuauagccuaggcagacuugcaucuauguacuucuuucccaccaucaucucaagaauuuuggauagagauuuauacaaaucuccauucacuccaaguuuugaauuugggagcauuaucaagguaccccaaaucuaacaccuggauggaggauuggucaaugaaaaagugucucuuaauauuuuauuuguaacauggaacagugaauuuacaaggaucucauuaaaacugugagagaggaagacccuggaaaguuuguaaucagcggauuaagugaaaguuaauuguacagcauccuuuagugcucauuuaccaaacacaauugauauucuuuuuacuuaaugugcuguuucuguugcuuuauuuugaugagcauuaacaaauauuucuaagaguucucuuagggucacuuguaaccacagucuccuaaauucuagggaauguggcauuguucagcucaagagaaaauucugagggagcccaaggccuuagguacuuauguuuagcuacugggacucacuuugaucccagaacacugggaccuuuuucugagugucugagaaguagacuuucucuuucuaguuguauucuauuauucuugcucgaaggcuaaacuuuuccuaaacuccccucaucuuugaugaaagaaaagcuuucacucaaacccccauuuucuguccucagccagccacauuguuaccucaagccuaauucucauuauuuugagucagcaggacucaacuaguuugcagcuaugcauucuccauacuuuauuuuacacuuuugucugauuccucgcaguuuucagcuccuuucaggccagacuuccccuuucauuucaucugaucuauuuuaagugucauuugugcuucuccugaccaacaccuuaucuauuccaaauuagcauauauaagaaaguuguuugucuaaacuuggaagguagcuuccuacucccaccaaggaggacugugaggggagugcaaaaagggaaguuuguauuucuguuccuucugcuguuaccuacaaccuccccgucuucugaacugggacccucaggcuuuggcccuggauuagguauuuuuucuauagcucccaccagcugaggaccacugaguuauuuacucuuuaucuacagugaagauauuuuugaacuaaacaugguaggggcauguggucuaaaaaugggaccaaauauuaaaaaucagaauuuuuccuuauaugcuguuauucuuguaacucaacuauaucuuuacuccacuuucuauaaucuccacuguagguagcagcggagggugaggggauguguugggagugagaguguuuugugaaacaagucuugccucccuuagaaugugaagaauaaguucugguuuauucuuuuauuuuauuuucuuuacccuucuucuuuuuuucuggaaagcaaaauggauuuaccaaauaagguuucacaaauaacuguacucggucucccauugaucuagggccccuauacaaacagcccuggaguuguauggcuggugaccuccucaugcuuuuucuuacgaagaauaaguacaaccuaccucacuagggaguguccagucauguguuuccaguuuuguuaaagugugacugaauguguauguuuaaaguguacagugugaucauuugauauacauugugaaaugaugaucacaaucaagcuaauuaacacaacaaucaccucaccuaguuaccguuuguguguguguggugggaacacuuaagaucuacucucuuagcaaauuucaaguauacaguuuuauuaacuuaguuuccauucuguacauuagauucacagaacuuauucaucuuauaacuaaaaguuuguacccuuugaccagcuauuccucauuccuccugucucacaccucccuuucuccuuucaccgagucauuuugugaaggcucuacuggccaugguuaacuuguccuuccucacagguuuauuuugcuagccauauucucucuuucagaagacauguugauuacucuuuucacuuucuggugaugauugucuucugugagaucuauuauguaagacuuuaucucuugcuaaaaggauguauaagcuaaggaaagauuccuggcaauagcuauguaauaaagaacagggaaaaaguacaaugaaauguauuaaaaaugacuuuguggaagaaauuuuuuuguaucacgaaaugcauaguuacauaguugccacagaaacuuuccagauuuuuaaauuauugucuauauucaugagagguaaccauuuguauaguuaucuauugcugcauaacgcaucaccccaaaacucauugcuuaaaacaacaauaauaauuuauuaucucucauggucucuguggguuaugaauuugggaauggcuagguuggaugauuccugcuggaggucucuaauggggucaugcauuaggccauucuugcauugcuaugaagaauuaucuaagacugggcaauuuauaaagaaaagagguuugauuggcucaugauucuacuggcuguacaggaagcgugguucugggauuugcuucuggugagggccucaggaugcuuccaauaauggcagaagguaaagggagaacaauugcaucacauggcaaaagugggaacaaaagagagguagaggugucaggcucuuuuaaacaaccauaucucaccugaacugagugggaacucacuuguaaccaaggagauggugcuaaaccauucaugagggaucuguccccaugauccagucaccucccaccaggccccaccuccaacauugggaauagaauuucaacaugagauuugggagaggacacacuuccaaaccauaucagguugcaaucuaauguuggcuggggcugcagucaucugaaggcuuguuuggggcuggaagaccuguuuccuagugacucaauaacauggcugcaaguuggaacugacuguaggugaugagacucaguuccucuccuugugggcuucuacauaggucuucuguaauauccuuauagccuggcaacugauuuuucccaaaacaagcaauccaggagaccaagauggaagcuacaaugucuuuuuuggccuauacuuggaagucacacaucaucacuacugcuguguucuauuggucaugcagggccaagccugauucauugugggaggagacuauccaaagucaagaauaccagaaggugugcaucauuggggaccaucuuggaagcuggcuaucacaccauccauaugaaugagaaauaaaccuucugaguaucugauaauaauaauaauaacaacaacaauaacagaagcuccuacuuuucugucuuaauaauuucuauauagaaacuccuaguguaauuucugggcuggcacgcacuccugguucucuucuuuccuccuugccuuuauuuugucuaucacuuucauggaacucuuucuucagucugcacuuucaacauguuuccuuaguggcuuaucuuuaguucuuuauucucacuguacaugcuuuaccugggugacauuaagggugcuguauuagucaggguucucuuagagggacagaacuaacggguauguaauauauauauuacuguauacauauauaauguauuauauauaauguaauacauuauguauauaauauaauauaauguaauauauauaggggaguuuuuaaaaauuuaauuauuauuauuauuuuuuuuuugagacagucucacuccguggcccaggcuggagugcaauggcacaaucucggcucacugcaaccucugcuucccggguucaagcgauucuccuugccucagccucccaaguagcugggacuacaggugcccaucaccacacccagcuaauuuuuguauuuuuaguagaaauggguuuucaccauguuguccaggcuguuccugagcuccugaccucgggugaucugcccgccucugucucccaaaguacugggauuacaggcgugagccaccaugcccggcagggaguuuauuaaguaauaacuuacauggucacaaggucccacaauaggcugucugcaagcuugcggagcaaggagagccaguccgagucucaaaacugaagaacuuggggucugauguaugagggcaggaagcauucagcaggggagaaagauguagacugggaggccaggcccaucucucuuuucacauuucucugccugcuuuauauuugcuggaagcugauuagauugugccuaccagauuaaagacggaucugccuuccccagcccacugauucaaauauuaaucucuuuuggcaacacccacacagacacaccuaagauuaauacuuuguaucccucaauccaaucaaguugacacucaguauuaaccaucacaggugcccacugcugaggucucaaauccguauuuucugccuaaacuucuuuuauuuccagcaucuaucucuaaaauauauugcaaauugaccauuuucaaauucuaacugaucacuuuucucucuaagccuacucuuccuguacccucuuucugauaucugacaugaaguugacauuggaguguuuacugaaugaaucuauuuaugcaucgugacaucucuaauuguaggcaucuuuaugcuuuucagugugggcaaaugucacacuggcaaaaauaaauuauuagacaacuuuagggcugggcacgguggcucacaccuguaauccuagcacuuugggaggcugaggcaggagaauugcuugagccaaggaguucgagaccaagccuaggcaacauagggagaccccaucucuaccaaaaaaaaaaaaaaaaaaaaaaauuaaaagauuagccaggcaugguggugcuauuaggucccagcuacucaagaggcugaugugggaggauugcuugggccugggagguugagcaugcagugagccacugcacuccaggcuaggugacagaacaagaacuuucucaaaaaagaaaaaauaaaacuuugauagaagaauuuuuuaaaaauauaggcaauacauuaggaauaaauggguaaaaguaaacauacacauagauauaauacuuaugguucauuucaaacacuuauuuaugaaccagaaaagaugccugagagucacugucaacuauuacuugaagucucaaugcccaauacugccauaagggauucguaauccuagguauuaucaggauggaaacaaagcucuaccuuuucaaaaauuauuuuauuggguauucuucaaauguggccuuuuacaaucaccucuugucccaaccucagcauaacuucagcuuucuccuuugaccuacucugucuauauaaugcccugguucugagaagcuuagacuaaaacuuuugucaaaggauaggaaaagagcauggugaugauggugaugauggugaugaugauggugaugaagaugaugaugaugaugaugaugaugauaguuaacauauaguaauuuucuucuauguaccaaaugaugugcuaaguggucuguaugcauuaucucauuuaaccaucacaacaaccucgcgagauagguacuacuaucuuuaaccccauuuuagggaugaagccacugaggcucccaagaucacacagugaauaagauaugcauucagguugagauugacaccugucuuacucaaaaucucuuuguaaucccuuccaaacccccuccccuagccucaaucaccuuaauaagugcuguauaccuucuuaaaggauauaauacugccuaaagucacugaguuagaggaaacuccaaaggucauauauauagccuauaaaccuacauaugugagauauaagacacuauagcuucugcuguuacuuuaguguccucucuaaguugaaacucucaacagcucagugaaguaucuauaaaggauauuaucaccacuuaggggauaugugacuugccgaaaaucacccaguaagcuugugauagagcucgaacuagaaucuaggccuccuaauaccuaguuccuuuuuuuccuucuauuuuaguguucaaaguuaugaguauggaaccacauuucuaauuaucauuagccagaagauacacaugacuguucugagaugucuuuuuuuuuuuuuuuuuuugaaacggagucucgcucuguugcccaggcuggagugcaguggcgugaucucggcucacugcaagcuccgccuccuggguucacgccauucuccugccucagccucccgaguagcugggacuacaggcgcccaccaccacgccuaauuuuucuuguauuuuuaguagagacaggguuucaccguguuagcagggauggucucaaucuccugaccucgugaucugcccgccucagccucccaaagugcugggauuacagguguaagccaccacgccaggccuguucugagauaucuuaaaugauauagauuuuuauaacuggggagaacaaaggaccaauaccagucaugugcuugagaacuaccauaucaguguugaugacucauuugcuuucacccaaacgcccucuugaguccuuuaaacuuuuuucccuucaacuuuauugagguauaauugaccaaaaaaauuguguauauuuaagguauacagcauggugauuugauauauguauacacugugaaaugauuaccacaaucaagcuaaugaacacauccaacuuguuuaaaauaagucuauuaucccaggauucccagaccccccugauaaaaguccugggucuuccugcaaggcaugcuuuaauacagcuucuucccacaagggggagccaaaaaugcuuugggggcuaggagaugaaaaacacuaagagguucugaaaauccugcuuccuuucugguuucuuuugccaguaaggcccuuccagcagucuccagaaaggaaaaguagaugguguugcugcugaugguaguguuuuuguauauggacaugggauggggguagggggcuuuuaucugaagaaacuugauccugagagauaaaguccuucugagcaaccagucagcacuguauucucaucaccuauuuccuucuccugcuggaacuuuguccugcaaagcugcauucuuuugccaccgugugggggaauuggaucagcugccuguugaagucugcucccuuaacacugggucgauaaucuugccccaucagcccauuggagcugcuucugccaccucccgcuaaggguguuaaagaggaccugguaaaaagacuucuacugccuucuuugcagaaaguggguagauguugggggagaaaaucccaugugauuauggccuuuagcacugcuuuaacuuugguaguaccaauauuucaguuaagccaggagcaagaaggguugcuguggcuuugacagauaaagcaaauuacugaauccacauuugaagaagaaauuuggccccaaaccaggaguauguauaaaggauggagaaauucaggcuuauucagaauguaaaaauuaauuaaacuauuguuuccauugauacccugcagaucuuuuuuucugucagaaauauuuaagaaauuuacaugugauaauaacuuucaaacacgauauuuccaaaugucaaguuaauguguucagggaacaaaaagacucaaguacccaguaugagguucacaucacaucuguuuccgcaaguacuuuugggacccuuugaggcaaagacagugggggaccuugacuuauuuguaagacauggaagugaagaugggaacaucccuuucaucuccuuucaucuuuaaaaagggagaugaggauugguuggcauagucuaguauuucaggaaaaaauaaauuacaagugauuuuaauugcagaaauaacaauauucauaaaugaaaaaugggguuacuuuuuaggauagagagaaguaggcuauuaaaauggcauauuuugaauaauauaacuucccagcaagauguaauugcugauuuuuuaaaagaguaaagcaauaaucuaguaauucuaaaaauccauucaguuuucuguagacauuuaagaauuacuguuuguuuuuuggaguggaaguaacaucuuuugcaguuaguuuuuggaacauggccacugcugaauaaagaauuccagucgugcauuauauuccuuuuguauaauugcacuaagagaauacguuggcauauuguaugguuuauaaugagcuggaaauaaaaaugaaaaagguaccacaaacccucaacaaugaauuaguuauucugaauauuuuauuuuucuaacagugaugcuauguaaauugaacaaaaugucaaaaaugcuucuugguauuuggucugagaguuaaacgaaagcaagguacagaacugaucagugacuagauuucuugguucuucuaaggaguuccuucacagggcaguuuagcuucugucuaaaccugccuuugaagacauguuggguuaggucuaaaucuguucuuuuaucacuauuacuccaaaucaggcaaugaggagguugugcgacccugaggccccaguugcaauuaaaguacuuaauaauaauugucaaaaacauauacaguuauuauacaagaaugauuaucuugagcuacuagcaauccuuuaaccuuuaggcuauagguuccuuacuuucuuucuaauuccucccauguauuucauaugaguccagucagaaacuauagacuguuaaaaacugugaagcaucugggauuuuuuaccuuacuugcaagccagcaaguuagcuaagacaguuucuuguugcuggcaggagacacaagacucguaucagagaugaagaacaguuuauuacucacagcaguagcaguagccaaagucucagcauuuucucugagccccgguacccacaagauggugugaagagggccacaugaugucugcucacucacuggguugcauuacagaagagaaccccaagcucagggggcucaaaucuuuuauaaaaggcaguaagcaugccagcccuuugcuccagagagugacauuauauuuauuauacugcaauguaguuaucuguaucuucaagggcuguaagcaaaccugcuuuuuuuccccgcagaguaagacacugucucugucuaaacagucuugaaaagauuauuccagaacgaagucacucagugcaucugcucacaagcuguacaaaaacacaagagauccacugggaauugucucccaacacagacuagggccaagauggccucugaagaacuguuggccuaguccauccuugggaguugcugcugacaggacaaagcaccauagucaucaccaucauuacuauuacucuugccuggaagaauuuuguccucaucuucccgaaacagaaaguccguacucugcaccugacucugguuuagccaggagauuugggaggauguaacuuggucaccauaauuuggcuugugacuugagauugggggccaaugguuacaaaguuaacaugcuaauuugguuuacuccuaucucucacuuaaaaaaaauaacuaacuugauugaagcuuuauguagcuccaguucagcgguucaaagcuuugaagggaaagaccauucuguuggaaggaaagauguggaauuuggaagcucaggccaacucccagucccugaagaaaaaugggucuccugacauagccuucaauaagcuucugggcaaaggggccaugaagccagccaaaagaucucuguuuaucugccacauuuucuucacauagguagaaauauuaucuuuaaaucagcaagcuguacaaucugaaauuaacaaaaaauauugaauuauagagcugugcugucaugaaaauccaaaaauuacugucuucaaaguuuugccuuaaaaauccuuuuguuuucuugccggauucuaggaaguucaacaugagaaaaggcuguauugucagauuguauuucauggacucuuaaaguugcaaggaaccuuagagcucugcaggccagccuggcccccagggcuaaguccuugcuguaacuucuugucagaggaucauuguuccucucagagagguagcuggacugggcaaagcucuggaucuguacuaggcuccgccacugaugggcugugagacuuuguggauaucacuacuucucuagccuagguguacucagaccuaaagaagagagaagccagaugaucuuuuaguguucugcuagcucugacaugccucugguggucucuaaauucuggaaugugugaauauuugaacauuuugaaaggaugauuuuuuuuccugauaauagaaguaacacguuuauuuuagaaaaauaagaaauuacagauuuuaaaaguaauuucuaaucuuauuaccaauuucagugcauauuuuagacuauuuuguguguguaauaaaauuggagucauauuguucuguaauuugccccuuuuacuuaucaaaauagcaugcgcaucuuacuauagcaauuguacuguauccugaaggaaguagagagccagugaaggguuuuaaguaauuuucccuguaagucaucccucuccaggucagugguagacaagagagaagauaguuuuuaugcaauuuugggauuaguucauuccauuguuuauugcuuucugugcagaaaaaggauggcucaugguucucuucauugaauauggggguuauagauuauuuuagaaguucagacaucaugagaugcuauauuauuggcacugucuguguacauuugucugcugugaaaacaaauuagaauggcacauuucaaggcacuacucauauggagacuauuuaauuauaccaaaaucaaaacuaucagcuaugaauaucaaaucucacagcucccaacgcagauacugacaaccaucaagccaauuuuuaguagcaugugggccaauuguuacaaaacagcuuuuauuuauuuaagcucuuuauuuaagugaccaaauuuauuuaagauucuuucauuccuuacacauucaaaaggaucagagguacuguacaaaauuaaacacuguaaaauauagggccuuuacauuuuaaaaaucaaggauaccaacuaaggaaccaaaaagcguggaugccaugaaguaucuagauaagucaauccaagucuguuuccuagcagcaaaaguaaacaggaaaauauauuggcuugcauguuuuuauuguugcagcagaaaaauauguauucuuuucccccagacaaauuuuauccugauauuuauuauauggucucucaugugaaagauaauagguaguaguagacaccuucaacuauaguuuugcaaaggaacaauaacccuguuaaaauggaaaauuccuguauugaccuucuacauaaggguugaguguguaauauuaaaucauaauucaguuuagacauuucuuuggaggcugaaauaauacaguccugauauguggcuuucugauuauuuaaaauauggaaauagaacuuggagaaugugguugaucaucuagcuaucaugcccacuuuauucuuucuuucucaagggucagaugccucaaggggaccauugccugacuauagcuugcauaggaaucauguuggaaaucuuggucagguaacucuaggacccagggucuagguuuauccauacacuuugaguagguguucgauaaaauuuuguuaaaugaauaacuuaccaggguccacagccuggacagacacuuuccucccucuuaguacucucucucuacuagggagcaccuuacgugaaucugcuuuuuucuccauguacuaucugacuacucucuuauucauuucucagugaucuccucuucuuccuucucuuuuuuaccauuuccacccuugugcagucugcaucugccauguuuuggacaacagcugccacaaauacaauuugaaugcaaauacaauuacauuucaaaaauuacuccuaccauauugcaaaaaauagaaaacaacaaucaagaaaagacugguuaaauuaugaaacagcaauaugauggaauacuaugcagcuguugaaaagauguugagaagauuuaaugacaugaauaaauauccaugauauauauuuaaguggaaaaaacugugugugaguauacaugaauuucuuuugauaucuauuuuuuucuauccaccuaucauuuauugagagagugagacauagagacacaaagacacacacacccagagacagacacacagacagacauagacacacacagagaguguacagcuuuaggugguaaaauuaaaggugauugcauuucuuugcauuuugcuucucuguacuuuaaaauuuuucuauaguaaacauggauuauuuguguuuaaacaaaaaauauaaaacuccuuggcauggcauacaaagccuuuuaauaggcggucagugcauauuccucuagcuucuguuuuaauauucccucauccuuuguuauaugcguuacaaacuccagucacauggggccacuugaauuucccccagaugcucugggaucucccucccauacuagacugcagacuccuaguagcaguugguggcuggguuguggcccugucuguaucuuuuccacuuagugcagugccuggcgcuuaacaagugcucagcgucuguuuguugaaugaauaggcaauguaucauauacucuucucucgauuuuaaucagacccucccuccuccuuccuugucacugaugcacuucugcuguucaauuaucaaauuauggaccuuauaucauauguuaacauggguuuggagauagucagugaacauguccagaguuguuuaaccaugaaccuuauauauauguucaugcccuuauacauucuuuagccucuaaucaagcucauucccuaucuauuucaugaaagcacaccuucauuuuaggacuuauuuugaacacauaaaaagagaugaucguaagacauccuaacuauaaaaaccugcaguauccauuucccuccugaaaaaacauaucuggcucuguuucuucuaaaaguaaaauuagaccuugcagagaugguacaauuuaaacggcaccacccaauuaauuuuucuggccaauuuuauuuuugaaacaauaauuaaacauggucuucuguaacaucuauucuuucuuuuccccaaggagagauuuuguauuauuuuccuuuugucuuugcucagcacuuuggagugugugaguuuucauuaacuauucugaaugcaggcaaaggcaaugugguaggaacaaacacaaaucaaggccgcauaaauuaauaaucuuuuuagaaccauuguccuguaugccuuuagaaauuaauuuuaauaccagcaaacaaguucaaaaauuccuccuucuuuagcuacuguaagaaacucaaacuuccuuuggcaauuuuaugaaugauaaaagcucacuuuugccuauauuuuuauggcaaguaucauacggauuuaugcaaggggaacaaagaaaugaguggagagagaccagccaccuguguuaaucaguagaguacaggaaaguguguuauaaauuaugacagguagaucuuucccuuucucuuuuugucucuuucugacuaacugggugugugaauuuaucuuccugaauuguaagggauuucuccauaaaauaucaguuaauaaguaccucagguagguucauucauggguagagugucuccuaaagaucuaguagccauagaauagagcacaguguaguuucaugguuaacagcagagauugguguuagacugaagcugacuuuaaccccagccucaccgguaguaagcucugucauuuuauuuuauuuauuuauuuuuuauuuuugagacggaggcucacuccaucacccaggcuggagugcaguggugcgaucuccacucacugcaaugucugccucccagguucaagcaauucuccugccucagccuccugaguagcugggacuauaggcacguaccacuacgccuggcuaauuuuuguauuuuuaguagauaugggguuuugccauguuggccaggcuggucuugaacugaccucaggugauccacccaccuuggccucccaaaaugcugggauuacaggugugagccucccugcccagccagcucugucauuuuagauaaaucgcuuaaccucaguguauaucacuuguguguaaaagggggggaaauggugguauuuacuucauaagauuauucugaaaauuaaaugaguuaauagauguuuuaauuuguacuccccuaauggcuagugauguugaacaucuucucaaggguguuggccaucuacauacccucuuuggcaaagugucuguucaaaucuuuugcccauuuuuaaauuggauuguuuauuuuuuuacaguugagguuuuuuuguuuuguuuuguuuuguuuuguuuugagacagagugcaauggcacgaucucagcucaucgcaaccuccgccuccuggguuuaagcaauucuccugccucagccucccgaguagcugggauuagagacaugcaucaacauacccaguuaauuuuguauuuuuaguagagacgggguuucuccauguuggucaggcuguucuugaacugcaaaccucaggugauccgccugccuuggccucccaaagugcugggauuacaggugugagccaccacacccagccuacaguugaguuuuuaaauauaaguuuuuauuuugaaauagucugugacucacaagaaaugcaaaaauagugccgagaauucucaaguguccuuugccuagcuucccccagugauaauaucucacaaaaccauauauauuguuaaaaccaggaaauugacauuggcacaauacuacuaagucagguacagaccuagauuuuacauacacuuuaaaaauguauuuuguuaaaucuuacuaaauguguagauucaaguacacaucaugauaaucaggauauagaacuguuucaucaccacaaauaaacucccucauguuaccccuuaacagucacacucuucccucaaaccuaaucccuaguaaccacuggucuauucuguaucacuauaaucuuuuuuaacuuugagaacauuguauaaauggaauuauacaguaaucuuuugagauuggcuuuuuuuuucacucaguaugccuuuggagauccaucacaugauaguucuuuauauauuauggguauaaguccuuuguggaauguaugauuugcaaauauuuucuuccagucuguagcuuaucuuuucauuguccuauaaaugucuuucucagagcaaaaguuuuuaauugugaugaagucuuccaaauuauaaguguuguuauggauuguguucuuggugucauguaaaaucacucuuugccuaaccccaggucaaaaaacaucuccuauguuuucuuucaaaaauuguauguuuuuuuuuuuuuuuuuuuuuuuuuuuugagauggagucucgcuuuuguugcccaggcuggagugcaguggcauggucuuagcuaacuguaaccuccgucucccagguucaagcgauucuccugccucagccuccugaguagcugggauuacaggcaugugccaccaugcccgacuaauuuuuguacuuuugguagagauggaguuuugcauguuggccaggcuggucucgaacuccugaccucagguggucugcccgccucagccucccaaagugcugggauuacaggcgugagccaccaugcccagcccccaaaauuguaguuuuacauuuuauguuugaauuaauuucuggaaaagguuugauuuuagggagagauuuauuauuuuuucacaaguaauuuuucaacacuguuguugaaucuuugcuccacugaauugccuucaagccuuuauuaaacucauuuuccccuauuuguguggguauauuucuggacucucgguuguauuccgggaauguauauaucuaucccuuuagcaacaccaugcugucuaaucuuuacaguacuggagcuuuccaauaggacuuaaaauugugcaauaggauucccccaauuuuauucuucuuuuucaaaauuguuuugguuauucuggguauuuuggauuuccacaggaauuuuaggaucaguuugucuguauaugcaaauuaucuugcagggauuuugauaggaauuguguuaauuagaucaguuguguuaauguagauaaauuugggaagauuacaucuuuacuauguaaagucuguaugaauuuugaagcucugucauuaggugcauacacauuuaggauuguuuuacuuucuuuguggauugacucuuuuaucauuauguaauguccuucucuaucccugauaauucuuuuugcucuguagucuacuuugucugauuuuaauauagcuagcccagcuuucuuuugauuaguauuugcauaguauauuauuuuuuucuuuuugcuuuuaauuuccauguuugugaauuuauuaaauucccuucuguuauugauuucuaauuucauucuaccaugguuagaaaacaucucaugugucauuuuaauucuuuaaaauuuauuuaaaauuguuuuguguccugacuuuuggucugccauggagaaugcuugauguucacuugagaauguguguucugcucuuguuggaagaaauguucuauagauguuugcuaggacuauuugguuuauaguguugugcaagucuucuguuuccuugcugaccuuugucuaguuauacuaugcauuauugaaagugaaguguugaagucuccaacuauuacuguugaauugucuauuucuuucuucaauucugccaacuuuucuucauguauuuuggggcucuguuaucaaauucauauaugcuuauaauuguuauaucuuuuugauggaauaacccuuuaccguuauaaaauuuuuuugucucuaauaacguuuuggucugauauuaguauagccacuuuagcucuccuuuugguuacuguuuucaugguauaucuguauguuuucuuccaaccuuuuauuuucaaucuauuugugucuuugaaucuaaaaugugucucuuguugacagcagauagcuggaucauuuuggcauuuuaguuggacauggguuuuuauuguuguuguuucccuauccaauuuaauucaguuacuuuauuuauauuuuuaauugacaaauguuguauauauuuauggaauacaacauaauguuucaauauauguauacauuguggaaugacuaaaugaagccaguuaacauaucuaucaccucaucuacuuauguacuuuuuuuuuucugguaagaacauuuaaaaucuauucuuaaagcaauuuugaaaaauacaauacuuaauuauuaacuguagacaccaugcugugcgauagaucucaaaaaguucuuucuccuaucuaacugaaucuuuauacacuuugacagacaucucccuuuuccccacucccccaccccaggcucucauaacugucauuugauuuugcaucugugaguucaaccuuuucagauuccacauguaagugagauuaauuggagacuuuaauaaauucccauuuaauguaauuacugauaaaguaggguuuccaucugccauuuuuaauuuguuuucuauauguuuuauguuuuuucuuguuccacuauuccugcauuguccauuuuaaaaagaucguuucaggccaggcacaguggcucacaccuauaaucccagcacuuugggaggcugaggcagguggaucaccugagaucaggaguucaagaucagccuggucaacaugggugaaaccccaucucuacuaaaaauacaaaaauuagcugggugugguggcgcucaccuguagucccagcuacucuggaggcugaggcaggagaauggcuugaagccaggagguggagguugcagugagccuagauugugccacuguacuccagacugagcaacagagcaagacuccagcuugaaaaaaaauuaaaaauaaauaaauaaaaauuaaaaauaguuucuacugugccauuuuaauuuucuugucaucauuuuuaacuauauauuuuuguguuauuuuuuaaugcuugcugucagcacuacaauuaaguucucagcuuaugacaauuuaguucagguuaauaccaaguaaauuuaaauaaauauaaaaacuuugguuguucuuuuuuuuuuuuuuuuuuuuuuuugggauggaguuuugcucuuguugcccaggcuggagugcaauggcaugaucucggucacugcaaccuccgccucccggguucaagggauccucccucuucaaccucccgaguagcugggguuacagguaugcaccaccaugcccagcuaauuuuuuuuucuuugagauggagucucacucuguugccuaggcuggagugcaguggcgugaucucggcucacugcaaccacugacucccagguucaagcaauucuccugccucagccuccugaguagcugggacaacaggugugugucaccacgcccagcuaauuuuuguauuuuugguagagacaagguuucaccagguuggccaggcuguucucgagcuccugaccucaaguaauccaccugccuuggccucccaaagugcugggaauacaggugugagccaccaugcccggccuaaaaucuuugguucuauauagcacgguuacucccucuccuuuaugcuguuguugucacaaauuacaucuguauauaucguguguccauaaacacagauuuauaaguuuugcuguauguaauuguuuuuaaaucaggagaaagaaaaaagggguuacacgcaaaaacuacauuuauauugucuuuuauauuuaccuauauaaugacuguuaccuguguucuuuauuucuucaugugaauuagagucacuaucuaauauccuuauauuucagccugaaggacuuccuuuaauuuuucuuguagcacaagucagcuaguaacaaauucucucaguuuuuguuuaucugggaaugucuugauuuccccuucaucuuuuuaccuaggugaaauucauauacaauagaacccauuuuaaagugaacaauucagugacauuuaguucauucacaauguuguucaaccaccaccucuaucuacucccaaaacauuuucaucaccccaaaauggaaucuuguauccauaaagcaguuacucuacauuuccccuucauuagaggcauaguuuugauagauauagacucuuuguuugacagguauucucagcaauuugaacauauuaauccaccaucuucuggccuucaugguuucugauaagaaaucagcuguuaauuuuauugaggauuccuggugcauggaucaguucuuucuugcugcuuucaagguuuucuguuugucuuuguuuuucaaagguuucauuaugaugugucuagguguggauaucuuugaguuuuucccaagaaucuguugaguuucuuggauguguagauugauuuuuucaaaaaaucaaauuugggaaguuuuuggccauuauuucuucagauauucuuucugcaugcuuuucucucucuucuucugggacaacaauuauguuuuuguugguaugcuugaugauauucuacaggucucugaagcuguuuuucuucaugcuuuuuucuuuccuuuccccaaccaaaugaucucaauugauguaucuucaaauucgcugauucuuuauucugccugcucaaauaugcucuugagccccucuagagaauuuuaaaauucuaguuauuucacuuuuaagcuccagaauuucuauuuaguuuuucuuuaaaaaaauuauauugcuuuauauuuuugacauggugaaacauuauucugauacuuaccuuuaguucuuuagaugugcuuuucuuuagcucuuugaauauauuuaaaauagcugauucagagucuuuguccaguaugucuaaugucugugcauacucaggaacaguuucuauugauuacuuuucccuucuguguaugggcuauaauuucuuguuucuuugcgugucuuuuguggguuuuuugguuaaaaauugggcguuuuaaauaauauaaugugguaacucuggaaaucagauucuuucccuuccccaguguuuguugcugcuguuacuauuuguuuuaauuguauuuauuuagugaguuuucugagugaacucuguaaugucuguguguggccacugaagucugguuagcuuaguggucagugaaugauuggacagagauuuuccuuaaaugcuuggaaugaacaaauuuuccaauguuugcugaggggcucuguguguauauuggggcaucuuuucaacaguuaggcaguugacaacucugccuuagccaucauuucuuacuugugcagggucucaaggucaaccauaaguaagaccuuugugccuucucaggucuuucccgaggaugagcacagcccuacauguguacaugaccuucuguauuuccaugaauaugucuaagauuuccaaagccccuguggauaucuucuuuuccaguuuuuccuguuaagcuuuuguuuauucuuugucccagcuguauccaccaccucaggcagucacagagccuugucaguaauacucuuugacuaauucccaacccucccuccuccccaagaaaaugcuuuuuguaguggguacuuuccaaaucaggucaaaugcaaacagccuuguaaauugcaucuuccagauaaccucccaaugggucacauaaugacaauuauuugagaaugacacuuugugagagcuccacuuccauucugcuccuuaagguggcugucaggcugcaccaggaaugcagacuguuauuuuucaaggcuacugcagaacuggagagcaggagauggaccuagagcaaguuaaaauuucacaaaauucacuauucuuacaaagauucagcgauuuuacuugaauaacugcucccugaguugcuccaagccuuccauuaauuuccagaauucauagaaauguaauuuucgccaggcacaguggcucaugccuguaauccuaacacuuugggaggcugaggugggcagaucaugaggucaggagaucgagagcagccuggcuaacacggugaaaccccgucucuacuaaaaauauaaaaaaguagcuuggcaugguggcacacgccugaagucccagcuacuugggaggcugacgcaggagaauugcuuuaaccugggaggcagagguugcagguugcagugagcugagaucgcgccacugcacuccagcccgggcgacagagcgagacuccgucucaaaaaaaagaaaaaguaauucucgcaauuuuuuugccaguauuucauugcuuuuauggagagcaauuuuuuugguauuaacuuuuuuuuuaauuuuaaauuuuuguggacacagguauauagagcacuuuuuaaauugaugcauuguaauuguacauauuuaugggguacaauuuaauauuucgcuagagauauauguuauguaaugaucaaaucaggguauuuagcauagccaucaccucauguauuuaccauuucuuugugguaagaacauucaaaagcuucucuuuuagcuguuuuguaauauaccauaucuuacuguuaaccaucaucauccuacuaugcaauagaacaucagaauuuauuccuccuauguaauuauaacuuuauaccuguugauuaaccucucccccuucgucuccucccuuuucuccuccccagugucugguaacaacuacucuacucucugcuucuaugaugucaauucuuuacucugucauuuccacugauguccuucuauaucuuuguauuuuaaacguaccuauaucaguacaugggagauagaucucuuauagacacccuguaguuuguaauaucuaucuuuuaauuggauuguuagaccauuuacauuuaaugucauuauugauauguuuggaucuauaucuaucauuuuaugaucuguuuucuguuuuuuccuuucuguuucucauuccucuuuuucucuuuuccuguuuuccuuuggguuauuugaacauuuuuuauuauuccuuuuuauuuuuuuggcuauaucucuuuguauuuuuuuuuuaguguuuuuaguuuuuagugcucuaggggauugccauauacacacuuuacuuuucacagucuucuuacaauuuuuuuuuuuuuuuugagauggagucucgcucugucacccaggcuagagugcaguggcacgaucuuggcucacuacaaccucugccucccagguucuccugucagccucccgaguagcugugauuacaggcaugugccaccaugccuggcuaauuuuuuuuguaguuuuuuaguacauauggggugucaccauguuggcuaggcugcucuugagcuccugaccucaagugaucugcccgccucauccucccaaagcacugagguuacaggugucagccacugugccuggacagucuucuuacaauuuguauuuaaccugaaugcagaaaucuucuauuauguaaguccccuuuccaucccccuuuuauauuguauaauaguuguuuuauaugaauauauugcaaaaucccaucagaaauuauuauguuuguauuuaaugguaaaacauuuuaaagaccucaaggccguuauagacuauuuuauuuauuuggauauuugucuuuucuguugcucuuucuuuaguucuuauuuucagauuuuccuucugauaucauuuuccuacuauaugaagaacuuccuuuagagcauuucaguggcuaugaauucucuuaguuuucaauuauauggaaauguuuuucuuuuuaauuucaucuucauuucugaaagauauuucacuggauacagaauucuggguuaguaguuuuuuuugucaucacuuuaauaaugugccacuucuuucuugcuucugugguuucuuaugaagaauccacagucauucaaauuguuauucuccuguaaguaauaugacauuuuuccagccaguuuuuuuuuuuuuuuuuuuuuuuuuuuuuuuuuuuuuugagacggagucuugcucugucacccaggcuggagggcaauggcgugaucuuggcuuacugcaaccucugccuccugaguucaagcgaaucuccugccucagccuccugaguagcugggauuacaggcacccgccaccacaccuggcuaauuuuuguauuuuuaguagagaccggguuucgccauaucggccaggcuggucuugaacuccuggccucaggugauccgccugccucagccucccaaagugcugggauuacaagcaugagccaccaugccaggcuguuuaguuccuuuuaugccaaguaauuuuauauguguucuggacauuuuguacauuauguuaugaggcucugggucuuguuucuagucugugguaauuaguuuaauuucaucuuuuaaacacauauaaauguuuggcauaugauauaguagucccuccuuauccauggacaugcauucaagaccccuaguggaugccugaaaucucaagucuuaguucagucaaauaguacugaacccuguauaugcuauauuuuuccuauacaugcacaucuaugaucaguuuuaauuuauacgcagggcacagugagagauuaucaacaauagccuaauaauaaaauagaauacaaugauauacuguucaguuucacagauagauuuguccuuaccauagaucuuagcaaccucagcauaugauuuuuuucucuuuccuuauuaagaacuuucaccuuuucacuuaaaggaagcacuuucugacuccucuuuggcauaugugaauugccagcaccacuauucuugcacuuuagagccauugguaaguaaaauaaagguuacaugaauacaaggcacugugauacugugacaguggaucugauaacugagagacuaagugauuaacgggugaguaguauauacaguguggauaugcugggcaaaggaaugauucguaucccaggugggaugcagcaagacagugugagauuucaucacgcuacucagaacaguauugcaauuuaaaacuuaugaauuguuuauuucuggaauuuuuuguuuaauauuuucagauugugguugacugcaggaaacagaccacagauagcaaaacugcacauaagggugagggggacuacuguauuuaugcaugcccuuuagaaagguaaaaaugcauagacucugcaguauaccguuaucuguuuucugggucaagugaugccaauucaacgaugacucuucaaucaaaccaaagcaaucuauuucaacacaaugauuuugacugugagugacaauuauaggauuauuaauacuuuauuuguaauauguuuuccuagcaaugcaaaauuccagggucaaaaauucuauauuuuccugaaaguuuuaucaccaagcaacaaauguuucuuuggcuucugcucgcuauuugucuaccauaauuuucaggcccaugauggauauaaagaugaauaaugccuacacuagguauuauuaccuuuuguuauguggaugagggagcugaggcccagucagacguuacucaccuaguaagugguagaaccaggccuccauuucaaguguuccgaauauauauguaucucuauagccccagcuuaccucuaucaaguacauaaucugagacaaaaggaaauaaauauuucaacaguuugaagaguuugaacagaacuauucaugugccaguauucccaaauuauagauaaaauugacuguguaaagauugugacacuguugcuccuuacuuuuauggaccacuuaagaaugugccaggauuauacagaaauugaaaguauuaauaauuggcuauaguauuuaccaaaguucuuuuuccuucugauggcaucaaaaagcuaauuagucaauggagugcauaugucauuggcuggugacuuuuguaauaauuaguguacauuuaugcuuccaaaacaagcuauuuugagguuaccuuugaucauuaacuuaccuucauuguucauucaccagguguugaaaaaaaugauucuguugaaaauguugcuauacagguguguggcuagaaagaucacuuuguauacacuugaagacuuucauccuuuggcuuuucggcacaaccccuuuuguggaacuuuaagaaaugcauggagcucuugcuaugugcuggccauuggacuaaguuucuggcauauguuuccucagucauaccuuugaacacagucaguuugagauccuagugcuagauggccaaaucacacucuuguacuaucucccaucuaccagcuauuugcuccucugucuuuuuugcuuaucacuuuucaggcugcccagcaccuuugagagcccuugcuagccagacaugauuacucuuuugcugcuagcuuaggauaguuaguguauucuuucugugaaagaaaguacgugagaguaucagguucaagcuaggugcccugauucauaauuuuuguauggacuuccucccauuuucucuacccaaacuuauggcccaacuggcugcucugauuugugguguuuguauauuucuuuaucucagucuuaccucuucggcuuccugagcuucuaauugugcuaacucuaacuacuaggauggucuuaccaaaccuccuaguuccaaaaucaucugguaacucaaauuuuacugccacucaaagucccagcaugacauuuucuugaaaacaaagcaucccauuucugauugcuccacaccaggcugaacugccugcuucuguugcccacagcuaaacugcaucaucuaauguuaugaucacuaauauugcacuaauuugcaagaaaaaaugcauuagcagcacuaguagaaaaaucaaaucaaaauugacuguauaagauauguaucucaugcugcccuuugcauucuuguuacaacuuucauucuuguccuuaggguuggaacauuuauuucucuucaguuacauauauuaucauggugacaguguuaacaaauguggugugaaaaaaaugagguuuccauguuugguuucuaagcauuuccugaccaggcaucuaaguuauuauuggcuuccucauugucagugggauuauacaguucuguuaugguuagcuauguggcccaaacuuuauuucuuagugaccggagagacaaugaagauaauaguucagguuuagguuagacugaaaggacuguagugugauugaaguaaugguaagaauagauuuuggaaccauauagauuaugguuugaaucuagauucuaccauuaaccauguauaaccuugagcaaguuuacuuaaacucacugaaccucaguuucauuaucuuuaaaauggagauaacaaacucacaggauuguugugaagaucaaaugugauauuguuuauagcacacuugucacuuagccugcuauugauuuacagagaggcuaaguaacuugcccaagguuauauugcugguaaguggcagaguucagucuggaauccaagucugcuugauuucaaagacccauguuuauucuacuguguuuuguuuuguuuucccauuuauaaggcauuugaucuguuauuacuuagaaauauagaugcuuaguacuggaaggaacucaaaugucaucuauuauaccacugaucagauauucaaguuuccuucacagcauaucucacaaagcccugccaagauucaagcuauucuugagcaccuuaguuugucuauacuuugcauaauuuuugcugauauuguacucuaugucaaagauugcugucauuuaaagugucuaaccauguuuauauuauguuggacaggacaccaguagaagggaagggacugucaggaaguaugcaaguagaaugggagucuaguuuaaugagaagccccugacgccguaaguguugguagcagguuaaaaaaaaauccgcuuguucucacucacaggugggaauugaacaaugagaacacauggacacaggaaggggaacaucacacucuggggacuguugugggguggggggaggggggagggauagcauuaggauauauaccuaaugcuaaaugaugaguuaaugggugcagcacaccagcauggcacauguauacauauguaacuaaccugcacauugcgcacauguacccuaaaacuuaaaguauaauaauaauaaaauuaaaaaaaauccaucaguagagaaaaaucaccaaaagggucuccagucuaggauucuccugaacugauuucauccuaacuuuccauguuaugauaaacauaacauggaaacauaacaugguuuggggucauggcacagcaguuucagaaauaacugcuuugaccugcacccacuuuuauuuuuacugaaauagggaaucuucucagauucccacagggacuggguagccguucauugccauagugcagacagcuauaacuuuacaacuugcucagaguuuauauggccuaccacucuauugggcuuguuaaacuggguaauuugcuuuuuagcuuauuauaacacauauucuauucugggggacaaccaaucuauugcacuuuucauuaccuguuguucaauaacaacaccuaaggaauucaggguguuuggugcuggaguccugcuuuaaauccuuaucauuuggauuacacagcugaucagugcucugacuucuaauaguuagacuaacucuggaaacaccuagcugcuuuuagaccaaugugcaaggguggguggcucuccauucucagcucauuucaauuccuuaucucagggagagggccaugcagucuuuuuggaugucguaauuuuaaaccacuuggaauaauauucuccuuugcuuuaauguuauacaucccugugcauguucuucaguaauugaaagggauaucgggcaaauuugaucugucuagcuuugacuuaugcuguccuuaucuuggccuuugugucauuaagaaaaaaauugguauugaucuuggaccauaccacuacauugugcugcaauuuuucuuccuugcuaguggaauauaaaucgauaaaaggcagcugcuuuacacgaaggccagauauggugccgucauuuauauauuguaaauccaaugauagcugaucaaaucagugccucuccuguuccaaacuugacaugauugaauugucaauagaaaagauuuuacaguaagagaaggaaagcugacaguguaaaugucugaaaacccaaugaagcucaauauaaaauaaaacaaugagcuaggauaucauuuuauaauuuccaauggggaaaaaaaguguuuagugaaucacagcugaaauugggggugaucacagggagggggaagcaggaaugaaaagccagcuaacuugcauuauaauuuuugagaaaucugaaaugcaaauuugcagaugcaaauuuuaggaauuaugcaucauagucacugaguuguuuauuuacagaaaugguucaaauacucuccaucucuuuccuccuccauacacauaguuuuuagugauaauacccaguugcuggggagaaauaagccuaucuuuccccaggaguccugcugacuucuaguaaguggcuugggaacaaaucuuguagaacuuauccuugcauucuuaaagucaaucaguagagcacuaguuucauuuaaaagaucccuagaaggagucagguuuguuuuuguuuuuguuuuuguuugaagcugcagaacuuucucagauauauacaucuugcuucacauguggccaaccacacuucccuuaggaaaacuaaaaaacuaaaaaagcuguaccccuuaaaacuugaagaacuccugccaauuuuucaggauaccugauuugucuggcaucacuguaauacaaagaggguuagcaagcaaggaugcuggcuaagaacaaccucaaaagucuacacgcuagaagaaaaggucccaagagaaggugguaaaaaaaguaagaagggaagaagagaggagggauaaauccuagaggcaauggucauguacuagauauaugggggaaaacagaggauggcuuggaggagaauaaugguauuauacuagcaaaaaguggacagaggugagaucaguaaccaguuugcagcgaggugauacaaaaauagauguuaaaugaaguuuuagacaugucaacuuucgggguacaauggaaacugugcaauggaaaacugaaggcaagagccugaagauacaccuuuguuuuguuuaugggucccuaauuaaaccugugaacucaugccccagaaaauguaugcauguagaugcaugaaauuuugcaucacauuucagagggucaaugaugccccaaacccaccuacagcaccuuuaguacagugcaugugcaauaagcugaggguggagauauauagauuggagaguguaguucauggugggugucacaucaacuucuuugacuuccaggaucuugcucuuccuuguuccccuccuuccuuucugaucacuacuuuuccauuuuuuuuguuggcuccuacucuuuucccuguccagcaaaauuggguguuaaccaauaaucuagaguauucuuggcccuguuuuucuucucucugauuuuuauagagauucugugagcauuaaaugaaauaauacauguaauuugaacagcacaaucuuuggcuuguaaaaagcacuuaguaaaggguagccaugauaauaaauugagagcaauugauugagcuuuauaagaacuccacugucagaacaagagauuaaugaaguugguugaaugagacgaagaacaagccaucaagaacaaguuuugauaagcuucaaaaaaagagcaauauuaggucaggugcaguugcucacaccugucacccuagcacuuugggagaccaaggcaggaggaucccuugagaccaggaguuugagaccagccugggugacaaagugagaccuggucuuuauaaaaauguuuuuuuuacuagccaggcaugguggcacguucagcuguagucccagcuacuuggaaggcugaggugggaggacugcuugagccuaagagguaagggcugcagugagcuaugauuguaccaaugcccugcagccugggugacagaaggagaucccaucucaaaaaauaaauaaauacaauaaaaagugcaauauuggagaagcuuccugggagaagagcacaucacagaaggagagagagaggauggucagugguguaaugugccaccuccacagggaggagaauaaugcugaauuucauuuauauuuaaagaugucuccaaaaauaugcuccaacaaccucagaauauaguuuucaagaugaaaacucagaaaccaagcaucucucagaagcuaauucucccuuaaucaggucccaugcauuuagaacaacuacugaggcaagaacgucaugcaaacaaggcucugucugcuuuuaaaugaaacagcauucucuuaucaguucacagccuggucucucccuaugggaugucauaugcuucucaacauacaaauaaguaccaugcucuuauauuugcaaacagacaaaucaggucucuugaaaaauuggcaggaguucaaguuuuaaggaguacaacuuuuuaaguuuuuuuaguuuuuuuaguuuuccuaagggaagugugguuggccacaugugaagcaagauguauauaucugagaaaguucugcagcuucaaacaaaaacaaaaacaaaaacaaaccugacuccuucuagggaucuuuuaaaugaaacuagugcucuacugauugacuuuaagaaugcaaggauaaguucuacaagaucuguucccaagccacuuacuagaagucagcaggacuccuggggaaagauaggcuuauuucuccccagcaacuggguauuaucacuaaaaacuauguguauggaggaggaaagagauggagaguauuugaaccauuucuguaaauaaacaacucagugacuaugaugcauaauuccuaaaauuugcaucugcaaauuugcauuucagauuucucaaaaauuauaaugcaaguuagcuggcuuuucauuccugcuucccccucccugugaucacccccaauuucagcugugauucacuaaacacuuuuuuuccccauuggaaauuauaaaaugauauccuaacucauuguucuauuuuauauugagcuucauuggguuuucagacauuuacacugucagcuuuccuucucuuacuguaaaaucuuuucuauugacaauucaaucaugucaaguuuggaacaggagaggcacugauuugaucagcuaucauuggauuuacaauauauaaugccacaagagugggucacgcacaguggcucaugccuguaaucccagcgcuuugggaggccgaggcagguggaucaccugaggucaggaguucaagaccagccugaccaacauggugaaaccccgucucuacuaaaaauacaaaaauuagcugggcguggugguguaugccuguaaacccagcuacuugggaggcugaggcaggagaaucacuugguccugggaggcggagguugcagugagccgagaucacgccauugcacuccagccugggcaauagagugagacuccaucucaauaauaauaauaauaauaacaauaaaaauucaaaaauagugaacucucuaagucccuuccaacacugacauccuaggauuuugaucucugauuuugacagaauguagcaucucaaacaaggcuuacaaggguuacaugcuguccuuaauugaaacuguuugucucuccuagugagcagacaagccucaguuuucggaaaccacaucagcagauuucauuccaggguggggaacuauuucugacaaggagccccgcaaaguaugugugcuucagagaaaagggaaaacugaguaaacaaauacucccuuugcugaagggggauguggguugaaaaucauauuauagaggagguauccuggaguguccugaguaacuagccaaaaauuugaucugguuucucuuagcaugggguaacucaccaugccaacugacauauuucuccagugaccucgacauccgaaaguguccccugaaagcacagcugucuguucuccaugcuucaagccucacuauuuucccuaauagccugcaagaugccauucugcagauguuucuucgacauuucuuaacacaagggcauauuaggcuccuuuacauuucugacguuuguacgauugaaauccccuccuggaaauccgggguugcuuuuauaugaugcaggccauccaugcuugagaagcuggggccuugcagagcagcaucuuaaugccauucacccaccauuuccaccaacugcccaaaucugggucuacauuaaguugcaauuugcuuucucaggauauucuagugagcagaguggaaagaagaaacauuggcauguccuccagaauuuuaacuaaccagagggcugucugcugaugggugcuccgugcaccacuagcuccaaaccuuuacuaauuaugcaaacucaucaggaaugucaccugauguucuuccauuuaaugagugguugugcaccacacuucauucauucugcaucagaauuauugacaugauauugacauucaagggcaagcugguuuucuaaugcuugccagagaaucaaaguuuuuuuauuuccuaacuuuaccuauccuuucagaaaaccugagaaugucauugauacuuaaugcugcauauaguguuuccaccaauaauacuucccccagagguuagucuucggaguacauaggacaggguaauuaggucuauugaucuuugcuacagccaguguuaucggaauggugaucaacuuuauaaauaagacguggauauucauuuuagcuaaggggcuacgacaacucuuguuucuuggacauucuuugcccuaacagaagcauggcuaagcagcuaucaggacauccugaagagcuggaagcccucuuuuguaggccuaguguuaggggccagaauagguaggcacuugcugugccaagaaggggaaaaccuuaaacuuaaauagauuuggcccauggggcaagauuuguaaagucaaaaacucugucaggagcucccaccccugccaucuaaauugccaagugaauucucagaaagagaguuucucagguaaaauguucagcauagaacccuucucaggaggcuuuucuuucacuucaccaaggcauagaguggggcaaguaauagcuuagcuugcagcuggagagaagccuuaaacagguagcacugacaauuguacuggaaccuagaucaacaucuaccuagacccagagagucugggcacugggaaggauuguuuucuggauugucugguguauaauuccuacagucaaaggauuugagcuuugcugagccagagagaggcucacagggagccaggacaccuuguguuuaucacauuuaguagccacccugagcucuuuucuauuuggguucccaaagagagcuccuuuuaagaaaacaggcacacauauucaaacgucguagauuuaguucuuugccuggccggaauaggguggguggagggguuggagauuaaacugucaggcaggcauacagccaaggaagcaagaguccaguuacaagagaaaucugaguaaggcccuaggcagcaagaucaauucacagugaagccaggaagaucuggacugaggucuccuuauuccuccucaccuguucccccucccaguuuucuauagggcuuauggaaaucauggcuacugcuuucagaacacaucuguauaucuguauacauagccugaaucaacugcagugacauccacacacauucgaguuuaaauauuaacagcaauuuguuucucauguggcuuugaaauuuuaaaaguagauccuucugacuagaaugguaaauguuuuugagacuagaucugucugucaggcaccucuucaccagaguauuuaaauauuuuuauaugaugaaguccuuuagacccauuuauaucagucuccagcuugaaaaauaauuaaaauacuuagguuuagauaaagguucaauaaaauuuuguccaaauaacaugaauguuuguugaaguuugggacuacuuuauuaguuuaaauaugucuuugggucuucacaauaguuugcuguagcccuuuucagucccagaaaaagaggauaucaauuuugcaccacuguuugcaacaaaaucuccuuuccuuauuugguuuuuaacuaauacuuuuuguaggacuucuauauuuuaacuaggucuagauacuugucuaagaauuucuuuuaaguagcccccaaguuaaagaaguuauuuaaaccugagauuuucaagacaaguuuaaacuagcagucuaacucuguaauuagucuggugggaauugucuguggagaccugagggcagauuuugaccuacaugagcagcuuuguugauuauguggcuuuaaaauggcuaguuuucagaauuagacauuuuucucucaguuuaauuuaugcaaguugaccuacugugugcaaaugauguuugaugacaaaagagagugagucacacuuaggcagcaacaucagugcccauuaagcagaauauaaauaacugucucuagauaugcaauagagauuuaaaauggucccauggaagcugaauuacauaggagaguuuccugugcaauuauucugaaacaaacagaaaacaagcaaaaaacccaaaaaccaaaaaccgaaaaacaaaaaacaaaacaaaacaaaaaaacaaaaaacagcccccaccaauuucaguugggacaguccuuauaucucuuuagucaaacaguugaaucucaacuaugugcuccccuacucaaccuuguuucuuauuucacuguuuguauagcuccuuccucccaccuucccuccuccuuuucuuccuuccuuaaggaaugaagcucuguaauuuuaaguacguuagcuagagagauguaauuaacuagagcuguauaccaaaguacaaaacuuacauuuagaagugacucacagauagagugacaauauaaauuauuguccaaacaaggauacuuuugagagugaaaggaagugcuaaaaauaacuaacagguuaguugcucugcaagguauaaaccaagccuguagcaggcuaaucaggauguauggucacccuauucacacagacgauuaggaugcuaagguggaagaggcuucagaaagcaucuaguguucccuccuuugaaagaggaaacggagacugaaccaguaaugccugguucugauuuaggucuucuaucuucuaggccaggccucuuucuuuuuuuuuuuuuuuuuuugagacggagucuugcucuaucacccgccucccggguucaugccauucuccugccucagccacccgaguagcugggacuacaggcgcccgccaauaugcccggcuaauuuuuuguauuuuuaguagagacgggguuucgcucuguuagccaggauggucucaaucuccugaccucgugauccacccgccucggccucccaaagugcugggauuacaagcgugagccacugcacccaggcgccaggccucuuucaacuacuucccgugccucacuucucuaccaagauggaaguacauauagcguggacucacuucguuuuuguaguuuuuccucacuguccaaugaauaacuuuuagacaugaaacauuucagaugucagaaucccaggcuccucuucccuccaaaucagugcuucacaauuaagcagcuacacugauacuugcagaacucccacuguuaacucauuuuuggucuuucccccacuuuucuguaauuuaggaaggaugacgaauucacaaaacccaagccaauuagauauuauagaaagauucagauaaucuggauucaaaaauauuuuuccuuuuaaaauucaaaaccagugaauccuuaauugauuucaaggcagacuuuucagacuagccauacuuaaguggucaucugcuaaccaacaagguuagacaauggaguacaguuucuccuucgauaaugaacuugagcuuguacuucugggugagagaugagaaugaguaaaacucucagcugugacugacuuuuguuuugaaacugaacagaauguaccugaaauaaaaugggccggaaacugguauuaaguuuauaaauauaaugcucacugucucauauuuuuauuauccugugugucuucuuucaucucuguucacacacuagguuugcuugcccuggugauagacaggcagcaugaugauucccucauuaaugaaaaggauggguucugaaaacacacuuuguuguuagaaacuuuauuaccaguaguagagaugacagagaaaacauacagaugaguuuuaggacacagggaaacaaggacucgcagaauaaaaauacugucagauccuaauggaaauauggaugugacugauacagggcccuuaauguugaggucaauaucucacuccccuuuuauguauagcucaauaaucauuuguugacugaauagcauugcuggaugccgccauugauucugcaggccaaugugaguucuuccuuucauuugucuaaugacucugaguaggaggauguucuguggccaacaguaacacuguuggugguuguuuuaccagagacuggaaauuggauuacaaggaucaacuaggagucugggaagcugcaacaaggaucaacuaggaggcugggaaggaugagagguggaaguaucucuagcucuuucucacuguccucccugcuuuucuucuuccuaguggguccuuauagugaauugaucacccugauacuuuuccccuccucuccaaauaaaccuggaugucuaggcaaacuagacauuuggcuuaacaaguuaugaauuuuaacaaaugauuuaaaaggaauaccaacauaacuaacuucauuguaagugaacuuccuagaaaggaggcauacaaaauugcauaaauauagcuguggauuggucaauuauuuuuuucccugagucauuucuuucugcacuccucauauuccucuugcacacuucguauaguugauguuuuaccauuuggcccuuauuuugguucacuucuucuccuuauucacauaugcuuaacaguuuuucuccauugucugucucuuuuccacaccguugaucuuauaacaaggauaugaauaggaaaaagagaauaacuugaaagauggguuaaaaacaacuuuucuaaugcauuuggaacaugccuaugucuauauaugugucuuguccuuguauuugagaauaccuaaagccaaaacugucuuuuuauuaugugugaaauuucauuuugugcauuaugcauuguuugugggggaagauguacaagaaacuguagguggugggauuauacauuuucaaaguuagaacagguauuuguuuguuuucuguuuuuuuuuuuaaauacucauguccugggcacuuuaaauacauuaucucauuuaauucucacaaaaaucucaugaagaugugguaucuugcucauagucucacagcuaguaagugguagaaguggaauuggaaugcagauuugucuggcuccaaagcuccagacuuuuuccaugacaccauacugcuucaaaaugugaauaauucugggucuucuacuuccugauauuauagcauauaaggaccaggcauauuuccccacugagcucaguguucuuauauugaauuucuuuauaucucaaagucuguugaauaguuuuucuauuuagaaagcauucuaagcuuugaguuguauuuugggaugggauaaccccccauuuuauuuccccaagacauauggaguucuuugaaaaaaucaaacugucauuugagacuaagaaggaaaggaaagucagaguguguuaaauuucccuuugucucaagggcaugguuuucauuaaguucuuugccuuuuuuguagggaacaacccugugggccuggguguauguuuaauguuugcuuuuauguggaccuggucuucuuccuauucucaggguccugucaugauugcuucguaauaguguacccaagucauggugaugucacuguagugccuuagccuuuggcauuuggccaguauuguuaacagcguugucuuauguuuauucugauguugcuuugguccagcagaaaugcaugggaggcagggaagcuggagaugacacugcacuggaacagugguucuucaacuugaucuuccuuccaaauccucuggagggcuugguaaaacacagauuucuaggccuuaccccauauuuucugauuugguaggucuaggcugaggccaagcaauguacauuucuaacaggcucccaggugaugcugaugcugcugacccagagacuacucuuuggggaucacggcaguagagaaugaagggaaauuagcuuuaccacuugauauuauuuuuuugcagauuuguacaucucuugagcacagugccuggccacauaauaagugcucaaugcaugucagugcugcuuauuuugguguguauacagugauacuuauucacuguacuuuucccuuugccagccuuuucuagucuagaaagaguuaccuguacaagagcacuuaacagcauuugccugguuuggcaaacucacccucuagagacucauauuucuuucuuugucuuaugccugugauucaggcagcugugucagguucauaccauuuuguucccccuggugucuuaguccauuuguguuacuauaaaggaauaccugagacugaguaauuuauaaagaaaagacauuuguuuggcuuauaguucugcagguuauacaagaaacauggugccagcaucugcuucuggugaggaccucaggaagcuuccacugguggaaggugaaggagaacaggcaucauauggucagaggggaaggaagagaagagagaggguggugccagacucuuuucaacaaucagcucucucaaaaacuaauagagugagaacucacucauuacugugaggaugggaucaagccauucaugagagaucuaccccccaugacucaaacaccucccaccaggccccaccucuaacacuggggauccaauuucaacaugagauguggaggggauaaauauccaaacucuaucaccuggucuugaugaucugagaacaugcaguaggaugcuuuuuuucacucguuuauccuuucuuugcuguaagugaacccucagaauuccuuuaaaauaggcgaucuuggccgggugcgguggcucacgccuguaaucccagcacuuugggaggccgagguggauggaucaugaggucaggagaucgagaucauccuggcuaacgcggugaaaccccgucucuacuaaaaauacaaaaaauuagccgggcgugguggugggcgccuguagucccagcuacucgggaggcugaggcaggagaaugacaugaacccgggaggcggaacuugcagugagccaagauugcaccacugcacuccagccugggcgacagagaaagacagaaagacucugucucaaaaaaauaaauaaauaaauaaaauaaaacaaauaaauaaauaaauaaauaaauuaaaauaggugaucucaauuucaacaaauugccuauuaucuuguuuuuugaaaucugcauaauuuacugagguauaaacaaaagcauagaucaggaugcuaaaucaagaccaguuuuuucuucaggcuuguacagcauacaacuuucuaacuuaauuugaagacuuacuuagaguaacacaucaaaugaagaguguucugcuuuggucacuguucuguuaccuugacuuuaucuucacucccaagauaggcccaaagaauucuaauuuagagauaaaauuuuaaguuuuuugugaucuuaucacuuccaguuacaucugacaauagucucugugucucuuuucugucugugucuuauugcaaaagcagagagggaaauaacauuauuaugggucuugguuuaaccacaacaguaacaaugaaaacaagguagaaaaccuuguacauucugcucuuguuucauauagcauagagcaccacagguauuuugcuaaguuguacuaagugccagauaauugcucuucaauggcaugaaguaauuuacuuuccuuaauuccagaggaucagguuuuguauuuuccacauauaacuggcuacuaaauauaguguacucuuucccugggauauacuucuuaaaauguuagguugcaccacauaaaauuguuaauuuuccuuuuuucaucagugaaaauggcuauuuguuaugguucgaucaaauacuuuuaaacaauacaguuuuuaaauggaaauauaaagugauucuuuaagguacuugacgaugaugaugauaaggaugauaaggauaauagcuagcauuuauacagggccugcuaugugccauauacuuuauaugugauuccucauuaacucaucucaacaaccuuaggagguagguacuguuaauacuauucauauccucuuuauaaaggaaaacacugaaucuuagaaagguuaaggaacuuggucaaagucauacacguuaauuagcaaagcugagauucuaaccuaagucuagcugauuccaaacuugggcuuuuuucaacuguaucaccauugucauguuguaauucaguauagggaauuguguaugguaaggcauaggaggcagcauucacugaugaccacauucaaagguaagcucccuuccauucagcucuaacuuuggcauagaacuugaccucauauuccacugucccccaguccuaggcugccccugcucccuuuuacugguucaauuccuuuucugagacauucuggaagagggaguuccaggacacaaccuuuguuuucuaccuagugugagauggagaggaggauaauuagagggguggggagugggcugguguaaaucccuguagauaguccaguuuguggcauugccauaacuuucuguuugauuuuugcccacuuuauauauuucuuuuuuauuugcaagacaaaauaaucagauaauuaaacaaagucuacuacuucacuucuguucucauauacucaacacaacucaaggacgaauuuugacccagauaugccugcgucuguguaaccuggugaauaagaaguuucucugaaaaacuguugguggaauuuuccucugauggcaccagugauacuuuaaucaggaccuauuuuaaauggauaccauauaguaucuaaugguaauauuccaucucugcacagauauaauauaguauaccuauuagauuuuugugaauagagcagauauuugcuagggcucauuacuuuuauuuauuuuuacuauuuuuuuuaaccuccaucaccaccaccaccaccuaggauucauuacuuauaaaaaaaauauguagugugaagaaaaauggcaaaugcagagugguaaaguuuuauaacauauuuuugggucaauuuuuagaaauuauuuuuaaaagaagaggcauaagguagggauguuagaauucuaguuuguggaaaugcaagggaucuugacgugccucuuuuugaaauauuauguuaagaaaaacaacuugaaauuuagacuuaaagaaggaacagguuggagaguaaaagagaugaauuuaguguuuuggccuugguauauuugagaugcuucugagacacccuaugggcuugucuggagcucaaaaaaaaaaggucagggcuggggagagauugaggaaucuuccgaagagagcagagaugauacccuaggaugggaugaguuaguauagaugucuugaaacgguuaaagauacagauuccuuggguccugccuuuggagauucugauucagcacaucuggaauggggcucgauccccgccucuuccuuaacaagcuccccaggccauuccgauuugcagccagguuagcgcauuggcucaucuaucaacucaggucuuggcuguugcuuuguugccucuaaaggggaucauaaaaugugaaagauucuucuccuguucuuucaaaagaggguaguuuccaaaacaaagcaaguuugagagauauauuuugaggaaauauuugugaaaacaccagaaauaguggagccacuuccauuucaaucuucuggauuugauuuguuuguccauuaaaaaagggggggguaauuauuugugugucuguguguguguguguguguguguguguguguguggauuuaucucagacauugaaugggucauuuuuuucauauuuuccaaagucacauaaauaauaauaauuuuaaaaauucagagugcugggcuaauuuuacuacauaaguagaauauacuuagcagcuauuaguggcuucuacacugaaauagaacccugcaguuaugaaaaucauaccugaaauuugagaaaaguuguuuuugcacaguaauauaggguaaaugauaacucugguagaaauagccuaaaugaaguucaauaaaugcuggacacuauuugagguugacuuuuggauuuuguuguaaggguuaucuccagaucuaaguguaaacucagaucacuccggucuuccugaaucagaccuauuuuucauuugagacagauggaaccaucaagaauuuuuccccuuugacuaugucuuggaagaacagggugccauuccuuucaggugcauuuaaacccaauccaaguagucaaacugaagaaugcagagagcaauggcuauuacaggccucaaagaguccgaauccuuugcaauggccaugaaccagucuugccuuuucagaugaucuauaagccuggaauaggacaguuuuggaccaugguagggaacuuggaaauguuaguuggucuaaauuccugguuauggaauuaaaacaaguuguaucuacuuuaguuauuaacuuaauccaguauuuuuguuuuggcuuaauccuauuagugucacauuuuacuuuuagaauaucuuccacuguuaccgggcgcacuggcucacgccuguaaucccagcacuuugggaggccagggugggcggaucacgaggucaggaguucaagaccacccugaccaacauggugaaaccccgucucuacuaaaaauacaaaaauuagcugggugugguggcgcaugccuguaaucccagcuacucaggaggcugaggcaggagaacugcuugaaccaggaccugggaggaggagguugcagugagccgagaucacaccauuguucuccagcaugggcaacaagagugaaacucugucucaaaaaaaaaaaaaaaaaaaaaaagaauaccuuccacuguaaccuugcauuuuuuuacacaucuccaagucuuuuacucauucucucauucucucugcugauguagacagauauuuuuauaucuggagcuggacacagucccuauuuucugggcaggaauucucauuagaugggaauacugggaagacuuuggaaugaucagucacuagugugugauguauagauuguuuauauugauaaaauguuauucuagcaucauuuagggggaaguucucagaacaguuuuauauguguuauucacuucuaacuagcccugugagauacggaggguaggacaagggucguugacauucagccuuccuguggaaucaggaagaggaggagugauggacaagagaauauauguauauggcuaugaaacaguuuugcaaaucugcaggcaggugaucaucauuaugaguuuucccauggggcaaaaauauuaagcacagucuugagaaccacacaguuuauacaaaacaguuugcaggcuggacugagucacagaguuggcucuuaauauguuguuguuguuguuguuguuguuguuguuaauauaaugucuccuccuaaaaugcuauuauuuuuuaugaacugaugggggaguauaugugaaugugcauacaaacuacagugccuugacuuuucucucaugauagagggcuuuugcauuuaauacugugcucauuuuauguaccauguuuaagauuagaguacaugaucccaugaaaugaugcuuguauccagaccuucaaaaaaguuaauuauucaucugcauguucuguuuguauugacucugauguuggggaaggaguuauaaggcuuggaauuuaugauuaagacuguuagaguuuauaauuaagugucuugggaauggcgaacagaaaugaagagggcaguaagguuuuguuuuuuucuuccccaggcccauuucuguuucucaguugcauuuucucacuaucuuuaaacacauacacaugugcaugugcacacacacacaccacuagaugguuaguucauucaugugcaauuaaacuuagaaugcagacuucauggagacaacacauaaaaaacaaaagcuuaagagaccuauuagugaaguucauuugagugccugagguauaaauaaucuuuacagccuugacaaaauguaucucuaaguguucuuuguuuaacugagauaugcugauacaugucuuguuguauuuuaguguucuugaccuuuuaauuaaaaucccuugaaaugaaaccuucaagagaugacauagauugcauugaauuuaccaaagauuggcauuuguuaagaauaauggcaguuugguuaacaguuuuuuaaaaacacacuugcuauuucuuuccauagaggaaggggaagaggugauuuuuuuccugcaugauuuuauaaaaugcguucgacuacauaaggccuuauugaauucauaagcaggaaggugcauguauaaacacauguuagcaagcauauccuaaugaaaaauaggacugugaaccuccauuuaccaagauagggaaggaaguaagcaacagcgccauugcuuaaaauacuuuccacugaaccugaccaaaaguagaaaauguauuucaaagagcaucucuggcugggaccaccugucuaucuaauuucuauggcuguuucagauggaaaguucuuggugguagaaauuucucguugaauaaaaagaaacccccuuugugaacucuguuaccacaauuaauuuucuuauaagguguuccuuaccagaaaguuucagaauucauugaucaauccuguguuuccuacuaacuuugauuacuagugcuuggauauccuaauucauuuacugggggugggauuuuuguuuauucuguuaguugcuuguaaaagaagaugucuuacaugaguagacuucaaaucaaagcagcagagauaguaucauugcagcuuagaguauuugaaauggacuagaugugcuugaacaaaagacuugccuaucucauuaaauggcuguuuaauacuuucccuggugaaagagguggaccucaauuugauuugguagucuuccucacacacauugguggucuucuuccaugaugcauuucaaucuaguugaacuccaaacagacuacuggcacuguuuuuuucucaaauuggacuuuccuaauguaugcagcucuaauggcucucucuaaacagucuuuccagaauguacuuaagaacuuuucuauuuuugcuuuuugaauuuguagcccgccguauuacuugcaaagccauucacaugugcuuuguuucuuucgcucuuuuaaaaaugacaacaaaaagcgauuucagaaaaaaaugagcccaaacagacuagauugacgguacucaucaaguuacuacccgucuccugacaccauaauaaccauauuucagaguugugcaugcuugaucguuacaacagaguagaugaaaucagauuuagaguggggcuuggaauucucugcucaaguccacagaaaucugaaagcccuaguuuguaaucucuaauaucuggucuagucuggaauucacaaaauauugcuuguucucuguguugaagaaauggacauuucugugauacauuuaguaaagcccuuuggcucuggggaauaaguggaugguggaggucagguaaagccaaaauagucuuccaaucacaugacaacauaauuauuuuuaucggacgcaaacgcugaauuuggcuauuugggcauguuuuaguuauugguuuuugcacugugucaguuuccccaaaggaaccaaucuuugggaagccaaagaaagaauggauugaagauaccacagaucaaauaaagugcaagguuaaucggucaucucuguucaaaagggugcugcaauucuagguaacuuuuuaugucagucagaaagcaggggcuuccuuccaaagucauucauguuccuuuuuguugacauauugacucaucaggacaccuggaaagcuguagagcuuauccuucuagacagguggcuaaaugaaggucuagaagaggauucuuuccaucuguagucucagacuuugaccuuuuagacuccagagguuauagcuaucugaagccccucuuaaguuaccauauguucucaagcaagaagaaugagagucacaauccuaucagagagaacuaugcugggcuugcaugugagugaagaaagaaguaucaaggagagcuucugggacaaggaaugccuaaacuguagcuuuaagggucaauaaaaauuuaucauguaaaaaacaggcagggaguacaaaaaagggaauuucaggcacagagaauaaacagcacguacaaaagcuauguagcacuguauacuagauuuagaaagaugaauaugauccaagcccugcccuuguagaccucacagucaauaggcuaccuauucugacuuccuuucccaguaauuaagauggcuuuguccugaugguggauuuaacuucaagccuuuggcccagagguagcuucaggacuuuuuuuugagacagggucuggcucugucacccaggcuggagugcuguggugcaauaauggcucacugcaaccucugccuccugggcucagaggauucucccaucucagccucccaaguaacugggacuacaggcaugcauuaccacuuccagcuaauuuuuguauuuuuuauagagacaauguuuuaccauguugcccaggcugguuucaaacacguggccucaagugauccugcugccuuggccucccaaagugcugagauuacaggcgugagccaccgugcccaguccaacuucaggaucgugcaacugugcagucacacaaagcccugcacucagaagcgcccagugcuugguuuaauguucugccauugccaucuuuuaaaauucuaaauauuuuuugaauaaggggaccacauuuuuauuuugcacgggacccuacaaguaaugaaggugguccugcugguguccaugcuacuuuaaugugcugacgugaggcaaaacacaaauguccacuacccuuucuaguacccuuuugucuucuacauaccaccccagcugugucccagugagggaaacuucagauagacuuauucuuacccaaguugauggggcuuaauagcuuucccuuccaaggacuauuugccuucuaaaagaagauagcaggcaaagggugcagugcucaaaggaaugcauuuaaggguggauguugaaaaacauaaaguguuuaucacaauuauagcagcaacagcagcaacaacauuugaacugagugcuuacaaagcugcuucucacauauuauuccacugucaaagcacaagcagucugaugguuucuguguuguauucauaaaagguaaaucaacaaguuagauggaugggguaaccucccuaaaacaagcauguuuauccugugacccacgggagacaagugcuuguacuuaguaucuagcagugucgguaucuagcaguguuggugguggcuguaccccauuccaucuuuccuugcuagcaucaauuaaggggaacauuuugaguacuaaagcauaaaaagaaggggagauuguaucaggcugaggggucccauucaucaugugggaauuuacuacauggacccaucuaagacagcugacauggaccugucucucaugaacaccaucaucacaccaucugccugaccagguccucuuuuaauuauuuacacucugaucuuuugggggaaggaaaacugguuugcucucuuauuuuagauagauaagcuuaaaaugaaauauaaaaucuuaauguguuacugagcccuaguugaauuuaaaauugaccuuuuuucacuuguguuaaagaagcauuguaagaagcgaugucuugaaguuuuugacaaacuugcacuguugagaaaagaguuaucaacuugagacuuuaggaaacuuauuauaauuuuucuucagaaagagagcauuuuuuuuucuuaacagcuuuggaggggguauugaaagaaggcugaagagaaagagaagaaauuagauuuaacaaucauuuaugcacuuuauuuuuuauuuucuaauuuuuuuuuugaggcagagucucacccugucauucagucuggaguacaguggcaugaucuuggcucacugcaacuuucgccuccuggguucaagcgauucuucugccucagccucccaagcagcugggacuacaggcacauaccaccacacucagcuaauuuuuuguauuuuuaguagagacaggguuucgacauguuggccaggcuggucucaaacuccugguuucaagugauccgccugccuuggccuccaaaauugcugguauuaccaguggagccaccgcacuuggcccauuuaugcacuuuagaaacaaaaccuaauaauacacuuguccccuagucuuuaaggaaucucagggggguagagcuggugaucagggagaauuccagagauggauaauaggaagaaguuguaguuuugugggcacaacaccagguucaagcaagcauggcagcauguaauaaauauggcagaagucuagucauccaaucaccucuagucuuucuauauacuggacauuguguucuguucuauagaaaaaagaugaauaaaauaaggucuuugcucuugaguucaaagucuagguggggagauagacauguccccagucaguacaaucugauugcggcugagaccaccggacugugguuaagagccuggauuccuaauccaagguuuggggguaggacuguaacagcagcagcaaggcaguccacaggagccaggguucuggccaagaaaccaagacagggacucaggcgagauacaguaucaagacagaggcagaacugcuggaauugacuaaaguauguaaaucacaaggaauuccaaaggcccaguuauugcaacuggguaaaaugucagagcaggacuagaagacuugauguugaggggugacuugaugcugagcacuguguauccuaggagcuuccuuagguuaggagauuaccaugagccuagguagggcugggguacuauggggaguaauaaguaggccucaucuguagucauucaagaaaauaguggcagugaaguugaguuaguuuaacuguaaaggcaaagcuaaaaaguucuaugauuucuaggagacuaaaaaaagaaaagguuauuucugacacuuuauaaauugcaccacuuaagcuguugguuaguuuggaccaauguguccucuaaaauccuuauuugaguggugaguccccaaguaauugaggcagagggugcuagagaaaccucaucuaaauaagcacagagcuaaucuaugggagcagagaauguuccagacuuagagaaggcugccuuuuaaguaguuucuguuuugagucucagauaagguauacccaauuucuaauuacugugcuuuaacugaaagccauuugucuucucccaguuccuccuuucuuaguguuacuguagccagggucuaacuugucaguacauuucucuucaggcacauuuagggauuugucauacaugguagaaagucauauuuuucaacugugguacuuuuaacucuaucagcauaggguugauuuuguacuuauacuucagcauacagaaaugaaauuucguugauguguguugaaaauggcucuuaugccaggcgcgguggcucacgccuguaaucccagcacuuugggaggccaaggcgggcagaucacgaggugaggagauugagaccauccuggcuaacacggugaaacuccgucucuacuaaaaauacaaaaaaauuagccgggcgugguggcggggccuguagucccagcuacucggcaggcugaggcaggagaauggcgugaacccgggaggcggagcuugcagugagccaagauugcgccacugcacuccagccugggggacaaagcgagacuccaucucaaaaaaaaaaaaaaaaaaaaggaaaaagaaaauggcucuuauagccuuuuaaauuuaaaagagauacaucuaaauuaguaaaauauuaaacugugaaaaaugacuguagucacugcccaugaagacuuuugcuccauggaauauacuauauugaugaugauuguuuacuuggagacucuuaugagagggccaguccaccauuuuuccuauuguagcaguucagggaaauagaguaggauucuaguacauaauaugcuuuucaaaagccucaagauaauuuauauuacuuguaacauaaccuuuaaaaaacagauuuugaguccauagguauuuagauacauacacaagauaguaaaguuguuuuacuguuuuuuuuucuuuugaagauuugaaugaaaaauuacacuucacugggugguuuucaugacaaucuaucuuaucggaccuaagccagguuuuugagaauagaagcuggaaauuuucucuugucucgccccaccuugaccaggcacugcaacaugaauuuggaauugggaccaugugugacccuuauccauuuauuuaauaucuaauccuagcaaagcguaagcagacucucugccuuuguaguuuuucauggcuaugaccacuuuaugugaauuaccacaaggggaagacauggucccugacaggcagauaaaggauagucuuuccaaaggacauuguuccugaaaaauagaauggcuuuuuaaauguuccuuguuucuuucgauuauaucaguuguuucugguuagaauagccauaugugucuuagcaauuuaguuuucaaaaacauuacaugauccacacaucagauacuuuucaguuggcauaucuuaggcugagaccaccauuuuuguugauuguugauacauagcgguucagugaaacaaaugcuucuaaagagccccuucugugucaggcucuaagguaaauacagagacacaaagaugagaaagacacaguccugacccucuagcgguucauaguccagugggcaagacaaauggacagauauuuucaacauauuuugauagacucagauagaaacauacaaaaugugccauuggagccaauacaaaaacauggucugugacuaauagaaucuauuuuuccccuugcuacucacuaaauagauuuuuuaaaaauucucccuucaacuagcauaggaagccacugacaucuucagccacuuaguagccaaccuguuaccauaaggaagugcauuuacaguggggauucuguugagaucaugugaggcgguugugaaggcacguuuacaaccccaauugaugguaguuacuuuuggucuuucucuuccuccccauggggaagaaacagacaaugaguagagaccagaggaggaaaaagaagcaccgcaaaaaaggaauagagaaccuaaaaggcacaaauagugcccccccacccaaagccaaaugugugccuuugaggcuaaaaaggugacugacccugguguuaacguuguauauuuucaauaagcuauauucagcugucuacuccuugaauuucuucuuagcaacuuaaacacaaacgaggccuccuuugugcucagggacauucucaagcacuuacguucuuuccuuggaauucacaggcccugcucuguucuguguuuuauugcucucagcuuauuuccuuuucucuugauuaaaaacuaaagccucuguagacaugauaaguuaaaaauggaacagacaccaagcauugcuuacugguguccacacccuggaccaggugaacugaauccagggcaauugggauaaaaacacuauaugggaucagccuuuugcacgucuuguucaaaggaaaaagaagugcuuuaaaggucuugcuuuuucaaauucucuguggaauuauuuugauaaguuuggagcuguuuauuuuuucuuucauucuguugucucuugugcagauggaagagaagccuccuauauuagcuuaguuuaagugaugcuaaaagggauacauuugccggcacuaucagggggcccaacugaaaaugaucaccucugacagcacaagauggaccagcucuuucuuuucaccuccugaggguuuaaacacucucaacuuuuuuauuaacaggaacuugcagggacaagccugcuaagcuuaucucauuccaaaugaacacuuuaauucaucaaaagcuuacagugaggcuaugcagguuuauagaagaaauaccauacaaaaggcucucagagguccaaggcagugaucugguucugaagcuagagauuguugguuuuacacacaaauauauaggcuauuagaauugugagcagccgugcaguuguggccugagggguugugugcaagauuggaguucauaaaaggaugucacccagggugcagaguuaggauauuucuggguuuggugacuuaggaaaaaauaugaggaaaaucuguuucgcuuuaaggguuggaguacacuuacuaagagcaucagagcauuuauuucacaaggggguauugucaaacuuaaaugcauacaucacaguagccaaaaccuaugccaucacaauaaaaauucauauuaaauguuuuuggauauucauuaagcccuuauauuucuuaauacaaauuauaugcauaugcccauacacauuaacuguaauggguuuuucuuuauauauuuucuugcacaccuuuaauacuauagcaagguguucaauuuuuggauuuaauuauacucuuuugaaaaacuccccaacuuauaauguguauagcguuuuaauuaaaaugcauuuccaccaagucacaaugauaaauuucuuggagcagcaaauaagcaacuuguaaugucagccuacuuugaugccaggaguuggcuuuuuuuuuuuauuucuauuuuuugguguuaauucagaauaaucauaaaccagaagauuaucauuaucauuuuauuacauuacucuaguuaaagagaauacaucaaaaggacgauuucauuaggcagcccuuugcauaauggccuuuuguuagaaggaaacguggcucccuccccuaguguguauagaacaacccaggacaauucuggcagcuggccauggaguccgucuuggcucuggcaagaacagaugguuuuggggucuguuguucacauuugauuuccauguuacaaauuuugaaugaagucuuuacugaacccuuuguccugcagucugcagcuccucacaucagggggcaguuaggcgccgguccugacaugccaauuugacaccauuuauccagaacuuggauuccccuuucuucuggcccucuacuggauggaagcaguaaguguggguauaccgcccucugguguccagcucggagaggugccgaaagcuggaguucugaacuccaggagcuuagggggaaacaaaugccugagccuucucucugguacuugggaggugccuguuugaaugccaaauccuuaucagaaaaggacccaaggugugaaugccaugguccauagucuuucaacucagggaaggaucuuggggcuuauccauuucaccaccuuccuugucucauucuauacccauuuauugagcaucuacuauguuuguaauuuuuaauucaacagauauuuauucacaccuacuaugugcuaggcacuguguccugaagcaaauaauauaacagugaaaaagauguacaaaaauccuugucuuaguggaacuuccauucauuuuggggugggguuggugaaaggccaggcuaacaagaaaauaaauaaauaaggcaaauuuaaauuuaugguaaguacuaugaagaaaaaguaacagcacuuugggaggcuggggugagugaaucccuugaggccaggaguuugagaccagccuggccaacaugacaaaacccugucuacuaaaaauacaaaaauuaaccagacaugguggcacaugucuguagucccagcuacucaggaggcugaguugggagaaucacuugaauguggcaggcagagguugcaguggcccgagauugugccacugcauuccagccuagguaacagagccaggcuaugucaaaaaaaaaaaaaagaaagaaagaaaagaaagagagagagggagggagggaggaaggaaggaaggaaggaaggaaggaaggaaggaaggaaggaaggaaggaaaagaaaaaggaaaaaggaaagcaggguggaguuagagagagaugcagguggggugacauuuuagauaggguggugaggauaagcuucugagugaggugagggaacagccauuuagaauguguuuaggucaggaaaacugaggucaggaaaaggggagagacauaccucaagucucauagcucuuugauaguagaaguaggacuagaaugcacacucccugauuccaaagccaauguucuuacuucugaguugcaucuaaguaagauaacagaaaaagauaauuauugagcugcuucuauguaucaggaaacagcuagacccuggaucagcaggggccacacaaacaugaaugauggugaguucccuguuuuaaaggagcuuaaugucuaaaugcaugugccuggcagguaucuuuugcgcagaaagucggcaucuaccugcacuaauggcacucuauugcucaaauaugacauugcagaccuguggugucugggacuagccaguugaguguuagguacccugugugcuaagggaugaguuuccggggaagcugcagcauuaggucacuugcuauccccucaaccacugccccagcagagucgcugcuccuuauaaucuccuggacucuguacuggccauggggagaggcuaucuuggcuugcuuugaaagaagucaagucaggagaacucuguggugagaaggucucuuuuauucacaaaguggugguggugaugcucaaagguaaucagguucagagacagggucaaagcacuaaugaacuggaacccucauccacaugguagaccagucacuuaggacagacugaggagaugcugccuuuguugaacccugccacacccacaccaucuuucaugcccuuggcucccccagcuuugaguagccaauucccauuccuuucauggagugauuuauacugugcucaggaucuuucuucagaagaaauaacugccuguccucauuuuuuuuuuaacauaaugguucagagauuggaugggagaauuucucuaguugaccuuuacagccugauuuucuucuuucuaaaaucuauuaucauauguagauaugguguuauaucugacagccuaauuguggacaggccuuuuaacaaacacaccaguaggcugcacagggguagaguggguaacugguuuagcauuuauuuaccucugauuuuucuacaacugaagauaauuuuuuaagucagcauuuuuggaguaaggaacuuugcagcaaaaaauguauucuuuugaaagauauguauauuucaucugcuacaauaaaauacccuuuucggucuccccccaacacagcaaaugaugcaugugacaaucaaaaaaugagaguuugaaaugaaaugugaugaauauaaucugaggucaacuuuuaggauggucugugugaaugucaucaaucuccagaggaaaugaucaccuccucuucccagagagagaaauguuccaaggggugggugggaggggaagaaauucuuccuuuaccucugguccuugccaauugccagaauuucuuugcuacauauucgucuuucucugggccuucaaauuguuucucauucucucucuccuucguccucucacucuuucucuuucucacucguaaaucagccagccugucuuuuuuuuuucuuguuuggcugauauccauuucuucuaugucauccagccaauugacuccucauuuaucaguuaacaacuaauugugcacugauuacccuagccuucucccagcuuuggcuggggaggaaccugcaauucacugaccucauuucauugcauaucuggcaucagcacuguuuuagaaauaagugauagccuuggggagcuaaaggaaagaaaaaaacaguaguuaaguaggaguuccccaaguuuucagcugacugagaauuuugcccuuuuggaaauccuuccacuaagugcucucugcucucguuuaccacuuuauuuggcaaaguugaaagauagcaaaaugauccauuugugaggaguuuaaauugauaauagauaauagcuuauauuugcacaguacuuuaaaagcauuuuuguaugugucuccuuuuucuccuguaacaacccugggagggauaugggaucaucccuguuugaugguggggcagcaaaauguaguugaaagcauugcagacucagaaucagaaaaccuggccucuuuuagucguccauagaggugacagguguccccuggagauccuggaaguagguuguuccaugacaauuaaacuuaagcaagaagcaauagaucaacgcagagagcugucucuggaagguauuaauauaaguuaaagcagugaugugucaaugagaauggagacuggagagaguaauagagcucacauugaagggccuguccaguucugucugaaggcaugggugucuaauaguucauuacauuacaaagacuugaugccauugcacauauagaugauuuaacuaacucacuggguaaugcuuccagguuugccagccaaccuucugauuauaauucaucuuuucauguaacuugucuauuggagggagaguguggccagagaaugugugaaucuaguccucuuaguaguaauauuuaauaccucaaaugaauacuuugguagucugguugcauaugaccgucucuugagaacuuacuuagcaugagucagaugaauacugggacacugucaaaaucaaauuuccuggugggcaaaacugaggaccaaauuacagacuauagaaaauuuaucaaagggaagccuccccugugaagccucauaguggcugccuggucugucagccuuccuuggugauauccuucauuaucaucacauauauguccuuuugaaccuccaaggauuccugcuuucauaggcuguguaaccuugggcaacucaguucuccucucugagccucagugucugcaugcuuagagugcuuuggaaacuauccaaaacuaaggugguaauauucugaagaaaaggaagaagaaacaaagaagaggaggaaaaggaagggggggaggaggaggagggcauaggaggaggaggggggaggaagaggaggaggaggagagggaggaggagggggagaugagaaggagaguuuuggcaucaaaagcaauuugcccaacaccauauauauagcugaugguagccaaaaguagcguggcaaccaucacuguauucuuuucuaccaguggagauauggagggcugagaaguggugaucuugugagauggggauagaaaggcaagaaaggggcaaccucuugaauagguaaggggugugugacugucaugucagaggugaaacagugaggcugaacucuaccugggaagaaaggguugaucauagaucauuggagaauucauaauagugagaaagcaucuaaucccacaacuggaucuuuuggugcugucuuaagggaucccacaaauagcucuuuaagcucaaguuuuuauaucucuccaccuucuaggucuuuuccuagagcccaggagcagaguuuucaccugaaauuuuuguuauauccucugucugguggcuaggucucuuuaccuaggaagcuggauaaggggaguuuauuaugaagcuaaugacauuugcuuuggaccacuacagauauuucuguaucauauauauacauacauauauauauauauauauauauauauauauauauaaaauaauaugauaucuuuauauuauauauuacguauauguauauaucauaaaacaucuuugaggguacacgcauauucaucuuuaauccccaggggcuaacacagugccuggcaauaauguuaaggaaagccuuaaucacugaccuauuauugaaugaaguuuucuuugagagugguugugucccaucuucuucauuccaaguucuguugaugaugagaguagaagagagagaguagccaaguguauuguaauugaacuaugggaugcucagaaaagcagaucauguaggucuacuuucacauuuuacagguguggacguggaagaccaggggauuaaagccacaucucaagguuguacaguuaauggcagagguggggccagaagcuagaucaguugaugaauaauuagaauagaacagaacagagcagaacagaacagaauagaaggaagugagcagauaacugacuucaccucuacuugguaacagccuggggccccugggggaccugccacucucuguuuaguccauucuauucaaaacuucuuucuguuggagggaaaggacuaguugaauuccuagggguucuucauuacuuguucaguguuccuccuuucuagaaccaacaccugauugcuagaagaaguaaagaccuucuacaacaauggggaaaaaaauccugaaaguuaaucauugcuucauauaaucaugggccuuggcauaggcccaccagaaccuaacuaguauccaggacuguuuccuuuagauggcuguugcuaaugagcgagagggaaaaaaauauaccuuccaauaucaggugaaugauaaacaauugugucagacuccucauuccuuugccauugauaaauguuagaggcucuaaucuucucuuucuggauaugauuucuugaggcuugaauaguaucauggacuggggauuagaauggcccaaguuuuucaagauuuaggaaauccuacagaaauagaauuguguugagaaccuacugcuuugugauuauuuucuauuacuauaaauaguauuaaaugucauguuauuauccaucaaaccugagaaaggagugaaauacccacagagaccugugauaauuuccuuguuuuuguucaccuaccagaccaacuaugugugcaguuauaaaauacuugacuuugaacuuuuuauuaggaaagauagauguuugauuguguuacagaauuuugcuccuuaguucaguuaaaaaucuggguucuugucacaugaccaggaaaauuuaggcacgcagacacauugaagggugaguagaucagaauuuuauugggcgaaaaggaaaaaaagaaaaaaaaacucagcaaaaugagauggaguccugcuaacaggcccccgaccucacagaucaaaucccaggccaccacacaggaacugaagaagccaggcucuuccccugcauaagcuaccauuccccauggcuccacucacuucucccagugcauaugucaggcuccagucugcugugggcaugcccagacaagcccugggcaaguucccucaucugcacaaaagcgucuaauacacacuuguggggcaggucggagauucuccggggaccccuuuuuaucugccuaggcauuuggcugucucaguuguguuuaaaaacccuaucgggguucuuucuuucuuccuuucuuuucuuuucuuucggcagaguuucgcucuugucacccaggcuggagugcaauggugcuaucucggcucacugcaaccuccgccucccagauucaagcacuucuccugccucggccucccgaguagcugggauuacaggugccugccaccacgcccagcuaauuuuuuucguauuuuuaguagagauagguuucgccauguuggccaggcuggucucgaacuccugaccucaggugauccacccaccucggccucccaaaguguugggauuacaggcgugagccacugcacccagccucacuuuauaaaauauauauucuuuauuuugacaggauuauguuuaagguagcuuuugaugagagacguuuaucuuuucuagaucuuuuguccccggugauuaguuguaaauuuuuauaaaucaaagaaaggucuuauugaucuauagguuuuauauuauacugugcaugaauagcuauugcuauauuacugaagagacugccauauagucaggguaaaacauugauuuucacggacuauaguauucuuugcagaaacaauacguugaacuuuaauuuccugagaaugucaacuugccuugcccgucaagaaauuaaucuguggcuagagcuuacugauauagcagucucaccuacuugauuagacaucaugucauuuuauuacaucgauaucuuucagaggcauugccaauacuuguauucagaaucccaucuuuccuuuugaugagguacacuuagcuccaauaaguaaacaaugaguaagugcaaaaaccaguaccuggcacacaauaggcauuuaaguuuagauauaauuuguugagaucuuacuaaugccuggcauaguacgaagcuauuuaucuguaucuauauuuauauugguaccugucugucuagcuaucuaccuacuuaucgaucucucauuuaguccucaaaauaaauccugugagauagguacuaucauuucccuuuuacaggcgagaaacugaggcugagaggucauauaacuuccccauagucacacacaccauaaccugcaaaaaguaguagagcuauggcuuggaaccuaguuuaccugacacucuagucuacucagguauacugcuuuucacaaacaggcuggaacuggcuuugagauacucagaucugcccugcuucugacaaacagcaaagaagaccccccacuuccccaaccaaaagagaaagagagaaucagaccugggguaaaagucugugcucaagcagugcuaucugucagcagcuauauacauccacaaguaaagcccccuaaggaaguuucuuccaagaaaguucccauccugguuuauucaaagaccugaauuuuaagugggaccaccucagcauuuccacugaucuguuuccugcaggggguaaaaaacacacacacaaauaaauaaaaaacaaaacccuaugcaaaaagaagugacuguccagaauaggcaaauccauagagaaagaaaguagaguagugguugccuagggccggcggggaggaaagagaggaaauggagagugacuguuacuguacacaggccuucuuuuggaagugaugaaaauguucuggaaucagaugguggugaugguugcacaucuuugugaauaugucaaaaccaaugaauuguacacuuugaaggagugaauuuuaugauaugccaauuauaugucaguuuuuaaagaaaugagggaucaugccccucuucuuuucuaacaauaacaauuuccuuacauucucuguguuacaaacagucugcuguuaaaggggagcgguccuagaaauggaaugucuguuuaaagcguccauguccuuggggguucacagugccauuuagggggaugccauuaguggccugugaccuuugacuuaagaacagugguaacuuugaaaucagcucugccgaggagcuggucaguaugggcuccuagauuccagaggggauuuucaauucccugauuacaaauuuccuaggaaaguaggagacccaguuuggguuucugccucucugcaugauacucagguaaaggcugggguuuuuccccuuuaggagaaaugugaauaguuaaaguguaacuucugcaaauaacuugauuuaucuugaagugcagcaauuugcuacacgugcguuuuucagaaagcacuaauaaauuccaggucagaaucauuuaaagcgccccacaaauugauagugaggucuuaaaaaggcgcagcagcuuuggaacguuaaauuuacuugcuguaaauuuggaauaagaacauaaagaaucacuuuccagcaagaugaugaaaauucaucauguucauuauguguuucuuuagaagcacacuacauuaauuuuccagcucaacuaaguggaggaaguaagguuucucguuacuaaagaguugcucugauguuuagagaggcgguccaguuucauuaaugaauccaaucuggucugacuugagauacugcuuaauguguccccaaaacucgaauauggauaagugucauacaaaucaacaucagguuuucuccuuuuaaaacaauggccagaagguauuuauaaaacuuaguuuuguuuuccaaggauucaaaugcaauagcuugcauucagcucuugauuuuuucaugguaaugagggagagcaaugguauggcuccucugaaaauaguaucucuuugcauuugacucugaagaaugugucagaaugaaagaaaggaaaauaaagaagucccacuggucagcaccuccuccuggaagcccucuucagacauuugucccacucuagggcaugcuggagaaugauaacaucaccucucagcccaaaggggcuuuugcuagcuagggggaaagcaaaaagugucuuccuguucaaaagccuucuugcucagcugcaggccaacauggagaagugaaaggagaagcaaggcaaucaugugcgucaacaucaaguguccugucaccuacuuuguuuaacuuggcuaauaggaacaugaaagcaaggucauuugcccgaggauaccugagauauacaggcccaucuuucuaggcccuguaaaacacacuuuccaucucaucuuaaagaaccucaaaaagcuuugcaaacuacacaguggucuagaauugcuugacaccuccugaaaugcaaccuauguugugacugguagcggcuguuaaauaacuccuagaaauucugcccggaaguucagaucagggauggggagguaguacuuuggguugcugugguuccagcaccuccagaccuuggaucccuagcucucuguuuggccugaucugcuugggcucuccugaccaagcugaguccuaggacaccugaaccuuggacaucuuuuuuggccugauaucuguugugaucacacaucccucucuguccacccccugccuacugaccccuugacaucuacccaacucugcuggccuaaugagcucucagaauuggccccugcuaaccugucuucuugcugccugagucaaaagcuuuggcagucuguuugcauagauguaauaccuauucuuguggcagaucucuaucuguaaccaugggaacuaggcacagacauuuauaugauaagcauccagucucucuauggucaucucuuguuugucaaugcuaguggagaggaguagagacauagguaaucugauagaaugggugauccaaaauucauuuguauuugaaguugaaauggacauacacacuucaucaggcagccauauauaaagagacugcucugagucugguucugacuucuguuuuauaguaaggugcuaggaacagagaaggaaagggacaugggaaaaaugaaaagaacaagaggaagggaaaaaggacagaaaggggauggaaauauagaauaggaaaugugaagagacacacugagaggugagugcuucuuugaguuaaaacagguggagugcugagugcuuccagagguaacugacuugcucuguuggccuugucuuuuccuuguguuccguaaaugcuaaccucagauuuacauuucuaucacagaguuucaggcuugauuacucuaagaagugcuucucagauagucaccuuucuauuacgcuuucuguagagaugaaauuuagcaacugguaauaauuacggugaaggucucaguccucagcagagaaugugaguuugcaggguagucacaaaugauguugcuuuggugcugggccagggguuuaggguuagcacucugucucccacagaggagauggaagggaaugccugggaucuucaauaaguagauucccucugguagcauucagagcuguuacuucucagagcaauugcuaguuugggaaugggcucucugaugagucacuguggucugcaugauuuguagaggucuuugcaaauggcagugcuuccaauccaaaagaaguuaugaauuucuguccucagaagugcugggaagauuaaagccccaggaacccaaaauaagcuguugagggcauaagagagauuggauuucacaccagacaguaaauuucuucaggaaaggaaucaugcccaauucucuuucagguuccuggcacccuuaguaccaugucuggcacagagcgggcacucacugaacacaggaguugaggcuaaacaaggaaggguaggaguggagacuaaaggguagcuuuggccauugcaacugcaggcuuugugcaguucccugacuuccaauuugccucuuccccaccuucccacuaggcaugcuuacaccuaguuucugcuucaucagccuuguucaaggcuuucagaaaaagaagucugcucuaauguaccccuucugccaaacuaucuggaguucaccuuugcaaagggaagucaauccaugaagauaguguugcaaguuguuuucucaguuuguagaaaaagugcuuuauuggucuccugacagacuggccuuaaagucauuccauagaguccccaguugcugcauuuugagccccgacaccuggcucagcucuagccucuguuauccuggcuguguagccugccagcugugacagucaccauauggccuggucucucacucuuccugccucagcauugacuaauguggcagaaaaacacucccauuacauuuuuguggaugaggcagacaaguggauuuacuuuugaagugaaggaaaugagacugagauuuccuucuagccuguguugccagagaacucuucaucagugaggcaguugggaaagaaaauauagagcuaccuuuguagauacagaggaucgauucagagagaaaaauaaugaaagaaauacagaauuaaaaagaaacaagaugcaaggguguaaugggggaggaaauacaauauccuacauacugagaacaucauuucugaaauaauuuucaauaaguuagugaaagcagugcaguuccacagggcuugggauaugagaaaaauaaaguaaauauuuggaauaagccaucauggagaaaggucucugaugaguugcuauucacucugacuagacuauaaugauacuaaacagaaauccuuuggcgccuccuauuugcaaguuuuuauugaggcacucaagaucaucguucucuuucccuuugggauaacagcaucccaagcagacuguacaggguuugauggaggaggugauguugcccauugaucuccuuuuacacuacuagcaauagagccugcuucauuccuaagcuaggcaccacauuucugaaggguggcugucacugagacugcagguccggcucugugaaagcagguugauagguaauuauauguucccaugaauuacuuucagagcuggguaauuaucaugaaacugaccagcuggaacucacaauuagcucagguccaggcuucccaggccaccagucauuaccuucgagucaggguaaucugggacacaaaucguuucuuuuaaauguuauaagacaggaaaacauuuaaaaugaggaauggcuaggcccucuagaaaacuaaaaucuguuauuaaaacaaaguauaaaagaaaauauuauaccuuuaaagaagccuguuugugagaggcacaaggaagaaaagggauacucugaaauaguuuuggcagggaaaauuucaaaauuuaauauaacuuaaaaauauuccuuaagauuaaagagaaacgagcuguaauauugaaugauuaggaagcuauaaccauuuuuucuagcuuccaaauagcuuucucucuaaucccacguuuauaagaacaaaaaaauuuugugacucuucauagcuuacaagaucaaaccuaaaccuccuagcauggcgucuaggucauuucccagccucgccccagccuacuuucagccucugcuuccauauggaccccauaaccauuucauuucauccauccauauggcauuuauagaaaggugccaugugcaagauacuucuagguguuuugugaucuaacgccacauuacuccaccuugguggggacuuuauuaguucaccaugcuccuauuugggccccauuuaaaaaaauuaugagguggugagugccugggcaaggauuguagcaauggcuuggggguggggauagucaggaccaggaugugguaggagaggggagaaaaacuuuaaauaacaaaaaugauggauaugacccaccuucuguuuuuuuuuuaauuucagugauuuuccaaacuccuaugaaucaucuaaacccaugcaagauaaaauuggcuaagcaagguguuauauauuaacacaauggaaugaacaucucauagcuacaugaaaauguggguaugaaauaaugcuauuaauaacaaugaacacugaaugagcuuauuauaugccagacaguguucuaaucauuuuguauauauuuuaucauguaacccugacaacagcccucuuagggcagguacaauuauuaucccgauuuuacagguagagaacccaaaguacaggaagguuaagugacuggcccaaggucacacaacuagcauguggaggaaccaggauuggaaagguuguguucugguuccagaguucauguucuuaacuacuguauuauaacugucucuguacaggaaaaagaacauaaaaaguacauaagcauagcuacccacauauaaauaccuuguuaaagacaauuugcagugaugcaaaugauuggauuuaauguuagauucauucuucuguaaagaagcuuaaauucauaagaagaggaaaagagugagaauaguuuagcgucaugggggucaagggaaagcaauuuaggaaggaaagugucaauggugucaaauguuaacugagccaggaauuaacuuaauaacuucaagcaagucacuuagccuccuuaguaauuguuuccucaucaguaaaauuuucuauugcuuuacagcuaccuuuugaagauuaaugagaugauguuaauaaaguccuugugauuuccuuugauaauacuuucucaaaauugcagaccauauuuuuagaggguaaaaaaacacuaaaggcagaaaauauguaaauuuuucaaguguugugcgauaaucuaaaguguuucauguccuucaacucugguugggguagcaacauaaccccaaaugucuugguauuugaagggaagaaucagccacgggcccuguacuguuauuauauucaaaccaagcucucagagucauccaggcagucccaggucaagaagacaaccugauauucccaguugagugucucuugcaugucuuuggcuaucauguuuaacuaaaucugaagugaccuuuuacauuuuugccaagagggagaucaugauaaugcuauaauagacuuuauguucaucuuggccagacauaacaguacuugaaaacuaucucaaauucucaguuguuuauaaugucuaauaaucacauugcuguuucaauucguaucaguugcucaguggguccauuacuaauuuuguuuccaaaauauuuaucuauaauggaaaaaauucuuuguaagaaucuauucugaugguuacauguaaguaacaacucaacuauaaacaaccaaagaagggggcugucugaggggccagguucuuucucuuuuauugcuucuuuuccauucugcuuuugaguuuuugguuugccuucuacagucuucauaaagaaaggguaacaagcaguucagauagcucgaguaaccaucccaauauaauucucucaagcuccaaugcauugcugaaauguucaagucucuccugcuuuugacccauguaauuuuugggggggaaauaauaaaucuucaguagcuaaugugugucaccacaagaugacugucuuuaguagugugcaacccuuuuuaaagcagggguuugagcaaguucaacagauaggucauuguguucuuuacaaaacaagguuuuauugcuaauugacuuuauaacuuguucuuauucaaggcaguucuaacauauuucuuccaggaggagagaaaguuggaugauggaaagaacaaaagaccggggcucaugaggcuuggguuuuaguuccugccucgucaguuuccucaucugugaauugacgagcuuugaucaucagagugcccagacuuggcucugcaucagauuugccuggggagcuuguuaaaauaaagauucuugugaccaaugccuagaaacucugaauugacaguucuaugguagggccuaagaaucuguauauuuaacaagcaccccaggagauucugacauaacagguuugcagaccaacaauaguuagaagucauugacuuagauuacuucuaaggccuuucagauuucaacauauguaauucuaguaucaaagauuccuaaucuaaacaauagaugaaaauaaacagaacugagauaagaggaaauguauauuaauaguuucaugaugggcuuuuguauucugaaaccagaauuugggguaucaggcacuacuagaagauguuggcaagguuguggguccagcaagugugcuggagucagaggucagacuucuaacuugagaaaaggaggugggcaccaugaagucauaauuucacaucaagaauuugggcuccagagguccagggaagauaagcaggcauaaauaggaacagaagccuaccauacaggaauugcuugagacuuagaauuaaaguaaaaagagaauaaagagaggguggagaccaagagaggaguggagaaagagggguugaaaccaggagaauaagaauaagaucucuguucuuggaauaccugugguccaugcauuaagaaagaaacgacgucuuugggaggucgaagcggacagaucaugaggucaggauuuugagaccagccuggccaacauagugaaaccccaucucuacuaaaaauacaaaaaauuagcugggcgugguggugggcaccuguaaucccagcuacuugggaggcugaggcaggagaaucacuugaaccugggagguggagguugcagugagcugagaucgcgccacugcacuccagcgcgggcgacaguguaagacuccaucucaaaaaaaaaaaaaaaaaaagaaaagaaaggacgugacuacuuccuugcuguacuaauuuuugaguauacucauugcuguaagagaaugagagcaaaguucguggacugugauuggaacagaagugucucuuaggucauaagguauuggggaugcaccugaccuaguauucuucugaccucuggauuaucacugucagggcuaugggaaauggcugugacuggaaaggaauaauagccagugugaacaaagacaggaagauggagguggaucucaaggagccugagauguccagcucaaaugacucagaaaauugauaacaaugaauaauaaacaauagugaaggaucuuggcaucaguggcugcauuuaauggagaggcucuucacuugauuuuccacauacagucaugaccuguauagguagguacauuuugccacuccaguugaaagugaguaaaaauaugggcaucacaguuuagcgaucucgaauacuagcagcaggccucacuguggaucuaugcguagacgagacagaccaaguagugcuggaaaaggggucugcgaagggcugagacauggggauuguuuugucauucuugggaaggccaggagggggcgccagucauuugauugauacccuauaaucuguguaacgagauucuuugagaauguguuuugaucagaaauagcaaugaauuugguuaacaauaucuccucaguuuucugcuauauauauuauuagaaagauauauuuagaauagauaaacuauaaaaauaacuccauaauuacaacccuagaaguuuaauaugucacagacuggaaaaggcuucuuugauuugauagaaaggguguguuugaccauuguucacugugcucacguguugauauuugcuaugcacaccacaguuuuuccuuucugggaggcuuuuuauuuuccauuaacuuugcagucuuaccuuuuccacugauaacuuuuuaaaauaguuuuggguaugcaccuuucuuuaaacccaugccccuuuuaauuuuuuauuuugaaauaaauauagacuuaauguuguaauuauuagauaucaugaauuaugcuuaugauucucagagauggccagaggugucuucuucauggguuacauuuuuguucccaagguaucucuuuuucaaagugaugcucucaauucugccaaagccccucguguagugaauuguuuauguccaauccuguaauuuccuugucaauauacacauccuuuugcuguguuggggaaagaccauguaauuacugaccccggcacgauaccaauuuuuacaaucuuauacugaaauagauuuuugugacaauuagagcaguuagacagccuagacagagugcaugaucuugggcccuaauguuaguaagauggccaggcuaucugccugucuguucauaucaaucucaacauaucuuugaauguaucgcugagacauggaagcaacuuacaggggccuccccaagacccugaaaauaaggaaaaugaaaucacuaccuaaaaguuaagcuagaaaaucaacaagcuauggaugagaacagaacuaugcaaauucacuuugaagagacugaauuacaaaagaacaguggagucgcauauuuguugucuaauuuugugaaguauaaauguaguaaaaaaaaaaaaacacgcuggcagcaaauugccaaaaguuaacucauguugauaacaguuggugggaauaugggugauuauuacuuuacuucuuugaacuuuauuuuuuuaauuucaaaaaaaaagagaaaaaacaagacugagacagagacagacagacuuaacggcugcuaugaaaaaaggccagacaguagccugacugacaguguuaacacaguagaagaaagaaugugucaaucagggagugggagccaugggcugucagucaugaaagcagaugaaaaggagaaagucacagagaaagauaguaacacugaucagugcccuucuaccaagaaagaaacugccuucuugggcucugggcuaggcacagaggcaacacagcaaagugguuauaagugagaucccagauccagacugauuagaguucauaucucaugcccaccacuccccagcuucaugacccugggcaagugguuauaccuuucugagccucaguuucugucuauaacaugggaauuuuaauaaugguacuuaccauauagagccauugugagaauaaaaggagauaauuuauguauucaguauggugccugacacacaguaaucucucaauaaauguuagcuauuauuauaauauuuuauuuauaauacccuauuuauagagauauauuuuaacaugaugccauaauuagauauucaaagcuuauaccuuggguugacauugcuuccacggucacuaagcgagcuuuggauuauauuuugucuuccuauguuauuuaucaguagggagauuauaugaggaucugucaccucaugaauuauauguaucauuauaaauggguuacauauauuauauaugucauuguaaauggguacacuaguguucagcuuuauucuagcagucuuuggaggguuugauaguguggguucaaucaaucuggaacauuaucaaauugaguuuugagccuccaaauccugggcauuuuaaaauuuuaaacauggcccucugugagcuugguugaagugaauccaccucugagggccagaauccagaccuaaugagguuuccuagcagccagucugccagcauucucccgccaauuaacucccucuguuucuacacaaaauuguacgggauaaaaccagaaacucauuucauauuuucuguguacauuugcuugaguccugugcuuuguacauguccuauaugaguuuauacagugccuuaguaagauacuacauuauauuguuacuggaguugauguguaauaucagccaacuaguaacuauggagaaauagcacagaauuauggaauuacaaugcuugaagggaacuuaacacucagguaguccugucucccugaaggccagagaggaaaaaugaccuauccaggaugacaggugguuuauuugagacaacacuauacucauauaaaagcauaaaaauuuuucugaauuacucaucaaagcagagauaaaggacugaaagaauguaucagaaacccaaaacagaacccaaagaugaaggguccaccucauuauuauucugccacauggaaaauauuccauggcugaaguccuucacucugcucuuuuauguucacuuuauuggcuuuuuccuucauucugauauuuuuccuggagaaauaacugucacuaguguucaagagcugacucuucaugaacuaggucaaauuaaaacaugguucugcuccuuuuccaagacauuuuguucauccuaaaaugcuuuucuuucuucuuuuuccuuaaaaggggacugccuucuacauagugcucccauuuuauuugcauuucccucucaauuuucaguuaguucaauuacuuauuuauugaguccuuuucuuugucuaguuuugugcuucuuugucaauugguacuguucuucacauuugguaugcaggccgccugggcucugccuucaugacuaacucaugcacucuuuuaauaaaaauaaaaauuuucauggugaaaccccaucucuacuaaaaaugcaauaauuagcugggcgugguggcaggcgccuguaaucccagugggaggcugaggcaggagaaucucaaacucaggagguggagguugcagugagccgagauugcaccauugcacuccagccugggcaagaagagcgaaacuccaucucaaaauaauaauaauaauaaaaauaaaaauuuucuacccccuuuuuguuaugugaaauuucaguaacagugaauaugccacuugaaacugccuuccucuuuccuucuccaaggacaaggucuagucucccauaucaggcauuagagaggaaugcuucagagcucauuuugaauuccagcucugcaccacuuacuuguuguguggcuuugaggaaguuguuucugcucccugagccucaguuuucucaccuaugaaguggaaauaaucauaauaauuaaauaauaauguaauuaauuaauaaaaugugaggggcacuugaaauagugccugguccaaacgaaugugcuaugcugauauuaguucuuguuacuauugucaucauuguucuuguuacuguuauuuagucaucauuauaaaacuggucuucugacaucacguuaaccaugauacucaacccagauugucaauaucagcacugucuccaguaaugccauggcauucuuaggacaaaauaaacuuuuguuuuaauuuaaugaauaaggagcauauaacauuuuuagggggugggguaugacgauaccaucaacccaaaugugcugaugaaagagacgugauuccagggagguugggaccuaucauggugaauguauucaccugguuguuugucgggagcagaccuuucuccguguuggugugugcuggcaugaugcaccacaccagcaccuuuguuuaugaucaauagugacauaggucugcucaaauaaauuaacauucuugucuggcccaacucauuuugagaaaacugauuugcaagccaguguguaagcugacccauauaaccccuuagcuuaaaaaaaaauguacuguauaccauuguaguuuuacucuaacaagcauugagcgauggcaggcaaacuuuucuuuaguuuaguuuuuuucuuuuuauggcuacaucgacugacuucuaccuggcguucuuugagaggcauguggaaaggagacugaaaacuaaauacaggagaaggaaagggacacagggaaaagagggauauuggaauuugucagcgucucugaauacuggugucuuguucuauaguaaaaccucagaucugagcaauucugaagagcuuaaacacagcauaggaauggagcaagcuaauuaugggucuauuacaggggcgauuugaacaucauuuacauuaguauuccaaugacacauugacaugauggcaugccaagaccacacagcacuaauauuuccuucuucccucucugcccagagaauuuauagccuaaggagaauauaauagaaaacaauuuacuucucuaguuugguuuuggucauuccgggccagaggcauagacuguagugacuuccacaugcagauuugggaaagugacaaacuugaauuuuaauucaucuaauugugguguguuucaaaccuaaacaauaccauuuugagggguuuggccucaucuuucuuuccuuaaacaaauagaauuuucagugaugucaacuucacuauucuagaccccaugagauggaauuuagcguuugggucaggcuagugaggucagcugaggagacacagugcaauugugccaugucuuccuuugcacuggaauuggggaugucuccaggcccacacagaggggcccucaggcauguuuaaggaaagcgcuaagcaacaggaucagacgaccucauuagggaaagugacuguaacuuguauuuuagagauuuuguuuaaaaugcccaaucucaaauucagccuuuuccaggcacauugccaaauuacagcaauggaccauuuuucaaaugcccauuuaaaauaagcggucuugaauguagcagugugacaaaagauccuuuuggcagaaagccacuuuagacaucagauuacuccaagcauuauuuuaaaauagugcccgggccuuuaaguaauucaggugcuguuuccuuugaacacagaaaaugucaguguaccgagagcagacauaaauggggcaggccuggccaacagcuggauuuccuuuuccacagauggauugagcccucauaguguauacugucccuuguccaucuguccgaauggaguuaucuuccucugauucacuccuuccccccauccccucccagauuuaaaugggggugagagaugggggaguuacgaggaaagaaacuuauugugagauauugagggugaaacuccuagaagaaaauagaagaacaauccugcuacgagguggauucugugcuugcucuucccuuuuuaucuggaauagcaauugggagguagugacaagggcugccagagguuugcuaaagagaguucugaaauaauagguuuuggucuugugcaaauaaagaccuguaguuuguuaggagcuuggggacaaaugguagcaaauggacaaauggccccaucucugauccugcaagucacugagguagcaguggguggcuugcuuucuguuucuagcucagaacuugggacuuucuaggagauucuaauauugcauaugaaccuugccagaggugcucggacaacacaaaauagagaagcugaaucaagcauuuauacuugugggagugguugcuugucuuucugaccauacccucucuucuuccagguuaauucuaggauuacuuucauugcuggcucuccauuuuuauaacuucuuauuaaacugguuuccacauucuguuaaaauaaucaaguguucaagaauguucagaagguccaauuucauuaggucaucugguccuuaaucaugaaccucacaugcgauuuuuuuuuuugacagggucuuccucugucaccuaggcugagugcaauggugggaacauggcucacugcagccucgaccuccugggcucaagcagucccccugccucagccuccuguguagcugggaccccaggcaugcgccaccaacccuggcuaauuuuuugauguuuuguagagacagagucucacuauguuguccagagacuggucucaaacuccugggcucaagugauccuccugccuuggccucccaaagugcugggauuacuggccugcggcacugcacccaacugugauuguuuuauaguacaauacaggcagcucuuguggcugagucacugcuuuaugcagaaagauuucuuaagccaggcacccugcauguaugcucuuacaugcaggguaucuggcauuucguauacagaacuguuauuuguauguccuuuauauauaaugucccuuuuaaaaacaaauccaguuaagcuuugaauaaaaaagauguuucucuaauucauuucuucgacuuugcacuaggcuuuuaggcucuucagauaguugcugaagucccuaacaacugcuguagaccagaacuaaggugguagcuaagccucagaauuuagcugguuuggugcaaauagguaccaaguaauauuuuauuuaggccuacauagauuagaugaccugccuucuagaucacacugguauuauaguauauuuuccaguuuauugagguguaguugacauacaaaaagcuguacauauuuaaugugugcaauuugaugaauuuggagauaaguauauacccuugaagccuucaucauaaucagugccauaaacauauccaucuucuccaagaguuuccucccauccucuuaauuuauuauuuucuuugugauaagaacacuugacauaagaucuaugcucuuggcgaaauuuuaaauauauacaguaucguugacuauagacacuauucuguaugguaaaucucuaggacuucaucuuguguaacugaaacuuuguaccaauugaaugaugauaccucucuguuuugcccucacccaggcucugaaaaccaccauuccucucucugcuuugaugaguuugacuauuuaagauucuucagauaaguaguaucauguaguauuuguccuucugugucuagcuuauuucauuuagcauaauguucuccagguuuauccauguuuuugcaaucagcaggauguucuucuuuuaaaaggcugaguaauauuccauuguguguacaugugagugugcaugugcaugugugugugcauaugugcguguaacauuuucuuuucuuucuuucuucuuucuuuuguuuuuuuuugagacagugucuugcucugucacccaggcuggagugcaguggcucaaucucggcucacugcagccucugccucccggguuccagugauucuccugccucaaccuccuggguagcugggauuacaggugcaugccaccacaccuggcuaguuuuuuguauuuuuaguagagacaggguuucaccauguuggucaggcuggucucgaacuccugaccucaggugauccacccaccuuggccuccaaaaguguugggauuacaggugugagccacugcgcccagcuguaacauuuucuuuguccauucaucugucaagggacacuuggguuguuaucuaugucuuggcuauuaugaauaaugcugcaaugaacaugggaguguggguaucucuuuuucuacugccucccuccauuuuagaugucaguaguacuggcucuuuauccaaaaauuaaggaggggagaaggggguacagugggguaugaaggaggagagucaucauagguaguguucagguauguauauacucuaguuuuggauacaugacaauaauuuucuuuuuaagcaaaggcaaugucaaaaagagguugcaaagaccugcuggaaaaaggagaaaaguuuugcuucaugaaaagguccauggagucaaucuuuacuuacucucgagcucuuccuggagagugaauucuuuacuuuaggcgcucgaugcucaguaaauugugaaacucuucccccucugcguauaggcauuagagacuuuuggagaugcauccagaauuuaucaaacuccucagcaaucaaauaaugauaaauuacaugguugcuuuagugccucgauggccuuguaagacaacugggggaaacagagacuaacgugcccagcuagacuaagaacuucauuagagcaacacggcuauuuuccuaccagcugacuuauuuugucagguuauaaccuuaauccuggagauuuacccccccaccccgccacccuauucucucacacagacucccuaacacacacguacauacaacucaguucuaauguggaugcaaaaaucauuuuauaauguuuauagaauauaagagcaguuggcugaaggugaaacauuccuucuuuugggcaggcucaggggaaagcugcaugguugaacuuugcuugugugccaccccugcccaccugccauugaauuuggcuggagucccugugguggugguuaccuuccuguuaagucuucgccugcuuccggagcccauugaguacaccugagcagcucucuuccccugaguuaacuaugccagccuucaacaguccccuggccuucauccucccuguguuucauguguuggaauacccugcaggaaacugaguccuaagaaacugucaagaucuuggcccuugagccuuguuucugccaguagcccuuugaacgaacugcgacucaagggagagccuggccuuuuugcaaaggcuagcuuuccaauuaaauagcagaguuuuaugguuagaguugagagcucugagauuucauaccuguaucaguaaucccuaggaaaugcacaauauugaccuuuuucacuuauuuucuuauaauuuccauuucaucaugacucuaaggcaacacagguaaugcauuucuggggaauuauuguuguugguaaguaguuggaaucauucauauuuuugcauaguucaucacaucuuacccaaguuguagaguuauuuuccugaaauauuuaguagacccaguguagccaaacagcugagguauuaaguuuacuuagagucaaaccaaaaggaaaagaaaaaagaaaaauagacaaacuaccuauaucuggaagcauugugacauaguaauuuaguagguaagcucuggauucaaacugcuuauauucaaaucuuggcuguucuacuuacugucuguauaaguuuucuaaguuacuucucugugccucaguuuucuuaucuguaaaaugaaaacaauacuauacucaccucacagggugguucugauaauuacauaaauuaauucacauaaaacgcuugaaacacugccuggcagaugguaaaugcuccaaggaugcuaguucuuauuauaccuaaagcuaaucuugaagugcucugcaauauuugcccuugaagaagauggacauaauggaaaaaauauuggacaaauaggaguucuguguuucauugcugccaccaucuacuacauagcuauaugauuuggagccagucuuaguuucgguuaccucgucugugaaauugggauaauaauguuucccuuagcgacuguucaaacacaugcaugcacgaguacacauacacacaugcucacauucaaugauagagaaagagaaaauuaaguuagaacacagauuuuuaaaaucugaaauuacaugaggcauuuugcagauauggugaucuguugccauguauacuauguauacuuaagcuauaaaagagucccagaacaaaauagauuaauacuuuuauaacuauaugguauuuuaugguuuucaaaugagauaggccaucuuguauuuaucacagcuggcuauagcuggcuauugcaagccuuuaggacccagggauaaguuguuugcauauuuuauucacagucuagcagagaguguacacucaguaaauauuaaauggaaaaaauguauuuacacaagugcagucaaucuaaugagacagcaaagaugccucaaaaauggucuuuaaguaguuuuucagcaagugguuaauguugcugacuuuaccuaaugucaggggccuaugauaauuuaggucccaaacaaguugaaauuuguauuggacacaucuuuagagacugugguaugagucaccaagggaagcaauagcccaagccuuuggggcuugggauugcuuaucucagaucuaccuuaucauuaacaagagaguaggcagugagucuuauggcucucuaucuguaaagagucaaaagaaaauuguuacaaugagugcucaguuaguacuuguuaaguauaugaaugacuaaggcuuugggaggggguauguguauaaauguuaagccaauucagauaugauacuucucauuaaugauggaaaggagggcuggaaugcaccuuccaauaacaacggguaagaggagucuguugcuuuuguaaucacugaagauuuggcuguaaagcacuugcagaaauaaaaagugcuauggaaaucuuuaauaacaguuacagacacagugcucucaacaacaaugguugcauacacuacuggcaauugaccuuucuuaggauauuaauuuagugucugagugguuuaagagggaaagaagagcauauaagagcaaggcuauguaaaaugcacacauuaauuguccuaauaauaacacaaaacguccccuagauguuuggcucuuucuuuucaaugacuacaggauauugaaaagaaauacagguuuuuuauuagauaaaggcacuaccagaauguuugcauuuaaaccuuuaaaugcagcuauuccuuuuuuaaggugcagaaucuuucauucaauacuuacucaaaagccuauuuuuauuuuccuaagcuaugguuaguaacaguaagugcuugagagaagaaacuccuuagccuugauuuguggaauuauggugauacgcuauuaaaaaauucacaaguugagaaaacaauagccagauguagaauauauguuagugauuuuuuuuggucuagcuaagauauaauccagucuucgcauggcuguuuggaguaauccauguccucuccucauaaacucuuuggagaaugaccuuuuuuaaaaaagaaaaguuuuuaauuaaauagaaugauuuggugaguccugggagccuuuuaacuacucaguauguggauuauuggaagaacuguaguagaacuuuacuucuuuggguaccaucaggcuuucuuuuguaaagaaugaacuaaaaaaucuaagagugugauccugauacuucuucguaggugucauuucuuagccgugagaauguugaauaaguaagacuauuuuccaaucaaccaagaauuagcugauccaaaugaaauccugggagacagagaagaaugaaaaaaggcuaaggaucaugacuuauaacagaaauaacucaucgagaugacagcacaaaaaauacugauccccaagauucuguuacaagauccagaguuauucuugguguguccacaguaaaacggguuucuaaaccccaguggcuuuuacaagacaaacuguucuuaaaguuuuaucuauuuaagaaacaaguuuucaugugggauucuccuacgcuguucuguuuagcuacuuuccugcuuuuucaagggugucuuuuuccugaacccagugugaaaccagacacauucugagcgaugaugaagguagccuuauuagcaacucccuaauuuuaacauuguuacauuugacucacauuuuuaagauguggaaaaaguaaaaaguuggaagauuuuggaagggucauauacauagauucaaccaagggcauuuuuucuaauuucagcuuuuauuuuagauucaggagauacaugugcaggcuuguuauauagauauauugugugaugcugagguuugggguaugauugaucucaucaccuacguaugaagcaugguauccaguaguuaauuuuuaaacccccaccccuguaguucccaguuucuauucuuaccaucuuuauuuccaugaguaccccauguuuagcucccacuuauaauugagaacaugugguauuugguuuucuguuccugcauuaguuugcuuaggauaaugaccuucaguugcauccauguugcugcaaaggaaaugauuucauucuuuucuauggcuguguaguauuccaugguauauaucuaccacauuuucuuuauccaguccaccauugaugggcaccuagguugguuccaugucuuugcuauugugaauagcgcugugaugaacaugugaguguaugugucuuuuugguagaaugauuuauuuuccuuuggguauauucccaguaaugagauuacuagguugaaugguaguucaacucuuaguucuuugagaaaucuccaaacugcuuuccacagugucugaacuaauuuacauucccaccaacagugcauaggcauucccuuuucucugcauccucaccaacaucuguuguuuuuugacuuuuuuuuuugaaacugauguuuauuuuuugucagccuuauuuccauguugcuuaagagcugauauaagaacagcuuaagacuaaccagugguugcuccuacccauucaguggccugagcaguggaagcggcagaccagucuuccguggcaggcugagcacuccagucuucaguagggaacugcugaauaggcacagagggcaccugcacgccuucagaccagucugucaccucaggcugaguagcagugaacucaggagcuggagcaguccauucacuuugaaauuccuccuucaucacagccuuuucagcagcagucugcuauucuuuuucagucucuucaggaucucuguagaaguagagaucaggcaugaccucccacaggcguuugcaggaaaugguaccacgcgugugcagaacuuccugagccagcauccaccacaucaaacccacugagugagcucccuuguuguugcaugggaugguaauguucacauagcacagaggagaaucugugugacacagagcaauggugggaagauuaacauaagaugccucugugagaggcugguggucagcccuggggucaguaaccacaagaagcugcggcuccugaaaggcugccuggaucugguuagugaagauuccaggagugaagcggccagcaauuggaguggcucccauggcagcagcaaacuuuagcacggcccucuggccaguauuccuggaggauaugacacugacaucagcaggguuuucaauggcaacaaugguacgagcugccagcagaagauucucccagguccucuucagauuuaggauguagaugccaucacuuuuccuuuuauagauguacuguuucauuuggaagucagggcuggugccaccuaaguggguuccugcugcaaggaacuuaaggacacccuucuauuucauuugcaggacaucaagggcuccggacguugugaaaguuuuccucugaguuaggacaggaaucccgaaaaacgcuguauggaccccucugugggcagggcggaaaggcuguuguuuuuugacuuuuuaauaauagucauucugacuggugugagaugguaucucaucgaaguuuugauuugcauuuaucugaugauuagugauguggagcauuuuuuuucguauguuuguuggcuacuuuuaugucuucuuuugagaaguguguguucauguauuuugcccauguuuuaacgggguugucuuuugcuuguucaaauguuuaagguccuaauagauucuggauauuagaccuuugucgaugcauaguuugcgaauauuuucuccuacucuguagguugucuguucacucugcugacaguuucuuuugcuuugcagaagcucuuuaguuuaauuaggucccacuugucaauuuuuguuuuugcugcaauggcuuuugaggacuuacucauaaauucuuucccaaggccaguguccagaaugucaaccaagagcuuugaccacugcuagggaagacaguguugaacugcuaaugagucccugacaagguguuugccauuuauaaacauaaacauuucuauaguugcuacucauacuugugagaaaacauuguugaaaugguauuuuuucuuuaagugguaggcauagcuccucucccuccuucuccuuauuuauuuaccuaccuauuuguuuuuauccuacuuuguccccagaggaauuuaaagugcucuacaaauaugugcauaauaaauguaagaugcaaugcaacugaaauacauaggaacuaucaggcaaaggggaauguaagauggagccagguguaagauuaugacacaaaguacauaaugaaguuuauuaugcuugauagaagcagaccauaaauuuggcccuaagcguucuaguaauaaaugugaagagggaaaaaugaugaguuacccaaauuaugguguccagaagguuaaaauaaacuaguuguucaggaaagcuaaugguggguaaacgagaagagcuaguugggcuaaugaguuggucaauuguugcagacucauacauuuucuaguaguuagagcuauucacuucucauuucugaggacccuuugacugaauuauuuuaauuguucucucugaucuauaauagccuuuagggaaauaucuguaucuaucuaucucuccaucuaucuaucaaaugauauauauaauagccugugaaaagcauauauuucuucuuucuuucacucauucuucuguuccucauugauguacauuguauuuagaagccuagugugugaaauuuaaaaagcaagacuguauauauuuacaggcuggucauggaucugcacaaauaaauugcuuauauuuaauagcaacuuauuucuaagcuuuguccauucuaguuaaauuaaugugaaacauaaaaugccagaaaaaucugacagaaauuggagcaacacuuuuagugucuucucuauuauuuaguuuuuaaaaugugaggcuuuucuuagcuugcaguuucuauguggcugauuucuaaaaaaucauuuaguauuuaaaaauaacauugaaauguguuaccuauuuggcuguuuggguccauuaaccuuuuccagugguuuuuuucaauuaaaauuacauugaugccauauggcaucuauuguaugugaaaacucccuaaaucaugaaagaaaugucaaagcagaucgagggggaaaaagagggagugauuuaacacucuucagugguucuagucacuaauuccaucaagggcuaauuuccaagaucuaguuuuuaaaaaaaaaaauuuaaaagauuaauagaccuuauuuguuuagaacaguuuuggauuuaaagaaaaauagagcaguuaguacagaguuucuguguacucccucuucccugcacaggacuuauucuauuauuaacauuauuagcauuaguuugguacauuuguuaugauuaaugaaccaauauugauacauuauuauuaaccaaagcccauauguuuacauuaagguucauucuuuguauugcaugguucuauaauuuuuuacaaaugcauaaugucuuguaucuuucauuacaguaucauacaguauaguuucaccacccuaaaaucccaugcuucacuuacuuucccauguucucuccccucucaaaucccugacaaccauugaucuuuuuagugucucuauaguuuugccuuuuccagaaugucauaugguuggaaucauauaguauguagccuuucagacuagcuucuuucacuuagcaauagacauuuagaguuccuucaugucuguuugugucuuaaucucucauuucuuuuuauuacugaauaguauuccaguguauagauguaccacagcuuauuuauccuauugaaggacaucuuguuugcuuccaguuuuggugauuauaaauaaaacugcuauaagcacuagguuuugcuguagacaugaguuuucaaauaaauuggguaaccaccaagggacacagcugcuggaucacaugguaagaguauguuuacuuuuguaagaaacugccaagcugcuuuauaaaguggcuguaccauuuguauuaacauucccuccagcaaugcaugagagugccuguugcucugccucuuugccaucauuuguuguuaguguuaugaauuuuaaccauucuaauggcuuugugaugguaucucauuguuauuuuaauuugcaguucccuaauaacauaugauauugaauaucuuuuucuaguuuuuuuuccccaucuguauaucuucuuuggugagaugucuguucagaucuucugcccauuuuuuaauuggguuguuuucuuacuguugaauugcaaguguucuuugaguguuuuggauacaaggccuuuaucagacauguguuuugcaaauauuuucucuuagucuguggcuugucuuuucauuuucuugacauaugcuuuacucuucauucucuuaacauugcagaauggauguuuuucugcuuagugccugauaagucugacuaaucaauuuucaacuucauagauugugcuuuuacuguuauaucuaaaaacuuacugcuaaacuuaaggucagucaccaagaacucccacuuuacauucuauaaguuuuauaguuuugcauuuuauguuuaugucuaugauauauuugacuuaauuuuaugaaaggugaaaagucuauaucuagauucauuuuuugcauguggauguccaauuguuucagcacuauuuguugcaaagauuauucuuucuccauugaauugucucugcucuuuugucaaagaucaguugauuauuguauuugugugggucuauuucugggcucuguauuuuguuccauggaucuguuuuucaauucuuucaccaauaccaagcugucuuuauuacuguaccuugaugggaauucuugaauucaggucaugccaguccuccaacuuuguucuuuugcagugcuguuacagcuauuuugagucuuuuauguuuccauauaaacuuuacuauugauguccacaaaauaaguugcagggauuuugauugggauucauugaauuuauagaucauguuggaaagaauugaaaacuuaauaauauugagucuuucuauccauaaacauggaguaucucuucauuuauuaagauauuuuuuauuucuuuuaccagaguuuuguaguuuucccaaucuguacaccuuuuauuuccuuuuauugucucauugcaguagcuaguacuuuaaguauaauguugaauaggagugcugaaauagggacauucuugccuaguuccugauguuaaggggaaagcaugcaguugcucaccguuaagcaugaugcuagcuguaaaauuuuuuguggacguucuuuaucaagugaagaaaguuauccucuguuucuaguuugcugagagauuuuaucaugaaugauguaggauauuggcaggaaaaacagcaaauguuuuuccugcauuuacucauaugaucauaugauuuuucuuauuuaggcuguugaugugauggauuacauuaacugauuuuuucccuaguuuucuuuauuuuuuaauuuuauuuuaaguuucaggguacaugugaaggauguguagguuuguuauauagguaaacgugugccauggugauuuacugugcuuagcaaccuaucaccuagguauuaagcucagcaugcauuagcuauuuuuccuaauguucucccucccucccugccucaacaagccccaguguguguuguuuacccccauguguccauguguucucauuguucaauucccacuuacaaaugagaacaugcgguguuagguuuucuguuccugcauuaauuuacugaggauaacagcuuccagcuccauucauguuccuggaaaggacaugaucuuguuuauuuuuauggcugcauaguauuccaagauguguauguaccacauuuucuuuaugcauucuaucacugauggccauuuggguugauuccaugucuuugcucuugugaauagugcugcagugaacauacaugugcauguaucuuuauaauagaaugauuuauauuccuuuggguguauaccaaguauuaggauugcugggucaaauaguauuucugccccuaggucuuugaggaaucaccacacugucguccacaaugguugaacuuauuuacauucucaccaacaguguaaaugccuuccuguuucuccacagccucaccagcaacuguuguuucuugacuuuuuaauaauugccauucugacuggugugagaugguaucucauugugguuuugauuugcauuucucuaaugaucaguaaucuugagcuauuuuuucauauguguuuuggcugcauaaaagugugcaaaggacauaaacagaaacuucaugugauaugaccaauuuuaccacagauccuggcauguaccuugcaguuacuucauaaauauuacuuuucuuccuuccguuaagguaccuaagcuugaaaacaaggaccauuuuuuauucuaacccauugugaggcauuuauaccaggaacauaaaaaguucuuaaguauuugccauucuuacagugcuggaaaaauugccuugaaaaaaaauaaccugcuucuauaaggacugccuuacccuaaagggcuugaaagagauuccaugguucauuuauuccucucuucuuccaaacacaaguauauucuccuuuuuuuaaauacccagcuacuacugaaaaggcccauaaaaacacauuucuuccugucugagucugaauacaggaacaucaguaucaaauacuaaagacagucauuuugcuacagugauagguuauauguccugggggguaguagaaguuauugaaccauuuaaagagagguaauacccugauuguacacuucaccaucaagccacaucuggagaauuguaucccuuuuugaacaccauaauuuaaggaggacauugacaacacuggagcauguccaaaggguggugaccagaaugauaauggggcaucuagauaucuagaaaccuugcuauauuaggacauguauuaacccgaauuuauuaagucuauuugccugcaccacuuauuuuucuuuauguuguaaaaaauuagaauauuuucuauccaaugccaaaauguucaugauagcucugauuuuacauuguuuguucaaauuuuuccuggauauaacccuugauuucuucccaggaaagaggcagagggaaaccuccccuaguugaaguguaccuuauuaucugaccaaaaaaaucagugagcugaacuucuuugcaguaauucuagcccuugauuucauuucaugaaaccuuaaguugccaagaaaagcugagcauugcuuuucgccuaguguugguuucuauaagucucccaggagccuuuaguugaccaguuauggcuugguuuguuguccugugauacagaaguaaguggguugggcaaagcccagagaugugcuaaguggauucugagcugcggaaguuggagcagggagcacauaugagcuugagguucaaaguaaaccccuagcccuuuuccccugcaacaugcauugugauuauucuuucugcagaagaguucaugaucuuuuauaauuuucuuuuucuauugauuuaggagugcuaguaacagaaacuuuuaaaaauguuaugacaguacagucaauggaaucuugcuguuguacaucuugcacauuggagaaugaaugcacuguacuugagauaaagcuugccuuguauagaauucauuuuagggaugcuuggaugauugagaucuacaggaguggcauauccacagcagucuuuucccuucucuucauucugcacaaaggcaaaggugaaaggugugacucugcuuuguuggucuuuggguugcaauuucuucuaguauguuuccauuugaagaugggaagccaaugggaaaauaaugaguuuaaaauagaacuguacuuucugcaaagguuuuugagacuauauguauuggcuguaggucgaaggcagcaagcguguaacuguuauggaagacacuaguuugugcugauugcuucuacuuuccugugugaccacgggaaaaugcuuuaacucuacugagccucaauuuugucgcauauaaaaugggaguuguaauaccaaacuuaaaagauuguuguaaaaaguagaugccauaauauacuugagaauauuuuguaaacucuaaaccauauagcuugugaauacuucugaaacaaggaugguuuaucauuuaucuccaucuacccagcauuuaugugccucuagcaccuaguacagagucugauauauaacaagugauugcuagcugaaauuaaaaugaaugaauaguuucaaaucuccaaauuucugaugauuuuaacgaauuuguugacugguccucuguauugggcuagauaaucucuuggccucauccagcuuuuagaaaacaaggauugagacuaaaguagcauguggaguuuggagaguuguuauaagauagagcaacuuucuaggaauugcuuaauguucuaaacaaacaaacaaacaaacaaacaaaaaaaccaagugaacauucaacaacuuacagaaaggcagauuuuuuuuccccagggacacacagcugcaaaguaaucagugcaagcuagugucccucagagacuguuacacucucacugcccucaguacacauauacucaaaaaccuuuuguaggaaguuaaguuuuguuuuaaacucauuauuuucucaagugagcuuggaaacccaauagaacuacacuggcaauuguucaacauugcugggcaugucauaagcccaagggaagaaucuagggagcauguucuacucugggagggaucuggggcagauggugguagcacaaccuagagcucacuucugccacagaugacugaaauguuggacuaagugaucccaaggaacuguuggaguauggucucucuaguagucuaaaagugguaauaauucgauuuuucaaggcucaugaacuggcaucauuuggaguacaucugucauggaccuuugcacuuuggaaggaaauggaaggaaggacuaaguuaauuuuaagugucucaggaaacuuggcuauuuuuguuuuuaaacucugucuuauuucuucaaaagccuauugugguuguuuuuccuucccucauguaaauguagacucugauuauuugaaauaauuugggucugggauguuucaguuuggagaaaaugagauggugacauuacuacuuucucuuucaaaccaaugacacugauugggcuuuaugcaaagggguuggggcagcagauguaaucaugaauuuguggucucuguagagcagauaaggcuuccaagccauguggaagcugaacuuagcaaggaagcuuaguaguuaucccuccggauguucagcuugcaaauaccagagguguuguuuucaauaccaaaugauagauaagcacauggauuauuuuuccacccagauacaaaugcauuggauagauuccauuuccaggucuggcaaucugucagaaagcucucuuuaaaguuaucaggagaaaaucuaccaaaaugauuaaauucgugauagcuuuuauucuuggcuaggaacuugccuccccuccagggcuaaacaggcuuaaauuguugugugaguuuauacaauguaugguuuguugucaaauauuuaucucugucuaaaaaugaaauguccugaaauacaauuucuuuuuaacugaauaaaucagugugagaaagagaaauaacuucucauuuagccaauuuuuaaucaauauuuucaugaaaggccgaaauguuaacugaaucuuggcuuuugucauuugaaauauaauuuguguguuuaagaauuuaugugcacaucagaaucuggacuucauguucagaaaggaaaauugauuuauaggagcaaacaacugcaagaguagaggcaaugccagaaaugaaugagagucaauuauuuaacgcaaaugggaccuuaaucaccacagcaauagagaagucucaaauucauuuucacacuggauuuucaugcuuuaauuuguacacauuuuugugucucuuuuuuuuuuuuuuuuacagaggccuuugaaauuguuguucgccaugccaagaacuacaccaaugccauguucaagaacaacuacccaagccugacuccacaagcuuuugaguuugugggugaauuuuucacagaugugucucucuacaucuuggguucugacaucaauguagaugacauggucaaugaauuguuugacagccuguuuccagucaucuauacccagcuaaugaacccaggccugccugauucagccuuggacaucaaugagugccuccgaggagcaagacgugaccugaaaguauuugggaauuuccccaagcuuauuaugacccagguuuccaagucacugcaagucacuaggaucuuccuucaggcucugaaucuuggaauugaagugaucaacacaacugaucaccugaaguucaguaaggacuguggccgaaugcucaccagaaugugguacugcucuuacugccagggacugaugaugguuaaacccuguggcgguuacugcaauguggucaugcaaggcuguauggcaggugugguggagauugacaaguacuggagagaauacauucugucccuugaagaacuugugaauggcauguacagaaucuaugacauggagaacguacugcuuggucucuuuucaacaauccaugauucuauccaguauguccagaagaaugcaggaaagcugaccaccacugugaguaccagucuacaguugucagaggauuugggccuuauuggggugagguggccaguagcagguacugauggagagaaaugagaacaaaauuggaagguggggaaggggugaugauggacugaaugaccucacagaguuaggcagcauauuaagaccacaggcuaugcaaucguaaagccuggcuccaccuacuuccuuacugugcgauguugggaagucauuuuaucuuuaugaguucauuuuucugauucaugaaauagaaauaaaaagaauaucgucuucauagggaaugacauuuguuaaagcacuuagcacgugucugguaugugguaagucuucgauaaauguuggcuauuauuagcauuauugucaguuaucauaauccucauuauugauacacaauagaugacaagccugugaagugggagcuauuaucuucauuuuauaaaugaggaaacugaagcuuaagugaaauugcaacuugccuaagagcacccacguaaaguuaguggaagagccaugcuucagaaauugaccaggucucccuuuaauuugguuaucaccaauuuuucugauucuaauuuccucuugguguuuucaaucauguauaucacauuagcauuuugaguagugacuucaaacacaaaagacccagcuagaguucacuaauuaaaccucacaagcacauaagcaaggcaaacaauccauguucuccaaugguuuuguuuauagccuugauuauaucagucuaagucugaugaaauucgugauggaggaagggaaguucugugagugaggcagcaguuuccuugguuucagucagauauuguuaguaacggaaucucgggagauaccaacuuccaauauauagcagaacauguagccaagaguuaccagucaguuucccuaagguaguaucugauuccugaaugcugccagcuuuguagaaggagguggcagaauaguauauuacacuaccauuguugagcuuccacuacaucucaagugcuaugcuggcuaguuuacauaauaucauuucauaguaacccaugaaaucagucuuaauaaaccuaaaagcuggguuuuguuuuauuuuucuguuuuagaaauauucuauuucugcuuucugcuaauuauuuuucauugauauacaauauguguacguauuuucaggggacaugugauaguuuaauacauucauacaauuuguaaaggucaaaucaauauaauugggguaucuaucaccuaaauauuugucuuuaugcuagaaacauucaaauucuucuuuucuagcuacuuugaaauauauguggccaggugcuguggcuuaagccuguaaucccaacacuuugggaugccuaggcgggaggguuguuugaggcugggaguucaagaccagucugggcaacguacagaccccaucucuaccaauaaauaaauaaauaaauacaaaaaauuagccaggcaugguggcaugcuacuggggggacugaagugggaggaucaacgcugcagugagccaugaucacgugacugcaccccagccugggcgaaagagugagacccugccucaaaaacaaaaacaaaaacaaaaacaaaaaaaacaagagagagaaagaaauauaugauagauuacuauacacuguagacacucuacugaucuaucaaacacugagucuuauuucuuccucaaagcuaguuaagucagaggagcugggauucaaacccagacuuuguuggcuugguugauagacacccuuagcaucuauacagugcaacugcugugcacucugaacuauugcuuauccaaaauguggaggguggauuaggcuauuucagcuugucuuuaaacucuaggaguaauuaguuucuuuggugaauuaaacuaggaaagaggacaaaaaugaugcaacccucagcauggcuacuuacggaguugcuguaauugccccauucacaauguuagucauuuaaaacacauuuccugugaaaauauuuuauaguaaaaugaacaaaaauguccuaucuaauuacgguguucuucaguggcuaauuauucccuugacugcuucacaauucaaggccagguucuggggccuucugcaaaaguaaauuuuacaaaacuagaaaaaguaaaugcauucauauguucauucaccuaauacugauugagagcccacuguguguaagacacaaagaaagcaugccaggggcuuggaaaugcuuucaguaagaggaaaauaaagagacaacauuaaagacaggguguaggaguguucaaagguugccucugauauuggucauuucauagcaacacaauugaucuggaaaacaaguauccuccuguggugcuuuuauuuauuuauuuauuuauuuauuuauuuauuuauuuauuuauuuauuuuugagacagagucucgcucugucgcccaggcuggagugcagugguguaaucucggcucacugcaaccuccaccuccuacuucuaaucaauucuccugccucagccucccgagaagcugggauugcaggcgcaugccaccaugccuggcuaauucuguauuuuuaguagagaugggauuucaccacauuggccaggcuagucucaaacuccugaccucaggugauccacccaccuaggccgcccaaagugcugagacuacaggcaugagccaccacgccuggccauguggugcuuuuaaacacaugaaaaaaggaggugaggaacuuguaaagaauuaagcgcacuguuuugaucaggcacuagacaugaagguucauuuaggaaacauuuauuaaacaucugcuuuguguauggcacuuugcuaggugcuggauauucaaaacuacccaagaaauaguucuuaagucuugaaaaggucacaguuuaguugguagacagacguguaacugaauacauuucaccauagugaacacuucaccauaaugugaauguugaaagggcugugagagauuagcuaguccaaucccauugauuuacaaaggaagaaauaaaguucagggaggcuuacccaaaguuauauaauuaauggaggaaccagaaguagaauccaaggucuucugcugcuacaauguaauacuuucuccauaauaccagucuguccccgcuuagaccccccuagacuuuuacucuaagagcuccauuaggauuuugcaaacacguagugaaccuaaauuggauagcaauuucuggcugccaauccugcuacauuuuaggugcaugcacaugcgugcagggggagugcauuucaugucauuaucauucaggaagaaaggcuuuggcugucaagaggugcucagugaugcaggcccuuucuguuuuggccuuuaagggccugauugcucccagcucccagcugguuaugagagugugaauucugccauccccggggaaugccugaacuaaaccagaaaacauauguaaacucugccuuguucauguuuuaugaucaccaacucuaaguaauacguaccaaaugguggggguaggggaaucacuggccagaugugauccaacccauacucaguacgggucaaaaagggacugggcauuuaugagggcgagggggagucggagcugcagaacucuauucacauuaacaaacccacagaaugccccaaagcaaaagcugguuuaaaacuaaagcuuuaaugagauucuccaguagcacccuaaccuuccuguugcgauaaaauguaaaacccugccauucaguccugcuugagguucaguuguggugagagacuucuuuaaaaauauccucuuccugagcucugcugggauauccuuucgagcuggcuuuaagccaugacaugaggucugccacacagagacuuugccuaguuguuuuuguggcugucaucuacccagauuaugaagauuguuuuggucuucuaagugagugugguacuguucguuuuuuuaaguguggcuuguuggugcuuuaguuuucucuagcauaguucucaauacuucagacuaccaagugaaggcaggcagacaaauacugggguguugucgcuggcagcaccacuggaggugguaaaggauccuguucucaaacucggcucaucaucacaaucaccuggguuacuuguuagacacauuccuggaguccaccccugcagagauucuaauaccaaaggugugugaagagaucagaugauuuuguuucguuuuguucucuuuuguuuuuugagacagggucucacucugucacccaggcuggagugcaguggcucgaucuuggcucacugcaaccuccgccuccugggcccaugcgauucucaugccucggccucccgaguagcuaggauuacaggcgcgugccauaauaccuggcuaauuuuuuguauuuuuuuuguagagacgggguuucacuauguuggccaggcuggucucgaacuccuggccucaagcaauccaccugccucagccucccaaagugcuaggauuacaggugugagccaccgugcccaaauuauuuuuuauuuaagaaaugucccaguugauucugaugcucccuugggagcaaauccagccaccucguuucgaagauaaagaaaauaagccccagagguuggaagugaauggccuaaguuccacaggcaauuaguggcaaagcuaggaccuugaauucuucaucuauaaaauggggucaagauauggcgauuaaaugcaguguuagguucaggaacauggcaaguauucacuaagucccaguccaguacucuuucuuacuacagugaucuaagugccaaaugaaaaaugaguuuuucuuaaacauauuuuuaggugccaagauaucuuaauguuauuuuagucuaaacgaaguaaauaaaaauaguaugugugagaauguaugugugugaauacauguguuggggggaagagagauggagggagggggaaagagaagauuugugcugaaaaguccaagaaaguauuaaugaugagacuauaaauagauccguuuugcaaacugagauaaauaucuauacaaacuaggauaaauaucuuggccccaagugagaauugaauagaucuuuaacaguauuugggugaaaguaucacuguuaaauuuaucagugcauuauugaauuccacaucuuauaccuuaaagcaacugcaaauauguaccauuuugcaauacauauauuuucaguguuguuacacccaaacugcugagugccacagcuucuuuuuaaaauaugacuguuuuuauccugaaaaccauuuugauugcuguuaccauauaccuauguguggacuauaugcauagccauugcccauuucauguauaauucauccauuuacuaaaugauuaauaauuagcauguuggauguuuaucccucuccuggaaacuuucccaaaacuuucuguaauuuuguuuacuuccuuuaauccccaaaauaacuacucacaugucuucacauggugguuugcacuuuuauuuuucuacuuguacacacauacauacuuuauugauucaucucagcauuucucagaguuagugcuuccucucccacaauuucauuaccuuggcuuguucuaugcuuccuugaauauuguguagaauugcaaccuuuucuaccaccauuacuucucccuuucuuuuuucguugugauauucauuuuagcacuaucugaaauacgauucguugcaggaagcauuuauugagcaucuaauaauggaagcacuaugauagccacuggggaucagagggaguagcuggaaagaugcacaugacucuguuguguugcccucagcggucacuuggcuaguagguggcagaacuaguauuuaaagcugaaccugucugacucaaaagcucaugcucuuaaccauuacucuauauugcucucucaagcaguuccauucucuucagcagaaucuuuuuuccccaaacacagacuaaguagguuuuuauuauauuauuuaauauccuguauuacucccuacuguuuuuccagcugcacaaucaguuucugaauucauucucccuccuuggagacuuuugcucuaguauuucccaaugaaguacuaaaaggcaugagauuuacaucuuccuaacacuuaaaggaacaguguaguuucauggaaaagaaggaauguuugugcaggugauggaagguccagucacacagucagaugacuuggccuagaaucuaugugagcagugccgguggugagaaagagguucucuuccacuugcaaaguuggaaaucugccgauuggaccaacacauaguuuuuaaugcaucugccuuugauuccggacaguagaagaacaucagaucuccaguacggaguguccuugguauuuaauaauaguaacauugccuacugagaaccuaacguauccaaauacauccauuuccuuugcuaggauuucugaggucaguauuuauuuuugugugccaggaagcucuggggaagauucucuguugauccucaauaauaauuaacuccaucaaacucuuauauuuugcugucagugugagugacuguaacucgucagaauuuccaagauuagccuuaccuuccucuccacuguugaaggcugagguuauuucucaggugucagaaugucaguguuuuucuccucaugcuaucacuuuggacuuucauuuuucagucucagauagagauaccuugucugaauucauacaagcuguuuucaguaccaagugauuugaaagugauaaaaagaaguaaauggcucacuaccuaauuagugucugcaggucagccucuagaacaaugguaagcaacuuuacuuacacaagguuuauuucuggaaagacaaaaacuguuuacagguugccaucauuuuuucauucacaaucaaaauagcuucagugauuuccauggagaaaauacguaguuuuaaaacacacauuaccuauuuauugcaagaauacaaaugaaaaaauuggcaccauguuuuaggcaauaaauguuaacuuuaugguagguuucaaaaagugguuacauaaggggagcuuuuuaaaaauguuucauccugaaauuauacguauauuacaggucauauuaagaaauuagauggguucuucauaaaucuagaauugcuugcccuugccuuggcauaaucgccaguugcuuauauguucugaauuuuuagagagaaauuuuacauccuuucuguggucaguggacugauguggcaggaacacauccucaagagcugugaaagaucugagauuuuuacccugauugcaagcaaacaagcuagccuacugcaguuucaucgauguuaguuaauggcauaagacuccugagucagagaugaaggacaguuuauugcuuacagcaauagcagcagccagaguauuagcauuugugccagaucccugagucccaauucccacaggguaaggcaaagagagcugaaugacuccuguacacauagugaguuguauuauaggagagaaacuuugaacuuagggaacucaaauauuuuauaauagaugguaagcccaccugcuguuuacucuaaagggaaacaucaucucuaucuuccaaggcuguuggcuauacaaagauacuugaaaaggauagucugaaacaaaggguagucaguucgucuguuccuaagacaugccaaagcacaagagauccauggagaauugucuuccaacacauggucccccacccuuggauggcuccaagaacuuuucaaguucucaaugcuuuuggaggaucuggcaaggaaauuagaaguuaguaaaagacaguuagcucaacccugacugauuggccaaaaagcaggcccaugugccaccuguuggaggguagcagaaggcauaucuaaauacugagaacaguggcaguuuucucagcucuucagagaauacuuuaaagagaaaguaucaaagaggcaccuguuuguugcuucucauuagcaguaaauucugcuacugugggccuccagcuacuccacugcucucuuucagucucuaagcugucauuuccuuucuugcucuguucaggcuauaggguugggaguuuuguguugcuaagugacuuggcugaauuaaguuuucucuuuuauugaacuucuagggugaagcauugugaugaccacagagugguaggcacaugcuuauccaugccugcuggcagugacacucagaguguauucagaaaggucagaaagccagggauauuugcccaaguaggcagaaguccaagaagaucucaccauggccugauauucugaguaccccugugguccugagacaacagugagggagccaacaaugccuuuuuuuaaauaaacuuuaaauucugggauacacgugcagaacaugcagguuuguuacauagguauacgugugccauggugguuugcugcacccaucaaccuguuaucuacauuagguauuucuccuaaugcuaucccuccccaaccccccacccaccgacaggccccggugugugauguuccccucccuguguccauguguucucauuguucaacuccuacuuaugaaugagaacauaugguguuugguuuucuguuccuguguuaguuugcugagaaugaugguuuccagcuucguccaugucccugcaaaggacaugaacuccuccuuuuuuauggcugcauaguauuacaugguguauauguaccacauuuucuuuauccagucuaacauugaugggcauuuggguugguuccaagucuuugcuauugugaacagugcagcaauaagcauacaugugcaugugucuuuauaguauaaugauuuauaauucuuuggguauauacccaguaaugggauugcuagaucaaaugguauuucugguucuagauccuugaggaaucgccacacugucuuccacgaugguugaacuaauuuacacucccaccaacaguguaaaaguguuccuauuucuccacauccucuccagcaucuguuguuuccugacuuuuaaaugauugccauucuaacugacgugagaugguaucucauugugguuuugauuugcauuucucuaaugacuacugaugaugagcuuuuucucauauguuuguuggccacauaaaugucuucuuuugagaaauaucuguucauaugcuuugcccacuuuuugauggguuauuuguuuuuuucuuguaaauuuguuuaaguuccuuguagauuccggauauuagcacuuugucagguggacagauugcaaaaauuucucccauucuguagguugccuguucacucugaugauaguuucuuuugcugugcagaagcucuuuaguuuaauuagaucccauaugucaauuuuggcuuuuguugucauugcuuuugguguuuuagucauuaagucuuugcccgugccuauguccugaaugguauugccuagguuuucuucuaggguuuuuaugguuuuagguuuuacguuuaagucuuuaaucuaccuugaguuaauuuuuauauaagguguaaggaagggguccaguuucaguuuucuacauauggcuagccaguuuuccgaacaccauuuauuaaauagggaaucauuuccccauugcuuguuguugucagguuugucaaagaucagaugguuguagauguguggcguuauuucugaggccucuguucuguuccauuggucuguauaucuguuuuggcaucacacugccugacuucaaacuauauacuacaaggcuacaguaaccacaaugccuuuuuaaaaagaugucgaguggcuagggaaucagaguacagugaaaguagccuccuaccuugugggggcagaaaagccccuggauacuugcucccuucauuagaaaagcugaaaugccacacaaaacagagucauauacacugugauuucccugugauuaaauuucccccacuuggagcaagguuccucuuggcgaguguaguucugcauuauccacucacaauggcaccacaaguaaccuuggcucacugaccucuuaugcccaugcauuuugcuaucuugcucagguaucuggcagaaaaauguuuucuaacuugacuguuucuuaaaaggaccauucguccugccccuaccuuaaaaauggaaaacauauucgaauaucacagaagcauuuuuuaaugaaguugcacuguccuauaguaauuuccucaagggagguggcaauuuuaauacuugcuguaauaaagaauuuuacaaagucaaagauaagggaauucugagcagaugucuuccagcauguugcagccuuuggaagauaaaauacaaauuucaucauuaccagcaaccacaauuuucugagugcugagugcugagcacuguucuaggucuuacaguuuaccuuucccuuccuuguccgggggacuguuaaugggguaaaacaaauagccuuuguuuuggugaaauuacagauuucuuaauguccuuuuaaaaugccccuuugggaaguacauaauccagcaaggcugcuuucuuauuucauacggggggugaggggaggguuguugcugccuccuuauuacccaauucaaauucauucugaagaauauucagaaagugaauuaauuuuucccuuuuucguuccacucagaaugccuaaaacagauaaaguaggaagcagagucauuauauuugggugcugucuauuaucauuuacugagaaucuaucuaagccuuucugcuuuuugcagauaauuaauuuuguuccuaaauguagggaagagugauuguaaucaguguguuuguacuuucagccacaaauagagcccaucaaagauaugcaguacaaauaaaccucauaaaauaugcagcccaaguacugcucaaaguuaauguucuaucuuuuuuuccaaagaaaaaauuuuauacacguuauaugauuuuuaaaagucauucuugguauuuucauauaguuaauagaugggccccucuuuuucaaacucaaaccuaugcugugaauuauuuuuuaucauuaaaucucauguaguggagcugaaggagacugauuuggcuuagaaaucaucucagcaacauauacacauuacugaguucuggguguggguuucucuuaugcuuccagaaaauaaugaaugaucagaucuaaguuacaggcucaguuucauggaugaaaccccacacuaagagcaugguguuugugaaugaguuccucugaacucuuuuggaaagcuuuugcccuucuaucccagcugccuguccccaaccucuggccaaugccuacacuaagcccaucccuuuuccuucugcuucagauuuguaccuugcucuguucuguucauucaaacccuguacuuuauuuagaguggugaugugugauuaugguuuagucaucacaggaagcccauuucugcuucuacuaguucucuaaugcauuccuucucuugagaagcaaacuucauuagcaaaguuaucgcuagaaaacucuuaaaaaggauuauugaaaaagguagaucucagucacugugaugcaguuguagggagaaauauuuaaguguaugugggaccuuaugaaauuaccuacuauacauuguaaguuauaaagaacauucauucagaauuuugauacaggaucuuugccuugugcugccacaggcaaguggccugcgaaaagcaacuucuuagugucuguuccuuaaucuauacaacgaggaagaugaugacaagagugauuauuuaauaagcacuugcuaugugccucacacaauucuaagcucuuuacauggaucagcucauuuaaaguuuacaauacuaaugagacggggauuaucauuaccuuuuuccuaguuaaagaacugagacagagagacuuggaagcaggugccagcaacaaggcagcuucagcuaauugcucucuacugcagcaacuuuugagguacaucucuugcccagaaccagacccagucuuagaauauaugggcauggcuuggccuugucugcagauggauauaagcugacucaguugucuggaaugaggcaggauggggagccagaaguuauuaagggucuuucauucuugccuacucuuucaguuacuauucauccuguuuucuacguguggccuugagaauugcauggaaacuuccaaugggcuuagcuuuucuucucugcuuuucuucauauuuguauuaauuaauccuaauuaaaguuuucuuucuuuuuuuuuuuuuuuuggcuuaaacaacagaaguuuauuuucccacaaauccagggguugaaaguccaagaucaagguucuggcagauucagucucuggcaagggcuuucuucuuggcuugcagauggcugccaucucauucugucuuaacauggcuuucccuuggugcaugugaacccuguggggaaagaggaggacauagagagagacagagagagagagcauaaccucucugguaucacuucuuaugaagacacuaauccuauuagaucagggccccacacuuauucagagaugaggccucuaaugaagugauuaagauuaaaugagcuaacuaaauuuuucuaaauuugcuuggaguucaggccucccccagaaucagggccuauuucauuuacguuuuuuuaaaacaaacaaacaaacaaacaaacaaaaaacccacacauucauucuugaugagcuuuuugaaaaaauacuuuaaaaaaguauuuuaaaaaguauuuaaaaguauuuaaaaaauacuuuaaaagauauagggcuucuacauuuucucucuuucagaucagaaauccuaagaauugugaaauaccaagcucugugucuuucuuauucuguuuuaaacccuguaaugaucucuuuccauacauggaaggaguucccuauuaacuaaguuucugauuuacucaacugcuuauuccucuuaacaaauuauuaaugcaaaaugaaugaguuucuugacuguagcaaccugcuagcauauuuuuuuaaaaaauugugaacccuuuaaauaaucuuugagcaguuucuucacaaguucuagacaaaaaagcagggaacuaaacuaauguccuuacucugguuaaaaauaaagcaauaauugugacaaauugguauaaucagacuugacagauagaagcuauagaauucauguuagauuucuaucagucugaaaaggauguuaacaauucccagaucacagagagugaaagaauacacagugguggaaacguuuuccucacacaucuguguuuaucaaguuuuaaagucuguuuccuccccuaccauuucuccugaaucuguaauacauugauuuaaaaacaauuaaugcaugacucaaacugcucugcucugaaaggccccauucagaauugucucgguucugguuagcauugaccgaaaacucuaugagauaccaggaauaauaaauuacaacaaacauucauuuuuaauggcaccauagagauuuuuaagagcaaaccuuucuagauggaaagcugagucaauacccugcacaggaauggaucggcuuggcauugcaaggagcagaggaagaaaagguugugugaugcagugaaaagaacaugggcuucaggaguuaaaaugugacuuucucucucucuguuuuuuaauuuauugagacaaagucucacugugcugcccaggcuggagugcaguggcgccgucucggcucacugcaaccucuuccaccugggcucaagugauccucccaccucaccccuugccccaugccauaagugggacuacaggugugcaccaccaugccuggcuaauuuuuguuuuguuuuguuuuguuuuuguuuuuguuuuuuuuuuaguagagacagggucuugcuauguugcccaggcuggucucaaacuccugggcucaagugauccucccaccucagccucccaaagugcugggauuacaggcaugagccacuacaucuggccagacugugaauuucuauucagcuguucuuuuucuuagugaccugaacauguaguauaaucucugagccuugguugcuucaacuauagaauggggauaaaaauaccaaccucgcagaacuacuaugaaaauuuugcaacaaugccuaccacguggcagcacuauaaaaucugacauguaacaugaucuauuuaaucugcugugaggcaaaauagccuuuucuuccuaggccuucucucacauggaggcacucaucuuugggguacucucauuaguagcaccaucauugauaaauauuuacccgacuucugugacaaaggcccuaugucaggagcugccaacacaaauacacuaauauccccauguccacagagagauauguuccaagacacccaguggaugccugacucccaguggaugccugaaaccacagauaguuccaaacccuauauauacuguggguuuuuuuucccuauacauaccuaccugugauaaagcuuauuauaaauuaggcacacuaagacaguaaugacaauaacuaaugaugauaaauagaacaacuccacccuuuccuacugaaguuccugcuagucuuugcauucagaaauugcugugucucugaacaaguuuauucagcauguauggcuguaguccucugcuucuauuugcccagccuuugccacuaauaaccaggagaaucaaucauaucccccagauguucggauaaauugauucacagccaagcagaccaaguugaacacacagguuuuguaacuacucacaguggucuucacagaagacucaugaauaaagggcagugugauauaucuggauucccuauggggauuuuuagcauucaucuucuuuugcucggauuuagugcugaaaucccugggaauagagggaagacucaagcuguguuuauggcuccuuuguuuuggagugugaauugugcaguauaaugcuaaauugcuuuugcuggguaccacuguuaaaugaugauuaaauuuagguuggguauaaaaaugaauagaugucuauuacaaaucuuugggauaauuuaaugauaucuccuuguuuuagauauuuuccuuuuauuggguccuuaaauuuacuugucuguucuuaucuauccugccuacuaagagucuuuccucuuuuauaaugaaucacaacuaccuuucugacucuugggauuacggguuaucacuguuucuuugauggaaggaaagggagaaagcaaugacagugggagugaagggaguuuaacaggaguacaaggaagaugaaaggugaaucacaggccuggugcaauggcucacgccuguaaucccagcacuuugggaggcugaggcgggaggaucccuugagcccaggaguucgagaccaguggcaacauagcgagaccuugucucuacaaauaacaacaacaaaaaguagcugguguucuggugcaugccuguggucucagcuacucgggagccugagcggggaggauugcuugagccugggagguugagacugcagugaauugugaucacaccacuguacuccagccugggcaacagagugagacccugucugaaaagaacaaaaagugaaucagaucauuuugaaaaugauuuuuuuuccagacauaugucuucugcaguauuuacuuaauguuaucauugccccacucaugcugccacaacacaaaugucacaaauucuagauuuuaaaaauauagaaaaacauuaugucucaacuaugauauauuugccauuuucuuaaaucaaacagcaguuuuaguaugugagacuacuauucucucuucauccccuaguauaccucaucuuacacguaauagguauuuaauuuuucucuuaaaucaagaaaucaagcuaaagggguguggaguucauccuugggagagugaggagccauugagaccauauggaauguggaucuccaccuacaaaaucagaaguauaagaaagagugcucuuuuauuuauguuuuugcccuucuuuuuuuguuuguuugcuaauagacuuucuuuuuuacagugcuuucagauuuguagcaaaauugagcagaaauuacagagcguuuguuuauaccucuuaccuccuccacacacacacccucccucacuagcaauaucccucaccagagugguacauuuguuacaauggauggaccuacauugacacaucauuaucacccaaagccugucauuuacauuagguuucacucuugguguggcacauucuuuggguuuugacaaauguauaauggcauguauccaccauucuaguaucaugcaaaauugguucacuguuauaaaaauguucugugcuucaccuguucaucccucccucuccacuaaccucugauaaccaccgaccuuuuuacugucuccaugcuuuugccuuuuccagaaugucacauaguuggaauuauacuauuuucacauuagcuucuuucacuuaguaauaugcuuuuaaguuuacuccaugucuuuucguggcuagauaguucaucucuuuuuaguguugaauaauauuuguuuggagcaucuuuuacuuuuauauuaauugaauuucaaguccuaaucauuauucccauugcauuagugguaaauuauaccucauuacuucuuuuuaaaaacagcuuuauugagauguaauucauauagaauacaauucaucaauucaacuauuucaaaugugcaauucauugguuuuuaguauauucauggagcugugcaaccauuaccauaaucaauauuagaagauuugcaucaccccaaaaggaacuuaguaccaguuagcuauuacuccccuauuacucuccaucuccccugucccccauaccuggcaaaaacuaaucuggcuaucugucucuauagauuagucuguucugaacauuuuacauaaauggaaucauaaaauauauggccuuuugcaucugccucuuucaguuagcauguuuucaagguucagucacauuguagcauggaucaccacauuacuuuuuauggaugaauaauauuccauuguauguauauaccacauuuuguuugucuauuaucaguugauggacauuuggguuucuuccacuucuugguuauuaugaauaguguugcuaugaacauuugugcacagaucuuuguguggauguauguuucaucucucuugggaauauaccuagcaguagaaucaugggucauaugguaacucuauauuuaccuuuuugaagaacugccaaacuguuuuccagugaagcugagcaauuuaacuuucccaccaacaaugugaggguuccaauuucuccacauccacaccaacaauuguuauuaucuaccuuuuucuauuacagccauuguaguggauuuuaagugguaucucauuguaguuuuaauuugaauuucccuuaugauuaaugauguugggugauuuucaugugcuuauuggccagaucuuuuuugguaaaacgucuauugaaaucuuaaauuuuaaacugggcuauuugucauuucauuguucaauuguaaggauuauuuacauauucuggauacuagacccuuaucacauacaugauuuacuuuuuuuuuuuuuuuaaacagggucucacuaugucaugcaggcuagaaugcaguggugugaucacaucucacugcagccucaaacuccugggcucaagcaauccucccaccucagucucccaaguagcugggacuacaggcacacaccaccacaccaggcuaauuuuuguauuuuuuguagagaugagguuuuaccauguugcccaggcuggucuugaacucaugggcucaagcaauccaccccccucagccucccaaaguguugggauuacaggugugagccacugcccccagccuauaauuauuuucuccuauauucugggaugucuuuucacuuuccugauaaugucuuuuuaacucaaaaauuaugauuuugaugaaguucaauuuauauauuucuuuaugugucauaucuaagaaaucacugccuaauccaagggcauaaagauuuauaccuaugauuucuucuaagaauuuuauagaaucagcccuuaaauauaggucuaugauucauuugagcuaauuuuuguauaugguaugagguaguggcacaacuucauucuucuauauguggauauccuuuugucccaaguuccauuuguugaaaagacuguucuuucccccaugaauugucuuggcacuaucaucaaaauucaauugaccauaaauguauguaggguuuuuuuugacucucaauucuauuuuauugaucucuaugucuaucauuaugccagugccaugcugcuuugaauacuuuguagcaaguuuugaaaaugggaagugugaguucuccaacuuugcucuucuuuucaagauuguuuuggcuauuuggggcccccugcaauuccauaugaauuuuaugagcaacuugucaauuuaugcaaagaagucagcugagauuuugauagcgauuguguuaaaucuguagauaauuuaggagguauugccaucuugacauuaagucuucuaauauauuaaugucuuuucacuuauuuauaucuuuaauuucuuucaaugauguuuuguaguuuucaguauaaaagccuugcacuucuuuugcuaaauuuauuccuaaauauuaucaucuucaaguuauuguaaauggaauuguuuucuuaauuucauuuuggguuauuuauugcuagaguacauaaauugauuuuugcauacugaucuuguacccacuagcauuacugaacuuguuuauuaguuuuaauuguguguguguguaagugagugagagagagagagagagagauugucagucuuugguguuuucuauacacaagauaacauuaucugcaaauacagaugcauauacaguuucauuucuaccuuucugaccuguaugcauuuucuuucuuuuucuuuccuucccuucuuccuuccuuccuucucucuuuuuuuuucuucuuuccuuuuccuuuccucauugcucuggcuugaaccuccaguacaaugucaaauagaacuagcaacaauggauaucccugucuuuuuccugauuuuaggugaaaagccucagucuuuucccauuaaguauaguauuagcugugacuuuuuuauaaauacucuuuuucaaguugaggaaguuccuuuguauucccaguuuuuugauuguuuuuauuaucaucaaagcauguuggauuuuauuaaaucccucuuuagaaacugaugagauaaucaugggaauguauccuuuauucuauugauaugauauauuacauugauuaccagauguuaaaccaaccuugcauuucugggauaaaucucgccuggucaugguauaugaugcuguuuauauuuugcuggauucaauuugcuaggauuuuguugaagauuuuuauaucuguccuuaugagaaauauuggucuauaguuugcuugugauuuuugucugcuuuugguaucaggguaauacuggcuucauagaaugacuugggauguauuccuuccucuucuaaagaucuucuauuuggaagaguuucagaaggauugguauuaacuguucuuuaaauguuuuguagaauuugccaguaaggccaucugauccuaugcuuuuuuuuguggaaaguuuuaaaaguauuaacucaaacucuuuguuauaggauuauucuaauuuuuuauuucuuccugagucaguuuugauaguuuuuagaaaucauuuuggaauuuguacauuucacaucugcuaucuaauuuguuggcauacaguuuuuuuuaauauucucuuauaauucuuuuuauguauauaaggccaguaguaauguccccccucuuucauuccugauuauaguaauuugaguauuuucucuuuuuuuguuggucagucuagcuaaagguuuaucaaaccuguugaucuauucauagaaccaacuuuugauuuugucaguguuucucuauuguuuuucuauucuagauuucacugauuuucacucuaauuuguuauuuccuuccuacugcuugauuuauguuuaaugugcucuucuuucuagugucuucaggcaacaauuuagauuuuuuaaaauuuuuauuucaauagcuuuugggguacaaguaguuuuuuguuacauggaugaaauauauaguggugaauucugagauuuuaguccaugaaucaccagaguaguguauauuguaccuaauguguaguuuucuuuuuugucucuggcuuuccuuucacccucccccuucugagucccuaaaguccauuauaucacuuugcaugccuuuguauauacucauagcuuagcucccacuuauaagugagaacauacaguuuuugguuuucuacuccuuuguuacuucacuuagaauaauggccuccagcuccauccaaguugcugcaaaagaucuuauuucguuccuuucaauggcugaguaguauacucagguugagaccaaccugggcaacauggucaaacucugucucuacaaaaauacaaaaauuagccaggugugguggugugcaccuguggucccagcuuuacgaggcugaggugggaguaucacuugaggcuggggggucgaggcugcagugagccgauugugccacugcacugcagccugggugacagagugagauccugucucaaaaaaacaaaaggaagaaagaaaugugaacucuugauaccaagguucuguaguggauugccuccaaagaacugaauuagaggcccaagcaaggggaaagcugcacagggaauggaggaauccauucacuuuagaugccaauuugggugauuuagauccucuacagaucucuuucuccugaacuguguauuuguuuuucuuuuucuuuuuggccagaaauuaggaggugguaggaugagugaagccaucuguauaucugcccuaaucucuccaucauuuugcuugacuagacuuaucauaaggaugauuaaagguuucucagcacuugagaauugcuuauuuuuuuaccucaccuuugccuuuuaaagaagaguuaguuaucauuuacuuucccauccaauucuucaguuuccuuagucaauuaauuccaugccuauccuguuuguuuaagguuuggggcagcccagacgaacuaaccuagaccucugauuuuucucagguuauaaaugcucuguguucccucauccauucucccaacuuugauuuccaccuauuacucuggcuuugucaguaaguggcuuaagauucaaguucccuuuuugcuccuuucaugagcccgccagucagacucuguguggaugcugcuuucuuuuuucccagauuuugugauugggucccugaucucauguuucauagauccuuaucugggucucugaaccuugcauccugauuguacaggacaucagucuucccaggaucuaaauuaccuaccuguuucuccuuuauuuccuucacacacuucucuuaauacagcauuuagacuucccagcuuaaguauuagccagaaacccuaucucacguccaccacagccaacuauccuggauccuggccuuggauuugaaagugacagcaaaagaggaagaacaaaauacucauugaaugcaauuuguaaggcaaugcauaguuuucaagaagcagcaagugaagacaucuauugggggagcucuacucugcagaaugaaagaggcuauuggaugaaaaaggaaacaaaccuaucagcccagcaacuaggaaggcuuaacguagacagggcagacauuuccuuguuuugucuuuucaaggcagaauagggagauuuaguugguuggguguaguagacaaaccagcaaaguagaaaagugaggguuagaaauauggcaaaguaaucaagugagauauggcugccuuuugugaagacaagaaaaacaaauacuaaguggguacuuuuguagcaucuacaaguucuaugaucaaagaaaaaauguaguagacaaaccagcaaaauagaaaagugaggguuagaaauauggcaaaguaagcaagugagauauggcugccuuuugugaagaaaggaaaaacaaauacuaaauggguauuuuuguagcaucuacaaguucuaugaucaaagaaaaaaaucuguaaauacuucaagaaguuugcuuuuguacuauauggcuaauuuaaaaaucaacuuacaggggaaagugaaaugcuuaagucuagaaauauagauaaauaguccaaagucacccaugcacacauguccaagaaaggccauaugaccuggaaauuuuuuuuggauuagccccauggcauuuauauaaaccaggguucuucucuguuagaggugccaugggagguauccucugaaauuacaagcuucccuuaauggucuguucuucaaaacauccuagagaaauacuguucuuggauuaggaccuuuguuucuguuaucaaaauuuucuccucaucucugauccuguaaaguauccucacuuauccuugucucuccuuccucuuaccuaaaguuugugguuuuuaaaaaaucauuucuucuuuacuuuccauuuagaaguagagaacgacaucuggaauggcccucaaauaucuaguuuuguuucuucauuuugaagacuagaaaacugaggcauaugauuuaaggcaaaggaauugccaaagaucaaccaguuaaugucaaaccagaacuaaaacauggcuucuggcaauaacaccaguauucuuucugccauaccuuccuuuuuuuuuauauaugacauuguaugcuucuaaggcuuauuuuuagacuuauuguaucuucugcuaccuaaaaauauucaaauuagcaucuaagaugcuucuugauuuucucugcuuuuugauuguaggauuccuagaaaucacaauagaugcaacauuaguauguauuucaaugcacagacuauuaugagcauuuuuaugugaaaaagagaaauaaaauaggcagaagaugacauuucuugccaagauauuuucggaucuguguuuuuacagguuaccugagaaauuguuuaugaugaaggaaucaaauauaaauacgcaguugagacuaggagaaccucugaaauacggcucacuauagaaauagugaauaaaaacuuucagucuuguuucucucagcuuugacuguugcauaagucuaagcaaaucaauauaaaaguguuucucaaaaugugcuucaguuauagccaauuaaaggucaacauauauaauuuacaugaaauggaugggcaggaacaaaagguaucuguugggccaugaggaaugauucuauuucauuugcagaugaguacuauaaaggucauugaaaaugugagaugcaaaucauuguuuuuuuaauaaagcauuuuuucuagguuuggucucucagccuguuuuauuuuguuguuugcaugcaugccacagucauuaguacaauugaauuauagaaugaccuacacuauuagacuguuagacugcuugauugaaauugucuuuauaauggaaaucagagaacacuuuuaaccuuguuagagcaucacuguaucguugauuaauauauaaagcaauucauaaauuucacagugagcuauuuauuuccagacaaucuugugaaagcacuuuggucuauauuacagaaacuuucuuuauaccuuugucaggcugacauuaaugauucugauuauuucuaggacuuucaaaguaucagcguuaauuaaacuaaugcuuaaaaauaugcguagaaaagaaccuuugaauguuacauuuaaauguuugacaauguguaugaagauucuuuuguuaccugguuaauuuuagagaacugacuucauuugauaagguuucuccccaguagcaaaugcuuagcuaaguagcaguagccaauacugccaaggucacagcuucgucuauauacucaauacauauuuguugaguacuuuugauauguucuucacuagauauguaauacagauagagagaugaaaaagccagcaccugcccucaagagaguucauagucuagugagagucacagaaacagagaucagccuaugcccaggcauuaugaucgcacagauuaagggaguauuauuuaacccagccuggguaggacagggaacuuguccuagaggaauucccccugaaugaaaacucuucuaaccacugaaggggugagggaagggucugugagaaauagaugacugcugggaaggaacaaaggaaacuuagggcuuggguggagacugaggaauaauggagggaauaggguccuuuuuacuccaguccggaacucauuugauggcccagauacauguucugagcaguaccaaaccacucaaauccugagaccuaacauugauccugggagcaaggaugcuguuauacugccuucccugaagccccacuaaagauggcucuggcagcaagaggguaacaugguggcuagagaagucaggccucccacacuggaccagccaccugcauauaugggagguuuggacacaggagcuuauaagucugggaggcccuggacuaguuccagaaaagaaaacaaaagguuugggagugaaaaaacugguccuuuuucuaaagaaacuguuuucuauaaaaguguaccuuugcuuuuagacuauuagggggauauagaacuaauuaagagaccugaacaucaucaauauuuuucuacuuaacuuuuaugaguaguuaauuuuauaaaagccucugugaagucacugguggaaaagcuaaugcacagcuuuucagcauauugcccuucaagacucagguuauauuuaaucauaaauugcauacaaauagcuaauugcuagcuucugcaguaaaauguauuuguugucucaaauuggauucauagccacaaaagucaagccauagccagucuuuguagaggacauugcuaaaggagauacuaagccaaaugaccugcauagauacagugcugagaggccacuaggccggacugguggacuuuaaguuagcaggaauagaguuggauaaacauauugaguaggggguguucuaaaucaacacuuugugacagcagagauucauaugaugacuucugguucauauuugagaauuacauauccuagaagguaacuguguuuccuaucuaaauucuccuccuucaucuucuccuucuuuccuucacuccuucuuuccuucccuccuccuuucuccuucuccuucucauucuucuucaagaaaaaugcacugguaagagcagauugcaauguccuuuuaagggaaaaccugcuacaggguguuuugucuccagaggccaaucuuuagcugaucugagaagugaagccaaaagggucuucauugacacguaggccacuggcauggguguguagcuguuugcauguggggagaacugaagccagccuugcaccuuucccuugccuuuaagauagguugcaggacucaaaguggaaacucaguaaaacuuucagaagcaaauaaauggaaccuagaaggcuuguuuccuugggcauggggaggcaccauaugucagcuucacguuuuuaaucaaaaggccaaggcuucaucuagauuguaguaauaaguauuugcuuuccagagauuuucauugaaaugacaaaugccuuuccuuuaacuauuucucaugcuguuuccggugaucagagacaaauucagaacaaaaaaaugccuuucagaauuuuguauaauuuccuuuaugaugugcuaucauuaucuaaccuauuuaugaggaaguaguuauaacauuugauugccuaagaaacauuggaacccaggcuguggccacaguggugcuacuugcaagauccuuagagauuauuuaguccaaucucauucuuuuaccagugaagaaacagauaaccagauggggagaugcauguagaggagaacagggaucuggaaauaaccauggcaaaggagucaaaaggaagaauaugaaguauguuaaaaguugccacauaucacuuuuuuuuuuuugagacaguguuucguucuuuuugcccaggcuggagugcaauggcgcaaucucggcccacugcaaccucuacuucccggguucaagugauucuccugccucagccucaugaguaggugggauuacaggcaccugccaccaugcccggcuaauuuuuuuauauauuuuuaguagagacgggguuucaccauguuugccaggcugguuucgaacuccugaccucaagugauccacccaccucagccucccgaagugcuaggauuacaggcgugagccaccgcacacagcccacauaucacuuuuuaaaauuuuagaagauggugugagaagguuggcaugucauaaagaugggggagaagggaacugcagcuuauuaagugccuuucauguaccaaacuuugugcuagacacuucauauauauucauucauuuaacccucaccacaaacacauaaaguggaacuucuuauuucccucauuuuacagaugaggaaacugaggcuuagaggaguaaaauauugccuuucccuuauugccuuucccuuugagaagaagcaggagaccuggaaacagaaacucaagucaagcaucuugcuuccuggcccauguugcugagucuguaaccuaggagcaaauacaaggaacauacaggugucagucaugaugucaauaugcagagaggagcaaaucagaaaguaggaaauccaggugcggagggaguuuccugauaggaagagcacaugggugcuccagcuuuuacaguggccaguguggccacucgguuuguuuuuuguuuguuuguuuuuguuuuguuuuguuuuguuuuuuggagaaaugagagccaacagaaagauuugugaaccuggaagcaggugggaagaaggggagaaggaauauuugagcacaugggaucaagaguaggaaggugagguaauaagagagugacugccugcugagagggacuccauaagaagagguugagagaguuggcagaugagugauuacggaagugaauaauuaggggacagcaaaaagacuccagggaauuccuaacaggcugguuugcuccuuagacauuuguacaagcaguauuuuuagagugaucgagacaacugaaugcuaacuucauguagucauugcuacuuccugugucuuuauuaucauuauuugcuuuuucaguguuuaugaugacucauuaaucuggauucccugucuuacaguugauauuugagacaauguccuaagggagcccuacccagcagccuuuugcagaggaguuguaaccugaaugcuagguuuuuuuguuacccagcugccaauguuuggaucaaaacaauccauuucugauucauguauguuauuagcucuggcaggauggcaggacgugaggcagauacuguuuuguauauuacagaaaccuagauaagcaaacagagaaugaagagauugccuuuauuagaaaagcaaucuuuugcgauauuucuuagcaccaagcaaugaguuuuuaauaaaaccuaggagauagagcguuuauguaucuagucucacuccccuucuuugaaucuagauauaugugauuucaugaugcuagcaagaggccugcugauuugucaguucaucaaaaguugcuaaaggaaagccaacacaaaagaagcuaaucaucaucuugucuuuucccagugacucuauuggacuucuagugucugagcugccuguucuccauggcaguguuaccaacaguaguaccugcgcccuaguuguaaagggugagaaucucauuuugucucucuuccucuugauaauaggcugggggccgauuccuuggaagagcuggaagaauuauuaacacaaguuauguguagccaaguguugcuuuuccucccuuguuuggucauauucacaauaacucauuuuuuaucacacuugcccuccucuagaccuaugucuuugaggcucuucucucacucccuguaagucaacuccaagaugaaguaauuugauuuucuucagguggaacaauguguuucaggugucccuaguccaaauggaauugugcagcugccaugcaaacuguggaaacagcauaauugugucuacuaauauuuuguaauaggaaucacugauauuguucaggcaauacccacaugggaagaaucugauguuacaacaggauuuuuuucuuuuuuuauaauaauagagacagggucucccuguguugcccagacgggucucgaacucgugggcucaagcgauccuccuaucuuggccuccccaaagugcugggauuauaggcaugagccacugugccuggccagaauuuuugccaaaagcaccuuuccuucuuagaaucaacuugcuuugagaauucucuuguguuaugugauuuguccacauugaaucaguagcagaacugagauuauuuauauuaacaauauucugggcaucauaaaagggcaucugaaaucaauggaagacucucuguugcuuuacugacccucaaaucuguucuggaccccaacugccugagguaauguguuguccuaacagacugcagccuuucugaccugauaauaccuaucaggagccccaugcaugaccuccaaacagcuauuucuuuauuuuucguuuaucuuauuacuaugcucaauuaugaagacuguuaaaagauuguggcacaaagagcaaagcucuuguccaaguauuaccuuuauuauggcuacugcaaauucuucaggaacaaaauggcagggugauaggaaaaggaggcauccucuauuuucaaagggaaauuacuucccauuccuuucacuaguccugcucuuagaucaauagaauuauaagauuccagaguugagagugauauuuaauucaaucccuuucauucuauaauugggggaacugagacccagagaagagaagggaccuuaccaauggcaugcaaucucaguagcaggcuagcacuguagacuuuguuauucacaucccaaauucggugucccagaaagaaugauuaguggcuuuuaaauuucaaacuggggcuccuaagauacauuucaagcaaagucuucauuauucuucagcauaaagaaaaauagagccuccuccuuagcccccauguccaacuggagauucuuauaauguagguaucacuugagacgauucauucuuaagguaggaauagagaaaacacuuggucaggucuguuucucuuucuguuaauuauuauuuccaucuuccugaagaccauagcuucuaaguaauuaccuucagcuaguugaaucuuugauccucaguuauucccaaaggguuuccucaaguaaagacugcgagcaaacgcauuaggcuuugaaguuguagauccugguuucagggcccuguuuuguccauuacuaguuguguggccuugggcaaucacuuaaccucuuggaaccuaagcugauaaaaauaggcaugauaucuuaccucacagggcugguuacaaagcuccaugugauaacguaauguggacaagugcuuuguaaagaauaaaggacuuugcccaaccuaaguguuaguuaugagaauaucuacuauauguauuucacgaaaguagucugggaugcccucaguuccuucugcacagcaauaaaacagcuaucucuugauuauucacacuaaugauaaggaaaucuguuaggccauuugcauugcuauaagggaauaccugagucugaguaauuuauaaagaaaagagguuuaauuggcucacgguucugcagacuguacaagaagcauggcaccugcaucugcuucugaugagggccucaggaagcuuccacucauggcagaaggcaaagagagagcaggagauuucacauagcaagggagggagcaagggagagagggagaaggugacacauucuuuuaaacaacgagaucuugcaugaacucagaacaagaacucacucauuaccucgaggagggcaccaagacauauaugaaagaucugcccucaugacccaaacaccuccuaucuggcuucacuuucaacaugggagaucacauuucaacaugagauuuggaggggacaaacauccaaaccauaucaggcgaggagcacagauaauacaaaacagaaacauucuaccauuuguguuuguguuuaaaauacauuuaguuuggggaagccucugaacucuguuugcugaaagugaaauucaacugaggaagaauuccagaagcaggccaugugcaagucccugcccuuuucugggccucaguucccuaccuguagaagggagaauugcccuaacuagucacacagucucugccagcuccgauguccaugugucugugagucuagacauauggaaggcaacaggggaaagccaguuuuagaugaugcacaaaguuuuauugggcagcugaaguugugcaaauacuaggggggaaaucacaagcugccaaaauagugucaccucauugauagaauggacaaagagagaagucaauucuaaguggaagaaaccaugacugacauuuuaggaacugaucaaaagaagcgaucggaggaaagugaaaauaacaucuguagacaggaaggcccgggacgauagcaauguguaaugcugcugucacagagggaaaugugcaagaugagucucuuugugcuguuuuuguucaggggucagacucuucucaauucaccugauuuuuuuuuccucuccuuucaaucauauccuuuucaaaauucaucucagaaguguuucucagccauucugauuacaacuuuugcuaaaaccaaucagcagaggucugcuuacagugcaaggcaaucaacagagacccaagguauuggucagagaugauaucuucauuuagauggacuguggcuaaucggauuggcugaaguuacaaucagagcaauuuugcaacagcacugcugccuaccagguacaaagcuuccuguacaauuuuaggaaugaugcccgguuaaauauaguguuuuauacuauuugcaugacaaaugaauuaugaaaacgacauauguugcacuuuaauauuuuccuuuauagccuguaauacuccuuuagccuuuaauaauugaaugacagugagaaaauaagaucaaaauuuggccucuucuaacauaccgugcuauguggugguauccuguacucugaaccuuguaaauuggaaaggcagugacauuguuuuaugugauuugggguucugugauagggugguauguaauguuccaugauagucaauccugguuuuauaugccauucccaugcauucccagaaaaaaacaucuuaaaucagacucaagucuuaauuguauaugauaaauaggaacagacaggugaauaguaacaaacuuugaaaaaugaaauacagguacauauuagucaauaucagauaaguuacagacuauaaaggggcucaucagacuguauccguaugcauaauaauauuaugauuuuauuguugagguguaaguguuccuuuuguauuuagaguacuagauccuuauuagauauaugauuugagaacguuaucucucauucuguagguugucuuuucauuuucuuaauaguuuccuuugaagccccaaagugcuuuaauuuuuaugaaguccauuucaucuauuuuuugcuuugguuauuugugcuuucauugucauaucuaagaggacauugucaaauccaggauuacaaaaauguacaaaauuuuuauuuaagaguuuuacagauuuagcacuuaauuuuuauuuaauuuugguauauggugugaaguagggguccaaauucagggguauguuacuggaauagccuugcuaggauucuguuggggauuuuuaagccuaucuucauaaaugauguuggucuguaguuuucuuuucuuaggaugucuuugucuaauuuugguaucaggguaauacuggccucagagaauggguugggaaguguucuaccuuuucuauuuuugggaagaguuuaugaaggauugguguuaauucuuugaauguuugcuaaaacucaccagugaagccucuggaccugggcuuuuuaaauuaauaauucagccucuuuauuuaugaaucuauucauuuucuauuucuucuugagucuuucuaggaauauguccauuucaucaaaguuaucuacuuuuuggcauaaaguuguucauaguauucucuuaugaucauuuuuuuuuuuuauuucugugaaguuacuaguaguguccucgcucucauuccugauuuuagugauuugggucuuuucucuuuuuucuuuaucaaucuaccuaaagguuuaucaguuuuguugaucuuuucaaagaaccagcuuuuacuuuuauucauuuucucuaauguuuuucuauuaucuauuucaguuauuuccauuuuagucuauauuucugucugcuugguuuggguguuuacuuugcuauuuuuuuuuuucuaguuucuuaagguagaagcuuaaguuacugaguugggaucucccuucucauuauuuuuuaaaaauuuuuauuucaauaguuuuuggggaacaggugguuuuugguuacauggagaaguucuuuaaugaugauuugugagauuuuggugcauccaucaccugagcaguguacacuguacccaauguguaguauuuuauuccuuaccccccucacccuucccccugaguccccaaaguccauuauaucauucuuaugccuuugcguccucauagcuuagcucccacuuauaagugagaacauacgcuauuugguuuuccauuccugaguuacuucacuuagaauaauggucuuuauuuccauccagcuugcugcaaaugucauuauuuuguuucuuuauauggcugaauaguauuccaugguguauauauaucauauuuucuuuauccacuuguuaguugaugagcauuguauuaguuuguuuucaugcugcugauaaagacauacccaagacugggcaauuuacaaaagaaagagguuuaauggauuuacaguuccauguggcuggagaagccucacaaucauagcagaaggaaaggaggagcaagucacaucuuacauggauggcggcaggcaaaaagagacagcuuguacagaggaacuccucuuuauaaaaccaucggaucucaugagacuuauucacuaucaggagaacagcaugggaaagacuugcccccaugauucaauuaccucccaccagggcccucccacaacaugugggaauucaagauaagauuucgguggggacacagugaaaccauaucaggcauuuagguugguuccauauuuuugcaauugcaaauuaugcugcuauaaacguguguacaagugucuuuuucauauauuggauagauacccaguagugggauugcuggaucaaaugguaguucuguaaggacucuccauacuguuuuccauaguggcuguacuaguuuacauucccaccagcaguguagaaguguucccuuuucaccacaucuacaccaacaucuauuauuuuuuuauuuuuaaauuauggccauucuugcaggaguaaggugguaucucaucgugguuugaauuugcauuucucugauauaauguugagcauuuuuucauauguuuguuggcuauuuguuugucuucuuuugagaauugucuauucauguucuuugcccaccuuuugaugggacuauuuguuuuuucuuucugauucgaguuccuuguagauucuggauguuaguccuuuguugaaugcagaguuugcaaauauuuucucccacucuguggguugucuauuuauucugcugauuauuuauuuugcuauacagaagcuuuucaguuuaauuaggucccauuuauuuauuuuguuuaaaguccuucucuuuaauauaggcauuuacagccauaaauuuccuuuuuuuuauuuuuuauuuuuuuuuauuauacuuuaaguuuuaggguacaugugcacauugugcagguuaguuacauauguauacaugugccaugcuggugcacugcacccacuaacucgucaucuagugggugaaggacaugaacagacacuucucaaaagaagacauuuaugcagccaaaaaacacaugaaaaaauacagccauaaauuucuaagcacugccuucucuacauaugauaauuuuuguuaaguuguguuuucauuuucauuuaccucauaggguuuucuaauuucccuuaucauuucaucuuuggcccauugguuauuuaggaguauguauguuuaauuuccacauauuugugaauuucccaaauuuucuucuguuauuguuuucuaauuuuauuccauuguggucagaaaauguaugauuucaaacuuuuuaaauuugagacucguuuuguggcccaacauguacccuguacugaagaacguuccacguguaguagagaauuguguuuuaccacuguuguauggaguguucuauagaugucuguuugaucuaguuggcuuauaguguuguuaaaaucuuccauuugcuuuauauucugccuaguuguuugaacuauccauuauugaaaguggggaauuggagacuccaaauauuguuuuuguaugaucuauuucucccuucaauucugguaguuuuacuucauauauuuugggcucauguacauauauguugauaauuauucuaucuuccugauagauugacacauuuaucuuuauaaaaugucuuucuuugucccuaguaacaaguuuugucucaaagucugguauuuuccccaacauuaguacagccacucuugaugucuauugauucuaguugguauaucuuuuucuauccuuuacuuucaacguauuugugucuuugaaucuaaagugugucucuuguagacagcauagacuugcaucauguugguuuaaaucuauuuugcccaucccugccuucugauuguaguguucaauccauuuguauuuaauguaauaaaacgaguaauaaugaauaaguaaugaaauaagguaagauuuauaucugucauuuucuacuugauuucuaaaugcuuuaugucuugcuucucaguuuguccaguauugccuucuuuuguguuaaauaguuauuuucuaggguaaugguuuuauucuccuaucauuuuuaaccauauuuuuaaaguuauuuucuuagggguugcccuggaaauugcaacuaacauuuuauaacaaucuaauuuggauuaauaccaacuugauuuuaauagcauguaaaucccuuuuuuucuguaaagcuuaauucccuucccccuucuugugcuguuacugucauacaaauuacauuuucaaacauuguauuccgaucaacacagauuuauaauuauugcuuaugcauuguguuuuaaaucagauagguggaaaaaagaguuauaaccaaaaauauauuuauacuguuuuccauauuaaccuauauaguaaacuuuguggauguuucuucuuucuuucucuuuuuuucuagagacagggucucacucuguugcccaggcuggagggcaguggcacaaucauggcucacugcagcuuccaccuccugguaucaagcaauccuuccaccucagccuuauuucuuugugugaauuacauuacaggaugcauacugaaggacuccuucuaguguuccuugugguauauauuugcuagugauaagcucucucaauuuuucuuuaucugggaaugccuuaauuucacuuucauuuuucauguauacuucugaugaucauagaguucuugggugauguuuuuuuccuuucagugcuuugaauauaucauccuguagcaggacaagccacagacaaaaccccucagacaccgaguuaaagaaggaagggcuuuauucagccaggagcuuuggcaagacucacgucuccaacaaccaagcuucccgagugagcaauuccagucccuuuuaagggcucacaacucuaaggggguccucgugagaggguugugauugauugagcaagcagggggugcaugacugggggcuucaugcacugguaauuagaacggaacagaacaggacagggauuuucacagugcuuuucuauauaaugucuguaaucuauagauaacauaaccaauuaggucagaggucgaucuuuaacuaccaggaccagggugugguaccgggcugucugcuuguggauuucauuucugccuuuuagcuuuuacuucuucuuucuuuggaggcagaaauugggcauaagacaauaugagggguggucuccucccuuaaucccauugccuucuuguguuuauacuuucugaagagaaagcaacuauagccaggugcgguggcucauaccuauaaucucagcauuuugggaggcugaggugggcagaucacuugaugccacgaguuugagaccagccuggccaacauggugaaaccccaucucuaccaaaaauacaaaaauuagccgaucuugguggcaugugccuuguaauuccagcuacucgugaggcugaggcacaagaauugcuugaacccuggaggaagagguugcaaugaguugagaucacgccacugcccuccagccugggcgacagagcaagauauugucucaaaaaauuaaaaaacaagaaaaaaaaagcaacuguuaaucuuauugagggcccuuugaaugcaaugaauuacuucucucuugcugcuuucaagauuaucuuugucuuuugacauuuugauuauuaugugucuacuuggaauucacugaguuucuuggauguguggauuaauauuuugcaucaaauuugggaagcuuuuagccauuauuucuucaaguacucuuucugccuuuuucuuucucucuucucucucugaaacuuccauuauauguauguuggcacacuuacugguguuccacaggauucugaggugcuacucauuuuccuuaauucuuuuuucuucaucuuccucagauaggaaaauuuaaauugaucuaucuucaaaugugauuauuguuucuuuugcaugcuaaaauuuccugcuaagccccauuaaugaacuuuuaauuuuaguuauuacaauuuucaauuccagaauuucuauuugguucuucuuaaaaaaaaguaauuucuaucuuuuugccuaucaaggcaucauucuccuaccaucuuuuaguucuuuaggcauuguuuccuuuaagugucugaacauauuuaaaauggcuaguuuaaaguuuuuugucuaauaaagcccauaucugggcuuccugagagacagugucuguugauugauuuuuuuccuguggaugggccaugcuuucuuauuucuuuacaucucuuguaauuuuuuuuugucaaaaacuagauauuuaaagaauauaauguaguaucucuggaaaucagauucuccccuauccucaggcauuguuguugguguuuguuauuguggugguaguucuuauuucuuugucacuuuucucaaccaauucuguaaagucuguauucuuugucauguguagccguugaagucuuuguucaguuagcuuagugguaguaaguuaaugauugaacaguguuuuccuuaacuuucuggaaccaguaagucucucagucuuugcugaagugcucuuuguguaugcugggcacaccuuuaacauucagccuagcaguugaagacccugccuuagccuucacuuccuugcacagaaccucaaggucagucaaaggugagggaauagggcuuucucagaucuuucuugaucuggcaugcacacagccuuaugcuugaguguaacccacuagauccccaggaauauguagcuuuuauagcacuuauggacaucucauuaccuggauuuuccugaaaauuuuuugguuagccuauuauuugcucuaacuauuguccccuugcuucaggcagcuacaaaguaaaauaauuaccucuaauugaguucagcagaugucuccagggaaaaggcuuuugcacaggugagcucaauaucaguucaaauaaaaacagccuugcaaaugggguauuuuagguaaccaucagacaggucaaauaauuacaguuuacugaguguagcuuugaaagaacuccaaccugucagaguucucuagagagacagaacuaauaggauagaugcauauaugaaagggaguuuauuaaggaguauugacucacacagucacaagaugaagucccacaauaggccaucugcaagcugaggagcaaggaagccaguccaagucccaaaaccucaaaaguagagaagcugacagugcagccuucagucuguggccaaaggcccaagugccccuggcaaaccacugguguuaaguccaagaguccaaaagcugaagaacuuggagucugauguucaagggcaggaagcauccagcacaggagaaagaugaagaccagaagacucagcuagucuggugccuuccacauucuucugccugcuuuauucuagucacacugacagcugauuaaauggugcccacagagauugagguugugucugccucucccaguccacugacugaaacguuaaucuccuuuggcaacacccucacagacacacccaggaacaauacuuugcacccuucaaucuaaucaaguugacauucaguauuaaccauuacaaaccccauucugcucccuccaguggcugccaggaugcuagauuucaccaugaaugugggcuguuaguuuucaaaaguacuucagaacuggagaggaggaaugagaauagggaaguuaaaaugccacaacgcucacuguuccuacugacauucagccauuuucuugaauaaaugcuucucggauugcugcaaauacuuuuauuaaauuccagagcuccaaagaaguugguucugaauguuuuugccaauuuucucauugcuuuuauggaggagcacuuaaaacacuguccagcacauaguaggugaugaauuaauauguuauucauuaaugccauuuuauuuauuuauaaauaauuuaauuuauaauguacuuauaaauuauuauuuucagauuauuuuggauguuaguguagagcagagauuaugguaucaggacccuuuacauucuuaaaagcuauacaggaccccaaagagaugucgauggaguuauaucuauuguuauuugcuguauuagacauuaaaacuaggaauauuaaaaguauuuacuuacuaauucauuuaaaguuaauaauaaaggaaucagacacucauauguguuuuuucaagauaugcuuuccaaaauaaaauacuuuaguggaaagaauaccauuguuuuacauuuuugcaaaucucuuuaauuuuuuccuuaaugguagacagcuggauucucguaucuucuucugcacucaaucugguuugacugaggaaaauuuggucucacaaauauauacaguuggaagaagaacuguguccuaauacccuuuuuugacaauuagggauauuuucucugauacuguacaagaaguuggcaagugauacuuucuuaaagguuaguuacaauauggaagcugcaaacguaucaauugacuuuucauuuucuguuauguuaaaaucuaucuuacacuuugggugaauuauuagucauugugugauuuuuccauuaugaugccuuggucauuugaaaaauuuuggcucacugaguuaugccgauuuuccaaauauuaacacacuucauuauauaacgucaaaacucauauucauuagugucaccucuguucucaucagaaaagccuucagguauugggaagcugucaaguuucauaguagaagauaacaaguuuucccaaauucuaauuuucaccugaaagugcaaauucuaucauuggcuaugaacacugucaguuguuuuccuugaaguaacaggcuugcuuuguucauuuccaagaaaaugccuacaaaauacuugaguuugaauaagaguuugucugucaguuuuucuuucaaguaaaaauaguguuacauuuaaaaaguguucaguucaucucacaagucaaucacacuugugcuuuuccucuagaugaccaucauacuuuaguauguaccagaaguacuuuaugcauacuucccauuucaucacacauaauaucaaaaaagacauguagucaagggugaagauuugaugaaauuaacuuuuacugccucuucaaguauauucuuaagugaaacuagcuuuuuuuaaaaugugugugcuuggcagugaaaacuacaaugacuacuauugcaguuuggugucacuacccugacuuaugauaaagugcaagcaguuuuacccaccauagcuuuugcaucagugcaaauuucaucacauuuguuugagggaaaaccaugaauuuuaacacugcuauuuaacauuuugaauauuucagcaccacucaugguuuuuuuucccaaagcuuucacauaauagaucuucuuuaaugauuaguuagugcuuaauacuggaugaauauaagcaaaacagcaauuccaccccaaaucuguagauuuguccauuuauaaggcaaaaacacauucugcagaagagacauuaacuaaagagggcuuuauguuugcaaguaaaccuuuuauuugaugaguuuguuucuccaucauuggagaguggcaugauuucuucuaugacuuuucacccagcaggcauucagcaaugucaaaucuacagggguuuauuuuuuauuuuuuauuuuuuuugagagggagucucgcucuuuuccccaggcuggagugcaguggugugaucucggcucaccgcaaccuccaccuccuggguucaagcaauucuccugccucagccucccaaguagcugggauuacaggugccugccaccaagccuggcuaauuuuuuuuuuguauuuuuaguagagacaggguuucaccauguuggccaagcugguuucaaacuccugaccucaagugauccgcccgccucagccucccaaagugcuagaauuacaagugugagccaucaugcaggccucuacagggguuuauuaguuuuuccacuauuguguguacuucuacagcuaauauaaugcaguaacuuacccuacaguauguuucagugcguuuuucguuucuauuuggaaaagccauaacaaacacuuuugacuuuuaaagagcucauaacauuuacuuuaaauguuuaauuucauuuucuuuaaacuccaaguaauuaauuucaagaugacucuacaauuuaacuuacacucuaauauccuauuccaaaauguucuuuugcaucagaaaaacaagauaaauuaugcaugucuauaaggucaaggaaaagacagcuuuuguuguauauuuguuucuuaauuacaguuguaaucuacagaguagaucccucucuuccaugagccagaacucugugauaaguuguuuugacauguuuuuaucaguuuuagacauagacauugcugcuguggguuggugaaguaagucuucuaaucuccuuuuucaaagccaaucauccauucuuaaauaucagaaaaacauguugcaaauaaauuuuaucuuauuguauaauacguccaauaaguuacagaaaaaauuuaaaauuuauauucuucaaaaaauauuuuaaaguguuauugcaaaacaagacuacaaaauuuuuucacuucauauauuuucacauagauacaaaacuucuagauuuccaaauaacaauuuauuaaaugauaagaagguuacaaagauuaugguuugcauaaccuagauagccaguaagagcacucaguucuggguauaagguaaacucugaaaaugcauguauuuuuacuugcucccuuagaacauucuagaaugcacaaauacauauuucagaacagugauaucacuuuacaucauguugccucuugaaauuuccccuguauacuugugagagaauaagaguaaaaaggacaaauaaagucuuaguauuauuaugaaaauagguuugcccuuuaggaccucccgagaggucucagagaacuggaaggaauggauuggaggaggucaaaacuggagcuuuggagaccaauuaagaggccguugggauggucuguguggcagugguucuccaacuuguaugcaucagaacccccugaagggcuuguuaaaagcugggcuccacucccaggauuucugauucaguaggucuaagucuggccccaaaaugcauuuccaacaagugcccagaugguauugaugcugcuuauuuuaggaccaugcuuugagaaccacuaugcuagggccuugcuaaucaucucagacuucaccccagaucuauugaagaugaaacucugugaauaagauuuucaggugauuuguauacacauuaaaguuugagaagcacugcucuaagagacaguugauggaauccuagaccuaaagguagagaaaaguucacaaauugaaugguuauuuauaagagacaauaaacaagacuucgugucuggauguagagaaguuagagggagggagaaaucaccagaaauuauuugguuucuucuggcuugagcaauugaguaggagguaauuccuuuucacugggacaaaggacacaaggagaugaguauauuugggggagugguauuugaauucaguauugaguugauuuacuacacaaaguucucuuuuaaucugcacauuaaugguuucacaugguuaaauaauaaugucaugaacuccuggugcugcaaagggauugguaaugcauaagaaguguuaggcacacaugcaggauucugcuuucagcucagacucuguuuguggcagauauaaauuagcaaaauauaagucucuucuacauaaggagcauuuaaaaccugucucccaucccuacagcauucagccccucagacaaaagcauguggguaugagacacaggguaaacagccaaagucacguaccaccuauugguaauucgagauuagaagaacagaagaggauauuccagauauuccagagcagaccggacccaauugugugacugccagacuugggcaaauuccaugugguucccuuucagggacauauagcuacccauguuccugaccagcugaaccaggauuaugacacacaaagcaggcugcagaaggaaguaguccccacuuaagaaugaaucaaauuucuaucugguugggggagacauuacacuuucaaccauuguuucgcuugaucuucacauuacagccagguccagcaggcauuuuaauuaucuucauuuugcagaugaggaggcugaguuucaaggaaaguaaaugacuugucuagaguuauugaaaugguaagaggaugaacugacacugggccccagguauccugacuccaaauuguguguuccuuucacgauaauaccaugcuguaguucaauuuagcagcaggcugaucuguaggacauuuguuccuuuuuuggauuccaauuuacuucaagaacuaacauguaugaaauguucaaauaauagcacuugauuucuuaaaauugcuugauuuauaauacauuacagauuauuagugagcuuuuaucuuaauggucaagcaauuaacaaugagucacagcaaaaugucugaaaggugaggaaagaaaaaaaugcuuacauugucaccaggucuguucauuauccucugugcuguauaucagaucaaucaauaguuaauuaauaaugauguucuuccugaaguacaagguuauaaauuaauuuaaugcucauaugcauauuuucuguaggaaaagugagaggaaaaugccugccaugcccaucucauuguaagaaaauguauguaaugauuacaagcauauaauaagaaugguuugcuuagccaaauguuuguucauuucuguuaaucaguauucauuugagcuaccuccaugcaguuuguggaagcagugcaaucaguugaguaguguggcagauuuaaaucaguaauaaaagcccuggggaaauuaacaagacaaaacauuaaccacagucuaaacauuaacauauauuagcauuuuuauuauaccuguagaauuguuaaaugggcacgguugcuacuauuaaaaaguuuauguuguauaucacauaauuucaauguauauauuguuuuuaaacuuuuaagauuuaauuaaaugaaauuguauagugguaugauagaugauucaagagaaugaacugaaauucaucauuuuauuuuaacugaaaaacugaaauucccacccaacuccaccuucagccccaagguaccacaaagcgaaugccacagguaauacucauccaaaguagacaacuagaucagaguugauaauuaaauugcauaacucccaaaggaaguuuuaguuuuaauucuuuaggguccugaugaauccaucaaugauccaagacuaaauuuaaaugguauuuggcaacauuucucagaaaagcacuuuuuuuucuaaguuggaugaacuuuuauuagcugaauucgagacauuauaauaacacuucaauuaagagaaugauauauuugcauaagcacaaacauuuaaauaaacagaauagaguucagaaauagauccacaaacauggccaauuaaguuuaaagaaauaaaaaauugaaguaacuaaaugagaaaugaucuuaacaaauuguacugaaacaaucugauaaauauuuggaaaaacauaaucauuauuucuugaguguuaaauaacuuggaaaguuugacaaguuaaucagauaaacaaauggauagcauucaugacagauaaacagagcauacacauuauuuuuaaauaccagagaaaaauauuuaaaggaaaagcauuaggccuaaaaaugucauuaacuuugugaaaguagaaauccaacaggucauaugauuuaagcacugugaaaugaaguagaaaugucagugaaagggaaaucaacaaguaauaucuagccauguacaaauuuuauuuaagauagauuucuuuuauuucuuuuuuaaauaguuucagcuuuuauuacagauuagaggguacacuugcagauuuguuacauggguauauuguacgacgcugaggcuucgggucccagugaucccaucgccuaggccaugaaaacagcaaucuuuacaucacacaauauacaaaaauuaacacaaaauggguuaaauaccucaucauaaauguacaaaugauaaagguucugaagaaaauaugucugugacauugccauauggaaaggcuucuuuggauggaaaacagcaucaaucauaaagcugcaaaaauauauaaaaucaggugcaucaaaaaauuuuaaaaaguguucugugcaaaaggcaucacuaagaaaagugaaaaaccagauaaugggaaggaguauuuacaaaacauauauuugaaaaugaaauggcaagauuugaguaaacagugcagcuuuauucacaaaagcaaaaauguggaaacuacccaaauguguaaacauauuugguauauuuauucagcaauuaaaagaaaaaaguacugguaaaccaccaacauagaguuccucaaagaaaaaauuauccugagcaaaaaagcagaaacaaagacauaaauaccgaaucuauccauauuuauuuucuauauuucuauucuuucuuucuguuaucaaucuaauccuaaaaaagacagaucucaucuguagugauuaaaaugucagucacuauaaaauuaugacaauauuuucuacauuaugagguaguguuuacacauguguauacauuuacaaaucucaucaaacuacaauuuagggaugcauuuuauguauauugggucucaaaacauuuaauuaaaaaaagaguacagcaaccaaaagagguaauguacugcagcauaaacucugcccccccauuaaaaaauuaucucggauaauuaacacacuauuaauuauauuaauuauacuuaauaagauacaugacauaaccuuuauguaaaauaacugccuaugcuuuccaucuauuugcuuacucuccauauauucuacaucuuaugauucuuauuuucagaacuucucugcugaagugacucaugucaucauuaucaaucaucuaaauuuacuaaacacaguacauacuagguccucaucuuguugaaucucucaucguuguuaaacccagaauauugaucuggguuuucucccuuuggauguuuuaauuacacugguguuacauaaggacaggauucuccuacaaaauauuaaauauauguuucagaaacauaaaaacaucacaguuucaaauaacuuuuuuugggauucagggaguacaugugcagguuugucauauggguauauugugugaugcugagguuugggguauggauggucccaucacccagguagugagcauaguacccaauagauaguuuuuuagcccaugccccuuuuccuccuucugcccucuuguaguucccagugucugugauucccaucuuuauguucauuaguguauucaacauuuagcucccacuaauaagugagaacaugcaguauuugauuuucugucccggcauuacuuugcuuaggaaaauagccuccagcugcauccauguugcugcaaggggcaauauuucaugcuuguuuauggcugaguaguauuccaugguguauauguacaacauuuucuuuauccaguccaccauugaugagcaccugaguugauagcaugucuuugcuauuguguauagugcugugaugaacauaugggugcaggugucuuuuugguagaaugauuuguuuuccuuuagcuauauacccaguaaugguauuguugaaucaaaugguaguucaccucuuaguucuuugaggaaucuccaaacuccccucugcaguggcuggacuaauuuacacucccaccagcaguguguaaauguuccccucucucugcauccucaccagcaucuguuguuuuuagacuauuuaacaaaagccauucuaaauucugugagaugauaucucauugugauuuugauuugcauuucucugaugauuagugaugauaagcauuuuuucauaucuuuauuggccacuuguaugucuucuuuuaagaagugucuguucauguccuuugcccacuuuuuaauggggcuauuuguuuuuugcuuguugauuuauuuaaguuccuuauagcuucuggguauuaggcuuuugucagaugcauaguuugcaaauauugucucccauucuguagguugucuguuuacucccuuaauaguuucucuugcugugcagaagcucuuuaguuuaauuagguuccacuugucaauuuuuguuuuuguugcaauugcuuuugaggauuuagccauaaaugcuuugccaagggugauaucaagaaguguauuuccuuaguuuucuuguaggauuuuuauaguucgaagucuaauauuuaagucuuuaaucuauccaucuugaguuaauuuuuguauaugguaaaagauaggaguccaguuucaaucuuuugcauauggcuagccauuuauccuagcaccauuuauugaauagggagucaacuuugccaaagaucagaugguuagacaucagaauuuuuuuaaauguaggaauuaccgaagauuuuguagccaacccaauaaucugaauucuggagccagggucaagggacauccugcaggcagcaaguggcaagcuagaccuacuugggagccuccuuuuccauagaauuugacaugcagugcuuucguaugguuacuaauucacucuuacuuggcagaccaaagaauuuaaaucaucccacuauuggcuuacugccacuugaaauacuaccugaaacuuagguuaaaauugaaugucaguuuucuguugaacaacuuuagccauuucuuggaauauguuuagagaauuuuucaucauuauuacuguccuccaauuauagguaagguguccacauaaccacagaccugggucacacccaauacugggaagccccagagccuaugccugugacagaacuccaugacacgggaaaaucgaaaacaaaaacauagguuuuagaaucagacagaccagcauucaagccucagcucuaccauuuacuaacauugugaccuugcuuuuaaguuccccaacuuuugugagcuucaguuuccuuauaucuaaaaauggggcuaauaauacccauucuguguaaucccagugcuuugggagaccaaggugggcagaucacuugaguccaggaguucaagaccagucugggcaacaugcugagaucccgugucuagcuacauuagcuaggcaugguguugugugccuguagucccagcugcucaggaggcuuaagugggaggauuaccugagccuggggagaucaaggcugcauugagccgugaccacaccauggcacuccagccugggcaacagagcaagacccugucucaauaaauaaauaaauaaauaaguaauaccugcucuguauaccucagaggguuguugguaggacugagugaagagaauggagaauggauguagaaguuaucugugaagcacuagguuggaauaggguauuguguaagaaacgugaaguguugguauuguugagaagcuuuugauacaggcucucuuucucuguucuggagugaaagaucaaaucugaauuuuuuugucacuugagaguucccagaaccaacagugaauaggggccugagaaugacaguuagauuuuaaccaauagaguagccgcauuucuugacauguucauuauagaguauaggagugaauuguaucagaucaaauuuuugcaugauuucagaauguuugguaauaaugggauucaggacacaccaccccaaaauauggcaccuuugcauuuaagaaaacuucaaaaacaagaaagucacucucaccuuccccucaccccuucucccaugaagcaggucauaaaaccuaacugacccucuucuaaaguaugucguaagaccgucauguggaggugcccacccuauaccaagaagaaagaaacaucuuuaccuccaaaguuacagggacacagagaaaaaucugaagaaacugcccuggcuaaguuucccccaguuuauuuccauucaguuauaaccucuuuguccaaucacacuucaccacucuccauuuccuuaacaaacuuagcauaaaaauccacagcuuuccucauuucuuugggucuuccuuucuaaaggaucucgugugacguaaaacuuauauuaaacauauuuguauggauuucucuuuuuaaucugucuuuuauuacagguuccucaggcauaggucaagaaaauaaaauuuucccugcccuacaauaacauacuccauucagaaaguaauuuucaccuuuuuuuuuuuuucaaggaaacugagaagaaaauauggcacuucaaauauccuaucuucuuccuguguauagggcuagacuuacagguagagugaagcuaugggaccaggucacagugaaguccugcugugggugagagguggaaguggggugguaggccagguuuccugaugcccagccuacugggcucugcaugaucuagaccaagcuuguccaaccugcagcuugcaggcugcaugcagcccaagauggcuuugaauguggcccaacacaaauucauaaacuuucuuaaaacauuaugauauuuuuuggugauuuuucuucuaucucaucagcuaucauuaguauuuuauguguggcccaagacaauucuucuucuuccaauguggcccagggaagccaaaagauuggacaccccugaucuauaccuugcugggucccagcaguguauuuuccuuauguagguacaaggacggugcuucuggauccuggcagaaaagaaugaugcuaagguuacuaaaaugucuuccuggcugggcgcgguggcucacgccuguaaucccagcacuuugggaggccaagguggguggaucacgaggucaggagaucaagaccauccuagcuaacacggugaaacacugucucuacuaaaaauacaaaaaauuagcugggcgugguagugggcaccuguagucccagcuacucgggaggcugaagcaggagaauggcgugaacccaggaggcagagcuugcagugagccgagauugcaccacugcacuccagccugggugacugagugagacucugucuuaaaaaaaaaaaaaaaaaacuuccuggccuggauauggucagaggcccugccuucuucuuauguuucaggacuuguaacccugcagagcacuauugcuuuccuugucaaaagucuagcacauaaauaaaaacaccuuuaggaaucauggucuauggaaaacaaaaagguuuuauauuccagucuuuugguagagacacucaccuauccaauaaauucccuccaacuaaccaaauuuaaagguagcagcauccuugacuagauacauuagucagcgaaaggaaauuggauuccacuucuuauuuaagagccuaaaacuccugggcaggauacugauuucuaaaaugccacuugggaggcuggcuucuucaguaagggcugcugaagaauaagacucaagucucccagcauagccugauguuucccaagugugaagcugaaaggacuucuuuaaugugaaugcugcaucucuuuguaaguuauguuuucuuuuaguguccacuucucaaaauaagcucauaauauucaccuauagcucacauaguguggaggugaaagauguagggagaagggcccaaaggagggaauauauuugacaaaugcuuuguauaugagaagaauuugcuucaugguagauuuguggaggaaaaugcagccugucugauaagauguggcacauuucagauggaggaguaggguuauuggcaggacaccauuguuugcgccuuaccccacacagagccuuggaaaguuggcuugauaauacuauauuggguggcuugggaagaaagaucagacugcagaguggcgacauuaucauuuguucuuaaccuuccuacuuuugccucagcugcaccccuuuccaguagguugggguuggugaggggggaggggguuaaaaacuuuaaagucuuucuguggaccaauuaguauucauugauacaaagggcugacuuucaauggggagggagauuucacagcuguggguugcaaguagacaaguuacugugaaagaugugugaaagauuugauuuuggugcuggacugggaacagguguaggucaagagaauguguacuaugcucuugaaugugcuaagaauacuuugauccuacugaaauaaguucucacaugaauguuuauucacagaauaauagauauuuauggaacaaacaucaagguuuuguuccaugaaauuuuaccugcauuuucacaaaguaaacauguauaugucuucagacagaaagugguaauacacagucugcccucauuuauuuggcaucugcauuauaugcuuugaaaaugauuggaacuuaacuccccaguccagcuaggcagccccugaccuaaagcacccuaccagacugcuacuaguuaaggcauauucauggaaugcacacgcuucguuugaaguuaauauuagcucaagucacauagcauuacauaagcacaucugaaaaauucaguaucaugcauuccaaagccaaauugaaugucuuuaagugucuucggcuuuuguuuuauucccauuaagauaaacuauugaguauagcucaucugaauaucaaacuauagaugcuaucuuuuauaaaugaaggugaugcuacucugauucuagauuuuuuuuucuaauucgagaauuuauuuauaugaaaagccuuccaaagcuguauaaauagauaacuuaguaaaugcugucagggccaucuugagaaauccagaagcugggauuaccacacagagcccauggcuuauaaguagagugcugaacugaggcugauaauagaagauucuuucaauucacuucaauuaauucaccuaacuuagacgcacaaaauccauucugaauagcguggaaauacaaaagugacaaacauacaacccuucuccuugccagauauuucuaauauuuuuccugaaguuuacaguccauauauucaccuuggcuacguuggauggcuauguuuuugaggacugguaguucuuuauauuuuucuacaauggagaauguaagccacuggaaggucaagcauuaucugcuagggaggcaauguugcauaaucuuugaagucagauaaauggguucuaagucagacaagugaguccacuguuuuucugccucaugcaagucacuuaacucccuaagccucaauuuccucaucucuaaaauggggaugauaauaguuggcauagugucuggcacaagggagauauauaagaauguuaauauucauauuucuuuauauggagguucauuuaggcuuuugcuugaaagugaaaaaaguagcaaaucuacuaagaauuaaaccaaaaaaaucaaguagaauggagcuaaguaagaaagauuaugccauuuuaaaaaaaguauugcuauaugaguguaaaagaggucagcuuuagcgagagauauccaauaaauauuuuugaaugaaugaaugagaaaagauggaaggaagaaagggaggaaagaaggagacagggaggaaggaagaaagggagacuguugagcaccuauguuuuuaaaauacuuuuaauccugggcuuauuuaaugauauaugauucauaggugaugacacuggcuugcuuauuuauuuauuuauuuauuagaaacaggaucucccucuaucacucaggcuggagugcaguggcacaaucauggcucacugcagccgugaccucccaggcucaaacgauccucccaccucagccuccugaguagcugggacuacagguguacgccaccaugccuggcuaauuuuuuauuuuuugcagagacugggucuugcuguguugcccaggcuggcuuugaacuccuggccacaagugauccucuugccucagccucccgaagugcuggaauuacaggugugagcugccugucacuggcuacugauugguugacuugccuucuucccuuggguauuuuuaggaaauccagaugagcaaucauacuuuuuaucagaguaccuuaucuugggucuuauaaaaaaauacucauagaaauugggagcacucugugcuugggaggcuggucuucuauuaacugacuacacaacccccaucuucugcaccaguucuuccuaaauuuugcaauucccuuuugugaacuucuucauacauauuaauacuaagugccauugaaagguaucaauagcgugaggccugcguugacaguccucucaaauguauacuucacuguagaaaaaaagccauuuuuuaucuuaggaaaucucugaauaggcuguacuuagaauggggcccccauuccccgucuccagccuucuuuccaccagugguucuuugucuuacaagcuuaucaccuuuuuugacucuagucauagcuuuguucugcuauuuaaaauugggggaagaaauugaagugccuuucagaauuuguuucuacuaucauaucugcacaaguaucauauaauuauauugcauuucuuuuuucagauuggcaaguuaugugcccauucucaacaacgccaauauagaucugcuuauuauccugaagaucucuuuauugacaagaaaguauuaaaaguugcucauguagaacaugaagaaaccuuauccagccgaagaaggugagagguuucuuuuuucuuuauuccacaauacaauuaacaauuguauuuuaaggucaaaaaccacuagagugaaacuucuuaaauacauguuauuuaguucuucugaguagagugcuugauuaauuaaauuuuaucaucugucaauguuuaaaaaaagaugguauuauauccaaggcauauuuaaauguaaauuuacuguucauaaauaucuaguacagcaacauguguggaaaggacuucccuauucaagaucuuuuauugauuaagcaaaauuguuucugcuuacaaucuggucucgcgauuccuuggcuugcuuuguagcuuuucccauuauuaacagugagucagaguuaaauucaccagagagaagcuggugagacacauucauguguauacacagacacugcacacuuuacacaccuuuuaaaaaugauaaaaugaaggaucugguuccugguucuuaaaacaacagucaggggacaaaauccacguuuguuucuuauucucuucauccauucuccccugauccagguucccucuauccccauucuauuuuuuugauuacaauaaagggguagaaauuggaucaaaagcccaauacaauucuagaagaagugcccuaccugaaaagacugcacauguagccagcccugccacuggcucaagaauagcuagacaugaguuguuccuauugaccuugaggggggagugcaguggcgcgaucucagcucacugugaccuaugccucccagguuaaagccauucucgugagccaccacacguggccuagauucauccuccaaggaaaagaaaggauaguaagaaaaacugacaaagccuguagaguugaguaaaugauggucaggcagagcuucuuugguguuaggagaucgagacugcccaaugauguuacucacuuuuuuugaaacugaagcauuagaaucugagauggagccuuucuuugugaauucucuggcagaagaagaaaacgaaacaacaggagaguaucugauuuuauuuaacucccucaaauaggcauuguaaccccuuuuagggagagaggagaagugggaauuaagauaaucucuugcuaaaugcacugcccccugcaaucugauguuauuaagaggguuuguuuuugcaguguuaguaccucuauaaaucucucaguauguucugcacagcauuucacacuguccagaaaaauauaugugccucuagcacuccucaugcccaugcccaagcuccguccucugugguuaaaaauaugauaauugcaaaggaacccuauuguaguauucagucuguggagguugugagcaagcugucugaaucugaucaugaguugaaaagcccuuugccuuauuaaaauaacaacacacaaugaauuccuuugguaguauucagaagucaucuguuuguuuugucugcccccaacuggguaguuugcaacacacagcuaaucuuagaaauagcuuaguucaauuucaaggcgauuugauacucaacugguggucuaugugugggacucaguguuccuuuaagggauaaguauugaaaauaucugucauagauuuaaaacagugaguggagaacaagaugcacaacuaguacaaucagaauagaagaaaucagaucuucacugccccuucuagcuuucauauuuuuggcacaucucaguugccagcuucucccuucuuugcccuuccgaaugucuacuucacugcuucccuuaugauacuguuuaccuugccacaauauacuguuugguugaguacaugaacaauauuuuuccauuguucaaaugccgaaucuaugguugaauaguccaucuugcaucuacagauaccaagcuucuggcccaacugcuaacuugugagaaagucacacaguucccuccacccuugugaaauuauaucuacauauuccagccuucuccuuccugugcucccccuccucuccuuccccucugacuuggucuaaagcggcaacggaucaggugacacuaguaaaugaucuagaaagaaaagaacaaaagcugaccucagcuccccuaguccaaaaucaaugccuacucccacccacucugaacaaaacaacaaaguauguccugagugaaucaacgaguucuggaucugguacaagucauucugcccuaaauaggccucuacuucuuucaacauuugucaacaccaucucuaugcuucacauuguguaaggguuaggcucugaggaauggaggagcaccuagcuuaguuagggagggagacaugcaaaugaauaauuuccauacauuggggggugagugccaaaucagagcuaggugcaaaagaguggcagugucacagauggggaagauagccccucuccuuggagcauuaagaaagacuucuuggaaaagguaacuuuugagcucagccugaaggauaaguucaaacaagcucagcagauugaggaaggaaaggagggcguucugggcaaagggaacacuaugagaaaaaguaugggcaagucuuuagaaugguagaaagcucuaguuugggauuaaacugugaaaggcucucuccagcagaauuaggcaugaucuuacaucauuccaauuuucguuauuuuaguuuagguacuuuuuugcauugccaacuuuuaaaaauaauaagcucauauuacuuuacaugaagagaaaaaaacgaaccuuaauaauaaaggaaaaaguuccaggucugcagucagggaugaaaggcuguuuuuacuugcagugauuuccaauuagugcugcuuugaugccugcccaagcaaaucauugcaagaaagcaaaggcaaucuccuccccugcaaccaaagaagggaagggaugauccucuucaggaugauggaagcccuccagggaugaucacgugcacccagcugccauauuugaaaauggcucaugcgugcaaaggggcccuauccuuuaguuccacauuuaacacauugaauggaaaccucuaugaagagacuuuuuccugagcaggcugucguaagcaaauguuggauuugucuaacugagagcuguaggcaucagaauuuuuguaugucaaugcuauguuugacauuuauguauuagaauaaaguggaauuacaaucaaagaacauucccuucaaucacauuguuuuucccaucccaggcaacgaauuguccaaacuuucuauccucuuuuuuuuccccuaggaacaauucaguugagcagacugucuuaguucauagguggagauucuuuuguugucugucaugggcuacuagcacaaaggaaaaaaaucuggacugugucauacauggguaauuaacaugucacuuaguuucaugugucuuucuuuaaagagaaaaauagaaauauucaacuccucuuuuacaacuauaagcagaggaauauaaaccuuuauuuaagaaaagauuaaaauacgcuuaauuccugugcuggaacaaguuuagaaaggaaugacaggaagagacaaagaagaggagagaugagagaggcccaguaaacuugguaggagguaaacuacucuuguaacucugcugcuguagugucagaggacauuaucaccuguuguugcuguccuuugaaaaacucauuaacucuccaacaguuucugaagucuucuucccuacccucgaaaacaguaugucugcacuuauuuucaauaaucaguuucuuuuagagaccaagauguauuuucucacaguaauucagaagguuuuccauaaaggaauggucuucaccguaacacuguccuuugggacucuaagauauugaccaguuugagaacugugcuggagaucuacucuuuguucucccugucucaucccacagggccugggaauuaguugagaaccaggauuuauuuaauucugagguucuuguagucaaaucuaccuuggauucuaaguggauucuaauggagauaauacacacuaagaaccaaaaagaacucagagaacaagccuaucaagaagaauagguuuuaaagaaauaaauguaaaacuuuacucaagagaaaaaucuagaacaaacuacauugaaauauuaacagugauuaucugugucuggugggaccaugaauuuuuuucccuuucuaucuuucuuuauuuucuaaauucuccauagugaacauauauuucuuuuacaaugagaaagaaaacaaaauacuuuauuuuagaagauggaggaagaaauauauuugaacuguuuacagcuggugcggcacugaagcugcagcuuuuacaaauuucucuuuucuucccucaccaccuauguguuuauuuuauuugcauccagccuggcuguucccaacucuccucccugucuguuuucauucuuccaaggggcgucccuccccauacuagagaacccucucuuucucuaagacauauuucucaccucuucucuacccuuucuuuuuaggggcagggguaacagcuuuauugagauuuaauccacauaccauacaaucuauccauuuaaaguguauaauucaauuguucuuaguauauccacagaguuaugcaaccaucaucacaguagauuuuggaacauuuucaucacuucaggaagaaacucuguacccuuuagcuaucauuccccaaccagguggagauaauugaaucauggaggugguucccccauccuguucucaugauaguaaauuaguucucacaagauccgauggauucauaaggggcuucccccuuugcuuggcacucauuuuucuccuuccugccaccaugugaagaaggacacguuugcuuccacuucugccauaauugugaguuuccugaggccuccccagccaugcagagcuggcuuuucuuuauaaauuacccagucggguauuucuucauagugaugugagaacagacuaauauauucacauucuuugugguuuucuuagacuuuuaucuugacccuuccagguaauaucuuucuauacuaaagugggaggucuuauguuuauugcagccccucaugcucuugacauuuagaucgaaccucaucuugaucuucuucaaauugucaauaaucuuuaugauccaccaagaaaacugcaaggguugggagaaguucagggugguuuuuuuuuuguuuguuuuuugguuuuuuuuuuaacuucuauggaaaucaaaauggaaggccuugcauggguucaauuuuucuugccaugugugguguuagugagaggggguuuggagguagggagaggccuaagggaaacucuuuccuuuaagagagggccauuguuucccguagacuaauggccauauuccauuuccuuauggaguggggggaauuacuuagacucagccuuuacucuuucagcuuccacucuugggaacuguauuauuaccuuguaaaacagaacaucucuccuauuagcuguuaauugaacccaucuuuuuccucugugaggaacuauaauguugacuuuuauuuucagagcucuguauugagccucuucuuuuuggagauugauggugcucagacaccagggguaggcugugggguaggggguacaggcauaacaggaagugacuuguggguaucagaaguuaaauaugucccaacaaccuuucuugaguuguucuguccaucaccuuggcuuugcagugacccaagccuuugugaaucuaugcugagagcccuuucucucccucccccgccucuuaaaucauuaguugaaaugaagaguuuuaugguaauuguccuaguuuguuuuauguugcuguaacagaauuccuaagacuggaugauuuaucaagaaaagagguuuauuuauuaggcugggaaguucaagauuaggcggccucaucuugugaggccuucauuuagaaggccucauacugugugaaaacaugguggagaaaaggaaagggaacugagcacaagugaaaaggacaaauaugaaaggcagucucacuuuauaacaaccgcucuccugguaacuaauccaaucccuggagaaccaacccaggcuugcaaggcagacauaaguccauuuucaccucuaaaaggcaccaccucccaacacugccaccuuggggaccacaccuccacaugaguuuugguaaggacaagccaucuuaaaccauagaguaauaaaaugaagaaucggauuaaguccaagaggauauuuucaccagucuuccucauuuggccagaucugagaacaacucccagaaggcauuucugggcuaaggacuuccaccaguguccaaaugauauucaggccucugguuccuauagaggccuguacaucaggccaguccauucuuagccuggagacaauauugaauaauuacuccacugccagaaaauucccugaauagagucuccaaaaacuuaguauagacauaagguacauuuggaugugaaggaugcuuuaauuuucuaccaguaacauugcuuuagaaaauaaaguguguuuuauuuuuguuuauuuaccacuguacaucuauuacauagauauuuuaauauuucuuuuuaaacauauccacuucucuccagucuaaggcauauuacuuuguguauccauguacaucugaaaugagauaacagaccugaaauuuuucugguauauguguguguguuuacauacaauugcagacauaauauauucucucucugugucacucucucuuucucucucucucugucucacacacacacacacacacacacacacacacacacacacacacacuugucuuauuauauguagcacaaaaacaaaagcaaauaaauaauaaaauauacuagaauugucccccacccugcucccucucccucacaggagccacaauauacaaauaacaaagaaaccuuccucuucuggcagaugugaguugcucugacuguauugccaggagaauuucauagagcuuauacuguucugagcacccugcaauucugaucugcaaccauuagccagagccuauauggaaacggaccaucucuaggguaauagcauuguaaauuacaaucaaugcacccaauuacacucagaaaccaaaagauauguagugcuccaguguaccuuguaaucagcaccuuugaaaauguagguaacagcauucugaauaagaaaaauggaaguggaacgucuuagaaaaugaauguuggaauuaaaucauccuucugauagaaacagcaccuuauauggcagucaacuuuuuuucuaauaucauuuuauugauuuuuaaaaaaaaacuaaacuguggccuuguagccaagaaugucuuuaaaagucauuuauugcucuaaucagccuggcagagccuuucugucaugcugauaaggaaauuaaacuuuucucauacugaguuuacuugccucuuaugcacagauguuuuguuuuucuuuuagggaacuaauucagaaguugaagucuuucaucagcuucuauagugcuuugccuggcuacaucugcagccauagcccuguggcggaaaacgacacccuuugcuggaauggacaagaacucguggagaggugaucuuuuuugaaaguuacauauagcaauauuugaggaauaauugucauauguuuauauaaaaguuaauuaugucuucuaucuccauuaauugcaccagaaaaauucuagagaaaucuaugaggcuggaugcgguggcucaugccuguaaucccagcaguuugggaggcugaggugggcagaucaccugaggucaggaguucgagaccagccuaacacagugaaaccccaacucuacuaaaaauacaaaaguuagccaggcaugauggcgcaagccuguagucccagcuacuggggaggcugaggcagaaggaucauuugaaccugggagguggagguugcaaugagcugagaucgcaucacugcacuccagccugggugacagagcaagacucuccaagaaaaagagaaaacaucuaugacauuccagaugaugucuauaauuuauagcccuccuagaaguugcaaaguuugaaacacauagagaacugugucugaaggcaauuuuacagaguuuaaagcauaaaacaacuuucuuuugucuucgauucuuccaucuccucauuauguggguccuuauuuauuugauuugaagaaaucacauucaucuugaaagcuaucauuuauugagaguuaauuguauauuaaguaccaugcuaagugcuuuguauguauuauuuaucuuuauaaaaauccuaugaaaugaauacuguuauuuucccccauuauacagaugaagauagagaaaggaagaaaagggagggaaagaggaauaccauuucacugagcaauuuuacugaaauauuuuauggagcauuuguggguuuuguuuguuugcuuguuuuguuuuuuuguuuguuuuuuuuuuugagacagagucucacuuugucgcccaggcuggaguacaauggugcgaucuuggcucacugcaaccuccgccucccaggaucaagugauucucccaccucagccucccgaguagcugugauuacaggcaccugccaucaugccuggcuaacuuuuguauuuuuaguauagaugggguuucaccauguuggccaggcuggucucaaacuccugaucuugggugauccaccugccucggccucccaaagugcugaaauuacaggugugagccacuccacccagccgaguauuuguuaauauaaucuaugcuaucauuaugugugaagaauuugcucaucacugaaaaggaaaucauauauauucauuauauucauuuauucagcagguauuuacugagcaccuucuaagugccaagccuguugaaaugaacaaaacagacauaauuuccuguccucgcagagcuuucauucuggugcgcuagugguauuccuaaucuccauugcuuuccaugugggaggaauagcuugcgauuaaaaaauuaaaucaagaggacagaaugcuuaggaaaccacaaagaguugaugaacaugcuuuagaaaauguuuguacaaguagcauguuauagaggagaauacagaagagacccaaaaucgagucugaaucuuucacuaauuaguuguuuaaccaaaggcaagugacuuaaucucucuaggccuugguuucccccaucuaaaaaaggaggugguuggauuagagccccuccaggucugacaaucuguauuuuuuucuuauuaauuuauucacucauucauaccuucaacauuuauguuuugagauauuauguguuaggcaccaagcuaggugcuagguaggggugcaagggcgaaaaaggcaaguuagcugcuuugaagagcuuacauucuagugggacccaauaccaggacauggaaugcugaauggaauuuauuaacaguauaauggagugcaaagaggaaggcuuuggagccagaugaauuuggauuugccucucaguucugcuacuaacuguggccuugggugagucacuuaaccuaaaaagucuuaagguccuccuccucuguaagggaagggcaucucacaggauuguuguaacuguuaggagaggucauaaaugaaaagccccuagcaaacuggcacaugcuggaagcucaauuuauauuacuucucuauuuuucccccuuuccccuucacuccuccucuuuccaacacaaaacaaaagacaugucagaaaauagcuuguuccucaucuaugcuauuuuacugacaugggacaaugagaauaagguugcgugccacccugaaugaggcacugaaauuguauggagauacacuucucucuggcaaauguaaaucagccuggaaggauuaauggcuccaugcacuggagaaauaauguauauuugucauccuaaaagcucaucagguacuaagaagaaucaugaacauuuuuuuuuaauuuucagaaaaaaacaguugguauuuggcuuuauaaaaagcugaugcuuuaaaacugauacaaacaauaacuauuugaaaaagaauauauccacaggucaaauaugugcuucuuacauaaacuugaugacaaaccauuccagugccuuguccaguguuauguuacuuuagcgaaaaaugaacaacuccugaauauuuguuuuaagcagcuuaucuucuaaccaugguuucuuauuaaaaaggaaauuuuacuuuacaaauauauuuauuuacugauguguucauucauucacguauucauucuaacaaauauuugagcacuuauccaauaucaagcacuaauauuuguuucuucauugugauuguuugaagcaaauauuauaacccugcuggauuuaucuucuauuguuuauggugaaaaaucagaucgauccaguuuuaguuaauuguaaaauaauuuauuccuaggccuauguauuuugaauuaguggaauuuuuauugaauuuugcucauacugacuacuucauguuugguacacuuuggugaagaaugaugcccuggaaccaagaaauuucucuucuaucaaaugguggauuccgaagccugcuaaauuugaaugaguccaaaaguuagccaaauguacuuuuauaucauuaaaagaacuaugguaacugaaauauuuuuguuucauuugcuagcuuuaagccuuaggguauugaacaaaauaauaaaauaaauauuguaguauggagaaaagcuaauauuccaaacuccuauuuauauuucugauuucugaaaaaucuuuauuuucaaaacgacuuuuauuguuaauauauacuauccaggaaagaaagaaaggaaagaagggagguaagaaggaaggaaggaugaaggcaaggaagggaggaagaaaauaaacauauuuucagagagaauaaggguaguguaauccaggaagugacuccuucuugguuaguaaccucagguuauaauuaacuuguacuuguauuacugaccuaaugcaaugaucaaacuagggaauaaugucaaacuaaauuuuuuuaaaaauuacucaggaauauaccuuuaauaauaugaaguucuuuagccugaagacauguauggcuucuauuuguaccauuuauaaagauuagcuuugcacucgugucucaucuauagugaaaaccucuuucuagagcuuuucaauaaauuucucauuuaauuuagucuuaaguaacaguuaccacuuccuauuguccaguggguuguaacuuuguuaucuuucuaggucaaguuugugugccugugaaaaauuuuacuuuuagucaagaaaaauuaugaaaaucaaggauccugauagggaaugagacuugucaguggagacacuugaucaaaaggaaaauauugauguugagggaaauacugagcaauauucaugucaguuggguuauuagagcuguuuguagccuacuauggauguaucgaucacucaacuuuuaaagaguuaauuccuuaucucucugaauaaggucauauuuuccauccuuuccuuuuuuaucucuuaugaaugcaaucaauugaaauaugaaugaagagaauguuuucaccgauccagucuuagagaguaccacauaagccuaucauucuuccuucucagcuucccaccaccacccuaucugggcuugagauaaacauugguuugucuaccaggacuuagcugagaaaccuucaaauuagcaaacugggcccaugugagauauccucuuuuaugugagccacuagcauauccuacaggcaaagauuuccuaaaauugccaaaggcagaaagauccuccagcuucugccuuugucaaacuacagagaauuucaauuagagaguccuugagaccaagagaaagauaaaggaacccagauugcugaguuaacacugggcuucacaauaaguaaaugucuuugcccugauaacacccaaaugaacagugaacauuuuuguaaaucauucucaaacacccuuuuugcuaggccaaauaucuggauaauugacugaauuuucauucauuuucuggauaguuugauacuuuauaaauuaguauaacagagcaacuauaaauuaguuuuaguuucuauaaauuaguuuagaaucuauaaauuaguaaacagaguuugacacuuguuuaaauuaguauaacacaggaacuguuuaaacuauauauguucaaaaaccccuaguuugugagaaaaaaaauaaacguauuuugucuuuacauuuaauaucugauaggccaggcgugguggcucacgccuguaaucccagcacucugggaggccgaggcaggcagaucacaaguucaggaguucgagaccagccuggccaauauagugaaaccccaucucuacuaaaaauauuuuuuaaaaaaauuauccgggugucguggcagguacccguagucccagcuacuugggaggcugagguaggagaaucacuuuccaggagguggagguugcagugagcugagaacccaggaggcagagguugcagugagcugagaucaugccacugcacuccagccugggcgacagaguaagauuccaucucaaaaaaaaaaaaaaaaaaaaaaaaaacucugauaauucaggcucauuccacacagauugagcacuuaauauauaauagggcauaccuugauaaguagaauccagcuccugcgccugcuaaggaguucacaaccuagagaaggaugaggaaagaaaaucaagccaucucugccgggcacgguggcucacgccuguaaucccagcacuuugggaggccgaggcaggcggaucacgaggucaggagaucgagaccauccuggcuaacacggugaaaccucgucucuacuaaaaauacaaaaaaaaaaaaaaaaaaaaaaauuagccggccaugguggcaggugcccguaaucccagcuacuugggaggcugagguaggagaauggcgugaacccaggaggcagagcuugcagugagccgagaucgcaccacugcacuccagccugggugacaaagcgagaguccauccgucuccaaaacaaacaaacaaacaaacaaaaaaagaaaaucaaccccaucucuuccccagcaguccagggagagcuccucuuagagguaucacaacagaggccccauccauguguauugugugugugugugcaggcgcaaguguguguguguguguguguguguguguguguguguugagguaaaauuugcaugacaaaauuaccauuuuaggguauacgauucaguggcauuuaguccauucacaauguuguacaaccaccaucucucucuaguuccaagacauuucaucacuccaaaaggaaaccuuguuguacauuaaugggcacuccccauuuccccuuuccuccagccccuggcaagcaacaaucugcuuucugucacaacagauuuacuuauucuaaggguuucauauaaauggaaucauucacuuagcauuauguucuuaagguuuauccaaguuguagcacauaucaguacuuuaucauuuuauggccaaauaauauuucauuguagguauauaacauauuuuguuuauccauucaucaguuuuuauucauuuuuauauaaacucugagcaacuacuucucugucagaucucucucacuaccucugcauucagcuuagcucacccuuauccuugaagacaggucagccaaaccuauaggccucccauccccaucauccuugagcaccaucuaaaugcuagccuaucaccagaccucaucucuguaauccuuugcaaugauucuccccugagucuuugucucagccuucuguuuguagucagcuggccucuccuacaauuagcacaccucccauagggguuuauauuucccuagugacuuugaggcuuaucaacucugcauagacaacugcuuuacuuuguggcacgaugccuuaguucccuuugugauucagcuggagcugcuaaugcuaccccuuuaucauguugcugggccagaugggccuagcuccagaugucagcuccaggauauugcuguuuucuggcugacaguuucuacauagccacuucuguucauuaugaauuggagcugggcguggugacacgugcuuguugucccagcuacucagaaggcuaaggcaggaggacuauuugagcccaggaguuucaguccugccugggcacacagcaagaccccaucucuuaaaaaaaaaaaaaaaaaacuauguuaugaaugcauguucaucuuuaauucucucaugaugacucugagacugucacauggggcagcuggccuuacuaaauaaacucccuaagaucugcaggggaaaauuguggugaaucugccuccucuuuaucuuaugcaaucuuaccucucauuucaccugagaaauuuuauauauauauauauacacacacacacacacuuugaauucucuuauuuccauuaaccagacaagucuuccaauguuucuaaugccucuucaggauuucucugcuuaauugagaaggcagaagugggaauaugcaaagcaauuauguuaauucucagaguuuuguccguugucucaaaaccuucuggauguuucagaaaaguacaguaaggaaacauuuuucucucucuucugcuggguuggaaggauagacuguggcaugucagcaaguugaagugaauaugagagaaccaugaacacccaauucaugagauguguaaaaucauacaaacaauuaaaugaccgaaauagcuucuuuuuuccccuaugaucuaggaaaggcaagggagaauaguugauucugcuuuuauaaugcaauuauuuuaagaacacgguauauuuugagaaauuugguugggggcacaguucuuucuuuucuuuaguuuuuauuucuauagcuuuuggaguacaaguggguuuuuguuacauggaucaauuauauaguggugaauucugagauuuuagugcaucuaucacccaaguaguguauguuguaccuaaaaauuucuaacacgaaaaagucuuucacugguuuacauggaaacaaggaaagaccuucagaaucuucaaucuaguaguaaagagauuaaguaaaaaaaaaaaaagaccuauaugccaaagugcauauauacucacacauacauauaaaacaugcacaucucauucuagucaugucagaacaggccagugguacgcagcaguugcuauacaucgcuuccaugcucucgugcuaaaauaaguuauuauuuguuguuguuguuguuguuuuuuaauuuauaggguggcuuuucuccaaagugcccaaggcaguaugcauacaauuuuaaauauagaauagccaaugcaaacaucaauggggaaauaaauaaauaaaauacagagccaagaggaagaggguacagaaaaacauaaacaauggacaauggaaauaauauucaguagcauugagucagguccgaaaguccauugauucaggcauaagucagacuaaagucaugcugaaggugagacucaguagcucuucucagccacuguuguggugauuugaggguuagaaacugagguauagucuucaacuucccagcucucucuucucauagcuaguucuuccuuugccccuauauuggaggaggcucugcuuaugaaaggcuggugggagggacagagggacaaauagggcuuugguauuugauuuaucacuaucuaucuccacaguuccuggucccccuaagacauuuuuggauuucauuucuacuuuaguuuucccaggagcagaaacaugacacuucauuuuuuccgauuuggggaacugcuauguuagccugagugugugcccaagaaugaacauacugaaguauaaugaugcuuugcuaguauggcaguuuacauauucuaccuugccuuagauaagucaagauugcucuuggaaagccuuugaaggagaaauggauuaugcagaaagugacuuaauuugguauagcaugaaauauuuauggcagcuaagaauuuuuuuaaauccugguaaggcagaacagaucaguuuggagaguacccccauguaauaaucucucuauggacuuagauuggcauauuuuucagcagcgauuuaucuuagauguagucuuuaaugacagauauuuaucaggacauacucucguggcaauacaguaacauuuaucccuuaagauuauggugucauauacaguagcuuuaccuucagaauugagugagaaaaacacagcuuaugcugcugacggauggcuuaauacagugugcuccauucaggauguguuagacuugguugacugucaugucuuaaguagcaggaagagacauuuucauggcucaacauugauaugucuauagacaaccuguugaauacuggauagcuuauuacuuuaagcagauuguguccuauuaguauacaauucuagccucuguugagcucaguuggaucauuuugugauacaaagagcauuugggggccuccaaagcaggucccagcauauccacacccucaacaaauaaacaucaccuccuaauuuccucuuggaaaugugauucugaugguuggauaaggccugucuccuuuuacuaucacugcuccaugaaucagaaaucuucuauuuuagccuggaaggcuuaggagauggaaccaggaagaaacauaucugcuuuuaagaaauggguaaauuaacauacuagagcuucucugccccuuaacuauuauugccuccuucaaagguagugccuugguaagugacagauggacuccacugaugcugccagucuuccaaauaauuuuucuaccuccuuuuuggaaaaagccuuguggguuuauggcugaucccugccgucuacaaguuguugauucucaaccaguugauuaucgguggugcaggcugaggucuucagugagaagacccugaaacguuaggaaacauacacuaggugauuaauacauacugggaagagugcagucuuuagaaugauccagauggauuuuuuuuuuuuuuuuuuugagucagagucuagcucugucacccaggcuggagugcaguggcacaauuuugacucaccacaaccucagccucccggauucaagcgauucuccugccucagccucccaaguagcugggauuauaggcacgugccaccaugccuggccaauuuuuguauuuuuaguagagacaggguuucaccauguuggucaggcuggucucgaacuccugaccucaagugaucugcccuccuuggcuuccuaaagugcugggauuacaggcgugagccaccgcgcccggccccagauggauauuuuaauccuaguucagacaccagcugugugcuuugggcaggacauuuaauaugacauucuguuaccuuauuuauaagaugggaguaaugauaccuacucugcagggcuguugugaagauaaguucuggcacauaggcacuuaaauaauugauagcugguguugauguugucauuacuauuauaccaugguugagcagcccauguaaauguccagaguaaaggugaagaggugugggccauguuucuucccauaaagguaaacuggauuuuuuuugggaaauaaugugagucuuugggaacgaaacugcuaaaugagguggcugaucaagcaggcucauaccauuugggguucauuuggagugagaggauaaaauaauagggcuguuuccuucuucuaacauuuauauuggcuuuaaaugggguuuccaaagaggaguuccaggaauuuuucuguagagacugggucucgcuguguugcucaggcuggucuggaacuccuggguuuaagcgauccuccugccucaggcuccuagguagccgagauuaugggcauguaccaccacgcccagcaagaaguguuuugagugaugucagcauaauuguugcaacaacguuugggcugcauacauucugguagauuuauacaaguuugaaaucugucaugacuuuauauucaccccucagagagcauguaaguugaauacugauugaaacaaggcugcugagugugauagguguccugacguuucccugguaaauuucuuuuaguguuaucagugucacuucaucagaacaccucugaccucuacaaacaguaacacccgccugaaacauuuuuguccaauuucucugacucaggaaguuucuuucugauagucaaucacugagcaucagugaaaguggacucuugggacuuggagugugaagcacagggaaagguauguuagggaagccucuuucuugggagcuuccugcuagcggcccugcucuuagaacaccucuggcaguugucauuguuguggcugugaucguuggauugugguggugguuuuucuguuccacaggccacaggaaauggcuggcaggugccacuuucuuugcugcuacuggcacaguucuuucccuaggguacaagcucuuggugacuucuuugaaagaaauuuagcucuccuauuuuuuugcucuuucuuccuauacuucagcaaguacaaaaucuuguuugaguuucuccgaugauuuuuuacugauagaaauguagccaaacaguugagggauuaacaaaaagcacacagaguuauguggcaaccuaaggcaguguaguagaguguuuaaacuuacaaccuuagagucagcaaagccuggguuugaaugccuuuuccauuaccuauuagcuccuuuucuucucugauccucagcuuccccacacguaaaauggaguuaauaguuucucccuuaacagauuguugaaaagauuccaggagauugcgaagugcagaguauagugccuggaacacaguuagucucucaaaaaugguagcuauuauugcuguucuucaaaaaaaccuauaaaaaagcccuugaagaucuuuacugggagauagauggaguuaggccugauauuggcucccuucaauaacccauucuuaacuuuucaggaacaccuaccccccucucauuuuuauguuauuuccucuuuuuucugcaaaaacaucaaaaucccaauccuuggucaugguugguucaaauggugggcauuugaguccacuggggaucaagugagaguuauuugcaucuaagggugugcgcuaggcuggccuucuuaccuucagcaucuuguuucacagcaaagacaucuuaaaccauuucuccuaugacugcuuuauagagauuaacucgggcaaucuuccuaaauuacauuaaaaaccaugaugagucuaguugcaggucaaaaauaguuguucagugcucuaaaguccuuucugucacccuugaguuagccuuuguagaaaaggagaaagaucauuaaaaucagucaugauuucccaauuucucaagccaaugaauuuuauucuuuuacgugaguauggcuuugauccauggguuugucucauuuagaauguaguuucauuucccuggaaaagaaauuuguuuuaauuuguaacuccagugucacaggagcuuccuauuuuuugcccgcugagaucuuagugauccacauggucagauggaucuuaaaaacuacccaaaugaacuuuuucuugguuugagccacuuguuggcccauuuugucauuguucucuuugcuucuaaucacagcuucgggccuagagcugggaugaguacuuguucagcaggagccagaguaagguguucccaccugggguagggauacagcaguugggguuggagggaugcauagaggauugcacuauguaagaacucaugcugaaaagcuaauuuccaaauacuauuagggagcacuaagacaaggaccaucuuagaaugggcuagaaaaagagccauuggcuagcuuaccccuacuuauccuuaacauuaucucuucugaggacccuggauccuccuguccacaccuuugucuggguuaaggcuugcuggcaccuuaucuucucucuagcauguccccagcgacacuauauugagagcuuuuacaugucugucuguaaucuucuaguagcuccuucgugacugguacugugggccgggcacaguggcucaugccuguaaucccagcacuuugggaggccaagguggguggauugccugagcucaggaauuggagaccagucugggcaacaugucgaaaccccgucucuaccaaaaauacaaaaaauuagccgggcgugguggcaugugccucuaguuucaauuauccgagagggugaggcgggaagauugcuugaacccgagaggucgaggcugcagugagcuaugaucgcaccacugcacucuaaccugggugacauagugauccccugucucaaaaaauaaaauaaaauaaaauaaaaaauaaauaguaguacugugucuuccaucuauagaaccucauugcuuagcugugccugccauagaguaaacucucuauacauguuuauugaauucguaggaugaaccaacaaacauaguuguggguaacagaccuuaguacuaggccuagcuucccaugguaucacuguaccauuaagcagauuacuuaaacucuauuuuguuuucuccuuuugugaaauuaauaccuccccugccuaccucaaaggguugcugugagccuccaauaagaaaacgcauaugagauguuuuugaaaauuauaaauuacccuccauuuacuagauguuaguguagaagaguagaucagauguaaggggaaguuuuacccugaauaaauggaacauuggguaaucaacacagcauuacugggcucucuuuacaaacauggauccuuuaguagcuuccugaguaucucucucuguacaucucucaaggacuugaggaaugucacuuaaaaaaaauuuuaagcaaauccaccuauccccaugaauuuuauuuuuaaacaagucagcccguggugcugaauuaaaccaguuggcccucgauaaggaaauacuuugagagauugguagcaucaguuuaaauuaaugaaaagucugagugacagaucauuuuaaaguaaaugcaguuuuauuacuuucaaacacauauaauaacaaugcugggaauugaauuuggagaaagacagccugugucagagaaucgaagcauacaaauaagaaucauugauaaugaggcuauugcuguguggcuauccugcuaaagaccauccuccucaaauuggcuaauguuccccuggagaagcuuaucuauuuaagaaaccccuauuuuuuucauuuauaggcaugaagaaaguaccauuacaaauuccuauacauggcuucuggauaacccagcuuuuucaaaccccaguggauagcaucuagcagcagugcccugcucucugguuauaacaaauaguaaucucgaacagcaaauacccucuggccccuacagugaucaacuuuuuccagguugccuaggacuuuccagguuuagcacagaaggucccaaguccuaggaaaccccucagucccagcaaacuggagugguugguuaccuauugguaccuaugacucuuacagcuacuaaauauagggaaaagaugcagucguggggguuuacauugaagggguggaggagagcugggagagcugcagcucacccauucuguugguuucucugccuucacuuuuuaacuccucuuaccuuuuccucccugaugcauuuugaucauugcccucuucccuuugcucucucaaauucuaaggguacagugggacuucagaaagcaggacugagacaguaaaguggcuaauaauaguaauaacuaaccauucuauggagcuucccaagugccacacaauaugcuaggcaguuuguaugcauugacuaauucucaacaacagccuuuugaagcagacaguauuauuaccuacauuuuacugauucuacugaugacauugaguaaauuaccaaaggccacagcaagaugggcuucaaacccauccaauccaucccuuacccacaguacuguccugccugucaaaugccugacuucucuccugcaagguuuaaagccuucucaccuucuuccuauucuugguggaaauccugacgucagcuugcuuuaaucugucauccagcagaccuggaaugaguguucugugcagcuuuucucuggucuguacugcuauacccuguccuuuccuuguucccugcccagucuugcuccuugagaguagaaguacauuuccugccucucauaccaugcuucucugcucucauguccucucaagucuauaaggcgccauccccuggaagaaggaguucuuagagauauuucagccccuugcuagaaaauggcacucaccugccucugaggcuagcucuccauuuaaucuccucuacucacaugccucugauaauaaagccauugccugugcauccccuguggcgcuuuggaguccaugcaaacaaacaaacaaaaaaccuuugcccuaggcugagacuccagccugaguccuagcucuacugugaacuuguugcaugaccuuggacaagucacugcacuucuguuuuuucuuuuacuuauaaaauaaaggaauuugacaaaaucaccucuaaagcacuuuccaccuauaacaggcuaugagauccuauaacaaagauauuugaugggggagggaauaugaaaggaaagggaacaccauaaagcuaccuuaaugacuuugaauuugaugccuucccaaguagaccaaagugaaagugauucgaaaggaaccccaggguauaaucauucuccugacgacagcagugagcucuucauuuuacuccuccagguauuauuggagcuacaggggagcagguagguuggcuguuugagaugucagaguuguucucgauuucuaauguuggagaguuugggguacaacucacauaauuaaaccuuaaagaaaauguuucccccauagcacugcauaacuccaauggggcuucugagcaggaaaaagaaaauggaauucaaugucuguugcucccaauaauauuugacacaacuguccagaaugaaaauuagaagcccucuaaccacagagauauauaagugacaggagagagacauugggggagugccaagggcugaagggcagguuaagagcaaaggaauacaaaguggcuaagaaaaccagagggagagagacaauuuccacccuuuccaagacccuccaggcuagagggcuuggguaaauuuugaccuaguuguccuugugugcauggcugugagcuuuuauuaaguauuuaugcagcaguuuauauuuuaccaagugcuuuacaaucacuuuuauuuggcuuaguaaaguuuuccuggaaucccaucuacuuuaugaucagaagagucauuucuuguuugcuuagcaccuccauguguacagccucacacaauaggccacuuguuccagcaggagagcaggugcaaagaguugagcaguggagggcaccugcagcuaccagggcaguuggaguggguguaguuuacacuucagcucaccuuuucucccccuuuguuauucuuucauguuauguuauugcuggcaacuugagaguggcaggguaaggcuugggccugucgagugcagagcuguccugcauauggacacuggcaaagguaggcucuuuccccugugccagugucucugcccaugcccaccauggccaugcacuuccaccaggcaaagacuugcugaguguguuucuuucugcugcuucaggguucuugcugcagccuugguccuagaucucuggacaugaguuuaggaagacuauagaaagagcaguucuacucucugcagacaagaccagccaguguucuuggacaaaucuaacacuuagcuaccuuauucuugguagucccuucucccuuccagcaaccacggcagccccccugcaccagcacucuggauuuugugauguaggaugguguggcuguauagauggcucaugaagcaauauggcuacacacucucaaucaccgguuugcagugggaauccaacacagucaucaguuggauguuuccuuuucugaagaccagauuugccaaggcagaaacuaaaugcugguucgugaaguccagaccggaauuaguaggccagaacauuggaaaauucaggaccuccaacaacuaaaguucuguggcugagaacagggcuauguagaugcuuaauagguaaguguagaauagaugaugacacucaguggagcauagaaaaggaacucugcuguucucuagguugccacugguuucuaaaauggugugaucuggcaggugggacacauugacagguuuaccucgaagggcccaguguaacauagguccucagucaguggcugcagauuugggggaaaggccccaggggcaacagguugacaaggguuaggcagaguagcuuagagucuccaucacacaaacugagcauuggauggggccuuuuaucucaggucaguucaguagacauuuauugaguggguacugggugccagguacuggguaagggagugggccuagaaaugaauacagacaagagccccaggacagaguuuugcucaggaaaacacagcuggcaagaggaagucauaccugaacacccggggcucacucaaaaaaacaugaaauacuggcuuggaggaacaaaacgaauuccagagccuggggccugacaagugagucaguuaaacuaacaccuuccugcccuugucacuacuggcucaggaucuggguagggcuaauucugcagguugaagguuugaggccuggaagugacugugacuaaggccagaggagcugacggaaaacaguggcaggaauguuuagcuuucuuuucaaguguaucaguagcaccuauuugcaugaaaacaguuuguucuuugaggcugaucuuuggcaauuuauuaaccacaguucagccagacauccaaaagaacacugaggagccuuuccucccucuguuuacuacauauucuagagaugccacacaagagaaaaauccaccaggcacacuuuuuccuguuucagacuugccucucucccaaacgugucuggagucaguuaagagugauuguuuagguggacuuugagaguccuguucuucauuuugaagaucaccacauuaaagaauggauguuuguugugggcccugcagcgacuggagacaaacaaagcaguguucugagcagagagauuugaaaaagcgugugggcauuuucaagagucaucuaauucauuacuugugacaguauccaaaguggaagcagaauauuuucuaucacugagaggaggaauaugaacugugggagaaggagggaggggaacaggcuucugacacccaaagcuggucacucaggaaacuuuggaggguugcccugggccacaggugaaugauuaguucuucugugaacuaaaauuaauuuugagccguuugaagcccuuucuggucauuucccccucagaugaugcccugucuccuggaagguuugggagggcaccucugcuaaaaaguuccucucagcuaggcuuaaaugcucagagccagccauucacacaucauugcucaaucgcgauggcaaagaaaguuccagugcuuuuucccuugcccauuuucccugaugauaagccauuccuacucaugccuugacccauacuuuaccgaggaccaaaauaagagaacugagacucuuccacuucuuaaguucucaauguggggaugaagggauuugaagcuucccuuggcuauucauugcaagguuuauuucuucucucucaggaagcucuuuuuuauuuuuuuuagagacugguucuccuguacuccacccaggcuggaguacagugacaccaucauaacuaacugcagucucaaccuccugggcucaagugcuccucuugccucaaccucccaaguagcugggaccacaggcaugcaccaccaugccuggcuaauuuguuuuuaaguuuuguagagaugaggucucccuauguugcccaggcuggucucgaacuccugggcucaagcaauccgcccaccucugccucccaaagugcuggaauuacaggugugagccaccaugccuagcaggggauucuuuucaaauaaccuuuauugaacaucuacugcauuugagaugcuguguuuggugcuuucacgugauaaaaauaauaacagcagcccucauauagaacuuucuaugugccuggcauugucuuaagcacguuaucucaauuugcuaacauucauuauaucaaauaauucucaaaacagugcagguggcauuauuccuauuuuauagaugaggaaacucaaguucggcaagguuucacuauuuaucaaaagucacacagcaggugggggcaccagcuuugaacccaugucucugacuccaaggccagugcucuuuccaccacgugacucuuccucccuaaaauguauuauguacuugcugccucaguaaacuaugacugccaaaccgaacuuaaucucuuacaacaauuauugaucauuauuuugaacgucaguuaccuucacacaaugcccucauguuguugagguaugugacuaguuccuugcccccuuguucuuugcuauucuauuugggggagguaacagcuucauuccugucucacuagcagugaugccaauaauaacuuuaguugcuguuauuuggccucugggccucaguuugccccucuguaagaggagaacauugggcugaaugacuuugaagguccuuucuaacccugauauuuucaucaauuaaaaucuaacuuaaaaauagguaaagaggcugggugcaguggcucacgccuguaaucccagcacuuugggaggccgaggcagguggaucacgaggucggaguucaagaccagccuagccaagauggugaaaccccgucucuacuaaaaauacaaaaauuagccaggcaugguggugugcgccuguaaucccagcuacuugggaggcugaggcagagaauugcuugaacccaggaggcagagguugcagggagccgagauugcgccauugcacuccagccugggcaacagagcaagacuccaucuuaaaaacaaacagucgggugcaguggcucacgccuauaauccuagcacuuugggaggccgaggcaggcggaucacgaggucaggagaucgagaccauccuggcuaacccggugaaaccccgucucuacuaaaaauacaaaaaauuagccaggcaugguggcgggcgccuguagucccagcuacucgggaggcugaggcaggagaauggcgugaacccaggaggcagagcuugcagugagcggagaucgcgccacugcacuccagccugggcgacagagcaagacuccgucucaaaaacaaacaaacaaacaaacacaccagguaaagaucguguccuuuugguuuagcuugaguaggacaagaaaaugucugguccuaguucucuggacuagaaggacuugguaaacgaguuuggggugauugaauaagaagucucuaccacacuccuuguucuguuauuccccacccccgauuacugagcuuugaauuacaccuuuuucuuucucuguuuuuaaacacaguuggaguccucuccucauuuguguguuccccucaaggacagccaucagagagacacugcucuggccuaguguccugaccgccauguuuaguucucaccagcuugcuuacacuuugggcucugccuagcuugcgauucucacaagaaucacuuuugcugugcuuauuuacuuuucucucucuuuaucucuagccucuucugcaaaguugguuucuucagacuaacauucaggugaccucaucucaagcauuuucucauuaccuuccccuuucugcugggggacuguucccuacagccacagacucuucuccuuguaguggguaauacuaaccucucacucuuuccucaccaucugaaaaauauucuuugcuucucuggguuucaguggcuuccugauuauguaccaagacaaaucuuuuagucccuccucaaaguaagguuggagacugcacuguaaacagauucuaaugcaguuauucccucauauagcuaauggcuacuaacggaaauauagaaauagguuuauaucaccaaacaccgcauguucucacucauaggugggaauugaacaaugagaacacuuggacacagggcagggaacaucacacaccggggccuggcgugggaugggggaaugggggaaggauagcauuaggagaaauaccuaauguaaaugacaaguuaaugggugcagcaaaccaauauggcacauguauacauauguaacaaaccugcacacuuaaaguauaauaaaaaaagaaaagaaaaagaaagagaaacagauuuacaugcccuggguuucuuuccuagauuuugcuuccucucuacugaaaucuacuuguaauuucugaaaggcuguuguuggagaacacagguacuucuuggaguaaaguggauauaucuguuucuagcacccucguagcuuaacauuggcucugaaguaguacugcuaugcaaacaauuaugaaagacauuuuuuucacaugaaaguuuuuaguuuauaaauccucucaugaaaaauccacaauggccgcagauaacauauugcagcccuuuacuucuucgacuuuuugccagcaccaacauuggccuuugcggucccccugacuuucuuuauuggguucuugcauuccuuucguugcuuucuugaggucuuuuucuucucauacaggccaugucuugcaagucuauguuuggguucauuuuucuuugcauaauccagggaaucauaaaucaugccaaagccaguugucuugccaccaccaaaaugaguucugaauccaaauacaaagaugacaucugguguggucuuguacauuuuggcuaguuuuuccugucuuaggcacucuaaauuucugucuuaggcacuguugccuuccuggggucaaggacaucaaugaccauuuguuuccccugaaguagucgguuggucaugaacuuuguaguuuggauaguuaccgugucguucaugauggcugucuauccucagacagccagggaggagaaagacauuuuuauuuagauaugugcauaaauaaagaagaagcuaauuguuucugucuuuauuaagcacauuuacaaaucucagcucuuuucaccuuugcuuuauuuuacugugcauuuauguaaauuaacacuguaucauggauaaagaaaaggacguuuucuuaggccucuuaauaggaugguuuuucuacccuguuuucugguuugucuuuaaagcuauuuaugcucuuuaaauuauccaguuuuucccacagugauuguuguggccagaaugcguuccaaggaaacagauaaaucacugaguuagggauuacaugcaauacugaaucguguccauaagauggcgcucugagaaugugagaucucuaacauuuuuagccauacauagcugggcagcauauuaaacuuuugugaaaucaaauuuuuuuugguggggaccuaguccuucugauuggcucucaagcacuuggaaccauucugauacuuaagggaagaaggaaagugaauuuucuagcaguucccuuguccuaaaucaguacuagcaagugucaaaaaucagcaagaucuguuugagagaccuuuuaaagaaaggcauuucuucuaaaugugggacuugugauacuaacccuauguguuguuacaaaugucccugucuggguaucagauucuuccucuacacagugaguggauuggaccagaugaucgcugagagugcuuccauuucaaaugaucuacauuugaauuuguugauuucccuccacuacaacauugcugccucagccagaacagaaaugagaagaaaagaucgccuauuuuacgcuuguuugacucuauuccucuucuacaagugcucucuuugcuucaacugucccaagacaagcaugcccagauguccuguuuuaaugagguuccuuuucuguuuauggcuuuugcgcagguuuuucccugcucuccccaacccccuccgcaaucccuaaccaaucugccugaacagaagcaugucccccuuuucacuucacaaauaggauuuucuuaguauuaugacagucaucuuugugcuaaacaguuaccaaacuggauaaagaagaagacgccgcauguaagguaacacuucuaacauccaacauagcauguccaguuaagaaaacauuagauuugggagguaggaacaucucucaguuuauuuuuccuccuccacuugcuaguauucauugccagaaccaugucaaagccucaguagagaagcagcauuuugcagaggaggacaauuuaauuacagaugaguauuacuaaguagcuaacccauuguuacaaucccccauggccaacaguguccccauuccugacauccucugggcagucuguggauaagaagaauuggggccacgcuggcucauccucauucaaggccugucgugaaccacgugcuccaguggcacagagcuagccugaggaaaugaaaugcugaauuaaugaauuaaugcaaagcugcagaggcacccuucaucgauugacuucccucugggcuugaagcucagagcacacauguuacaugaaauuccccaggggcacaucacacauguugccuugcuguagccaagaugacaaaggcaggggaugcacuaagacauuguuaugcugcauuuguuuuccuauuguccuuagacaguugaaaucuucaaauagucuuucguaugugucuaguggcauggauggugguggugguggauuauuuauuucucuaacuucaacaccuugucucccaagaacacaaguaugucacugaauggcuuugaccugcccacccuggccucccaaaguauggcuauuaaauagccauacugucguaucucuguguaagagaagaaacccuauacacagggcucucuccaggggcucuuaaagggcaaguccaagaaucuugcugaguaggccaagagagcuuuguggcgaugcugcugggagccuuguagaccaauauaagcagcucauccauuguuuccuacaaggaagcaauguagcaggguggugaggaaaugucaaauauuuagucaacaucauuucucucuaagaaagcaagaccagcauagugguuaagaacccacacagcuggagauggaacccacacagcuggagauggauucucaaaguucacacuccagcucugcugcagacaagcugugugacuuuaggcaagugaccuaccuucucugugccucagcagcagcaaaaacaggcugccaauaggguagucaggaggauuaaguucauguuuucuuuuucuucagugcuucgaacaguaucuggcacagagaaagcacucaguaacugacagcuaguauaaguaccaugaggugcuuugggugauuuaaaaaaaaaaaaaacuaaccaagccucugccuucaaagaccucacagaguacaugggguggcaaauggaauauacauaaaaggagcacuagcaacucagggcagugcccacaguacauuucaaugcgagagcagugaggucagcaugacucagggugguucagggaggcccucaauucucaucaggugaggacuucaggcaucuacaggaaaagguagugagaacuugaauauguucuuugccucuguuuugagggaggguacaacugauaauuuacauucauguucacauccucacuaauauacuaucuuuuugaaauaggcaggucggaguuaccucauugaagaguagaaaauagggccgggcaugguggcucaugccuauaaucccagcauuuugggaggccgaggugggcgggcggaucaugaagucaggagaucaagaccauucuggcuaacagggugaaaaccccgucucuacuaaaaauacgaaaaauuagccaggugugguggcagggcgccuguacucccagcuacucgggaggcugaggcaggagaaugacgugaacccaggaggcggagguugcagugagccgagaucgcaccauugcacuccagccugggcaacagagcgagacuccaucucaaaaagaaaaaaaaagaaaagaaaauauauauacauauacauauauagagagagagagcaagagagagaagguuucacucugucauccaggcuggagugcaguggugugaucucggcucacugcaacccccaccucccaggcuuaagugaucuucccaccugagccuccuggguagcugggacugggacuacaugcacacggcaacaugccuggcucauuuuugugucuuuuguggagaugaggcuucaccauguugcccaggcgggucucaaacuccuggacucagacgaucugcccaccuugaccucccaaaaguacugggauuauaggcaugagccaccacacccagccaauaugggcuauauuuaaccuaacaaaguugacuuggugaccugaugucaaccaccuaagguuugaaggaacucaagggugacauugugaacauugccccaaauauguguucugucauaagaaagcaccuuuaaggaaggacauuggugauugccaacauaacucuuauuaacaggaaggauuucccagaggcccugagaugugcaucugagucaggcccacuuuuuguuuuucuuuuguuuuguucucuuuugccuuuaaaacaacuaaugccuaggaauauaauguauaauauggugacuauauuaaagaauacuauauuguauauuucagauucacuaaaagaguaguucuuaaauguucucaccacaaaaauaaagauaauuaugugaggugaugaauagguuaauuagcugguuuggcauaaucguuuaacaaugaguacauauaucaaaacaucacaucggaaguguacauguauuuaacuuuuaucgauucuaccucaagaaagcuggaaaaacauuuuaauuaacugcuauauaaaaucucauucguuauauauuaaacuauuauaaagauuaaaaauggucaugguaaaaaauauuuuaaaauauagaaggauauaaaaaaauaagauuucacuagcaucucccuauucucacucacugaaagugacugcucuuauccuuuucuuauauauccaucuaaaauuuuucugggcauauuugaacauguauagaguauauaagaguaaugcaaauguagacccauuuucacugcagaugcugcuauuuguaucuguuauaauguaucucguacuugauuccauaucaacacauacagaucuacuuugcccuauuaaugugcucauaguauuucauucuaacacugauuacuuuuaaaauuugguucaauauuuugucuggcuaaggagcaaaggauagagacaugagaaacagaaaaaaguauugagagcugugggagagguaucaagauaccuaaaggauagugcaagaacacagaguuuuuaaauagugccacuaaacuuaagcaacuauaggcaucaguuggaccaggacuuuugguuacugccuugugaaguagaugcaaaaauggcaagcuuuaggccuaagccacagggcagcuauucccaacacuucuguaaccagaaaccaugcuuaauuugcuagaguccuuugaggauuuaaauagcacauggauagagcagaacaguagaugcuauuucaacuuucaaaaaguuuggcaagcuucuaaacccaaaacugucuuuuaaaaauggagucacugugggaucagggagcaguguuuaguccuggcacuuuauccauggcugcgagauaagaaauuuaaaaaaauacauagcuaaaggggcacuuuucugaaugacagaaaauaauacaguaggaccacaaaggaucagcugugggauuaauuugauuuaauauuuauaaugguuuuggaagcuggaguacggggcaaaaucgcuaaguuggcagaugucuuuacacuauuccaaugaggauaagaagcuuugggaagacgcuuguuuuauagaaguggacauaaaagugguuggcaagcuuugauaugaaaaagaccaaggauaugucucuagggacacauuccugaaguucauuucagaagauuuauaaugagccuuaccucuuuaucugcaaauagggucucugcuucaggcaucaguaggaguuaaagaagagaagauggaguugguaguaucaucagaagaugaaugauauuuaaacagaccgcauuauaugaacauaaaagaggaggcuaguagugagcugauacccaccagauaaagaauguuccuuuaugucucuuuaacacagcccccaaaggcaauugguauuugaugauuggugaucuguguauucaugaguuaacuuuuaaaguuaaauaaucugaauguguuaagcuaucauuuuagaagaaaugcaaucaaaugugcucuucagcaucuuugcuacaaaauauuuuccuucucagaggaugacuuuuaauuaugaaugucagaacuagauuuccugaccuccucuguuagcaugcauguuuuucuaaguauguccuuaauauuggcagauauauuguaucauggacggggacaucuaauagaaugagauuaguauguucugaaguugugaaauuuuuaguaauaaagaaauaaugcccuaucuaauuuucaguaauaaagagcuaaugcccuaucuaccucucaacuucacagugugguugagaagcucaaaugagcugagugauaugaaacugcuuuguaaagugcuguacaaaaauaugguaauguuaauuauucuuuguacuucauaacuugggauuagaaauauaaauugacucaaaaucuauaaauuuauccuuuauagauauaaaugccagugugugaaaaucaguauacaaggauguucucugcagcauuguuuauauuaacaaaauauuacaaauuacuguuaaucaguaaggcauuggauaaagaaguugcuacugagccauacagaggaauaagaacaaggcauuuccauguguucuaacaugaaaauauguccaaaguauuuauuuaguuuuaauuuuuguuuugagacagggucucacucugucacccaggcuagagcacagcucacugcagccuugaccucccgggcucaacacugcagcauccaaaggugugcaccaccacgcccggcuauuuuuuuuuuuuuuuuugagugguucgguuucuuaauuguuuuauuuuaagcaguucuguuuuuuuguauuaaaauacugcaacucaauauuuuugucaaaguuuccacuuucuuaucagagacaaaagccagaaaaauacaaaaaguguuccuuucccucauuucucaagcauaacauccaacaauuuggcagcugguagcuguuuuugacaguugugacuuguaucuggugauauaaacaagauuacagaagcacuaaaccauaaauguaguuucauuuuuuuggucauuacuaucauuuuacaaaauauugaaucuacuuuugaacauuaaaauguaguccagcuuuuuaaagccgcaauuaaccaccauauuuuuuauaggaccaaaacaguuugauugugcuuuaaaaaaugaucauuuagaaucaauuaauuagaauuagaaaugcuuaaugccuaccuuaaguggauagcuaauugauuccuaaaauaaaauuuuggucucuuuaaagauguucaaguugcaacauugaagcugcuuuggugguacuaucuaaaugauaaucuguuugcaaaugccaaaugaaaacucuuuguugguagauugagcuaugugccgaauuaaacacaaaucaguuuaggcaucuucacuuuucauuaucuuaucucauuggaaauuauacauaauguaaacaguagaacccgauucacugauuuuuuuuccuuaguuuaauacaagugugccucacuuuaagcaaaauauacuaaaugauuucugaaacaggaguuuccuuauuuuuucaguuaaaaagauuugcuuacagaauuucuuuaaauaacaaggcuucuuuggccuguuuagaguauucagaucacagaaauucauuucacacacaacuucuuugaaauaccuacauugcauaaaaugaggcacacaaguacaugugcccauuccaucgagauugccucauuauuuugugguuauuuuauauuuuucaguuugucguuauuaacacuuuaguaugccagguucauucacucccuauuuuaguugagaugaguuaguguuucuaaggaguguuucauaaucucuugucccaaacuaggcugguuugggaacccagugagagugacugaaaauugaaauucaaguccuaaacauacuuccagagcacagccuaucacccuguggagauaacacacaaacuaucucagaggacccccaccuguggaagugaaaaucaugugagagucauaguucaaaagaaaaaagugcugggcaccguggcucaugcccguaaucucagcacuuugggaugcugaggcaggaggaucacuugagcccagguguuugagaccagucugggcaacacagggagacccugccucuacggaaaauuggccaggcucgguggcucacaccuguaaucccagcacuuugggaggccgagguggacggaucaccugaggucaggaguucaagaccagccuggccaacauggcgaaaccccgucucuacuaaaacgcccagcuaauuuuuuguauuuuuuguagagaugggguuucaccauguugcccaggcuguucucaaacuccugggcucaaguaauccuccugccuuggccuaccaaagugcugggauuacaaguccaguccaaaguauguauauuaagugauacaaaguugcaaaucaguaugaguaguaucauuccaauuuugguuaaaauuaccuauuaguauauguaggugaaaaccucuacauguauaucaaacuguugaccaugguccacucuuggaaagacagauugauggggcaacuuuuacuuuaugccuuguuuauuuuuguacuucuuaaauuguuuacaaugaacauuauuauuuuguaauuaaaaauaugaguuacagauaucaauuuugcccuuauaacccuggcuacccuauuguaauugaaaaaaaaaaguauauaaugagagagcaaaagcccugggaaucuuuucauuucuuuaagaaagcauuccauuaucaggaucaggagcaaguaaaaaagagcucaaaaccuuuuucucucuuuggcaaugguguucugguauuuccacaugaugaaagcaaaaggaauaaaugaaaucuguuucuuguuugcuuuguuucgcaaaaugaggaauacuucuauguagaggucuggaaccaacaaggaaaccaccucauuugugaaucacugucccaguugaaguuggcaaaaccccacacuggaaggcagaauugccuaguacuuuaaauaguuacccuucucaugauggugaggauguccauugcuaccuugaaacuucaauucuggaguaaagccuaugguuuauccuacaggagcacauuaaaaucuucccuugggcugguguucucuccucucauggagaacgcagagggaagcugacagguauaauuuauggugaaagugauuugagaaagucuccugaauagauacccagcuccagagccuacaggaaauggugggaggaggaagaagaggagaaggaagagguaaagaacauggaagaaucuuucuccuucaaaugaguagaaggcucacacacagugaagguucauucugugugcuucacugucaugaccuugaaccuccccuagcacagcucuaaucacucugccuggucauuggcccuuacucuucuagacuccccacuggacugagagcacaauaagggcacacagaccuugucugucuuguucauuguuguauucccaacaucuaggggaaaaaaagcauguuguauauauuuguugauuguugaacgaauuuuuuuuuacuguaaauagacacuauguggaguggucuacuuuugcaccaugaggucgucucaugagcuuguggucagucugacuguugaugccaaauacagucagcuuuuccuuuguuugggacuuucuuugacaaaccuuuucuuuaccuucaccuuuacagauacagccaaaaggcagcaaggaauggaaugaaaaaccaguucaaucuccaugagcugaaaaugaagggcccugagccaguggucagucaaauuauugacaaacugaagcacauuaaccagguauguggaauauaaaaaauaauaauaauaaaaaguagaaauaaccgagagagaggaggagggggagagagagagggggagagagaggggggggggagagagagagagagagagagagagagagagagagagagagagagagagagagagagagagagagaaagagagauauagccagcuuccacuguucaaacuauauucuugggcuuuuaggaaagacgcuauuauuucuucaaauagucugucugcuagaaaggacuucuggccuuauuuuucaccccacuuuuaaauuauaaagacaauauugcaauuugagggguagcuuggaaaauagagggaaaaauauuucucacaaucccacuauuuuaucccaacuguuuucauuuuuacauguucucuucuaauauuuguccagaaaggcacacucacacagacuuuuuccauaauuagaaauccacaagugauuuguaguucugaaaauuaacacuaucuuggaaacacuuuucuuuuccauguugucacaaaucuuuuuguuauuguuguuuuguuuuguauuguuuugagacauggucuugcucuguugcccaggcuggaggucaguggcacagucauggcuuacugcagucuugaccuccugggcucaagauauucucgugucucagccucccgaguagcugguacuauaggcaugcaccaccauaccuggcuaauguuuaauuuuuuuguagagaugaggucucacuauguugcccaggcuggucucaaacuccugggcucaagcaauccuccugcaucagccccgcaaagugcuaggacuacaggugugagccaccaugccugguccccacaaaucuuuauauuaauuauuugucauggcugcauaauauucuguugaguauucaucauaauuaaucagcaugcuuuugcuggauauacagguugcuucaaauuuuuugccaucauaaauaaagguaccuccucauacauagugcuuuauccugaucuuagcuuauuuucuuaacaugcuaaaguuauugggucaaaggauaugagcaauuaaaaugcauguguccaaauuugcuuuucaaugagaauguaucaguuuucacugccaccagcaagacaggagagguccaauuucacugcauccuugccagcuucugacucacugccaugcacagagacacccacagauucccuugaccuguacacauaguuuuuccucucauaagaaguuuaguaacaagacacaaauagaaguuaguuguaccaucugcuuaugauugcuuuguggccacaauaaaaaugccaccaaaaaggcauauaccagagugacaguguuccugccccaugauccaugggugggaggacuguggcaucacugacuucuauuuguaguuuaggaagaacuuaaugaaacugaaauccuuaugcaagaacagagguuuuaauacaaagacauugguaugaguuuuuaaaauauggauuuuagcagugaaauuuuuguggguccuagaaaauacuuagaagggcuuucuaagaguaguauauuuuucacugcaauuggcauugugaaaguauugacaacaugcuuggguauaaacuccucuggugccugauaaggugcucuguacucagugagcacuuaauaaauagcuguuagugcugcugagcacaugguaauggcagugucuaccuaacugagccauuuuugugugugaaaguacaacuucacuaaguucuaucaagccuugcuagauauagugugaugauuucaaaaugcaucucugaggggaucagagcacaaacgauguaaaacacuuacugcugaguugagggcaugauaugcuucacuuggggacagugguacaaauuaucucaaaccaaaaugugucuagguggcuauguucaacugguuagaccccaacacuggugaggccaaaaucucaguuuccaucacugugucccuaauucuaaaugaggaauauugucaacaggucccuugugucaacagaccuuaaggauuaccuacuauguacucagccaggugccagggacuuuggggauucaaaggaagucuaguccucuguccucacagccuccuugagggaggaagcauaagcauaagaagugguuaaauaaagauaaagggcagccugugaugcagagucugaagaggagugcugcucaucgguuuugggugguaugauuaggcuagugggaagauugcagagaggggcaaguguuaagaucugccauaagcaaugaguaggguuugaguagguaaagacaagcaagggaggggcagucauaagaaagaucgagugaagaccugugggcggaccccacccuagaaaaugggaaagcugcaucagacaugggcuucuauaugaucaggcagucacuaaaaaauauuuauagcaaguccuuucagcaaaggcuuugggcacaguagaaagaauuugggcuuuguauccaaauggaucugaauucaguuauagauuuugcuaggcgcauaacuuuggguaaaucaguuaaccucucugagcuuuaguucucucaucuguauuaugguaaagauaucaaaaacuccaguguauaucuaucauauacauauauauaauauguacacauagauauauguaauugcaugugcaugacaggcacuuaauauauggcaguuaguugugaggacuguguuuaggauuuucucuauaggcaggacuugaguuugaaagggaguuccaguacuuucugcgagucuaauucuucucccccaguuuuguauguuuguagaucccuuugaugcaucucuucuuucucucccauauugucuccuucuuuuccucuccucuaacuuucagccacaaaagcugaaaccagcugacagguagggagauguacauagagugagaaaagucgcuauuacaauuccuuuuuccuaccucuggccaugaauaugugcaugaacauuuucaguuucuauacaaauaccauugagcagccaauuaauucucauugauaaaccaguuuuaccuguuucaguugagcuguuaaaauugguuggacuccaaacacccacauugauuuuuuuucucaucuguguugcuuuauauagccaaaacacauuuuuucaguccuuaaauaaaauuuauauuuuggccaugauucgaucugaaagugagacacuucagggaagucauaaagaagaaagucaugaugaugaugaugaugucgaugaugaugauaaugauaauguguucucuuuguauagcauuuacccauauuucaaagugaugucauguucuaaagucuaacugcuuaggaaaaaaauccaacuuggaauuauauaagguauaaaacugugacagaaucuuuucaagaacucauuauuacucuuaaaccuuaucucauuuucacuguuuuucagaagguaagggauaaauaauguuuguccuuuuuauaguuagagaaacugaggcagaaagccauuaauggcuguauagacauacugccaaaagauccagugaguucaguuuaaaacucaaucaaucauccagauguuuccuauacacugccaaacaucuggauucacugaaugccugacuaaaucggccuaaagauuuggugauagggaggaagaaucaaguuaacuuucuaaguucacauguaauugaguggugaaucugagaaugugauguuauuuuccuaagccccuugcucggugcugcaucuauuaaaacuacaauagcaugcuccaacauacauauuuauaaauacagaaauacuucuccucucucucucucucucucucucucucucucucucucugcauguaugccccaugugcguccauccagaugaacuauagcuaggccauuuaugagcacaucccaaaauagcuuuucacuuuguuuccugggaauucucagcugccuccuugcagguuaugguuacuguugauagcgcuggaaagaauauacccacuaagggaauaaaguaacauuauuuucauauugauagucccaugguauaaccuugaggggauggguucagagccaggcucaggccccuuuccugggaaggccuacagguguggaauguucuccccuccuccuuccaaggcagaguucauguguaacauucccacgaucagaaaugaggaccuuuuuauuuccuuuucaguuucuaauuugugugaggacuuauuuucuuguguuaggaaaagaauugaacucuuuuauguccucagugucaguccuggaauuugcuaggccauguugcuuuaaaacaacaacaacuaaguuuuguuuuuguuaguaucauucugcuccaggcuccugcauggagagaagacuccacaauuaccaaaaacgaucacaacacaucguuacucauauaauacuaugggccauuuauccccuaaccuaguuuuguuguuaacuuuuucucucucuuuaagaguaguuauguaguuagugcuaauuuaguagucccuaaacugcuacaggacuuauuguucccaaggaaaaaucuauccauuuauuguuuccccauuucaguucagguucaaacgaaauaccagaaauuguuuuccugcccguuguaaacaguugaagccagaguagucaauaccugcccacuuggugucagagcuuuucauucaaaguuagauaaagucucaucuguuugggaucguugaaauguccugcugaauggugggggaguggacgagauggccucuuaagauuccuuccagccgugugauuccaugauuuguggcucaaggucaggcuuuaacccagcacccucuugugaacaagucuugugacuuuauucucugcucugccacucuuuuuaaaacacccuguucccaggucaccccuuuccacuuuguaaccucucaucuuuucaaagguuguucccuucccaccagucuuccagccugggcagauggaacuuaaacuugcccuuccccccacccaauucuucuguucugccuuguucucauuaggcuaugaaaacauuaaacuauagaaacaguuuugcauuuaucaccccuaaguuucccuccuccagggccagauaggugaccuguuuucgaaucauguuaaccaugugauuccauaugaaugauaauucugccauauguuuacauagcacaauucaguuugcaaagcucuuuccuauccauuagauaacgugaucuuuauaaccacucagagaggaaagcaaggcaggcauuauuacuuacauuucccagaugaagaaacugugggcauuagaagucuacugaguuccauacaguaagugguagagcuagaccuagaauccagagcuacugauuucauucucugugcacuuuccuuuacuuguaccaagacauggcacaccuauuaggaagaucuauauagaaaagaugugcagaauacaaauaacaaaaacuccuuaauuuguggucugauaauuuucaagugccaaauaugguaauuucuauggccaaagcucuaaaaucagcagcaaugaaagauuaagcacauuguuuacaaaaucucaguuggugagauucuuggaaaacuaaccaccacauuguauggaaacagaggaacuuuguggcaugaguuugaguuauaaauagcagaagaacuuucuguuagugagcccuacuucauagaaugauguuaaauggucaaagauaauuaaaaaaucuagaacagaugcugaaaugucuccacuuccaucccccucuguaaacaccagaaaauuauuuuuaagaugccuggcagacucuagugcaaugaagaaacuaacuuuugaaauagaaaguuaaaauuuuuuaauaaguuaauuaguaaagcuguuaagugccaaaggagcacucaggacauuccuuagcaugugauuuuaauaaaauguuugaaaugaaucucagacaugauggaaaacacuccaaguaacuuguuuucauagucuucucacaauaacaccagugagaguuguaaaacacuggccuagugcagugguugcuagaaaagccaauauugagcuaaaauuucuaaauaaaaggagaaaccuuuugaaagucaacuuuaaauaaaagaccuucccaaauggaauuaugucccagugucugucuuacuuguucacaagugacauggcagaacucuaguaauugccauuuauuuccauacggagccagaaugugugugugugugugugugugggugugugugugugugugugugugugugugggugugugaaggacagaguaccuacaagacauguuagcaaaagccaaugaaugacuucugagucacaaaaggacaaugugaguuaguccuuaaauaccagacuuagacucuguggaguuaaacauuauuucaugaaguaaaagggaauucucugauauauuccaaaacggauuuaucauuaaaaaaucuucugucacuuugccuaauagccugaaaaauaaucacaaugucugguggcuuuggggagcauguguuuuuaauaucuuaauuacuauauacaguuuaauaacacugcaccaagaagaauucccaaguauuucauacuaaauuucuugaaaaugaacuauuugcuauauuuagaauacacaggauuaaagguacuuaaauuaggucauguauuuuaguccuugcauauuaaauuaaauuacucaaaaauggaagaugagucagaaauggugagccaaaauguuguugguauuaguguuguggucaucuugauugagcaauggagggaaauacaugaacuuuucugauuacauuauuguauucuuucauaggauauuuuuaacuggacauguuagcaauggaaagacaaguucuacauaugaaaagagaauucugucaaacaauauagacuaccagguuuaugaaguuuagaaauacauuucuaaauuuucuaugaaauucauagggucuccuauuguauuuacauuuacccacuggccaaaugcagcaucguuuuuuguuuuuuguuuuuuguuuuuugagacggagucucacucagucgcucaggcuggagugcaguggcgugaucuuggcucacugcaaccuccaccucccggguucaagcaauucuccugccucagccucccgaguagcugggauuacagguacccaccacugcgcccagcuaauuuuuguauuuuuaguagagacaggguuucaccauguuggccaggcuggucucgaacuccuaaccucaggugauccgccugccucggccucccaaagugcugggauuacaggugugagccaccgugccuggcugauauuuuuuaauaaacaguuacaaaugcucauucccuaaaacguuugcaguuacaaauauuugcuauaugagguauaucagucuguguguauguauguguguguguauucaaauacuauuucagaaauuaacccagauauauuuaugaauauguaucaugcuucuagacuguaaacucccuaaguguggaaucacacauuuaauucuuuguaucccauggcaccuaacacaauagcauauacaaaguagacccucaauauauauauaauuaauugacugaucagucaauucaaaggacuuaaccuuugcugcccuuauuucugaauuuagauuucauuuaagguacuuuucgcauucaauauuaaccagugucugugcuaaagggcagaauuauauaagugcaggaucauagggucuaacccuuugauuuuacagaggauguuaaagccaggagagggaaaugacuuguccaaagucauacuaccaguaaaugacaacacugggacugggaaaugaacagguuaauauucuauagugccauuugcucugcuuccaaaggcucuugaugcaaacaugcuugcaaauacacagacacauuuucuuauacaguaaguacuccaaaucauggcagaagcccauaguuaugaaguucaucuuuggaacaaauggcugcacaguaggaaucaugaacuugcuaauuauuuaucacuuauuuuggauauuaacuaaguuugggccuaacaaguauaccuuagugcccaacugccucauucaacucauugggcaguuguugcaccggguggggaggucucugcugggaucacugaaccaaaggaaggcagaaucagcaagaccuguugcucauggccuuuuacccacucacagagucugacucaggcuccuguucucauucagggucagucauccuuucagucucauccccuggaucucaacuccuccaccuuccuggacaucuuauaauaauuuaucucgugccuccuuccuccuuccagaaugacaaaauuagcaucauauuagucagugggcuuaugugccagauagcucaguuguuuagggcaguguauucagauuguguuccauagggaaugugggagaggugcuguggagguuguucuaagucccccauuccuauuuuaaccagagcagcuccguuuuuaaaaaucuucuucacauauuggucuucuaaguaagauuucacuuaaagggguccaacugcaaaaauaacagaaaucuuagaugcccuuaaagcuaacauuaaaggcuuaaucccacgugagccauuucguaauuugaguggucaaugaagguacuaaauaucuauaauacacaaggaagucacagcaugcccuccaguccccaucagccacuuucuaaaaugaacugugggucagaauggagaccaaaugggagaaugugaauggcuuggugguaacauuauugaagugauagcuaaaggcccaugcucuaguacuagugaaccagaaguggcuucuuugaagcugaugaccaacauauaugaguuuucuuugcccaugucauuaggauucuaacaaaauccgaugaaaacaaagugcugagcugagcucuuuugucuugaacuagcuugucuauauggugcagucuuguguuaauuggcccaaacaaauguuuggucuuaguccuuuaaucccauggcuauuugagaucuaguguucaacuguagauuuauuugacacauagcaaaaaauguuuccaaauucuguaugggcucaguguugguauauaguuaagguaaaaugguaauaaugagauuaauucuuuacuccuaacuaugugcuuuccuuagauagugagcacagugauuuuauguagcaacuguuaaguggagugucuccaacagaguucuaauuaauauccaaaauaaagaugacauuauuauuuauaugcacuggaucuuauuggauaauuucuuaaguauggucuucuuuuccuuguuuaauaaguugaucuagauauuuuuuucauagucccuauuuugcuaagucaucacuucugagaguaauaucuguucuguauuaugggcaagcagcugacgaaaccaaauaaaagcuaagagaauuacucuucugguaugucacaaaaaugagguccaaguucagguuaguuacauucaaggccacugaggauucuuaugguuauuaucaugguaucacuguuauuaaacuuugaagcaucacaaagaauuggugaagagccaaaagacugaagacuggcacaauuguuuaccaucaccuucaauaagggauggaaauuggauucuggaagccacaaaccagaaagucuggugucacaucuuaaugaaauucuagauuagauucuuggagagcaugagcucuuggaagcaaccauggugguuacaaguagccacuguggacuuacucagaacuaaucaggccauuuccccuuauaugugcguacaugcacaugccuuauugaucagaggaauggcauagacaugcugggucuagauuucagcaagguguuugacagagauuccuaugauuuguuuuaaaauaaguaaggagaaacauuggcuaacugaucaucuacuuggauaaauguguagcuaauuaauuaucauauaugaaauguaucaauaucagcccagagugaggccuuugguuauuaacuuugugcuuagccccuuauugccuaaaguuuuugcuagugacuuaacugaagauagagaaggcauacuucuaauauuuagugacugcaugaugcuagguggggguuagugaauacauagauaacacaauugggaugcaaaaauaucucaguaggcugcaaugacaggagaaaacuagcagaguaauauccccauggggauaaaugugaaguauuacauguagauucacaaacaugagugccuaagcaugauaggggaaauccaacuuagcacacauguuaguuuuuaguuaugauggaaacagcuaugaaaccuucacugacccaaaacaauaucccccaaauauugugauaauuuggcaacucucuugauguuguugccauuuuuggugggaagagagggauacguauuuacauguauguugaggugggagagggagagacauggaagugacuagaaaaguacucuccaccgcuugcagugagccgagaucgcgccacugcacuccagccugggcgacagagcgagacucugucucaaaaaaaaaagaaaaaaagaaaaaagaaaaauacucuccacccuguuuaaagguuaaaaaggacuguuuugggauugugauguucacugcuccacaugaguuuuuguuacaccaauacuaccuguuuuaguuguaaagcaucacugguaugugacugagagucucagugagacaucugagagccaaaacacuggauuauuuaguuugggggaaagaacaaaggcuuuagagccaaauagaucuauuuuuaauucucagauuugucauuuuguaguaacuuggcuuuagggcaaauuacuuaacuuuccuauacucaugcuuccuaaucugugaaauggguauacuaucaucuaucuugaaaaguuaagacaaauauuagggauaauauaugugguaggcacucaauacauucuagauacuguuuuucuucauauuauuacaauaugaagaguuagcauaagggcaagucaagagugaccuuuuaagugacuugagucucugugccucaguuuaucaauuucugaaauggagagacuacaacguuuccaguuuggaguguuguuuaaaugauuuaaaaauucuaaauauaauaaucuaaauucuaaagauucuuggaaaaauauaucuagccaaccuucaacagauuuuugaacuauuuaaagauuaguuuggcucaaagugacugaauggaaaaugaagacgauuuuuuauauguguguguguguguguguguguguguguguggguggguguguggguguguuuaaaucaaguucuucagauuuucccaaguuugaacucugcccugaaguagaggcucuauaaauaggcaggcugcccuuggaguacagcuuagagauuuuaccacaugauccagaagucccauuuuaaucuucagccccaccaggaccuuucauggaaggaugguaucaaguggagagacuucagagcuauaaagaucagggcaaguuaaucugcauuccuuuugcauuuugcucucugguugaagauggugagagguuccuauauuuaaaacccgguugacaugauauccuuauuggccgaugucucacaggagguauuuagaaugauuuugagcagcauauaauauguuugugaguguguguguauuucacaugccaacagagcagaaagaauucacagggcuuguggcuacugagcuuucuugagacaccaucacucucagcuguuggggugaugucacaguuacaagugacacugccuaggcccaaauucccaaagcucuuuuuugcauugcagagccuagggcagaccuacaccaugggcucuaccuucaaagaacuauggaauuuguuagccacagacugggaccagugaccacuuguugucaggcaaaaggaaagcugcccccugcugccugagccuuugugccugccugggauaccauggaaaauggggaaggaauccagacucauuaaugagcuaauacaaaagauuaagccaagcuagaggcaguuuguuauagcugcauauggaugcucgaaggcagucagagcugaaagaucuccagaccagaacccaguggugcugccgccuuuguuugccagacacaaauauaggauaaggguauccccauggggagcaauuuucguauugccaauuucuuuuuucaguuaugucauuccccgagcuguugugugacaaauugauugaucaguaauugcaaucugauaacccaugguccaaauuauuguuaaaacugcagguuucauuauaauauacugagauggaacucagaucugagcuuuuacuuggucuaauggucuuuguucuuguuuguuguucuuggaagucacuuaaagcaugauuacuucuauggcuccuuuucaaaaugaaauucacaaggcaaaauaaaaaguaaaauacacacacacacacacacacacacacauauauauauauccucgucauuuauuaggaguuauuuauugaaugcccauuuuuuauguagugcuggauuugauggggucuguugauaaggacauagagaaucccccccaccuacacacucaucacauaugcauauaucaucaccauuugcauucauuuauucaauauugagcaagcagcucucugugccaagcacugagcauaggggcugcagacaaagguacagagauaacuuaagcacuuucaaugagggugaugaaaacaugccuaccuuacuauacuccaaggcacagugugucauaaaagaaauauaaaccaaguacuaugcuagccuggagaagagaaggauuaauucuuaccgagggaauuagacaagacuuuaaaaauaggagguagccuuuaagccagccuuugaaagaugaggagaauuuugacagaucgagauuggaaggaaggaucuuccuggcagaggaauauggcaugagcaguggcucaaagacaugaaaguacaucgauagcauuauguggcuggggagcugaggccacaagccagauuggaagaggacguggacagugaaagaugagauggaaaaggugguaaaaaauuugggagggccaugaauagcauacuaaggaaucugagcuuuacucuguggcagugcagagcccaugaagggcuugaagcaugagagugacauggucagaucaguuaacaucaguaauguuaacucugccagcagcgugaaggauguuuuaaagaucagaaauuggaggcaaggaguccaguuaagugauagcauuuacaaggcaaagaaggaaaguuuguuauucaaauucauuacccuuccuuuccacugccugaugggaaaauggaagggguauccaaucuuuuggcuucccugggcuauauuggaagaggaagaauugucuugggccacacauaaaauacacuaacacuaacgauaacugaugagcuacaaauaaaaauugccaaaaaaaaaaaaaaaaccucauaguauuuuaagaaaguucacaaauuugcauugggcuucauucacugcuguccugagccguaugcagcccgugggcugcggguuggacaagcuugguuuaggagaugagaaccgcuuugucccuaaaguugacuuaaucaucuuuuggccauuagccaggacauaggagaggcuggagcaggcagugguuugggucuccgcagaagguaguagggugcggcccucccacaguagaccaguagcuucuccaggucccacaguagaaaaugaaaagaaauuucuaguaccugcagagauuugucccuuauugaaccuuuaguagaaguucucacaaugagguauuuagauucccugaugaauguguuaacuauuacuuuuaaucaauuuguuacacacuuuuuuuuagucagaauuccaauuaaauguagcuccuuggcuguugaauguugagugccauccauucacugaagucucaaaaauuaccaaaacugugagaaagaucgagagagauuauaguguuuuucuucagcugccacugugggugcuuagauguguuggagagacuacuguguuucgugacagccucacaaagaagagugggggccccagagggaagcagugacuguucgccuucuccauaccuucucagaacacauuuuccuguuuguuaucaacuccuaugucuuucuaauuauggcagcuccuuauagcuggugcuguuucacuagaacagucuccaagaacuuuacacauguuauauauaagaccucgcuuguucauuuuacucaagcaugugcugacaaggagcugaccugacauuucaccaagacgcucugccuuguacucgacagugccucuucucuccaccuuagcaccccugugcccuugcuggucagagcagaugcugagaagacagagcggaugucucgguuaggcuaaccuugccugucccacucaccaccguaucuucagcucuuugaacaaugccugguauagaauaaguggcugauaacuauuuauugcauaaauaaguaaaaaacucuguuccucuuuauccucaguuuagagcuguguggacagggugaauauauuuugcacauggaaaagauaugaauuucagggagaaaauguaguggcagguacagagagaaggcaagaaaguagggggauucuuuucgccaucaaaaaaguuacaaaauguuaccuugggguuuugcuuuucaaguauguacagaauauuuuauuucuucaagaagucaucuggaauagcccuuccucuauuuuauugagaaaugcaguggaauaauaccacagcuuccccauaagucuucauuacaucaguucagaagguccucaacuugcgaagaaccuggaaaauccaugaacucucuuccuguucagucgcccuuuucugaccuucacuugggggcuaugcuguggcuaucauacaguggaauuauuuuagacagagcccccaggcucuggccuacuccccaccuacucugccuauucaguugcuauaaaauauaguauugagcaaagaugggaaaccuacuuugucugucaaagccugaguaauagcaacuuucauuuucuuggcugccuccuuucaacuccaagcucagcuuguugaggccugaagagcugagccaaaacagcaauucaugugcguauuucuauuuagacuccagucucccuggguaguguaguccuguggugauucaugccucgaguauagauagcuagauauugggaaacuuccuuauuugcaggauauaaaagugaaugaagugaucaaaaucuuuggcauaccucccccuauugcauagcuuucucgugcuuucccuaagagaaucauuucuguaaggaaggacagaugggucugugauccucucuacuuucaguauauucccuggaccuacuauguccuacucacuucucugcugacaucacuaggccugaacucucuucuauguagccgauuaccagugcuuucaggucauucuuuguacaauucugucuaagauccuuuucuguccccaugucguugcccuaguccagaccugcuuugcuucaccaucaguccugugcugggcacaggaacuagaaaaaucaaugagauagucacugcccuuggcuucuagggacucacaaucuuuuuuuuuuuuuuuuugucuuuguuuucuuauaguacuauagucuucaacuucuauuuauauuuugcuuuauauauuuucuuuuguugauccagaaacaauuuuuuuuguguaacuuuuuucucugccacaaaaagacauguugccuuccuuuuauaagucccauauuucccugacucccacuuaugccaugccaccuucucugagggagagguacuucucuccccacaauuccucacuuuuuuuucuuccuauccacccacucucaucuuccacauaauuuaagaauuccucuuauagguugauuuauuuucuauggucuuagugacucugucuuaaagggaaaguaauagaagaaaugaccuggagaaagacagugaucaagaccaaguagcauuuaucugggacucgcugaguguuaguccuugucuggaugucucacaaccucuaauaaagaacaccauguuugcuaugugcucccuucuagaugaaaaaaaaacaguccauaaucuauaaaugcuuuuggcuagcaaugaugaacagcagcagcuuuuauuuuuuuucaaagcgaaagcaccagaaguuuggaaaggaauugcaaguuauguuguaaugcaacugaucuccuucuuccugagaaaguugguuucucgccagaguguucaauucaggcccacgcaaucuggguguauuuauagaggguccaacaaggaagagaacaugauaagcuuuccuccccaguaugguagacaacggcaaacaaucgccaggugaaugcuauggggagccaaaugccauuuagguaugugacagcagacaucugcuagacugagaggcccgccugccccucaaagcaguugaauccgguccgagaaguuagaaauauuauucuggaugauggcaagaucucagagaguuuugggggcccugucugugugggggacaucuaggagaugagacccacucuaaagcugccuaauucuuaacaacauaaaaauguuaauaagaaaauaagaauccagcuaggugugguggcucacaccuguaaucccagcauuuuaggaggccaaggcggguggaucacuugaggucagaaguucgagaccagcuugggcaacauggcaaaaccucaucucuacuaaaaauacagaaauuugcugggcaugguggcaggcgccuauaaucccagcuaccugggaggcugaggcacgagaaucacuugaaccugggaggcggagguugcagugagccaagaucgugccacugcacuccagccugggugacaaauugagacucugucucaaaaaacaaaaaaaaagagagaagaaagaaucccugcagcauuuaaguguuuuaacacuuuugagacccauaaauauaaauguuuuauuuacauuaucacauuuauuucacauauauauuuuaaaaauuaaugcauauauauguauguggaauaaagucuguaagaauuauaucaaaacauuagcaguauuacaguaauuuucauuuccuuuuuauaucucucugcacucugcccaaaugcuuuuuaaaauuauuuuuuaaaucagaaaaaacaauaaaucuauaggcucauacauguaaauguuuuauuuacauuaucacauuuuucaccacuauccucugauuaauaauauccacuguuaauuauaguuagcuaccauuaauauucucuuuuacagaugaggaaaauggcagucagauugugaguaacuaaaagguuaaacuuggacuugaacccacguccuauuacucuaaaauuuaugauuucuuuuuuauucuguugaagaaaugagagccauuagcacagucucauugucaaggaggucacuugaaguagccagaaacuagcagcuccaccucuaacaauuucucccaaggaaagaacaugacaaucuacaaagauguauguauaaggauauuucaguagcauuguuuaugaauaacaaaaaaauaaggccgggcucgguggcucacgucuguaaucccagcacuuugggaggcugaggcgggcagaucacgaggucaggaguucgagaccagccuggccaacauagcgaaaccccgucucuacuaaaaauacaaaaauuagcugggcaugguggugggcaccuguaaucccagcuacucgggagguugaggcacaagaaucgcuugaaaccggaaggcagagguugcacugagccaagaucgcgccacugcacuccagccugggcgaaagagcaaaaccccgucucaaaaaaaaaaaaaacauaaaaacaaaagcaauccaaauguccaucaacagcagauuuauuaugggaacuaugcuguuuccauacaauggaguaaucuguagacauuuaaaaauauuuuuuaaaacacaguugugcauagaaagauaccuaucauauauugcuaaguaaaaaacaacgcagacuaugagacaguaguaaaguacaauccaauuuuuuaaaaaauuaauguguauauauguauguggaauaaagucuguaagaauuauaucaaaacauuaguaguauuacaguaauuuucauuucuuuuuuuauaccucucuguacucugcccaaauacuuuuuaaaaauuauuuuuuuaaaucagaaaaaauaaaucaauuuucacuuaaauaaacuuuuugaaauagauaaagacagauguaagacugaaaccacgcuggaccaaagcaaagcucuuccuccuugguccccaacugagcuguauucaucucuacuggcugucucagaagcagccuagcuucugugaggaggcaacagcaguaucacuuggucugguggccuggugaccuccugaccagugcauacugacccaguguuccaagccuuauagccuagaagucauccccuuaauucugagggcagcaccaaggaccuuuuagagacauggucccagggacagcccccaugaucuacaccauccaggauucuagcugacaggcacacucagagaugugugcacagugagagguagcccccaugcaucugaacuucucagaauaacccaguaugauucugucauucacaaaugggcccaaacauuuuagaaucuauuucuauuuuuggccaguccaacuccuuagggaaauaaauuccuuaguauuugauaugcaaaguagggccucccuuuaucuaaccccaaaccaucucuuucaaguucaaggggauaccccucaaacuccaguauucuagaacuuaaauugugguuacucuaccuaucacauuguaugcacuucuuuucuuucuuuuucuuuuucuuuuccuuucuuucuuucuuuuuuuuuuuuuuuuuuuuugagacguaguuucacucuuguugcccaggcuggagugcaauggugcgaucucagcucaccgcaaccucugccuccuagguucaagcgauucuccugccucagccucccgaguagcugggauuacaggcaugcgccaccacgcccagcugauuuuuguauuuuuaguagagacgggguuucuccauguuggucagguuggucuugaacucccgaccucaggugauccgcccaccucagccucccaaagugcugggauuacaggcaugagccacugcgccuggccuguaugcauuuauuuucuuuuccccuucagucgucauauuuucagacucgagaagcuagugauuuuaguuugucccuauauagcuuugcuuuguucuccauucuucauuguuuuauuucaccuucucuggacauuuuccuguucuauuuugucuucuuuaaugugccaccagcagaacauaaccccaaauauucugggaauaagguacaguagcacauauaugguagugcuaaaaacaguuaccgcagcuugaaagcaacuucuuucuuaguggguugcuaggugcagacauucacaaguucagcuuucaaugggagaagagugaucauuaaagagcugugaaugcuggucuguuuuuccuuaccuuagagauguauauguggccuccguuuuacauuguacuaggaucuaauggaaccccaaacuagguuugauuguggggcagggugggugggggugcagugggaaaucccucaaaucagugaaacaaacgcugauuccaaauguagcaugcaggcucuauagaauaagacagcucuaaucucucaaagaccaaagauaaggccaucugacagcuuugcaacgucagagacuuucagucauuucuuuacacacauguaaaaccuuuagacguucuugagaaaauaaccuuuauuucaaaaaauagcuuugaaguuugaaaaucaaagcaggccagcuguuucucagcacagaaagaauuuuuccuaaacugcuagaaagcuaauaaggauuucaaagggcagugaucacuuacucuaaugcccacgguccaggaagcaccaggcgugggacaagcuguuuacugcaacuaacacaugaacuagggagugugccagaccuuccucuguguuuguccaucuuuuccugugucccaguaucuaguuuuucuccuuuucucucucaccauccccuggccucucucuuucuauucucuaccuuuuguuuucuuuuucuaaucucucugucuccucuuuccugacguuuuuuuuuucuuugagacagucuugcucugucacccaggcuggagugcaguggcaccaucucggcucacugcaaacucugccucccggguucaagcaauucucccaccucagccucucgaguagcugggauuacaggcgcgcgucaccacaccuggcuaauuucuguauuuuuaguagacacgggguuucgccauguuggccaggcuggucucaaacuccugaacucaagugaugcgccugccucggccucccaaagugcugagauuacaggcgugagccaccacaccuggccuggacaucuuuuuuuuuaaccuccucauuccccaaacuugguauagcauacaccuggaauuuuuuuaaaauuuacuacaccuauucaauggaguuuuccuuucccuguccuuauuuuucuuaaagaaaacaaggugaauguuuucuauuucuuccacaaacacaagcaaaaaaaaaaagcuaaacuaaaucaagcagcuucuuacuuguguguggccccaacugauuuuuuuuccucugugggucaguggcccuugauagaaaaaaagguccccacccuugcacuaaggggucuugccaauuuaauucuucuucagaaaaggggaugaauaacaguauggacaauuaguuacugugggugggagaaggaauuuggcuggaggcaauuuucuuuggaaagcgauaggacggcacaagagguugaaauaguucuacgugugaaaaauagaggguaugaaauaacuuggaaaguucagcugagaacaggagcaucuggggcuuauucaugguuuuucagaaguuuuugaagcuuuuuuauuagcuggguugaccucagauugaggaggagauuuuucaaauguuaaacaguuuuuucuuuugcauuccuaaagucauauuguguucagcuuguuaauaucugcacagggggccuucggcagaggcugccagagcggcgugcuuuugggacauaguucccuauagcugguauuucccuuucuuguugaggauuugcaugugucucuuucauccacgcauacagcagauuccuccacaaauaauugcauuugacaucacaguuguuagagaaaaugcaggggagggggaaaagccucccuuuccuccacacugagacagcuggagggaggaagcagguuagacagggaaauacauaaacauaccuggaauguagcagcagguaauucugucuguguuagucaugauaauaacuugcauguuggaauaucaauaguguagauuccaagaugucuaggauuuagaaaggaacaaagaaaccaccacauaucaacaccuagcaucucacugauuuacugugccuaagacaggaaauauuggcaaacauguuuaguuagaaucaauggaguauguuccaaggugccuuccccaaauauuuuuuacagaagaacuuuaggcaauuuauuuccagcuucuaguggcaggggcaagugcacccugcugggaaacugaaaucuggcucaugauagacuggcaggaguugggggccggugucagauuccauuugcacucccaguagaaguuacuggaacccucagaaaggcacacucuccaaaaaggaguguuuguucagggcaugacaguauugagaacagcaaaaaauaaucuauccacuaacacugugaccagcaguaacuuucuauguuagaaauuaaccaguacugccuaaacagaagcccucauucuuaauggucugcaaaauguuccguggcuaaaacuuuuggagguaagucagugauuugauuuuuuuuuuuccuauuaacugccaggccuacaaaguuuucaugcaagcaaaauaauuuaaacaaauuucccaaaauuugacauuuaaaaauguuuggagcuguucugacacagacauucuguguucuguauuugguuuauggacuaugccaggcuccuugauuaacagguagaggacauacccacaguucaauagaucaacacauaguauuugaguucuuacucuaaauguuuauuguuuauucagucacugagugucagguacuuggguaggcucugggagagacacaaagaugaaucagacacaguaccacccucaaaaagccuuuggccucauagaagagacagauacagacacaaauaauuacaauacaaggcagaaugugauugagauuuuaagacaaguccaaacaaaauguuuugugagcacagaugaaaugauuagauucaccugcaggaauuggggaagaauuuauggaagaaauuacauaugagaugguuccuggaagauaaucagaauuucaacagaggggggaucacucaaggcuaagagaacagcguggacaaagcacagaggugugaaacuguguggcauauuuagagaauguugauuagcgagaugugugcggugaauucugggagaugagguugggauaaugaaguggaaguauacagugggcaguuauaaauuugaauuaggagccugagggaaaagucuagacaacagaauuuuuacuuaaaacaagcuuguccaacccacggcccacgggacucaugugucccaggacagcuuugaaugcggcccaacauaaauuuguaaacuuucuuaaaacauuaugagauuucuuugcgauuuuuuucuuuuuuuuuuuuuuuagcucaucagcuauuguuaguguuaguguauuuuauguguggcccaagacaauucuucuuccaguguggcccagggaagccaaaagauuguacaccccugauuuaaaagucuaaaaaguaucauucccugugaaccacaugccuugaggaacaauauuagaacucagcaucuguucuuuggggauccacaacuaaauuugaggcaaggcauucauauacaucuacauuggaaaacagaacgaccuacguauuguaugaugcaguguacaugggcaccagccaagaguggaugcaggagagcacaauacauuauugguaacuugucauuuuugaggccaaccuggaguugguccaaguugcuuggcccccgcuccaacucaugugucacucccuuccuagacaaauacugacacaaaccacaaacagacuucauucaucagcacuaguguuugggaaggaaggggacagaggagaaaagacuggcaggcgagggaacaagcaauucauuuuuaggcuugagaauaagaaaauuaacuggucauaaauuccagguaaucgguuuuucucuuguuuuaucaugaauaaaggacguguucacauuuugaaaguaacaccucauaguacagaauggaauaagcaggcaagccaaauucauucuuugcuuuuguaaagugugagaaagggaaguuuuucugacccauacauagauucccuaaaggacgaaaacccuucucauuaugaacacauagguaccugacacuuugugcugcauugaaaauagauuuaauuaaaauauuuaguaaugacucauuuugagggccagguauuuacacaucaugauuuugccucuaagaauuucauagauuuaaaagauaaugugaccaggcacgguggcucacaccuguaaucccagcagucugggaggcugaggcgggaggaucaguugagcccaggaguuugggaccagccugggcaacauaccgaaacccugucucuaccaaaaauaagaaacuuagccaggcuugguggcaugcaucuguguucccagcuacucgagaggcugaagugggaagaucgcuucagccaaggaggucaaggcugcagugagccgugaucaagccacugcacucuagccugggugacagagagaaaccuaucucuaaaaaaauuuuauuuuaacaaauaaauaauacaaaagagaaucuuuggugaauuaauguuguccccaauagaauuuucuucuggacaacauuaugcaaguccccaugaaugacuuuauaggagaaguccuggaaaagagucuaauuucccacaagugaacuuccuagcucucccuuugaaucugguuggcuaaggcaucugcugccuuuuuuaaaauuauuuuuuauuuuuuauuuuuuuuuuugagauggagucucacucuguugcccaggcuggagugcaguggcacgaucuuggcucacugcaaccuccaccuuccggguucaagcgauuuccggcuaauuuuuguauuuuuaguagagacaggguuucaccauguuggccaggcugguaccaaacuccugaccugaagugauccgccugccucagccucccaaaguucuaggauuacaggcgugagccaccacgccgcacaucugcugccuuuuaaagcaucauucuucccacuugauuuucaucacccuauacuacaaggaccagugcaccugucuuguauuggaaaggaaauaaaugucaaagugagaacaaaauaaggacaauuggcucauuccaaguuugcgugggacuggagaacaauugcuuuucccagcguguugggcagggguggugggaaggcagcugcauggggaagaaguguuaaauuguggcuuguguucauauccauugcagcuaucaucccuuuaaaucacccccaaauaaugcuaaguucuuauuuagaaguaaguuuuucagagagccugccaucugaauagugaggggagaucugcuagugagaagccaugcaaaucacccuccccuaccacaaaacaagaucagugcaacagcagagguuuggggcuccaaaugauuccauuuugaauaagaugugaugccaagguugcaaugacuuuuaggugugaaagauacuguggcuauuuauuuauuuauuuacuuugagacagagucucgcucuguugcccaggcuggagugcaguggcgugaucuuggcucacugcaaccucugccuccuggguucaagcgauucuccugccucagucucccgaauaccugggacuacaugugcaugccaccauguccagcuaauuuuuguauuuuuaguagagacaggguuucgccauguuggccaggcuggucucgaacuccugaccucaggugauccaccugccuuggccucccaaagcguugggauuacaggugugagccauugugccuagccccuguggcacuucuuaaaggagaguuugcccugaucuccuuggccaaaguucacaucugguaaucgcaucuguugacacuggcuucccuuguccuuucagcuauguacaauauuggcucucucgcauccugucuuagacuguucuauaguguugcuaugugcuauuaaauagcaaucgcauuucaccgaguggagaaugcauguggaaauccuuugggagaagugugcuguagaaauguuggauugacaauguuuuuuuucuuuugugaaccaggaaguguaaguguaagaaacagaucuaaacacuguucggaauaauuguuaguguguacggcagaguaagcaaugaccauauaugcaagcccagguauuccagggcucaacagggcccauuagagauagggaaaugaaaacagaauguuuuuuaaaaguaauuuaagugagugggcuuauaguucagaauaacauauaaagaauuuuggaguuuucuggaaaguagacagccucuauuugaaugggccuuugcaauuuaugaaguguuuuuuuuuuuuuuauguacacacacugaauucccauaaccaugugagauagguauaacucuuauccugauuucacagcauaggaaacuaaggauuugugagguucagggaucugcauaaggucucacuucuggcaaguagaagaaacaaaauagaugggaauccagguuuucugaccuuaaauccuuugucuguucagcacaccauaacuagaugaguguguugguugugguuugaugaauggagugugagucuggcauacuuucuuagguauauuuuaaacacugaaugacuagaauuccuggagauucuggaaagcucaguuguuuuuugacaccugaagguuaggaccaaaauuucaaaauguuaaacuguuuuuuaaaauacaguuuaacauuucuaaaauagacuucccuacuuugucacaugauugcuuucuacuguagauggaggugcuuuaaguugucacucuuuuaaacugcuacuggccuuggcugugucccagagaccuccaggccucacagcauaacucaaauaagugcucuccuucugguccauuuucacuuucuugucauuuucguguuguuggauaaaaguauuuugcauagguaaaagaguuaguauaccuuagaaaugacuaauuucuacagagcaaggaguuuacucauuggauaggauccucucauagagauuuauuauuauuaaauauuggcugugggaugaaaaagagagauuucagaagagcaggaauuucauuuuaaaaagugucaacuugaacuucauggaguuaauguguuuccuggccgacggcaugauuauaggugguugaaugcuaggacaggggaggagucugguaagguacugcuggcugaaagauagcuagcuuucuacuggguuuuuacuccaagggcagguauuuuaauccaagcuugaguuccucacuuggcacacagacuagcauaaucucuccaucuugcaaagacauuuuugguuacuuuauugagguauaauuuacaucucauaaaauuuaccuauuguaaauguacaaugcaaaauguuuuccugaauuuauacaauugugcaaccaucaccccaacccaauuuggaacauuuccaucaccccaacaaguugccccauaggccuguuuuccgucacuucucauucccaccccagccccaggcaaccacuaaucuacuuucuguccuuauagauuugccuuuucugaauauuucauguaaauggaauucuacaagauguaaucuuuugugucaggcuucuuucauuuagcauauuguuuuucagguuaaucugugcuguagcaugugucuguacuuuguucuuuuuuguugcugaguagcauuccauuguacagguauacauuuuguuaagaauauucauucaccaguugauggacauuuggauuguuuucugauuuggaauguaugaauaaugccgcugugaacauacacauacaaaucuuuguguagauguaauauuugcacuucuuugagguagauaccuaagaguguaauggcuuggucauauaauaaauauauguuuaacuuuuucagaaacugcuaaacuauuuuugcaaaauggcuguaccauuuuacauucccauuaacaaugcaugaggguucuuuuuauccauauccuauucuacauaugguauugucauucguugauuauagacuuucugguggguguguagugguaucucauugugguuuuaauuugcauuucccuagcaagugaugauauuaaguaucuuuucauaagccuauuauccacugguacauauucuuucaugaaauaucuauucaaauaguuuuuaauggauauuuuauaguuucaauggagagaaaaaaguggaaagaauaugacuaugccaggagauuuuuugcauucuccccuccuaaguauucaucagucuuuguuuauuuuuguaguuggcuuugggaguuuuguuuguacuguuuugagcaaguaaagggcugacaugguccauagcaauucauugaacuaaacagaauuucuguauggaguaggaauagaguuucucuccucuagagcagagguaaaguuaccuuaaacugcuuugggugagauauuacaaagugcuuucauauguauuaucucauugacucucuguaguuguuucaugagguacaugcuuuuaugaucugcucuuuacagaugagacugauuggauaagugacuuauaccaggaucaucaguugguaaauugguagagccgacucuugaccccaggucuccaaauccucuacucuuuccacuauagcaggcaaucacacuuaagguccacuuuauuuucauguaucagaacucuggcaaagcccagaccagcaccuucaggauaucacaugugggaauggcugcuggguaaacuuugaggaaguguuuccucccauaccugaguaaauggcuuugcccauuuucccuuggcccagaugucuggaucucuguguuaugagcaaacugauuguaaucuggaaacaaugaggacucagaacaucuguugagagaaggaaaucuaauagaugagauggcauauucugauuggagauuauuuuagguacaaaucaguuuacauaaaaccaacuaaauaauguuuaauugacaaaaugcuaaggcauaggucaaaauauuguuuuaaaauuauuaaacauagaaaugagaauacuaauauauuuauuacuggagaaaugacauuaaaauauauuauauucagugcucccuaagguuuuaagaaaguuuuauugguguggggagugugugaguaacaguucuguaucacucaggggcacauuuuaaagcuuuuuaucuguuuggccucauaaaucauugaacaugcaugauaauuucaguauuuaauaugcauaugaaaauucacauacugccucacauacucaaauacagcaugcgugcacacacacagacacacacacacagagacauauacacauccuuuguuagaugguaugcuuugguugaguugaaaauaugguuauuauuacuggggcauauaagagaaauguaaagcacagucccuuccccuguaaagcuuacaaguuauggagcacugcauguucacacagaaagaacaauuagaaaauaguauaaggcagaaccuaagcaacugcuaauuugggcacaaaaacaguaagaauuacgaaaaggaagagaucacuggaagcuacgugcuguggccaaagcaacuagcauaguguuggacuaucuaucuauuuagcuauccauucauccaucaucaucuaucuuaaacuuuuaaaauuacauauguucauuggagaaauuuagaaauuauauauaaguaaaaauaaguuaaucuaccccuaauccuacuacacagagauaaccacucuuugagcacauauguuguguugcuuuuaaaguaacaaguguuggugggguaugcuggcucacaccuguaaucccagcacauugggagaccgaggcagaaggaucacauuaggucaggaguuugagaccaaccuggccaacauggcgaaaccccguuuuuacuaaaaauacaaaaacuagccagacaugguaguacacaucuauaauccuagcuacuugggaggcugagacaugagaaucaguugaacccaggagucagagguugcagugagcugagauugcaccacugcauuccagccugggcaacagagggagacacugucucaaaaaaauuuuuuaaaaaauuuuuaaagugguaaauguuaacuguuuuaaaaauaacccaaaauuccuguauccugaaaaaaaucauuaucacauacucaaauacagcaugcaugcacacacacacauucauucauucuggcaguauguccuaaacuguguuccacagaacuuuuguugguuugaguuuguuuuuuuuuuaauacgugcuccuucagcaagcacaugaaaaaugcucaucaucauugaacaauugguaaauguaaguuaaaaccacaaugaguuaucacgucauacccaauuagaauggcuacuauaaaaaaaaacaacaacagaaaauaacaaguguuggggaggauguggagaaauuagaacccuugugcacuguuggugggaaaguaaaaugguguagcugcuaugaaaaacaguauggugguuccucaaaaaauuaaaaauagaauuaucauaugauccagcaaucccacuucuggguguauuuaauauucaaaacaauugagagcaaggucugcaagagauauuugaacacucauguucauagcagcauuauucauaauagccaaaaguuauuggcauaauagcagcccaaguguuuaucaacagaugaauggauaagaaaaaauuugguauauacauacaauggaauauuauucagccuuaaaaagaagggaauccugucacauucuacaacauggaugaaccuuaaagacaucaugcuaaguuaaauaagcaccacaaaaggacaaauauuguuugacuucacuuauauaagauaucuagaguagucaaacucauagaaauaggaagcagaguuggugguugccagggacuauggggagaaggaaauaggcaguuguuuaacagguacagaguuuuaauuuugcaagaugaaaauguucuggagauugguuguacaguaaugcaaauauauuuaacacuacugaacuguacacugaaaaaugguuaauaugguauauuuuuguguguuuuacuacaaguaauguuuuaaaaaauguguuccaugugcucaaguaaggaaacaguggaccaaacaaaauuaauguaguuuguuuauagcaagacuucucagaaccuuuaauauacuaauguguauugugacucugcaugaggagauacaguguaauguguuuucccaacuuaucugaccaugggucucuuuuuccaauauauuaugggacuagcaaaauauauuaaggaacacacuuuaggaaauauuacuacaaaauguuggugauuuaaggucuuaccucucuaagagacauuugauuucaaggagacaccuggggugauuaauguuuauuccaaaggaaugugucucuagagauagaaugucaagucuuguaaauaccuaagaaggaaaaggucuggggcacaaggccacccagcaccucucagaucucugcuugucgacagccaaauauucggccugccuggaaggucagcccagcauuuuggcaauugagaggaagccuucaaauuuagaaacuacucuuaggaggcaacaaucuucagugucugauuauagaguuucguaauuucauuaaggcauccagucauuccaguacagacagcagccauuuccaagcaagaacuuuaaugcuguacuggaaacucuggauggacagaauucaggucaagggaaagauaauucucuagguugaauaucuucauguguaauucaaaacgagaguuugcuaguagauuuaaauguacuguaguugaguuaaaggaggaugucaugguuaaaagccaagcauuuccucuaggagcaggugaaaaaacagcugacauuccugauuguuuuucuaaguguuuaaaaugacuuuuccagaccugaagccuguaagcauuuuauuaacauuugauuagcaauuauuccuuacuguguugaaccugaaauuaggaucagguuuccuuacauuaccacaaacacacacacacaaaacacaaaccccaaguaacucaacucuuucuuuauucuuuuucuuuuccuuuuccuuuuuuucuuuuuucuuuuuuauuuuugagauggaguuucacucuuguugcccaggcuggagugcaauggcacgaucucggcucaccacaaccuccaccuccugaguucaagcgauucuccugccucagccucccaaguagcugggauuacaggcaugcaccaccaugccugacuaauuuuguauuuuuaguagaggcaggguuuauccauguuggucaugcuggucucgaacuccugaccacaggugaucugcccgccuuggccucccaaagugcugggaauacaagcaugagccacugcgcccggccaacucuuuuucacaaagguucauuccaaaauaauuuccccuuucccuuuccuuagcaaucucaaagaaucauagacugaggccaggugugguggcucacaccuguaaucccagcacuuugggaggccgaggcaggcagaucacgaggucaggaguucuagaccacccuggccaacguagugaaacccugucucuacuaaaaauacaaaaauuagccgggcauggugaugcgugcccguagucccagcuacuugggaggccgaggcaggagaaucgcuugaaccugggggguggagguuguggugagcugagaucgugccacugcacuccagccugggcaacaaagcgagacuuugucucaaaaacaaacaaacaaacaaacaaaaaagaaucauagacugucagagcugggaaagacuuagagcucauguaguccaacuccuuuuuuggacauauggggaaaccaaggagcagagagguggagcgauuucccccaauacucaaagagugacagagcugagaaaaccugacugcuugucuagugcucuuucuaauauaguuacuucauuagaagaugauccauggaggcccaauauaucuaugacuacaggucaaauugguuuauaauguauuggacaagcaaauaauaacgguuuuauuugaaugccagaaugugauuucucauagguaauacaauuuguaagcugagcaugaaauuuaaaaccugaaaugaaucaguguucacagcauguaagaauguauauuacaaguguaauguaacauuuuguuuuauguguaaauauauagcaguuaggucaaauacauccaccagaauuacuugguggccuugauucgcguggacauccauagcagauucugaagagaauuuuuacugugaauuauauggcuucauagguacucuguaugccauacccuauuuguaaguugcaagcaggaaauaguugauagcaaaggucagcuagaguauaauggagauaaaauguugguugcguaaaauuuuuuaaaaagagggcucuuuaguaauguuuauaaucacuugcuaauuaacauauugguguguuauguauuugaggccacauaucuuuuuuuuuuuuuuugagacagagucuugcucuguugcccaggcuggagugcaguggugcaaucucagcucacugcaaccuccaccucccggguucaagugauucucccaacucagccuccugaguagcugggguuacaggcgugugccaccaugccuggcuaauuuuuguauguuuaguagagacaggguuuccucauguuggccaggcuggucuugaaccccugaccucaggugaucugcccgccucagccucccaaagugcugggauuacaggugugagccaccacucccggccaaggccacaugucauuaagcagcuucaaauccaucaaccaauuaggauaacaauucugaugucaacuaguaguuuauuucaugguucucuacagggauucuuaccacauuagaauaauuaaugucaggacacacuguuuuugauguugcuugggagaagccacaacuaaguaaacaaccucauugguuugugaaugcaaauauugagauagcuggagucuaguuuuuuuaggauagcuaaacaacgaccucugaauggagggguuauaaagaacaacaacaaauagaagaguggauuuaaagauuguuaaaaugcuuaaaccaucgacacaaaaagucauacuucuuaagacauauuuucccucuguucuagacuccaggauccucaucuacugaugucaaacaauagugcaaacagggagucuuguaagcggcucuuuguaaagagaauuaaugacuugguaaaugcaguacuuggcaguaaacauuauauuccuauagccuuagcccauagggcucugcguuuacucagagccuagggaggcagauuuccccauagagacugcccacagaaucauuuguuuccuuuguggauuuggaauggauuuggaauuuguacuuuuucucuuuuuguaacaauaagccucaaaacauugcauaugcuguccuaagauaccugcggaucaaaacauauaagccuuuaaauucacuuagccaguuuuagaaguuggccuuuguugaauuuguacuuaucagauagaaagccagcaacauuaguuuagaggaaagaguguagcuauguucugaaagcauuugaugguuauauuugaugaagcugggaauaugauggaaauuucagaaauauaacaaccuccuaugccauguuucuggcuugguauccagucauucacacagucccuguuaauauuaacgguaggaaugaauuuuacucccccaggaaacuauaaacuuucaauauuuuauucaugguuuaagaauacuuuugacuuuugaaccuaagauuuuagccaaauaagaacuauuuacugaacucuuuuuuuuuauacuuuuaaguuuuaggguacaugugcacagcgugcagguuuguuacauauguauacaugugccauguuggugugcugcacccauugacucgucauuuacauuagguauaucuccuaaugcuaucccuccccccuccccccacccugcgacaggccucagugugugauguuccccacccuguguccaguuguuuucauuguuaaauucccaccuuugagugagaacaugugguguuugguuuucucuccuugugauaguuugcucagaaugaugguuucagcuucauccaugucccuacaaaggacaugaacucauccuuuuuuacagcugcauaguauuacaugguguauaugugccacauuuucuuaauccagucuaucauuguuggacauuuggguugguuccaagucuuugcuauugugaauagugccacaauaaacauacgugugcaugugucuuuauagcagcaugauuuauaauccuuuggguauauacccaguaaugggauggcugggucaaaugauaauucuacuucuagauccuugaggaaucgccacacugucuuccacaaugguugaucuaguauacagucccaccaacaguguaaaaguguuccuauuuguccacauccucuccagcaccuguuguuuccuaacauuuuaaugaucgccauucuaacuggugugagaugguaucgcauugugguuuugauuuguauuucucugauggccagugaugaugagcauuuuuucauguguguguuggcugcauaacugucuucuuuugagaagugucuguucauauccuuugcccacuuuuugaugggguuguuugauuuuuuucuuguaaauuuguuuaaguuccuuguagauucuggauauuaccccuugagagauggguagauuguaaaaauuuucucccauucuguagguuucuguucacucugaugauaguuucuuuuguuaugcagaagcucuuuaguuuaauuacaucccauuugucaauuuuggcuuuuguugccauugcuuuugguguuuuagucauaaaguccuugcccaugccuauguccugaaugguauugccuagguuuucuucuaggguuuuuaugauuuuaggucuaacauuuaagucuuuaauccaucuugaauuaauuuuuguauaagguguaaggaagggauccaguuucagcuuucuacauaugucuagcaaguuuucccagcaccacuuauuaaauagggaauccuuuccccauuucuuguuuuugucagguaugucaaagaucagaugguuguagaugugugauauuauuucuaagggcucuguucuauuccauuggucuauaucucuguuuugguaccaguaccaugcuguuuugguuacuguagccuuguaguauaguuugaagucagguagcgugaugccuccagcuuuguucuuuuggcuuaggauugucuuggcaaugcaggcucuuuuuugguuccauaugaacuuuaaaguaguuuuuuccaauucugugaagaaagucauugguagcuugauggggauggcauugaaucuauaaauuaccuugggcaguauggccauuuucacaauauugauucuucuuauccaugagcauggaauguucuuccauuuguuuguguccucuuauuucauugagcagugauuuguaguucuccuugaagagguccuucacaucccuuggaaguuggauuccuagguauuuuauucucuuuguagcaauugugaaugggaguucacucaugauuuggcucucuguuugucuguuauugguguauaagaaugcuugugauuuuugcacauugaguuuguauccugagacuucgcugaaguugcuuaucagcuuaaggagauuuugggcugagacgaugggguuuuguaaauauacaaucaugucaucugcaaacaggggcaauuugacuuccucuuuuccuaauugaauauccuuuacuucuuucuccugccugauugcccuggccagaacuucuaacacuauguugaauaggaguggugagagagggcaucucugucuugugccaguuuucaaaggaaaugcuuccaguuuuuccccauucaguaugauauuggcuguggguuugccaucaauagcucuuauuauuuugagauacgucccaucaguaccuaguuuauugagaguuuuuagcaugaagcguuguugaauuuuaucaaaggccuuuucugcgucuauugagauaaucaugugguuuuugucuuuguuucuguuuauaugauggauuacauuuauugauuugcauauguugaaccagccuugcaucccaaggaugaagccaacuugaucgugguggauaaguuuuuugaugugcugcuggauuugguuugccaguauuuuagugaggauuuuugcaucaauguucaucagggauauuggucuaaaauucucuuuuuuuuuuuguugugucacugccaggcuuugguaucaggagacuacuggccucauaaaaugaguuagggaggauucccucuuuuucuguugauuggaauaguuucagaaggaaugguaccagcuccucuuuguaccucugguagaauucagcugugaaucccucugguccuggacuuuuuuuugguugguaggcuauuaauuauugccucaauuucagagacuguuauuggucuauucagggauucaacuucuuccugguuuagucuugggaggguguauguguccaggaauuuuuccauuucuucuagauuuucuaguuuauuugcauagagguguuuauaguauccucugaugguaguuuguauuucugugggauuggugauguuauccccuuuaucauucuuuauugugucuauuugauucuucucucuuuucuucuuuauuagucuugcuaguggucugucaauucuguugaucuuuucaaaaaaccagcaccuuggauucauugauuuuuugaaggguuuuuugugucucgaucuccuucaguucugcucugaucuuaguuauuucuugccuucugcuagcuuuugaauguguuugcccuugcuucucuaguucuuuuaauugugauguuagggugucaauuuuagaucuuuccugcuuucucuugugggcauuuagugcuauaaauuucccucuacacacugcuuuaaauaugucccagagauucugguauguugugucuuuguucucauugguuucaaagaacaucuuuauuucugccuucauuucguuauguacccaguagucauucaggagcagguuguucaguuuccauguaguugagcaguuuugagugagucucuuaauccucaguucuaguuugauucccuguggucugagagacaguuuguuaaaauuucuguucuuuuauauuugcugaggagugcuuuacuuccaacuauguggucaauuuuggaauaggugugguguggugcugagaagaauguauauucuguugauuuaggguggagaguucuguagaugucuauuagguccgcuuggugcagagcugaguucaauuccuggauauccuuguuaacuuuuugucuuguugauccaucuaauguuggcagugggguguuaaagucucccauuauuauuguguggaagucuaagucucuuuguaggucucuaaggacuugcuuuaugaaucuaggugcuccuguauugagugcauauauauuuaggauaguuagcucuucuuguugaauugaucccuuggcauuauguaauggccuucuuugucucuuuugaucuuuguugguuuaaagucuguuuuaucagagauuaggauugcaaccccugccuuuuuuuguuuuccauuugcuugguagaucuuccuccaucccuuuauuuugagccuaugugugucucugcacgugagaugggucuccugaauacagcacacugaugggucuugacucuuuauccaauuugccagucugcgucuuuuaauuggagcauuuagcucauuuaccuuuaagguuaauauuguuaugugugaauuuaauccugucauaugauguuaucugguuauuuugcucguuaguugaugcaguugcuuccuagccuugauugucuuuauaauuuggcauguuuuugcagugucugguaccaguuguuccuuuccauguuuagugcuuccuucaggagcucuuguaaggcaggccugguggugacaaaaaucucucagcauuugcuuuccuguaaaggauuuuauuucucauucacugaugaagcuuaguuuggcuggauaugaaauucuggguuaaaaauucuuuucuuuaagaauguugaauauuggcccccacucucuucuggcuuguagaguuuuugccgagagaucagcuguuagucugaugggcuucccuuuguggguaacccgaccuuucucucuggcugcccuuaacauuuuuuccuucauuucaacuuuggugaauuauguuucuuggaguugcucuucucgaggagugucuuuguggcguucucuguauuuccugaauuugaauguuggccugccuugcuagguuggggaaguucuccugaauaauauccugcagaguguuuuccaacuugguuccauucucccugucacuuucagguacaccagucagacguagauuuggucuuuucacauagucccauauuucuuggaggcuuuguucauuucuuuuuacucuuuuuucucuaaacuucucgcuucauuucauucauuugaucuucagucacugauacccuuucuuccaguugaucgaaucggcuacuaaagcuugugcaugcaucacguaguucuugugccaugguuuucuucuccaucagagaagcacucacuccauuuaagugcuucucuacacuguuuauucuacuuagccauucaucuaaucuuuuuucaagguuuucagcuucuuugcgaugggcuugaauauccuccuuuagcucagagaaguuuguuauuaccgaucaucugaagccuucuucucucaaaucgucaaagucauucuccuuccagcuuuguucuguugcuggugaggagcugcauuccuuuggaggagaggaggugcuccgauuuuuagaauuuucagcuuuucugcucugguuucuccccaucuuugugguuuuaucuaccuuugguguuugaugauggugacauacagaugggguuuugguguggauguccuuucuguuugugaguuuuccuucuaacagucagaaaccucagcugcaggucuguuggaguuugcuggagguccacuccagacccuguuugccuggguaucaccagcagaggcugcagaacagcaaauguugcagaauggcaaauguugcugccugauaguuccucuggaagcuucaucucagaggggcaccuggccguacguggugucaguuggccccuucugggaggugccucccaguuaggcuacuuggggaucaggcacccaguagaggaggcagucugucuguucucagaucucaaacuccaugcugggaggaccacuacucucuucaaagcugucagacaggaacguuuaacucugcagaacuuucugcugccuuuuguucagcuaugcccugcccccagagguggagucugcagaggcaggcaggccuucuugagcugcaguggacuccacccaguuugagcuuccuggccgcuuuguuuaccuagucaagccucagcaauggcagacgccccucccccagccucauugccaccuugcaguucgaucucagacugcugugcuagcagugagcaaggcuccgugggcgugggacccuccaagccaggcgcgggauauaaucuccuggugugccauuugcuaagaccauuggaaaagcacacuauuagggugggagugucccgauuuuccagauaccgucugucacagcuuccuuuggcuaggaaagggaauuccccaaccccuugcacuucccgggugaggugaugcccugcccugcuucggcucacgcuccguggacugcaaccacuguccgaaaagccccagugagaugaacccgguaccucaguuggaaaugcagaaaucaccugucuucagcaucacucaugcugggagcuguagacuggagcuguuccuauucggccaucuuggaaccucuccccugaacucuuuuuuuuucccagugcuucuucuugugcuaaaacucuauaggcccuuaucauacagaacuaguuauacugcugcuucuuguugaggaaaagagucaaacccuguaaaauauuugaagagauguauucugagccaaauaugagugaccaauggcccaugacacagcccucaggggauccugagaauguguacccaaggugguugggccacaacuugguuuuauguauuuuagggagauauguaucaauuaauacauguaagauguacauugguuugguccggaaagguaggaaaaccggaaauguaggcuuccaggucauagaugguuucaaagauuuuuugauuggcaauugguugaagcacuuauaaucaauagaaaggaauaccuggguuacaauaaggaauuguggagaccaagguuuuauugugcagaugaagccuccagguagcaggcuucggagagaauagauugcaaguguuuccugucagauuauagagucugcucuaucaguaauuccaaaagggugggaggaggguauaaugaggcauaucuggcucccuuucccaucauggccugaacuaguuuuuccagguuaacuuugggacacccugggcugagcaaggagugguccauucagaugguugaggggccuuagaauuuuauuuuugguuuacauucuugauggcucuucuccuuguauaucucacuuuccaugggcuaaaugaauacugaaagcaaaucugugaaaaauccuuuugcaagauugagaccccugagauuuuugguguaauaagauaauugaugugcuggcaucauaguucucaggcaaguugaaguagaaaaauaaaauaaagguuccuucuuagaauuaucccaaggaaauaucuuuucacaggaggggauaccaagucauaccuauaaagaguagaauuuuuuuuuuuuuuuuuuuuugagacagagucuugcucugucucccaggcugaagugcaguggugugaucuugggucacugcaaccuccaccuccuggguucaagugauucuccugccucagccucccaaguagcugggauuacagguucccgccaccucacccaacuaauuuuucauauuuuuaguagagaugggguuucaccguguuagccaggauggucuugaucuccugacaucaugauccgcccaccucagccucccaaagugcugggauuacaggcaugagcuaccaugcccggcaagaguagaauuuuucaaucaccuucuuaacaccagacaauaggaaguuugguucugaauuugggguugcaaauucuuccuaauugguuagugcccuuuuuguugucuuuuuuuuauugaguaaaauacacauacuauaaaauucacccuuuuaaaauguacaauucagugguuauuaguauauugaccaaguucugcaaccaucaccucuaacuccagaauauuugaaucaucucaaaaagaaacuccauuaugccccuuaccccugaccccuggcaaccccuaaucuacuucauauuucuauggauuaaccuauucugauaguucauauaaauggcaucauaucauauauaguuuuuuuuaugucuggcuuucuuagcauaauguuuucaagguucauccacaauguagcauguaucaguacucauuccuuuuuauggcugaauaguauuucauuguauagaaacaauauauuauguuuauccaugcaucuguuguuggacauuuuggcuguuuccaccuuuuggcuauugugaauaaugauaccacaaacauugguguacgaguaucuguuugaguuccugcuuucaguuauuuggggcauauaccuaggagcagaauugcuggauuauauguaauuuuauguuuaucugauugaagaaccaccaaacuguuuucugcaaugaauccaccauuuuacauucccaccagcauuguaugaggauucuguuuucuccauauccuaacaccuguuauuuuccauuuuuaaaauuauuauuacagccaucuaagugguugugaaauaguaucucauugugguuuugauuucauuucauuuauggcuuaugauguuaagcaucuuuucauuggcaauuucuauaucuucuuuggagaaauguuuauucagauccuuuguccauuuuuuuuuaaauuggguauuugccuuuuuauuuuugacuuguaagaguucuuuagauauucuggauacaagacucuucagauauaugguuugcaaaaacuuucucccauucugugggucaucauuccacuuuuugaugguaucuuuugauucauaaaaguuuuaaauuuugaugaaauccaauuuaucuauuuuuucuuuggccauuaaauaugcuuuugcuuaacccaaguucacaaaacccuauguuuucuucucaaaguucugucauuuuugcucuuacauuuuaaccuuuggucuauuuuuuuuuuuuuuuuuuugauacagugucuuucucugugacccaggcuggaaugcaguggcaugauuuuggcucacugcaaccuccaccuccuggguucaagugauucuccugccucagccucccgaguagcugggauuacaggugaccgcuaccacaccuggcuaauuuaacccuuggucuauuuugaauuuauuuuuguauaugguauuagauagggauccaaauguacucuuuugcaugugauauccaggucucccaccaccauuuguugacaagagcauucuuucauuuugaauuuauuucauuaugaauuuugaauuucauuuugaauuucuuucauuaugaaugaaaagagcauucauuuauucauucauuuguauccagacgguuuaagaaaaaaaucugucuuauauuuuuaguauauaggagccaguguugcuucuauuuguuuugaauacaaauuccauuuuucuuugcauauuagacccuauauguaagaaacaacuuuacacaauaauuuguuugcugguaauauuuggacaagugccauaaauucauguguauuguacuuucugaauagauuuuuucuaaucauagcaaaauuuauuuauuucaaaacuacaacucuuugaaguguucagcuauaauaaaauuuaguuauaaaauuauguggcacuacugaaaaucuaaaggauaaucugaagaaugaguaagacaaauauugauaguaauuuuuaguauuuucaaaauguuucgguucacacacauaaaugaaaucauuuuaaaaacuaggggcugggcacaguggcucacaccuguaaucuuagcacuuugggaggcugagguaggaggauugcuugagcacaggaguuggagaccagccugggcaacauagcgagaccccuguagcuauaaaaauaauaaugauaacuagguaccauauuucagaaaccauugugaaaaauaauaacuagggauugauuauaguaucuuuacucuguauucacaaauugaucucuauauuccugaacauauuuaauccuuugauuuaccuuugacuagguuugucauuguaaucccuagguugcuuaggaagauacuauuugguuugaugaaaaagccggaaugauaauagcucaaacucuuuugagcauuuaguacaugcuuggcacuguucuauacauuuuaaguuauucacucauguauuuaaucaucaacacccuuauaagguaaauaucccacaauuacuuuuguaccaaccuaauaccauugcagacaaggaaacagaugcaaagaggcuaaguuacaagggcacacagccauuaaacuuuggaucuguagagugacugggcuucaaaguccucuuccugacugcuauucccaugucuuuugcaaagauaagucuuugacagguauaugcuuaauuaaaaucauguuuagaaggaaaugagacaauagaauuagaaaaagaaauggcuguaggcuucaaugaaaaugaccuuugugacugggugaaaauuguuuggcuggauguccuggaaaauugucuucugggaauaucuauauuguaggguucacuuuugucauagaauugcuucuuggcccauuuaagagagauacuuuaaguucguuauuaauaaaucaaauauuuuuauuuuuuaaaaaagagcauucuuucccccauugaauucuuggcacucugucaaaaaucaauuucuaggcuaggcgcgguggcucacgccuguaaucccaguacuuugggaggcugagguggguggaucacgaggucaggagaucgagaccauccuggcuaacccggugaaaccccaucucuacuaaaaaauacaaaaaauuagcugggcgagguggcgggcaccuguagucccagcuacucgggaggcugaggcaggagaauggcgugaaccugggagacagagcuugcagugagccgagauugcgccacugcacuccagccugggcgacagagugagacuccaucucaaaaaaaaaaaaaaaaaaucaauuucuguacucucaauuauauuccacugaucugucauuauuccaagaccucccugaacuaaguacaguacauuuacaguaaguuuuaaaauauggaauugugaggccucugacauuguucuguuuuuucaaaauuguuuuggcuauucucaguacuuucauaugaauuuuaggauuaucuuguccauuuaaaaaaauaaggcagcuggaauuuugauagaaauuguauugaaucuguagaucaauuugaagaguguuuccaucauacuacugaggcuucuaauccauggauauagggcgucuuuuuauuuacuuaguucuuuuuaaauuucuuguugugauguuuuguaguuuucaguguauaagucucacacuucuuuuguuaggcucuaaguguuaauuuuuuuggauguaauuguacauagaauuacuugauuaauuucauuuuuagaguguucauuguuagucuauacaauuaauuuauuauaucaaucguguauucuacaaucucgcugaacugauuagcugauaguuuuuucugaauaacuuaaaauuaucuauguacaaagucguguuacuugucaauaugauuuuacuuuuuccuuucuaaucuggggacuuuuauugccuaauugccuggcuauaaccuccaguacaaugucaaauaaaagugguaagaacagacauaguuuucuuuuuucucaucuuaaagagaaaacuuucaguuuuucuccuuuaaguauacugauaguugugaguuuuagauagauauugcuucucagguugagaaaguucccuuuuauuacuaguuuguugaguuuuuuuaaaucacaaaaggcuguuggauuuugucaaaugcuuuuucugcaucuauugugauaaucaugugguuuuucaccuuucuuuuuuuuuuggauugcauuuucuuucuuuuuuuuuguauuauaccugaaguucuaggauacauguucacaacgugcggguuuguuacauagguauacaccugccauggugguuugcugcacccaucaaacugucaucuacauuagguauuucuccuaaugcuaucccucuccuagccccucacccaccgacaggccccagugugugauguuccccucccugcguccaugugcucucauuguucagcucccacuuaugagugagaacaugugguguuugguuuucuuuccuguguuaguuugcugagaaugaugguuuccagcuauucuuaaguuauauuaauauaaugauuuauauaauauauuucuaugaauauauuguauacauugauugauuuucauauacucaaccaaccuugaauuccuguauuaaaugcuacuugguuaugguguauaauccuuuguauauguugcuggauucagauugcuaguauuuuuaaaggaucuuugugucuauauuuacacaacacuuugaucuguaguuuucuuuacuuguaaugucuuugccugguuuuaguguuaggguagcacugacuucauagaaugaguuggaaauucuuccuuucucuuccauuuuuugaaaauuuuguggaggauugguguuaauuauaguuuaccauuugguaguauuuaccagugaagccaucuguuccugggcauuucuuugcaggaaguuuuugauuacuaauucauuauuuuacuuguuauagaucuauucagauuuucuguuuuuucuugagucaguuuuaguaguuugugucuuuguaggaauuugucuauuucgucuaagcuaucuaauuugcuggcaugugaugucuauaguauuccaguauaacccucuauagcucuguaagaucagugguaguguucccucuuucauucuugauuguaguaauuugagucuucucucuguuucuggguagucuaacuaauggcauaucaauauuuuuaaucuuuucaaaaagcaacuuuggguuuuaugaauugucucuauuuuuaaauuucauuaauuuauacucuaguacuuauuauuuaccuauguaguuaccuuuccuaauauacuuuauuucuuccuacaguguggguuacugucuaguguccuuuuacaucugccugaaagacucuuuuuaacauuucuccuaggguaugucuacuaauagcaaacucucucagcuucuguuucuguuucuuuuaauuuccccuuuaguuuugaaggacacguuugcugguuauagaauuauuagaugacaguuuuuuuuuuuucuuucaguguuuugaaugucaucucacugccuucuggcuuucaugcuuucugaugagaaauuaguuguuaaucuuauugaagauuacuuguacaugaugaaucucuucuuucacugcuuucaugauuuuuucauugucugacuucaacaguuugauugacauacauagguguggaucucuuugaguuuauccuaguugauguuuguuaaauuucuuagacacauaaauuuauguuuuucaugaaacuuaggaaguuuucagccauuaugucuuuaaauauucuuucuuccuauuucucucuccugcuucugggauauccauuauguauauguugauaugcuugaugguaucccacaugacucugcagauuuguucauuuuuguuccuucuuuuuuucuuuuccucauaccgaauugucucaauugaugaagcuucauauucccugauuuuuuauucugccugcucaaauuugcuguugaguccuucuagugaacuuucauuuguuauuuuacuuuucaacuccagaauuucuauuuugguguuuuauauaauuuuuaucucuguuaguauuguguaugucaugggacaucauuauaaaacacuucuuuaauucuuuagacaugauuucuuuuaguccuuugaauguguuuuaaauagcugauuuaaaguuuuugucuaauaaguccaaugucugugcuuccucaggggcaguuucuauuggcugcuuuuuuccccuguguaugagccauauuuucuuuugguucaauuuuuuaaaucuccauuuguucaugaggaaguaacauggaugcuuggaaauuauuuuauacuugugggucuauuguauuuacaaaaaccacucucuuacauuuuauaguuuccaaaauacuuauuuaaguuuauuacauuugauccuaaaagcagcccuaugcuuuuuccagggcagagauuauuuuuauuacuguucuacagaugagaaaacugaaacuccuaugacaagccucuuuccauaauacuguauauuuuauguaucccucugucuuuuacauuuagccugcugccauucauaauuccacuauguuguuuuauguacaagcucaguuugguuucuuucauucuuugggcuugauauuauuccagauuguuacaaaaauagguuuaaaauuguuguaaaagcucuuggaacauucuuauuaaauucuuuuugugaagcaaauuacauagaagagcaaccacauucaccaaaagccauaaauacuuagauuuacuucuggcuccuaagaguauucuucauuugggagaaguucauuuguauucagguuuauuuuacauguucucuuauuucaguugcuuuuuuuucucaugauauuuugauuuuuaagguaccaaagccuuuuucuuauaauacagggaauuugaguuaaaguuugaagauaggagaacuagacaacugucaguguggagugaaugcaaggauauccagaaacaucccaccuacaccaaaauaucuguuucaccgguguuccccagucucuauaauuuccacugccaaucauuccuuugggaugagccauucuucccagaaggccauguuuaaaugcacaguuuaccaaaggggaagucauaucugaaaucauuauuauuuucuauuaacagacaaaggaaucugacauuuauucucagucuauugugugcccaggcacugugcuaaauuauuuccucauacaguucauauaagguaggugauauuaucuugauuugacaaauauggaaaacuuaaaccaccaagaacaagauccuaagugauugacacagauuuugccagaguggaggaccugaagcauggaagagguuccccaguuagaugagugaauaggcagacauugagcauucaagggccauuuuaaaagacugggucaucugaggagaagcaaauagagaagaccaaccuuguccaauugaagguacuguuucuuuguuucccugucagcuagacugaguggugagaagugcuguaaauuacaaggacggagagagagggagagaggggugcgagaaauagcagacuuugauaauuauuuaccauagggcuagaaagugaaauuuuacaaagcaauacagugaaugagugugcuucucuaaaagcaagauaauauuucuaaggguaaaguuuugaccuacauaaaggagcgaauguuuuaaugccaaaaauaaaggaacuguuuucccaguugaguugauggaaaauaaaucuuauuccuggcgggcauaccuagaaacagaagucaagcugggaugggguggggcaaggccauguuuugggaagaagaaguacuugauuagcagcagcagcaaccuccuccaaauucccauggcccuccauguuuuauauuacuuguuagggaaguuauguauuuccuuugcauuaauuaagguaucagcuuaagugugagugccuaagcaugugaauuuguugugcacucugucucugauguugugaguggugcauuuauggcaaaaggucucuucauugccagcucacagaugguaaugcuagaauuuaguucaaacuugugguaucacuacauacaacuucagugaugauugcacuguauauguuccugccucucuccagaaacaugaaaacacaagaugucgaccaucugaaaugucaugguaguccuuaaauauaguugcuauuuaaagauguauaaauuauaaucaucccaccagauuucaucucuggggcagcaacauauuugaaguuuugauuuaguugaaaggcaugauaauuuaggaguuuaccauuuauauuaacaaacuugaucaaaugcuuaaauguguauaagagacugggaaacaaaauggaauucuguguaauugaaugcaaaugcaaugauuuuaguaugauuaagccuaagaugcuuucaacuggaauuauuugggaauagauagaaagaaaugaauaggagaaaauaauaaaaggcauuugauuuauccacuuaaucaggaguggaucagaaugagaacuuugaaagguuguaggaauugaugauuugaguguaggaaccaagccuuuuccucuucuugcacugagcugguuuuauuccacuacauuuccacaccuugcagaaaggaacuccuuguggacuauaugaggguaggcucuauguucuguaacuaccacuuacucacaccaaccuggaaauuggcugcuucaugcuccaccccccaccacacccccacccacaccccacccacacccaggggcuguguugcucucccccuagccuguuauuuggcaagguuuggcuaaggauucaggaagaagaaccucauuuuccccuacuggaacuuaaacucauuuuacagcucucacauucuuuugcuucuuuuucacuuuaccugcccucaacugauucuccuguguuauccccaagauuaggcagcaaucuagcauuauuuauagcacuggugugguugaaaggcuuuacuaucuauugucuucguagacuuucugucuuccccuguaaagucgggguuggggggaggugagagggggauuuuaccaugugcucucucagguccuuucuaacucacuuaccauuccagucuguaacuuucuucccaacucuuuucuaauucccuuguaagguguugaauauaaugcugagcacuucugggugcucaauacaucuaauaucuccauuucucauacuagaugccauccucugagaggcaagugccccauuucccagccauccccucuccuguugcaucuagcuagggcauucaaguugauuucuucaaagacggaaauuaccauagcuguauccagaagaauuauguugaacgaacaugauauuaagacuguguguauauuaccugguauaucaaaaggggguuaaauguuaugggggaggguaacagcuauuuauuuaacaaaauguuaauugaauaugacuacaaggaaucucagaggaugauggagaagcccacguuagaacuaaucaggacauuguuaccuacugagcucagugaagagaaagguggaacaguaaguguguugacuauagccuguuauaagcuguccuuuucccuucccacacuuaccuucugcuguuccuaccacucuaucaccaccaucaucaccaaacaauuuugugggauagggaaggauuccaaguaagaaacccagccaaacacuucagucccaggagcaagcaaaaugugcacacccuauccaccaaagagggccaacagagaaaauaauucaccagaaucucuaccaaacuauaccuagccaaaauaggaagaguucaagcaccgcccaacacugaguacaaauuagcuggacuugguuacaugaugcucuucccagaccuugugguuaaauucuaauaaccuucuuaggaaaaacaagagggcugucuugggaaugcuugaugagguuuggaauucaagaauaagaggcaaugaugagagacacccagaugagcauggaaaugauuguaucugaacuaaguuccaacuguauacuuauuucagagaagugaaauuaacccaagcuaugcuaccccaaggcaaguauauagauacacuaaaucagcuaguguuuuaggggaugaaaggucgaugugaauguuaguuuaggcaaaugccaaguagcaauuauucugugaagguuaguuuaggccaauauuaaguagaaauuauuuuguaagccuguacagucaacccaacagaaaauuuuacaacuguggaaaaaacauguaaggauauaguagaauuaacuaagcuaaaauugagagaaucuucaccaauaucaauaauauguagauguuaaaugacuaugaauuuuguuaaaagaccgucuaaccuaauaugggaugccaacaagguaguaaauauauucaaauugcgaauggcuaagcuuaaguugaacuacgguguucagugguauccuuucaaccaauguccuaaauaauuaccaaaagcagggcucaaauuccuuuccuauucgaaaauaccagcaguucuguucaauuucacauuccuucaucuacuguuuggccaugccagucaaaccacuugagguacagaaaagagaacuacacuacaacaaggaaguacuuaaucauuugguagcugcagaauauaacuuggcuugccaauggcccgcauaagagucuaguggucuucugugaccaacauguuacaaaagcuauacaugcugaauucagagagacccaaucauuuuagcaucuuuaaugcuguauuugccaaacaaagcacuguuuuaggauaugucccaguuuuuuauauuuaaaagaaugaccugagcauuucuuaaguuaauguuuacuuaaggagugaagcuaaaaauuauacaagggcaccauuccuuugcugcuguugcuucagccuguaaagguguaugauuagauaggaauauugcaaugauuuuauucuuguuuccugagagacagcccauuucccccuuaggauucagugaccuaaaauuugggaagagaaaggcuugaaaaucucugaccuccaaggaaacuagaagcucaaaauagaguuuuucaagucccagucucaauuaucugaaacauauuuaaaaauucauauucuucaaauaguauaccagaacaggaaaacugcucucaccgaaaaccuauuuauaaacccugaucuagaccuagucuuuaaaggaaggaaguuuugucagaaacuagaggcaucucauuaauccucaguggacuagaggccuucuggaagaauagugaaccgaugucccccagucauugagguugacucuucaagcccaaugcuugaugacauggcugcugugguucauacacagauguuauuuuuagaggcaagaauucucauuucccaaaaguauaaccacaagaugucuauuuggaaugaaucacauuuaugcauuuggacaauaguaaauguucagaucaugucugugcaaccucaguucccugaagaaauauguaauauccugguacacucucaccccaggacccuugcccucugucaguggcccucaucuaacugaggugauuucuuuggaaauggagcagggcugugggguuccauagaugucuuugaagcagguuuuucuuccaggaaaaaaaguuauauuuuguccuuguggcuuuccacaaaaacugguuuagggacaaaaaugucaccaaucuuccacaaagcggguagcaaggcucagagaccuucagggagaauuugaacuugguggcccgcaagggugccuugcuguguuugcacuuugcugccacagcuggcaaaucagccugaucuggcuaagcuuuuugggccuaggccaaucucagguccagccuuuauaacugugacuggacuguguggggcuuuuggccccuuaaacugagcuuuacucuaguaaggcuggagacccucaaggagggcauuacagagcccagaauuaacacacacaggcaggcuaaucuagcaaagagaguacuuaucugggaauuggcagaggcucccuggguggguccaguaaccuuguuuagccacuuggugcuuugcuuggccacaucccuuuggguuagcugcuuccuuugcuuaaaaagaucgaaugacugccuuccucuuugacuuugcccuccucccucaugggaagagucucccucaucuguggggaaagaugguaccugucuuucaggguagcccaauaaaguaaaugcugguagucaaucacucaguccgucuguucagcugucuugcuaucuagcuguggaaucagggcucccuggcaggaaucagcuauuaccauaccaggaaaacagcaauggcauaucagacuggucaaagggacagagguuggaaaaaaaucaagucaaugaauagggcuggcacaguggcucaugccuguaauuccagaacuuuguaaggucaaggcaggaggauugcuugagcccaggagucccagaccagccugggcaacauagcgagacccccaucucuauuaaaaagaaagaaagaaaaaaaaaaucagugaauaagcuacuuacuaauuucuuaacccauugguucauucauucuuucaguuaccaaacauguccugagcacccacuaugugucaggcauugugcuagucccagagcuaugcccuuuccagauuaauacuggaguucaaaaccccuccuuccuggccccauuccaaauccuaacaacuuuauacuagcuacccugaggaaaguuuucaggcugaaaauggacauguugccccacaucucucucgacucucauuuccucauuuguaaaaugaggcuaauaauaccugcccugcugccucacaggggucccauauagaucaacuaagagaacagauacagcagcuuuuaauuauaaaaaucauaaaaugcuaauaguugugacucaauaaugaagauuuauugagggcuuaccauguucuccagauuuagccuuacccaggucauaacugaauguuaaccuauaccaaaaauucugaauuuauccuguuuggaaauucagauuuuauaaauauauaguuuuucauguauaauauuaauauuuugugaaugcuguguaccagauacuaagcucagugcuuuacacaaauuaccucauuuaauccccauaauuacacaaugugggagauggauacaaguauuauuauacucauagagaagaaacauggaacucagugagguuaaagaauaacuuguuggcugggcacagugacucacaccuguaauccaagcacuuugugaggccaaggugagaggaucacuugagcccaggaguucaaaaccagccugggcaauauagggagacccugucucuacaaaaaaaaauucaaaaguauucaggcaugguggcaugcaccuguaguccuagcuacucagaaggcugaggcaggaggauugcuuuagcccaagaggucaaggcugcaguaagcugugaucacuccaccacacuccagccugggcaacagagcaagacccuguuucaaaaaaaauaaauaaaauaauagcuuauuuauaguaacaaggcuaguaaaggauagagucaauuugaauccaaguuuucugacuccagaguaugaaccuuuaaccaccaugcuaugccuccucuuggaaaagaaucaaacccuauacacuucuaagcuauugguaauauuauuggaaauuuuccacuuugagguagcggacaguuucuuagaacuacagagaaccauuucuacuacuggggaaggagccccacugaaauggauuuaauuccauccugggucggcuucuucacauccugguguuuugauuguuuguuuguuuccuguccauuuaacagggggacauauuuucauaaguuucacugcugcauucacaaaccauaaaguaagaauugggaaagcuggaagugguagagaaaguguguucuguggaucagaggcagauguggaagcaaggcccaggcaagaacauauguggguguggguagcuuugcugauaccauauggaagcacagccucuagcaggucucucuucuuugucauuaaacaucucuguguguauccuugguacacagacucuuaucuuacugggagcauccagaaggguuuucccagacccacaaaaauuccacccaggcuucuuucuagugcuucaguguguggccauggaguauuacuuuuuuuugccuuaggagguauuuguaacaagcucuuaugucugcugcuauggcugcuacuacuaccccucuuccuccucuuuuccucuucaagaucaucauuguuauucugagcagaagaguuaacauguccaauaacuuauuaccuuuccaggcaaugugcuaagcacuuuacaugcauuauucuauuuauuuguucauucauccauuuaauauuuacuguucauuacuuuguaccaaacacugugcuaggcacugggaaccgaacacacuuuuaucccuucuguuagucuaguggggaugcaacagggaauauagaauuacaaacaguggaaaguucuagaaaagaagaauacauggaacuauaugaaaggugaauggugcuauuuuauuuaauauuucaacagcccugugaagauaauaaauaguauuaucccccauuuuacaggugaggcaagugaaacucagagaguuuaagugacuugcccaaagucacacagcuaguaaguaggcugaguagggauucacauccaugcuggucagauuccaaagcucaugcccuuaacugcuauacuuuauugccccccccccacgugugaagugcauauauagccauuaauucuaggccuauacauuuggguucuggcuuuaucucaaauguguggaguugcaauuguuuccaauuaguuguggcugugguuuggugcauucguucaaagagagugugcacgcaaaacacaggucacgugcuaggccuuguggaugugcacaacguauaaauaauaauggcauuccaaaaaagcugggcuucauuggagucaccacauuuguuuuccauuagcuuaugcuacucaaauacaaacgguaaagcauguguuuacauugcuguggauacggaaagccaggaccccaaagcacauuuugcagguuguauaaagcugagcauccaaauaguucaaaaucaguuuuauaagcccagcuuaauagcuuuaaaauguaaccuggauuccagauauuaaaaaaugccuacagaaaguaugugaguagccaaaagagauaaaaccagcuaaauccuuaaaauauguaccaagucccguauuugcaguaucuauuuuguuacuuaucccuuuauuuuuuuuaaaugcuaaagagcuuaaagucaagcaaacucuuagccauguagcagcaguaauggaauuuuucauucuguacuaaccagcugucugaagcuuuucaaaacaaaccuguucaugaugagauaguuugguuauuuaaaacacaguagaugacaagccuggggaaagcaagcagaaagcauccaauguuguucaaugcccagugcuuaucucccccuucugguccucccacccaauagugaaaagcuuucccaucaaguuauaguuaaugcccagcaucugagaaaauggaauugaaauggaaauuaucugagcuaaaggcaguaaagauggcaaaaauguacaaugaaggccccauucguugaugucuuuaccuaagacacauguuucuuuugaagaguucuggaccuggggggcaaauauguuacuguuaaugagaucucuauuacuuacucaguaacuugguaagguuacugagcuucaaugucuucccuuaacgugagaaauggggauggcagucuucccuguuauacaaacugguggagaguauugaggauuaugugagagaacauauguuaaaccccagcacaguguguggcugauaagcuucauaucuuugcaaucaagacaauuccaagaggcauauuauuuauaccauauagacagaucaagacuugcugcucucacuggucuaauuucaacauauuugaucccucuccgaacaauaaauauguccuuugaucucccauggaccaagcacaaaaagagcuucagccaaaucucauugucccaugcugccauacccuuuuguuauauugguuauggcuuuaaaaauaugaaauugcuguacuucagaaagcccuuuuuucccuuucauuguguuuccaauuuucuuaaguaauuauuccaggcuuuuuguuuccuuuuaucacacaacccugaguaccuguuccaaggcuaacuuuaaauguuucccugucuaaucaaaugaagucaaucaccuuuauacaaggguauuuuccguaacuacaaagacaaaaggucaagauauccauaccuaacugaaaaggaaaucaucauauuauauuuacuuuuaaacacaugguuugaagagcguuuacuaaggauuccaacaugcauggugcucugguggcucuugucaaaagaugguuucagugggauucugggaagcagaguaacauuggagcagccuuucugaaagaguaaggaguggucugcgguucacucacaguaagaugagggggacagaucuaguuaggcgugugucuguaguaccagcuacucaggaagcugaggcaagaggauugcuugagcccaggaguucgagaccagccuaggcaacauagugagaccccggcucaaaaaaaauagaugcagaucugugugccccaucccagauucaccaaaucagaaacucagugagugaauugggccagggagcgugucuuuuuuuuuuuuuuuuaacuuuugccuuuuuauuuuuuucgaaaucacaauuuguauuuauuuugucaaaauugcugaccuggauauaauugggaaaggaaugauugaaugauugccaagagcucaauaucaacacaaaaauguaagccaucaagacuguuuguacacgaaaaaacuuauguuucuguuagguguuugggggaauuauggcuacacauugaauuacuuguuauuuaaauauuacuucuacaacaugcauuaucuuagauauuuuuguuuuuccuauaaaauaccuuucaacuuaaaaaauguuuaauucuuuauuuuuccuuuuauuuuugguugacacauaauuguacauauuuaugggacacagagugauaguucaauacguguauacaauguguagugauuaaaucaggguaauuagcauauccaucaccucaaacauuuauuauuuguguuguggacauucagauccucucuucuagcuuuuagaaaauauacaauaaauuauuauuaaccauauucauccuacaguaguauagaacagugguccccaaccuuuuuggcaccagggaccaguuuuguagaagacaauuuugccacggaccagggaugugaugguuucagaaugaaacuguuccaccucggaucaucaggcauuagauucucauaaggagggccaccuagauccuuugcauguguaguucauaauagggcucccauuccuaugagaaucuaaugcugccacugaucugauagaaggaggaucccaggugcucaccugcuacucaccuccugcaguauggggacccugguauagaacacuagaacuaauuccuccuaucuagcuguaauuuuguaucuauuggcuaauaucucccuauccuccccuucccagacucuaguaaccacuauucucuacuucuaugggcucaacuuuuuuuuagcuccuacauaugagcgagaaugugggguauuuaucuuucuaugccugacuuauuucacuuaacauaauguccuccaggcucauccauauggccucaaauaacaggauuucauuauuuauuguggccaaauauuauuccauuguguauauauaccacauuuucuucauccauucaucuguugauagacauuauagguugauuccaaaucuuggcuauugugaauagugcugcaauaaacaugggggugcugauaucucuucaauauacucauuucuuuuccuuugaauaacuacccaguagugggauuacuggaccauaggguaguucuauuucuaguuuuuugagaaaccuccauauuauuuuccauagugcuugugcuaauuuacauuccuaucaacauguauaagaguuuagcgaggcuaauuuuuuaauaagcauccuggugauuuuuauggaauuuagagaaucacucccacaguguguaaguauguacauacccuuugacccaguaucuuuacuaaggaaauaauccaaaauauggaaagaguuaugugaauguuccugaugauuacauuuuuguuuauaaaagcaaaauaacaggaaacaaugcaaauauucaauauuagaaaaaugguuaaguaaauguugauagaucccuuaauggauagaugcaucaucccauuuaaaguaugacauuuaucauauuuacuuauuacaacaauucugugaggcaggcguuauuucucucauuuuauagaugaggacacugagguuuagggagauuaagcagcuugucugaaaauacaguuuuaauaaguggaaaaaguagcguucgaacucaagucaaucugcuucccaaaugcaaguucaauuuaaaaacaagcauuaaaaagugcugaccuuugaaaacacaaacauuguuuauuaaaguuugggaauuagggguuuucuuccuuguuucuuuuccuuucacguuucuauauuugauacuugcauauuuaaaauauuagauucuaaaagaaaguugauuguaugcuuaggcaacugugauagucucaguggcuaaaacagaguugcacagacaguaguggcuguagaaaaagcuggaaugugaagggccuugugcacuuccacuaagguauccucuguauucaaaguaaugcacagcagaagugucagguuaacagaaugucuauggggauaguggaaugaaauacucagacguagguuuuaauaugaucguuuacauugauaaucauuauugugugccuuggcuuuuaaaaagcuaacaggacaguguccuuugaaaauggcaaacaguuaaucaaaagcauuaggccccuaaaguuaccugcuuuuguguguaagucccucauaauuuucuuuucauaaaguuaguguucagucugaaagacugagagagggaacagaaaggucaauauugugaauuguaauuaagcaauuggauuucugggccaaauuccaggcugccuaaauccacuccuugcuggcaauuccuccucucugacccauuacccuucuuucaacacucuggagcuucagucucuucuuuaagauuuucgcauuaacaauagauuucuagguuuggguuuguuuuguuaaugugugaggguuagguuuaucaguggcugucuguguaaaauggcuuaaaagucuacuauaauccuucuuccaugcugaauuugucaccagaaugggagugauuuaauaccuaaagaaguaacuucacuggcaaaguuuuaaaggguuuuuguuuaauugcacuuuguuuuaaacugagcuacucaagaauaguggggacauugcacacagguuggaaacagucucucaaagauuagcuaugugucuuagccaagguccuccaaaaauguuuagcuacucauucacaaauucuucuucuauaauuaaucugggccuugacuuucuccuuuuucauaagguuguggaaauagcuuuuaaagaauuaaagauaccauaacacuucauuuugcuucaguucaauagcacauauauugagugccuacuaugugcuagacacugccuuaaaugcucugggguucaaagauauauaagauuaaaccccugggcagcucacaggauggugguggagagaagucauauguucaaauaccggauugcauacagaaaguggcauuuaggagguacagauaaagggaacagugguagaagagggagagggagagcuauaaugacugucuaccaggaaagcuuuauuaaugacauggcguuagaacuuggcuugaaaguauggaggacuuugaacagacacaaaugaagaacagcucauaguacauucucaaugaauguguacugaagguguuaaugaaagggacagaugcaaggugugcuugagaaauagcaaguucacuaaucuauaucuaaacauaauucuacuuaugugaaaaauuaucauucagguauuccaugauguacacaaaagaugcauucuugaaaauuaacauaaaaaugcuuauaucgaaagcaaauuucucauaagacauaaugauaaaggagggcauuggggguuuuggugaaacugaagugauguuauaggcuagauuagcaguucucaaagaaugguuuauggauccugggaauccaagaaauccagggauccacaagguuaaaacuacuugcacaacaguacuaagauguuauuugucuuuuccccuguguugauauuugcacaaugguucaaaagcaguggcaaguacaacucuucgaugccacaguaugaaucaagacaccacaggaugaauuaagccaauagcaccaaaauguacuaguagucauuguauucaucacugguguguacuugcagaaaaauaaagggcaguuuuacuuaaggauaucauugcugagucuguaaaaaguuacuaauuuuauuaaaccucaucucuugcacuuuuaaaagauuccguguuauaaaaugggaaguacacugaaaguauuuacacaguaaaccaugucaaugugcaucucaagaaaaagcacuugugagaaauuugagcugugagcuuccuguuucauuuuuacuugagagaaugacugacaaacuauaguuaugcagacuuaaauacuugcuagacauuuucuuggaaaggaacaaagagagccugucaguucagggaaaacaacuggcaguauuuauugccaauaauaaaauucaggcuuucaauagaaaaccaaaaauuguuuuaaacuuuuaucugccacugugagcuugagagcuucccaaaacuuaaagacuuuucagaugagauuggagauaauauuaacaaaugugauuuuuuauaucacauaaugaaagguguugacauugggaagaccugcauugcucagugagccaguauuuuccagaugacccauggaugaugauacaaaaugaguaaaaugcguguucaaaguucaaaacauaccaauggauguaaauguaacaggauaugauauauuuauuuauauaguuucauauuccacacugcaacuaacuacuuguugaguuuuuaauguaguaucaaagaaaaaucuccacaauuaucugaaaagucugcuaaaauacuucucucuuuucccaugacauaucugugggagguuggauuaacugcaaauguuucaaccaaaaccauauaucacagcagauugaguggagaagcagauuugauaauccagcugucuuauauuaagcuggacaucaaagagauuuauaaaacuguuaaauagugccacucuuccuaugaauuaucuuaugucugggaaaauauguuugucauucaaaaauguuuguguuuuagccugggcaacauagugagaccuugccucuacaaaaaguaaaaaaaaaaaaaaaaauuagcuggggauggugucacacaccuguagucccagcuacuuaggaagcugaggugggaggauugcuugagccugcgagguugaggcugcagugagccaugaucaugccacugcacccccaccugggugauggauccagacccugugucaaaaaaaaagaaauguuuaugucacaucauggguucauucuuguuauguuuauagaagcuaucaaauaaauauuuuuaaaauuucucaguuauaauuucuaagauggcaaauguugauagauauaacuuguauaaacaaaaauaacuuauauaaacucuaugguucucagcaaguauaaaggaguccugagaccaagaaguuugagaaccacuaaucuagcucaucuuagccuguauuuauauauaauauaaauguaguuguguaugaugagcagcagcggaaguggcagggugaacguggugcuggagugggagacaguugguagauuggcuucuccaauaccauuagagguuguuggccaggaaaaaaaacaaaaacaaaaacaaaaaucucuuugggacuuuccuuucuuugcuaaaaaauaaaaauaaaaacguaaaaaccaccugcagaaucacauuucucuguaguauguagcucuuuccaaguagaucucaggguggcagcuaaaucacagguggagaacauaaaaguauacuuagccaugacauaaacauagggacgauggaaaccgcagaaaccccagcuuguguuugcagcaauuuuucuuucuggauaccucuuccacaaucacaaagaucucaguuucuguauauccagaaucuuuuguuggcugucuuuuaaaaguagggguuggaucuaagauuuaggaugagaaaugggugauggggaagaagccaggacaaaaacagaauaugagaaugaagccuuggagagagauggcaaggaaaaauaagauggaaucugacaacggcccucagggacccuucgugcggugugcugggucucugggucaguggagaggcuuuugaaaggcgggagucccgugaaauucguaaugcauuggccaugugacugaaaagccagacaccgcagagugaaacaaacaugucucuuagugugcauauuaucuacaauaaagcaaaauaaauuuaaaagcaucuuauuggaauugcgggagaggagaauaaugaacaauuuuucuagugaucaaggcauauauaaugaugauugauuguaaguagucauuguacauguguauaaaauggcacugcuauucuccucauuugguaggaagcauuuugugguuuuaauuuagugacuguaaauuugauuauugggggcuuccauagggaucuuuucuggucuugguguccucuuagcuuugccuuaucaugucuuaaguuccucaucagugaauuguaucauggagacuuucaggagcuuaaauaccaugguaugagaagaucuaaugcaauauacacucuggcuacugcaugauguaaguagagucaaggaguagaccaucacaucaaaugcuauggaaagguucagaagucugaaacucuaaagaguauaagcaguuuacaccuacguaaauuugaaagugauuuuuuacagcuucuguguaauucauugaacauuuuuaaugccuccuguuaauaacacacugugcagacccaccugagaaauaugaagagcugaugcauuccugguuguuuucuuucagcuccugagaaccaugucuaugcccaaagguagaguucuggauaaaaaccuggaugaggaaggguuugaaaguggagacugcggugaugaugaagaugagugcauuggaggcucuggugauggaaugauaaaagugaagaaucagcuccgcuuccuugcagguaacugauuagugcugacccaaauguaaucuaaaaauggugaugcucaggaauuaaaaauaaauugaacccgcugucugcaauucccuuacauucccugcaacacacaaucucaucaacucuucaaggaaagacuauacaagcucuagaaagugaaguucucagguagccuccuucuuuuccucccaccauuuccaaccuuugguagauuaaaaggguaacuuccuguuuuucauuaucuaaaaugaacugaccuaaucaguuggcucuguuucucauuggaguuuuccuugguucuucucauuuauaaaaagaaaugcauaauaagaaaugcaaauuugggaugaaauaaccuguaccauaaacccccaugacacaaguuuaccuauauaacaaaccuagacauguaccccugaacuuaaaacaaaaguuaaaaacaaacaaacaaaaaaaagaaaugcaaccuuggaagucuucugaaaaccacuggugagauaacuuucaaaggaagagccauuagcugaccuucuuuucuuaggacguuaugucuauuuuguuuucucacaagcagucuaacauagauaggcuauggcauaugacugaagaccuacauaaagacaagagugguagggcacgguuguucaugcuuguaaucgcagcaauuuaggaggcugaggugggagaaucaccugagcccaggaguuccagaccagccugggcaacaugaugaaauccugucucuacaaaaauacaaaaauuagcaggguguggugguacgccuauugucccagcuacuugggaggauugcuucaguccaggaggcagugguuguagugagcugagauucugccacugugcuccagccugggagacagagccagagucugucucaguaaaaaaaauaauaauaacuaaacaacaagagcaauagaaaaaaguaauauaguacugcuggggucaaggaggcaaaacaacaacaaaaauuccuuaaauuuguauuccauaucacaguuuagaguacuuucauguggauagguguucuuugauuuuacagguaauuaaaaccagggcucagagaagaaaugagauugcucuauauggaagaacuagaaaucuaccucgggucuugagacuuccacugccauucucuuuccucuguggugcacagccuucuccuuaaaacccuaucacccauggccucugagaugcuaaauguuccuauuucucuggcagccucuuuccuucuuaguucuucuuccuaauccuaccugaaacuggcuauuauccggaugucccuucuuaagccucugucuuuucucucuucuccagaaagaaugcagaucuuaucuacucucccucuuuugacuuuuucuuccuuuuugagauagggucucucucuguccccuaggcuggagugcaauggcgcuuucacaccucacugcagccucaaacucuugggcucaagugauccucucaccucaacuucccaaagugcugggauuauaggugugagccaccauggcuggccucaacuuuuuuuuaugauuuauuuauuuuuuauuaggguaaaaaaaaaaacuaacauggaaucugcccucuuaaacuuuuaaguguacaguacaauacuguuaauuauaugcacauuguugugcaacagaucucuagaacauuuucaucuugugugccuaaaacucuauguccauugaacagcaacuccuuauuuuucccucccccagcccuuagcaaccaccauuuuacuuucugcuucugugacuacuuuagacaccucauauaugauggaaucaugcacuauuuguccuucugugacugguuuauuucacuuagcauaauuuucucaagguucauccauguuguagcaugugacaagauuuccuucuuuuuaagacugaguaauauuccauuguauguauguaccacacuuuuuuauccauucauccaucaguggacauguagauugcuuccaccucuuggcuguuguggauaauccuacaaugaacauucuuuaacuauuauaacacugugggaaauaacuuacauaaagucauuaccacgagucucaacugcucuccuaccaucccacaucuccagcugcuuauuaaucauuucugacuucaccaccaccacccccagcgugaugugucacaagucagauuuaucaacugaccaucauucuccugaucacugaggcuuaaaccuaaagccaucuuugcuucuucucucuugcccuuaaaugcaauuaggcccccaaucccugucgauucuuucuuuguaauuuauucugcuucuguuaauacuuuuuuguuuuuuguuuuuguuuuuuuugagauggaguuuggcucuuguugcccaggcuggagugcaguggcgcagucucagcucacugcaaccuccaccucccagguucaagcaauuuuccugccucaaccucccaaguagcugggacuacaggugugcaccacuaugcccaacuaguuuuuuguauuuuugguagagacgggguuuauccauguuggccaggcuggucucaaaccccugaccucaggugauccacccaccucagccucccacagugcugggauuacaggcgugagucacuacgcccagcccaauccuuccuuucuauuccccccuucacacccuccugcacauacuauugcagacacaucguagguggucuccaggcuucuaggcucaggcaggaguauugagagccuuaggcuaguagauuagaggacaaagaauuugagacccaggcagaagauuccaucaaauucaucuugcauagcuaccugguuaaucuuuugaaggcauuucauacuuucuccgcagcucagcugucuucaugccuugaggauaaagcuaagacuccuuaguagaguucugagggucuucuggucuagccucaacuacccuucuggcuucauuucccaccacuagcccccguaagcacccuccacuuuggugagaacagccauauucaugcuccaugaaccccauaaacauacuguucuuguuucuguuuucccaccacugccuauguuuauuucuuuuuuuuuuuuuuuuuacuuuuuuuuuuuuuuuuuuuuuugagacagucucacuguguugcccaggcuggagugagugcagugacacaaucuuggcucacugaaaccucugucucccggguucaagugauucucccugccucagccuccugaguagcugggauuacaggugcacacaaccacgcccagcuaauuuuuguauuuuuaguagagacaggguuuugccauguuggccaggcuggucucgaacuccugaccucgugugauccccgccugccucggccucccaaagugcugggauuacaggcaugagcccccagugcccggccugcccauuuuauuucuauagagauugaccuuuuuuucuuucaucuuaaauuuuacccauccuucaaggugcaauucaagugugaugcagugaaaagaaaauaggucuugggguaggacaaauguuuauuuaaauucuugcucuacuuaugagcaagcaugaucugggacaaguuucuuagccuccccucuaugucuccauucugucauccauuaaauggggaucauaaccccaacuuuauaggacuauuaaaucgagggggaacauuuauaaaacaucuaggcaaguaucuagcauaugcuagguguuccauaauuguuacuuucucuccaugaaaucuuucauagccaucucaguccauaguuaccucuguccucugaauucauuacuaaaaugaauucugccagugcuuucaugaaacagucuacaauggcucccagguuccauaggacauaaagugaccacucagagccuggcaaccuauuagaagaauguugaauaaacaugaaaaguaaaaauaagagaagcuaauguucauuggacacuuauuaugcucuaaacacugugccagagcuuggcaugcauugucucauaucauuuucacaauaccacuaugagguaggggucauuacuauucucacuuuacagaugagaaaauuuauacuggagguguucucacucauagugggaauugaacaacgagaacacuuggacacagggcggggaauaucacacacaggggccuguccugggguggggggaggggggaggggggagggauagcauuaggagauauaccuaauguaaaugaccaguuaacgggugcagcacaccaacauggcacauguauacauauguaacaaaccugcacguugugcacauguacccuagaacuuaaaguauaauaaaaaagaaaauuaugcaggaggagguggaguggcuugcuuaaagucacauucacaaagggcagagucaggauucagagccaagaagucugguuucagaggccacuccuugaacaagccuacucugacucuuuuuucucugaucaucaacacaacuauaaaaagaucaaagucagcuuugcauuuugcuaccuggaaaaguuguggucaucuaaaguugcccagacaacuuaccaaaauguugccuggucccagcacugaucccugagacauaccgcuguucauacuucuccagaaaagucuaugcuuauuccuacuugugcuuuccugacuauaagccacuuccuuauccauuucaaggcacugcuccacaauuccauggugacuuaacuuguuaaaacaguguuuggcaugggaucuugucaagggccuuuucaaaaucuaaauagauuacauccaugguuucccuuuguccacauacacauuuaucguguaaaagaauucuagucaauuuguuaggcaugauuaacacuaaguucuuuauaaacuguaaaacauuagauaaauggugguuaauuuaauugagaggaaaaaugaugccuagcccccaauacauuacacuugccuaacauauucagugauccuaccagccugaaguuccuugggccccccuuuaaaaaugcuucucauggagaggagacucauugccaaucugccaggcucaugguacaauagcuauuuggcauaauagcuauuuggaaugacaggcuauaugcuuuggucagcuguuauacaauuuuaccuaaaauuuggauagaugccaucugguccugaugauucaucagcauccauuuauuuagucagcuagacuuggaacaccaugcacguucaccaccauuucauuuagcccuccaaauugccuccuccaaaauacaacuugggaauaaagagcauggcucggaauauguuaagacucucuuguaucucccuuuugucccugaacagaccuuuugcgacaugaccagcaaguagcucuaucggcuggcuucccuggcuuacuucuucccuucuuuugaggcacugaaugaagugcaggacacgcagguucuguuccuggcuuugcuucucccguauguccuaaagcgagccccuuccacuuuugaaaagucaguuucuccauuugugaaauagagggaguguacacacaagucuugcagggcauuccagugccagcagucugugauuauguucauuucuuuggcuuugaucccuggcaaggugcuuaucagagucuuuugaggacaucuucuuguaaguuuucaucugaccuugcagguucucuguucucuucucuugagcuauaguucuauauagaaaagaucucauuuuccccauucuaaccccuuugacuuuuccaccaaucuggcaagcugggcuucuuaccaagggcuccccacauguggucuucaacacauuuuugcauuaggaugcuauuaaaaguaauggcaaaaaccacaauuaauuuugcgccaaccuaauaauaagaagguuuuaguaguuuccaggcuuucugggguauauucauuuauaaaauuauucaccucaaaguucccuaaguauucucuuuuuccuuauuucuuauuuauaaauuuuacauagaauccuuagagucuucuucuuucugauuguugaauuuaauuguuggugggaugaccauuacaugaugucuuacccaugguuacaucuucgccuguuccucgcacuucucagaaccaaggguaauguauuucccuuuuggugcguguccuaguccauuugcacugcuauaacaaaauaccuuagacugaacaauuuauacauucuaguaaguuauacuuacaguucugguggcugggaaguccgagaugaaggugccagcauuuggugucuggugaaugccuucuuccugcauccucauguugcagacggaacaaaugcuguguccucaccugggggaaggcaaaagggcaaaaaagggacagaugcuguguccucacauggcagaagagauggaaaggcagaaaggagccuaucuaguucucuccagcccuuuuauaagggacuaauucccuccaugagggcagagcucucauggccuaaucaccuccuaaaagccccaccucuucauacuguugcauugccgggggcauuaaguuucaacaugaauuuuggauggggcacaaacauucaucaaaccauagcagugggauacuucaucucucucagccugcuucuguuucuaaaaaguggagauacagcaaacuagcacaggagcagaaaacaucuugggcuuagggcuuaaaccgauuguauuagucuguucucgugcugcugauaaagacauaugagagaugggguaauuuauaaaggaaacagguuuaauggacucacgguuccacauggcuggggaggacucacaaccauggcagaagaugaagggagagcaaaggcacaccagcacuuugggaagccaaggugggcagauaaccugaagucgggaguucaagaccagccugaccaacauggagaaaccccgccucuacuaaaaauacaaaauuagccaggugugguggugcaugccuguaaucccagcuccucgggaggcugagggaggagaauggcuugaaccugggaggcggagguugcagugagccgagauugcaccauugcacuccagccuggacaacaagagugagacuccaucucaaaaaaauaaaauaaguaaauacauaaauaaaaccaucagaucucaugagacuuauucacuaccacaagaacgguaugggggaaacugccaccaugauucaauuaccucccgcagggucccucucacaacacguggcaguuaugggagcuacaauucuagaugagauuuggguggggauacagccaaacaauaucaucaauacuaaaagcaaauggcuguuuauugcccuugguacacagauauuucucauagaaaugcuugccuucaggaaacuuucagucucucagaugucaguguggggacugcaaagagaaaaccugccacuuguugcuugacauggggugacuggucccuuuugccauucuucuguugucaucuccaagugcuaugggggaaagcaguggucugccccuggcuagucacuucgucccagcaguacuguggaggaagccuuuaagauuucacagcugugagccccauuuaggguaauauuauuaguauuauuuaguaucauuggauuauaacuuauuauuuuagcugucuguagcauauauucccuuuuuauaguuacuuuauaaucugaacacaaaauaacgacgaucucaaguaaaacagcaauuaggaaauauuuucauaagccaaugaucuuuauuuuuauuuauuuauuuauuuauuuuuacuggaucaaguguaaucuuacacuucuacuccuaauaagccugcacacauaggaaaggugaaggacaccucaauggcuuaaguguucuucuaaagugucaagucaaaccuucauaaacguaggcugguagucauuuugcauuaauaaauucauuaauagaguggucuggugaaaagggucauuggaaauuuaugauaggccuuuuaucaugagugacaacugcaaaauauuaaugauuuagaacaaaucauguugccugcugaaaagugaguagaaagcuuguagggaaaugaaauguccuggguuuuuuuguuuguuuguuuguuuuuuguuuuuuuaaaugggaaaguuguuagguccuaugcagaacucggaauacauuagauacaguaauauaucuauuuauacuacccuguugguaacaaguccaggaauaaauuauggcaguuuuaccaaaauguauuuuauagugugaguaucccaauuccccuuccuuugugcucuuuggaaaugcaccauucagaucuuugucacguaaguuguagauugcuuccugcuaaguaagccaccccuggaacucucaggcaagaucuuguagugacugccuccaaacucauuucuugggauaucagccccuccaacaugugaccucagugcaagcgaccccacgucauccacugggagggagaucccaucuguugggcaaaugagacaccuucuuacccuuagacuguugaaguuugagaucuaaagggaagggcgucacuucuacagagucaaacaaacugggucccaguucugugucugccacuucccaauguugugaccuuggacaaagucagucaguuccucugagccacaguuuccucacuugcaaaaauggugauaaaauauuuccugaccuacccaccucauaaguugcugaaugaaacacaugagauaauggauguaacauacuuuauaaacuuuaaagcaucauauccauuuaggauaauauuauuaauauuguuuaguguuauaacuuaaauuauaauuuuagcuaaaggcuuuuggugaauaaaacuaaacuaaguuccaaauguccaagccaauaauuuucaaauguccaagccaauaauuuucauuauaaaugugcuacucuuauacacuguugguggcaauauacacuaguacagcuacuauaaagaacaguguggagauuccucaaaaaacuacaaauagaacuaccauaugauccagcaaucucacuacugggcauuuacucaaaggaaaggaaaccaauauauugaagagacaucugcacccccauguuuagugcaacacuauucacaauggccaaaauauggacucaaccuugguuuccaacaacagaugaaugcauaaagaaaauaugguguauauguacgccguggaguaaaaaaaaaggaaauccugucauuccaguuuaacuguugccaauccugucauuccagguaacgugaauggaacuggaggacauuguguuaauugaaauaagcugguaacaaaaaguuaaacaccacauguucucauucguauaugaaaacuaaaaaaaguugaucucauagaaguaaaaaguagaacagaggugggguagggagagacaugucaaaggauacaaaauugcagcuagauaagaggaauaaguucugguguucuagaaccacuguaggaugacuauaguuaacaauaauauauaguuucaaauagccagaaggaggauauugaauguucccagcacaaagaaaugauaaguguuugagaugauggaugugcuaaugacccugaucugaucaguauauauuauaugaaucaaaacaucacuauguaccccguaaauauauacaauuauuacaugucaguuaaaaauaaaaaaagaaggaaucucugaaaaaaaagauguucuccaucauccccauucccaaagguggcauuuuuaauuacucauuaacuuguuuuuagcccagggugguuugaagugagaagguauuugaacaaugacaaauaugucggcugaguuguacaaauaaccacauagucacaacaauaguagucacuuacaucuugaaagaaucacagcuaguuauguuuuguuuucuuuggugcuaguggggcgguaagggcauggguggacaacgaguugggaagggucaagaaagggccccugauuuuuuccauucuaucucgcucugagcuacaagcaaucugcuuucauguuuuggucuuuucuuuuagagaucaaaugucauaggaaagcugaaggaagcaaagcucaccauaauaacacuuuucacacagauauagaccaggugguucucgcuaaucaauugacaagacagccaaucccagcucacccuagagcuuugcgaagcucccagggcucacaaaggggacuuagaugugagcuuuagcagugguauuaccugccaauugaguagguauaccaagaaagaggccuuccccaugcuuuaauguuggcuagggaauuacuauagguaaucuggugauagaugagaaugagcaaagguuaaaacuucccguaaaguuaucauaacucaggauaccuuagggaguuuguuucuuauuauuuggaaggagauauucugagauuugcuuuucuaggugugcugcgcugugauacuuucccaucugagccauuaggcuauaaggcuuuuaucaggaguaaugcuguaaaaguuguacuugcugguaggccuuacacauaacucuaagaauugaguaaguauuagggauauugugagcaauuuagugccauuguauuauauuuucuaaucaaucuucaaauuaagaggaaacuguugaacagaugaauuugacuaaguggugcaauugauuuucucuggacagaagccauguuggccaguuuuaugacagccucaacuaaaaugugguaauuuagccaaguauugguagaaaggaaagggauggagagguucagcauucagcuggugggaaaguagagaaggaucuagcaggaaaguggcaagccugaagccucucgcuggguugccaaacagaagugaagcagucccuguaggauaacauccccgagggaucugggagugcagacuuacaugccagcaaaaggaaagugcuccccugcaagaagaaauagcauagcagaaagagagaaauguggagaugucugauuaaaccugugcuguuguccaaaguuuccaugauaaacaaugaucuccuaggggguucaaaucagaaacaaggaaucgugagcgugcagagugagacagaagcugaaaagaucuaguguggauaguccuaguggcugcagguagagaucgggaauaaagugagggcugagguccugcucggagaaggggagggauguggagccauccaaugcccuccaauuguugacuuuccauaaggccccuuaaacugugcacaugugcacgcaugugcugucaaaucucuccaauucagacagugcaguccuuuagguuuuucuagcacggcaaaaagaacaaagaugcagccaucaccuccccucuuuauuugucugucggguacaaggacauuucccauucgcacugguaggaacgaaguuacuggcaaguuuuugugugguuaauuuuucugaagggaaaccuuguuauagaucuugccuguguacacaccugccuaaaagauguuuaaugauucuuaucauuuccaaauauacuugcugaguuuuuuaaaaagugccuuuuagucuguuuuuuguuuuuuuguuuuuuuuuuuuuuuuggcuuuuuauaauccuaaugugaaugucugaugguaaauaagcuuuuaaggugagaacacgagcaccagcacagacagaaucuuuuaauuuguagcucauugguggacugaagcaguaauauaauuaccaaguaaauaaaaauggaguagaaggccaggcacaguggcucacaccuauaaucccagcagcuugggaggccaagguggauggauuacuugagcauaggaguucaagacuagccugagcaacauggugaaaccccgucucugccaaaaauccaaaaauuauacgggcaugguggugcgcaccugucaucccagcuacucgggagggugaggcaugagaaucgcuugaaccuggaagguggagguugcagugagcugagaucgugccacugcacuucggccugggugacagagugagaaucuguuuuaaaaagaaaaaacaaaaauggaguagaggcuauucuacaaauucagguuuccgaggacagucuagguuagagcaggaggaaaucucaugagcacauucaggaugagcuucagagaagagucguucuccaaauaacagugaacuccuuggagggucgaaagcaaguauuuuucauccuguguauacacuucacaguucucaaucaccuauucuccuucccuccaugcugcucagugacucucaguacguauuuaguaaauauucaguuauggauuuguaauauuuacuuuucacauuugcuuccuuuggucccauauucaauagggcaacagugugcuucaccuucauugcaucuuaaacuagcuuccucaaaguauccucaacuuuuagcagccguauuugugagcaaagagaucugagauuccuguuccagucaacacaggaguaaggacucagcugagugggggaaggcacggcaugugaaacauaggguguuuguagccuccugugcaucuugagaagagacagacagauggggaagauucugcacacagggacagugggaggauggugaaaagaaguaacaguguucagucuacaugagagaaggauuaggaagauaugaauguugucuucuaauaguaagaagucuugcauauggaagaggagaguagaucuggagccaaugcaugacauuuacaaggagacauauuuuggcuaacagaaagaugaacuaucucuuugagcuauuccucaauugaauggauugcccugagaaacaaucagcuuccugacuuugaagguauuugacuagagaauaaauaagcauaucaggccaagugcaguggcucacauguguagucccaccacuuugggaggccgaggcaggcagaucacuugaggccaggaguuugagaccagccuggcuaacauggcaacaucccgucucuacuaaaaauacaaaaauuagccaggcaugguggcacacaccuguaaacccagcuacucaggaggcugaggugggagaauugcuugaacccaggagguggagguuguagugagcugagaucgcaccacuucauuccagccugggcaaccaagugagacugcaucucaaaaaaauaaaaauaauaaaaaaagagaguaagaaauauuggcuggauggggcuuaggugucagagaguggauagauaccuacaucaugauggacuuuugacuuccaggguccugaauagcucugaggggcuaaauuuuuaugauguaaacauguaaauagaacaaaagagaaucaauaugguggagcaaaccaaugaggccauuuuucaggcugggggaaagaaagaggaguggagaagagaaucucugugguuguuugucuaugagcacaugucaccaauuaugauuuucugcaacuauuuuccuaagaaaacggauccuuacgaauggcagagacuuuuccagggagcaauucuuuucaacaucuucugucauucacagccuccagauuuguuuugccacuacaagaauccaguucucauuucuccccaauuaucuccaggcuuguggccguccugccccauguuagaaaagcaaacccaggacagagcccuccccccggcuacaagcaguuagugcugauugcuguauugucaauauuaagguuguccaguucacacucauccccugcaccacucucucccuucugauucugcccacacagaauagaccagugcaucucaaguuaucuaugaugaaggacccagaguuuguuuguuuguuuguuucauuccucccaaaucugucauggaccaauaucuuuguagacaauaaaacuaaauuaccagaaaaagaaaaugaccaaaaaaaacccuauaaaauacaagccacacguuuuaauuaugagauucaacagaccuaaaaaucucugucagauugcuauaaaaguuucaaagugcuuauuuucaaugucuguacuuaucuucuugcagauuagcaauaaauagcagagcaguagcccacacauugaguagggagguguagccugcucugugugucucugccuuguauuccuccucaccuuggaucucauggugggaaacacucaaaagcagucuaaauagagugagggcagugguguacuagagcuggcuugcacuggcucacgagagccaauuguuaaauuuucagaauuccugugagucaguuguuaaacauggccauuacaaaaaauuaaauuauauaaauuuacaaugaaauaaauucuaccaaacaaaaauaacacugaagacucaucacauccuaauuauuuuauugcauuuuauaauuaucucuacucuuagggucauaugucuauuguguguguaugugugguggaaauaauauauacucuugcaauucuguguucaguguggucacauugguagcuuaaagcuggccaggauagaaauacuuacaccacagaaaucaggaagaaacuacaaaucagggcuugauuuauuguuuuguugauugucuagacucuagacuuaagaaagugauaggagaaaauguuaauagcacagaauaaacuuaaaaucauguugucucuguagccauuacauugugaauagcacaaaaaaauugaagaaauauucuuccaguauuugaaaacuauuauccaauucaguaaagaaguugcuccuaucacugauggagugaaguucugacuccauuggaguggaacacuaauaauaauaguguuauuucacuuuugugucaccucuuaguguauuccaauauaucaaccaguauucauguaggaacuacacuugcucaucgaucauaacucuaguuuggcuccaguugcaagagcuugaacaaaagucaaugaaagcauucugugagaacuaauuggcuaaauaaaauuuauaaugaagaguauuuuauauuuuuaucuguaaauuguaaggugcugcacauccuuuauuccaauaaaauuaaaaauaagcugacaugcauacuuccuuuuuuugagagccaguuguuaaauauuuaccagcucaccacuggguaagacaauauauuuagaggauuuauuuuccuuuguuuauccuuaaaguuucuaaguuuaaaucaauagcucuugcuaccaugagugagagaaaauuucugucuuccaaaguuaugcuggcaaauuaaagagccccucauuuucagugauacugacuucuaggaaucccaaacuuggaaacuuucuuaacuuggaucuguaagauccauaaacuuuuuuccucaaaacuucuuauucccuguugagguucgggggcucccucugaaaucccucugcuaaccgauggaaaucucaucagucccaucccaaaccucaaugguauuccugcaggucaauucacuggagcacccaggugaggaccacuuuuagaguucagccucgcuguagaagauggcauuaagacaaauguauaccgugugccgguauuagccuuggcuucauagaguucgaguggaacuccuaauaucagguuacauuuuguuggcucaguaaucauuuuuugaaccaccgaccauaugggcagagguugggaggaaagcuaaauuuggaacacacucccacucuccuguucaacauuucuuucuuguuugugcagggaggcaacauuauuacucauacucacauacaguaccaacugcuagaggacuaagaagugagauucucccaaaauguggucggaucacuggagauuuucuauacaaauaugcagcaguucaguaagaacaucugugcucugcuucugcagaugucagaaccugucugugacacauagcacuagaagacuaaauugauaaugaaaaggaacccagggauuucaugccuguggguucauaaauucuuuaucauuuuuaguccacaugcagagauagcaccuuucugaacugauaucuuuuugauucaggcauuuuuagagcauggagccaugaaugucucuccauuuaguuuuucuuguucuagcuuuccuucuccccacacaccacuucauauggaaugauaguuggaacaaagaagauggauauuuugggagaacaacaauaaugauuugggcaguaucugaggaaaucaugcacauuucuuucagcucuggggcuuucuaaaccuaaauacacaaguuguauuuagccuaaagcagcuaaaggucagugccuccaagggguuuagaaacauguucaacuuaaggaaugaaaguuagucugccuuccuucgaggagagguuguagucuucucaccaauagccagcuuggagucauaagggcauucuccuugcugucccuaaauucuaggcauaaaugaggaguagugaaaccaaaucccuuagcucagccuuuccuaaucuggccccaaccuacaucuccaaucuuuucucucacuaaccccuacuccauccuaugcuccaacuaccuuaaaguuuucacuguugccaaacuugcuauucuguuccuucaggcgugccugggccuuuguaaagucuuguaucuguaauauacauaaagcacuuagcccagugcccaugccuugguagguucccauaaauaguggcuguuaauauucugcacaugcugaccuguuaacccguacuuguuuccccuuuuguaccuuuaaaacucaguucaggcugggcgucguggcuugcuucuguaauccuggcacugugggagggcgaggugggaggaucacuugagcccaggaguuugagaccagccugggcaacauggugaaacccugucucuacaaaaaauuagcugggugugguagugugagccuguagucccagcuacuccagaggucaaggugagaggaucgcuugagcccaggagguuaagggugcagugagcuaugauugugccacugcacuccagccagccuggacaacagggugagaaugucucaaaaaaauaaaaauaaaaaugaaaaauucaguucagaugcaucuccuuccucagugacaccuagcccuaggcagagugcuccgucaauaugcuucaagcauuuaccaacaugauggucagguaauucccagugccugggaccuaauuggugcucaguaaguguuuguugcauggcccuggccauacaaaaaugaauaagcaaaguaccugcccauagaaguuccuaguguaguugggggucuugggggguggugggcaaugggaagggcacagacaccuaacuggaucauuguaauguaaagcgguuaaagcacugauugcaguauguacagggaguuguggaaacacaaagguaaagcuucacacccagccuugggucgucagaaacugagcugagucugaaacaauguguaggggucagguggaaagggaagaaaauuguaggcuggcaggauaguaugagcaaugacuuggagaugagaaagagcacggugguucugaaaaugacaugcacuuuggugugacuagaguacagagaagcaagaggugaggcuggaagauuuguuaggggucacaucaugagggccuucucugccuuguuaaggagcuuggucuugauccuguagcagggucuauaaauucacaacauaugggccauuagccuccccaacccccaucccucuccauagcagacauucauaaucacagcaccccacuccacugagcccagaugugacauccuaauccuucugaacauagcacuacagggaaacaccaccaaaagauugaaggcuugaaggcagcauucugguuugcugccuucaaaccuuugguuugguuugguguuuuguucuguuuuguuuuguuuuguuuuuuguuuugagacagggucucccucugucaccuaggcuggagugcaguggcacaaucacggcucacuucagccucaaacucuggugcucaagcaauucucucaccucagccuccugaguagcugggacuacaggcaugugccugguuaauuuuuuuuauuuguagagaugagauuuugccauguugcccaggcuggucuuaaacuccugggcucaaacgauccacccaccucagucucccaaagugcugggauuacaggcaugagccaccaugcccagccagagaaagguuguaagcauguugggaguuugagggcggcaagugagugcaagugaagggagaaggcugacauggucagaauugcauuuuggaaaacucucugggggaguggaugaagaugcagauuuaagaagaagaaucagcaagaccugucuauuuagauguggcagagugagggagaaagaguuguugaggaugaggucacuguuuccaccuugggcaaaugggcagaugccagugccauucagagagaaagcauggaggagguaaugauaggguuggcacaauaauaauagcucauauuuuuugagugcuuacuaugugcccggcacaguuuuaagcauuuuguguggauaaacucauuauauccucccagcaacgcugugguguggguaccauuauuauuuguuuuguagaagaagaagaagauacacagagggguauagaauacugaagagcuaacacaaucaagggcacuaagggagaguguuagaaugauaaaagcugaaaacccacaccugagucauuuggaggacuauggauagagccagccaggucacuaggcacccaugcuaggguuuaucaguucaucuuuaauguuuuggaaaccaaaggauuuaucguucuuggaagaagcccgauguguauaaauccuuccugcccuuaccacaucuguucuacucacaggggcaaacaucaguaggaauaggaauuaaaacaagccuguccaaaugaugaccuaaaugauuuccaaaugcaucuucaaauauaaaauacauccagcauucuuaaaauuaaaagggagauaguuugagggguggcuaguuucccagacucccccagagcaccucauuugaugaaugcuguaauaaaaacacuuccacccacuccacccugaauauuaaaagggcaagguuaggaaggguauugaauuuuaagagaauacaucacauuagauugugcuguuuuuucuaacgauuaacccuuucuuguuuuaauaauuagacuauauacaucuauggguauguauguguauguaaauguauauauuuaugcaauuuguuuaauaacuucaugcuuugcaaagcgcuuucucaugccguguuuauuugaguauuauaggagcuuaauuacuuuaaggaacaggcuauuucaaugacuaauagacguguugccauuuucaucuuagcuucaugucugacucucuugcuaucugggcugugucaguauugcagugugagcacuaccaagagucagguacuuuagccaggaggggaugaauguccaugccccauggccugaacauguagcucaacguuagagucaaggugagcugaggacugaacagcugagguuuucagaccuguccgccauauuugcuguuaacccugaacucagaucaugagaccauggauuugcuaauuaucccauaguguccucuggaacagcuauaaauaaacuacaaaugugcaauuuuugccugaacaugccauucccauaaacaugucuuuaccccaacucaggccauuacaucugcuugugaugucuucaauucuucuguccugaagccugccaauacuucaagacccuccuccuccacaaaacauauucuugauggcuucagcuauccaugacaucucguucucuucugaagcccuuaucuccaccauucuauacauaacaauaacaauaaccaacuagcagauuguuauuuacuaauaacuuugaaauucaucaucugauuaaaucuucauuacaacccuguaagguagacuuuaauauuagcucuuagagaggagaaaacugaguuucagagaguuaaauuaaauaacuugcccaaagucaauugauauuaagagcuaggauugggcugggcacagcagcucaugccuguaauuucagaacuuugggaggcugaggcggguggaucacuugaggucaggagcucgagaccagccuggccaacauggugaaaccccgucucugcuaaaaauacaaaaauuaaguguggugacacacgccuguaaucccagcuacucaggaggaugaggcacgagaaucacuugaacccaggaggaggagguugcagugagccaauaucgcagcacugcacuccagccuaggugacacagugagacuccaucucaggaaaaaacaaacaaacaaacaaacaaaaaaacagagcuaggauuggagcccagaucuuucugaugucaaauucauuucccucuccaccaugcuguaugacccagcacacauagcugaaaaguauuuguugaugaugaugacaacaauccucuuguguuaguaaauagccucugacuuuuuccauggaguugaugcucagaaucagaauagccugagcaagaagaguucugcgccucuguagccuuuuaggguuaagugcuauagagaggagcugaaaguacauugcuccacucaguugggugggacuagucuggauucccagaagauuuuucucccucucuuuauauacauuuccccauaucucucccaugaaucauaguucuucugggugccugagccuggacccgaaaaggagggauugaagagcaugugguauucaaguaagucacuauaugugcuuaggagaucuaggucuacuccucugugcuguacuugagagcuauaauuauugauccacaguacauucuugugccccaugaccauccggccucaguauauccuagacuaucauuugcuggggcagcaguugguuuggacagcuuauucugaagguagcuuuggaaacuugcauaaucuugguacugagagacugagcaagcagccaggcuagaggccccaugugcuguucuucgguccagugccccagcuaaaauaacacauuuagaauuauucaguaucccuuccgcucaucccuaaauuugaaaaugcauacucaugaggaagccuggcuuuuaguaggucuuugguauguuagagaauugcauguuaugggaagucaaaaugaauguuggagugaaucucauucuggcuguaauaauaaucuucacauaguagcaguauuguagccaaugagguuuauccacacaugauuauugcugauuaaaauaaugauaauaauaauagucagaaacauaauagcacuuacugcuaauuguuuucucuaugcugacguuggucuaagugaguguuaccacaguuaaucucuacaaggcccuauggaacauugguaauauaacucccauuuuauagauaagggauauaaagcucagagagauuaaguaaaaagauuaaguaaaugguuuaaggucacacaacuaauaaaugguccagccaaaauucaaacccaugccuuuuuggcuccaaaggccaugaaauauuaauaguagccucugcucuaccacuucccuuucugcugcuucuugguacuccugucuaugccuuguaagccuucagucagcacccagcugagacccacaggaagugcuucagccaauguugaggucagcuaaagaguagugaccagcaugcagcagaaagggacccaaacuguucauucuaaccaugccauugugcuccgcuggccaacccuuaagccucauuacauuucauucucccagcaaagacaguaaagauaagaaugcagauggagugugugggaugcgauaugacuaaauucauuuggucuucuggaacuuuuguaaaaauauaaacagaucugaucuaguuaaauacuccucuucuccuuaggcccagacauaaucacauaauucacagucagcuuugcuggcaagacaaagauuggagauguuccauaaagaagauaucaguuugaaaaaccuacaaccuuagcugaaaaauauaauuuuguucauaaagaugucuaguaggaaauaaccagaaagacugaaauaacuuugaaccagucguuaucuuuggucaauaucauguggccaaugagaauuuauaaucuccccuuuauauagaauguugcuuauauuaauauggcuuucuauaaaauaucauuuuaaauguggguuggugaacuggucucucucucucucucuuuuuuucucaauagcuucauugggauauaauucacauaaccauacaauucaaccauuuuuaaauguagaauucagugguuuuuaguacauucacagaauugugcagugauuaccacaaucaauuuuagaacauguucaccacccccagaaaaaccuuuuaccccucagccaccacucuccaacccuccuaacccccucaacucuagauaagcacuaaucuacuuucugucucuuuggguuugccuauucuugaaauuucauauaaauggaaucauacuauauguaguccuuugugacuucuuucacuuagcauaacauuuucaagauggacccauguugaaauauguaucaguaguucauugugggguuuugcuuaauaacauuccauuguauggcuguauuauuuuacuuaacuauucaucaguugauggaaauguguuuucuucccacuuuuuggcuauuauagauaaggcuacuuguuuauagccaaaaagugggaacaaagaguaggaacaaaacaagcagccuuauuuaucauagcuaaaaggugggaacaaaacacauuuccauccacauuuauuuaauucuuguuuaauuuccuuuaacaauguuuuguauuauucagaguauagguuuucuacuuuuuuguuaaacuuauuccuauguauuuuauucuuuuugauacuguuguaaguggaaucacuuuucuaauuuaauuuucagaguuuauugcaagucuauauauauuugauuuuuguauacaauugauuuuuguauacugaucuucuauccuacuaccucaauggauucauuuauuaguucuaauagacuuugugauuucuuuagguuuuucuacaugcaggaucauguugucuucaaauaaagacaguucuacuucuuccuuuccaaucuggaugccuuugauuuguuuugcuggccugcuuacacuggcuagaaccuucaguaccauguugaacagaauaggcaagaacugauaucuuugucuugcucaugaucuuaaagggaaugcuuucauucacucacucuuaaguaaauuauuaauagcucugagguuuuuauagaugcccuguauugggcugagggaguuuccuucuauuucuaguuuaaguguuuucaucaugaaaggaugcugaauuuugucaaaugcuuuuucuauuucuaucaagauaaucauguaggauuuuuuuuucuuuauucuauuaauaugguauauacauuguucacauuuuguauguuaaaccaaccuugcauuccugggauaaaucccgcuuggucaugauacauaaccuuuucaaccuguugcuggauuugcuuuguucauauuuuguugagaacguuuguguuuauauuuauaauauauauuggucuguaguuuucuuuucuugugauaucucugccuagcuuugguaucacaguaaugcuggccccaucaaguaaguaaaaaguauuucuuccucuucuauuucaggaagaguugugaaugauuguuguugauucuucuuucagcauuugauggacugaagccaucugggccugggcuuuguauauucagauuuccuauuucuucuuaagucaguuuugguaguucauguaauucuaggaaauuugucuauuucauccagguuaucuaauuuuugguuuacaguuauuuauaauauucccuuauaauccuucuuuauuucuuuacaguuaguuguaaugucccuuuuuuaucucuguuuuuaguaauuuaggucuucuuguaauuucauuuuuuucuuaugcagucuugcuauagguuggucaauuuuguagaucuuuucaaauaacaaacuuuuaguuuuguugauuuucccugcuguuuuucuguucucuauuuuauuaucuuuaccucuaauccuuauuauuuucuuccuucugguuguuuuggguuuaguuugcuugaguuauugauuugaaaucuuccuucuuguuuaauguaggugaucauagccauaaauuuuccucugaggacuacuucccugcauuccaaaagccuugguauguuguauguucauuuucacuuauaucaaaguauuuucuaauuuuccuugugauuucuucuuugacugauauuuauguaggauuguauucuguaauuuccacauauuagugaacuucucaaauaguuuucuuuauugaugucuaauuucccuccauugugacugaagaauagacucgacaugauuuccaucauuuuuaauuuauugaggcuuguuuuauggcuuaguuuaaggucuauauuggggaauguuccaugugcacuugagaagaauguguauucugcuauaaaccgguuaauuuuaucuacaggauuaauaugaagcuauaauaaaguacuuuuucagcuuauauuucauauuuuaaaacaagauucagucaauaaucccuucccccauguccuucagaaaagaacaugugauucauaaucaccauucagaucucaggauuaagaacagaacuacagaaaguccuccucuugacauuccaauuccacuguccuuuagaaccauagaggcagcacuuaauuauccacaaggagauuuuuuauuuuguggcuuaucugaagugaccuauaguuuucaaucuuucugccaccccucccaagcucaggccacugauguaagccagcacggaugaggggcauuuaaauaucagaacagggugguuuguuagacugucacugaagccauagggaccggauauguuaaauacaaaaagcccaucugacuaguguucuaagccucuuugguaaccuaaucagauuagcuauuagaaaauggcuaucaggcugggcgugguggugggugccuguagucccagcuacucaggaggcugaggcaggagaauggcgugaaccccagaggcggagcuugcagugagccgagaucgcgccacugcacuccagccugggcgacagagcgagaauccaucucaaaaaaaaaagaaaauggcuaucaggacaccccaaaaaaaguagccaaccuaaaugcgcagagcacaauggcugagugugagugguuggcugaaguaaaugugaugcuuaacuguauguugguaucauuuaugccauuuuugaaagcuggccaugccucaaaaaauacauucuggaacuaauuuccuauuuuaaaugguguucaauauugccuuuugucagagaaaccguucucacuuguagauuuauaagguaauacaaauaaacaucaaagaaauaaaaauauuaugaucaaccaagaugugaguuuaaagacaaaaagaaaaauuuugaucucuuuuuaugcuucuaaauucucaugauacuuaugccauacacauauguauaaguuuauaaagcugugcgauaauaaaaucacagacuuucacaguagguagguuuaagauugaaacacaggagaaccauuucuccugugagauuuuuuuuugagugcuuauaugagcacucuuaaaauccaaccacagaauauccugucucugaguaauaaaauuggguacacuggcuauaacaauauaaagauggccaagaaccaacauggaauggugaaucacuuuaagcauuuggucauggggccaaagaccaggcucuuggaccuagacuguguaucuaauucuacuucaguaaaucaagcuagugaaggcagugggucucaugcugagaaaagaaggaagcccagacucaaaggggucuaauucugcugggagguuaaagaauggaugccuuucauggaauuauuuuguucaacuuagaaugagucguccacagaugugcccauuucaucucauauuuguuuauaccucugcuuuaaaacauucuuuuucugcugggcacaguggcucaugccuguaaucccagcacuuugggaggccgaggcaggcggaucaccugaggucgggaguuugagaccagccugaccaacauggagaaaccccgucucugcuaaaaauacaaaauuaggcgggcaugguggcacaugccuguaaucucagcuacucgggaggccaaggcaggagacucgcuugaaccuaagaggcggagguugcggugacccgagaucacgccauugcacuccagccugggcaacaagaaugaaacucuguuucaaaacacaaaaacaaaagcaaacaaacaggccgggcgcgguggcucaagccuguaaucccagcacuuugggaggccaaggcggauggaucacgaggucaggagaucgagaccauccugacuaacacggugaaaccccgucucuacuaaaaauauuuaaaauuagccaggcaugguggucggugccuguagucccagcuacucgggaggcugagucaggagaauggcaugaacccaggagguggagguugcagugagccaagaucacgccacugcacuccagccugggugacagagcaagacuccaucucaaaaaaaaaaaaacccauucuuuuucuauauagauguauuaaggcugauguuucuagcauaaccaaaauuuguauaaucuagaaauaacuuccauuugcuaauacucauuaugcaagauggaaauugcucuuaagagcuuacgguuuguauuuauagggacacuacauggauagaugccuguggccacaugugucucacauuuaacuguaaaauagauaccaacguccauccagcauagagugauuugaaauauaacauuuaauuuccaaauguuaguuuugcucagaaaaauauaaagccugucugguuagagaagaauuuauggaaugaugcuucagggcuguuuuaauugaaguugugucuuuacuucaguuaaagcucucagggacaguaaugauaaacaggguucauagcaguggacuuccucuaaggaaaagcagcucuuguccccagcuuccaggaacugggaccaugguuuccaaaucagucacacacagacccacccccugcccucagugucccauaguuggucuugaaaucuuccuggcauuuggcuggagacaaaaagagggcagggacauagcagcuucuaaaggauuauggcuccaaaguggaaagcucaucugcagugugcaacugcuucaggcuuguucauucauuuuuucauuuuugauucacauauucauggcccucugcaaguucaucuucgucugccuuuucaguuuaaucuuuuuauuuugugagacaaggucucacuuugucccccaggcuggcgugcaguggcgugaucaugguucgcugcagccucaaccuccuggguucaagugauccucuugcuccagccccaccaaguagcugggacuacaggcaucgccaccacgcccaugcuaagguuuuuauuuuuuguagauacaggguuucgccauguugcccaggcuggucucgaacuccugggcucaagcaauccaccugccuccaccucucaaagugcuaggauuacagguguaagucaccuugcccggccuuuagucuaaucucuugcuucuucucacauaguccagcugaacuauuuccugagcauuuuccauuuuuccaugccucugugccucucuauauaccauuuuuuucuaucuagaauacuuuugccucuccuuccacuuacuccuccucucagucucuauauauccaaaugcuacccaugcuuuccagccucaguuuaaaugcuccuuccuccauaaugucuuuucugauccuaaaacacuccuaccuaauccagaggugauuacugucuccucuaaacuuccucucuuucucuguaccuuguugagacacuguaacacaauagauaacagcauagccacuuaugaauuguguggcuuugggcaaaauucuucuccgaaucugagaccuuaaauuuguacaauggagacaaugauaccugucucauaguauucuuguaagaauuaaaugagauuagguaugcuaagaaccuacacagcucucaauuguagcuguccuugaggacagagacgacaucuuguucaacuuuguacucucagcacuuagcauugcacuuggcccagggugguacuaugugaauguuuguggaguaaauagguaccccuuuaguaaugggaaugugguggagaugugcaaaguguuuuccagcuauuuaggaggugaucuuuugugucugucacuugccuuccaauggcucccuugucagccuacaaaauggagcuguccuucucuguuucuaaauuaaaagucaggucaagcaaugcaaauuuugugcuuggugcuucauuccagcucucugauuauucccugaggauuucgcucuccuuuguagagucuggagcucauccuuugcugaggacuugaauccauucagauuuugcauuguuaaguuuucagccaaguucagcuaguuugguaguuuguuuguuuauccuuggccaaaauaugacuuccucuuuuuucaaagugucuuugaaagguaucauaaagguuuugguacauucaaaagaucauuaaauauuuuauguguauauaaugagaaauucuuuguuuucuccuaaacugccccucugguaaagucaagaggaaagcauguguuauaagugggccuuaguuuuuauuuguuggauuugggccucucuccauucucuuuuuggcagauaccuggaguauauugaauuccaaguugacuuucaaucaaacggcauuucuauauuuccuuaagaaaaauacuccuaggguaaaggaaaaaugucuugagugccaagagggacuggucgauagauuuugaccacauuuucaggagcuaaggcaaggauaaauucaaaccuggaucagagaacucaaauggaagaaaagcagccuacuaaaagggcucugccacaggccauugguuucacugccaagggggauaugaguuuuguccuucauaggaaaauaugcagcucuuuaauauucuaucagaaccagaggaugcuguucauggggugugauuugaccacauucagaaauuuagccauaauuuuaaaacgugugggacauuacucuguguuguuguugcuguuuucuuagagccaugguaagggccuagugggugagacagauuggauaugcaacacuaugucauagauauacaucuuccuuaaccuugaacacccuaggaugggagcaagacagggcucaccugggaaacucagcauucaacccauggucuguuacucaggaggcacccuauaaguauuugaaugaauggaaaguacuugucuacaagaaugccuuuuuuagagcuuccuccuggcaucagugugggaggaacauuggagaaauacucaucagccuuuccucugccuucugacucuuacggcaauuccugcuugagggucaaugaaguuuggaagcugguagagggaaagggaaagauuccuuuuaaauuuuuauuuaaucuucccuaucuacuugagaucuguugaugucuggacagauguuaaggcuuuuguuuuuguuaauugcucaucacuuugaacaaaucucuuucucuagccuagaagccaggcuugagcuaaaugacagggcccauuaguauuagucuccuugggcucuguguaucuggugaugaaaaguaggauaaagcugaggggaugagguccugucuguaggaggaagauaccuggggccauacuuuauccuggauucugcucaccuuccccaauucaaaccaauuggugaauauuuuauuugcauagaacaccugcagguauacauguauguuauguucaaugugauacucuaugugaucuuuguagguuuuucaggcuugguaacaguacagcuaaagauuuuggaaggguggagaggcaaguauuaaugccaguucauuugacuucucuaucaccaccaugugaauagaacuuuuauuuaaaaaaagaaaagaaaagccaaacaagcccuaaugucucaugcuaugaacagaagugccugcaauauaggucaagccuuacauguccucuccagaguaggaccacccuacuggagucuggagguagaugauauuuccugagcugcaugucugaauccaucacucccuccccuggcuccuguucuccagacaaauggucuagccaucuugcuggaaucggcaauaucauccaaacauauggcagucuuuggagguaucuaaugggccagcagugcacauuauggugauaucauguuggaaccugacaaguucuauguguaaagcucaauugugcuuaaaaggaaguuccauggccaaucuguucauggaccugacugcuuuauuuagaaaaauuaaagucacucuuccaauuugaucaacaaauacuuauuggggucccauuaaauaccaagccuuauaugaaaaacuuuacauaaacacugucauuuaauucucuuggcaacuuuguuggggagguaauuuuuacaacuuuggagaugauaaaauuagggcuuaaagaagugaagucuuacugcuggcaagugguagagcuuggauuugaauugaggucugucucuuccucaaacucucccuauucugcccuguggcaucccaggaauucuuuuuccuucuuacuuccaauuauuucauagcccaguucuaccaaaaagcauaacucuauuaaggguuccacaguuacaaaaguccuuuggggaugagcccuuuaaccauuguucaugaggaccuuugaaguuucccaaguuccuccuuagucaguugcaugcauauaauaaaaguggucuuguugauggcacaggaaccuacuuucaucaccauuaacuugggaaggcacgaggaaugaaaagaaggugaugagagagagagagagcaagaauucaaugcagccaguuauuucaguucaacucacagauauuuacugagcaucuccuucaugccuagcacaguguuaggcacagugagaauaaagaggcuauauauacagcaccugcucuguaggagaaaggaagacacagaagaaccaaagaguuugggcugaauucugugaacaguugugaggcauuggugacuuuugagcagagaagugacaacugcucccaagguaugcuuuuauucauuccuucugggcuauugcgggggucaggagagagcagcuguugaggagggauggggcagugggcguugaaaaagccagacucuacuaugcugggguauuaaagaugcaacaguuucugcaucuuugccuagcaccucccauacaugugaaaucccacaguuuaauggaaaggauauaaaccaucugcagaaacauauuuguuuaaaaaggagacaccagcaugaagacuuagcaacuuugaaccaguugaaagaagagcagcugccugauauuuucauaguggaucuauugauuguucaucuuccauucuucuugugauuuuuauuacuagcauauuucuauugauugugccagaaagauccuugagagaaagaagaauuuguaaauuguuacuuuagagagauuaaaaucuauguaagaguuaaaguuucuguagguuugguccauuggcaugcacaguuaaagugcauaagauuuuggaagucauuuuauaucaugagggccgauggaggucaggaauuuuccaucccuguucaccuuuucauggaaugcuuacacuuaaucagcaccuacugugugccagacaccaugccaaugcuuucacauauccuuacagcaauuuuguuuuauaggugaggaaacuagggcccagggaaguuauauaacuuaccccaaaucaaaauugguaugcaguagagccaaaguugauggcuguguuuacugguuccaagucuagaacuuuuaccaccacaccacccaccucucucacugaucuauaucauacuccuagaguguguguacacagggugcaucacuagaaagggaugagagucucugacuugcucaugaccacccauugucguuuaaacaaagcacagggccaugcagaaaugggguucaagccucaaauuuugaugagggaaaggaacauguugggaggacuggguacugacacaacgcugccagcccaagaagguugcccugaucagcuauaagacagcaugaagucaacaaaucucuucugaggauauggaaggacuauaaugaaaaugacaucaagaggggaacaaaaacacacuaguccugauucucaauuuuugucccagauagaagcauaacaaugcuucuugguggguacagauccauaucacuucugugcauccaucucuccucucucuuaaaagaccaaugggcugguggcagaguuaaagacugguaaauaggcccagaccaaacuaacaguggcguaucacucuaguuugugccugaaucccagacuugauccuaggaccccuuucaguucccuaacuccucugcuugguuaugauuucauaauuuggaguuggccuaagcucuccagcacacucuuuccaaaauacuucuaggcgaaggcugggagugggaaauacagccuuaugaaauaguuggcuagggccccaccccuucucacaacuggaaaugggaaauagggcuuagcuugguuaaauaaaacauucauuaauaccugggacugggguccugguuauggaggauuaaaauuugggaaaaccuuuucagaaaaugaagagccaaguagucugaaaaagcaaguauuggaauuuuguuaucucagaaaugcuccaugugcuggcuuguuuuucaucaguaauaaagcuaugaggagcaacaaguugauuuauaucugaaaaucuaggaucuggcauugcaaaauaguugcuggaacuuaaugcaagaaaauaguuaauaucuuuagauuuagcuauuaucuauaaucuuuuauuuucucuuuugagcaaaauguauaaaucugauuguuucuaauguuuuuaucacuaaguacaaguauguauauuaaaagcucaguauaacuaucuugacacaagucaguugaacugccuuucuaaaauagaaaguugaauucaacaaaacagcucuaaggccuagucccagcuacucaggaagaucgccugagcccagggguuugaggugucagugagccaugaucaacgccacuacacuccagccuggguggcagagagagaucccuucucuaaaacaaacaaaauccagcucuuuuguauucaauucauagcauuggauagucagcuugccuuuuuuuuccccucaaguguuuugguaucauguagcccagcuucauuuauugguuccuuaaaagaauuauuuuaaauaccuccaaacccagccuugcagaauacuccccuaccccucuucagggacaacaacauaguuuaguuguccuuuuuaucucucccuguuccugaccauuucccucucuuugauccacaaacugggacauuuauaauaucuaauauaauuucuucuaccauccugugaaggcagugauauugucccuauuuugcagauuagcaacaaaaggcucagauuugaaggacuguggucacauggcuaguaguugaccggagcuacucaaucucucaugcggucccuccagauccuaacacucccauaaugguucuaugguggugaucccccuuucuaaugacuccuguggaaacagacuaguaucuacucagaauggaccugcccauagcaaauuucaucuaaguccuacuuuacuauauuaacuacaucgcagauggagacugaggugcagacauuaagucauuuauucuuuuuuuuuucuuuugacaccgauucucacucuuucgcccaggcugaagugcaguagcacgaucucagcucacugcaaccuccaucuccuggggucaagcaauucucguaccucagccacccgaguagcugggauuacaggcgcccaccacugugccuggcuaauuuuuguacuuuugguagagacagggucucacuauguuggucaggcuggucucaaacuccugagcucaagcaauccaccugucucagccucccaaagugcugggauuacaguugugugccacugugcccagccaggucauuuauucuuaaucuugggaaaaaucagcaggaaaaucaggaugagaaccugauaccucuaaggggaacuggaccaggcugccuccuuacuuuaaugcugcuuggaaaacugcucgugacuccuucgccuuuuugauuucacauaaauauuccaagguacccaaacauuuuucaggcacuauuuucgcuuuuuaaaauucucucaaaguuaaaacagaaugccuguaugucugugcauguacauauuuuagaacugugugcuuuauguacuguggcuugaaagccuucuauguuauuuugauuuuauaaauguuuucauaaucacccaaauggugcaguucaugcuuuugucaucgaauauaaacuaaauuuccuaauggaaaaugcauucauucuggaacaaugccagaaauuguccaaagaagauacuugaaguuugugucauaaaauaucuguguggguaaauuaucagguguucaacuaaaacuacagaacugauuuuuuaauuccuauugacaucauugcaagugcuccaaauucuaucacuugugcacuucacaugccuucuucauaauuaacauaaagaaauuaaugucuuacaagcuucaauauuugaugccauaugaauccugaggauauuuaaaaggagaagaaauguaaauaggaugaaauucuuaagcaagauuacugauaugacaggacuaaagagcuucagagugugugaaaagugccucuuuucuucccuuuaauaaguccauuacuugcacuugggcauauuuuaagguccuuuucaugcugaaucuggaguugggcaugcuuugcauuucaagcuuugucuaugaaucaguaaaagccaaaguuauuucugcuuuaaaauaacaggagccaggaacagcuaaucucuuuucauucugaguuccuuacauuauuuuaguggacaaaguuuguguuggcuacaaaacaggccauucacaacaucuaugagaaggaauuuagguaagaaugaagagagauuguaggauguauaaagacucccucuccugaggccauuaagaaauuccaaauuggcacuguuuugaauagugacauugcauuagccuugcuaauuucaguaauucaagcugauagcuucuguuuaccaaucuuuuggauaaaaccuucccaucacuacaguaccaaugugcuucucagcuaaggugaguugguauuuuaaaauaagugauggagggggaagguagugaagcaaguuggagguugaugaugggcagcaugguagcaccucuuucucugucagaaacgcuuugaaaagagguauaugucuuuacuuccucaguaagacaggccuuuugcuuuucuuucuuuaagcaggaaugagagagaauaugagacagaggauaugucacucccuuaccucauugcaucugaccucuuugaugaucucugucuggcuuuuaauuguguucauuucaauaauugggacaggcaaagaaacccauccaagauuuuuuaauuuuuauuuuuaauugguaaauaauaauugcauguauuuguggaguacaaugugauguuucaauauaugaagaaauagggacuuuuuuuuuuuuugagacagagucucacugugucgcccaguuuggagugcaguggcaugaucucagcucacugcaaucuccaccuccccaguucaagcaauucuccugccucagccucccaaguagaugggacuacaggcaugggccaucacgcccagcuaauuuuuguauuuuuaguacagacgggguuuugccauguugaccaaguuugucucgaucuccugaccucaggugauccacccaccucggccucccaaaguguugggauuacaggcgugagccaccaugcccggccaaaauaggcacuuuuuaauaguaggaauacauuugcucuucaguucguaaaaugugcaaauaaacuuacaaacaguuaauggcaaaaacuccagggggaaagggaacuccuuuuuuuaaagacauuguccuaagucucucuugaauaacuggcaucucacaucaugcuggaaaaauguacacagggaaaucuucagagccucacaagcugagaaaguagaaagauugccgaguguuugaaaggguuuaggguuucauuugaagagcagcuacaccccaccgugccuaugcucugauacacagaauaugggugaggcgguccauuggaaaucacccugagugaauucacagugaaccuugggugacaggacacugacggcaauccacaccuuccgaacauccggcccuggguuauugaccugggauuccuguccgucagugacuaagaccaaagcacagauucuucccugaauacuuuggcucaucaaacaauaaagauuagagagagaaaaagagagaugagagagagaaagagacaggagcagagacauagagagacagagagaaaggaaggacaucaaagggugggcggguagaugaugugaaaugcaugagagauuuucuuagguuccagagcaguguuucuccagaaauguuaauggcuuucucaaauaaaaaauaacaucuuacgcuugaggagcacguuaaaguuuacaaguauuauuuacauaucuuaucucauuugagaagugaguacaaguauuuaguauuauacaaguuugauacuaaauaaucaagucuucucugcuuauagacacagcaggaaaggucuguggaucagucuuucccagguuucucuucucagaacacuccacaggcucugccccugcucagaauccccauggcacucuguucaugccucucuuguggcacucaucacauucuaccuuggccuacgggggguuuugguacuugccccaucuuccccacaagauagagaguuccuugagauuuccugaguuuuccucaacuccguacccacuauggcaccuggcacagugucuagcaaacaacagguacccaauuuauguucaucgcugcccuccuaacaccuaugccaugugucaaucuccugcuagauggagagccccuugagggcaggcuccauggguucuccuguccccaaugccuggcccgcugguuccucagacauccauaaauguucucagcacucaagaaauguuacauaaauuggcuggacaugguggcucacgccugugaggcggagguugcagugagcugagaucauacuacugcacuccagccuggaugacagagcgagauuuugucucaaaagaaaaaaaaagaaagaaagaaagaaagaaauguuacauaaauuaaugaauuaauuacauuauacuaaacauacucaauauaaacccuuccuuucaccuguggcugccacacccaccacucguccacuuuaagggcuuauucaugaggacacauuuauuuuuauuuauuuauuuauuuauuuauuuauuuauuuauuuacuuacuuauuuuugagacagagucuugcucuguugcccaggcuggagugcaguggugugaucuuuggcucacugcaaccuccaccucccggauucaagcgauucuccugccucagccuccugaguagcugggauugcaggcccugcuaccaugccgggcuaauuuuuguauuuuuaguagagacaggguuucaccaucuuggccaggcuggucuugaacuccugaccucgugauccauccaccuaggccucccaaagugcugggauuacaggcgugagccaccgcaccuggccgaugacacauuuaaaccaaacuguuuucaucaggccucagguaauggcgacaaagaucagcauccagaauuugauacguuuucaacccuaucuuuccccaaaaagauacuccaaaaagcaaaucguaaggguuagaagagauuuuagagaaagaagcuauagagaaaggaaaagaaaaaguagugagauaaagaagguaggugagagagccuggaaggcgaaggaugcugucugagucuguucucagggcccugcacccucuaaaugcugccuggccaaagcaugagaaaaaugagacaaagaaaaaaaaaaaaagcccaaauugaaaagggagccuccuaaacuuggucuuaggcuucauacugaggaaaaaaagaaagauuugcagguuacuuaccuuguuguuagucaaaagggggcuucacauuucuccccugggugaccuaagcuauaaucugucuccauagcccucuguaaauauuucuuccauuugugaggaaauuauagugacuucagaggcucaacuuacuuucucuaaucucuuggcaaagaaauuaaaaagacaaccagaaauugcuguccgaccggauuucugcauggcauagggagaaccacuugggagaaaucaaucgagaaaaaaaaaaucuuuauuuaaggggaaugcaucuuuaaucaugguaaucccuuuaguaaauugcauucucuggugacauugcauaccuaauuacaguuugcucauuuugauuuucucuuuauauuguugccugcuucuuaugcaguuguggaucugcaggcugagcaaugaauuuacugcuggcauuaaaaacucucggucaagugggucucagguccaaaaugucaccacuuugggaagugaauccaaggucaccagacaauuauauuuccuuuagcacuuccucaaaagauguauucuccacccucuuaaaucauuuggguuauuuucucaaagaaguauucucaacaucuuaaaacugugaaaauaaaaaugaaauauuguaaauggguucaaccaagcaccauagugguagcucacauacuaggauuugcuccauaauccaacugauauagccucgugucaugcugggguuuguuuuguuuuguguuguguuuguuuuuguuuuuguuuuuuaaugaaagcacucuauugccaagucauauucuguggugagucacugugacucccaggucaucuucuguagcaguugugcccagccagauucaucagauguugaaaaugcuguuuguuucaaauaaauauuuuuuauuuauuuauuuauuuuuauuuuuuauguuuuugagacggagucuugcucugucacccaggcuggagugcaguggcgugaucucggcucacugcaagcuccaccucccagguucacgccauucuccugccucagccuccccaguagcugggacuacaggcgcccgccaccaugcccggcuaauuuuuuuguauuuuuaguagagacgggguuucacuguguuagccaggauggucucgaucuccugaccucaugauccgccugccucggccucccaaagugcugggauuacaggcaugagccaccaugcccggccccuuaaaugaauacuuuuuaauagcaguugcauuagggugauagcauuauaagaugauauuucaaaaaaaaaucuuuauuuuuuuuuuaaauuauacuuuaaguucuaggguacauguguacaacgugcagguuuguuacauauguauacaugagccauguuggugugcugcacccauuaacucgucauuuacauuagguauaucuccuaauguuaucccuccccccuccccccacccccccaaaaacuuuaaugucauauuucccugauaaccuccucuacauaaucuuuuugacaucauuuuuaagaaaaaaaaacauuacucucccuucucucaaaauauuuuucuccaaccaaucuguaccaccuucugucuuguaacuugucccccauacagccuccauuccuacaugccaggaccuuggcauguaggaaucaccauguacccaaaggugguauguucuaggauauucacuacagcauuguuuauacagggagaaaugagaaacaaccuaaaugcccaucagugggaaaaugguuaauuguguuauauuaauacuaugaaauuccuugcaguaaugagaaagaaagagguaguuccacauguaugaacaggcagagauuucuaagacauuacauuacagucugagccuauguaugcauauucauggaaaauccaguaauuacucuuggauagugcuaggagggggaggugaaagggggcucucuuuuguuacucuauauacuuaggcauuguuugaaucuuuagcuucaagaauguauucacauguugaguaguuuuaaaauuaacaaaauaaaagaacucuaucaagaguucagggaggaugauuugagaggggacaaaacaggggagcugucacaauaguccaggugagaaauuauaagaacauaaucuaagccguagcaaacaaugguaauugaaagaagaguucacaaaauaucaaggaaacagaauuuacaggaugggguaauuaauuacagcuggaggaugaaaaaggaggaggaaucuggggguggcuggcagguuucuggauugggcaacaguagaagcauuuacugaaaaaggggaaccugggaggaggggcaguuaagggaauagaaauagaaaugcugcauugcugcauucaucauuucaguggcuuuuuuuuuuuauuuuuuuuuuugagauggagucucgccuugucacccaggcuggagugcaguggcacaaucucggcucacugcagucucugccucucagguucaagcgauucuccugccucagccucccaaguagcuaggacuacaggugcaugccaccacaccuggcuaauuuuuguauuuuuauuagagacaggguuucaccauguuggccuggcuggucuugaacuucuggccucaagggauccacccaccuuggccucccaaagugcugggauuacaggcuugagccaccacacccagccuucaguggcauguugagucugaaaugccugagagacauccaaguagaaauggccagugggcaguuagaucuucagaaagaugucugagcuagagauagauuugagaauccucagcgauaaacagaaucagggacauggaugagagcauuuaggaagauuuguaagaugagaagaguggaaggccaaggaagagaugagagaauauccaucuuuaagaaaugagcagaggcaaaagagccugcaaaggaaucugagaaugaucagagaaguaggaggagcauccagaaggaagugguguaagggggaaccaaguuucaagacagagaguggccagccuggccagguggcaugcgcccauaguuccagcuacuuggaagcugaggugggaggauugcuugagcacagguguucaaggcugcagugagcuauguuugcaucacugcacuccaccugggugauagaguaagacucuuucucaaaaaaagaaagaaaaaauaccuggguguaguggcaugucccuguagauacagcuacuccagaggcugaggcaggaggaucauaugagcccaggaggucaaggcuguguuagaaacaaaaugcuuguuccucagugccacaaagaaauagcacucaaacauaaauuuaauuuucucagcaaggcaauuuuuacuucuauagaagggugcaacucaugaauggaguaauggcaagagcacaccugaacaagggaagggaagggguucuuauuccugacgcugguagccccuacugcugugucguuccccuacuggcuaggguuggaccacacagucuaagcuaauuccaauuggcuauuuuaaagagagcagggguaugagccagagcagcagggugaguaguuugguggggaggacgguuagaaacagguaacuaaaggugacuuaggucaaagcaggugaccaggggugacucaggucaaagcaggugaccagggugagucaggauggagcaggugaccaggggaacagaugugaacuacugauuaaaacugguggaaaagguuguuuacugaaacuacaaggaaguuaaacuuuaaaaugcaggacaaagaacugaacauacugacauacuaauucuuugacgagaaaucuagaacucacuguaucuaacagcugcaaugagccaugauugcaucacugcacuccagccugggcaacagagugagaccccaucucuaaaaaaaaaaaaaaaaaauugccagauacaguggcucacaccuguaauccuagcacuuugggaggccaaggugaguggaucccgaggucaagagauugagaccauccuggccaacauggugaaaccccgucucuacuaaaaauacaaaaauuagcugggcaugguggugcgcaccuguagucccagcuacucagggggcugaggcaggagaaucacuuaaaccugggagguggagguugcagugagccgagauugugccacugcacuccagccuggcgacacaguaagacuccaucucaaaaaaaaaaaagagagagagagagagagaaagaggauagucuguaguauugaaugcuguagagagcucaggauggaaacccugaaaagaauccauugaggaauuaacuguaaacuagcaugagggaucuuauugggcuaaugaaaaugaucuaaaauuggauuauagugauaguugcacaccucaguaaauuuaaaaauuauugaauucugugcuugaaauguacuugaaaugggugaauuuuaugaauuuuguuuuaaauuaugccuuaauaaaguugucaaaaauauaaauggaaaaaaagaauccauugaaauuuaguuuagggcaaaauauuauuccaaggggcacuucuagucugaucucuuccuaaaugguuugggaaaagcccugugaaauaaaaugacagggagucuaugagauuacugaugcuacaccucaacacuccuauauugcaauaucaauauuuagcuuauugucugauuugcuuuucaccaagcugauacuaucaaccuauguccuguccuccucuggauaauugcagauuaguuguuuuacuuauuuuuaucauuucguauuuuuagcacauauuucuagaaaaaaaguaggaugccaggcuauaaagccucaauuuauaccuguuuuaguuguuguuguugauugcauuuuaauguguuuaaacauggauuccuuauuggcccuacagaaagugagauuucauacugaaaucucaucauucauuuucugacacuucuaugaugccuguccuucucagccauuuuccuucuuaauucgacuuggccaaucacacgauguauuugucuugguuaaugggcacaugugauguauucuauaguuagguaaaaacaaaauggaaaacuucugccccuucuuaguuguaaggaaccagggcugucaauggcccuacuuaauuaaaguguucguuucuugccaauugcaucuucuuuuuauuuugguucaauaucuuccugcugcuuauuauaguccugcuuagugaucuggcugccacucuuuguaguagaauuuuccuuuuucccuuucacaucuuuauagccgugaguuugagccacuuagcaucuuuuuacuuuuccuggccuccuuuugcacuugcuugcuuuguucuaaugcccacagagcuauuuguaugaggaucauccagcuuuuucuccucaguugccuuccuguugguuccuuccaacuuauguccuaaucauguucccaaauugaauuuucuucaccugaugccucuucuuuucuuccucuggauccugagugaugccauugugugauugcauugagcaaaauaucuacuaacugcgaauuaguuuccuauugggagggagaaaaauucaauguaaacaauugcugaguugguugcuccaucuucuccauaggcaguauccucauaugaccaucuuuaccguauaggcgcauuucguauugcuugauauguauucacacuaucccugagauuaaccucuaguuuaauaagcuggauagauuaugugguuuuuucuccccacuccaggcagguccgugguuauuucccuacaauuaugucuuggucaauaacuccuugacugauuuaaagcccuccucccuaagugagucauggucuccaaaagacgcuggucccuuucuuugaaaaggaugcaaagcagucucuuuagauuucucuccagugucugugucaaagcaaaggucacuuuaacccuuaugcuuucacccuucuucccugccaugagaccucucaagaccugaaugaaaucuuagacucuuagggcuagcaagggucaucagaagcuauuuaccuucacccccucauuccauguuugcaucccuucaccgacaucucuaccuaauggcuguccaaacucucauagacugccucccagagauagaucucacugccuagggccagccuaugcaauuuccagauugcacuuauuauuagaaaguucuuuaucuuucaaguccaguuuucagauuguguuauuagaaaguucuuaauuucuuuuaaauccaaaucauuuuccccuuaggggaaagacaaagccaugaaucagcauuaacuaaaauggcauggcuauggggcaagaagaaucuaagaugaagaaagagagaagaggaaugacaaagagggugcaggcaggugcuggggucaggaaacaggcaggcauuaucagauaaauaggucuguggagcuagaggggcacaggagggaaacugaggugacaggcagaagugcugagaggagaacaguaagggaauggaaacugguggaaaauuaaagaaggagauacuggaaucucuucuaaaaggaauggaacccagacuagagguuuaaaucaaaguggggaggaacagaaaaucauuuuuaagauucaaaaccuaucagaggauuccaacguugcccuuugccuacagcuguggaaaagagcauuauggagacaggagaaaauguuuacuagaacaaggacuagacagaagagaagggaauaauuggacacaggaaauuaguuuaaagagcaauggaaagagaaaaagaagugaauagagaaauggaaaggagggggaaugaaaacacagaacuuuuagguuaaagaauuacauuuauuccugugccagcacauaauuguauuuuccuggcaagcauccugcagcccucugcaagggaaaaggggugccggcaugugugacugcagggauugaagucuuacugcuuuguacuauuacagccaagcgagggacuucauuaacgagccuguguuuugaugucacagagacaggcacugaaacuucaaucaccagcagucccugcacuugagaaucaguggugauggaaagggcaggguguggccaagggcgaaggguggggugggggggggcagauugugaggcugggacaggggucaaagguaugggaacacaaucaugaagguuccaaguaagaaaugaauagaaccuacucaucaaaaacccuguuuccugcccagcauggcacacagauugccagcaugugucagcugcucacauagcaaagcaucaaguuccaggcagcaaaagggaauaagaacauaaucuuuguggauuccauccacacugagugugguaaacugaugcuguggguaaugaggacugaguauugcucagaaguaccuuggaaucuagaggucagggcuugagcccugccauuugcuuccugagccacccaccauuggcccugccuuuuucuugacuucauggaucagugguggcuccuucuccuaaggaaaucaucaguuaguagagaucaacuccuugggaagggugucuuguaaggaggcagcccuucaccugcacauucucaguaggguggagauguguguucauucaugcagccauuguuuccugcauucacucagucauucaacugaaugacugauguuuuuagguguuuguguuagccaagcacugugugggagugacagaggggaauaaggugaauuucuuucuucaaugaagcacagucuaguugaggagaggaacauagaaaugacuaacucuacugugaggcagauggaaauuaguacuguaauagagguucaauucaauuaauacucagagagagaagugauuuauuuggcuugaagugagaagggaaggcuuccuggaagaggcuaucauguaaguugaggcuugaaagauacaauuguggggccggucacaguggcucacuccuguaaucccagcacuuuaggaggccgagacaggcagaucaccugaggucaagaguucgagaccagccuggccaacauggugaaaccccaucucuacucaaaauacaaaauuagccuggcaugguggugcaugccuguaaucccagcuacuugggaggcugaggcaggagaaucucuugaacccgggaggcagagguugcaaugagccgagaucacaccauugcacuccagccugggcaacaagagugaaacucugucuaaaaaaaaacaaaacaaacaaacagaaagauacaauuguggauagaaaagagaggguaggugggagacagaaagacagaggggggaggaaggagagaaagagaaagagaaagggagagagagagaaaaggauagaaagagagaaggagggagggaagacaggaagagagagagggagggaaggagaaaaagaaggacagggagggagggagagagagggagggaaggagaaaaagaaggacagggagggagggagagagagggaggaagguaaagagagagagagggaggaugguaaagagagagagagggaaggagagacaggagaggggggaaggauggagggagagaaagaagagagggagaaggggagaagaagagagagagagauaaagaggggggagggagggagagagagagagaggccauuccaggcuaagggaauagcaugaagaaagacaugggaacuccagagugcuuggcauuuucagcaaauggugaaugggaugguaugacugcagcauauggcacuuggagaaauauaugggcaguugaaacuggaaagcaagaaaagaugagcuggggaggcucaugaaugccaugcucaggaauuaggacucuaucccacaugcaguagggagccaucaaaggauuuugaggaagagagaaauguguuccaacauauguuucaggaaaagaguuuucucugguuccagcuaucacagaauggaacauucuuucuuccuggauggcaaugggccccuggagaggaauggcucuuauguggcuaaggcauugaggacuguggguggcggugguggggaagcugaaggaaagaggagaaauggacagcaucaaaagagauggcaccugugugaaugugagaaugggcacucgcugacaugcagguccaaaggugggaagagaggaggauggagccaggaugacagugugugcuuccgaguaaauugagggaaaaugagucucaauucuccaaaucccauugaugaugaguguauuaguccauuuuuaugcugcugauaaagacaugccugagccugggcaauuuacaaaaagaaaagagacuuaauggacuuacaguuccacaugacuggggaggccucacaauaaugauggaaggcaaggaggagcaagucacaucuuauguggauggcggcaggcaaaaagagagcuugugcagggagacucccauuuuuaaaaccaucagaucucaugagacuuauucauuaucacaagaagagcacaggaaagaccugcccccgugauucaauuaccucccaccggguccuucccacaacccuugggaauucaagaugagauuuggguagggacacagccaaacuauaucaaugagggagagauuucauacucagaaaguauuuaaagaacaaauccaaauggaauaacuuagggaggcuauucaucuuucauguauaaggauaccugccugcuguugauuacuggauaggguguuuucagggccuugagccauuuugaccccuuggcuauuguaugaguaccuuucuuggcuguugggcauugccaggacauugcaugcauuuuaguucucagguccauuuauuuauugauuuauuuauuuauuuuguaagauccauuguggcugauuaaaaauguaagguuaccugauuugggguuuucccauccaaguauaucuaaaacccugauacacugaugaagcccugauauacuugggcuccaagggacugcaaggccacucccucacucccauaaccccucaccagcaauuggauuuggcuacaauaagugacauuuuguguuuuucuucuaugugcucaaagcccaaugaugcauaccucuguagcugcaucaugccugaaauguauauugcaaacagagcucugugaaucuaaaugauuaaauaacuuuugaaaauguuauaaggacagaguguaugcuuucauuuacuuuuuuuuuaacaguuucagcguagcagccuuuguaugaguuacaaaagcaaauguaaguuuccugagaauguauaaaagugucucuuaaaaaaaugcagccucaugccugggagugguggcucacaccuguaaucgcagcacuuugggaggcugaggcaagcauauggcuugagcucaggaguucaagaccagcccggacaacauggugaaaccaugucuguacuaaaaauacaaaaauuagccugguguggugaugugcaucuuaguccuauaggcugaggaaggaggauggcuugagccugggagacagagguugcagugagcuacgaucacaccacugcauuccagccugggcaacagagccagacccugucucaaaauaaugaugaugaugaugauaauaauaauaauaauaaugcagccucagauuaaaauucuuggugaaaauuacccucuuccccauucccaguugaagagcuaucuauaucugcuauuccaggguagcacucaaauauccauucaucuucauucuuuugcacaacuuaacuugacuuucaaagcacagacgaguaccauuuggcauggaugcuuugguaucagguauauucacacacagaccccucuacaagguaagauaccagaguaguggugcacuccccuuaggaacuagggagcauccccagaugcuguuaucucuugguuucuaguguaaguuuuuuuuucuuuaaauuauggcaaaauauauagaauguaaacuuugcuauuuuaaccaauuuuuauuuuuuauugagguaaaauauacauauauacuuugcuaucuuuauuaauuuugagugugcaguucagugguaauaaauacauuuguauucuuuuuuucuccuucaucccuccugcuucuccccuucccagccucugguaaccaccaaucuaccuucaugagaucuauuuuuuagcucccacauaugagugagaacaugcaauuuuugucuuucugugccuggcuuauuucacucaacauaauggccuccaauuccauccacguuguugcaaaugauaggaucucauucuuuuuuauagcugaauaguacuccacuguguauacauaccacauuuucuuuauccauucaucuauugaugcacacuuagguuaauuccaaagcugggcuauugugaauaguacuacaacaaaccuggaaguacagauaucucuucgauauacugauucccuuucuuuugaguauauaccuagcaguaggauugcuggaucauaugguuguuuuauuuuuuguuuuuugaggaaccuccaaacuguucuccauagugguuguuuacaucucuaccaacaguguacaaggguuccccuuucuucacauuugaaccauuuuaaaguauacaauucagugguguuaauuucauuuacaauguugugcaaccaucaccacuauuuccaaaauauuucaucaucccaaaaagaaacucuguaacuuuuaagcuguaacucacccuuccccuacccccagccacuggcaaucacuaaucuacuuucucucucucucuauuuguuuaugcuggacauuucauauaaauggaauuauauacuauauggcauuuugugacuggcuucuuucacuuacuauaaugguuuuuuuuuaaguuuuuuuuuuuuaaucuuggcuauuccacauccuucuuaauguguauauuaaguuguucuuuagcuagguagaagagguguauacauaucauuauggaaaauaauucuuuuggcugaccuggaaugacacaaaagaaagugaggaacauuuaaguaauaauaaccuuaaugucucagaacuuguaagggcugaaaauuggacaagcugaagaauuccagcauaaguuucuguguuauucuagaaugcaggcuaauuucaauauguguguggugcaacuaaaaacuaacagcaagaggagauaaguuagagaaaugacuaccuuguggagaauuuagggccaccaacauauuagaaguaguuaaaguccuaucaguguuugucaaccuuuagaaauugacauccccguuuguuugcuuguuuguuuauuuaugagacagagucucgcucaagguucauucauguggugccauuuaucaguacaucauuccuuuuuuuuuuuggcuaauaguccauugaauggacguaccacauuuugugucuccauucaucuguugauggacacuuagguucuuuccaccuuucagcuauuaggaauacaaugcaaugaacauuggcauacaaguaucuguuugaguaucugguuacagguuguuuaugcaucaaugacagcaagaauauaguauuuuaaaaggccauuuugcuuuggaauucuagaggcaccgucuaacaaaacuugguuguacagacuggugagguguuguggcacuaacagcacugccaugcaccccaggcacagucaggguggcaaaugccucauuucacucacucucagacuucucagagaauccacauuagcucccccucucuccuuaacucacuaaucacugucuuuuuuuaacagaugggucuugcuguguugcccagacuggaauacaguggcuauucauagguguaaucauagugcacuacagucuugaacuccuggccucccaccucagcaacccaaguagcugggacuacaggcaggcaccauggccacaucugguuucuuacccaacaauccuacugaaacaucuuccaaaaaucacccauaaccuucuauuuaacaucuacaguggcuucuuuucagucuuuacuuuucuugaccccuacacaacauuugaccguguuaacccaccccucuuuaaaguguuucccaucccuugucuucucuagaucaguuaucuugaucuucuucccuggcccuugcuguacagugucucuguccucagcuccucuucuucuacugacuguuaggcccaucauuucccaugggaaugagauaaccuuuccugugggaaguaaaggcucugaugagcuucgaucucuguggagcuguuaggcagccucaggcaagaaggaccuguagacaucagaggaguggucaugacacugcuggggaagguggugagaaugcuggggcugguggaggagagccaccacccacauuacccacacauacugucagugcuuccaggaugggguuguucuguuccugggaauaugguuugacucaugaugugccuaaauaacuaugguaggccgggcacaguggcucacgccuguaauccuagcacuuuggaggcugaggaaggaggauaauuugaggccaggaguuuaagaccagccugggcaacagagcaagacccugucucuacaaaaaauaaaaauaaaaaaauuagccagacgugguggcacacaccuguggucccagcuacuugggaggcugagguggcaggauugcuugaguccagguauucaaggcugcugugagccaugacuaugccacugcacugggaaacagagugagaccccaucucuauaaauaguaaguauguaaguaagugguggcccauaugacuuuuuuauuucuuucuuaauggcuacacauaauagugaagcauagcuggugguugaaaaccccuggaaacauuuguguuagaaaaaggaagcagucugagcccuaguuaaggacaaucacugugauguuucccucguaacaaggaaguugccauagaaaagacuacauuaagucacucaucaggaauuugugagucagaagguccagcgugguaguugacaaagcccaggugacccaaguugccuaacagugcugggauuguuuuuuguuuguuuguuuguaacagggucuuacucuaucacccaggguguagugcaguggcacaaucacagcucacugcagccucaaccuccugaacucaagcaaucaucccacgucagccucccaaguagcuggaacuacaagcacacgccaccaugcccagcuaacuuuucuguuuuuuguagaaacaagguuucaccauguugccaaggcugguuucaaacuccugggcugaagugacccaucccccuuggccuaccagaauccugggauuacaagguguaagccaccguacccaaccucuaacaguguuuuuaagauuuuucuaccuaaauccccccacuacgucagagaagggugagugaaucccuacuccugaggauuugagacauaaccugcuaaacaggaaaugucugaugacuucagugagcuugcaacuaauacauuucugcuccaucauuagccuugcauauuuuaguauaaaaaagugugcuuucccccaauucccuaggaagaagcaugugauggcuucauguaccuacaacccacugcaguguaaucugaagauacacauacuccagauugagaaacagaggccuacaauaagagaggccaugccucagcuaaugggaaaaauucauuauauucuuucaacauccuauuguuguaacuaaagauguuugcaagcuggaaugagccauaagaaaugaagaggacaucucauugcccaaacccucuucuaggagaggccauuggauuauucccagguguuacugucauuuagugggcaaaauuagcaauucauuuguuugucagaaaggcagauugugggccaggugugguggcucacaccuguaauccacgcacuuugggaggccaaggcgggcagaucgcuugagcucaggaguucgagaccagccuggacagcauggugaaacccugucucuaugaaauauacaaaaauaauccaggaguggugguauguauuuguaaucccagcuacucaggaggcugaggcacaagaaucacuugaacucuggagguggagguugcagugagccaagaucacgccacugcacuccagccugggugacacggcgagacugucuaaaaaaaaaggcagauuguuaaaugagcccauucccaaaagaagucccauuagaccaguuaaaaaccagaggucucaaguauuucuuguccuccucaucugaucuaugaagaagaaaaucuagacucccagagacccaagggucauuugaaaagucauuuucuucugcuuuaaagucuagucauuucacaucuaaaaguugacaaaagaggagguauugagguggcaggaaagaggguugugcugaagggagaacaaggaaaccagggucuguuuuggauucaagagcgaauggcagagcccaguggcuccugugggaacagccagcagagugagcaguauugcaaugaaugugauuucuccagagauuucccccagcuucagccucuggggguugccaagcaauguccugagguuucacguaugcaugucuuggaggccaacuguacacagcaaaugcaaaacacagagauagcaguauugcucuguugcuauauuagggccagauugaagccaucugcugaugcaagcuuggcaaguaagaaacccccaugcuuggcucagcaguagcguuuucucuccuggcauuuugauagcagcacuucuuucagucugcccugugaagucuuccuguugguaugggugaagcccucauagcaaugcaucauccuccuugaagcccacacccucagagggugagcauuugcuuccuauuaugugcucaagacuccauuagcuuuguaagggcccaaaggcuugucuuccuggcucccagaucccccugugcaugccuauccaugccugcuugaugcaccccagguccagcaacuucucccccaaagcucuguguguacugccuccaauggaaguuguuaugccagaguuuaaaagcaaaacagaaacaauccagcauggauguguuuauagccaggaucucucauccaagauuaaaaaacagcucaagaaaaaaagagaauucagaauuugguagcugaugaauaucaccagagaaacaucccaagggaagcaacugauugaccugacuugcuuauggaggcccugucagggacagccaccuuggcugcuguaaguggaagacugauuacagccugcagcaggcuaugucccucagugggcugcaagagccuuggaaucagagagaaauaaaacuagaaggaaacuuagaggucauccaguucaacacuuugauuuaccagauggggcaacugaggcccagaaaagaaggaaaugacuugucuaaggugagauaauaagucaguagcuaaacuaggcuuggaacccagggcuccagacugccaggaugcacaggaucacuugaggccaggaauuuaagaccagccuccuagggacucugcuaggagacgcugaauaaccaaagauggagggcucucuauuuauugcuuuucucaauacagaaaaacuuuucaacacacaaaaaaaugcagaccuuaaugacugacaauuauuuuaaaaaagaauuaucuagucuacaacacaaaggacaugaaggcgaaaugagagucaggggcugaauguguaauuaguacagauguugagucuacccuuugggcauaguuaaacugauuacaaauagaaacagauuuuuggauuuagcaugaaaaucuccuugcuggcccaaaagguucucacugaugaucaagauagaaacaauuuaugugcauuuuauaauauguaccuaauacagcaaaaauacauucuggaaaaucacugauaaacauaaagauaugaaugauugaaaagagaaugguuuguggugauucucauaauacaucugguuuguagcaaacugagaaguuucugguuugauguagauuuagccacuuuguaggguuuuuuuuuuguuuuuguuuuuuuaacuuugcuacuggcugauuccccagauacuauucccacaggcuucuuguuuauuucaacacaagaugucugacaagucucucccucuuagagcugucuuccacaguguuaacaaucaucuuucuaaaaaacacaaaucagauuguguuguuuguuuacuucaaaaccuucaguggcucccuguugcucacagaauaguuuuacuuuccuaauccaccaugauuuggcucuuacuugucccuccgccuuaccuuucaucucccaccaccucuucccccacagugcgcgcacacacacacacacacacacacacacacacacacacacaccacaacaauguccauucuguggcuccuccuaccauggaggcuacuugcugcuucugaauaugccucauagacauucucugagcuuggugauuuuggucaggcuguacccucugccuggaauaaccauucauucagccccugccauaauucuguccauccuucaugguguagauuaugucccaauuauucuuaauuuuauuauuuuuuauuuuuauuucaauaguuuuuggguacagauguuauuuaguuacauggaugaguucuuuaguggugaauuuucagauuuuagugcaccuaucguccaagcaguauacacuguacccaauauguagucuuuuaucccucaccucacucccacucuguccccugaguccccagugucuauuaugucauucuuaugccuuuguguccucauagcuuaguucccacuuauaagugaaaacauacgauauuugguuuuccauuccugaguuacuucccuuagaauaauggccuccggcuccauccaaguugcugcaaaagacauuauuucauucauuuuuauggcugaguaguguuacaugguguauguauaccacauuuucuuuauccacuuguugguugaugggcacuuaggcuggauccauauuuuugcaauugcaaauugagcugcuauaaccaugcguguucaugugucuuuuucauagaaugacuucuuuuccuuuggguagauacccaguagugggauaucccaauuguuuuaagaagucuucccagaucuuucuauuuggaauuuuuaucucuuucucuucuauccccgagguguuuugcuugugccuuuaacugagcccuuucuacuuucugccacguagcuaguugaauugucucuugaucaauuucccuugccagugagggggcucaugaaggcagacaguaagucuuucucuaacccucaacugugaugcuugagacaucauaggcuaguuuuguuuguugaauuaaauuggauuacauuuccccuguccagaaaugucuguauuuaucuuucaccaaaaauccuauuuccucugucuccauaaugcuucauuauugugcuaagcuauucccuuuaucucuaaucuucaugaugguggcccaagcguacaguggcuuugcugggauucccaccaauuauaagccacaggugccuggcuauggaauugguugauaaacuuuugcuacugcugaaugaagagccucaggaaaccugcagccauagcuuauggaacacagggagauagcguucugaauauuccugggggccuuuuggagguagaagacuuggccaccuuugugguugggguaucuaauggcuuuggccaucauuguugauuucuucagggaaauagaacugauaugauaauucccauuuccaacccagagcucuuuucaggauuucaaaaaguuuaacaaggcuacuuaaucaaguauguggucaauuuuaugugcaaacagugacuuugcucucaugcuguuuggaaguucucuuuggcacuguguauuucacuaauggaguuuguuuucaagaagaauccauuacuacuuaauuacuguaguuuauuugguauauagaauuuuucaagaggcaguguagcuucauuugagguuuagagucagaccuggacucaaauagcucuucuaccccauaccagcuguguaaauaugggcaaaauaauuaaccugagcuugagcuuccucuccaguaaaaugggaauuauaauaccuaccuuauaacaucguggagaugguuaaauucaaugaaauaauguacggaaauaguuuaacacagugccuggccuacagugaggacucaguaguugggggucauuacuauaauuaaaaaauacagggcccaagagauagaaauagcaaaagagggccaggcacaguggcucacacuuguaauuccagaauuuugggaggccgagguggucagaucgcuugagcucaggaguuugagaccagccugggcaacauggcaaaaccccgucucuagaaaaaaaaaaaaaaauacaaauaauagccaggcaggguggcacaugccugacuauuauuuguauuuuuuuuuucuggagacgggguuuugccauggccccagcuacuugggaggccaaugugggaggauugcuugagcccuggaaaucgaggcugcauugagccaugaucgcaccacuauacugcagccugggcgacacagaaagacccugucucaaaaaaacaaaacaaaacaaaaaacaaacaaaaucagaagaggucuuuacuggcaaaaaaaaaaaaaaauuagacacaacuggauuuaacaaaacuucuggguuugccguaacuacuacaguaaacaaaacuguugaaaguuagcagaugauuugaagaaagaaacaguguaggagcugaguagugacauuaauagauauuguuucaucuugauguugggcaaggggcacuauccagaaaaggaaucugaaagcaaugcugagagugcucgcauucaggucaacccuaaaaauacuccucuuuauuuaaguugagaaguugcugugagaaccaaggcugggcuuucaacagaucuagccauaugugcucuccacuuuggugaaacccgaucaugaccuaagccugugcuauccuugccgacugacagcugaccucggccuucucugugcacccugcauaguucaccuuucaaagaaagaggucuaauuuccaaguagagcauugcucuuuguucuuuuucucuuuuuauuuuguuuguagguauuuauuuuggaaggcagggaaucuagauuguagucugcucaauugcuucucccuggguaagagaguuuccuggaaaauuugauuugaauuauuacgaguacucaggaagaaaaacucucugcuuuuaaaugaguaaaauguaaccagauucauauaucuuaaaccuuaggacauuauuucuuucuacagccaugaaaauaguuauaguuaauaacaaaauggagaaaauauuuguauaaaauauaggcaaaaguucaacaaaauauauauuauuaaaaugaauaggaaaaauaucaauacccacuagauaaaaaggcaaaagguauaaacuacuacacauugagaaauauaauuaguaaacuaaaacauaggaaaaguuugucugcacuaguaaucaaaucccugcaaauuaaagaaacguugagaugucgccuuauauuagcaaaaaauaucuuuuuucaauggaggugccguaaaauuguuucucucaucauugcugguggcaauauagauugcaauagaccuuuuggaaauugguaucuuagucugugaaauuagacucccuggcuuugaucacuuugaccuugcugccugcccuaaccagugcuagccuuagcagagccuugguccugggcccugcucuguacuggaccagcugaguccccacgcuuucuuccugugacuuauugaguguuucauccccuguaagagaagcucuuccuuccucuuccuuccuucccucuguagaaucccagucauuuccucugugccuguugccgggcaucucagugucccaaaggaucuuucuagcucccuuggcuaccagacaguuggcuggugaaguugcucacaucauaucaccuucacaagauauugaaauagcaacauuggcaacggagucuagaagagccaagagaguagauuugaucucuaaaucuggaaaagcaaaucugaaagauaaugagcccuuggccagggucagccaucuugaauuuccugauaaaccacugucuuccuuagauuugccuucuggggccaccuuugcuuuaggacaagcuaaauaacacccugauuucuuuucagaaucaugaacauauaucauaaaugcuaggcagucaaagaaugaaaggcucuugcccauuagccucuccuuacacccauucacuugguaucaguuuaaaucuaugcuuugaucaauuuugcuuuuuugcgaggauucuuuuuagggggaaaugaaaagaccuuauagauaaaaggagaauuauuugggaaaauaaaacaacuuucaacagcaaacuaccuauccucaacccuaauuaaggaaaagcucccaggacaaggaaauguauauaaggugcagggccuaagaaacguacacugggaacccacagcacccccuccccaccagcacacauacacacaagaacacaaccacaugguauagucaccuauauggcaucuuacguuuugauacccauaagaucuggugaaaaugcccuucaagcaaaaccuugccugggaggagauguugcaaagggcuagcaugcacccuacaauguggaugcagccaaaggggaguggggugcagccuguucgcuccccacuccugcuugcugugaucucuggaaggagcacuucuggcuggcuccuuccacugccuccccucuccccacccccacccccacauauccuucuuuuucccaucucacaguggccuuuuucucccccauaaaaaagggaaucaaagcugaggcuuuccagugguccagacacaugcucgagcugugcauaguguuauacugaggcuauggguagacuugcauuucaaauccuucucuuuugauugacagaacuggccuaugaucuggauguggaugaugcgccuggaaacagucagcaggcaacuccgaaggacaacgagauaagcaccuuucacaaccucgggaacguucauuccccgcugaagcuucucaccagcauggccaucucgguggugugcuucuucuuccuggugcacugacugccuggugcccagcacaugugcugcccuacagcacccuguggucuuccucgauaaagggaaccacuuucuuauuuuuuucuauuuuuuuuuuuuuguuauccuguauaccuccuccagccaugaaguagaggacuaaccauguguuauguuuucgaaaaucaaaugguaucuuuuggaggaagauacauuuuagugguagcauauagauuguccuuuugcaaagaaagaaaaaaaaccaucaaguugugccaaauuauucuccuauguuuggcugcuagaacaugguuaccaugucuuucucucucacucccucccuuucuaucguucucucuuugcauggauuucuuugaaaaaaaauaaauugcucaaauaaaa

SEQ ID NO: 18982 - RNA, 63321 nt, Homo sapiens
ugaguugaaaauaugguuauuauuacuggggcauauaagagaaauguaaagcacagucccuuccccuguaaagcuuacaaguuauggagcacugcauguucacacagaaagaacaauuagaaaauaguauaaggcagaaccuaagcaacugcuaauuugggcacaaaaacaguaagaauuacgaaaaggaagagaucacuggaagcuacgugcuguggccaaagcaacuagcauaguguuggacuaucuaucuauuuagcuauccauucauccaucaucaucuaucuuaaacuuuuaaaauuacauauguucauuggagaaauuuagaaauuauauauaaguaaaaauaaguuaaucuaccccuaauccuacuacacagagauaaccacucuuugagcacauauguuguguugcuuuuaaaguaacaaguguuggugggguaugcuggcucacaccuguaaucccagcacauugggagaccgaggcagaaggaucacauuaggucaggaguuugagaccaaccuggccaacauggcgaaaccccguuuuuacuaaaaauacaaaaacuagccagacaugguaguacacaucuauaauccuagcuacuugggaggcugagacaugagaaucaguugaacccaggagucagagguugcagugagcugagauugcaccacugcauuccagccugggcaacagagggagacacugucucaaaaaaauuuuuuaaaaaauuuuuaaagugguaaauguuaacuguuuuaaaaauaacccaaaauuccuguauccugaaaaaaaucauuaucacauacucaaauacagcaugcaugcacacacacacauucauucauucuggcaguauguccuaaacuguguuccacagaacuuuuguugguuugaguuuguuuuuuuuuuaauacgugcuccuucagcaagcacaugaaaaaugcucaucaucauugaacaauugguaaauguaaguuaaaaccacaaugaguuaucacgucauacccaauuagaauggcuacuauaaaaaaaaacaacaacagaaaauaacaaguguuggggaggauguggagaaauuagaacccuugugcacuguuggugggaaaguaaaaugguguagcugcuaugaaaaacaguauggugguuccucaaaaaauuaaaaauagaauuaucauaugauccagcaaucccacuucuggguguauuuaauauucaaaacaauugagagcaaggucugcaagagauauuugaacacucauguucauagcagcauuauucauaauagccaaaaguuauuggcauaauagcagcccaaguguuuaucaacagaugaauggauaagaaaaaauuugguauauacauacaauggaauauuauucagccuuaaaaagaagggaauccugucacauucuacaacauggaugaaccuuaaagacaucaugcuaaguuaaauaagcaccacaaaaggacaaauauuguuugacuucacuuauauaagauaucuagaguagucaaacucauagaaauaggaagcagaguuggugguugccagggacuauggggagaaggaaauaggcaguuguuuaacagguacagaguuuuaauuuugcaagaugaaaauguucuggagauugguuguacaguaaugcaaauauauuuaacacuacugaacuguacacugaaaaaugguuaauaugguauauuuuuguguguuuuacuacaaguaauguuuuaaaaaauguguuccaugugcucaaguaaggaaacaguggaccaaacaaaauuaauguaguuuguuuauagcaagacuucucagaaccuuuaauauacuaauguguauugugacucugcaugaggagauacaguguaauguguuuucccaacuuaucugaccaugggucucuuuuuccaauauauuaugggacuagcaaaauauauuaaggaacacacuuuaggaaauauuacuacaaaauguuggugauuuaaggucuuaccucucuaagagacauuugauuucaaggagacaccuggggugauuaauguuuauuccaaaggaaugugucucuagagauagaaugucaagucuuguaaauaccuaagaaggaaaaggucuggggcacaaggccacccagcaccucucagaucucugcuugucgacagccaaauauucggccugccuggaaggucagcccagcauuuuggcaauugagaggaagccuucaaauuuagaaacuacucuuaggaggcaacaaucuucagugucugauuauagaguuucguaauuucauuaaggcauccagucauuccaguacagacagcagccauuuccaagcaagaacuuuaaugcuguacuggaaacucuggauggacagaauucaggucaagggaaagauaauucucuagguugaauaucuucauguguaauucaaaacgagaguuugcuaguagauuuaaauguacuguaguugaguuaaaggaggaugucaugguuaaaagccaagcauuuccucuaggagcaggugaaaaaacagcugacauuccugauuguuuuucuaaguguuuaaaaugacuuuuccagaccugaagccuguaagcauuuuauuaacauuugauuagcaauuauuccuuacuguguugaaccugaaauuaggaucagguuuccuuacauuaccacaaacacacacacacaaaacacaaaccccaaguaacucaacucuuucuuuauucuuuuucuuuuccuuuuccuuuuuuucuuuuuucuuuuuuauuuuugagauggaguuucacucuuguugcccaggcuggagugcaauggcacgaucucggcucaccacaaccuccaccuccugaguucaagcgauucuccugccucagccucccaaguagcugggauuacaggcaugcaccaccaugccugacuaauuuuguauuuuuaguagaggcaggguuuauccauguuggucaugcuggucucgaacuccugaccacaggugaucugcccgccuuggccucccaaagugcugggaauacaagcaugagccacugcgcccggccaacucuuuuucacaaagguucauuccaaaauaauuuccccuuucccuuuccuuagcaaucucaaagaaucauagacugaggccaggugugguggcucacaccuguaaucccagcacuuugggaggccgaggcaggcagaucacgaggucaggaguucuagaccacccuggccaacguagugaaacccugucucuacuaaaaauacaaaaauuagccgggcauggugaugcgugcccguagucccagcuacuugggaggccgaggcaggagaaucgcuugaaccugggggguggagguuguggugagcugagaucgugccacugcacuccagccugggcaacaaagcgagacuuugucucaaaaacaaacaaacaaacaaacaaaaaagaaucauagacugucagagcugggaaagacuuagagcucauguaguccaacuccuuuuuuggacauauggggaaaccaaggagcagagagguggagcgauuucccccaauacucaaagagugacagagcugagaaaaccugacugcuugucuagugcucuuucuaauauaguuacuucauuagaagaugauccauggaggcccaauauaucuaugacuacaggucaaauugguuuauaauguauuggacaagcaaauaauaacgguuuuauuugaaugccagaaugugauuucucauagguaauacaauuuguaagcugagcaugaaauuuaaaaccugaaaugaaucaguguucacagcauguaagaauguauauuacaaguguaauguaacauuuuguuuuauguguaaauauauagcaguuaggucaaauacauccaccagaauuacuugguggccuugauucgcguggacauccauagcagauucugaagagaauuuuuacugugaauuauauggcuucauagguacucuguaugccauacccuauuuguaaguugcaagcaggaaauaguugauagcaaaggucagcuagaguauaauggagauaaaauguugguugcguaaaauuuuuuaaaaagagggcucuuuaguaauguuuauaaucacuugcuaauuaacauauugguguguuauguauuugaggccacauaucuuuuuuuuuuuuuuugagacagagucuugcucuguugcccaggcuggagugcaguggugcaaucucagcucacugcaaccuccaccucccggguucaagugauucucccaacucagccuccugaguagcugggguuacaggcgugugccaccaugccuggcuaauuuuuguauguuuaguagagacaggguuuccucauguuggccaggcuggucuugaaccccugaccucaggugaucugcccgccucagccucccaaagugcugggauuacaggugugagccaccacucccggccaaggccacaugucauuaagcagcuucaaauccaucaaccaauuaggauaacaauucugaugucaacuaguaguuuauuucaugguucucuacagggauucuuaccacauuagaauaauuaaugucaggacacacuguuuuugauguugcuugggagaagccacaacuaaguaaacaaccucauugguuugugaaugcaaauauugagauagcuggagucuaguuuuuuuaggauagcuaaacaacgaccucugaauggagggguuauaaagaacaacaacaaauagaagaguggauuuaaagauuguuaaaaugcuuaaaccaucgacacaaaaagucauacuucuuaagacauauuuucccucuguucuagacuccaggauccucaucuacugaugucaaacaauagugcaaacagggagucuuguaagcggcucuuuguaaagagaauuaaugacuugguaaaugcaguacuuggcaguaaacauuauauuccuauagccuuagcccauagggcucugcguuuacucagagccuagggaggcagauuuccccauagagacugcccacagaaucauuuguuuccuuuguggauuuggaauggauuuggaauuuguacuuuuucucuuuuuguaacaauaagccucaaaacauugcauaugcuguccuaagauaccugcggaucaaaacauauaagccuuuaaauucacuuagccaguuuuagaaguuggccuuuguugaauuuguacuuaucagauagaaagccagcaacauuaguuuagaggaaagaguguagcuauguucugaaagcauuugaugguuauauuugaugaagcugggaauaugauggaaauuucagaaauauaacaaccuccuaugccauguuucuggcuugguauccagucauucacacagucccuguuaauauuaacgguaggaaugaauuuuacucccccaggaaacuauaaacuuucaauauuuuauucaugguuuaagaauacuuuugacuuuugaaccuaagauuuuagccaaauaagaacuauuuacugaacucuuuuuuuuuauacuuuuaaguuuuaggguacaugugcacagcgugcagguuuguuacauauguauacaugugccauguuggugugcugcacccauugacucgucauuuacauuagguauaucuccuaaugcuaucccuccccccuccccccacccugcgacaggccucagugugugauguuccccacccuguguccaguuguuuucauuguuaaauucccaccuuugagugagaacaugugguguuugguuuucucuccuugugauaguuugcucagaaugaugguuucagcuucauccaugucccuacaaaggacaugaacucauccuuuuuuacagcugcauaguauuacaugguguauaugugccacauuuucuuaauccagucuaucauuguuggacauuuggguugguuccaagucuuugcuauugugaauagugccacaauaaacauacgugugcaugugucuuuauagcagcaugauuuauaauccuuuggguauauacccaguaaugggauggcugggucaaaugauaauucuacuucuagauccuugaggaaucgccacacugucuuccacaaugguugaucuaguauacagucccaccaacaguguaaaaguguuccuauuuguccacauccucuccagcaccuguuguuuccuaacauuuuaaugaucgccauucuaacuggugugagaugguaucgcauugugguuuugauuuguauuucucugauggccagugaugaugagcauuuuuucauguguguguuggcugcauaacugucuucuuuugagaagugucuguucauauccuuugcccacuuuuugaugggguuguuugauuuuuuucuuguaaauuuguuuaaguuccuuguagauucuggauauuaccccuugagagauggguagauuguaaaaauuuucucccauucuguagguuucuguucacucugaugauaguuucuuuuguuaugcagaagcucuuuaguuuaauuacaucccauuugucaauuuuggcuuuuguugccauugcuuuugguguuuuagucauaaaguccuugcccaugccuauguccugaaugguauugccuagguuuucuucuaggguuuuuaugauuuuaggucuaacauuuaagucuuuaauccaucuugaauuaauuuuuguauaagguguaaggaagggauccaguuucagcuuucuacauaugucuagcaaguuuucccagcaccacuuauuaaauagggaauccuuuccccauuucuuguuuuugucagguaugucaaagaucagaugguuguagaugugugauauuauuucuaagggcucuguucuauuccauuggucuauaucucuguuuugguaccaguaccaugcuguuuugguuacuguagccuuguaguauaguuugaagucagguagcgugaugccuccagcuuuguucuuuuggcuuaggauugucuuggcaaugcaggcucuuuuuugguuccauaugaacuuuaaaguaguuuuuuccaauucugugaagaaagucauugguagcuugauggggauggcauugaaucuauaaauuaccuugggcaguauggccauuuucacaauauugauucuucuuauccaugagcauggaauguucuuccauuuguuuguguccucuuauuucauugagcagugauuuguaguucuccuugaagagguccuucacaucccuuggaaguuggauuccuagguauuuuauucucuuuguagcaauugugaaugggaguucacucaugauuuggcucucuguuugucuguuauugguguauaagaaugcuugugauuuuugcacauugaguuuguauccugagacuucgcugaaguugcuuaucagcuuaaggagauuuugggcugagacgaugggguuuuguaaauauacaaucaugucaucugcaaacaggggcaauuugacuuccucuuuuccuaauugaauauccuuuacuucuuucuccugccugauugcccuggccagaacuucuaacacuauguugaauaggaguggugagagagggcaucucugucuugugccaguuuucaaaggaaaugcuuccaguuuuuccccauucaguaugauauuggcuguggguuugccaucaauagcucuuauuauuuugagauacgucccaucaguaccuaguuuauugagaguuuuuagcaugaagcguuguugaauuuuaucaaaggccuuuucugcgucuauugagauaaucaugugguuuuugucuuuguuucuguuuauaugauggauuacauuuauugauuugcauauguugaaccagccuugcaucccaaggaugaagccaacuugaucgugguggauaaguuuuuugaugugcugcuggauuugguuugccaguauuuuagugaggauuuuugcaucaauguucaucagggauauuggucuaaaauucucuuuuuuuuuuuguugugucacugccaggcuuugguaucaggagacuacuggccucauaaaaugaguuagggaggauucccucuuuuucuguugauuggaauaguuucagaaggaaugguaccagcuccucuuuguaccucugguagaauucagcugugaaucccucugguccuggacuuuuuuuugguugguaggcuauuaauuauugccucaauuucagagacuguuauuggucuauucagggauucaacuucuuccugguuuagucuugggaggguguauguguccaggaauuuuuccauuucuucuagauuuucuaguuuauuugcauagagguguuuauaguauccucugaugguaguuuguauuucugugggauuggugauguuauccccuuuaucauucuuuauugugucuauuugauucuucucucuuuucuucuuuauuagucuugcuaguggucugucaauucuguugaucuuuucaaaaaaccagcaccuuggauucauugauuuuuugaaggguuuuuugugucucgaucuccuucaguucugcucugaucuuaguuauuucuugccuucugcuagcuuuugaauguguuugcccuugcuucucuaguucuuuuaauugugauguuagggugucaauuuuagaucuuuccugcuuucucuugugggcauuuagugcuauaaauuucccucuacacacugcuuuaaauaugucccagagauucugguauguugugucuuuguucucauugguuucaaagaacaucuuuauuucugccuucauuucguuauguacccaguagucauucaggagcagguuguucaguuuccauguaguugagcaguuuugagugagucucuuaauccucaguucuaguuugauucccuguggucugagagacaguuuguuaaaauuucuguucuuuuauauuugcugaggagugcuuuacuuccaacuauguggucaauuuuggaauaggugugguguggugcugagaagaauguauauucuguugauuuaggguggagaguucuguagaugucuauuagguccgcuuggugcagagcugaguucaauuccuggauauccuuguuaacuuuuugucuuguugauccaucuaauguuggcagugggguguuaaagucucccauuauuauuguguggaagucuaagucucuuuguaggucucuaaggacuugcuuuaugaaucuaggugcuccuguauugagugcauauauauuuaggauaguuagcucuucuuguugaauugaucccuuggcauuauguaauggccuucuuugucucuuuugaucuuuguugguuuaaagucuguuuuaucagagauuaggauugcaaccccugccuuuuuuuguuuuccauuugcuugguagaucuuccuccaucccuuuauuuugagccuaugugugucucugcacgugagaugggucuccugaauacagcacacugaugggucuugacucuuuauccaauuugccagucugcgucuuuuaauuggagcauuuagcucauuuaccuuuaagguuaauauuguuaugugugaauuuaauccugucauaugauguuaucugguuauuuugcucguuaguugaugcaguugcuuccuagccuugauugucuuuauaauuuggcauguuuuugcagugucugguaccaguuguuccuuuccauguuuagugcuuccuucaggagcucuuguaaggcaggccugguggugacaaaaaucucucagcauuugcuuuccuguaaaggauuuuauuucucauucacugaugaagcuuaguuuggcuggauaugaaauucuggguuaaaaauucuuuucuuuaagaauguugaauauuggcccccacucucuucuggcuuguagaguuuuugccgagagaucagcuguuagucugaugggcuucccuuuguggguaacccgaccuuucucucuggcugcccuuaacauuuuuuccuucauuucaacuuuggugaauuauguuucuuggaguugcucuucucgaggagugucuuuguggcguucucuguauuuccugaauuugaauguuggccugccuugcuagguuggggaaguucuccugaauaauauccugcagaguguuuuccaacuugguuccauucucccugucacuuucagguacaccagucagacguagauuuggucuuuucacauagucccauauuucuuggaggcuuuguucauuucuuuuuacucuuuuuucucuaaacuucucgcuucauuucauucauuugaucuucagucacugauacccuuucuuccaguugaucgaaucggcuacuaaagcuugugcaugcaucacguaguucuugugccaugguuuucuucuccaucagagaagcacucacuccauuuaagugcuucucuacacuguuuauucuacuuagccauucaucuaaucuuuuuucaagguuuucagcuucuuugcgaugggcuugaauauccuccuuuagcucagagaaguuuguuauuaccgaucaucugaagccuucuucucucaaaucgucaaagucauucuccuuccagcuuuguucuguugcuggugaggagcugcauuccuuuggaggagaggaggugcuccgauuuuuagaauuuucagcuuuucugcucugguuucuccccaucuuugugguuuuaucuaccuuugguguuugaugauggugacauacagaugggguuuugguguggauguccuuucuguuugugaguuuuccuucuaacagucagaaaccucagcugcaggucuguuggaguuugcuggagguccacuccagacccuguuugccuggguaucaccagcagaggcugcagaacagcaaauguugcagaauggcaaauguugcugccugauaguuccucuggaagcuucaucucagaggggcaccuggccguacguggugucaguuggccccuucugggaggugccucccaguuaggcuacuuggggaucaggcacccaguagaggaggcagucugucuguucucagaucucaaacuccaugcugggaggaccacuacucucuucaaagcugucagacaggaacguuuaacucugcagaacuuucugcugccuuuuguucagcuaugcccugcccccagagguggagucugcagaggcaggcaggccuucuugagcugcaguggacuccacccaguuugagcuuccuggccgcuuuguuuaccuagucaagccucagcaauggcagacgccccucccccagccucauugccaccuugcaguucgaucucagacugcugugcuagcagugagcaaggcuccgugggcgugggacccuccaagccaggcgcgggauauaaucuccuggugugccauuugcuaagaccauuggaaaagcacacuauuagggugggagugucccgauuuuccagauaccgucugucacagcuuccuuuggcuaggaaagggaauuccccaaccccuugcacuucccgggugaggugaugcccugcccugcuucggcucacgcuccguggacugcaaccacuguccgaaaagccccagugagaugaacccgguaccucaguuggaaaugcagaaaucaccugucuucagcaucacucaugcugggagcuguagacuggagcuguuccuauucggccaucuuggaaccucuccccugaacucuuuuuuuuucccagugcuucuucuugugcuaaaacucuauaggcccuuaucauacagaacuaguuauacugcugcuucuuguugaggaaaagagucaaacccuguaaaauauuugaagagauguauucugagccaaauaugagugaccaauggcccaugacacagcccucaggggauccugagaauguguacccaaggugguugggccacaacuugguuuuauguauuuuagggagauauguaucaauuaauacauguaagauguacauugguuugguccggaaagguaggaaaaccggaaauguaggcuuccaggucauagaugguuucaaagauuuuuugauuggcaauugguugaagcacuuauaaucaauagaaaggaauaccuggguuacaauaaggaauuguggagaccaagguuuuauugugcagaugaagccuccagguagcaggcuucggagagaauagauugcaaguguuuccugucagauuauagagucugcucuaucaguaauuccaaaagggugggaggaggguauaaugaggcauaucuggcucccuuucccaucauggccugaacuaguuuuuccagguuaacuuugggacacccugggcugagcaaggagugguccauucagaugguugaggggccuuagaauuuuauuuuugguuuacauucuugauggcucuucuccuuguauaucucacuuuccaugggcuaaaugaauacugaaagcaaaucugugaaaaauccuuuugcaagauugagaccccugagauuuuugguguaauaagauaauugaugugcuggcaucauaguucucaggcaaguugaaguagaaaaauaaaauaaagguuccuucuuagaauuaucccaaggaaauaucuuuucacaggaggggauaccaagucauaccuauaaagaguagaauuuuuuuuuuuuuuuuuuuuugagacagagucuugcucugucucccaggcugaagugcaguggugugaucuugggucacugcaaccuccaccuccuggguucaagugauucuccugccucagccucccaaguagcugggauuacagguucccgccaccucacccaacuaauuuuucauauuuuuaguagagaugggguuucaccguguuagccaggauggucuugaucuccugacaucaugauccgcccaccucagccucccaaagugcugggauuacaggcaugagcuaccaugcccggcaagaguagaauuuuucaaucaccuucuuaacaccagacaauaggaaguuugguucugaauuugggguugcaaauucuuccuaauugguuagugcccuuuuuguugucuuuuuuuuauugaguaaaauacacauacuauaaaauucacccuuuuaaaauguacaauucagugguuauuaguauauugaccaaguucugcaaccaucaccucuaacuccagaauauuugaaucaucucaaaaagaaacuccauuaugccccuuaccccugaccccuggcaaccccuaaucuacuucauauuucuauggauuaaccuauucugauaguucauauaaauggcaucauaucauauauaguuuuuuuuaugucuggcuuucuuagcauaauguuuucaagguucauccacaauguagcauguaucaguacucauuccuuuuuauggcugaauaguauuucauuguauagaaacaauauauuauguuuauccaugcaucuguuguuggacauuuuggcuguuuccaccuuuuggcuauugugaauaaugauaccacaaacauugguguacgaguaucuguuugaguuccugcuuucaguuauuuggggcauauaccuaggagcagaauugcuggauuauauguaauuuuauguuuaucugauugaagaaccaccaaacuguuuucugcaaugaauccaccauuuuacauucccaccagcauuguaugaggauucuguuuucuccauauccuaacaccuguuauuuuccauuuuuaaaauuauuauuacagccaucuaagugguugugaaauaguaucucauugugguuuugauuucauuucauuuauggcuuaugauguuaagcaucuuuucauuggcaauuucuauaucuucuuuggagaaauguuuauucagauccuuuguccauuuuuuuuuaaauuggguauuugccuuuuuauuuuugacuuguaagaguucuuuagauauucuggauacaagacucuucagauauaugguuugcaaaaacuuucucccauucugugggucaucauuccacuuuuugaugguaucuuuugauucauaaaaguuuuaaauuuugaugaaauccaauuuaucuauuuuuucuuuggccauuaaauaugcuuuugcuuaacccaaguucacaaaacccuauguuuucuucucaaaguucugucauuuuugcucuuacauuuuaaccuuuggucuauuuuuuuuuuuuuuuuuuugauacagugucuuucucugugacccaggcuggaaugcaguggcaugauuuuggcucacugcaaccuccaccuccuggguucaagugauucuccugccucagccucccgaguagcugggauuacaggugaccgcuaccacaccuggcuaauuuaacccuuggucuauuuugaauuuauuuuuguauaugguauuagauagggauccaaauguacucuuuugcaugugauauccaggucucccaccaccauuuguugacaagagcauucuuucauuuugaauuuauuucauuaugaauuuugaauuucauuuugaauuucuuucauuaugaaugaaaagagcauucauuuauucauucauuuguauccagacgguuuaagaaaaaaaucugucuuauauuuuuaguauauaggagccaguguugcuucuauuuguuuugaauacaaauuccauuuuucuuugcauauuagacccuauauguaagaaacaacuuuacacaauaauuuguuugcugguaauauuuggacaagugccauaaauucauguguauuguacuuucugaauagauuuuuucuaaucauagcaaaauuuauuuauuucaaaacuacaacucuuugaaguguucagcuauaauaaaauuuaguuauaaaauuauguggcacuacugaaaaucuaaaggauaaucugaagaaugaguaagacaaauauugauaguaauuuuuaguauuuucaaaauguuucgguucacacacauaaaugaaaucauuuuaaaaacuaggggcugggcacaguggcucacaccuguaaucuuagcacuuugggaggcugagguaggaggauugcuugagcacaggaguuggagaccagccugggcaacauagcgagaccccuguagcuauaaaaauaauaaugauaacuagguaccauauuucagaaaccauugugaaaaauaauaacuagggauugauuauaguaucuuuacucuguauucacaaauugaucucuauauuccugaacauauuuaauccuuugauuuaccuuugacuagguuugucauuguaaucccuagguugcuuaggaagauacuauuugguuugaugaaaaagccggaaugauaauagcucaaacucuuuugagcauuuaguacaugcuuggcacuguucuauacauuuuaaguuauucacucauguauuuaaucaucaacacccuuauaagguaaauaucccacaauuacuuuuguaccaaccuaauaccauugcagacaaggaaacagaugcaaagaggcuaaguuacaagggcacacagccauuaaacuuuggaucuguagagugacugggcuucaaaguccucuuccugacugcuauucccaugucuuuugcaaagauaagucuuugacagguauaugcuuaauuaaaaucauguuuagaaggaaaugagacaauagaauuagaaaaagaaauggcuguaggcuucaaugaaaaugaccuuugugacugggugaaaauuguuuggcuggauguccuggaaaauugucuucugggaauaucuauauuguaggguucacuuuugucauagaauugcuucuuggcccauuuaagagagauacuuuaaguucguuauuaauaaaucaaauauuuuuauuuuuuaaaaaagagcauucuuucccccauugaauucuuggcacucugucaaaaaucaauuucuaggcuaggcgcgguggcucacgccuguaaucccaguacuuugggaggcugagguggguggaucacgaggucaggagaucgagaccauccuggcuaacccggugaaaccccaucucuacuaaaaaauacaaaaaauuagcugggcgagguggcgggcaccuguagucccagcuacucgggaggcugaggcaggagaauggcgugaaccugggagacagagcuugcagugagccgagauugcgccacugcacuccagccugggcgacagagugagacuccaucucaaaaaaaaaaaaaaaaaaucaauuucuguacucucaauuauauuccacugaucugucauuauuccaagaccucccugaacuaaguacaguacauuuacaguaaguuuuaaaauauggaauugugaggccucugacauuguucuguuuuuucaaaauuguuuuggcuauucucaguacuuucauaugaauuuuaggauuaucuuguccauuuaaaaaaauaaggcagcuggaauuuugauagaaauuguauugaaucuguagaucaauuugaagaguguuuccaucauacuacugaggcuucuaauccauggauauagggcgucuuuuuauuuacuuaguucuuuuuaaauuucuuguugugauguuuuguaguuuucaguguauaagucucacacuucuuuuguuaggcucuaaguguuaauuuuuuuggauguaauuguacauagaauuacuugauuaauuucauuuuuagaguguucauuguuagucuauacaauuaauuuauuauaucaaucguguauucuacaaucucgcugaacugauuagcugauaguuuuuucugaauaacuuaaaauuaucuauguacaaagucguguuacuugucaauaugauuuuacuuuuuccuuucuaaucuggggacuuuuauugccuaauugccuggcuauaaccuccaguacaaugucaaauaaaagugguaagaacagacauaguuuucuuuuuucucaucuuaaagagaaaacuuucaguuuuucuccuuuaaguauacugauaguugugaguuuuagauagauauugcuucucagguugagaaaguucccuuuuauuacuaguuuguugaguuuuuuuaaaucacaaaaggcuguuggauuuugucaaaugcuuuuucugcaucuauugugauaaucaugugguuuuucaccuuucuuuuuuuuuuggauugcauuuucuuucuuuuuuuuuguauuauaccugaaguucuaggauacauguucacaacgugcggguuuguuacauagguauacaccugccauggugguuugcugcacccaucaaacugucaucuacauuagguauuucuccuaaugcuaucccucuccuagccccucacccaccgacaggccccagugugugauguuccccucccugcguccaugugcucucauuguucagcucccacuuaugagugagaacaugugguguuugguuuucuuuccuguguuaguuugcugagaaugaugguuuccagcuauucuuaaguuauauuaauauaaugauuuauauaauauauuucuaugaauauauuguauacauugauugauuuucauauacucaaccaaccuugaauuccuguauuaaaugcuacuugguuaugguguauaauccuuuguauauguugcuggauucagauugcuaguauuuuuaaaggaucuuugugucuauauuuacacaacacuuugaucuguaguuuucuuuacuuguaaugucuuugccugguuuuaguguuaggguagcacugacuucauagaaugaguuggaaauucuuccuuucucuuccauuuuuugaaaauuuuguggaggauugguguuaauuauaguuuaccauuugguaguauuuaccagugaagccaucuguuccugggcauuucuuugcaggaaguuuuugauuacuaauucauuauuuuacuuguuauagaucuauucagauuuucuguuuuuucuugagucaguuuuaguaguuugugucuuuguaggaauuugucuauuucgucuaagcuaucuaauuugcuggcaugugaugucuauaguauuccaguauaacccucuauagcucuguaagaucagugguaguguucccucuuucauucuugauuguaguaauuugagucuucucucuguuucuggguagucuaacuaauggcauaucaauauuuuuaaucuuuucaaaaagcaacuuuggguuuuaugaauugucucuauuuuuaaauuucauuaauuuauacucuaguacuuauuauuuaccuauguaguuaccuuuccuaauauacuuuauuucuuccuacaguguggguuacugucuaguguccuuuuacaucugccugaaagacucuuuuuaacauuucuccuaggguaugucuacuaauagcaaacucucucagcuucuguuucuguuucuuuuaauuuccccuuuaguuuugaaggacacguuugcugguuauagaauuauuagaugacaguuuuuuuuuuuucuuucaguguuuugaaugucaucucacugccuucuggcuuucaugcuuucugaugagaaauuaguuguuaaucuuauugaagauuacuuguacaugaugaaucucuucuuucacugcuuucaugauuuuuucauugucugacuucaacaguuugauugacauacauagguguggaucucuuugaguuuauccuaguugauguuuguuaaauuucuuagacacauaaauuuauguuuuucaugaaacuuaggaaguuuucagccauuaugucuuuaaauauucuuucuuccuauuucucucuccugcuucugggauauccauuauguauauguugauaugcuugaugguaucccacaugacucugcagauuuguucauuuuuguuccuucuuuuuuucuuuuccucauaccgaauugucucaauugaugaagcuucauauucccugauuuuuuauucugccugcucaaauuugcuguugaguccuucuagugaacuuucauuuguuauuuuacuuuucaacuccagaauuucuauuuugguguuuuauauaauuuuuaucucuguuaguauuguguaugucaugggacaucauuauaaaacacuucuuuaauucuuuagacaugauuucuuuuaguccuuugaauguguuuuaaauagcugauuuaaaguuuuugucuaauaaguccaaugucugugcuuccucaggggcaguuucuauuggcugcuuuuuuccccuguguaugagccauauuuucuuuugguucaauuuuuuaaaucuccauuuguucaugaggaaguaacauggaugcuuggaaauuauuuuauacuugugggucuauuguauuuacaaaaaccacucucuuacauuuuauaguuuccaaaauacuuauuuaaguuuauuacauuugauccuaaaagcagcccuaugcuuuuuccagggcagagauuauuuuuauuacuguucuacagaugagaaaacugaaacuccuaugacaagccucuuuccauaauacuguauauuuuauguaucccucugucuuuuacauuuagccugcugccauucauaauuccacuauguuguuuuauguacaagcucaguuugguuucuuucauucuuugggcuugauauuauuccagauuguuacaaaaauagguuuaaaauuguuguaaaagcucuuggaacauucuuauuaaauucuuuuugugaagcaaauuacauagaagagcaaccacauucaccaaaagccauaaauacuuagauuuacuucuggcuccuaagaguauucuucauuugggagaaguucauuuguauucagguuuauuuuacauguucucuuauuucaguugcuuuuuuuucucaugauauuuugauuuuuaagguaccaaagccuuuuucuuauaauacagggaauuugaguuaaaguuugaagauaggagaacuagacaacugucaguguggagugaaugcaaggauauccagaaacaucccaccuacaccaaaauaucuguuucaccgguguuccccagucucuauaauuuccacugccaaucauuccuuugggaugagccauucuucccagaaggccauguuuaaaugcacaguuuaccaaaggggaagucauaucugaaaucauuauuauuuucuauuaacagacaaaggaaucugacauuuauucucagucuauugugugcccaggcacugugcuaaauuauuuccucauacaguucauauaagguaggugauauuaucuugauuugacaaauauggaaaacuuaaaccaccaagaacaagauccuaagugauugacacagauuuugccagaguggaggaccugaagcauggaagagguuccccaguuagaugagugaauaggcagacauugagcauucaagggccauuuuaaaagacugggucaucugaggagaagcaaauagagaagaccaaccuuguccaauugaagguacuguuucuuuguuucccugucagcuagacugaguggugagaagugcuguaaauuacaaggacggagagagagggagagaggggugcgagaaauagcagacuuugauaauuauuuaccauagggcuagaaagugaaauuuuacaaagcaauacagugaaugagugugcuucucuaaaagcaagauaauauuucuaaggguaaaguuuugaccuacauaaaggagcgaauguuuuaaugccaaaaauaaaggaacuguuuucccaguugaguugauggaaaauaaaucuuauuccuggcgggcauaccuagaaacagaagucaagcugggaugggguggggcaaggccauguuuugggaagaagaaguacuugauuagcagcagcagcaaccuccuccaaauucccauggcccuccauguuuuauauuacuuguuagggaaguuauguauuuccuuugcauuaauuaagguaucagcuuaagugugagugccuaagcaugugaauuuguugugcacucugucucugauguugugaguggugcauuuauggcaaaaggucucuucauugccagcucacagaugguaaugcuagaauuuaguucaaacuugugguaucacuacauacaacuucagugaugauugcacuguauauguuccugccucucuccagaaacaugaaaacacaagaugucgaccaucugaaaugucaugguaguccuuaaauauaguugcuauuuaaagauguauaaauuauaaucaucccaccagauuucaucucuggggcagcaacauauuugaaguuuugauuuaguugaaaggcaugauaauuuaggaguuuaccauuuauauuaacaaacuugaucaaaugcuuaaauguguauaagagacugggaaacaaaauggaauucuguguaauugaaugcaaaugcaaugauuuuaguaugauuaagccuaagaugcuuucaacuggaauuauuugggaauagauagaaagaaaugaauaggagaaaauaauaaaaggcauuugauuuauccacuuaaucaggaguggaucagaaugagaacuuugaaagguuguaggaauugaugauuugaguguaggaaccaagccuuuuccucuucuugcacugagcugguuuuauuccacuacauuuccacaccuugcagaaaggaacuccuuguggacuauaugaggguaggcucuauguucuguaacuaccacuuacucacaccaaccuggaaauuggcugcuucaugcuccaccccccaccacacccccacccacaccccacccacacccaggggcuguguugcucucccccuagccuguuauuuggcaagguuuggcuaaggauucaggaagaagaaccucauuuuccccuacuggaacuuaaacucauuuuacagcucucacauucuuuugcuucuuuuucacuuuaccugcccucaacugauucuccuguguuauccccaagauuaggcagcaaucuagcauuauuuauagcacuggugugguugaaaggcuuuacuaucuauugucuucguagacuuucugucuuccccuguaaagucgggguuggggggaggugagagggggauuuuaccaugugcucucucagguccuuucuaacucacuuaccauuccagucuguaacuuucuucccaacucuuuucuaauucccuuguaagguguugaauauaaugcugagcacuucugggugcucaauacaucuaauaucuccauuucucauacuagaugccauccucugagaggcaagugccccauuucccagccauccccucuccuguugcaucuagcuagggcauucaaguugauuucuucaaagacggaaauuaccauagcuguauccagaagaauuauguugaacgaacaugauauuaagacuguguguauauuaccugguauaucaaaaggggguuaaauguuaugggggaggguaacagcuauuuauuuaacaaaauguuaauugaauaugacuacaaggaaucucagaggaugauggagaagcccacguuagaacuaaucaggacauuguuaccuacugagcucagugaagagaaagguggaacaguaaguguguugacuauagccuguuauaagcuguccuuuucccuucccacacuuaccuucugcuguuccuaccacucuaucaccaccaucaucaccaaacaauuuugugggauagggaaggauuccaaguaagaaacccagccaaacacuucagucccaggagcaagcaaaaugugcacacccuauccaccaaagagggccaacagagaaaauaauucaccagaaucucuaccaaacuauaccuagccaaaauaggaagaguucaagcaccgcccaacacugaguacaaauuagcuggacuugguuacaugaugcucuucccagaccuugugguuaaauucuaauaaccuucuuaggaaaaacaagagggcugucuugggaaugcuugaugagguuuggaauucaagaauaagaggcaaugaugagagacacccagaugagcauggaaaugauuguaucugaacuaaguuccaacuguauacuuauuucagagaagugaaauuaacccaagcuaugcuaccccaaggcaaguauauagauacacuaaaucagcuaguguuuuaggggaugaaaggucgaugugaauguuaguuuaggcaaaugccaaguagcaauuauucugugaagguuaguuuaggccaauauuaaguagaaauuauuuuguaagccuguacagucaacccaacagaaaauuuuacaacuguggaaaaaacauguaaggauauaguagaauuaacuaagcuaaaauugagagaaucuucaccaauaucaauaauauguagauguuaaaugacuaugaauuuuguuaaaagaccgucuaaccuaauaugggaugccaacaagguaguaaauauauucaaauugcgaauggcuaagcuuaaguugaacuacgguguucagugguauccuuucaaccaauguccuaaauaauuaccaaaagcagggcucaaauuccuuuccuauucgaaaauaccagcaguucuguucaauuucacauuccuucaucuacuguuuggccaugccagucaaaccacuugagguacagaaaagagaacuacacuacaacaaggaaguacuuaaucauuugguagcugcagaauauaacuuggcuugccaauggcccgcauaagagucuaguggucuucugugaccaacauguuacaaaagcuauacaugcugaauucagagagacccaaucauuuuagcaucuuuaaugcuguauuugccaaacaaagcacuguuuuaggauaugucccaguuuuuuauauuuaaaagaaugaccugagcauuucuuaaguuaauguuuacuuaaggagugaagcuaaaaauuauacaagggcaccauuccuuugcugcuguugcuucagccuguaaagguguaugauuagauaggaauauugcaaugauuuuauucuuguuuccugagagacagcccauuucccccuuaggauucagugaccuaaaauuugggaagagaaaggcuugaaaaucucugaccuccaaggaaacuagaagcucaaaauagaguuuuucaagucccagucucaauuaucugaaacauauuuaaaaauucauauucuucaaauaguauaccagaacaggaaaacugcucucaccgaaaaccuauuuauaaacccugaucuagaccuagucuuuaaaggaaggaaguuuugucagaaacuagaggcaucucauuaauccucaguggacuagaggccuucuggaagaauagugaaccgaugucccccagucauugagguugacucuucaagcccaaugcuugaugacauggcugcugugguucauacacagauguuauuuuuagaggcaagaauucucauuucccaaaaguauaaccacaagaugucuauuuggaaugaaucacauuuaugcauuuggacaauaguaaauguucagaucaugucugugcaaccucaguucccugaagaaauauguaauauccugguacacucucaccccaggacccuugcccucugucaguggcccucaucuaacugaggugauuucuuuggaaauggagcagggcugugggguuccauagaugucuuugaagcagguuuuucuuccaggaaaaaaaguuauauuuuguccuuguggcuuuccacaaaaacugguuuagggacaaaaaugucaccaaucuuccacaaagcggguagcaaggcucagagaccuucagggagaauuugaacuugguggcccgcaagggugccuugcuguguuugcacuuugcugccacagcuggcaaaucagccugaucuggcuaagcuuuuugggccuaggccaaucucagguccagccuuuauaacugugacuggacuguguggggcuuuuggccccuuaaacugagcuuuacucuaguaaggcuggagacccucaaggagggcauuacagagcccagaauuaacacacacaggcaggcuaaucuagcaaagagaguacuuaucugggaauuggcagaggcucccuggguggguccaguaaccuuguuuagccacuuggugcuuugcuuggccacaucccuuuggguuagcugcuuccuuugcuuaaaaagaucgaaugacugccuuccucuuugacuuugcccuccucccucaugggaagagucucccucaucuguggggaaagaugguaccugucuuucaggguagcccaauaaaguaaaugcugguagucaaucacucaguccgucuguucagcugucuugcuaucuagcuguggaaucagggcucccuggcaggaaucagcuauuaccauaccaggaaaacagcaauggcauaucagacuggucaaagggacagagguuggaaaaaaaucaagucaaugaauagggcuggcacaguggcucaugccuguaauuccagaacuuuguaaggucaaggcaggaggauugcuugagcccaggagucccagaccagccugggcaacauagcgagacccccaucucuauuaaaaagaaagaaagaaaaaaaaaaucagugaauaagcuacuuacuaauuucuuaacccauugguucauucauucuuucaguuaccaaacauguccugagcacccacuaugugucaggcauugugcuagucccagagcuaugcccuuuccagauuaauacuggaguucaaaaccccuccuuccuggccccauuccaaauccuaacaacuuuauacuagcuacccugaggaaaguuuucaggcugaaaauggacauguugccccacaucucucucgacucucauuuccucauuuguaaaaugaggcuaauaauaccugcccugcugccucacaggggucccauauagaucaacuaagagaacagauacagcagcuuuuaauuauaaaaaucauaaaaugcuaauaguugugacucaauaaugaagauuuauugagggcuuaccauguucuccagauuuagccuuacccaggucauaacugaauguuaaccuauaccaaaaauucugaauuuauccuguuuggaaauucagauuuuauaaauauauaguuuuucauguauaauauuaauauuuugugaaugcuguguaccagauacuaagcucagugcuuuacacaaauuaccucauuuaauccccauaauuacacaaugugggagauggauacaaguauuauuauacucauagagaagaaacauggaacucagugagguuaaagaauaacuuguuggcugggcacagugacucacaccuguaauccaagcacuuugugaggccaaggugagaggaucacuugagcccaggaguucaaaaccagccugggcaauauagggagacccugucucuacaaaaaaaaauucaaaaguauucaggcaugguggcaugcaccuguaguccuagcuacucagaaggcugaggcaggaggauugcuuuagcccaagaggucaaggcugcaguaagcugugaucacuccaccacacuccagccugggcaacagagcaagacccuguuucaaaaaaaauaaauaaaauaauagcuuauuuauaguaacaaggcuaguaaaggauagagucaauuugaauccaaguuuucugacuccagaguaugaaccuuuaaccaccaugcuaugccuccucuuggaaaagaaucaaacccuauacacuucuaagcuauugguaauauuauuggaaauuuuccacuuugagguagcggacaguuucuuagaacuacagagaaccauuucuacuacuggggaaggagccccacugaaauggauuuaauuccauccugggucggcuucuucacauccugguguuuugauuguuuguuuguuuccuguccauuuaacagggggacauauuuucauaaguuucacugcugcauucacaaaccauaaaguaagaauugggaaagcuggaagugguagagaaaguguguucuguggaucagaggcagauguggaagcaaggcccaggcaagaacauauguggguguggguagcuuugcugauaccauauggaagcacagccucuagcaggucucucuucuuugucauuaaacaucucuguguguauccuugguacacagacucuuaucuuacugggagcauccagaaggguuuucccagacccacaaaaauuccacccaggcuucuuucuagugcuucaguguguggccauggaguauuacuuuuuuuugccuuaggagguauuuguaacaagcucuuaugucugcugcuauggcugcuacuacuaccccucuuccuccucuuuuccucuucaagaucaucauuguuauucugagcagaagaguuaacauguccaauaacuuauuaccuuuccaggcaaugugcuaagcacuuuacaugcauuauucuauuuauuuguucauucauccauuuaauauuuacuguucauuacuuuguaccaaacacugugcuaggcacugggaaccgaacacacuuuuaucccuucuguuagucuaguggggaugcaacagggaauauagaauuacaaacaguggaaaguucuagaaaagaagaauacauggaacuauaugaaaggugaauggugcuauuuuauuuaauauuucaacagcccugugaagauaauaaauaguauuaucccccauuuuacaggugaggcaagugaaacucagagaguuuaagugacuugcccaaagucacacagcuaguaaguaggcugaguagggauucacauccaugcuggucagauuccaaagcucaugcccuuaacugcuauacuuuauugccccccccccacgugugaagugcauauauagccauuaauucuaggccuauacauuuggguucuggcuuuaucucaaauguguggaguugcaauuguuuccaauuaguuguggcugugguuuggugcauucguucaaagagagugugcacgcaaaacacaggucacgugcuaggccuuguggaugugcacaacguauaaauaauaauggcauuccaaaaaagcugggcuucauuggagucaccacauuuguuuuccauuagcuuaugcuacucaaauacaaacgguaaagcauguguuuacauugcuguggauacggaaagccaggaccccaaagcacauuuugcagguuguauaaagcugagcauccaaauaguucaaaaucaguuuuauaagcccagcuuaauagcuuuaaaauguaaccuggauuccagauauuaaaaaaugccuacagaaaguaugugaguagccaaaagagauaaaaccagcuaaauccuuaaaauauguaccaagucccguauuugcaguaucuauuuuguuacuuaucccuuuauuuuuuuuaaaugcuaaagagcuuaaagucaagcaaacucuuagccauguagcagcaguaauggaauuuuucauucuguacuaaccagcugucugaagcuuuucaaaacaaaccuguucaugaugagauaguuugguuauuuaaaacacaguagaugacaagccuggggaaagcaagcagaaagcauccaauguuguucaaugcccagugcuuaucucccccuucugguccucccacccaauagugaaaagcuuucccaucaaguuauaguuaaugcccagcaucugagaaaauggaauugaaauggaaauuaucugagcuaaaggcaguaaagauggcaaaaauguacaaugaaggccccauucguugaugucuuuaccuaagacacauguuucuuuugaagaguucuggaccuggggggcaaauauguuacuguuaaugagaucucuauuacuuacucaguaacuugguaagguuacugagcuucaaugucuucccuuaacgugagaaauggggauggcagucuucccuguuauacaaacugguggagaguauugaggauuaugugagagaacauauguuaaaccccagcacaguguguggcugauaagcuucauaucuuugcaaucaagacaauuccaagaggcauauuauuuauaccauauagacagaucaagacuugcugcucucacuggucuaauuucaacauauuugaucccucuccgaacaauaaauauguccuuugaucucccauggaccaagcacaaaaagagcuucagccaaaucucauugucccaugcugccauacccuuuuguuauauugguuauggcuuuaaaaauaugaaauugcuguacuucagaaagcccuuuuuucccuuucauuguguuuccaauuuucuuaaguaauuauuccaggcuuuuuguuuccuuuuaucacacaacccugaguaccuguuccaaggcuaacuuuaaauguuucccugucuaaucaaaugaagucaaucaccuuuauacaaggguauuuuccguaacuacaaagacaaaaggucaagauauccauaccuaacugaaaaggaaaucaucauauuauauuuacuuuuaaacacaugguuugaagagcguuuacuaaggauuccaacaugcauggugcucugguggcucuugucaaaagaugguuucagugggauucugggaagcagaguaacauuggagcagccuuucugaaagaguaaggaguggucugcgguucacucacaguaagaugagggggacagaucuaguuaggcgugugucuguaguaccagcuacucaggaagcugaggcaagaggauugcuugagcccaggaguucgagaccagccuaggcaacauagugagaccccggcucaaaaaaaauagaugcagaucugugugccccaucccagauucaccaaaucagaaacucagugagugaauugggccagggagcgugucuuuuuuuuuuuuuuuuaacuuuugccuuuuuauuuuuuucgaaaucacaauuuguauuuauuuugucaaaauugcugaccuggauauaauugggaaaggaaugauugaaugauugccaagagcucaauaucaacacaaaaauguaagccaucaagacuguuuguacacgaaaaaacuuauguuucuguuagguguuugggggaauuauggcuacacauugaauuacuuguuauuuaaauauuacuucuacaacaugcauuaucuuagauauuuuuguuuuuccuauaaaauaccuuucaacuuaaaaaauguuuaauucuuuauuuuuccuuuuauuuuugguugacacauaauuguacauauuuaugggacacagagugauaguucaauacguguauacaauguguagugauuaaaucaggguaauuagcauauccaucaccucaaacauuuauuauuuguguuguggacauucagauccucucuucuagcuuuuagaaaauauacaauaaauuauuauuaaccauauucauccuacaguaguauagaacagugguccccaaccuuuuuggcaccagggaccaguuuuguagaagacaauuuugccacggaccagggaugugaugguuucagaaugaaacuguuccaccucggaucaucaggcauuagauucucauaaggagggccaccuagauccuuugcauguguaguucauaauagggcucccauuccuaugagaaucuaaugcugccacugaucugauagaaggaggaucccaggugcucaccugcuacucaccuccugcaguauggggacccugguauagaacacuagaacuaauuccuccuaucuagcuguaauuuuguaucuauuggcuaauaucucccuauccuccccuucccagacucuaguaaccacuauucucuacuucuaugggcucaacuuuuuuuuagcuccuacauaugagcgagaaugugggguauuuaucuuucuaugccugacuuauuucacuuaacauaauguccuccaggcucauccauauggccucaaauaacaggauuucauuauuuauuguggccaaauauuauuccauuguguauauauaccacauuuucuucauccauucaucuguugauagacauuauagguugauuccaaaucuuggcuauugugaauagugcugcaauaaacaugggggugcugauaucucuucaauauacucauuucuuuuccuuugaauaacuacccaguagugggauuacuggaccauaggguaguucuauuucuaguuuuuugagaaaccuccauauuauuuuccauagugcuugugcuaauuuacauuccuaucaacauguauaagaguuuagcgaggcuaauuuuuuaauaagcauccuggugauuuuuauggaauuuagagaaucacucccacaguguguaaguauguacauacccuuugacccaguaucuuuacuaaggaaauaauccaaaauauggaaagaguuaugugaauguuccugaugauuacauuuuuguuuauaaaagcaaaauaacaggaaacaaugcaaauauucaauauuagaaaaaugguuaaguaaauguugauagaucccuuaauggauagaugcaucaucccauuuaaaguaugacauuuaucauauuuacuuauuacaacaauucugugaggcaggcguuauuucucucauuuuauagaugaggacacugagguuuagggagauuaagcagcuugucugaaaauacaguuuuaauaaguggaaaaaguagcguucgaacucaagucaaucugcuucccaaaugcaaguucaauuuaaaaacaagcauuaaaaagugcugaccuuugaaaacacaaacauuguuuauuaaaguuugggaauuagggguuuucuuccuuguuucuuuuccuuucacguuucuauauuugauacuugcauauuuaaaauauuagauucuaaaagaaaguugauuguaugcuuaggcaacugugauagucucaguggcuaaaacagaguugcacagacaguaguggcuguagaaaaagcuggaaugugaagggccuugugcacuuccacuaagguauccucuguauucaaaguaaugcacagcagaagugucagguuaacagaaugucuauggggauaguggaaugaaauacucagacguagguuuuaauaugaucguuuacauugauaaucauuauugugugccuuggcuuuuaaaaagcuaacaggacaguguccuuugaaaauggcaaacaguuaaucaaaagcauuaggccccuaaaguuaccugcuuuuguguguaagucccucauaauuuucuuuucauaaaguuaguguucagucugaaagacugagagagggaacagaaaggucaauauugugaauuguaauuaagcaauuggauuucugggccaaauuccaggcugccuaaauccacuccuugcuggcaauuccuccucucugacccauuacccuucuuucaacacucuggagcuucagucucuucuuuaagauuuucgcauuaacaauagauuucuagguuuggguuuguuuuguuaaugugugaggguuagguuuaucaguggcugucuguguaaaauggcuuaaaagucuacuauaauccuucuuccaugcugaauuugucaccagaaugggagugauuuaauaccuaaagaaguaacuucacuggcaaaguuuuaaaggguuuuuguuuaauugcacuuuguuuuaaacugagcuacucaagaauaguggggacauugcacacagguuggaaacagucucucaaagauuagcuaugugucuuagccaagguccuccaaaaauguuuagcuacucauucacaaauucuucuucuauaauuaaucugggccuugacuuucuccuuuuucauaagguuguggaaauagcuuuuaaagaauuaaagauaccauaacacuucauuuugcuucaguucaauagcacauauauugagugccuacuaugugcuagacacugccuuaaaugcucugggguucaaagauauauaagauuaaaccccugggcagcucacaggauggugguggagagaagucauauguucaaauaccggauugcauacagaaaguggcauuuaggagguacagauaaagggaacagugguagaagagggagagggagagcuauaaugacugucuaccaggaaagcuuuauuaaugacauggcguuagaacuuggcuugaaaguauggaggacuuugaacagacacaaaugaagaacagcucauaguacauucucaaugaauguguacugaagguguuaaugaaagggacagaugcaaggugugcuugagaaauagcaaguucacuaaucuauaucuaaacauaauucuacuuaugugaaaaauuaucauucagguauuccaugauguacacaaaagaugcauucuugaaaauuaacauaaaaaugcuuauaucgaaagcaaauuucucauaagacauaaugauaaaggagggcauuggggguuuuggugaaacugaagugauguuauaggcuagauuagcaguucucaaagaaugguuuauggauccugggaauccaagaaauccagggauccacaagguuaaaacuacuugcacaacaguacuaagauguuauuugucuuuuccccuguguugauauuugcacaaugguucaaaagcaguggcaaguacaacucuucgaugccacaguaugaaucaagacaccacaggaugaauuaagccaauagcaccaaaauguacuaguagucauuguauucaucacugguguguacuugcagaaaaauaaagggcaguuuuacuuaaggauaucauugcugagucuguaaaaaguuacuaauuuuauuaaaccucaucucuugcacuuuuaaaagauuccguguuauaaaaugggaaguacacugaaaguauuuacacaguaaaccaugucaaugugcaucucaagaaaaagcacuugugagaaauuugagcugugagcuuccuguuucauuuuuacuugagagaaugacugacaaacuauaguuaugcagacuuaaauacuugcuagacauuuucuuggaaaggaacaaagagagccugucaguucagggaaaacaacuggcaguauuuauugccaauaauaaaauucaggcuuucaauagaaaaccaaaaauuguuuuaaacuuuuaucugccacugugagcuugagagcuucccaaaacuuaaagacuuuucagaugagauuggagauaauauuaacaaaugugauuuuuuauaucacauaaugaaagguguugacauugggaagaccugcauugcucagugagccaguauuuuccagaugacccauggaugaugauacaaaaugaguaaaaugcguguucaaaguucaaaacauaccaauggauguaaauguaacaggauaugauauauuuauuuauauaguuucauauuccacacugcaacuaacuacuuguugaguuuuuaauguaguaucaaagaaaaaucuccacaauuaucugaaaagucugcuaaaauacuucucucuuuucccaugacauaucugugggagguuggauuaacugcaaauguuucaaccaaaaccauauaucacagcagauugaguggagaagcagauuugauaauccagcugucuuauauuaagcuggacaucaaagagauuuauaaaacuguuaaauagugccacucuuccuaugaauuaucuuaugucugggaaaauauguuugucauucaaaaauguuuguguuuuagccugggcaacauagugagaccuugccucuacaaaaaguaaaaaaaaaaaaaaaaauuagcuggggauggugucacacaccuguagucccagcuacuuaggaagcugaggugggaggauugcuugagccugcgagguugaggcugcagugagccaugaucaugccacugcacccccaccugggugauggauccagacccugugucaaaaaaaaagaaauguuuaugucacaucauggguucauucuuguuauguuuauagaagcuaucaaauaaauauuuuuaaaauuucucaguuauaauuucuaagauggcaaauguugauagauauaacuuguauaaacaaaaauaacuuauauaaacucuaugguucucagcaaguauaaaggaguccugagaccaagaaguuugagaaccacuaaucuagcucaucuuagccuguauuuauauauaauauaaauguaguuguguaugaugagcagcagcggaaguggcagggugaacguggugcuggagugggagacaguugguagauuggcuucuccaauaccauuagagguuguuggccaggaaaaaaaacaaaaacaaaaacaaaaaucucuuugggacuuuccuuucuuugcuaaaaaauaaaaauaaaaacguaaaaaccaccugcagaaucacauuucucuguaguauguagcucuuuccaaguagaucucaggguggcagcuaaaucacagguggagaacauaaaaguauacuuagccaugacauaaacauagggacgauggaaaccgcagaaaccccagcuuguguuugcagcaauuuuucuuucuggauaccucuuccacaaucacaaagaucucaguuucuguauauccagaaucuuuuguuggcugucuuuuaaaaguagggguuggaucuaagauuuaggaugagaaaugggugauggggaagaagccaggacaaaaacagaauaugagaaugaagccuuggagagagauggcaaggaaaaauaagauggaaucugacaacggcccucagggacccuucgugcggugugcugggucucugggucaguggagaggcuuuugaaaggcgggagucccgugaaauucguaaugcauuggccaugugacugaaaagccagacaccgcagagugaaacaaacaugucucuuagugugcauauuaucuacaauaaagcaaaauaaauuuaaaagcaucuuauuggaauugcgggagaggagaauaaugaacaauuuuucuagugaucaaggcauauauaaugaugauugauuguaaguagucauuguacauguguauaaaauggcacugcuauucuccucauuugguaggaagcauuuugugguuuuaauuuagugacuguaaauuugauuauugggggcuuccauagggaucuuuucuggucuugguguccucuuagcuuugccuuaucaugucuuaaguuccucaucagugaauuguaucauggagacuuucaggagcuuaaauaccaugguaugagaagaucuaaugcaauauacacucuggcuacugcaugauguaaguagagucaaggaguagaccaucacaucaaaugcuauggaaagguucagaagucugaaacucuaaagaguauaagcaguuuacaccuacguaaauuugaaagugauuuuuuacagcuucuguguaauucauugaacauuuuuaaugccuccuguuaauaacacacugugcagacccaccugagaaauaugaagagcugaugcauuccugguuguuuucuuucagcuccugagaaccaugucuaugcccaaagguagaguucuggauaaaaaccuggaugaggaaggguuugaaaguggagacugcggugaugaugaagaugagugcauuggaggcucuggugauggaaugauaaaagugaagaaucagcuccgcuuccuugcagguaacugauuagugcugacccaaauguaaucuaaaaauggugaugcucaggaauuaaaaauaaauugaacccgcugucugcaauucccuuacauucccugcaacacacaaucucaucaacucuucaaggaaagacuauacaagcucuagaaagugaaguucucagguagccuccuucuuuuccucccaccauuuccaaccuuugguagauuaaaaggguaacuuccuguuuuucauuaucuaaaaugaacugaccuaaucaguuggcucuguuucucauuggaguuuuccuugguucuucucauuuauaaaaagaaaugcauaauaagaaaugcaaauuugggaugaaauaaccuguaccauaaacccccaugacacaaguuuaccuauauaacaaaccuagacauguaccccugaacuuaaaacaaaaguuaaaaacaaacaaacaaaaaaaagaaaugcaaccuuggaagucuucugaaaaccacuggugagauaacuuucaaaggaagagccauuagcugaccuucuuuucuuaggacguuaugucuauuuuguuuucucacaagcagucuaacauagauaggcuauggcauaugacugaagaccuacauaaagacaagagugguagggcacgguuguucaugcuuguaaucgcagcaauuuaggaggcugaggugggagaaucaccugagcccaggaguuccagaccagccugggcaacaugaugaaauccugucucuacaaaaauacaaaaauuagcaggguguggugguacgccuauugucccagcuacuugggaggauugcuucaguccaggaggcagugguuguagugagcugagauucugccacugugcuccagccugggagacagagccagagucugucucaguaaaaaaaauaauaauaacuaaacaacaagagcaauagaaaaaaguaauauaguacugcuggggucaaggaggcaaaacaacaacaaaaauuccuuaaauuuguauuccauaucacaguuuagaguacuuucauguggauagguguucuuugauuuuacagguaauuaaaaccagggcucagagaagaaaugagauugcucuauauggaagaacuagaaaucuaccucgggucuugagacuuccacugccauucucuuuccucuguggugcacagccuucuccuuaaaacccuaucacccauggccucugagaugcuaaauguuccuauuucucuggcagccucuuuccuucuuaguucuucuuccuaauccuaccugaaacuggcuauuauccggaugucccuucuuaagccucugucuuuucucucuucuccagaaagaaugcagaucuuaucuacucucccucuuuugacuuuuucuuccuuuuugagauagggucucucucuguccccuaggcuggagugcaauggcgcuuucacaccucacugcagccucaaacucuugggcucaagugauccucucaccucaacuucccaaagugcugggauuauaggugugagccaccauggcuggccucaacuuuuuuuuaugauuuauuuauuuuuuauuaggguaaaaaaaaaaacuaacauggaaucugcccucuuaaacuuuuaaguguacaguacaauacuguuaauuauaugcacauuguugugcaacagaucucuagaacauuuucaucuugugugccuaaaacucuauguccauugaacagcaacuccuuauuuuucccucccccagcccuuagcaaccaccauuuuacuuucugcuucugugacuacuuuagacaccucauauaugauggaaucaugcacuauuuguccuucugugacugguuuauuucacuuagcauaauuuucucaagguucauccauguuguagcaugugacaagauuuccuucuuuuuaagacugaguaauauuccauuguauguauguaccacacuuuuuuauccauucauccaucaguggacauguagauugcuuccaccucuuggcuguuguggauaauccuacaaugaacauucuuuaacuauuauaacacugugggaaauaacuuacauaaagucauuaccacgagucucaacugcucuccuaccaucccacaucuccagcugcuuauuaaucauuucugacuucaccaccaccacccccagcgugaugugucacaagucagauuuaucaacugaccaucauucuccugaucacugaggcuuaaaccuaaagccaucuuugcuucuucucucuugcccuuaaaugcaauuaggcccccaaucccugucgauucuuucuuuguaauuuauucugcuucuguuaauacuuuuuuguuuuuuguuuuuguuuuuuuugagauggaguuuggcucuuguugcccaggcuggagugcaguggcgcagucucagcucacugcaaccuccaccucccagguucaagcaauuuuccugccucaaccucccaaguagcugggacuacaggugugcaccacuaugcccaacuaguuuuuuguauuuuugguagagacgggguuuauccauguuggccaggcuggucucaaaccccugaccucaggugauccacccaccucagccucccacagugcugggauuacaggcgugagucacuacgcccagcccaauccuuccuuucuauuccccccuucacacccuccugcacauacuauugcagacacaucguagguggucuccaggcuucuaggcucaggcaggaguauugagagccuuaggcuaguagauuagaggacaaagaauuugagacccaggcagaagauuccaucaaauucaucuugcauagcuaccugguuaaucuuuugaaggcauuucauacuuucuccgcagcucagcugucuucaugccuugaggauaaagcuaagacuccuuaguagaguucugagggucuucuggucuagccucaacuacccuucuggcuucauuucccaccacuagcccccguaagcacccuccacuuuggugagaacagccauauucaugcuccaugaaccccauaaacauacuguucuuguuucuguuuucccaccacugccuauguuuauuucuuuuuuuuuuuuuuuuuacuuuuuuuuuuuuuuuuuuuuuugagacagucucacuguguugcccaggcuggagugagugcagugacacaaucuuggcucacugaaaccucugucucccggguucaagugauucucccugccucagccuccugaguagcugggauuacaggugcacacaaccacgcccagcuaauuuuuguauuuuuaguagagacaggguuuugccauguuggccaggcuggucucgaacuccugaccucgugugauccccgccugccucggccucccaaagugcugggauuacaggcaugagcccccagugcccggccugcccauuuuauuucuauagagauugaccuuuuuuucuuucaucuuaaauuuuacccauccuucaaggugcaauucaagugugaugcagugaaaagaaaauaggucuugggguaggacaaauguuuauuuaaauucuugcucuacuuaugagcaagcaugaucugggacaaguuucuuagccuccccucuaugucuccauucugucauccauuaaauggggaucauaaccccaacuuuauaggacuauuaaaucgagggggaacauuuauaaaacaucuaggcaaguaucuagcauaugcuagguguuccauaauuguuacuuucucuccaugaaaucuuucauagccaucucaguccauaguuaccucuguccucugaauucauuacuaaaaugaauucugccagugcuuucaugaaacagucuacaauggcucccagguuccauaggacauaaagugaccacucagagccuggcaaccuauuagaagaauguugaauaaacaugaaaaguaaaaauaagagaagcuaauguucauuggacacuuauuaugcucuaaacacugugccagagcuuggcaugcauugucucauaucauuuucacaauaccacuaugagguaggggucauuacuauucucacuuuacagaugagaaaauuuauacuggagguguucucacucauagugggaauugaacaacgagaacacuuggacacagggcggggaauaucacacacaggggccuguccugggguggggggaggggggaggggggagggauagcauuaggagauauaccuaauguaaaugaccaguuaacgggugcagcacaccaacauggcacauguauacauauguaacaaaccugcacguugugcacauguacccuagaacuuaaaguauaauaaaaaagaaaauuaugcaggaggagguggaguggcuugcuuaaagucacauucacaaagggcagagucaggauucagagccaagaagucugguuucagaggccacuccuugaacaagccuacucugacucuuuuuucucugaucaucaacacaacuauaaaaagaucaaagucagcuuugcauuuugcuaccuggaaaaguuguggucaucuaaaguugcccagacaacuuaccaaaauguugccuggucccagcacugaucccugagacauaccgcuguucauacuucuccagaaaagucuaugcuuauuccuacuugugcuuuccugacuauaagccacuuccuuauccauuucaaggcacugcuccacaauuccauggugacuuaacuuguuaaaacaguguuuggcaugggaucuugucaagggccuuuucaaaaucuaaauagauuacauccaugguuucccuuuguccacauacacauuuaucguguaaaagaauucuagucaauuuguuaggcaugauuaacacuaaguucuuuauaaacuguaaaacauuagauaaauggugguuaauuuaauugagaggaaaaaugaugccuagcccccaauacauuacacuugccuaacauauucagugauccuaccagccugaaguuccuugggccccccuuuaaaaaugcuucucauggagaggagacucauugccaaucugccaggcucaugguacaauagcuauuuggcauaauagcuauuuggaaugacaggcuauaugcuuuggucagcuguuauacaauuuuaccuaaaauuuggauagaugccaucugguccugaugauucaucagcauccauuuauuuagucagcuagacuuggaacaccaugcacguucaccaccauuucauuuagcccuccaaauugccuccuccaaaauacaacuugggaauaaagagcauggcucggaauauguuaagacucucuuguaucucccuuuugucccugaacagaccuuuugcgacaugaccagcaaguagcucuaucggcuggcuucccuggcuuacuucuucccuucuuuugaggcacugaaugaagugcaggacacgcagguucuguuccuggcuuugcuucucccguauguccuaaagcgagccccuuccacuuuugaaaagucaguuucuccauuugugaaauagagggaguguacacacaagucuugcagggcauuccagugccagcagucugugauuauguucauuucuuuggcuuugaucccuggcaaggugcuuaucagagucuuuugaggacaucuucuuguaaguuuucaucugaccuugcagguucucuguucucuucucuugagcuauaguucuauauagaaaagaucucauuuuccccauucuaaccccuuugacuuuuccaccaaucuggcaagcugggcuucuuaccaagggcuccccacauguggucuucaacacauuuuugcauuaggaugcuauuaaaaguaauggcaaaaaccacaauuaauuuugcgccaaccuaauaauaagaagguuuuaguaguuuccaggcuuucugggguauauucauuuauaaaauuauucaccucaaaguucccuaaguauucucuuuuuccuuauuucuuauuuauaaauuuuacauagaauccuuagagucuucuucuuucugauuguugaauuuaauuguuggugggaugaccauuacaugaugucuuacccaugguuacaucuucgccuguuccucgcacuucucagaaccaaggguaauguauuucccuuuuggugcguguccuaguccauuugcacugcuauaacaaaauaccuuagacugaacaauuuauacauucuaguaaguuauacuuacaguucugguggcugggaaguccgagaugaaggugccagcauuuggugucuggugaaugccuucuuccugcauccucauguugcagacggaacaaaugcuguguccucaccugggggaaggcaaaagggcaaaaaagggacagaugcuguguccucacauggcagaagagauggaaaggcagaaaggagccuaucuaguucucuccagcccuuuuauaagggacuaauucccuccaugagggcagagcucucauggccuaaucaccuccuaaaagccccaccucuucauacuguugcauugccgggggcauuaaguuucaacaugaauuuuggauggggcacaaacauucaucaaaccauagcagugggauacuucaucucucucagccugcuucuguuucuaaaaaguggagauacagcaaacuagcacaggagcagaaaacaucuugggcuuagggcuuaaaccgauuguauuagucuguucucgugcugcugauaaagacauaugagagaugggguaauuuauaaaggaaacagguuuaauggacucacgguuccacauggcuggggaggacucacaaccauggcagaagaugaagggagagcaaaggcacaccagcacuuugggaagccaaggugggcagauaaccugaagucgggaguucaagaccagccugaccaacauggagaaaccccgccucuacuaaaaauacaaaauuagccaggugugguggugcaugccuguaaucccagcuccucgggaggcugagggaggagaauggcuugaaccugggaggcggagguugcagugagccgagauugcaccauugcacuccagccuggacaacaagagugagacuccaucucaaaaaaauaaaauaaguaaauacauaaauaaaaccaucagaucucaugagacuuauucacuaccacaagaacgguaugggggaaacugccaccaugauucaauuaccucccgcagggucccucucacaacacguggcaguuaugggagcuacaauucuagaugagauuuggguggggauacagccaaacaauaucaucaauacuaaaagcaaauggcuguuuauugcccuugguacacagauauuucucauagaaaugcuugccuucaggaaacuuucagucucucagaugucaguguggggacugcaaagagaaaaccugccacuuguugcuugacauggggugacuggucccuuuugccauucuucuguugucaucuccaagugcuaugggggaaagcaguggucugccccuggcuagucacuucgucccagcaguacuguggaggaagccuuuaagauuucacagcugugagccccauuuaggguaauauuauuaguauuauuuaguaucauuggauuauaacuuauuauuuuagcugucuguagcauauauucccuuuuuauaguuacuuuauaaucugaacacaaaauaacgacgaucucaaguaaaacagcaauuaggaaauauuuucauaagccaaugaucuuuauuuuuauuuauuuauuuauuuauuuuuacuggaucaaguguaaucuuacacuucuacuccuaauaagccugcacacauaggaaaggugaaggacaccucaauggcuuaaguguucuucuaaagugucaagucaaaccuucauaaacguaggcugguagucauuuugcauuaauaaauucauuaauagaguggucuggugaaaagggucauuggaaauuuaugauaggccuuuuaucaugagugacaacugcaaaauauuaaugauuuagaacaaaucauguugccugcugaaaagugaguagaaagcuuguagggaaaugaaauguccuggguuuuuuuguuuguuuguuuguuuuuuguuuuuuuaaaugggaaaguuguuagguccuaugcagaacucggaauacauuagauacaguaauauaucuauuuauacuacccuguugguaacaaguccaggaauaaauuauggcaguuuuaccaaaauguauuuuauagugugaguaucccaauuccccuuccuuugugcucuuuggaaaugcaccauucagaucuuugucacguaaguuguagauugcuuccugcuaaguaagccaccccuggaacucucaggcaagaucuuguagugacugccuccaaacucauuucuugggauaucagccccuccaacaugugaccucagugcaagcgaccccacgucauccacugggagggagaucccaucuguugggcaaaugagacaccuucuuacccuuagacuguugaaguuugagaucuaaagggaagggcgucacuucuacagagucaaacaaacugggucccaguucugugucugccacuucccaauguugugaccuuggacaaagucagucaguuccucugagccacaguuuccucacuugcaaaaauggugauaaaauauuuccugaccuacccaccucauaaguugcugaaugaaacacaugagauaauggauguaacauacuuuauaaacuuuaaagcaucauauccauuuaggauaauauuauuaauauuguuuaguguuauaacuuaaauuauaauuuuagcuaaaggcuuuuggugaauaaaacuaaacuaaguuccaaauguccaagccaauaauuuucaaauguccaagccaauaauuuucauuauaaaugugcuacucuuauacacuguugguggcaauauacacuaguacagcuacuauaaagaacaguguggagauuccucaaaaaacuacaaauagaacuaccauaugauccagcaaucucacuacugggcauuuacucaaaggaaaggaaaccaauauauugaagagacaucugcacccccauguuuagugcaacacuauucacaauggccaaaauauggacucaaccuugguuuccaacaacagaugaaugcauaaagaaaauaugguguauauguacgccguggaguaaaaaaaaaggaaauccugucauuccaguuuaacuguugccaauccugucauuccagguaacgugaauggaacuggaggacauuguguuaauugaaauaagcugguaacaaaaaguuaaacaccacauguucucauucguauaugaaaacuaaaaaaaguugaucucauagaaguaaaaaguagaacagaggugggguagggagagacaugucaaaggauacaaaauugcagcuagauaagaggaauaaguucugguguucuagaaccacuguaggaugacuauaguuaacaauaauauauaguuucaaauagccagaaggaggauauugaauguucccagcacaaagaaaugauaaguguuugagaugauggaugugcuaaugacccugaucugaucaguauauauuauaugaaucaaaacaucacuauguaccccguaaauauauacaauuauuacaugucaguuaaaaauaaaaaaagaaggaaucucugaaaaaaaagauguucuccaucauccccauucccaaagguggcauuuuuaauuacucauuaacuuguuuuuagcccagggugguuugaagugagaagguauuugaacaaugacaaauaugucggcugaguuguacaaauaaccacauagucacaacaauaguagucacuuacaucuugaaagaaucacagcuaguuauguuuuguuuucuuuggugcuaguggggcgguaagggcauggguggacaacgaguugggaagggucaagaaagggccccugauuuuuuccauucuaucucgcucugagcuacaagcaaucugcuuucauguuuuggucuuuucuuuuagagaucaaaugucauaggaaagcugaaggaagcaaagcucaccauaauaacacuuuucacacagauauagaccaggugguucucgcuaaucaauugacaagacagccaaucccagcucacccuagagcuuugcgaagcucccagggcucacaaaggggacuuagaugugagcuuuagcagugguauuaccugccaauugaguagguauaccaagaaagaggccuuccccaugcuuuaauguuggcuagggaauuacuauagguaaucuggugauagaugagaaugagcaaagguuaaaacuucccguaaaguuaucauaacucaggauaccuuagggaguuuguuucuuauuauuuggaaggagauauucugagauuugcuuuucuaggugugcugcgcugugauacuuucccaucugagccauuaggcuauaaggcuuuuaucaggaguaaugcuguaaaaguuguacuugcugguaggccuuacacauaacucuaagaauugaguaaguauuagggauauugugagcaauuuagugccauuguauuauauuuucuaaucaaucuucaaauuaagaggaaacuguugaacagaugaauuugacuaaguggugcaauugauuuucucuggacagaagccauguuggccaguuuuaugacagccucaacuaaaaugugguaauuuagccaaguauugguagaaaggaaagggauggagagguucagcauucagcuggugggaaaguagagaaggaucuagcaggaaaguggcaagccugaagccucucgcuggguugccaaacagaagugaagcagucccuguaggauaacauccccgagggaucugggagugcagacuuacaugccagcaaaaggaaagugcuccccugcaagaagaaauagcauagcagaaagagagaaauguggagaugucugauuaaaccugugcuguuguccaaaguuuccaugauaaacaaugaucuccuaggggguucaaaucagaaacaaggaaucgugagcgugcagagugagacagaagcugaaaagaucuaguguggauaguccuaguggcugcagguagagaucgggaauaaagugagggcugagguccugcucggagaaggggagggauguggagccauccaaugcccuccaauuguugacuuuccauaaggccccuuaaacugugcacaugugcacgcaugugcugucaaaucucuccaauucagacagugcaguccuuuagguuuuucuagcacggcaaaaagaacaaagaugcagccaucaccuccccucuuuauuugucugucggguacaaggacauuucccauucgcacugguaggaacgaaguuacuggcaaguuuuugugugguuaauuuuucugaagggaaaccuuguuauagaucuugccuguguacacaccugccuaaaagauguuuaaugauucuuaucauuuccaaauauacuugcugaguuuuuuaaaaagugccuuuuagucuguuuuuuguuuuuuuguuuuuuuuuuuuuuuuggcuuuuuauaauccuaaugugaaugucugaugguaaauaagcuuuuaaggugagaacacgagcaccagcacagacagaaucuuuuaauuuguagcucauugguggacugaagcaguaauauaauuaccaaguaaauaaaaauggaguagaaggccaggcacaguggcucacaccuauaaucccagcagcuugggaggccaagguggauggauuacuugagcauaggaguucaagacuagccugagcaacauggugaaaccccgucucugccaaaaauccaaaaauuauacgggcaugguggugcgcaccugucaucccagcuacucgggagggugaggcaugagaaucgcuugaaccuggaagguggagguugcagugagcugagaucgugccacugcacuucggccugggugacagagugagaaucuguuuuaaaaagaaaaaacaaaaauggaguagaggcuauucuacaaauucagguuuccgaggacagucuagguuagagcaggaggaaaucucaugagcacauucaggaugagcuucagagaagagucguucuccaaauaacagugaacuccuuggagggucgaaagcaaguauuuuucauccuguguauacacuucacaguucucaaucaccuauucuccuucccuccaugcugcucagugacucucaguacguauuuaguaaauauucaguuauggauuuguaauauuuacuuuucacauuugcuuccuuuggucccauauucaauagggcaacagugugcuucaccuucauugcaucuuaaacuagcuuccucaaaguauccucaacuuuuagcagccguauuugugagcaaagagaucugagauuccuguuccagucaacacaggaguaaggacucagcugagugggggaaggcacggcaugugaaacauaggguguuuguagccuccugugcaucuugagaagagacagacagauggggaagauucugcacacagggacagugggaggauggugaaaagaaguaacaguguucagucuacaugagagaaggauuaggaagauaugaauguugucuucuaauaguaagaagucuugcauauggaagaggagaguagaucuggagccaaugcaugacauuuacaaggagacauauuuuggcuaacagaaagaugaacuaucucuuugagcuauuccucaauugaauggauugcccugagaaacaaucagcuuccugacuuugaagguauuugacuagagaauaaauaagcauaucaggccaagugcaguggcucacauguguagucccaccacuuugggaggccgaggcaggcagaucacuugaggccaggaguuugagaccagccuggcuaacauggcaacaucccgucucuacuaaaaauacaaaaauuagccaggcaugguggcacacaccuguaaacccagcuacucaggaggcugaggugggagaauugcuugaacccaggagguggagguuguagugagcugagaucgcaccacuucauuccagccugggcaaccaagugagacugcaucucaaaaaaauaaaaauaauaaaaaaagagaguaagaaauauuggcuggauggggcuuaggugucagagaguggauagauaccuacaucaugauggacuuuugacuuccaggguccugaauagcucugaggggcuaaauuuuuaugauguaaacauguaaauagaacaaaagagaaucaauaugguggagcaaaccaaugaggccauuuuucaggcugggggaaagaaagaggaguggagaagagaaucucugugguuguuugucuaugagcacaugucaccaauuaugauuuucugcaacuauuuuccuaagaaaacggauccuuacgaauggcagagacuuuuccagggagcaauucuuuucaacaucuucugucauucacagccuccagauuuguuuugccacuacaagaauccaguucucauuucuccccaauuaucuccaggcuuguggccguccugccccauguuagaaaagcaaacccaggacagagcccuccccccggcuacaagcaguuagugcugauugcuguauugucaauauuaagguuguccaguucacacucauccccugcaccacucucucccuucugauucugcccacacagaauagaccagugcaucucaaguuaucuaugaugaaggacccagaguuuguuuguuuguuuguuucauuccucccaaaucugucauggaccaauaucuuuguagacaauaaaacuaaauuaccagaaaaagaaaaugaccaaaaaaaacccuauaaaauacaagccacacguuuuaauuaugagauucaacagaccuaaaaaucucugucagauugcuauaaaaguuucaaagugcuuauuuucaaugucuguacuuaucuucuugcagauuagcaauaaauagcagagcaguagcccacacauugaguagggagguguagccugcucugugugucucugccuuguauuccuccucaccuuggaucucauggugggaaacacucaaaagcagucuaaauagagugagggcagugguguacuagagcuggcuugcacuggcucacgagagccaauuguuaaauuuucagaauuccugugagucaguuguuaaacauggccauuacaaaaaauuaaauuauauaaauuuacaaugaaauaaauucuaccaaacaaaaauaacacugaagacucaucacauccuaauuauuuuauugcauuuuauaauuaucucuacucuuagggucauaugucuauuguguguguaugugugguggaaauaauauauacucuugcaauucuguguucaguguggucacauugguagcuuaaagcuggccaggauagaaauacuuacaccacagaaaucaggaagaaacuacaaaucagggcuugauuuauuguuuuguugauugucuagacucuagacuuaagaaagugauaggagaaaauguuaauagcacagaauaaacuuaaaaucauguugucucuguagccauuacauugugaauagcacaaaaaaauugaagaaauauucuuccaguauuugaaaacuauuauccaauucaguaaagaaguugcuccuaucacugauggagugaaguucugacuccauuggaguggaacacuaauaauaauaguguuauuucacuuuugugucaccucuuaguguauuccaauauaucaaccaguauucauguaggaacuacacuugcucaucgaucauaacucuaguuuggcuccaguugcaagagcuugaacaaaagucaaugaaagcauucugugagaacuaauuggcuaaauaaaauuuauaaugaagaguauuuuauauuuuuaucuguaaauuguaaggugcugcacauccuuuauuccaauaaaauuaaaaauaagcugacaugcauacuuccuuuuuuugagagccaguuguuaaauauuuaccagcucaccacuggguaagacaauauauuuagaggauuuauuuuccuuuguuuauccuuaaaguuucuaaguuuaaaucaauagcucuugcuaccaugagugagagaaaauuucugucuuccaaaguuaugcuggcaaauuaaagagccccucauuuucagugauacugacuucuaggaaucccaaacuuggaaacuuucuuaacuuggaucuguaagauccauaaacuuuuuuccucaaaacuucuuauucccuguugagguucgggggcucccucugaaaucccucugcuaaccgauggaaaucucaucagucccaucccaaaccucaaugguauuccugcaggucaauucacuggagcacccaggugaggaccacuuuuagaguucagccucgcuguagaagauggcauuaagacaaauguauaccgugugccgguauuagccuuggcuucauagaguucgaguggaacuccuaauaucagguuacauuuuguuggcucaguaaucauuuuuugaaccaccgaccauaugggcagagguugggaggaaagcuaaauuuggaacacacucccacucuccuguucaacauuucuuucuuguuugugcagggaggcaacauuauuacucauacucacauacaguaccaacugcuagaggacuaagaagugagauucucccaaaauguggucggaucacuggagauuuucuauacaaauaugcagcaguucaguaagaacaucugugcucugcuucugcagaugucagaaccugucugugacacauagcacuagaagacuaaauugauaaugaaaaggaacccagggauuucaugccuguggguucauaaauucuuuaucauuuuuaguccacaugcagagauagcaccuuucugaacugauaucuuuuugauucaggcauuuuuagagcauggagccaugaaugucucuccauuuaguuuuucuuguucuagcuuuccuucuccccacacaccacuucauauggaaugauaguuggaacaaagaagauggauauuuugggagaacaacaauaaugauuugggcaguaucugaggaaaucaugcacauuucuuucagcucuggggcuuucuaaaccuaaauacacaaguuguauuuagccuaaagcagcuaaaggucagugccuccaagggguuuagaaacauguucaacuuaaggaaugaaaguuagucugccuuccuucgaggagagguuguagucuucucaccaauagccagcuuggagucauaagggcauucuccuugcugucccuaaauucuaggcauaaaugaggaguagugaaaccaaaucccuuagcucagccuuuccuaaucuggccccaaccuacaucuccaaucuuuucucucacuaaccccuacuccauccuaugcuccaacuaccuuaaaguuuucacuguugccaaacuugcuauucuguuccuucaggcgugccugggccuuuguaaagucuuguaucuguaauauacauaaagcacuuagcccagugcccaugccuugguagguucccauaaauaguggcuguuaauauucugcacaugcugaccuguuaacccguacuuguuuccccuuuuguaccuuuaaaacucaguucaggcugggcgucguggcuugcuucuguaauccuggcacugugggagggcgaggugggaggaucacuugagcccaggaguuugagaccagccugggcaacauggugaaacccugucucuacaaaaaauuagcugggugugguagugugagccuguagucccagcuacuccagaggucaaggugagaggaucgcuugagcccaggagguuaagggugcagugagcuaugauugugccacugcacuccagccagccuggacaacagggugagaaugucucaaaaaaauaaaaauaaaaaugaaaaauucaguucagaugcaucuccuuccucagugacaccuagcccuaggcagagugcuccgucaauaugcuucaagcauuuaccaacaugauggucagguaauucccagugccugggaccuaauuggugcucaguaaguguuuguugcauggcccuggccauacaaaaaugaauaagcaaaguaccugcccauagaaguuccuaguguaguugggggucuugggggguggugggcaaugggaagggcacagacaccuaacuggaucauuguaauguaaagcgguuaaagcacugauugcaguauguacagggaguuguggaaacacaaagguaaagcuucacacccagccuugggucgucagaaacugagcugagucugaaacaauguguaggggucagguggaaagggaagaaaauuguaggcuggcaggauaguaugagcaaugacuuggagaugagaaagagcacggugguucugaaaaugacaugcacuuuggugugacuagaguacagagaagcaagaggugaggcuggaagauuuguuaggggucacaucaugagggccuucucugccuuguuaaggagcuuggucuugauccuguagcagggucuauaaauucacaacauaugggccauuagccuccccaacccccaucccucuccauagcagacauucauaaucacagcaccccacuccacugagcccagaugugacauccuaauccuucugaacauagcacuacagggaaacaccaccaaaagauugaaggcuugaaggcagcauucugguuugcugccuucaaaccuuugguuugguuugguguuuuguucuguuuuguuuuguuuuguuuuuuguuuugagacagggucucccucugucaccuaggcuggagugcaguggcacaaucacggcucacuucagccucaaacucuggugcucaagcaauucucucaccucagccuccugaguagcugggacuacaggcaugugccugguuaauuuuuuuuauuuguagagaugagauuuugccauguugcccaggcuggucuuaaacuccugggcucaaacgauccacccaccucagucucccaaagugcugggauuacaggcaugagccaccaugcccagccagagaaagguuguaagcauguugggaguuugagggcggcaagugagugcaagugaagggagaaggcugacauggucagaauugcauuuuggaaaacucucugggggaguggaugaagaugcagauuuaagaagaagaaucagcaagaccugucuauuuagauguggcagagugagggagaaagaguuguugaggaugaggucacuguuuccaccuugggcaaaugggcagaugccagugccauucagagagaaagcauggaggagguaaugauaggguuggcacaauaauaauagcucauauuuuuugagugcuuacuaugugcccggcacaguuuuaagcauuuuguguggauaaacucauuauauccucccagcaacgcugugguguggguaccauuauuauuuguuuuguagaagaagaagaagauacacagagggguauagaauacugaagagcuaacacaaucaagggcacuaagggagaguguuagaaugauaaaagcugaaaacccacaccugagucauuuggaggacuauggauagagccagccaggucacuaggcacccaugcuaggguuuaucaguucaucuuuaauguuuuggaaaccaaaggauuuaucguucuuggaagaagcccgauguguauaaauccuuccugcccuuaccacaucuguucuacucacaggggcaaacaucaguaggaauaggaauuaaaacaagccuguccaaaugaugaccuaaaugauuuccaaaugcaucuucaaauauaaaauacauccagcauucuuaaaauuaaaagggagauaguuugagggguggcuaguuucccagacucccccagagcaccucauuugaugaaugcuguaauaaaaacacuuccacccacuccacccugaauauuaaaagggcaagguuaggaaggguauugaauuuuaagagaauacaucacauuagauugugcuguuuuuucuaacgauuaacccuuucuuguuuuaauaauuagacuauauacaucuauggguauguauguguauguaaauguauauauuuaugcaauuuguuuaauaacuucaugcuuugcaaagcgcuuucucaugccguguuuauuugaguauuauaggagcuuaauuacuuuaaggaacaggcuauuucaaugacuaauagacguguugccauuuucaucuuagcuucaugucugacucucuugcuaucugggcugugucaguauugcagugugagcacuaccaagagucagguacuuuagccaggaggggaugaauguccaugccccauggccugaacauguagcucaacguuagagucaaggugagcugaggacugaacagcugagguuuucagaccuguccgccauauuugcuguuaacccugaacucagaucaugagaccauggauuugcuaauuaucccauaguguccucuggaacagcuauaaauaaacuacaaaugugcaauuuuugccugaacaugccauucccauaaacaugucuuuaccccaacucaggccauuacaucugcuugugaugucuucaauucuucuguccugaagccugccaauacuucaagacccuccuccuccacaaaacauauucuugauggcuucagcuauccaugacaucucguucucuucugaagcccuuaucuccaccauucuauacauaacaauaacaauaaccaacuagcagauuguuauuuacuaauaacuuugaaauucaucaucugauuaaaucuucauuacaacccuguaagguagacuuuaauauuagcucuuagagaggagaaaacugaguuucagagaguuaaauuaaauaacuugcccaaagucaauugauauuaagagcuaggauugggcugggcacagcagcucaugccuguaauuucagaacuuugggaggcugaggcggguggaucacuugaggucaggagcucgagaccagccuggccaacauggugaaaccccgucucugcuaaaaauacaaaaauuaaguguggugacacacgccuguaaucccagcuacucaggaggaugaggcacgagaaucacuugaacccaggaggaggagguugcagugagccaauaucgcagcacugcacuccagccuaggugacacagugagacuccaucucaggaaaaaacaaacaaacaaacaaacaaaaaaacagagcuaggauuggagcccagaucuuucugaugucaaauucauuucccucuccaccaugcuguaugacccagcacacauagcugaaaaguauuuguugaugaugaugacaacaauccucuuguguuaguaaauagccucugacuuuuuccauggaguugaugcucagaaucagaauagccugagcaagaagaguucugcgccucuguagccuuuuaggguuaagugcuauagagaggagcugaaaguacauugcuccacucaguugggugggacuagucuggauucccagaagauuuuucucccucucuuuauauacauuuccccauaucucucccaugaaucauaguucuucugggugccugagccuggacccgaaaaggagggauugaagagcaugugguauucaaguaagucacuauaugugcuuaggagaucuaggucuacuccucugugcuguacuugagagcuauaauuauugauccacaguacauucuugugccccaugaccauccggccucaguauauccuagacuaucauuugcuggggcagcaguugguuuggacagcuuauucugaagguagcuuuggaaacuugcauaaucuugguacugagagacugagcaagcagccaggcuagaggccccaugugcuguucuucgguccagugccccagcuaaaauaacacauuuagaauuauucaguaucccuuccgcucaucccuaaauuugaaaaugcauacucaugaggaagccuggcuuuuaguaggucuuugguauguuagagaauugcauguuaugggaagucaaaaugaauguuggagugaaucucauucuggcuguaauaauaaucuucacauaguagcaguauuguagccaaugagguuuauccacacaugauuauugcugauuaaaauaaugauaauaauaauagucagaaacauaauagcacuuacugcuaauuguuuucucuaugcugacguuggucuaagugaguguuaccacaguuaaucucuacaaggcccuauggaacauugguaauauaacucccauuuuauagauaagggauauaaagcucagagagauuaaguaaaaagauuaaguaaaugguuuaaggucacacaacuaauaaaugguccagccaaaauucaaacccaugccuuuuuggcuccaaaggccaugaaauauuaauaguagccucugcucuaccacuucccuuucugcugcuucuugguacuccugucuaugccuuguaagccuucagucagcacccagcugagacccacaggaagugcuucagccaauguugaggucagcuaaagaguagugaccagcaugcagcagaaagggacccaaacuguucauucuaaccaugccauugugcuccgcuggccaacccuuaagccucauuacauuucauucucccagcaaagacaguaaagauaagaaugcagauggagugugugggaugcgauaugacuaaauucauuuggucuucuggaacuuuuguaaaaauauaaacagaucugaucuaguuaaauacuccucuucuccuuaggcccagacauaaucacauaauucacagucagcuuugcuggcaagacaaagauuggagauguuccauaaagaagauaucaguuugaaaaaccuacaaccuuagcugaaaaauauaauuuuguucauaaagaugucuaguaggaaauaaccagaaagacugaaauaacuuugaaccagucguuaucuuuggucaauaucauguggccaaugagaauuuauaaucuccccuuuauauagaauguugcuuauauuaauauggcuuucuauaaaauaucauuuuaaauguggguuggugaacuggucucucucucucucucuuuuuuucucaauagcuucauugggauauaauucacauaaccauacaauucaaccauuuuuaaauguagaauucagugguuuuuaguacauucacagaauugugcagugauuaccacaaucaauuuuagaacauguucaccacccccagaaaaaccuuuuaccccucagccaccacucuccaacccuccuaacccccucaacucuagauaagcacuaaucuacuuucugucucuuuggguuugccuauucuugaaauuucauauaaauggaaucauacuauauguaguccuuugugacuucuuucacuuagcauaacauuuucaagauggacccauguugaaauauguaucaguaguucauugugggguuuugcuuaauaacauuccauuguauggcuguauuauuuuacuuaacuauucaucaguugauggaaauguguuuucuucccacuuuuuggcuauuauagauaaggcuacuuguuuauagccaaaaagugggaacaaagaguaggaacaaaacaagcagccuuauuuaucauagcuaaaaggugggaacaaaacacauuuccauccacauuuauuuaauucuuguuuaauuuccuuuaacaauguuuuguauuauucagaguauagguuuucuacuuuuuuguuaaacuuauuccuauguauuuuauucuuuuugauacuguuguaaguggaaucacuuuucuaauuuaauuuucagaguuuauugcaagucuauauauauuugauuuuuguauacaauugauuuuuguauacugaucuucuauccuacuaccucaauggauucauuuauuaguucuaauagacuuugugauuucuuuagguuuuucuacaugcaggaucauguugucuucaaauaaagacaguucuacuucuuccuuuccaaucuggaugccuuugauuuguuuugcuggccugcuuacacuggcuagaaccuucaguaccauguugaacagaauaggcaagaacugauaucuuugucuugcucaugaucuuaaagggaaugcuuucauucacucacucuuaaguaaauuauuaauagcucugagguuuuuauagaugcccuguauugggcugagggaguuuccuucuauuucuaguuuaaguguuuucaucaugaaaggaugcugaauuuugucaaaugcuuuuucuauuucuaucaagauaaucauguaggauuuuuuuuucuuuauucuauuaauaugguauauacauuguucacauuuuguauguuaaaccaaccuugcauuccugggauaaaucccgcuuggucaugauacauaaccuuuucaaccuguugcuggauuugcuuuguucauauuuuguugagaacguuuguguuuauauuuauaauauauauuggucuguaguuuucuuuucuugugauaucucugccuagcuuugguaucacaguaaugcuggccccaucaaguaaguaaaaaguauuucuuccucuucuauuucaggaagaguugugaaugauuguuguugauucuucuuucagcauuugauggacugaagccaucugggccugggcuuuguauauucagauuuccuauuucuucuuaagucaguuuugguaguucauguaauucuaggaaauuugucuauuucauccagguuaucuaauuuuugguuuacaguuauuuauaauauucccuuauaauccuucuuuauuucuuuacaguuaguuguaaugucccuuuuuuaucucuguuuuuaguaauuuaggucuucuuguaauuucauuuuuuucuuaugcagucuugcuauagguuggucaauuuuguagaucuuuucaaauaacaaacuuuuaguuuuguugauuuucccugcuguuuuucuguucucuauuuuauuaucuuuaccucuaauccuuauuauuuucuuccuucugguuguuuuggguuuaguuugcuugaguuauugauuugaaaucuuccuucuuguuuaauguaggugaucauagccauaaauuuuccucugaggacuacuucccugcauuccaaaagccuugguauguuguauguucauuuucacuuauaucaaaguauuuucuaauuuuccuugugauuucuucuuugacugauauuuauguaggauuguauucuguaauuuccacauauuagugaacuucucaaauaguuuucuuuauugaugucuaauuucccuccauugugacugaagaauagacucgacaugauuuccaucauuuuuaauuuauugaggcuuguuuuauggcuuaguuuaaggucuauauuggggaauguuccaugugcacuugagaagaauguguauucugcuauaaaccgguuaauuuuaucuacaggauuaauaugaagcuauaauaaaguacuuuuucagcuuauauuucauauuuuaaaacaagauucagucaauaaucccuucccccauguccuucagaaaagaacaugugauucauaaucaccauucagaucucaggauuaagaacagaacuacagaaaguccuccucuugacauuccaauuccacuguccuuuagaaccauagaggcagcacuuaauuauccacaaggagauuuuuuauuuuguggcuuaucugaagugaccuauaguuuucaaucuuucugccaccccucccaagcucaggccacugauguaagccagcacggaugaggggcauuuaaauaucagaacagggugguuuguuagacugucacugaagccauagggaccggauauguuaaauacaaaaagcccaucugacuaguguucuaagccucuuugguaaccuaaucagauuagcuauuagaaaauggcuaucaggcugggcgugguggugggugccuguagucccagcuacucaggaggcugaggcaggagaauggcgugaaccccagaggcggagcuugcagugagccgagaucgcgccacugcacuccagccugggcgacagagcgagaauccaucucaaaaaaaaaagaaaauggcuaucaggacaccccaaaaaaaguagccaaccuaaaugcgcagagcacaauggcugagugugagugguuggcugaaguaaaugugaugcuuaacuguauguugguaucauuuaugccauuuuugaaagcuggccaugccucaaaaaauacauucuggaacuaauuuccuauuuuaaaugguguucaauauugccuuuugucagagaaaccguucucacuuguagauuuauaagguaauacaaauaaacaucaaagaaauaaaaauauuaugaucaaccaagaugugaguuuaaagacaaaaagaaaaauuuugaucucuuuuuaugcuucuaaauucucaugauacuuaugccauacacauauguauaaguuuauaaagcugugcgauaauaaaaucacagacuuucacaguagguagguuuaagauugaaacacaggagaaccauuucuccugugagauuuuuuuuugagugcuuauaugagcacucuuaaaauccaaccacagaauauccugucucugaguaauaaaauuggguacacuggcuauaacaauauaaagauggccaagaaccaacauggaauggugaaucacuuuaagcauuuggucauggggccaaagaccaggcucuuggaccuagacuguguaucuaauucuacuucaguaaaucaagcuagugaaggcagugggucucaugcugagaaaagaaggaagcccagacucaaaggggucuaauucugcugggagguuaaagaauggaugccuuucauggaauuauuuuguucaacuuagaaugagucguccacagaugugcccauuucaucucauauuuguuuauaccucugcuuuaaaacauucuuuuucugcugggcacaguggcucaugccuguaaucccagcacuuugggaggccgaggcaggcggaucaccugaggucgggaguuugagaccagccugaccaacauggagaaaccccgucucugcuaaaaauacaaaauuaggcgggcaugguggcacaugccuguaaucucagcuacucgggaggccaaggcaggagacucgcuugaaccuaagaggcggagguugcggugacccgagaucacgccauugcacuccagccugggcaacaagaaugaaacucuguuucaaaacacaaaaacaaaagcaaacaaacaggccgggcgcgguggcucaagccuguaaucccagcacuuugggaggccaaggcggauggaucacgaggucaggagaucgagaccauccugacuaacacggugaaaccccgucucuacuaaaaauauuuaaaauuagccaggcaugguggucggugccuguagucccagcuacucgggaggcugagucaggagaauggcaugaacccaggagguggagguugcagugagccaagaucacgccacugcacuccagccugggugacagagcaagacuccaucucaaaaaaaaaaaaacccauucuuuuucuauauagauguauuaaggcugauguuucuagcauaaccaaaauuuguauaaucuagaaauaacuuccauuugcuaauacucauuaugcaagauggaaauugcucuuaagagcuuacgguuuguauuuauagggacacuacauggauagaugccuguggccacaugugucucacauuuaacuguaaaauagauaccaacguccauccagcauagagugauuugaaauauaacauuuaauuuccaaauguuaguuuugcucagaaaaauauaaagccugucugguuagagaagaauuuauggaaugaugcuucagggcuguuuuaauugaaguugugucuuuacuucaguuaaagcucucagggacaguaauga

SEQ ID NO: 18983 - RNA, 45719 nt, Homo sapiens
auacaagcaaacacagaauagaauaauuuuuuauuugugguaaucaacaugaugcuacaaauaaaauuuucaauaguuuuuuucaagccuuggacucugacuuacaagaagcucaguauauuuuguggauuuagugagggcaaagcauagucccuggucugaggacaggcuauccauccacaacucacaaugcaagcaucucagccgggucuauuaauuuuccauacacacggagccaaauucugccugggauuauuaugcaauuuucaaaauggcucuaagucuuucaacuuacaaaguuaccauuuacauugcacuggccugcuggcugggaugaaugaaugaacacucuuucccaaaggaccauaauucauucucugaucauagcuuauacauuugggagcauugggaucagugugccuggcgccuccccuccccucugccccacaaaggagucauacacugcaagagaaggggagacaaaguggcugugugccauagagugcagagguguggccagggagguguugacugugagcagcaccagucuaacauauaagcaacugucuacaugaugugauuucaggugcaccaaaaaaggccucauugccccucaguuuaaacacucccuucccacuggcagaugccuggaauuccacaguuuuuagagcucuguuccuuugguuuaaagcuuugauccuguuaaaauacucguaccccugggugggcagccccauuauaaccuaucaaccauauacacuguaaacggacgaguuuuaaaguuucuuuucugaaagcagguuuugagaguggaguucagggcagaagauacuguguaccugagggauauggggagaggagaacaucaccuggagggcaaaggaaacugggcccaagacaaacaaugugugcguguguggccaugugcacggcuguguaugagcuccucccauggcggcagcuguugaacacccuuucuuaacccucucccagaaaacuugauuuaugcugcuuuuggagccauggaaccagacucuccucccagcuacagcaagauaauagcugcuggcuacagcugggaauucucgaauucuuucaaacuggagacuaggagugaaaggugaagaaaaguucuucugggccugcugugcuagguagccuuccucugggguccaaagagaaagauggggcccaacgguguuaucuaaaugcuuccaaccgggccugaaagcacagaaucaugaauugucaaaagugaacacuagcucaaucagcacauccuuuuguguuucuagacugauuguuucucuuugucucuacuaugaagaguaaggaugaaucacuggccuuacuucuaacacaaggaagggagccuugaaaguuaagacaguuguuuauguaaaagaggaaaagaaaacccagucuuaauccacagucgcccauuugggcaguauacaguauguaauguaacagauuguaugcuuugguuaaggaacuggauuuucaucaguaaaauuccaaguuacuggguaggcagggcggacagcugcucauagcuuuccugcaagcuuuccucaaugucaguuucagugccugaaauuccgcuauuagagucauugcuuagggacuggaagguuagaaagucuuugagaggcacuuauaaaaauggaaccacuccuuaaaccuagcaaguuuuauuaacuccuaccuuagguuggcuaaaagcucugaaguagcugcuuggagggacagcagaagcuuuuaggccaaagaaauauuuuccaaaaccucagggccagcuugccuaugacagcccaaauccuaguuauucacauaucgcccuacacauuuuguuauaucuucauauucccauuacuauuaaauauuuuucuucaaaccaguucacauuuuuauugaaauaaauguaucauggcaccagcuacuuaguuuuguccuaacaaaaucauggguuggauguacuaguuacauauauuuuuucuaauccaccauuaaaauaaauauuuauuaaaaugaaaagcaaaaacuucauugguccacuucagugaacccagggauucacacgcuucccuuugggaagcacugaccuagcucauacaaaguauauuaaauauaaaagcauauauuaaaaauaagucacauuuccccuuuuccagguacucaauacccaguaguugaaaacaacuguugccuuuguaguuaguugcaugagcucuggaagaucaugaauuuaugggaggucaugucuuccucugcaaggucaugaaauucaaucaaugcuugccuuccaaucugcccuuuggucacagggcuccacagguggaacauaucaaacucaccagccaaauuaugacucuuaauugguguuucuuuuaaaguggauaugucauuugucaaauguucaaugcaggcgcaggccuagccccaggcaaaauuaugaaguaggagaagaaugccagauacaucggcggcacucaaauguuuguugaaaaaagagugaaugagcccuccguccuugacuccuucucucccaucccccauaucgacuaggucacuaugcccuuuuaacucuauaugcuaaauaucuccaguaauuauuuccauuuccaaaucuucucugcuacaggacuuuaacauuucuugucuggauuauuuucacagccucuuaacuggucuccuugcuuccagucuuuuuccuucuucaagccauucuccacagugcugcuggagagaucuuuuaaucaggcaaauaugaucauggcaccccccugugcugaaaacuuccuuaagugguuccccaggcuccuccauauggcuucaagacugcauaaucuggcccuugcuuaccucugucaccuuagcucuuccaacuccgcaaccugaaaucauuacuugcaccucccaccuuccaacugggccaugccaagcccucuccccucagugucuuuguuuacacugcuuucuuugccucagcacccuucuccccaucugcuugucucaccuaaacuccuacuggucugaguuuaggacaucaucuccucuggcaugcuuucuccgaucccccccccccuucaccccuuagaacuucaucuuagcauucacacaguggguuaacuugguuguuuuccccauuaguuugcaguucuuugaggucagguaccacggguugguuaaucuuuguauccucauugucuguuuguaaucuacagugccuggaacacaguaggaguucaaauauuuguuaccgaaugaauaaauggaugaaugaacuucccccgugaccuuccucucucuuugucucccuucucagcccauggguccuggaacacaaccuccucucuccggaccuugcacaccccagacaauuuccuggugcugagguucucccucaaaaccuacuuucaccuaggucggaaacaaaaccaucagaugacaaacuaauucaugcugagguguuaaguaauuucaucauacaaauacuuauugaguucucuacuggacuaggguguggaggaucaugaaaauaauccacgcuaaagaucccuacuuagcagcauauagguaaugacuaaaugcauuuuuccuuggagagauauuucauucucaaagaacuggauuucuuuuuuucuuuuuucuuuuuuuuuuuuuuuuugagacggagucucacucugucgcccaagcuggagugcaguagugcgaucucagcucacugcaaccucugcccucugaguucaagugauucuccugccucagccucccgaguagcugggauuacaggcgccugccaccgcgcccagcuaauuuuuuguauuuuugguagagacgggguuucaccaucuuggccaggcuggucuugaacuccugaccucaugauccacccgccucggcuucccaaagugcugggauuacaggcgugagccaccgugccuggccuaaagaacuggauuucuaauggugaaaucuaagcaggagaggugggauuuggguguaggauaccuuucaaauagccuucuacuccaucuaugaaauaggcuagcuuuggcucaguaaauuugcuguguaaugauuuucuaaugaguuaggcuggcuuuaagccccugguuauuucguuguaaccaguuaggcuuugccucuugaagggccaccugggacugucgugcaguagauuuucuuuuaacgccccagaaucaggugcuuucucugacuuuguguggcucuacugaaucaaaucuagcaagccacagaggcuuucagacuuuuaagauacaauauucaaaggugaggcaggcugugaaaagcccagcggucccuggcugucccugaacgcgacuauuugcagguuggcuuugagaacccggucagagcugcguuaggaaaacgguucccgggaagcuccucagagaguagaaugaggagguggauuuugugugaaggaacaccuuguguggcucugguggccaggaaagagcuggcacaagcugaaagaaggccuguggcgaagcggagggggaccuaagucagggacccccaccugcccccaggaaggaugaaaaggagacaaaaauccuaaagggaaaagcccuccaggcuguaggccaaugagcggcgggaaggaggagugaggcuggggaacuucucccagagccagucagagcggacggcugcugggaagccaaucagcgcgcucgagccugcagccccucugcaguaguuaugccagagcgcccuguguagagcggcugcgagcgggcagcugggcucggcugccgggagccaccgcgcgggcuccgcacccuccucucgcacugccuucgcccgguccccgcgccgcggugccccaguggcccccgccgcgcuccacgccgcgcccccgcaccccgccggcuaccggccgcacaaccgccaccgcccccuggccgcgcggcucgccucgccccgccccgucccuccucgccccgccccaccccagucagccccgcccugccccgcgccgccaagcgguucccgcccucgcccagcgcccagguagcugcgaggaaacuuuugcagcggcuggguagcagcacgucucuugcuccucagggccacugccaggcuugccgaguccugggacugcucucgcuccggcugccacucucccgcgcucuccuagcucccugcgaagcaggauggccgggaccgugcgcaccgcgugcuuggugguggcgaugcugcucagcuuggacuucccgggacaggcgcagcccccgccgccgccgccggacgccaccugucaccaaguccgcuccuucuuccagagacugcagcccggacucaagugggugccagaaacucccgugccaggugaggaggggucccuugagcgugccuagcgcccagcggggagcaaggcgcgcgugguggcuguacccugagcgcgcuagccccgccgggcuguagucgugcgcccugcagcugggcacuugggaguggucggugugccuggggccuggcugggucuacugagggagggagagaggguguguguggacggagcccacaucccccagucucacgcugcugucagggaaggugugagcgggaggaaccguggggaucgccuucucgugagcgcccguuuuuuggaagggcgagaaggugggagcuauuuucccgggucucugcgaacuggcgccccacagccgagcuggugccucaugaauuugccauccuugcucgcacauacgugucagaauuucagccuuagcuggaccacagcuccagccaucccuuccccaacguacccccaccccccgccgccuuuacccagccuggguuuccuaagcucacgggcccaagugcaagcaaaguugaggacagauuucugagucugcaguggcgggugaagacacacugaggcaaacuuuugaguaagaggguccccaaaaugaggagacugaaccuuuuccuucaaaacagcaucccuuauauagguuagcgaaaucgcuuuaaaaccggugcugcuggcccagggagcaggaguccaaagauauuuaacuccucccccucccaaauucaucugccuucuugacaggcuggauccuaaaggggagaugauuucagguggaggaaaguuucugaacgccugccuuuuguucugcacaaucagaucgugccguaacgacguauuuuaacaucagccgagggcugccgcugucaacagaugaauauuaauggcccugcgugauugacuguccagcgguugggcuccuaacgcccgccuuagaauccaauuagaccaaauugcuacacugacaaugcggacaagaagagucgguuucaaacagguuaauuugucaggggugcacugagaagaaacggccaguuguauuccguaaccgugagacguuuguggccuccagggucucuucucaacucaggcauccagugaggcgcgcgucccgcgcuuccgagggaucggggagcagcccuagccaaaacuuggcugguggcucucaacaagucauggaggcgggcccgaugguuggaccaaguugugaaugcggaugcgcaccccgugggcgcugccagccaggguucacugguaggagguuaccuaggcagccagcgcgcccucagccuuuucuuuagguugaugaaaagagccgagugagccugcuguuuaguugcaaagguaauuggucacccuuuuuggugacugaaaugcauuugcgcauauguuaaauauugcuuugcaggauuucgcucuaagggagggucgaacuaccucauccccuguuaaguguuaauaauguaccacgugggcaugugcaggagcuguaaggggcaaccuaugaaucaguuccacagaacugaaacaacuggccaaucucucuccccuggaagugccaugguaauuagauuguuaaggcuagagaacaugcuuuuguugguaauguaaaaauugguccucacaggcugagcacccacaagaugaauggguccaggguugggguuggggccacauuuggcugauucgaagccaggagguaaagguggugcccaaaagaagaaaaaggccagaagaaagcacagauagucauuuagcaaccccccucuacacacacacuccugcaggcacucgcccucccuugcucucccccagcucucuggcugccugccucuuugcagcaucuguauaaaaguauugggagggcccacacgcuguguguaugagauuuggccugggcuccuucccucccuugaggccuagggauggccauacacuuauagagaagagggacuuguaauaaagauuuuucauuuuccucuacuauuucacaaacucuauaggagaaaucacuuuucaaggguuuucaucauauaaacccaacguucccugcuuuaguucuauuuaacaaacacaaacacuguugagcaucuucuacauggcaggcacuguccugacuugcacuggagccaagccaaacuucaaauauggugauccccauacagcuaccauuauauauccuggauuuuccgggggcagugcagguuucuaauacucuguccuggcaugaaacugcguguccugaauuuuagugggacaaauauggucacuguagauauggaaaacaugaaaauccuaauguucguguguggaaagagcucaucaguauuuuagggaagagacaauaauggcagacuaaauacaaugguaaguguauaauuucaaagugaauaaauguauaauuugcugcugucguucagugguuggaaauugaaagagagcugaaaauuauuugguaguuaugaaccaucaugaugaccgcuugacuuuccccccucugcauccauauuuuaagccauguucaguuugccugcugcacuauauuaacugcauuaaagcuuucuuugucccagaucaaaugagauucagucacaguaaggagaaauccucaagaauguccuguuucacuuagggggagcauuugggauugacugcuaacuucagccauuagcagaauuggguuagccugaauaagguacauuucuuaugcuaauauggaugagacuaaauggcauuugagaucagccagccuaaaaaauaaaucacuggugcugaaggacuacacuagacuuccacaaagcugaucuaaagccuuacaaucucauguucccauuucuuuuggaguguucaagucacaggauagcaguucuaaauagcauguccccaaaauccauagaucucuucauaccccacuuauuuuuuuaaggauuuguaacuuggaaagcaccacagauggaaaccaggcgcacagaguuagcauuuggcagaaaaauccauauaacugacuuucaguacagcucuuuugcccuuauuuaauuuagaaaaauucagaaaaaagccaaugagcucauaagucuagauguuuauuuuguuuugcuuaaccuacccacaggcgcaaucaagaauggauacaauuuuaggcaaggaaagugagcuaguaaucagacaaugauguuuccaauugucucaagggaauguuacagaagucuggaaaaaaauuccucuaaacaaaaaucaaguguaauucacuuuaugaaugccauacaccacuuuugucgggggagggggguaguguaagggauggauggaaaugagaaaaucaaacaaaccgugguaguguugcaacucccaaaagauugagggaucuugccuuggaaggccuuggaaagugcgagaaccaauccagaaggccaaaugccuguauggguaaaaggcagucuugaacagccaaaauugacuuggaguuucuugaaauagaugaaacaacauaaaaauaaaaagcaaugugcuugaaacaaagagauaguuugguauuuguuuuuguuguuuuuacugugagaacuagccuccguaucuggguugccagcugcgguuccccaauuaguuugaagcaguuagcgguccuaauguccagagagagaauaauaagugagguguggaaggguuuuuucucuucugagauugcacgagacauuugggugaccaggugauuuguuaaaacuuugaaacuuugaacaauacaaaaaacucuguauugugugcuacuuggaacaguuagagaauucuuucaaauguggucugaauaguacacgaauccugauacugauaccaagcugugcuuagagggagccaucaaucugauggaggacauggcugaugauugguggggcaccuugggcugaaaggagucuaacacugccaacuccuuggcagccucuguaauaggugcugggguugcagagaggagugagacacaaucccuuuugucaaggagcucacagucuaguggggaagcauacaaguaaacaggcuucccaggaaacuuguaggauuaaaaagggugaaaagggcuagaaaauaccuccaggaaauuggcugaaauggucacaauagccagccugggcaagggaaaagaacugaagagaugaagugggagauagggagaagucucuuaauagggccgccaucuuaaaaagaguuucuuaauucuuggagcaaauuccauuuuggaagcauuaggaaauacagacauaagaagaauuuuaaugguugcuaaaugacgcagauggcgucaguuuugcaauguguuuuuuucuuaugggcugguagguuguauccaauauuuugaugcaauauuuuugagcauucugcuacuuccaucuuuagaguugcaauguuugcuguucacuguagccuagaaaaaggcggcuuauuacugaucugggggaaaagaguccuggauuugucugguaugagacaagacagaaaauauguuuucucccuaaaugacagcuaucaaugaccacgccaacuucaguguuugaugcauauacaaaagcaugggucuuaagaguuaucuuauuacucauuucuaagaaaauugaagauaaucacuuauaacuugugcacacgauacaucauuuggaaagaauuucacuggggaucauguugcucaacugaaaaguucuggcaugcugaauuuguacauuuuuuugugaaugcuuccuuuuacucugaucucuagcuuuuuuucugcauaugguuauuuguauguuuuagauuauaagccucuuaaagggaaaacacugcauuugagcaguguugagcacaaggccauacagcauuuaguaaauaauuuacaaaaacagaauuucuagaucauuauguguucccuaugaacucucacauacuuucuuaagccauaugucaucuuacauauuuuaaaagccuaaguccaaauuguuacgauacauuauuggggcauguagacaaacuuuucagccuacauauauuuuggcuggagacagaugcaggcuuaccucaguuagcuggcaacucuuaccaucaguagggcuuauuaaauuuugaguacccaaauaacaaauugaaauuagcagcauuguuaugacuggcuuaguaucauuaacgaucaacaauuauuacagcacauaaauuguaggacaucucuuaaaucaagcccucuuugauuuauugucagcuagaccuuucuugcuaagguugauauuaccauauuugggaguugagcuauauaacacaugcauggaccuguugaaguaccucacagguuuuuguaaccugggaucagaacucguguacagacucaauucaagagccuauuccaggagccaaugucuauucaguccuagccaaucuuguaaauggguuagauguuuuugguaaucugcgaucuaagggacagugugggcagaaaaaucucccacucaucugcccauauuuagcaaauugucuggcuugaaacaggaucccuggcacuccauuaggaaaugagcaucagaaaauagaauccaaguuacaggccccagacuggcuuuagagacagcauaaaguaaugggaauuuaccuucugagacauaaugacagggagaaugcuguucaaaaaucaaggugaagguggguauaucagcagagaaaaugcguguuuugaaaugcuacguguaucagggggugguggugagaaugcucauuggaacauuguagccuuacuugaauaucuuguugaauauacaaaguaaagaagauuuaguucuguacuucuaauuagggcaauucaagaucaauuagacaaguguuaauuauuagaaauacuuguuugcaauuuaaaaaaaugaaucaagauugauuacuaagagauucauuuuucacuuuucccucuuuuuguguguagcuggacaaagccuaauuugagaguuuguauuuuuccucaugaauaaaaggaagucaauguuaugaccaaagugcauugcuaguguuccgaacaguuaauuacuucuaguagcugaaauuguauuuauaugcuagauuaguaaaucuacuaagcucuuugaagcguacuuaauaggcuuauguugauaaauaauugauaggaaggagauaaaauacaaguggaaguggcaauaagaagggaagucaaaagcuguuauaaaagaaacuuccaccguccagccaucugaaagcugaaaaauguacaugucucaguagaagugauguuuuugaaaauauucuguauuuuucaaaauuuccacagugaagcauauauuuauuccuuauaaauccaggagaagguacaauuuuagaguaaaauuuuacauggccuuuuugucugccuuuugcaacuaaguuuauuacuggaaaauuagaaguccccauuauggcaacuuugaaguucauguuucuaaugauaucuucccuacuagacugugaucaucuugagguuagcggcuauauuuuauucaucuuuguaucccagugucuagcacaguacaggguacaaauaauagguacucaauauguauuuauagacugaaugaaugaacggaguuagaaauguauuacaaacauaaaauuuccauaaagucaauauuuaaguaguugauuuauuuuuaccaauauacuaagguuuuuaaaaaaguaaccaguuuuuuuuuaggucaaaaauccauuuguuuucuauagguaagugauaaaggauauuaguuuaauucauuuggcuauacuauaacucucuggaagaaguagacuaguuaaaucuuauaagagguaaguauuuugugcuuguuuauaaggauauuauaaguaauuucaagacaaauugaagauauauuauacauguauguauaaaugcauaugcuuaucuucaccuuacagaucugugguauuuagguuugugaaaauaaugcaacuuggugccaguuacggaaacauacacugaauguauguaaguuuuuccucaguguucggcauuucuuaccuaaggcaucaagcuucauaaauguacauuuaaaaggacauaauccaggcugggcauggugucucacaccuguaaucccaacacuuugguaggccgaggcagggggauugcuugaggccaagaguuccagaucagccuggccaacauggggaaaccccaucucuacuaaaaauacaaaaauuagcuggacauagugguacauaccuguaaucccagcuacucaggaggcugaggcaggagaaucgcuugaaccugggaggcagagguugcagugagcugagaucauaccacugcacuccagccugggcgacagaggaagacucugucucaaaaauaaauaaauaaaauuuaaaaaaggacauaauccaaagugaauuuuccgccauggaaauuucauuuggguaggauaaagggccucaugagaguucucuuaauuucugucugcauuaggccaaacuuucaauuaguugccuagguaaacuaauugaaaguugaugggaaguucuuucaaauauucaaauagaggcccaaguaggaaaaaggauaaaaaacgaagggaugauguucauuugaaaacaaaaaucagaauucuauuugcauacucuucuccuuaauuauggcucugcucccucucucccaaacccugcauaucaguacuuacaguguguaucaugucacccugggauucuucauugcucuuugucaaacuuugguuugaaugauugaagcugauggaaacauggugaagggagaaagaguuagagugacagauauagggaggaguuuaaaagccuucacuugguauauauuagaaaguuagcuggcauacgacagauggaaaggauuggaaaauauuugaguauggaaauuugcaugugugcagagagaauacagaaggaugucccaauugcauuugguucagagaaauacuuuaucuguacuucucacuuauuauccauguuuuuugaaauauguagcuuauucauggccucuuccagacccuaugcuuauugaaugcagggaccauguuugauucaucaugauauccucuagaguggugaguagagugccuuguacagaguuuuuaauggauugauuaauuaguuggaaugaauguaagaauaaacaccuaaagacauagucuagagagcuugaccacuguccagugagauccugggguggcauauaacuauagaacauugauucucugaauguaucauugucuaaacuaauuugcagcagagacagaagggguggugaauuugaagcauauuuauuuauucucauuggcccugggagccuuguugccccucauuuauuuauuuauuuauuuauuuauuuauuuauuuauuaucauuuuuugagacagagucuugcacuguugccugagcuggagugugguggcacaaucucggcucagugcaaccucugcuucccagguucaagagauucuacugccucagcuacccgaguagcugggauuacaggugcccaccaccacacuuggcuaauuuuuguauuuuuaguagagauggcguuucaccacguuggccaggcuggucucgaacuccugaccucaggugauccgccugccucagccucccaaagugcugggauuucaggugugagucaauuuugcucccuggcgaguugccccucuuuaaaacuuacgauugaagaggagaugacaaguaaagaaauauuuuuuaacuauagcuuuaccuaagugugguguuuggauauguuuuauguauuuauauucauagauuuuauguauguauagaacgauuucuauuauuuagacagcaauaauuaauaaauauuucuguuauuuaaacuguuugaaaguuaauuguuacucuaagcaguaggugguauuucacagucauaccuuacauuugucucaugaaagccuugcuuucauauaucucauguacacacaaggcaaccacucauaaagugucugucacuucugacuuccagcaaccugccugguuccagcacacauacacacacauauuuguacacucauauacacauauauaauaucccuacaucuuuaugccuuuaauaaucuagagacuaagccuaauuuuucugggggagagcuaguggguacagcuuucagagauugaguaaaccauuuucaguuggauuggccugaaauuguagcagagcuaaucgucacugauaucauagagcuaccacucuuaaaaucaaguuccaucauuuccccaaguacacagauguuauccuuguuaaguagugacagucaccaauaaugcuaauuuggcccacuuuggagaacuacuucuagcacuggcagcuuugcauguugagugccauagaaaugagaaugugacccaagaagcaguuuccagguuagguuucauggagugauugcacugaggaccacaguuaucuguuuuggaaaacagauggaaauuugcagaaaaggaacucacuaauaaugaacuuuauaugccauuucugcauaaauauuuaaaaguuuuuaaaauuuauucuuacuucaaccaacauuuauugagcacugauacuaugccagguacugagcuaggagcugaugaacaagauaaaaucacugccagcaaggagcucccugccuagagagggauccaggcaaggaaaaacauagaugccaaggcagcaugacuguggccugcuauagagcugggcaccauguggaggccugagggcucuugagcuauggaggaauuugccuaguugucuuaagagggcugaguucaaggcugcagugagcuaccaucauaccaccacacuccagccugggugacagagagagacccugucucaaaaaaaaaagagggggcuuucauguaaagcauguacaaagguacagaauuaagaggcaaaaugacacaugacacauuuguuggacuggaauaguugggauuucuuggagcacagauguggaaguggagugaagaugaauuagaaaaauaggaaaugcugaggaguuuggguuauacccaaggaugaugaggagccuugaaaacauuuuaagaagggaaacauuauucaguuggaggaugacuggagagugagcgguggcagggaguuuuaguaacacaggugauagggcaggggaccauaaauaggagaauaaaagcuaaacuugagagaauagagggaguagaauagacaugacuuagugacuggauaugaggacagaagggagaaucuagaacuuuugguuuuucugggugguggugcuguggcacauaauaggugcuugguaaauauuuguugaacaaaugagugugcuugaaauauaggaggaacauguuuuuaagggcugaaauaaucaguuugguuucaaacagauugaguuugaaagguccuuugaugauggagguagaaaaugucugcuagguaguucaaguugcguuuuggauuacaaaagagggagaaaucagggauggagauauauacuuggaaauuaucagcauauagaugguaauugaagcccugggaacagaugaguucacugggaaagaguguauauauucuucuggaguuaaggagaagcacauaguugggacucaucagcauauaggcuuaaguuggaagucgugaguguggaugauauuuuccaggcuuuugcauguggcauguauuaaaauguauuuugccaacaucugaugauuuaaaaaaaaaaccugccaaagacuucaagaacccucuugauuaagagaaaguaugaguauauguugucaugauccaagacucugcaaauaagauaauguacuaccaaacacacacacgugcaugugcacacgugcauacacacacaucucuauguagaggaauauauuagaaucaaagaaucagacuucuauuauucuugauaguaauaaugaauaauuaugcauguuauuuaaauggaaaggcuggacaugguggcucacaccuguaaucccagcacuuuugaaggcuaaggugggaggacugauugagcccaagaguucaagaccagccugggcaacauagugaaacccugccucuucaaaaaauagaaaaauuagcugggcauaguggcauguaccugcaguuucugugacucaggaggcugagguuggaggauugccugagcccagaggcagagguugcagugagcugagaucacggcacugcacuccagccugggugacagagugagacuuugucucaaaaacaaaacaaaacaaaacaaaacaaaaaaaacgcugaaaguuauuagcuguuacucuuagcaguaggugaucuuucacaaucacacauuacauuugucuugugaaagccuugcccucauauagcucacguacacacagugcaaccacucguaaagugucuguagcuucugaguuccagcaacuuuagugguuccaacaugguggcuccucugucccucccccagggcaguacuuucccaauguaaagaaugaaaacuguaacaauauguagcuuuuggagcucuggucuguauucugcuucagacuuggcccugauggcuggucucugaaacaugugguuccaaguaaacgcuaggaauacuuguguaauugggcugaucuuucauaagugucuauggagauguauuauuuuuugguuuagggguuggggaggguuguauaauuuucuguuucucuggcauaaaugguuucuuucauuucucuguuguuuaagagauugccuucaucaguguuucuuucaacauaagcuugaaacuccuuguauuccaguugauuuuuugacaccacuuucagguugguggaauaguuuagaaggaccacgagggaagauuauggaaauuaaucuuuacugagugccuacuauaugucaauuacuuuauauuuaaccucucauuuaaucaacacaggaaaccugaaagguagguggugucagcuccauuuuacagaugaagaaacugaggcucagaaagguuuacuuacccaaagguuguguaaguggcggagccggaauuuucacccagguuugucuuacuccauagcucaugcuguuuccagaauaccuacuggaguaugagaggaagggauauagucuggauauaaaguauuugacuuaaauucccauacucugucaacuucugugacacuguguacucuggguucccuuccuacucgcuucagucuuugcuuguuugcccucuuccuccuacacuuuggauguaagugucccaguaguguuugucuuuugcccuuuccguucucucuuugcuuauucccacauccauucccaugacuucauuaucuuugcucuuugaaugauucaaccugaccucuuccuugcucuucagcucaguauuucccaguugucugcuggacauguccaucuggaaguccugccagugcuucauuuucaacagagccaaaaauuaguccauuauuuucuuuucccauccacacaaaccugccucuccuuaacguucuauauuucuggugaugguaucucugucuggcaccaacucgaaaccuugaaauugucuuugauuucuccuuuuacccaucccacacccaaauuaagugacuaaaucuugcaagucuaccucugucuauuaugucucucacucuuauggccuuggcgugcaugcccucuauuuaaguauaacagacugagccaaugaaugagaaugugauauugaaugggcuagggagagccaguaggaucucugcucaguggcuaauaauuuguaacuaguuggaaaguacugccuuugcugccuuagauggguagaaccucuagucuuggccuuggcuuaauuuaaugugaccagaggcagcuaucuccugagaucauuuggcucuucccauagggaacuaaugguuucccacuuuuucuuuugcuggcauucugggguauaucuuacuuggccaucuccagaagucagaguggaacuauugaagaguuucaaagagcuguggaagaacugugcucaguguuucaaauaguccuuucuguuuucagaaacagguuuucugcuuuguuuucaaacuucaaaguuuauuucugaaauaaaggauuauuuuccccaugguauucugaagguuuuauacaaguguuaauuucuaaaaccuaagucauuucuuggcuuuaaaacuucagugcugugggucaauuuaauaacguugccugaaggguuuuuuggccuucaaaagcugucagauugcuuuuucuuuguucuuugagaguguaagguugccucauuuaugaagcuugaaggagauguuggaaccagcauuuauucaaucauucagagucuuuucccaacaauauccaguuuuagcuucaaauuagauccuagugguaaugaaauuuacuaccaacuaauaauucgggguaaaauggguaagauucuugaaaagcuccucaacauuucauagaguagugauaagaaguagccuagguuacucuaacacccacaguuaaggggaacaacggauguucugugcacucucaucacagcccuccuggggcucaauauaccucugaagcuacugagggcccuccuucugucuguuggacuguucuccgcaucuuccuuucuccccuuccuccuacccucacacccucucucaacugauuauaauuuagaacagaaggugcuuuaugguuuuuuauauuuauuaaaugguuuuguuucuuguucucucuuaaaaaaaagaugaguggaauguuuuauauuuuccucugcauuuuaguuuuaagcuguguuuccuuuccccguagcuucugauuuccaucucuccucucucuuccuccauuuuccucugccuucuccacuucugucuguccucaauggagagaaaacaggcuuucaauuucugcccacauauuuuauuuggguaccugguuuacuuaucuugagauauuguaaaauacuauucuuuaguuugaaaaugaagagcccuaaaauauacaccaaugaauuuacauuccauuuucuaagaacugaguauuuaaaaagcuuucuauacagauagaacaaggcuagaugaccugacuuguguaccucagaucauugcuauguaguuuacauucugucucaccuugucauaacucucaauaaaugaaaauugcaucuuuguucuuagaaaucucuuuucuuacauugaaugcuuuccuuuuuucugaagauaagggagccccuuugaaacagcgcuaguguggguuaaaacugacaccuaccuuguaagcuaaccaaauuauaaccugcuuuucccugaugaaguuaucacacuucagggacauuguuuugcuugugggguuuuauugucccaguuucaauuuugacugcagguuagagauuguauuccaauuggacuauuccuugguauuuuuucucuuugucuuuauacuuauggggcucuguuguuuguccuguaucuauuaucucuuccaagcuuggccaagguuguuagguuaugcacuuauguauaaauauuuaacaagauaaguuagacaaaaugugcuugaagacauuuaagcccuguuccccaccuucccaccaccccaccccccagcucauuuuuuugcauagagucgcagauaguugcuuuaucucagauguuuagauuuggaggacauuccuuugcacuuugcuugauggacacaauuaaauggaagccuuuuagucaaucuugacuaccaaaauaguagcaccaaguaacagauaacauuagguucuucuuccuauuuuuuuuuuuuucuaacugguuauccaaacucccuuaagccagagaguuuuagguaugagauuguguguuuuuuaagaaaauauuacggauaaagacuaauguucucaagucaggaauaacaauuaguaccauucauuaaucaggaggcauguuuugacucuggguccuggcuaggaaauauaaacugugaaagucacacauauauaugaaccucaagcaaauuuaugacuugucagccuuuuaagguuaaauucuuaaccccagaucggagcuggcuuuauauguggagcccggcacauuccucugggccacugagcacgccccuccccagcccuuugcuuaacagcagcuaguggccuaaugagcaagaaggauuucugucucuuaucagcugccuaaacagcaacaggaaggcugauauacggaguacaggucaaaaccugaguucuugaaccaaaaagcuacaaggucaguuuaaaacucuagauaugugguaccgcuauagucaucaauaccugucaguaaaggaguuagacacuugaguucaaacaaauaguaauaguugucaaaaguaugaaucgucuaauuaauuuugcuaauaguucuuuccuucuuuguuuaguucuuuuagaaauagccuucauauacucuuuaaugagcuuuuaguuugugccuggagguuguuauggucguguaggaguguuugauugucaucuagugaugaugauggaggcgaggauauuuauauuuuggcccagauuuuggaaggggcugccaaauaaagguaaauagauaucuacuacuauuuuuauuucuuuuuaaacugggguuuuuuugcauaugcauucaacuugccauggagucagagaaaccuuugugccuccucauauugcacucagauguuuuuuuuuaaaggagaaauccucauugccuguuucuuagaugcacuuggaauccaggcucagauucacguagaauaaauauuuuaggguauucagugcccaucauagugaaagccccuugacuuucaucuucugcauuugcauguuuucagagacaauaaugaaaacuuuuuuucagauucuguuguguuauugaaaauccuauuuacauaaacaggcauuguuguggcuuagggaagaauguggggucccauucuuuagcuccuuguauaucuuugcuaaggcucgucuaaauagaaguaaugacgcuuuagucuaagcagcuuuucucauuuagguaagcagggugguuugaaauuucaguuuacuggauaauugagucucuucuucuuaauuauuucaggcaugcagguugcucucuuuauaguaaagacccuaaaaaucuaguaaucuccucaggcauccauuugguaauaaaguccugugcauuuucagggguuaauuuucaugacaauuguguguugccgcuccacccccaccccugaagaaauucugcuguuuuagagccuuggucuccucacaguugcaaaaacacacuuaaaaauauauuaggauguugcuggaauuacuggaucuagaggacauuuaaauguauucagauucaugcucauuauacaaauuuaauuuaggguuuuuaauagccuuguuauauuucuuggaaaaucaugugccugacuuugccagacuugguuuucugcccugaaugaaaaauggguaucagugcaaaagugcagccuaaguauccccuauucuauccuuuuucucuucuuaaaaaacaaaaacaaacagaaaaaacauucacagaggucaucuggugcagugaggugggaaaaacuaaaaaggaaaaaaaaaaaaaaagccuagguugccuucacaucugcuagucauucccacuagugugacuucaauucagcaaguuuuuauugagcaccugugaugggggcggugcuaauaaucguuaacauuuauugagccaggcacugugcuaagcucuuuaugggcaacauccuacuuaauccucacaacagcacuaccagguggauagcauuguuucccccauuuuacagaugaggaaacugaggcuuagagagguuuaaugacuuguucaagaucaaauagcuaugaaauuaaucaaacccaguuagucugguuccagagccauguuccuaaugauuacucuugugauggguucagcauuuguaggaauuacuccucaauucaguuuugagaacccaguaugugugagaugcuagggauucaaauucaaauacuccccucucccugcucuugguaggagaagcagacauguagacagacgacggccauguauggagugguccccacguugauugagggggaaagaggaagaaaugggaagaccaguggcuugaaccugugggaaugcuacgucacgaaggcagcccagcagccugggguuauagguauuucuuuuccuguuuggugaaggucauccuuugaguugaacugccucaaugauuguaucaaccuguuuccaucauugccucaacccaguguagcaucagcuaccuugaacccagcacuccuaagacaugcauggucagcacaguuugggccaacuggccucauagugucaccauuucccuuucaguuuucccuuaaaaaguaaaaagcaggcuggacacgguggcucaugccacccagcacuuugggaggcugaggugggcagaugacuugagcucaggauuucaagaccagccugggcaacauggcaaaaccccccaucucuacaaaaauaaaaaauaaauuagcugggcagggugcugugcaccuguaaucccaguuacuugggaagcugaggugggaggaucgcuugagcuugagagguggagguugcagugagccaagauugcaccauugcacuccagccugggcaacgggaguaaaaucuugucucaaaaaaacaaaacaaaacaaaacaaacaaacaaaaaaacuaaaaaauaaaugaggcagauauuccugaaccaaacugcuguccucucaagagcuggugguuuucugaagacaaguuauauaagacuggcaagccacagggagacucuggauccaggcuugguucauuccgcuugaucuagagcccuccuggugcuaccucuuggagcccacacugggaucuggagaucucugugucugaaucacccacgauuugaugggagaaugaaguuacucuuaacuguuuuugaguuuuucacuaaaaucauaggaauggaagggaaaucuccaaaucaccuguuuggauaauuuauuuguguuuuucauagcuccugaagaaagcaaggaguaaaaaaguuauuacugagcaucauugaaaaaucuuuuauguguugcauucauaaccuaauauuucccucaauuuuaggaaacauuugguucagagaaaagugaauucacuaauguacguguggguguuuuggaaacaauguccucuagcuuccagugucagcuuaccaagaacucuugugucuccaaguuucuuauaguugcucugcagugcuuugcuugccaacucuacuccugugcacuuucuccuccauuaaaucucuuccacagcaaaggguugccaccaagucuagacuuuaguaacaugcagaaggagggugaauuagugaggauucugauuugcauuacaugaggguaggagaaggaggaaaaucuauccuucccaguccuucagauacucaaguucuaacacaacacuauguugaagauguauaaaauuacuggagcauuuacacagcuauuccccaagauggcauaaaugccacagcacuagagcacguuaguauagacacucggauaagcugaagaaugggaaaaaggaaaagaucaauaacagcgcuucucacucggggaucaagagugaguguuugauuuucuuuugguugcauuuugcucaggugcaguguguauguuguacuaacaaggcaacugauuccuuuuuccacagguuccuaucauagggaaaggggaaagauauaauagagggcacggauuauuuacaguggccgagaauguaauuacaaggcgcaauggcuugaaacugaaauuuaaguuagcuauuagagcugggagaagcaucuuaacaguaagggcaguugggcauuggaaagauuugccugggagcuuguuaaacaacaucuccaggaaugcugaagaccaggaugggggaaugugaagaaaagcucauaucaaauucagaguugugcuggaggcccagacugaucugcaucuuucauuauugccuagcucccuuuaugauuauucaauugcuaauagcuugaaacaauuuuuuucauguauucaaaauaugccuaauuugguaagcauaacaaaagaaaugccuuugagcagugagaaugaggcuuuuagacuggucugagcauucuucuaacagacuuucuggaauaugggccaacaacggagacaauauuauuaguauuuuuugcuucugcaagacuuuuuccuucuuauuauaugggacuauugcuguuaaaguaguauucggccucuauuaauauuacuucuucaaagcugaccuuacagaaaauuugguuuuagucccuguuuaucuuuuucuugaucuuuccccccuuuuuaacacuucuccaguacuauccagguguucuggguugccucucuccccccuacuccuucuauccugugcuagaggaagauuccuaguaaagucuuuagcccugagguaugagggcauuacucacagagugcuauacaugaagacaacacgugaugaaauggcuuaaccaaaguaguaacucaccaaugaugaaacauuuagauauuauuaggcagaaacauuuagguuggguagaggaggaaagagaguguauuaguuuccuagggcugccauaucaaauuaccucaaauuggguggcuuaaaacaacugaaauuuauucucucacagcccucauggucagaaguccaaaaucaaugggucagcagggcugugcucucuucauagauucucagagagaaucauuccucgccucuuccggcuucugguggcuccaggcauuuuucgguuugugguuguaucauuccaaucucugccuccauccucacauggccuuuuacucuucuugugucucuccucugugugucucuuauaagggcacuugucuuuggauuuaggauccaccuagauaauccaggaggauugacaccucuccaguccaguccuauccagguguucuggguugccucccuccccacuacuccuucuguccugugcuggaggaagaucucuagccugauccuuaauuacaucugcaaagacccguuuuuccaaauaaggucacauuuacagguuccaggguuuaggacauggacauauauugggggugggggggggugacaccauucaacccaccauauagaggagagcuuucuggggccuucugaaucauaccaguuuaccagaacucucuacuguaaggaggaacuuguuugaagaaaucuuaaaguuaguuguaaagugucagaaaugucagugcgcuuccugagagggauguggguggcaacuacuguuaacucauuuuuuaaaugguuaaauugaggaccugggaaauaaaaugacuuaaaguuaguuguaaagugucaaaaaugucagugugcuuccugagggggauguggguggcaacuacuguuaacucauuuuucaaaugguuaaauuaaggaccugggaaauaaaaugacuuacccaagucacuggaucagaagaagaguucugaacaagaucagaaaaagaggucugaaacaaugagucuuacccaagucacuggaucagaagaagaggccugaaacaagacagaucuacuucuggccaccagagcugugagagaauaaauuucaguuguuuuaagccacccaauuugagguaauuugauauggaagcccuaggaaacuaauacacucuuucccccuuuaccugaccuaaauguuucugcccaauaaugucuacaugugucaucauuggugaguuacuacuuugguuaagccauuucaccaugggcuuuaggucuuaccucaucauucuuguugaacuuuuuuccugaaaaaauauaauauuuuuucuaagcauuuuugccacgggaaggcaauuguugcuuauuaugcaccugaaaaaccuuuuugcaggaucuguaggaucaaggcaguggugcacuugcaaucuacugcagcuuuccaccuggucuuugugguuugcugaaagaucagcuacagggaauuuuagaagccagaacaucugugaagcaaaagccuuccuuuuuagauucaggcauacugaguuuuagguacaacuugcgugcaaagugguaaauauaugguuuucacagaugagauauucucugaagaaaugcugucacacuuguuuaugacaaaaagaccaguucuaacauuuauggcuguggggcaucucuccucugaugcauuaucagagcauaccagugacaacuguggugugucaagagauuagugaguuagaguguggccuucauggaaacagagagaaaggaacccugggggucaccagauucagccucccuccuaccuaguguaggaguccauucugugguauaugacauugcuacccaaauuaugccugaaugccucaagagacagggagauuacuauguauaggaaguaggcugucauuguugacuaauauuuguucauuaauucagcaaccauuuauugaguguguacuauguacuggacacuaggccaugucagggaauacagagauggccaaaauauagcucuugcccacagaaaccuauaacuuaauaguagggauaagaaagguauaccaaugacuacaaaaccuagauugcaaaacacauuguuagagaaguacaaaaugaacagaaaauucugagagauaacagcucaaagaguucauuuggagaggaggggagaaacaugaaagacaccugagagagaccuuauggaugagaauauuuuaauagcugaagcuagggaaagagugcuucagagacaggaaaagcaugagcgaaacagggaagcaggaaauggaggcauguguuuggaaaacauuaaauaagaguuuaauuuaauucucacaacgaccuugagaguagguguuauugucuccauuuuauagguaaggaaacugaggcucagagauuaaguaacuugccuaagaucacacagcuaaguggauggccaaguugagguucacauucuggucugucugauuucagaguuuuucccuuugccacugcaugccauccaucaggaggauaucugccauuaguuggcuucuggagauacaggggcauauauguaaaaggacaugugguuauuacuugggauacaaugcuauaaaggccaacuuguuggucuuugccuuagccccauauccguauucauguaucuucaagugauauugacaaagcguuccuaaaagggcgaaagcaaguccuuugcuucuuuuguguccucccaaugcccgguugagaaugggcucagugaauauugauuacccuacaauugggaaacuuagauuugcuaguccaaucccuuugaggaaaacaggcccagauuugggaacacacuugauaaagucacacagcugauuugguagcagagcagauaauaacauuuuagcuuugauagggaagagcucuuuucccucugaugugauuucauacauguuggggagggaccuagcacuuagauugggccuaggguguugaaauucucagcucugccucaggucugcguauuuaaagauuguaucugaaaaauaaaaauuaaacaucuucugaaagacagggucucagcuacuuaucugaguagaauaacaauuagugaagaagugacuaggggaggcaggaaaauuaccucaguuuagucccucuggcagaauucuaaacuagaagauucugcaucccaacuccagcauagcuggcauuguucuccaacccaguuuucuuuuuauuaggguguuuccccucaucuaaauaaucaaugaugugcguguaugugugugaauacuuucgcuuuucuaaaaguugcucuaguagcaucaauuaaucugacccaguuccuuuaaaacugaacucucuugaaauucugacauuaccuccaagugaaaggggagaacaucaagcccaaacuacaaugggccccuugagacacaaagaugaaucacucaaggguccuucccucaaggaacuuaaaucuaguggaaauaaggcaugcauauauaacuuuguugcaauauggagagugugagaagugucuuuauaaagacuggagaguuccgugggaauucaauggauagaaagcuuuuggaguucaucuccuucugcucccauaaacauucuuucccaugggaauccaguccaaagauaacgaguagucaucuuauagcaggguucacauagcuccuugucaucuggcuucugccacucuccaccacuucaauuuucccuuuagccuugccagguuccuuggcagugccugaagaugccacccacuuucacaccccugugcccuuacuccauuuucuuggagguuuuuaaagaaguagaaugacauaaucagauauguacuuuagaaauauuucucugggacuuggguggagaaggguauagaggcaggaaggccaguuuggaggcuguuguuaguuguccaagugaaagaaggugaggugaugagggagcaauggaaaggaggggaaugauuacauuuagaaagcaaaaucaguagcauuuggugacauuuggcuauagcagaugagggugugagugaaguauccagaaugagugaaagguuucuaguuaauuugagaguccauuuucuauaccaauucaugaacucuggugcagggaccauguccuguucauuauuauauuccuugggcugggcauaguccuuggcauaaaguaggcauucaguaaauguuggaugaaugaauuguucaccacuuuggcaagguggauauaauccgugaauuuguauucucagagcacauguugaccacugguugguaaagugguccaggaagaaccucuuuaugggagaguguagugaucuggggauucaaccuuuacugggcaugaaaugauaggcaguuaauugacaguuggcaguagagauaaagguaauucuuucuuuaauuuucgggcuuagagaauggcuuaucuccacgguugcuuuaaacucccaguacuccagugugguagugacauuuuggccugccuuuuacagaggcagaguccaugguggccccaggcacggucuuugauuuaaagucugagcuccugauacccaggugcgcccucugcaaagucauguucuuucaggcuaaauaacagaaggguaaccuucagcuggguucccuaagaugauuucuuucgccagcaaucaucacuuuccccaccgguuuuuaaugcagccauuucuuucaucuguauuccuaucuugauuugugagaaauuaaaugagcauguaagaugugguuuagauaaugauuaauuaggggaaaaggcgucauuccaauagcaagucacuauuauaugcuaaggaaauuaguucauauuuuuggauggcaaauugacuuguccugcauuuaaaaagauaccuuuuaaaaaaugccuguuauggcuuuuuuugguucauuaguagagcaaccugcacuuaauccuuuggaugauuuuaauaggcaucuauuauuuucccuacaagucaugaagcaaccaguuugggauaucauuaauucuuuuguuuaauauuaauuuaaugauaaugcauuauuauuuucagcacaaaguacuuuuguuagcaaaaaaaaaaauaaucugccauucauaaagcagaccuuggcaaugaaaugugucaaaucaucauauauauauauagaaaagauuucaauuuucauuguuacugagcccugaugauucauucucuucuguugcuguuugaauaugcuuuaucugcucuuagaaaaguguaaggaucaaggucuacauuaauauuuuuucuguucuuuaaugugauuuuugacaauuuguaguuauuaacuaaaauugcagucuaguaaaauaaccaacauauagaacaugauaaagguaauuagagaaucagagaccuggaagugaccuugagggauuauuuaguccauuucccaauuucaagguguauggcuaaucuuccuaaacagcacucuucaucauauuaugucucugcuugagaagcuccagugguccauuacugccuaggagucaagcccacaggucucugccugcauucaaggcccuucaaauuugggucugucuuaccugauaagcuauuacgccccagggucuagccagucugcaguuauguuagcuuugccccguuauuccacuguuuccaaacacauuucacccauuggccucuccacaucuuuuccauucuguauggucuaccucaagccucaccuucuccuggaagucuucuuugacuccuagagccucuggugagcauucccuuauccagcaaauguugucuauaucacauauuuuaaaagucaacuuuauugagauauaauuuacaaacaauaagaugcacucauuuuaagugaagaguuugaugaguuuugacaaauguguacacccauguaaccaguaaccuaauuagaauguagacuauuucuuccaccucagaaaauacacugcauauuuugucacguaaccguauaccaacuuucacuguucucuagcuauuauuuugugugaaagucuagucucucagcaugaauuuaucuuugguuuacuuuuaauuaaugcauauugaauauuuacuuuguaucaaaaagacuaagagcuucacaugcauaaucucacuuaauuuuuguaauaacuaaguacuauugaugaucccauguuauagauaagggcaaaaaguuagguagagguugaauaaccuacccuugcuugugcagcuagcaagugauagggcuaggauuaaauuguaaacaacuugaccugaggaaucauaaguguuuuguuauuugcugcccacuagugccugugaugauacugaccucgaagccauuaaugcugauuuggaauaaaaauccaauagaacugacacauugaaacagcccuauacacacuguuggcuuuccucuuccaaguauggacagggauuaggccuggaauggggucuccaagugaaugugguaagcauaggacuucauagcaaagagaagcugaagucccacuccugggggaggugacuaaagaaaaccaggagcagucuaaaaggucagauauuuaaauggagcuaacaaagagcgagaagugggcccaaaggaaagagucugugauggaggucaagaaggccaagccacagguagccaggccugaaaagaucuccugucacaagaguaugccucagaagaaagccuucuguggaccaucugugguuagccucuaggaguggaguaaucccccagaagaaaagcuuccauagcucaaauauccccuuuuacuuguaugacuggacccaaugugcgagaaguugucuuaaaauaauuaguaauaaauuacuucauaguucauucaacugaaacaucuauuuauuguaucuucaagauguuuggaauuuuuuuuuuuuuuuuuucgagacgaagucucacucugucucccaggcuggagugcaguggcacgaucucagcucacugcaaccuccgccuccuggguucaagcgauucucgugccucaaccuccggaguagcugggauuacaggugugugccaucauugccuggcuguuuuuuuuuuuuguuuuuuuuuuuuuucaguagagaugggguuucgccauguuggccaggcguugguaguuuacuuuuuugguauuuuaaaauauuuuuccaagauccaaguuaaguguacagauguaacguuuucagggucaucugccuccccuugaucuuuuuucuuuuuuaucuuuuuuuuuuuuuuuugagacugggucucacucuguuguccaggcuggagugcaguggugccaucauggcucacuauagccucgaccucugagcccaagugauccucccuccucagccucccaaauagcugcaaccacaggcaugcacuaccaugccuaguuacauuaaaaaaaaauuuuuuuauagagacggggucucacuauguugcccaggcuggucucaaacuccugggcucaagggaugcucccaccucagccucccaaagugcugggauuacaggugugagccaccaugcccagacuccacuugcucuucuuagauauagacagacacaaaguucuuuguuaguauucucaaucugcagcccucauuaauucaacacuacguguacagggcugaaugggagugaaggaguaucccaaaggagaugggagucauucucugcucuucaggaacuuacaguuuaggagaggagauuauaguaugaagguacuuuuuaauccuucaauauaaaugggaacuagcagcccuguaaugacuucaguuaauuuuuuuagcgucugggaaugcaaguuauuaagcccuaaagagcugaaccuuucuggcucauuugaauagucaauugcuaagucuucuccuuaucuccaucccaggcuauauugcuugucuccauuccuuuuucccagcugaauuccauuuuuacaaaaaaaaaauaauaauaauaaagugagaacuccucuuugauagcugggcuucacgauuacuugucccuuauaucuaauaaagggguuauuuucuuuuaauuuuccuuugucccucauauauuuaaagagugcuuuuguauuuaguaugucuuuuguagguggcaucuuauuucuugaauuuacauuucugcuuuuauucaugcaaguacguaccaguucuuggcuuaucuccuuagucaucugcuuuugguuuuaguuuuucuucauuccauuugggauucaguucccagguuaauucuuuguuuacuugaugagaauucccucuaaauucuuuuucuguuucuuucuguuuucuguguucuuucuguuuuauuuauuucaugcacauguccauacauugaaauaguuauauuucauuauugucauuucauuuaggcaugccuagcucaccuaggcuucuuccucaugcugucuugugauggggcuuuucuuaaaagcuggucugugaaauuuacugaaauuuauaugaaauuuacuuaauacaaaauaucuuuuccuuuggcauguauuucucuccuuccugguuuggaaauucugaauucuuaaucaguuuauggguguuuuauuuccuuaaaucuauagcuaacuuuuagcccauagaucaauuauaccaguucacucauuaaccaagcaguaauaacugggagggaggguaaauauugcaacauauccacuuauauuuggauaucauauauaccuuucuucaggacaucugacauguuuucccaaaaguucucauuugaaauuuuauucuuuuaaagauuuuuggcuuaccugauucuucagguggugggaguuuauaaaaugaugagacuuggccaacucagggaagggacauacuguaugcaagcucuaaauuacuauaugaauuaucauaucaaaggcaaaucaaacuggugucaugguaguucaaagagucauucccggacccauguagguacaucaagcaacaauuuguuaccaucuaagaucugaaccacucauagcacuucacugagaaaagaucugagcccuuuuauuugauaacucccacuaccuagagcuggugggaauaggaccaguacuaacagucacccugccaaauaaacucaaccauuccugaaaacuggaagugauugucaaugcaaauuuagaaacacaaaggauuuuaucuauaaugauuaauuuuaugaacuuauuuaaauaugauauuuugaacauguacuacuuaggcaucaguuuaucaagaaaguaaauaaagccuugcuagaugaacaggaacuuuguaugugaaaguaccugccacauaggauuuuucaugucuacauaugugucccaaccagcauuguuuaaauuuagauuagcuacucuuacccaaggagacucuuucccuucuugguccaguaaacugcaucaguuccuauuccuagaauagcauuacauuuuguaacuucauguaguaagaacacagugagcuagaacuagcuguuucuuuacuuuuucugaagauaaucauaaagcuuuaagcuuagaccauauugaaaaucagucuaaggcuuguauaugagauugaaauuuauaggagauaaaucugaacucuaugucugcagaccccaaaugguauuuugacauuaaauaucaccuuuccaucuaguacuauaaauuacagugcuggguucaguuuggugauauguauuaucuguguucuccuuuacugcuuuugucagcagcucccuugagaagggugaaguggagagcuuggagucaauacccuggaccccagcagugaugucaugugaggcaaaacuugaugaauuucauuccuaaauuaagaaaaucuggacacauaaguuaaggacaugaucaacugaaauuccuagggaaauaagauguuguaauaaaaauaaauuuucuggugacuuagggcuaacuagucuccccucauuuuuuaaaaaaauaaaacauccaauuauugaaaaacugucuaaaaugucugaauaugcuuucuaguaugacuucaguaagauuucuugaaacuugcuuuucugaggaccuuguaaaacuuuaggggagucauccuuauaucccauauacacauuuuuuuuucauucuaccuucuuaguuugcuuuauugcacucauuuacuaugcaguagcuauuuaucucugcuagucccuuuagacggugaacuucuuuggagaagggauuaaauuucucuuguucaaagucguaccuccagcauguagcacagugccuggcauauagaagguauguuagacuggguucucugagaagcagaugccaguuggauucauaucuaauccaauauggaauagaugugcaagggauuuauugggggaaaacacuuaugaaggaaaaugaggagggagcugaaggaggccggaaaagccaucagaccauggugcaggucugacccuuguggaagagagaggaaaggaaggaagguugaguaggaggaaucuuagacugcagugccguuuuaagaaaguuuggcaaggucaauggggaguccucaagccaaaguccccugugagcaaaguccuggguuacaggacuuaguaucuuugccaugcucagucauuggcugggagcagcccccagggaauguggcuuaggaacaaugugguggugaauucaaagggcagcagcugggaccauuagucaauuacauuccccacaguagaagaucugagaugcccauauucacagccaccacagaaggagaucaacaaaugcuaauuggagaaagagucuggcaguggcucaugccuguaaucccagcacuuugggaggccgagguggauggaucaccugagggcaggaguucgagaccagccugcccaacauggcgaaaccccaucucuacuaacaauacaaaaaauuagccaggcgugguggcagaugccuguaaucccagcuacuugggaggcugaggcaggagaaucccuugaacccgggagguggagguugcugugagcagagauagcaccacugcacuccagccugggcgacaagagcgaaacuccaucucaaaaaaaaaaaaaaaaaaaaaaaaaagagaaaguuugaguaagacagaaguugaagagaggaaggagauuggucuuaauauucacugagcccuaauauuuguuaguauugguggaggauauaaaaucaucagauucacacucaccuuccucaucucuccucaaacguuaccuuauggaagaugccuucucugacuaccauaugcaaaacagaauagucuccacaaucaucacauucuguaucucccuuacuuuacuuuuuaaaaauuaaaaacaagcugggagaaucgcuugaacccaggagguggagguugcagugagcugagaucgcgccacugcacuccagccugggcaaugagagugagacuccgucucaagaaaaauaaaaaauaaaaauaaauaaauaaaacaauugacaccuuuauugaggcauaauugauauauaauaaacuacauauuuuaagggugcaaguugauaauuuugacaugcauauacacccgugaaaccauuaccacaauaaaaauaaugaacauauccaucacuccccagaguuucuccacuacucuuuauaaacccuuccuccuaccccuccugcccaccaucucccuuaacaacgacugaacugcuuucugucacucuagauuaguuucuguuuuuuagacuuuuguauaaacggaaccauagaguaugugcuucuuuuugaucuggcuucuuucacauagcauaauguuuuugaguuuugucccuccaguaguaugcauuaaugguucauuccuuuuuauggcuaaauagaauuccauuuuauagauauaccacaguuuguuuuccuuuccuuacuuuguuuuacuuucucuauaguauuuaucaccuuuugacauuauguuuauauuuuuguuuguuuguuaucucccagaauguaagcuccaugagggcggggacuuugcuuuguauacuguuacaaccacagugcuuggcauauaguaggcaccuaauaaauauuuguugaaugacuuguaucuugcuucagaccuuuaguuaaaacaacaacacagcuuugauaugauauugauguuuugaucauuuauccugaaaagcaguauuggguuggccagacauacauuucauuuggaaaucauaacuggaauuuugaaaauuguuucuugguugucuucucauucauacauuauaaucaggaaaaauaaauuauaggagugaagauugaucuuuuaaaagacaaacuaaauaucgguguucagugauguguuuuuggugcuauaaauuaguuuaugcagaauuuaugagucaaaccuaggcaauuaauucugaugguuauucaaaaagagucagccauaaggacaauugggagaaagcagggauuaguuaagaugaaacguaauuuugaauaaucaaaauuuuacuguaucucaaaagaaaugcauuguuugcccuguuugccaugugugaguguguguguaggggguggggguggugugggugugggugugugagagagagauccugcuuacugaaacaugaaaaccuuguuuguuucaggaucagauuugcaaguaugucucccuaagggcccaacaugcugcucaagaaagauggaagaaaaauaccaacuaacagcacgauugaacauggaacagcugcuucagucugcaaguauggagcucaaguucuuaauuauucagaaugcugcgguuuuccaaggugaguucuggggauuauuuuagaugugcugcuuaguggcaucauuauuugggcacugggcuuucaaauacuaaguauaauuuauaaauuaccauuccagcauuaaugcuugcuauuaaaaaccucccagugagaaauucugguuuaaaaaaacacauuuucagagaagcuucauuucaaucuuuggaaaggugaguauugucaaaaaaucauuguccaaggacauucuauuuaccuguauauaaagguuauaaaucucuacagaaagaauaaauaauauuuucucucagcuugauucaaaaacaaaaaaguucccuuaaauacugagcccaguuuucuccaggaaugaguuagaugcuugugggauacauguggacuccuucugaccacuaggaccauuuccauuuaagaggcagacacuggcuuguuggcccaggauuuucccauuggugugaguggugaccucuccucucuuugugacucucacuucuuaccaugccugugaaugauugcaagagaagcuguuguggcauugccagaacggguaggaaaugacacuucuccuugcuaacuuaguaggacuaucauagcaggauggggaguaccuccuucaauucuaacacccagcuaggaagaugaugaugaugauggaggugguggugguggugaugauagcagacacuuauauggcaccaugugcuaggugcucuuuuaagugguuuacauguauuaauucauuuaauccucacaauauaauuaugaguagauguuaguauccuuauuuugucgauggaaaucuaaggcacagaaugauuaaguaacuugcucaaggccacaaaauuaauaaauaaauggugaaggcaggauuugaacccagauggcauggcucuuagagucuauucuuuuaacuauccccauaggcugccuccuguaacugggaaaauuaauuauggguauucacaauuaauuaguaauuaauuaauuaucagucuuucuucuauccuuccucaagcagagggaaucagccaccuuuuucuugccucaccaagagaggaucgaggucagauagaaaaauaacacuucugacugcuugacauugcaaagcuugagauuuauggcacuguuacaagaauuaaccucugaauuguaagguguguugauuauagcuuauuuuguguauuauaaugaaaucuuuagaauuagcuaagaaaauuguucagauuaguuaauaaagccuacauucacaacaguuucuugggucaaagccucaggggguauuagguugauuauaugaaguauaauauauaagcuugaaguauuuguuaaacuauuuaugcagucagacucuugugaagaguuuguugagacuaacaauuuggugauagaaugaauaauuuagacagauuuuaaaaauacauguagcauucaugaacuucuuagauugguuuuggaguugaucuguuggaugaaaguggggugagaagaaaugaugugacaugagaauuggguugaagcagagagcugaaucuuacucuuuggggcaucaaggucccuuuuuagaacagaguauuagugauuuguuuaauucccagaauauccaagcucacagauguuaccuuacaauccuugucugguuggaggggagugguagagugaucauacuggcauuuuaacauuuacaguagcugacauggcuauguaucugagggcccgggucgucagcauuuacaccucuguccaguucugcacuuugcccacuguguuuucuagaucugcaaaaaugugagacuaggagagaaaaaaaguucugacaagauuuugguuggauuagcuuccagauaagccugcuauagcuuggaggcugaauacuagucaugugaacagaggguagaaaaugggggcagcaucuacuaauuguaucucucucucccuuucucucugucucucuuucacuucacacacacacacacacacacacacacacacacacacacacacacacuuucuugaauuguggggauagacagaaggacaacccuagcaaaggaacauggagacaaugaaauuaugucugagcuaauuauugcuagugcccuuuaccuugucaccaucgguacucauucuuuaucuuguuucacucccucuucucauucuuuuccugccucacuuuuagaaaaaauaaacccaacaaggaaaaauaaaccaugaucccagaccucaaggcacuuguacaauguuucagaagacauugccccuaaauccuuuuguaacaaacauuuggagagacaagacuucaaacuggggaccacuacaagauaauguauuauuaauugcuaagaaaaagagagcauccacuuuuuuucuuucuuaugaccguuuauuauuccauugaauugaaauuaggagacacaauuguuuuuccccuaaaauacauccccuccccaauauucugguagaccaaauuagugagaaaaccaucccaguacuucacucaugugaaauuugaugugacggcuuuugcuagcuauuuucuccaucacaugaaguugaagaaagcucaucuugaucuuggccuagauccacaaucucuuugguauuccuucacuaguccacauuggggguauuuaagcagugagugcuuucugcaaauaugugcacaguuccacgagcaauccuuacugccucgauuuggauuuuaugucuucauuugcaggaagccuuugcccucauaaaugagccuggggcccuuugcuacagugguuggagugcucuauugcuaauguuguuuugauaaugauugaagcauuuaaaaaaguuguucuuuauucucagucuuugcauugccucguuuccuaaauuuaauuuacuuagaugugcuuaguaaaauggggcagcacaauugcuuuuuguuucugcuuaauuaauucuuucugaaaaacuccacuaaaaguagacuuuccuuucucuuuuucuuuuucuucuccccuaccuuauaauaguuaugaugauaacaauagugaagauuuauuaagugccuacuauaugaugcugacuuuuacauaauuaucucauuuaauuuucccaacagcccuaugaggucuguacuguaauuaucuccauuuuacagaugaggaaacucauugaugccacagcuucuucugagccaucacgugacauggcuuuccuuguucuuaauguccuugagguaaaacaaaauugagaaguuggauuugugguucuugugaagaaaaauggaauagaauucugaauuuuucgucaucucacuaccaccucuauaccuuuaaaccuugaguucuauuuucuuuguagaauuuuauuaugauuuucagccuuguacuaucaagaaauauuugggguacauccaggucuuuucuagauguuggauaauucuagauuuccccaagauaccacugacuuugagugauaauagacucuuuuauaugcagcaauaccuuguuuuuucuggaaguugccuauuccacaacuugaacucucuucaucagaaaggaaaaauaguggucgagcaggaaaucaucucaucugaaagguuuuugaguccuugcuuagagccuacuacuguuccauguuuaugcguagucuuggcacacuugauuuucuggcuuucuagggggggauccaagaacucacuaaauguggcacuuggggacauuuaauagaggacuauacuccuacaggccacaguggcuccuguauuacguuagguccaagugauguucacaaugugguuacaaguaaauaaggaaaguccaacuuacauucacuguccuuuucuuaauauuuccauuuuaaauggcuaaaaugaauuuccucagugcuuaagaucagcgaaagaaacacuggacuuggagucagaaaauccaaguucaaauucuagaucugcauuuaugagcuuuauauuuuggggcaguuauuuagacuccaguagccucaguuuucuuaucugcaaaaugggcauaaaaauugcaguccugcuuacuuuuguaaaguagaaauaaugaaugugaaaguaucuugaaaacuguaaaacaccauaugcaugcauuaucuagacagcucauuuauguggaccacuuuaccccagguggugccaaauaaaugaugcauuaucauuacagacauuaaccucgacaaggcuggaguucaugauguauuucaacaacuuuugccacuuauugaugauauauaugcaaacagcuccaguguacagacaaaagaguacuuaggcaaaagacucuuugggaaagggguuuauuuuaugcacucuuggaugugaggcuguacuguuugaagugucaauacugccaggagcaauccuuuuuucagcuuccugaagcuucucuucuggcuaguaucugguguauuucauauaugaauaagcagcuagaucaggagagguuugucgguucaggccauauuuuaauugcauuuuuugguccacacuauuauggcagagaggagaaaaagguugguauaagucuagagaucuucaguugauccucacucaguauuggcaagcuugcuuucuucuaccugcuuucuguggagaugaaaaagacaucucugaaugggggggagggcagcguuucugugcuucuucuguuguuucucucccuuauuuucuguuuucaucagcucuuggcaguuuuuagacucucuucugucagauuccugucucucccacucccccuaaauaaaauugaccuugguuagaauacccuuuucugucagcucacagcaauuucuccagucauuucugcuugaaauaacuguuuagggacauuauucaagcaaagcuuuuuuccuucacaguuaauaugugacucaauaauugcuugaauguugauaaacauguuuuugagauucaaucauuugcuaauuuaguuuuuauuauguaguggggguuuuaagugaguacugagccauuuuucuccauuucacaauucuuucccccugacuagccugacaguucugcccgcacuccagcucugugcaggcugagccccauugcauccccaacucuaacuguccgccagucugucacaaccccuuucuugguuaaaaauaauguaugggagagaauaauuacacugaugucuaaucaaaacuuaauucauuugccgaggcuaaauacaauagcauuaaacugaauaggauaauuuuaggaacucaaaccauggccaugagugaaguuauauauccucaaaaauguaaauuauuaaucaaaccgcucaucuguacagcaaagcucuaguaaucccauuauaaaagggugaauuucucauuagagcccagaagaugcuggcauuaauuaguggacuuucauggcaccaacucaaaggcauauuuugguuacaaaguuuuuaaaaaugcaauucuuuaauuauuagggcaauuggaaaaccaacuggaaacugaguguuuaaagccauuucaguuuuaaaguaaaacuuuuggauucaaucgggucucaaaauucuguggcuuuaguagagccagaggcugggggaguuauaaaccuuuccugggcccuuuauugauuuagaagucagucauuaggcugaaaacuguuuaaugaaaagagcuuagaaaaacgacucaauaugcagccagagaccauucuggggccaaccaugaggugaggagauuaugcagaugaacucuuuuaccccaggccaucgcccuugauugaacaagguccugaacucaugcccuugauuuaacagggcucugaacucaccuccucuugcugucaucaucacugcccaccuuucucacuagugggcucaacaaagcacauuaaaggacauugucccugcccucuagaagcuuccaggaaaaacaccacuuuugccuagagugcuuacucuccaccuccccaccagcccccaaacuggaauuuguuuacuuucugaaaacauauguuccuccucuucuuucugucucacugaguugcaguaccugauauuggaguaaugaagcauauguuugagagauuugaauucucuugucaguagaguggagguagaaacaauuucccucuaagcuggaaaugguaacauagaaauuaaaagccccuucccuucuauugacugugagauacuuccagggacugaggcaccuguauugcuccuuuuccuucauugcacuuuucagucaccaggucucauuucuuccugcauccuucuucacaucauuuuccuacauuccaacugagaccccaucggucucaguugucucauuuaucauaugcagauggcuuuugauuuuaguuccucucugauuucaguuccaggcuccaucagcuaacaucuagacuaccagcaaaugcaccccuggguuucaugccuuuagccucccuugcuucccaguucagcaauggaguguaaugauuaagagugcaggcucuagggggcauucugacagggugugaaugagucugggugggguaggcaggcugguauggagagaagaaaguugagggcuugggugaggauuagagaccuccuuucugaaaguguacuguauuggagagagaugaauaaaaaauuuccucuucucaaguguuuuacuuaucucauuuaaaccucauaacaacccuaggagguggguacuuucauuagccucauuuuaucacugacaaaauggaggcuuaaagagauuaggugacuuguuuaaaguagcacccaauagauggcagagacaagaauugaacgcaggaaguacagcuccauagccugugcccuuaaaacagugcuauaugugugauacagccucuguguauuucaucucauggucauaagcagucuccucaauucuaacuuuccuccuugcaagggaacucuauuguauuuaauuaaaaaagcauuggcugagcaacuggauagcaugucuaaaggcagguacugugggggauucaaagagaaaaacuaccucauggcuaccuucaaguagaucaaaauucagaaaccaggacauuuguauacaaauaacuugggugcaaggcauccuaagaaaaauguaagaaaaaaccuuugcaguuuuccaaggggaguagagguggauccagguuuuguagugcucaaaacuuauauaauugggggaccuucuuuaagaaaaagaagacaaaauaaaaaauacaaaaugccuauggcucuucugugagagggugugcaagugcagggucccuguagcuuaaguuucauuguuuaacagaaaaauaacuuuucuuuucuuuucuuuucuuuuuuuuuuuuugagacggagucucucucugucacccaggcuggaguacaauggccugaucuuggcucacugcaacauccgccuccuggguucaagcgauucuccugcuucagacuccugaguagcuuggauuacaggcgccugccaucaugccuggcuaauuuuuguauuaaaauucacuucuuuaugguagugugggguuggaagagauuaacuccaaccagaggguagagguuccuggaggagacuggcuguaugaaaucuccagauagacaugcuguugaucaaagagaagaacacaugagggaguuggguaaaucagugcacaucuuuuucucaauuaaacucaaacucaaauuauuauuauuauuauuugagacagauucucgcucuguugcccaggcuggagugcaguggcacuaucucagcucgcugcaaccuccgccucccgggcucaagggauccucccaccucagccuccugaauagcugggacuacaggaaugugccaccacacagggcuaauuuuugcauuuuuuguagagauggaguuucgccauguugcccuggcuggucucaaacuccugggcucaagcuaucugcccgccucggccucccaaaguguuaaaauuacaggugugagccaccaugccuggccaaauucaaauuauuaauugccuauuagauacuagccuuucuggacuccuugucuauaccuguagucucucacuuagacuucccucuuggaaggggcaaacaccuaggaggcagcaaagggcauagugugauggcuauguggucuggcuucaggcagacuggugucuaagucccaauuuugcccuuuccucuc

SEQ ID NO: 18984 - RNA, 766 nt, Homo sapiens
gagacucagaagcaggaugccugagcuuugggaagaaaagcaugggccuuccuugcaccugcuuccucuucccccugggaaucccuuccuuuguagguuacucccauuuuuuuuuuuuacccuucuucuuccuccuccuccuccuucucguccucuucuuucuuuucuuccuccccgacccccacaucucuaaaacaauuuaagcucacaagccauuucccaucaacuccuccugggaccaugagacagccaaucuaugccuuaagccucuaaugccaaaacuuuugagucagauaagaggagggagccguggugauaguggcagcagccaugucgucgcagcuugagcucaagcucaaagucuucuucuguccgaccccugaagggagucaggcgauuuuggcuuagcuaauacagcagucugaagagcugagcuaccuaacuacugugacgaacagaaaggaaaacaagccucagaaaaagccaacaccagagaacaagaauuacaagcacgcaucggcacccacagcagacaggcuggguggaggacucccaacuuaacauacgcacagguuucggagcacagcagaauaccuuugacucuccggaaagcuaguugcaacacuucuuacucccuacugccccacuguggagaaaugcuuugggaaaacgcgacuuauuguggaggagcauucacugccauacucuuuugacuuuggacuccuggcagucuucauucccuuauuccuccagcaucuaucaagcu

SEQ ID NO: 18985 - RNA, 1020 nt, Homo sapiens
cugcggugucggccccgggagcagcgagacccaagauugcaucaaacguuugccccgucucugcauaugugacuggacgugaaugaugcuucauuuuggcacccccuuucccugcucagguagaauguaaacaauugaaaaaaaucccuucccaaucagaauaccacccacaggacaacgaagaaaaccuaucuucaguccccacccacgaaaugcugggggguggggaggacuggaaaaggaguaaggggagaggaagggugagcagcugcaagaagucuuuacaccucucugcgguuccugguaaacgcgcucauguccuggguauggaagggacuuaagaauucaggaaagaucaaaauaacgggccucuuccccacucccucgcccucccuuccccgcugcugggggguuagggaggcuccguggagcuccagcacucuagaaggaucgggugaggcgcgaggccuugcgggcgggugaacccaaggugggguggaaggcuccaacccgcccaaucugagcccgaggccugcugagaagcaugggggccuugggauaguuccagaaugaggaugugcguuucuagcugcuuugcgcccuccucccccaaaaaucugcuaccacaauuccaacccggcggcacgcccccaagacuccuuugucgccccaggggcgggaccugagcugucgauuucaggagcccuucgugacuucaaaaguccugggcacuguugcucaugagugcugcacaacugucgcccucuaaagccaccuccaucccucacugggcuggccuccugagccuucggugaggaaacgggguuccgaguugcccgccugagagcuuaacagucugacuagaaaagggcuaauucgcuuucugugcaaaucucuugagcuaauuauuuaaucugaaacauggacagguaaaggaccauuggcgggcguggggagggagguguggaaucuuucccacacuuuuugucaccuuaaagaaaaaaaaaagacacccaaacu

SEQ ID NO: 18986 - RNA, 2938 nt, Homo sapiens
gggugaaaagcagagcgaugggggauacgaauuaguguggaagagaaucuaauuacuucugaagguagacgaauaagguuaaguagaggcaauuggacaucuggaucauucuugccaguuucaaagucuuggugaaacuucuuccugcugcauauuacaagucucauucauuguccccauuaaaaaaaaacaaaaaacgaaacaaaaaaacaaccuuuauuggaaauggacucagaugacugaaagaaaauaaccaaaaccucaccgguagcuucagcugauucuuacacuaucguugcgacauauacaucuaucuuuaaaagcauuagauguccuaacucacugcuaguguuuuuauucuuaaacaccccagcugaguuauuuuaaagagcuccaaacaaugacagagaacuuucuguagaugaaauaccaguuuacauauuaaacugguuacucaaacuuauuuauaauuuauaccuaucaaugucaucuaucaaaacauaaaucaaaaaguuuaaauacuugaugucaagucgcuccuuccuguuucaagcagcuccacagaaacuuucauguccugaaauggccggcacugcgcauacuccuuaaugauuaacucauuagauaccacuuuuuccuuuuuaaaauggacacauauuagcaacaagucacaugcaugcccucuuuuuguuugaauacaauauucaauuaagcauuaaaaaaaaaacccacucugaaauccucaaucacaaaccuaaaaguuaaaacaacaaaaucagcacuaacuguaaugguuuugaaaguuaaauacauuucagcacaaguaauagacauuuaaauuauccaacuguaaguaucuuguuacacuuacaaauuaagucgguuuuucaaaaccaguacaaugaauguuaaguguccuauuuauuaguuaauaaaaugugcagaguauuuaauaagauuaaguaucgaauuuauaacauccagacugagauccagugguaacaaauacacuaugucaugguaaaaaaaaaaagucauuaguaacaauaaccccauucccuaaauugcgacaaucaaguaucucuacauuccaucuuguuuuggcaaugauauuuacaaacaacuuuuacacugacuuugggauuaauggagaaaaaugucguugacugcccuuaaaaagaaaaaaaaaacauguuuagcaaauguacaauuaucauguaaaacuccacaacuuucucccaacauuuuguuccacacaaauauacgagccaucaugucagaaguuaaagucaugccuaauuuaacauuuccuuaguugacuacuuagaaaaacaaaaguucauucgaaacagcaucggugucaaaggcgaaggucccuuccagauugcucuuggaaucaaauucauuuauaccuuucacccuaaccccuuucaucucucccagugauaguacaacgaguuacaccccuaaaaagccaccucgauccccuaguuuacauauuuccccuuagacugaaauuuacuuacgaaaagagauuacaaaggggcgucuugucacuucaggagagggucauucacugauacaauagacaaagaaucgauacuuucgaguugccauagccccacccccuucugaacugcaauguguuuggcuaaaugauuuaagagccaaagaauacgccucuuccucuguucauacucuacaacguuuugucuuuuaauuuugcauaugccuucgucccccacaccccaaacacacgauguaccuucucucggcgcauucuagccaaacuuccacaaugucaagucccuacggggaaaacuaaacaaccuuuaaaguuuuaauucgggagagacaaugugaaauuaaucacacauuucuuuccaagacauaacuaacuucuugcaaauaagaggaaaaguucauuuacauucugucaaaaccagucgcucccgacccuagcgaggcugacagucggucacugccccuuacucaguuuucucuccccgccccuccauguuaguuguuguuuuuuuuuucccaguccguuuccugagaauuucccggccgcacucauuuguuaaacacuuuaaaugucagauuugcccccaucccgcccgcaaaacgugcuuuacaacccccccaaacgccacagcacuuuuuucagaauuaucaccagauguuuuucugccugccguaacccacguuacagucgggaaagacgccagccaccaagucccuuuuuaaaaaaucgcaugucaccucuggcuccacucgaaaauggcgccgaaaucgaagaacuucuuaaauuucauugcaagcuuuuugcaaagguuucugggauuugccugcgaagcuguuucgccgcguccgagagcgagcgaacgugcaagccagcgagggagacagggaggaaggaagggcuggggaggcggagagacagaccgagcgagcgacacacggacagcgacggacagcgacagaagcggggcccgggacuugggagacggcgagguugcggggcgcgaggugcugggcacggagcuacagggacggagagccgagagccggggucgcagcguggagggggcgcuggcugcugccgaagcucggagagcggcguggcggaggcggagcggagccgagcgaggggccagcacggaacgcucccuuggaggcgagcggcgcagccggcggagaggcucccggagccgcccuagaaaaagccggcucggggggcguggccacgcgcuguggcgcuccccgccccccgguggccccgcucggcuccggggcccgggggcggaaggggggaggggaggagaggagcuguagggaaggggguugugcaggcgcucgacgccgcagccuuggcccgcugcgggggagggccgagaagggcacugggcgcccagaguaaccaacaccgagacgaaua

SEQ ID NO: 18987 - RNA, 2938 nt, Homo sapiens
uauucgucucgguguugguuacucugggcgcccagugcccuucucggcccucccccgcagcgggccaaggcugcggcgucgagcgccugcacaacccccuucccuacagcuccucuccuccccuccccccuuccgcccccgggccccggagccgagcggggccaccggggggcggggagcgccacagcgcguggccacgccccccgagccggcuuuuucuagggcggcuccgggagccucuccgccggcugcgccgcucgccuccaagggagcguuccgugcuggccccucgcucggcuccgcuccgccuccgccacgccgcucuccgagcuucggcagcagccagcgcccccuccacgcugcgaccccggcucucggcucuccgucccuguagcuccgugcccagcaccucgcgccccgcaaccucgccgucucccaagucccgggccccgcuucugucgcuguccgucgcuguccgugugucgcucgcucggucugucucuccgccuccccagcccuuccuuccucccugucucccucgcuggcuugcacguucgcucgcucucggacgcggcgaaacagcuucgcaggcaaaucccagaaaccuuugcaaaaagcuugcaaugaaauuuaagaaguucuucgauuucggcgccauuuucgaguggagccagaggugacaugcgauuuuuuaaaaagggacuugguggcuggcgucuuucccgacuguaacguggguuacggcaggcagaaaaacaucuggugauaauucugaaaaaagugcuguggcguuuggggggguuguaaagcacguuuugcgggcgggaugggggcaaaucugacauuuaaaguguuuaacaaaugagugcggccgggaaauucucaggaaacggacugggaaaaaaaaaacaacaacuaacauggaggggcggggagagaaaacugaguaaggggcagugaccgacugucagccucgcuagggucgggagcgacugguuuugacagaauguaaaugaacuuuuccucuuauuugcaagaaguuaguuaugucuuggaaagaaaugugugauuaauuucacauugucucucccgaauuaaaacuuuaaagguuguuuaguuuuccccguagggacuugacauuguggaaguuuggcuagaaugcgccgagagaagguacaucguguguuuggggugugggggacgaaggcauaugcaaaauuaaaagacaaaacguuguagaguaugaacagaggaagaggcguauucuuuggcucuuaaaucauuuagccaaacacauugcaguucagaaggggguggggcuauggcaacucgaaaguaucgauucuuugucuauuguaucagugaaugacccucuccugaagugacaagacgccccuuuguaaucucuuuucguaaguaaauuucagucuaaggggaaauauguaaacuaggggaucgagguggcuuuuuagggguguaacucguuguacuaucacugggagagaugaaagggguuagggugaaagguauaaaugaauuugauuccaagagcaaucuggaagggaccuucgccuuugacaccgaugcuguuucgaaugaacuuuuguuuuucuaaguagucaacuaaggaaauguuaaauuaggcaugacuuuaacuucugacaugauggcucguauauuuguguggaacaaaauguugggagaaaguuguggaguuuuacaugauaauuguacauuugcuaaacauguuuuuuuuuucuuuuuaagggcagucaacgacauuuuucuccauuaaucccaaagucaguguaaaaguuguuuguaaauaucauugccaaaacaagauggaauguagagauacuugauugucgcaauuuagggaaugggguuauuguuacuaaugacuuuuuuuuuuuaccaugacauaguguauuuguuaccacuggaucucagucuggauguuauaaauucgauacuuaaucuuauuaaauacucugcacauuuuauuaacuaauaaauaggacacuuaacauucauuguacugguuuugaaaaaccgacuuaauuuguaaguguaacaagauacuuacaguuggauaauuuaaaugucuauuacuugugcugaaauguauuuaacuuucaaaaccauuacaguuagugcugauuuuguuguuuuaacuuuuagguuugugauugaggauuucagaguggguuuuuuuuuuaaugcuuaauugaauauuguauucaaacaaaaagagggcaugcaugugacuuguugcuaauauguguccauuuuaaaaaggaaaaagugguaucuaaugaguuaaucauuaaggaguaugcgcagugccggccauuucaggacaugaaaguuucuguggagcugcuugaaacaggaaggagcgacuugacaucaaguauuuaaacuuuuugauuuauguuuugauagaugacauugauagguauaaauuauaaauaaguuugaguaaccaguuuaauauguaaacugguauuucaucuacagaaaguucucugucauuguuuggagcucuuuaaaauaacucagcugggguguuuaagaauaaaaacacuagcagugaguuaggacaucuaaugcuuuuaaagauagauguauaugucgcaacgauaguguaagaaucagcugaagcuaccggugagguuuugguuauuuucuuucagucaucugaguccauuuccaauaaagguuguuuuuuuguuucguuuuuuguuuuuuuuuaauggggacaaugaaugagacuuguaauaugcagcaggaagaaguuucaccaagacuuugaaacuggcaagaaugauccagauguccaauugccucuacuuaaccuuauucgucuaccuucagaaguaauuagauucucuuccacacuaauucguaucccccaucgcucugcuuuucaccc

SEQ ID NO: 18988 - RNA, 27634 nt, Homo sapiens
uuuaaaacacuaguaaauuuuaugcauguauacacacuuuauuaaauuugcauucuaagauauacacaaggccagcauuucacaaaacuuccuauuauuccaaaagcaguaaucaugaaacagugauuauauaagucaaucaagcaaaaaacauuaucuauaggguuguaucauaucaucucuuauaccuguuuucaaauagaagccugaaauauaugauauauauuagaauaggaagagagaauuuuacuuuauaacaaucgcuuuucaaauauuagacuuuauauaaaaauaaaggggucuuaacaaaguucaucugugaguuagcauaucucuuuauuucaaaacaaucccugcaaaaacuuaacuuuccaguccauuuaaacaacaaaaacuaaaaaugaagcuugguuuaaauaauaaagugaaucaucuugucuccuaguucucacaccauuggaacaacuuccauuuccugaccuaauucuaucccaccauugaauuucaaaaauuaauguaaauaccaucauauuucaguuauuucuuaacaguguuaaguucgagccuaaaaaugauggccaagugucccuuuaaggcaaagaagacaguagguggauaaauauccugaaagacaaaaccaucuauuaucauuauagaggcagaacauuuugacaugaucuuuuacaaacagaauagauacacugcauaccaucgaagaauuuuuucuuuauaauggcauacuaggggacaagcuucauaauagauuuauguuacguuugaagaaguagagacuuuucccagaugagagcaauacaagaaauaaagccauuaauggcuguuaugguuacaauuuaaaauaaaggacacaucggaugcuguaacagaaguacugcacgcuaagugaugcucucuuguaauugaaagagaauggguuucccuucaaaccauaugcuauuacuagucucugagugccuucaaagcacauacucuuccuuuaaaauccaaggauccuugccuucaaaagacacaaaugcaguaguuuucauuucuuacauucacuuaaaaauggauuaugauuccagcaggcaaaucugcauauuaaauauagacaacccaaccacaguaucugaacguuaaaagaaaucuaucacgacagacauuuuaccuaguuauaaauaacguaacaauagaucacacucagauuucuuaaacagcucacucaggaguuuccucuuuuaaaaauuaaauaacuuaugguaccucacacuuauagcacauacacaguucauagcugaaacagcuucuuaaaagcagaaugcacaaucacauugacuuuuucagcuucuaaaagcuucuuuguagauauuaaacugcccucacuacaaggcaguaugaacaagaacuggauucugauucugguggcaacacaauaacuauaaggcaguaagaacaagaacuggauucugauucuggcagcaacacaauaacuaaaacaccauucaccacaugacaaaacaaacaaauccaaugacaaaaaggaaucggaaaaaaagcagcaacagaaacaguauguggcaaucauucacauaaggccccucuuccaccauaccuuaugauauacaucccuuauagcaugacaauguaccccaaggcaccugaggccucauaauaccacucgagacacugacagcuccauggacgcuuuuguacacagugguuuguguguaaauaacuauucauucauuuguagaugcuccacacaucuggucaaggcaggaauuucuucuccuugauaacaccaccuagaaauaucaacaauauuuuauauauuccuuagggcaacagguuugaggagaaauauaucaacugugguagcaaagucauaagaaccugugaugacuaauccaagcauccuguaaguccguuuacauucucagcacuaaaaucaaugcucacuucacacaccccaacagcaaagaagcaauaagaguaaugaaagcaacuacguauuucuuccccucugugagaaauggcauaagcggcucaaacaggaaagggaaacaaaauaauguacuugaagcugaugcagaaaaauaaaaauuuaauauaauuaaaagcaauuuauauaucaucaugaaauaaagagagauuugaaacuauguagucaacagaggacaaaaaaaaaucucucaagcaagagaauuucugaucaaaucugucauaucacugcugcggaaaaggaccauuaaaggcaauacacaucagugccuuucuuaaauguauagacucaaaauagguguuuuuugaggcacuaagaaaaaagauuccucuaagcaaucaaaaaucagcauuugagauuuaaucacuaaauccaaaaugagaucagcaaaaccagauacuaguaaggucacuaggcucacaaaauugaacuuuggagaagagagaugccaaagaguaauaauagcaucagaaugugugaaaucuguaaaacuuuaauccucauuauggaucaaaguucucugcguuccccacuaaacauuuuauguaggaaacagcaguuaaaacguugaaucagaaaugguuaagucacuugggugagagaucauccaucaagaugaacgaagagcaugaauuggagcaugcuacuggagacucugcgguagcgcugccuuuagccagcgggucugaggauaagccacugcugcuacuacugccauccaaaauaucugaacugaagacaaagcaaaaagaauuauaagcaaaugcaacuaucaggguaaacauaacaugcaaugacacaguuucaagagcucacaaaucaguaaaucacuuguaaauaauaaaaaagcauaaagccacagcaaugaacuacauaauauacuacauuauaaagccacagaaauccaaaguaagacucuucgagguccuguaucauuugauuguccccccuagaggcaccagaccgccuaaccuacaauaaacguuccucgugacaugccaugguuuucgggagggaguuccuucacuucacuucagcucaagaaauuucuauucuuauguuuaccuucccaucaggcuuggagcaagaggaaugguuacuuauugagguaaccauacucggacuaucagagguguucgaucaaguacacugccucauaguuccucuacucuaaaacaaagucuuucaacuccccuagaguuaucacuuccccauucccaaagggccuucaauucaaacacauuuuuuaaaugauuucccccuccaauucuaugccauuuauaauuccuuacacuauuuccuuucuucuugcuuucaaaacccaaaggucuauuucuagaagagucccuuucuuugaucccuucaguuauucuccaguuaagcuucuacaaugaauaaucuacacuuguggucucaauacccguugucuauugccucuuuauccugacaacuggcuccuguuccuauccuuccaguaaaacuccagaucuggacaucaagaaccucuauacccagcccagggauuccuucccuauccagccugggggcucacuguuccccaaccaucaaccuggccugacucaugaaucuggcuccauacuucagcaaggaacugagagccuuuacagucuggcaucaagcugccuuucuggcuuugguuuccaucaauccaguaauaagcucuaugcuuuauauuugcccugaauucaaucauucacuuauucuaauauuuacugagugccugccaagugcaggaagcacacuagauauuagaaauacaaugguguuuaaaacagacguggucccagcccucauugaauuuacaguauugugcaggagacagacauuuaaauaaucaugcuaauaaauauauaauuauaauuugcaguaaaagugauaaaggaaagauacaaggggcuaugagaauauauaacauggguaaccuaaccuaauucggaggaaugagaaaagguuccccagagaugauauuugcuauaaucugaaggaugagcagguauuaacuaguuaagauuugggaggaagcaaggguaguuccaggaaucagugacagacaaaucaggagagguaauugggcaguuuuagaauuuacacagacacuuuuuauuuuugaaaaggaaaaaagcaucgaauuggagaaggaauuaugaaucaggaaacauggguucuaguuuaaguuuggucacuagcuccuuugaaaaagcccauuccagucuaacaugcucugagucgaaauguuaggagucuuuaauauuaucauuuaucugaauguccaaguuaauguacuucuaguguuaaaaguaaccuaugguacauuagaaaguuucugggcccuguacuacccucagugaaauauaucacccccacccuugcuucucuacucuucugcuuuucuuuaaaaugucauuucauuccauugcuuguggauuguuuuuagauggagacagacuacaaauaggcuucagaaaaguaaaaguaaaaauggaaacaguauauuccacacuacuccuacucuacgcucacugcugucaaaugcaucauuaauaauaccacuguuaaguaagaaguuuggaaauuuuagcuggcuccgauauuuuuucaaccaaauggcaaaauggaucuaaaauaugaauuauucaaacuacugaaagaaaguugcacagauaauccaagacauuggaaaaucaaaagaccuuucuauuugccuuuggaacauaugugauuuuuccuccugcagcuuuuugccuagacuaauauuaaaaugaauuuacuuuccuaaagcacauauuggccgggcaaacgaaggacacgcucuuugcuacuuggcaggaagaaaugggcuuagauuaaaacuuggccaccaagcagauaaucugaauauaaauaaagaauucuuuauucuaaccaccagacuuacggugagcccuggguuaaaagauuccauuuguaauaaggccugcuugcuugggugaauccuguauucauucaaaaacacaaaacaugacucaugcagugaaauuugacuucuaacacugcugauuaccuuaagagaaauaagcuaauugaggagcagaaaaaaaaagcccugaacauuuuauuucagaaugucuucccuauuauuaaaauauaaauauauauaauuuuguucauuaacagaaaauagcacacuuacauuuaguuuccacugcaauuuagauucagaacuugguaaaucuuuaaccagacauuuucacuuaacuaaaaucuaguuucuguuugaauuaaucugguacaacuacucauggucauggaagcagagacuucacgucacaaaucacucauuguuauucuauccaugucaaguaagacuuacaugauuuuuuaacccacagcaacaucacugcacaaaaguaauuuucacagucuacuauuaaaucuucuacuagagcuucuaaaagcaacaaguucuggucuaauuugaguuuaucucuucuuucuuuccuagcuuaagcucugauggaagugcuaaugagccuuacuuagacuaauggccgaaagccagacaacaguaaaaaaggaucuggacaauucaaauuggacauaggaauccuugaaucaaaacugaacaaauuaauuccagccacugaauauacauauugaggcaauauuugaaucacacaaccaaaaguacuuaugacuuggcugggcgcgguggcucaugcuuguaaucccagcacuuugggaggccgaggugggcggaucacgaagucaggagaucgagaccacggcgaaaccccgucucuacuaaaaauauaaaaaauuagccaggcgugguggcgggcgccuguagucccagcuacuuggagaggcugaggcaggagaauggcgugaacccgggaggcggagcuugcagugagcugagauugcaccacugcacuccagccugggugacagagcaagacuccgucucaaaaaaaaaaaaaaaaaaaaaaaguacuuaugacuuaaaguaaugcccucugucuagaaaaacuaaggaugaaguaugagcaacucauuaaaacaguccaaugauaaaguaauaacaaagguaggauguccagugugauucaugcuaucaccccaucuggcugagccacuuugugccuugucuagucaauaagccggguccuaucagauuaaugacgggcagguaaaugcacuagaaauuagucacagcccuaucaagccuagcacaaauuuugguauaagguaugacuauagggcauccccacaccccuugcucuggguuaaacugauauauauggcauguucucuggucucuacuaucuuaucuuaagggucccaguauuauccuucugaauaaccucuaaguuuuuaagaucacauauuuaaauaucagucugcagucaugcugaggacaggaguguuuuuguuguuuuuucuguuuuaacuugcucauuuuuauggugaagguagacaggaguuuuaaacuaucagcacagaugucuaaguugcucacauaaacaucucuaaaguguguguguguguguguguguauacacauguacuuuagagauguguacagacauacacauuccuguuaauuaaugauuaaaacuuauguuuuguacuugucacauauucaugaugaaauuuugacaugacacauauaacauuaaaaauaguguuagaaccacuaagacaaauuuaacaaaaaauguguuaaaacuaucacauuaacacugaagcacgggguaaggaaauuuguaaguuuuccguucauaaaaaagaaagacuaucauuuaaucaucaccguauggccagcagcccugaaaacuccuuuauuuuauauaguaugcugcagacacacacagucucacccccaaaagaaugaagagcagauuaagagcucccagugugcagaaagaaucaaagguagacuucugaguuaugcucaaauuuugauguccauaaggacuaaauacagaaugacauaauuccugccuugugguugauaauguccuccagauuugguuggcaaagacuugggaauuuucguuuaguaaaagaaaagaaaagaaaagaaaagaaaaaaaaaguaugccuaacuggacacaaacuccaaauggguccacacucaaauuucaaacuuaauuuaugcuucaaaagaugucagauuuuaaagauuguuaucuaguacauaaacuuuaaucuaaaggcuguaaaagccaucucuccuuuuguuggguggggcagggaauagacuauaaauauuuaaaugacaagauaacaucuaaugaucugauccuuuuucugcucucuaaaagauagagggcaguuguuucuguaguuucauuaaaauaggaaaucauuaaaaccauccaaugauaaaaguaaucacaaaacuaagauauccgguuugauucauguuaucaccccaucuggcugaaccacuuugugucuuguucagucaauaagcuggguucuaucagauuaacagcagguagguaaauaaacaaaaaauuagccgcagcccuaucaagccuagcacagauuccuuaguuuuguuaucaaguagguugccaaccuugguagcagaaaccagaacacagcugauuccuaucucuauccccauuucuaagaauaugaacaucugauucugauuaaugaaacuacauuaaagagauaaaagagccugggugcgguggcucaugccuguaaucccaacacuuugggaggccaaggcacgcagaucacuugagcgcaggaguucaagaccggccugggcaacauggcgaaacccggucucuacaaaaacagaaaaaucagcugggcgugauggugcacaccuguagucccagcuauucgggaggccgagguggguggauggcuugagcccgggaagcagagguugcagugagccaugaucacacuacuguacucuagucugggcaauagaccagaucuuguaucaaaaaaaaaaaaaaaaaaaaaaggccaggugagguggcucacgccuguaauccuguaaucccagcacuuugggaggccgaggcggguggaucaccugacguugggaguucgagaccagccugaccaacaugaagaaaccccaucucuacuaaaaauacaaaauuagccgggcgugguggcacaugccuguaaucccagcugcucucgaggcugaggcaggagaaucauuugaacccaggaagcggagguugcagugagccgagauugcaccauugcacuccagccugggcaacaaaagcgagacuccgucucaaauaaaguuucugcaaaagcaggauccaguuuuuguuuguuugguugguuuuuuuuuuuuuuuuuuuuuugagacagagucuggcucuguugcccaggcuggauggagugaaguggugugauccuggcucacugcuaccucugccacccagguucaagcaauucuccugccucagccucccaaguagcugggauuacaggcaugcgcaccaugcccagcuaguuuuuguacuuuuaguagagacgggguuucaccauguuguccaggcuggucuugaaacucccgaccucaagugauccgcccaccucggccucccaaaguguugggauuacaggcgugagccaccgugcuuggccaggauccaguuuuuauauaaaaaaaaucgggccgggcgugguggcucacgccuguaaucccagcacuuugagaggccgaggcgggcggaucaccugaggucaggaguucgauaccagccucaacauggagaaacccugucucuacuaaaaaaaauacaaaauuagccgggcgugguggugcaugccuguaaucccagcuacucgagaggcugaggugggagaauugcuugaaccagggaggcggaaguugcugugagccgagauugcgccauugcacuccagucugggcaaccagagcgaaacuccgucucaaaaaaaaaaaaaaaaaaaaucauauuuaaaaaucucuuaauuauaggcaaaaauaucagcaucauuaguauauaagguguccccaaagucuuagcacaauuguaagcuuuaauaaccucaggaguacaguugcugcaaacugacuaaaaacaucaacuggaaguuuaauuaaugacuuaacuaucuuugacacuuaguuuugugaauuuugaguaacagauuucuuuuucagauuauuugaaccacacuuggcuuguugacacucuaugaguggcugugaauaaagcaaaugucucuugugugacgcaacaacuuuuuuuuuuuugagacagagucucgcucugucgcccaggcuggagugcaguggugcgaucucagcucgcugcaagcucugccucccggguucacgccauucuuccugccucagccucccgaguagcugggacuacaggcgcccgccaccaugccaggcuaauuuuuuuguauuuuuaguagagacgagguuucaccguguuagccaagaugaucucgaucuccugaccucgugauccaccugccucagccucccaaagugcugggauuacaggcgugagccacugugcccagccacaacagcuuuuuacguuuaagaaucaaaaguuggccaggcgcaguggcucaugccuauaaucccaacacuuugggaggccaagguagguggaucaccugaggucaggaauucaagaccaaccuggagaacauggcaaaacuccauaucuacuaaaaauacaaaaauuagccggguaugguggcacgugcuuguaauccaagcuacucaggaggcugagacagaauagcuugaacccaggaggcggagguugcagugagucgagauugcacugcugcacuccagccugggcgacagagcgagacucugucucaaaaaaauaaaauaaaauaaaaaguuuccuucaucaccaauguugacguucccagggcucuccuagacauucacgggucuacaggguaggggaguagugacaaggaaauagaagccucacaauagccacugcuagagaugguuuagguugugcugcucggaggaauaaaugucuggacaaugagauaagacccuucguaaauacugcaccuucucuuuccuuucuuacuuauuugcaugaaccuguuuuacagcauccugcacugucagccaaagacaauaaaaaaauaagucaccucacccuguauguuuuuagcuugguaaaaugcugucauaucuuuuacuuaacuuggucacuugguuaguaacuagguaagcaaaccuauuuauagccaugugccuauuaaaacacacuuuaccauaaaagugagaugcacuuuccacuaaggauagaguuucauccaauaguccucuugacaagcuucagaaguuuucucuuugccaucaucuacauaccuggaaaggcacucuguaccaaaaucagcauacugaacuagcaaggacagacagagaugagaggaaaagagaccauggagcugaaaauagcuagaacaaucuaaaaggcaucuaucuguuccaagguuagaauaguacugaucaacaagacuaacaaacuagaauaaucugugacuucuuggucaacuagaaguacagguuauuucacacgaaacaaugaacaagugauuugggaagaagggaucauccauucuuauagcuuauaaguggcuuauacacuccuuccauuuaagggguaugaucuugcuauuuuuaaagugagugcccucaugggcuuuuuaaaaagaucuucaggccgggcacaguggcucacgccuguaaucccagcacuuugggaggccgaggugggcggaucaccugaggucaggaguucgagaccagccuggccaacauggcaaaaccccaucuccacuacaaauacaaaaaaaaauagcuaggcgugguggcccaugccuguagucccagcuacucgggaggcugaggcaggagaaucucuugaacccgggaggcagaggcugcagugagccaagaucacaccacugcacuccagacugggcaacagagcgagccuaucucaaaaaaacaaaacaaaaaaaauccucagcuguaaaacucagggaacaaaaaaaauucugaaaaacaguacacaauugauuacacaaguauucagugaguugaucagaacauacugaaauauuucaaaauauuaccuggucacugcuacuuaucccuuccccuuccuuccaaugugcacaugagcacucaagugcucaacuucagguauaggaaaagaaguuaacguucucaugaaaacacugaaggcccuuaaagaccuaaacuaggaugaguaagauuuaaaaaacaugugugugacuagaccguaagaaucaggaaauguuauuauaaaaaugaaaccuuagcauuguucugaaauauuucauaauuuucuaaaagauaacaauagauaaugcuaaucagagaauacuaugcuuaagagaauccugguauccucugcuaagucaaaaggacuggauacaaaaugcaggcagagcagcuacaaucaauacacauuacccacagccacccagagacucuuucucacaccagccagcaguuggcacugccacaccauuggcaacuaaugacaggcugaccuaacaggagcugggaacgaaagcgaaggugucagaaagacauauauauuuccaaaugaaauacuguugacuuugaaauaaucuguuuuuucacauuauccuccauagagauuuccccuucaugggggcauggauaagaaguugaaaauauuuuaaauuagaaucuuuggacaauuuugaugguaaggagcuggggggcagaaagcauaauuuuauugagcuaaacaccucaagugaagcuucuucagacuugaggugaugaaaaaauuuuaaaacuuaaaagaagagaagcuucuucauucacuguaauaauuuuuaaaaaucuguuaguuaccaagucaccauguuuuaggaccacauuucuggauuccuagagaaugccauuuacuaugacuugauaaaaaucuaagucaacugcuauucagauucauuugcuauuaacgaagcaccuguaucaacucuuucuaaucucuuugcaaugguguuuugaguuuugucagguaucuguuuuauaauauugucacauccccaaaauaaugauauaaaaaauaaauauuaacaaaauucaaaaaaaaauauuuuaaauuaucccaauauacuuucaauguggcucuuuuaaaauggauuauacucuaauauacuuuucauuuuauuucauuuuuuuaccaugaacugagaucagacaguugcgcggcaucuggagauaacauauugguagugccuuggaagagucucuugggcugacuuucugucuccauuucaccuaaaacagaaagagaugaugcuacuauaaaacaauuuuacaaauacaggcguggugcuaacauaugaugaccuuuguuuaaccaaagcucagaauacuucuucaaaccacuucuuaaaacuauuuucccaugugcuuuaacauggaagaaauaugcuuccacauaaacucaaucaaaaaguuggcagcccuaaaaaacuucucacucauuauccacagcgugcuauggacauauucacauuaauaggaaaguagaacacugacugcaucaggcaaaaugaagcaaggcugaccacaguagagauaaggaauucccaaauaacugaaacucacagucaauauuguaugcuacaugguuagcaaggccuauugguuuuauauauuuugauaccugaacauuuccugagauggugucaaacugguuuaaaaauguguagucugauaaguaguguauaaguaaaaaguugcuuucacacuauuuaaugaaaaugaagauuaaaaagauaaguuugaaaacacaccuguaaucaaaagcaaaucuuacucaauucacaaaacugguauuguacugaccaccucaaucauacagaucuucucagaauugcuaauagaaaaacuuugcaccaacagggauaaugcuuaacauuuugcuaccaggaguacaaagaguaaaacccuaaguuagaauaaucuccuuuaaaaucaggcucugauuuuauuuaaaacauacacauuccuugguucugaagcucuucaucugagcuugaaaacggaauguucaagacaauuuaauucaugagccugucuauacuccaguagaaaauuaguaacuuugaacuuaaaacuguacaauuagaaugaaaaaagaucaagcaagaacaaacgcaacauucauuuuguccauguuaucaacuaauucauauuaucuuuccucugggacuauucugaaaauugcugaaaauccucaaaaguuguuuuuuuccaugcuuuaauaugcagcuuuuaaaaguugcugcugggcuuuugaguucgccucacuagcaaaagacuuuagcucuuuugagcaaagaauuccuccaucugcugguguauuucggaauagcuguaaaacuaaacaaccauacuaauuccuucaacuuccugcaacaaauuuuaaguuaguaauaauaacaacaauaauagcuuuauuuccaacuguuauuuucacuuacuggcuacugagaacauuccuaggacuacaaauaacucccuauaagauuaaggaaagacuguuuauaaaauaaaacuuauaaacuaaauacaaauauugucaccauaucaggaacuauuuuccagagcacaccaucuuuaauuuuaaguuguuugaaauacagcacuuuuggaaucuguguaugauccuaugauuggaaaguuuucaaagccacaaauaccuguuccccuaacguuagaaaaguuggucuguuuauuggcccugaaggugauccgcacaaagaaaccacuugcugaauugcuuuuaaaaguacgguuggccaggcacgguggcucacgccuguaaucccagcauuuugggaggccgaggcaggcaaucaccugaagucaggaguuugagaccagccuggccaacaugacaaaaccccaucucuacuaaaaauacaaaauucucugggcgugguggugugcaccuguaaucccagcuauuugggaggcugaggcagaagaauaacuugaacccaggaggcggagguugcagugagccaagaucauaccacugcacuccagccugggugacagagcaagacuccgucucaauuaaaaaaaaaaaguuauuguuaaugacuggucucaauuaaaaaaaaaaaguuauuguuaauggcugggcaugguggcucauaccuguguaaucccugcaauuugggaggccaaggcagguggaucacuugaggccaggaguuugaggacaguguugccaacauggcgaaacccugucucuacuaaaaauacaaaaauuagcuggccauggugguguacuccuguaaucccagguacuugggaggcugaggcaggagaaucgcuugaacccaggagcccaggaggcagagguugcagugagcugagauugcaccacugcacuccagcaugggugacagagcaagaccuugccucaaaaaaaaaaaaaaaaaaguuauuguuaagacucguuuaaaaugacacguugacacuugcaaucauguagucauauccccaggaauaaugaauaaaccuguguugccggcugggcgugguggcucauaccuguaaucccagcacuuugggaggccgaggcagguggaucaucugaggucaggaguucaagaccaauauggugaaacucugccuuuauuaaaaauacagaaaauucgccaggcguggugguggugggugcuucuaaucccagcuacucgggagacugaggcaagagaaucgcugagcccaggagguggagguugcagugagccaagaucacgccacuacacuccagagucugggcaacaagaacgaaauucggucucaaaaaaaacaaacaaaaaccuguguugcuuuuuuuuuuuuuugagacagggucucacucuguggcccaggcugccaucucggcucacugcaaccucugcuuccugggcucaaggaauucuccagccucacccucccaaguagcugugacaacagcacaagccaccaacgccugcuuaauuuuuguauuuuuuguagagacgugguuuugccauguugccuaggcuggucucaaacuccugagcucaaagcaauucuccugucucggccucccaaagugcugguauuacagaccuguauugccuuuuuaaagagaugccaucaggugcccuuuauaagcaucuaacacuaguguugacugauacuaaacuaaacuauuuuagccuacugcuuugugguucaaaauaagguaacugagagcacccuguuauauaaaaaacuccauagaauugaauauaaggcaauucuugcuuugaugaggcauaauuugaugaggggguaaaccuuaccuuauauuugaguauacagcacauuuauggauauguuugcuacggcauuagcauauauuucugcaguuuauaaacuaugcaucucuuucauauuuagauaacagagaggcaauuuuuugaauauauaaugauaauaugaauauaugaauaaaacuguuaugaaguauaagaaaauauagauguaucaaauaacucauuuacaaaauugagaaucagcacagcaaacauuuggaagaauacuuuugaguuucccuagaacacaagagagcaaugcuguuagcucauuucagacaggaguucuaguuuuuaauucaagcuuggcuagguauaagaccagaagcgugaugcuuaucuuuuucuuuuuccccccagcuuuacugaaguauaaaugacaaauaaauuuauauauauuuaagguauacaaugugaugaucugauguauguacauacugugaaaugaugaucacagucaauuuuuuuuuuuuugagauggagugucacucuguugcccaggcuggagugcagugguacgaucucagcucaccacaaccuccgccucccaaguucaagcgauucuccugccucagccucccaaguagcugggauuacagguaccugccaccacgcccagcuaauuuuuguauuuuuaguagagaugggauuuugucauauuggccaggcuggucucaaacuccugacccgaggcgauccaccugccucggccuccgaaaguauugggauuacaggcgugagccaccaugcccagcccacggucaaguuuuuaacacaucuuuugcuucaccuaguuaccuuucguaugugugugguaagaacacuuaagaucuacuuucuuagcaaauuucaaguaugugacacaguagcauuagcuauagucaccacgcugcuacauaccuuuucuuuuaagaggaccaagaacacugggucuaaugcacuugacuggacucugacuucuccugcuuugaugaaaaaacaaacaggauaaugugaagaacauccacgaugcaagauaaaacagcaguccagcccaacaaauacauaaauaaaauggacaaucuuaucaaugacugaaauggaaaauucuucuguaauugaguaacugaaauccaauacaugauuugaaccagcauauggcaaccuggaauaauacagcauuuuaaguccuuuaaaaaauauucuauaugacaaaauacccccaacaguuuaaagaaaaaaagauacccuauuuaaaaaguauuuuggggcugggccgcagugacucacgccugugaucccagcauuuugagaggucaagguaagcagaucaucugaggucaggaguucgagaccagccugaccaacauggugaaacucuaucucuacuaaaaacacaaaaaauuagccaggcgugguggugcaugccuguaaucccagcuacccaggaggcugagacaggagaaucacuugaacccgggaggcagagguugcagugagcugagaucgcaccauugcacuccagccugggcaacaggagcaaaacuccgucgcaaaaauaaauaaauaaaguaauuuggauuugauugaucuaugaacuuuaacauuuuuuccuuauucuuaaaaaggauguauuauugugggggguauguaugugugucuuuccccacuaaauauaaaucagcauuaaauucccccuaaaaaacucuggggcugggcgcuguggcucacgccuguaaucccaguacuuugggaggccgaggagggcacgaggucaagagauugagaccauccuggccaacauggugaaacccuaucucuacuaaaaauacaaaaauuagccgagggugguggcgcaugccuguaaucccagcuacuugggaggcugagggaagagaaaugcuugaacccaggaggcagagguuucagugagcugagaucacacuacugcacucuagccuggcgacagagugagauuccaccucaaauacaaaaaaaaagaaaagaaaaaacucugguuaaaauguuaaugguagauuauaggcaguggguauaugguuguucacugugaaauucuuucacuuuugaugucugaaaauuucacagugaaauauugggaaaaagaguuaaucuucuuuuuuuuuuuuuuuuugagacagaguuuuugcucuguugcccaggcuggaguauaauggugcgaucucagcucacugcaaccuccgccugcuugguucaagcgauucuccugccucagccucccgaguaacugggauuacaggcgccugccaccaggcccagcuaauuuuucuauuuuuaguagagacgagguuucaccauguuggccaagcuggucuugaacucuugaccucagguaauccaccagccucggccuuccaaagugcuaggauuacaggugugagccacugcgcccagccacaaaaagcuaaucugagagauaaauguaaugaaugguacuucaaccacauuuaaaauucaaguuugcuuaccuugaaaaucgucuuggacugggaacuggacuugguggcaauccacugcugcucacgaacaucuguaagaagggugaaaaacauuacuagaaaaaacauauucaauauuaaaauaguucuagcacuccaguuuucuuucuuuuuuuuuuuuuuuuuuuuuuuuagagacagggucucucuuuugcucaagcuggagugcagugaugcgaucauagcuuacugcagccucgaacucuugggcucaagccaucuuccugccccaccuucuugaugagcuaggacuacaggugugcgccaccaugcccgacuaauuuuuuuguaucuauuuuuuuuuuuuuaauguagagauggggucucgccauguugcccaggcugcucucgaccuccugagcucaagugauccucccaccuuggccucccaaagaguuggaaugauuacagguauaagccaccauaccaggcccacaaucauuuucaaaagguucuuuucaaaaugacagaaacaauaucuuuagaauugcuuggcugucugugugucucauaacuaaauuacauauauauauauguaauauauauguaauauacacguuauauauauguaauauacacguuauauguguaauauauacacguuauauauguguaauauauacacguuauauauguguaauauauacguuauauauguguaauauauacacguuauauauguguaauauauacacguuauauauguguaauauauacacguuauauauguguaauauauacacguuauauauguguaauauauacacguuauauauguguaauauauacacguuauauauguguaauauauacacguuauauauguguaauauauacacguuauauauguguaauauauacacguuauauauguguaauauauacacguuauauauguguaauauauacacguuauauauguguaauauauacacguuauauauguguuauauauguuauauauguguuauauauacguuauauauguaauauauacguuauauauguaauauguuauauauauguaauauauauguuauauauauauauauuuuaagaagaccaagaauauacauauauauauguauauuuuccaaauuacugcuguagauuuucauugauuuuccuucaaggcauuggauacuuuaaaaguggggugauuuguguguguuuuagaguaaacagcucaguuugugaaauacacuuaauaucuugucaguuauccuaccuuuccgaauccccuggugggugaaggugcuggagaaacuggagugaagucaauucucuuaggagaauauaauuucuccggcuugucaaaaucacugucacucuguaaacauaaagugucaucuccucauaauaaauucagcacaucacagcucuuacuuacuacuauaacacacccagauuuuccaaggagaaagguauagacucuaauauucugcuggaaaagcagagaucaaaaaacaaguaucaauuuggaaguagaaggggaaagaagugugcgaaaaaauuaaugaaccuagugaacaacauaaaaguuucuagaaaaugaaaaccaaacagacaugagcaaacuuuaccaggcucaagcucucaucccaugauuggcuuaucugcauugccguuugcauuucccuaaaauaaacaaagggaagggccgucaguguuuacaaacaagacacuuauuaggcuaggcccugcucuugcaaagcacuaaccuuucaugugcaguuucucuguucaccauauccaggccuucuuccugcaaagacaaacauauaugcuaaaaaggcaggaucacugacaaaauauuaacucuuccacacacugcaauuuuuauccacauaguucucugcuucaaauaaaauaaaaagacuuuuucuaccucauugacauaaucacaguagaguggaacauucaugccgcuuguauauuuuaucuacacgcuccagaagaauuauaaucugucuccaacuaaccagaguugcauccuaauucauuuuaauaucuacgucuuuaaaauaaaaauguaaaauccaaaaaauuuccaaucugagcuaguaaguaaaauuuacccuuuugaucugaugcagucugcuacuaggaauacgauuaggugaggaugacagcaacuggaaagaaaaaguaaacauuuacuauuuucugaaucacaaagcagcagucugcugucaguacuggcguacaaccucuuccuagguaaguuuucauauucuucuucaaaauuuagcucuuuagaucacugaacguuaaugcacuaaaggcaguacauuuagucuucaaaaaguacaccagguguccaaccucaaagcgccaucuguugcuagacagacacugacuucagcacuuuucccaaaugaaugugaagcuacguaaauuuagagaaauaaagacuaugggccuuagaaauauccauuaucccacuuaucuaaaauaaagaacaauaugagaagggaaagaaaaaaaaacaccaauguuauuaauuuuuauuaucaaugcagcaaugggggaagacaggcuaauaagucuaguauauaauauuuugucuaugauugaugauuuucaaaaacacuuuaaaacugcaauaaggagguuuugcuuucacgauccaaauccauucuaaaaucucaucauaugcuaucacuacaaaucuuacuaguuaacaaaaaacaauuuggaaagacaagguguaucuuuaaaauaacugaugcuuucccuuagaucaucauuuuuuaauaacacaaagcagaaaugauuuggaggccaaauuauguuccuucacaauaauuacaagcuggucacaaacuguaagacacaauucauaucaacaggucuuagagaguucuaguggucauaauauaaacgacuacuauuuauucuauaacgaaaugcaagugaacuuguaauacuauaaaaccaaauaacaauuauccuguuuaagaggcccuacacuauuaaaacuuauuugaauacuaauguagugagcaguauaaaauagugauaaaaugcucuaaguuucuuuuuauuuuuuuuugagacagaguuucgcucuuguugcccaggcuggaaugcaauggcaugaucucugcucacugcaacuuccgccucccagguucaagugauuccccugccucagccuccugaguagcugggacuacaggcacacaccaccaugcccagcgaauuuuuacaaccauuaagggagacuggaguauaagauaaauguauuuuaguagagacgggguuucaucauguuggcuaggaugaucucgaucuccugaccucgugauccuccugccuuggcccuccaaagugcugggauuacaggcgugagccacugcgcccagccacuggugaacucuuaauaagaucauuuagaaaacaccaagcuacaaggcaagcaaauacagcaggaagacucuccaacaggagacuguggaagagagcgcagacgugucacuuagggaaacccaagaaacugaagaagcagugaaaugaucaggaaagcugacaugaggauggccaaaaacuaacuggggagaaagucagaaauuuacaugcuacauuuacauaauauacaacuugacaauuuuagacaaaacuggaaagaagaccagaaagaagaacagagcaaagcuguguguaguaccagaaacaacagggcaaugugucggcuuaaaaaaaaaaagaaaagaaaaagccagaacuccaaggaggugcuggcuaaugggguuaaauaaagcaaagaggucaagggggauaagcaacgaggccccugacauuggcaguuaaguggguacuggugacuuuugcaagaacaguuuuuuaauggaguugugguagaagcagcaugauuacaaacuggccagaaaugaggagacaaggaauuagaggcaguggaguguagauuaugcuuugaaagaacuuggagaggggaaggaaaagggaaggagagaccuacgaaaaagaaaacaguuuguuuucccccaucagaugagugagucuggagaagguggaaagaagagagcccgugaggaauagggaaaagauacaagauagagaggagaugauagaccgagcaaagcaacaggagagucaaaagcauaugaaccauuggggagaaaugccauaugugaagcuaaaggcauuucaaggcaaagaaagcugacauuuacacaagauaggugucugucuucuuuguaaaguaagaagggucaucugcucaaaguaaaaagugguuacacuggaagcggacagaaucuuuuaaaaaagugagaauacugcuuugaagaauaucauggggccagaggcaccuuaaauccaauuaugucccaaagaauucaucuuuuuccccuucaaacuaccaaucucuacuccuacuaaaggcagcgccaacccccggucaccaaaauacaaaauuuccaucacuuggagucuuccuucucuuaguccuuauaucuaaucagcuggugagccaugaagauccuacaucugcauauccaguccauuucauuuguaaacaccuuacucaucacagguuaccaugggacacagauaaacguacuaagauuuauagcacauccugugauagaguguauauaguguaauuaauauuaugauaguuguggaagccugcccaaaggagauauaaggauuaaacugaguuuuggaagaccaaaaagcuagaaaggagagggguaggaaugaaaagaugauaaggaucaacaaagagcagugagucaccauggcccuuucagaaaacuagguauuucagugagagaugaaccuagaccaugguugauaagaaucuucucaucuuacaaaagagguaagugaaguguagagaggcaaauucacuuucccuucuuugcuaugcuacuguuaucaggagcauggcuguauaacauguauaaacauuuuuucauauauccagcaaaaauaaguaauauuuuccaguguccucagagaaggaggugaaaugaaugaaaccuccagauagcuaacauuucccccuguaaguauuuucagccauuucaguuggaaaucuuucuacaauguguucuauuuuucccuuucuuaaacaaauuauaccaaacagaauugcacugggagaucucuauucuaaucccaguucuaccacuuacuaauugugcgauucugagcaagugacuucuaacgucuugaguuuuagcugcugcuucuuuuaauugggaaaaauaucuuugcccucccuauuucauaggggcuguuaugacaauuaaaugugugaaaguacuuuguaauacguaaaauacuaugcaaguguagguauuacuagaauuuaugaauaaguuaaugacccagguauccuuaagaacguaaauuauuauaugauucuacaccagugacacgcuugggguguacuaacaggcucuuagcccuuauacuaauuagccacaaacuaauuuuuuaaaaacaucuguuuuucaguuuuucccucuccucccuugcuagcagcuauuaguauacuuuuaaccaaaaugcaucucuucuaauuugcugcuucucacacacuauuggauuggaagcuuauuauaauugugcauacauuuuagaugauucagaggucagaggcucuccuauaaauaaaccgaugaaccucugugcacagacuauggaaaucuaguucugccauuuagggaucuaucuucuuucaccucggaugucuuccagagaauugaagcugcuugauaagugaguuccacaugugaacugcuacuauauaaaaaaccucaucauaauuucucccaaugcgaccaacuaauaaagcaaucccugacagcucuggcuauagagaucagucacaaucaguaacucuucagagaauauaaauacaagcauuuuaaaggagucuucauuuuggaaaaccagcauuguuuaacagguaagugucagaaacaaacacucugcuaccuuuaagugauuugugcauccuacgacaaaugaagaccacuguucucagcuauaauuaggaguuaauccugacuuaccucacaagccugaugcaaguagugacaaauaauaaugaacaauuuuaaaaaauacaaagucacacagcaaagaaaaauuuuuaaccauguauccuuuugguaccaaaagcugaauggccacagcauaagcaguaaacaacauagguaaaaucaaucuuuucuuucuuaaacaauugugcauagcacaucauuuuaagaaagaacuccauuucaaaguauuuuccccaaucuaaaucacuucagauacuuacuucuauacuuaccaggcugugacggcucauaauuguuguacuauuccuccgaguucuaaguguguaagguuggaaaaccugugaaaggucacugaaaaaaacaaaaacaaacaaacaaaaaaaacaaaauuaguaauguuuucuaauggaagaucucuuucaaauacauuagcaucaguuaucuaguuaacaacgaaaucuuccauggcuccucauuucauacagagaaugaacuccucaccguccucucugcagagcuucccaagugguaugcuguggauuauggguuugcagagauacugaucucaguggucggggggcagcugggagaggugaugcaggcggagcuccagacugguugacucuagcugcuucuggucagagcuacgcccccaaaccgguuaccaccagaccugagcagccucaucuguuuaccccagagaaccaaugaguacuguuuucuguguuugccaugaugcgaaaaggggugaggagcauuguucuacaauaugagcuggaucaagacaucuccccucucacccuaaacauguguccuaccuuugaacacugcuguuugauggaauaaacauagcugagauuguugccccuucugccucaaaugcucucccuccugccaacaucuauuaaaauccuuccuguccuuccacauccaucuugaaugccauacccuucagugaaggcauggcacaaaccucucuucaauccacaaacggaaugcaaucacucucuccuuugaacccaaagaguacacugggagaugagaugcuucuugagacaccuacuuugucucuuaauuaaagagaaauguggaugugucuuaaacccauugguagagagguguuuuguuaaucuuuguauaauaucccugcagugccuagcagagggcgaugcccacaauaaggaugagaauuccagaaggauuuucagaacugaacugcacugggcuuucagggcccacugagaucaccuaauucagcucucuuaauuuucaaagagagaacagccucagaaagguuaaaugacucauucgugaucauagcuaguuagugaaaacugggaccaggccuggucuccuugccccuucuugugucacaucaugcuguguuuucagugauuauuuaaaucaugauucaaaaaacaguauguuuuugcuacaauagucuaaauacaggucaauagaauugcugaagucccuagcaauugcuugcuuaugagauuucaaaagacaaucagaaaaagaccaguuuauuguuauaguaaccaaaauaaaugcagggccaaggacagcaacaggaaagcaaaaagucacuccuacauucccucaguuucaaaauuauacuuaauaaaugaaaaagucaaccuguuuuuuccccaaaauauggauguuauaaucaguucaacagcaaggauuaucucuuucuuugccuucacugugcuugauuaauauguuuuuggcuaauuguacucucaucuccuuuuuuggacuaaugccauuucuacagggucucgcaaauuggcucucuaccuaagaugaauugucuccuuauaaaagugaaauacaauaggcucaggaggugagccaaccuaaccuucacuauuacaagaugcuaccuuaaaacagacccucgaugacuuauugacaugaaaacacaagacccuaccacugaaauugaagagucgauucucuccaccguuuucuaaaaccugccuuuucacugacccuaagcuacagaccacccuucuuuuuuauucacugcaaugcauuucaggcaguuuuagaaccugaaaacauuagggcaaauccaaaucacguacuacgaugugaacauaccacuuaauuacaaguuauuagauaaauugugauuuauuaaaguaaacaucuguuaaugccaggauuccuaaacuaagcuuagaaauagcagcucugagagacaggugucaaguugcacaucuaguuccaggggcuucgaucugacauucccugguguaaguuagucggggcaagcaaccugucagaagagccagaagcuuucugcaguuccuuuuacagagggacaacauggccccagguagagggggaccguuuccuccacacugcccaaaguuggagauuaaacuuucacuccaccuugggacccaagucacugucaagcaaacaagucgccacccccucagguugaagagcccaaaugagcucaaacgugcacuuuaaggaaggaagauugcuugcaugggggcaaggagccccugaauccuguacuccauccuccccaacccugcucaccugagcccauggauuaggggagcgcugcuggaucuccucaggguucccccauaagaugugucaggcucaagguccagcuccauuuucuccugagccaugucagacuugcaggcaggcacagcgggcagugcucagcuccuggugcuuagcuauggacucccaagacucucacugcaggacugagcugcuggggacuggcagcugggggcgggggcuaaggggcggaggcuuggggacgggggcgggggcugggggcggagaaaaguaggagaggaggagggaaggaggaugaugaugaggaagggaggaugauggugaggcaggagaggaggacgaagagguagugguggaaggugacagaaugaaggaaaaggaugaaggaaagaaggauggagggaaaacaaggauggagggaggagggaagagggagggaaaaggauagguggaaaagcaggaggacagagaggauaagaggagggcagaggggggaaagggagaggaagggggcggaggagggaggggaagggagagggcagaggggagggaggaggacagaggguaagggaaaagaagcgcaggggcgggaaagaaggagguggucugggaagaggagagaggagggagaagaggagggggaggaaacuaggcagcggcggaacucaugcugcuaucuuuccggcugaggaccacaagcggggccgggcuacagaugcugcggcugcccgggcagcgcuagcaccgaggaccugacagucggguaggacccggccgggcggccuuggcggcuccagcuccccaugcucggggacccgguccagccccccaugcucccggacccggucccggaggcuccucagcccugggaucggugcuucuccccucccugccccccucccgccucgaggacagguuggggguucggccucucagccgccgccgcggugccuccucuuccucucucggguucuaauggucugggggaacccguuggggccaagaccaaaaucuacaaccugcagucucuuccgccucccacgcuucagaagcgggaaccuccgcugggccaguucuuccgcguc

SEQ ID NO: 18989 - RNA, 1196 nt, Homo sapiens
auuucuuuucaauaaugucugacauuuauugaaaauaaggaaaagacuuucuccagguaguguauuagagcagagcagaaugcagggguuacuguguugaacaaaaggcacacaucagagagacaguugcaaacucagaauacugcguuaugggcaaaacuaacugguccacaagagaaaaugagagacucgauuuggcugccaggaacaccugggccuaggcaagaacacaagagguuucuggggguggggaggaaauaggucucgcugaaggugacagaucccuuggggggcggccagcugucuggaucacuguccagggacuguggccagcccagauaccuccgaggugaguccagaucacuaggagcagcagucugucggugggaugcgauggauggcgauggcuguggcagcgcaggucugugggcagaaugauguagucgucuggcagucugguggggaggagagggcuuggcagcggcggcaguggguggucuguccaguguguaacaggagcccagcuugcagcuggagcgcaggacagcguccaaauguacaugggaggggcuggcuggcuggaaggagagggcggcggcucgcuccagagugaggcccaggggcggcagcaggagccuggagcgcuauuccuggaacaaaggcaagcacuacgcgggagggaacaggagcgcaggggacaucgcggcggcucgagggggagggaggcgcggagggagggcgccgguggcgacccuggcggcggccaguaacacagcggacccuccccagagcacccgcccccaggcccgagggucucccggccuagaaguccucguccuccucccauccaaagacucgcuucaucucggccagaaagccccgguaaucauugaggagggggcucuccuucuugauguaggggaucacccacugcagggcgggcccugugaggcgggugaugaggaacgucaccuucagggcgucgcuggagaacguguucucguccacgaacauguaggagcccgucugcacgaugaacuccgggagucggucgguaucgccgucaaacgucucgggaaagggaaucggguuccuccagcgacgcgucgcaggccggaucggcaaggccaggagggccuuuaucagcugcacccgaccguccaucgcugcuccucgcuucgcuggacgucaauggg

SEQ ID NO: 18990 - RNA, 1234 nt, Homo sapiens
cuccauuucuauuuaauagugucugacauuuauuaaaaauaaggaaaaaaccuuuguacagguaguguauuagagcagggaagggagcagggcuuacuguguugaacaaaaggcacccaucagagagacagcugcaaauucagaagaaaacaggauucuaggcaaaacuaacugguccacaggagaaaaugagagauucgauuugguugccaggcacacuuaagcccuggcagcuauguggcaggaacacaagaggucucuggggauggggaggaaaugggucucgcugaaggugacaggcuccuugggggacggccagcugucuggaucacuguccaggggcuguguccagcucggauaccuccgaggugaguccacaucacuaggagccacagucuguuggugagaugcgguggauggcgauggcagugguagcguaggucugugggcagaaugauguaguuggcuggcagucuggaggaguggagguggguuggcagcagcggcuguggguggucuguccaguauguaacaggagcccagcuugcaccugaagugcaggacagcguccaaaugugcauggaggggcugggcuggcaaaagagggcggaggcagcgcgcucuagagugcggcccaggagcugcagcaggagccuggagcgcuauuccuggaacaaaggcaagcacuacgcgggaggggacaggagcgcaggggacaucgcggcggcucgagggggagggaggcgcggagggagggcgccuguggagacccuagcgguggccacuggcacagcgaacucuucccagagcacccgcccccaggcccaagggucucccggccuagaaguccucguccuccucccauccaaagacccgcuucaucucggccaggaagccccgguaaucauugagcagggggcucuccuuccugauguaggggaucacccacugcagggcuggccccgugaggcgggugaugaggaacgucaccuucagggcgucguuggagaacguguucucguccacgaacauguaggagcucgucugcacgaugaacuccgggagucggucgguaucuccgucaaacgucucgggaaagggaaucggguuccuccagcgacgcgccgcgggccggaggggcccggccaggagggccuucaucagcugcacccgaccguccaucgugccgcgcgcgcuccgcggaguuucgcuggguugcgugggggucagcgcu

SEQ ID NO: 18991 - RNA, 11672 nt, Homo sapiens
uuuuacagaaaaauuuugaaagacuuaucuucugaagauacacggggcagaaaaggagacggagaaaauucuggaguuucugcugcugucacuucuaugucuguuccaacucccaucuaucagacuagcagcggacaguacaguauguauaggaaucaguuuccacauuauaaacacacaaaaccugacuuuucuguagaaagaaaugguguuaggaaaacuguaauacuuugauagugaugauuauuaaaggauguuuucagccaggaauaaugcgaaguacuguuucagcauuauuuacuccuuauaacaacuuugugacauaggcaauuaucaauguaugagggaacugagaccuacaacauuagauacuguuuuguuuuguuuuguuuuguuuuguuuugagacagagucucgcucuuguugcccaggccggagugcaguggcacaaucuuggcucacugcaaccucugccuucccgauucaagugauucuccugccucagccuccggaguagcugggauuacaggcgugugccaccacgcccggcuaauuuuuguauuuuuaguagagaggagguuucaccauauuggccaggcuggucucgaacuuugaccucaggugauccguccaccuuggccucccaaagugcugggauuauagacaugagccacugcgccuggccuuauuuuguucauucuuauaucuauguaguuccguacauaauugcuguauauuauauuaguauaauuccuuucagaacauuccuggcuuuuuuuuuuuuuuuugagguggaguuucgcucuguugcccagauuagagugcagugccaugaucucggcucacugcaacuuccaccucccggguucaagugauucuccugccucagccucccaaguagcugggauuacaggcguguaccacuucgcuuggcuaauuuuugcauuuuuaguagagacgggguuucaccauguuggccaggcuggucucaaacuccuccugaccugaagugauucacccaccuuggccucccaaagugcugggauuacaggcgugagccaccacgccuggccccugccuauucguuaaaaauauuuauuguuugauuuauauacaguaaaauucacucuuuggggaguuuaagucuaugaguuuugacaaauguguagaauaguauaacaccgccaaucaagauugaguucugucacccuaacgaauuuacuugugcugcccauuuguuaucucccccuccacuccuaacauuaaucuguuucauucagucuugccacaaaauauaugucccaucugaccaccucuugccgucuccaaccaccaccgccuugguuuaggcucucaucuuaauuacugaaguaggcauccaguuggucaucuugcuuccauucuugcucuaauaaucaguuuuccauacuguggccaaagugauuuauuuaagaugucaacuagaucacaucgcuccugcccaaaauccucuagugacauuuuaucacacuuagaauaaaauccggaucuuacaaggcauuacauuuaggaucugccuaccacucugaccucaucuccugccacuugguggcauucugaccaccccagacuuccuuacuguaccucagacacacgagcuuguuucugccucaggaucucuggaguugucauugcucaugccuggcauguucuucccccagauccuuauguggcuacucugcuuaagugucaccuccacaaagagaccacucucuucaaauauguggcuccucccuuuaguuucccuuaaccuccuauauuuuucuuuauagcauuuacauauaacuaagucaguacauauuaguuuaauuauagauuguauguauguaauuauagauuagcuuauucaugaucuguuuuccccacuagaauauaagauccuuaagggaaagaaccuuuuguuucauucacaacuacauccuugacauauaggaccuggcauauaguaggcuuucaguuguuuguuaugaauuaauuaaauaauauauauauagaauaccucuugagaaacugggggccaggcacuguaguucauguccguaaucucaguacguugagaggcugaggcuggaggauugcuugaagccacauucaggaccagccuuggcaacauagcaagacugugucuucacagaaaaaugaagaaaaaaaaaaaaaaaaaaagccgggcaucauggcaugugacuagucccaucuacucgggaggcugaaaugggaucucuugagucugggaguucgaaguuaccgugaaccgugaucguaccaccgcacuccagccugggcaauagagcaagaccagucucagaaaaagaagaaagaaagaaagaaacugggagcagugguugcaaggaaagaagcuugggagcagagaucagagguaguggggagguucacauguuaucacugaaauaaguguaguacaaacuaguauuuagggcaacauaggccaauagaacuucguaugauaaugggaauguuuauaucugcauugucccagaauaguagccacuaaaccaugugugacuguugagugcuugaaauauggcuggugggacugagaaacugaaauuuuaauuuuguuuaauuuuaguuaauuuaaauagccacauggagcuaauacccuaucagacagcucaguuuuagaauaaauacagcacauuaacagguaaauacacauguuaagaacaggaagauauguugcaaaaaugaaaauauguauucacacauauuuaauaucaaaacauuugcaucuacagguauguauuuugauauauuagguugguguaaaagaaauugcaguuuucaccacugaacauaauggcaaaaguauauaagucuguauaagcacaggaaaauaaugggaaggaugugcaccaaaaacaauaauuaucucaggauggcgguaaaagggggaaaaugaaauagagauagauaaugggaccuuuaauuuuauuuauguugauacuuauauaaauaaauguguauguguauauauguauauaauaauguguugcagggaagaagauugaaacuaauugcuaauauaacuucacagcaaaucucagccuggcguguuggaucacgccuguaaucccugcacuuugggaggccaaagugggaggaucacuugauuucaagaccagacugggcaauauagggagacccuaucucuauaaaaaauuuaaaaauuagcugagcauguccgugugcaucuauaguuccagcuacuugggaggcugagguaggaggauugcuugagcccaggagguagagugcaguggugaaccaggaccacaccacugcacuccagccugggugacaagugagacccugucucaaaaaaaauagccaacauaucccuguaucuaacauuuaaaaaaauauuuugaaacucauaaauuaaaguuggggcaguuggggagggauaauuaugaaugcgugaaaaaaaauauuuuuccaucacacacauauacauauacauguauuuuggcuuccugguagccaaagcauaaaaggaaaaaaaaauguuucauaacuguaaucugaaaagaggguacagagaugaggcauucgauucugaagaguauaugggaauugaauaaugcuaaaauguuuucuauuugaucaugccuuaugggcauuuaagggcugaggagaaagcaugaacacagguauaauucagugaaaaaauguuuguggggagcuaaguaguauuuucuacacaguggcuuucugcuaucuuuauuagugauuuucacuaggaaguaaaugaauagauuacauuucuuaacuaucacuuaaguaaauaucuuaauaacauguaauacauuuaacagugguaccacuagaaaaugaagcuaagaaaccauauaaagaugacuuauuuucucauuauauaaccuuuuauucuauugaauuuuuuccauaagcauguuaucuauucagaaauauuuuaaaguaauaauauuuuuaaugcuuuugacucaaaauuacaaacuauguuuauguuuccuuuuuauuuuuucuuaaaaauuaacuaucauggggccaagugcaguggcucaugccuguaaucccagcacuuugggaggcugaggcgggugaaucaccuggggucaggaauuugagaccagccuggccaacauggagaagcuccgucucuacuaaaaauauaaaaaucagcugggcaugguggcgcacaccuguaaucccagcuccuugggaggcugaggcacaagaauggcuugaacccaggaggcagagguugcagccagccgagaucgugccacugcacuccagccugggcgguagagcgagacuccaucucaaaaaagaaaaaaaaaaaagaaaugcuguuuuauuccuuuuacauguaguucaccuaaaguaaaguagucugcaguuaccaaguagaagugcauucauaccuguuuuaguaaauaguguuugugggcuuuuugccacuccuuugaauuaguguauuauauaaccuuacaauagcuauuuucucuuuuugauuaaaguugccauugccccaaauggagccuuacaguuggcaaguccaggcacagauggaguacagggacuucagacauuaaccaugacaaauucaggcaguacucagcaagguacaacuauucuucaguaugcacagaccucugauggacagcagauacuugugcccagcaaucagguggucguacaaaguaaguaugcuuucugucuacagaaagucuccuaacacugucagagacacuuacuaacuaacucauucacucuuguuuaccaucuagcugcaucaggagauaugcaaacauaucagauccgaacuacaccuucagcuacuucucugccacaaacuguggugaugacaucuccugugacucucaccucucagacaacuaagacagaugacccccaauugaaaagagaaauaagguuaaugaaaaacagguagguaguaaaaucguaguaccagaauggguaauguuuuuacaaaucucacaacauaaccagauguuaacuggaacuguauacagucaugggcugcaugacaauguuuaaguaaacaauggaccacauaaaugaaugacgguggucccauaaaauuauaauggagcuaaaaaguccugugcuaaugucauagugcaacacauuacucacguuuguggcaaugcugguauaaacaaaccuauugugcugccaaucauauaaaaguguagcacaugcaauuauguauagaacauaauacuugauacuauaauaaguuaauauguuacugguuuaugaauuuacuauacuuuuaaucauuauuuuaaaguguauaccuucuacuuuuuuuuuuuuuuuuuuaaaguuaacuguaggccaggcaugguggcucacgccuguaaucccagcugaggcgggcagaucacgaggucaggagaucgagaccauccuggcuaacguggugaaacuccaucucuacugaaaauacaaaaaaauuagcugggcgugguggcgggcgccuguagucccagcuacccgggaggcugaggcaggagaauggcaugaaucugggagccgaagcuugcaguaagcugagauugcgccacugcacuccagccugggcaacagagugagacucugucucaaaaaaaaaaauuuuuuuaacuguaaaacagccucaaggcagccccuacaggagguauuccagaagaaggcauuguuaucauaggagauaacagcucccuguguguuauugccccuaaagaccuuccagugggauaagguauggagguggaagacaaugauauugaugauccugacccuaggcuaguuagccuaggcuaauguugguguuggugucuuaauuuuuaacaaaaaaguucaaaaaguagaaaaguuauauuugguuuuugugauuuuuuuuuuuaagacaaggucucacugugucacccacacuggagugcaguggcacaaucuuggcuuacugcaaccucugccuccagggcucaagugauccucccagcucggccucccaaguagcugagacuacagauguauaccaccacacccagcuaauuuuuuuuuuuuuucuuguagaggugggguuuugccauguugcuuaggcuggucucagaccugggcucaagugauccauccaccugccucagccucccaaagugcugggauuacaggcaugaaccacugcacccagcccccaaaaauuuaaaauuagcuaguacaaccacuaugaaaaccaguauggagacuucucaaaaaacgaaaaauagaaaucuacccaaaggaaaagaaaucaauauaucagagggauaccuguacucauaaguuuacuugcagcacuauucacgcacaauagcuaauagaaucaacuauguguccaucaguggauaaauggauaagaaagaauuaaaucaugucauuugcagcaacauggauggaauugaaggucaguaucuuaagugaaauaagccaggcacaaaaagaaaaaauaucacauucucacuuauaugugggagcuaaaauauuugaacacauggaaguagagaguggaaaaauagggcugggcgugguggcuuaugccuguaaucccagcacuuugggaggccgaggcgggaggaucacuugagccuaggaguucaaugcaagccugggcaacauacccauugcuacaaaagauaaaaaauuagccaggcaugguggcgugugccuaaaaucccagcuacucgggaggcugaggugggaggauugcuugagcccaggggguugaggcagcaugaucgcaccacugcacuucagccugggcaacagagcaagacccuaucucaagaaaaaagagagaauggaaaaauagguaacagagacugggaacggugaggggcaaggaggaggaugaagagaguuaaaggguacaaacccauacacaguaagauaaaaggaauaaauucaguguuucauagcagaguaggaugaccacccuuaacaaaaaccuauuaauacucaggugauggacacccugaauccccugacuugaucgcuacacauuauauacauguaacagauuuucucaugugcuccauaaauaugcacagaaacauuuuaauggaaaaaaccauacaggccaggcgugguggcucacacguguaaucccagcauuuucggaggccaaggcaggaggaucacuugagcccaggaguuugagaccagccugggcaauauagggagaccccaucucuaaaaaaaauuuaaaacauuagcuagaugugguagaggcaggagaaucacuugaaccuggaggcagagguugcagugagccaugaucacgccauuguacuucagccugggcaacagagcaagacucuugucucaaaaauaaaacaaacaaaaaaaaacacacaaguaguuaauaaucauauaaaagacuacucagccuuauuaguaaucaaagaaauacacauuaaugcuacacauuuagauacccuuuauacccacccaauuggcaaaaauuuuaaagucuaaccaagaguuggcaaggauuuggaacaauggucaggaauucauagauacuacuauaggaguguaaauugaugcagccauuuuggaaauuaggccuuaucuuguacaguugacguggguauacucugugacccagcuguuuuagucugugugacugagaggaacuuggaggaaguauguauaagaauuuucauagcagcaaaaaaucaggaaacaaccucaagauucauugauaacagaauagguacauauugagccuaaacauaaaaauggggggaaaaaagaauagguacauaaauugugacuguauuuauagaauggaauguuuauuuguaaugacugaaugaauaaucauuucaacaugaauaaaucuuagaaaaauugaaugaaaaaacaaguugcaacagaauacacaaaguaugauauuuuauaauuuuagaaaauaaaugauagcaguuuuagggucauauacguauauacuacaacuauaaaaauaagaaaugagaugucacguagcaaaaauuauaaagugguaauacugucugucauugggcauauaaggaaaaggguaccucacauacauuacugagggaaguacggaguuuuaugguaucuacuugccccaacauuucuacuuguaugugacaaaagauaccauaaagaaacuuaaaaauaagucuguuaacugggaaaaauauuugcaacuuuuauauaaagagaaagaauuacgagauguauagguuauauaaagauuuauuucuguaaauaagagaccuaacagaaggaaaccggucugugaaagauggccuuguaaacaugaaauuauuccaaacuuugugcauaaugagggaaauguuaaagcagugagguucgcuuuuugucagccgcuagacugacaaccauuuuaaaauguucauaacaggcacucucauguacugccccugggaauguaaaugguacaaauacucuggaggacauucuggcauuuuuucccuuuuuucuuucugguuugacucugggauuuuuuuccuuccuuuuuuccccccuuauuucucuguacuucaaugaauauaaauuggcacuaucucuugacuuuaagugaauauagcuugugauccuucaagaaauacauguguagaaauacacguaaagaauggaggcugaguggguggcucaugcccauaaucccgacaccgugaccaggagugagaccagccuaggcaacauacugagaccucaucucuacaaaaauaaaauuagcugguguggugguguacaccuguagucccagcuacuugagaggcugaaguggggauaucuugaguccaggaggucaagguugcaaugagcugugauugugccacugcacucagccugguugacagagugagacccugucucaaaacaaaagaagaaaaaagaaaaagaauguuuacuggaaaccacuuaaaacaaacaaacaaacagagcuuaaagguaaaaauaaagucuuuuugugaggggaaagauuuuguacaguccuuuuaaagauguguacuaaaaagcaaguugcaaauaguaucuacauauauagcauaaaaaucuuaaaauaguacuguuucuuucuuucuuucuuuuucugagacagagucuugcucuguugcccaggguggagugcaguggcgcgaucuuggcucacugcaaccuccaccucccagcuucaagugauccuccugggucagacucccaaguagcugggauuacaggcaugugccaccacagcuaauuuuuguauuuuuaguagagaugagguuuugccauguuggccaggcuggucucgaacuccugaccucaggugaucugcccgccuuggccucuuaaagugcugggauuacaggcaugagccaccaugccuggccaauacuuccgauuucuauauguauauaaacuuacauaugacuucacagaaauguuuuaagaggacaugcacagaacugaguauuugcucaagcauuguuuguaauuugaacuuaaauaaaagaagucaugugucagaaguuaaccagaggacccauaauuucacucuuugguauuuauucaagagaaaugaaaccuuucuacaaaaagacuggcacaaaaacaugccuaugcagcuaacccuagaaacaucgcaagagacuggauacacaaauggugguuauauucauacagugaacuauguccagcagugugaaggaacaaacccccaugcagcaacauggaugaaccucagaugggcugagugaagggacaccagaguacauaguguaugacacucuuacaugagguucuagaauaggaaaaaaacuaaucucuggugauaaaaaucaaaacgauaguugcuuggaagggggcugaccaggaaggggcaugagggaacuuucugggacagugggaauguucuguugucuugacagagguguggguuauacagguauacacaauugccaaaacugacugaauucuacacuuaagaucuauguauucucuguguguagaugauacuuuaaagagaaaaaaaggugaccacggaaaauuacugaagaacauuuaccauuuaaagaaugugaaguuuuuucuaacauuguuuuuuuaaugcucauauuuagagaagcugcucgagaaugucgcagaaagaagaaagaauaugugaaaugccuggaaaaccgaguugcaguccuggaaaaucaaaauaaaacucuaauagaagaguuaaaaacuuugaaggaucuuuauuccaauaaaaguguuugauuccuaagaaagaaaauauuuuuguggacaugcauaaaaauuaaauggauuuccuaguggaguuuuauaaauuaaaaggucaaaacugaagcuuuuuauuuaggcuuuuccaaaucaaggauaaauaucuuacgcacgauaucuagugacagaggagaaaguggaaaaugaccucaaggaagcuacgggcacaacuggaagcuuuguagaaauuaaacauauucaaggagcaagaaaugaacuuucagcagucuaaauuuucuaaauaaccaauaguugccaaucuaaaauggcagagaagaugaaauuugauaaacugaauuuuuuuuaaaaauccauuuacccuacagguuugcauuuguuugcugaaauuuaccuuuuuuuaguuauauauauguguguguguguguguaauuucugccaauaaauucuaaauuacaaagguaagagaaaaccuaguacauuacuaaauauauaaaguauauguucugauuauguauacuuguucuagugucaagucuuuuuaaguggguuuuuaaaaguuuguuauuggacuugaauggauuuuugagacuagguuaauuauuuuugaggucuuauccuaaaaggcaucuaagguacaugaauggaguauggugauuuuauaacauuuuuuaucagaauggaaaaagaacuguuuaaaaguuugauacuuuuaaauaguugguuuuuuugcuuacucugguaaugauuuucuacaaauacauaauaaauuguuuuuuugagucuauauucuguaugcaguugaauauccauuacuuauucugcugugcuuuaauagaauggaauguuuacaggcccuuaaaauauuauuuuuaaaaaaccuucugaagauacauaccaaaguuuuuccaagaagauuuuauaaucaauuuaauaauguaagguuuaucagauucuauaauaguauaguuauuaaggcaauuuuauguuagagacuauuuuguaauguagugagugguaccuuuauaagaaaagugacugccaauauauuuuuauagcugaucuuuauaaauucuaauguugaguuuuuaaugauuauuuuaaauguuuauauaguuuaguaaaauuugcaucucaaaguaucauuuuuauauuaugggacguuuucagauuggcuaauauuugcauuguaaauuuuguaugcaguuuaucuaaaauucaaaaauacugucaguacaccagcguuuaacaucuauauuccaauuuguauacaguuuaaaauuguacugcaaaacuauugugugcucuuacacaguaugcaucauauuguugucugugaaauuaaaggacauuugaua

SEQ ID NO: 18992 - RNA, 61907 nt, Homo sapiens
gugagcagacagaaguugucagugaacagagacggcgcucagucuggggcgagcgcucuagugagcgcggacggaugcuuaggcaguaguccuggcagcggcaguagugguggcagcagaagagaggaagggggagggccccgagggcuacacacgcucacacuuucaaguucccuuggagggagaggagguggggcugcagaaagaggaggccaggagcggucccauccgucccgucccgucccgucucccccucuuccucuugcuccuugcuccccggcucugcgagaguugaggguucagguggccguacgcggcagugagggcaagagggccgggagaguggggagcggaggcaggagugcgggggaagaugcccauccugcuguuccucauagacacguccgccucuaugaaccagcgcacugaccugggcaccucuuauuuggacauugccaaaggcgcuguggaguuauucuugaagguaaagggaggggaggggagagauggggagagcucccgagggauuucaggguguggauugaggugcuucuguaacguuuguaucgcccuccccccuccuuuccuacgcgacccccuccgucaucccuugccccgcagcugcgcgcccgggacccggccagccguggagacagguacaugcuggucaccuacgacgaacccccguacugcaucaagguaaaggggcuacggguggggggacaggcgggaagcgggagcaagucggcgggggcugcuuaccccccugcccccgccuaaggcgguccugcgucgcccggcggggcgggcggcgagggggugcgcagagggcgggcggaguggugccgucggcggcuucggaguagcugucgcgccuggggucggggagaggggaccggggaggagcagccccggggagaaaccgcaggagggccgagcucguggcgcgacaaccgcagccgccucggaacauggcggacauuuugcuuuuguaugagccugcgagagggagacugagggcgcugcugagauggaaaggagggaggggagggaggagcggggaaggagggcccgaaacccggagggaggcugcgaggcgggcccgccccuucgaggcgcaccgcgcgagggucgccgcgcggggggccggacggagccugcgacuccgccccgagguccugccggccgggcgcgcgggcuuucccggagccugggcuccuccucuggccccuccuuccucccccggucuuccucccccuccuugggcucuucgcugcaucuccuccuucucccccucuuccuccugguccccuccccuuccugcugagagcguggcagagccagccgccggccuucaaagacuagacaaccgccuuugcacucguuggccucucaccacccccgcgcaaucggaaaucuguccgcgacgccagucuccccacccccagacccggagaaagucuuugcguuucugcuccggaauuggccagguucagccccgcucucaguuaccuuagcuacuguuacuguuucauuggaaauuccagcgaagcaacgacacggagggggacgugccaagugcgaacccacaggggcagagcuuuuuagggauccgcucuaccuauuuacaucauaaauuagguuugugcuagccacguaggaauuaauccagggacaagaaagaaaggaaggggaggacucaaaugugagcauuuguaauagucaaguucgaugauuugauucugaccuacaggagaaaaguagggaggacggucucugugggguaauuuauguuccuauggugaggagauaaagaacugcugcuuugccugcaguggccagauaaaauggaauuuaaacuguuaaaucaaccugcauaagaguccugcuugcauauugaaauuuuaaaaauacuaccacaauccuugacgucuuuuguuaggcuuuuucuuuuuuccucagaauaaucguaauagugcuagggagacgcagucuggauguguugugauccguuucuguagagugagguguuuuaaugaauggaaccuaccaagcugaauaguuggccaaagaguguuccuucaagcauaaggaaaccaaagagaaacuaauuuuguaacucguagcuucgguuaacuguuuaauuaguagguuccccuuaaaacuguucuuuuuucgauaauuuguuuucaguuugugauucuauccauuuagaaaaguggaacaaguagacaucuuucaaaaugccguaagcuuuuuaaaaaugucaguuuucccaaaaggaugugaucauuuuuuuccacauagaaaaggagauguuuauacauccuaggucugaaugucuacacucuucgacugcuaauacagauaagaaccgaccauuuguaguguggccauuugaagacaugcuccuuaauucgaaguaguaaaaaagauaaaccacaaagcagugugccuucuuuuccuuaaaggaacaacuuauuggccgggugcgguggcucaggccuguaauccuagcacuuugggaggucgagaugggcggauugccugagcucaggaguuugagaccagccugggcaacauggugaaaccccgucuuuacuaaaauacaaaaaaacaaaacaaaaaaaaaaacggccggaugugguggcgggcgccuguaaucccagcuacgcgggaggcugaggcgugagaauugcuugaacccgggagucggagguugcagugagccaagaccaugccacugcacuccagccugggcaagaaagugaaacucugucgucaaaaaaaaaaaaaaaaaaaaaaaaaggaacaaccuauuuaucauuuuuccauaugccaagaaggauuguuuaaagauaguuuuccaucuguaaaacuuaucaaaacaguauuuacagaaacuugggaaaggaaauaaaccucauucuuaacaaccaucauuacaucuuuuaaccuagcauugugauuacagugcacauauuacuuuguauucugcuuuuucuaccgauuuuuauccaaugaauuauuccaggucgccacauagccuucauacuuaaaauuuuuaauggcuguguaauuuauccaugcuauuuuaaaggcuccagauaguucuauagaacggacaggaaaaguuggauuuuguuuuuaguggaaauuucaucagauagcucuuuuuauccugccaucuuauauacuacauuuuuuuccuaaagcaaaaagcacguuuccaaguugaguuugauuuuuuuuccuuauguaggucagauauaugggaagauacuuuuuguaauauguuuaauuauuaaucguugguuaucuucuucuuagccuaucuuuccaaaguuuuucauuuuacucuuaggugauaacuacauguucuagaaaaagguuaaugaucuuaaugauguucuugucauuuugcuuucuauaccugaauuaauaauaugccauauuuugguagcauuuucuuuuuccgagucucucuucaaucacucuccugccagccugccuccaacccuccucagcaugugguaacuauuuguucuuuugcuuuuaggaucuaaccagcuuggaaggucugaaauuuuagaacaucuggugauuuuuuuuucuuaaaauuuagucuagucuuucacuugcuaauagcugggagccauaaaugucuguuuucugucacacugauuaucaaauaggucuuucuuugauugucagcgggcaccuuaguuccuacuuaaaaacuucacucucauuaggagucugaggucuuuucagcaaagugauguuggcuaggauuuuauugguagcuuauacuuuugcagaauaugaguguuuuuuuuuuuuauuucucuaagguuugagcgccauuguuucucuuuuuucacaguaacugcuuauuucuuaggucuugguuguauccaagucuaaacacuguaaaaugaacuuuauuuucuacuugaagguuuguuucuauugguguuauaacagacaugaguugugcauuugguuggaagauuuuuuucuuaauaggcaugcaacucuucccaguauauccacuuacaagauccgacaauaaaucuugugaaaaguuacugugacugaaaauuuucacuaauguauacuguugaauaugugacuauaguauuucaccaaagacuucggaacguuuuacugcauacuccucacuauauagcugugugcucuuuuaaaauuagucauaccuuuuacuugcagucccgguuugcauggauagaauuaaguuugacuuaaguaccacauaaaaagcguacgaaauguaagcaucaugugcuacaucuguuauguugcuuucuagacaaguuuuaugcauaguguuacaaguguugaccccaccuuuauaccgugguaucuucaguguacacagcuaguaugaaacccuguuuaacauuuaaaaacgucuaauguauccuuauaaaacuaguaugugguuuuuaaaaguguuaauguuuugggauuuuuugguauaauuguuguuuuuagucuuggcugagguucugcugucuuguauguuuuguuuugcuaugaaucauaauuuccuuuuauuuagugaauagaagaggcaggcuugucacuacuauuacuuugaaagaaaguaagccauuagaguaggguauauauuaacaaagguauucaaaauaguuuuauguuggaagcuacuuaaaauuauuucuuuuuuguugaaggaaauuaucuuuuuaaacauaaaauggaguuacuuuucuagaaauaguugaaacacauguauaaaauacuggccagaagauuuuuauaaauaggaaaugauaauguuucaaagaaauauccuaagucuguaauuugaagacauacauuugaaaaaguaaaauuuucccugaguguugccuuuucccauccuguagcuagcuuugcuuacuggugucugcaugccuuugacaacauguaucagaaaauagcaaaauuuuggcuuacagauuuaggaaguaauuuaagcuuuuaaaaugauauguguuacaggcauuuuuuagaauuuuaacuaagacauaacuuuuucauaugcccaugaauauauuuuauagaucuuauuugcaaaaggagugacuuuuaugggagccuuucauugugguuaagaagcuauggaagagcuuaucagugaaauaguagcaacauggccugugagagcaaucuuagacaaugaaagaugcuuuuaaaacucaaaaagccacacaggcagugcauugacuuuuacaacgaauugccucucccaugaucuugcuuucuuauccaccuuccuuuacuggccauuuguggcaugcagcaauaauuauuuugaaauaagaaaaggagagagucaacaguagaagacuagaccucugggcaauacaaucuucagacuaaggaccagcuguaagaugacuagggaagaugccugacaaaacuguggaggucugucuguucuguauccccaaccucucucguauccauucauucuuauuugcuccucguuucaaccuucaucauuucucacuugcaagcagccacucaguuguucucccuacuuccagucuugcucuccacugauuccuucccgucauugcccucagauuggucauucuuuaaauaaaauaaagucauuccccuaugaaaaaaaaauccuucaguggcacuccauuacauuucccaauaaaaguaaauuucuuggccuggccuccauggccguucaugaucuggcccuaucuuaccaugucucugcgcccucucuucucuucucauggaccucaggcuucacccacaaugaaaaauuagguccuccucuccaaacacacuaugccaguugcuucugugccauuguaaauguuauucccucugccugggacacauugguuggccagacauaccucaguucuuuauucuauguuuucaaaagucauuuuguccgucggcuuuuucccuacuccaagcaguauaacaacuuccucugugauccuuuaacauguuguccacaccuuaacuauauagcauuuagcauguuauauggggacuauuaguguucauguugacuucccuaaugugagcucuugaagggcaaauauuugaacuucuagguauuuguaucccuaguaccuaaggggguguuuagauuuuaauauguacucaacaaauggaaaaaagguuucaagcaauauguuaagugucaaagcuacucauuucccucaugucaaagcuuaccucauucccgguacucuuccccauagaguaaucacuauuaacaauuugauauauuuaauguuuauuacagcuagcauuuucauauagguucaaguuuauaauaugguagaaucuuauuguauuuuuuacaagauaaguguauauauuucucuuuuuucuuuuuuauagaaguauaauucauauauagaaaauacaugaauccuaaugacuugaugcauuuuuauauuuauacauucauguaaccaccaucccaggccaagauauauaacguuuccaucaaccaggaaaaugccucuugcaucuuucugcaauccaucucuccccugcauguaauuaccguucugacuuuuaucaccauuguagugacaugaucaaaaugguguuuccaaaagacaaguguaacaguggguugacacuacggcagucucggcauucauuuaccauauacuucuugaacaucuccucugcaccaggcucuguuauaggggccuaaggugaaaccagaaagaucuggccuaagaagggaccagaauaguaaaagacaugguccuagucauuaaaggucuugaggauagucacuggaaaaagcugacuagagaagguggcuuaggauaugggaaauguaaagagcaguggacucuuaaccagagaauuggaggugagggaggaggaugcacaggacucugagaaucuggugugucucaagacuauaacuaguuaagacuggaccacagaaaggcuuugaaacuuguaagcuagauuuuguacauuucuucugggaugcagagcucuuagguagaauugaagagaaauaggacaaagcuuguugucuauaugcuuguuugguuauaauuaccuuuuaagugagcuaaagggaggggagaauaaaaggcuagggagacccauaaguuguaguugaaauugccuaguuuuguugcuugcugcuugagagcuuuuggccuuaugguugggauugggguggggguagggagauggugaagggcagggcacagguaaggaaagggcagauauuuuuucuuuucaguuugccuuugcuuugggaagauaauuauaauuuagaacacaggguucucaguuucacagagugaaaaaauaugauagugguuccacaucucaggaagaaauguguuuucuagagaaggguaggauugaaggacccuccuuaugggagugagaagggcagugaagaaaggaaacuacauguuucauuuaaguucuuaaaugaaaaagucuuuguaaacauggccuccucccgguugccuuuuaccgaaagaguguaaaugagagacccaggcagucccuuuguaacuguguauugggagcuuggaacacauuaucuccuggauacaauguuggaaguggugauuauguucccagaccuuccucccaggaaccuuuuuaacccuucaugucacuuagccauagaccuauuguguuuauaauuguuucuaaugggaaauggguuuaaguuuccagcuugauuuguuaaaaacauauucuuucucucuucuuccucacaacuggguguggacuuugguuccaugagggguggggacacuguaaaggcuccggcagagagggugaggggcugagguggcaguggagguaggcggggcucuucacauaugccaguuacuccuauucauagauuggcuacauuuacacgguucagcauagcguccacuuagccacguaugguuauugagcacuugaaagguggcuagucugucagugggugcuucaacagacaguguaaaauauaauauuuuggauauauuaaguaaauuauuaaucuaacuuguuucuuuuuacuuuuucaauguggugaguugaaaauuugaaauuccauaugugaaauuugcacuauauuucuauuagcaguguuugucuauauucuuucuuaagauauuuuaugauguucauauccuaggaauuguuucugaaggaggauccuuucucuggaaguuccguuuaaaaugaacacccccccccccgacccaccgcaauaaaagacucauuugugcaugaaagguuaucauacaguucagaguugauggcuugauaacccuugccuguggggcaaaauaugaaagcaucccauucuuauuuguauugaaagccaguuugguugcuuagucuuuuggaugcaguuggugauccaacugguuggguuagaagucuuuuccugggcuaaguauaauggaauauguaugugaaugaauguaacugcaguaauucagaauucuguuuauaauaugugcucaccaguagugcuaaauguuucauacuuucaguguuauuagaaauauguaacauguccguuguuugauuuacauagcuacuuugcccaagaauucucaggagcagcauucuuuaggaaguguaggauaaaggagaaauacucuaguuugucauaguguaaaacuuaacaaaggggaauuuguaucacugcuguuuuugagagcuuucuugauguuccccagcggagcccuugucuuauaucauggcaagucaucaguggcguuaaaaggagggagaggccacaugacuggagggcuccuaggauucuuacuucugacagucguuaacuuucucaaaacuuaauccuccuaguggagguuacaggagugauuaauuguuauuuuuugguaacuauaauggcucccauuuaaggaauaagcaccaaugucuaauucugaggcuggguggauuuauagauaugcugaugaauagcaucuauaagagguaggaccacuuuauagcccuaauuuuggauccuccuaaaucccaucuuauagucgaagguguuaucuagcuuguauaacuaucccuguauuucagauaugauuugacuuauauuugcuuccuuguaauaaugaacaaucacgaaauagccuucaaauaauagcagcugacauuuauugaguaaugcuuagguacagggcaaugugcuaaugaauguaaaauguuuauuuaguuucucuuccuagucagucuguguacuggauuacuagguacuauuauuauacucuuuuuauagauaagggaaccagggcccagagagguuaaguaacacagccaguaguaaccuaggucugucucuauucuagucuauucagugauuaaccacuucacuucuccuaucaauugugacagaaaauuccuuuugauaacuucucacugguauuuucucauuaugaugcauguccuagagccaucauuuuuuaaacauaauuaucaugcuguuauuuauagcugcuuuuaauguaauagugcuuggcauuguagcaagcacucaaugaaugaaaauuauuacugcuaguguuauuauuucuaauauuucucugacuguugcugggugaguauuguggugcauauguuuguaaaacacuuuugccuuugaugucccacaguuaugccccuacuggugacagauauagaguuguugagacucucaguugauggaguaugaaauaguugaggacuggaggaugugaacugguggccuaggcugaggaggcccuauaggaauagugguagguuuguaaaagcagcaggguaguccuuggcuauuuauuaauaauagccacuaaaaacugauaugccgucuucacuuuaccaaucuccugauaaaugcuuuucuuaugaggaaaagaaagauauucaguguacuccacaguagccauuuguuuuuucuaauccacagccucuggaggagguagacaugguuuuuaaaaacgucuggaauaccaucaugccuuugcagaguuuuguguaucagccugagccuuaucugcugguguggucuucauuucaacuacuucucccauuuuccucaagccacacaccugucauagccagaucauugguuuuuuccccuccuguguaguuagauggccugggguagaagaguggauuuuauagaagaaguagagaugucagucaguggggucuuaaccagagaaacauugcaugaagacuuuugggugaugugccagauguuuauagaaaaaguagaauucuauaucuuaaaccauuuuccccugguuauacuacucauuaaugccagucgcucuuuuauuaucuauauccugcccuguagcucaaauaguucagugaacuuaguaccaggagccaaacacaggauuugaaugcaauugaacaaaagucuugaaacauuuuuguuugugcaacugaaaaauaguacuguuaagaaaacuaaauaugauuuauuaaggucuuaagauuuacugucgagcuacuugggcaaaguuacuaauauucauccucuuuguccuugacuacauuugaaacuaacuacuucuuccuuccagaaacuuaucacuuccuauauucuguuucuccacuccucucucugauaauucuuucucuaucuuccaaagucuuucccuuggggaguguauccugcuucauucgugguuccaaauauuccgacacacacugaugcuucaccaucuucagcuucucacucaggcaucucagcugagugcaggacaucuccacacaucuccacugacugucuguccugcugucagcucacagucagaccucuucugucauuauucagcuuuguuuuuucuuuuugccuuccaucuucucuggcuuaucugccaucccuuugaaauuucucuuacauguguuccuuugacucaauuucuguugccaucacuuuaaucuagguccucauguuuuuaugcuuugaccacuguaccagccuucuaacuggacucccaagugccuccaaaauuccugucuccacuuacaucaauugcuaacuuucgaaaaaaguugguuuuaucauaucacccuccccaccagccugccauucugagcucucuaguaucuguuccacgugucgguaaaaacuuauuucccaucauuucccacagaagcccugcacugucucuucuacccucugaguguaucuccccauuccugaugccagcccuuagaacaucaguuaaccaaaggaagaagagauacagagccaggagagcugaaggccugggggaggagaggaaguaaacugaaaucauuccauuaagggugugacuugagggugaggacaugacagaacaugcuuuaaaauacuauuauaaugaugagaaguugcagaaggaaggagggugggagcuggaguaugaccuuucguguuugauuagucugaacucuagaccaaaaugguuucauuuaaauuggccugaaguugccuggaggcacugcuguuuaaucagaagggccagucccucuuugaauuuuugucucugccaaagacagcccacauaacuagacaguggacaauaggauuccagggagaauaucuagccuuuaauauagccauggcauuggaaaguggagacccccuccuguuuuauuucuugaaggaggauguuggcgauaugcagagcaaagcucuccacuuuucuuaauagcuuacguaggugcguaaacauuguaaacucccuuucauagugaugccuuugaguuguguguuagaaguagauuuaggcuauagcuagguacuuuuauaaaaucagauuuuaaaaaguggacauaguacauccagucuaguagaucauaccaucuacugucauguaauauggcaaacuguaucauugucacuucaguagcucugucaaaagugcuggacuggaaggcaagagauccauguucuuaaccugagucuguuacuaauuacacacaugaccccaggcaagucacuuaaccuuuuauggugucaguuuccucaucuguuaaaugaagggauuagacuagauuauuuccaggacuccuuccgaaaaaguacaggagagaguuguauaacugaaaggcagaaaguggaauaauugaggcuuggaauucagggugacuuaaaaauuacuuuaggcuggacaugguggcucacaccuguaaucccagcacuuugggaggcugaggugggaggaccacuugagcccaggaguuugagacagccuaggaaacacggcaagaccuugucucuacaaaaaauaauuaaaaaaaaauuagccuggcauaguggcacaugccugcagucccagcuucucaggaggcugaggugggaagaucacuugagcccaggauuacaagacugaaguuagcuauguucacaccacugcaguccagccugugccacaaagugagauccugucucaaaaacaaaaacaaaaacaaaaacaaaaaaacaacuuuuaaauuuuagaaaacagguccuggauguguuuaaugugcuauaucacacacuuagugguuacauugguaaaugccacuccaucuuauugaugucaauucuguuugcuguaaacaauuuaauaacguucaugacagaguccuaucaauacuuuggaagagugagagugaggguuuggugaacagacagacuaacuuuguauuuuguugggauuuuuaacaaugaaugcauguuacuuuuaccacguaaaaaguagcucauaacaauuuuuuugaaauuauuuauuuucauuaacuuuuauuuuaaguucuaguguacaugugcaaaaugugcagguuuguuaacaugugccauggugguuugcugcauagaucaucccauuaccuauguguuaagcccagcauccauuagcuauucuuccugaugcucucccuucccccacccccauucacaggccccacccagugugugugguuccccccaugugcccauguguucucauggaagaauuuuuccuaaaagaauuaguccuggggaaagaggugcuguguaaucuucagaacguaauaaauggccauucugcuaucucauauguucaacacuuucugcaaugcuuagguggcuuagucucacuccuguccauguauguuuuuuccaaggccaaaaauuuuuauuauuuuguguaucuguccauaaaugagccaaaauguaacuaacugaaugugugauaugcacaauagcaguuuuuuuuccugauaauagguauuaguugauagcugcaguugaaauagucugagacugggaaaggaaacuuuucacauuuaaguaugaccaaguuuaguaaguucuaagauguuucugcuucaguagcagugcaauugacuuuuggagggaggagaaaagcuucuaaaauuauugguuucuacguguuacuguccacuggugaaggucagauuucuuuggauauuaucauguuuuccaguaaacuuugagaagugugcugcuucacaauuuuauccuaauucccugggguaauaauugaaaacuucauaaacauauuuuuaaaauuuucuagauccuuaugauuguuuauaugcuuaaaaaacuucauacuagauauuaauuuaaagaggucaguaaaacaaaauggugaacuaugugucaguggaaucaaacugugaaucauuucuuugcccaguuucguuaaaauaugugaucaugugagucuuuaacugucugcugaagaucagugcagcaggccacagacuguuaaauacauuucugcaauauaucgggggaggucaauuucuuaauaucuuuguuaaaaaguagaagacgcaaguaaacuagauuucauacauguagucuugguugguaguaucuccugaagcauguggaggaaaauugguagaucgaaacagaaugauagcauucagaguucucagggagagaaccgauuuaaucaaauaaaaugggcuuugcacauuucggcaaguucaagacacuaagaaaagcccuuggggaaguaacuuuuauaaaacugaauccaagagaacugguuuuucuuuucuuuuuuuuuuuuuuuuuuuaaauagagucuugcucugacacccaggcuaggguguaguggcguuaucguagcucacuguagccuugaacuccuggguucaagcgauuaccacuuggggcuacaaacacaugccacuaugguuggcuaauuuguauguuaauuuuuuguagagagaggagucucgcuguguugcccaggcugaucuugaacucgugggcuccagugauccucucuccucagccucccaaaguguugggauuacaggugugagccacugcacccagccuggcuauccuuuaaaaaguaauuuuaaagcuacacuauacauuuaaaacacagaacacuaaaauaccuccuuugagcguugaaguauauuaguaccuugaguaaagugagaaaagcacaaaaaaagugaaaucuggccaaauuguuggaguaucagggaaaaaguugugucagggucagaaaauauaagcaagaaggaaguuuuuaggggagguacaagaaggaagacaguuccauucuuauaaugauauaauguauucuuaguguguacuuuauaauuguaacaaccuccuuuauaggugugcuagcuguaaaaaucauuuuacaaagauauuucaacaguuuaaggugauucagcugucacaguguucuguuaccuaagagagcaaguaaaccuugucuuuguuaucagaauuggaguccauuuuaauugugagaagaaaauuccugaaguugagaaguuuuaacuugcccaaauauucagggcaaagaccaagagaaaagucauuugucuccucgggagacagagaugauuggaaaagcagggcuucuuauuuuucaugucauuccaucucacuggugaguuuaccaaugcaggaacaguuugugaugacagagaugacagaaugcuaaguugaagaagaaagugaguugguugaaaaauacuguuggaauugauuuaugcaaauuuucuggguuguuucagagcaaguuuuccccaaacuuauggagagcagauggaaaaaggaaaauaguuuaucuuucaacaagagaaaugauggcccugcuaaauuuagacucuggcuuuaacuugugacaucugggaaaauacucaaaucuguuaaucauuuaguuuguauaaccaccuagaagagcccaauguccaggauagaccucuaacaugggcuuacaaauggcagauauuaccaggcugauuuaauuuccuuuaauaaaagauaaaaagucuugucaaggagaggaaagcaacaugcauuggcuuucuggaugucaacaagguuuuccuucauucauugugaagagcuugcuaacaagcuaggaagauuuggacuggacugcacugcuccucaggggaauguccagauaggcugcaggauguaugugccuaaaacaggucagugcaguggcucagcaccaagucagggggacaccacaaauggagccucccagcaagaaguuuugucacugcugugugaaggagccuggcuugugaaaauucauaacguacaaggauucuuuuuacuguuuggaaagauucauugccagucccuuuaaauagcuaccacccuagagaauauuaaucauucaacuauuuuuuuuuauuuauaaauagucaauucacauacaguuuguaaggguuacuuuucuuguggaaaguuagguacagcugcccuaaauaucuuuaucgguuaccuuggcuggggaaauuaacagcauguuuauuaaacuuguacauuauacuguguuauaacauuauaccauuuuccaaauauuaguaaggucgcuaacauuuuggaaaaggauuacaagugaccuuuagagauagaacaggaguuuuucagaaaggccucuaacaccacucccacauccccuucgaggacaguugaucugcuuuuaucucuuuuacuuguucuuaguuccuggcaagauuucaauggaggaaaaggcuucucuauuuaaaaaaaauaaaaaucaaugaaaauuaaugaaucggagaaauggccuggcuaaaaugggaugaaguucaguauuaggauacugagggauacuaaaguuuaggggagccacuaaauaacacuccuucauuucccuccuccacuugaaaucuauugagaaguaagacacagaagccagccagaguuccaaauuacagcuuuauuccugaucaaagcuggaggaaaggauguagccuacauguguguucugaaaagcuuccaaguaguucacauauugacagaccuacccuaugggucuguuguagggguggaaccuaccccuuuagcaccacaugucagagaacauaccagaauauucaaaagagcuucagcaacaggccugcagagagcaugccaguuuccuguuugcaaaccaaccagucagaugagaagguggaaaugugggugcagaggguaauagaaaauauugcuuuuaggcuuugcccuucugaggagaaaagugcaaauucucuccuuccuguggugauguaaguggagaauaaauagcuaguggcuagucagaucaagcugggacaagaacccaggucacugauagaaaggcccauguuuuucuguugguaugaaaagacauuuuuaguugacuauggaaacuuaaacccgaucugaauuaacauauugaauuaacauuuauugagacaggagguguucucuuucuguaagucagauuuacaugaaggauuguuacaggguguagaauuauaagauacauaagucugauuuauauuaaaggaacguauagaauuauaggauauaaaaacugcaagggaccuuagaguugguuuuucagcccuuucauuccuugggugaggaaacagccacagugggauuaagugacuuacucuagaccacuugccaagcgaguuagugacagcuaggaauagacuaggcccuucuaauucuuaauucacuguuccccacaccuaauuguucuguacuuagaugucagggaaaguaggcuuaaauuaaaaugaaauuugaaaaauuuauuaaacuuauaaacuaaucuaacaagacauauuugugaagugaauauaggcuuaccaugaagauagugcagguucaauucccagaccaccacaaugaagugagucacaagaauuuuuugcuuucccaauucauggaaaaauuauguuuacacuauacuguagucuauuaagugugcaauagcauuaugucuaaaaaacaauguauacaccuuaauuuaaaauacuuuguugcuaaaaaaauguuaaugaucaacugagcuuucagccagucauaaucuuuuugcugguggacagucuugccuugauguugauggcugcugagugaucagggcaguuguugcugaaggauggggguggcuguggcaauuucuuaaaauaagacaacuaugaacuuuaccgcaucggugaacgcuuccuuucaggaaaguuuucucugaagcaugcagugcuuuuugauaacauuuuacccacaguagaacuucuuucuauuuucuuuuauuggaguccauccucaaacucugccacugauguauaaacucaguuuauauaauauuguaaauccuuuguugucauuucaacaauguucacaacaucuucaccaugaguagauuccaucucaggaaaccacuuuauuugguuauucauaagaaacaacucauucauuaaaguuuuauuaugagauugaagcaauucagucacauccuuagcuucacuucuaaaucuaguucucaugcucuuucuaccacuuaugcaguuacuuccuccacuggaguuuugaaccccuuaaagucauccaugaagguuggaaucaccuucuuccaaacuccugcuaauguugguauuuugaccuccucccaugaaucacgaauguucuuaaugucgucuagaauguugaaucauucccagaagguuuucaacuuuucccagacgcaucacaggaaucacuaucuauggcagcuauagcccuacaaaauguacuucuuaauagccuuacaaaauguauuuuuuaaauaauaaaacuugaaagucaaaaugacuccuucacccacgggcugcagaauggauguuguguuagcaggcaugacaacaacauugaucuccuuguacaucuacaucagggcucuuggguggccaggugcauugucgaugaucaauaguauuuugaaaugaaucuuuuuuccugagcauuaggucucaaaagagggcuuaaaauauucgguaaaccaugcuguaaacagaugugcugucauccagguuuuguuguuccauugcuaaagcacaggcagaguagauguagcauaauucuuaagggcccuuggauuuucaggauggcaaaugaauguuggcuucagcuuaaagucgccagcugcauuagccucuaacaaaaagucagccuguccuuugaggcuuugaagucaggcauugacuucuccuuucaaauuaugaaaguccuagauugcaucuucuuccuauagaaguccgcuucaucuacauugaaaaucuguuguuuaguguagccaaucucaucagugaucuuagcuagaucuucuggauaacuugcuacagcuucuauaucagcaccugcugcuucaccuugcacuuuuaugacauggaaguggcugcuucuucuagcuucaaaguuuucuucugcagcuuccucaccucucucagccuucauagaguugaagauucauuccaucaacucuaggaagaguuagggccuugcucuggauuaggcuuugguuuaagggaauguuguagcugauuugaucuucuauccagaccacuaagucuuucuccaucucggcaauguggcuguuuuucuucuuacuccuguguuuccugaaguagcauuuuaaauuuucuucaagagcuuccuuuguauucacaacguggcuaacuggugcaagaggccuagcuaucucagcuuucgacaugccuuccucacuaaguuuaaucauuucuagcuuuugauuuaaagcgagagaagugcaacuguuccuuucacuugaacgcuuaagaguccauuguagggucacuaauuggccugauuucaauauuguugugucucaaggaauagggaggccugaggagagggagagagauagggaacagcuggucgauggagcaguuaggacacauacaacauuuaucgauuaaguucacugcccucuuauguggguaugguucauggugccccaaaauaauuacaauaguaacaucaaagcucacugaucauagaucaccauaaaagauauaauaauaaugaaaaaguuagaaauauugcaaaaauuaccaaaauguaacagagaaacacaaagugagcacaugcuguuggaaaaauggcacugauaauacagggcugccacaaacauucaauuuguaaaaaaugcaauaucuguguggugcaauaaagcaaagcaccauaaaaugaggaaugccaauauacauaauguguggaagagugguuuaaauuggugggcucugaaguuaggcuaucuggauucaaaucuuggcugugccauuuccuaguugucuggccuggacaaguuaccucgcuuucccaagccucaguauccucauguauaaagugaagauaguaacagcaccuacccagagggugguugugagguucauguaagaaggauguauauuacaugcuaugcuuaguauaagugaguuccuaacauauaagcacugauaaauauuagcuaucauuagucaucaucaugauuauuuuaccuuggagagacuuaaaauuugaccugugaagauaauaaacccuuagcuuaggauucuacccauccuaaguuacuccuuuguccuaaaccuccauucuuuaggccucuuguaaucaucuuuuacugucuauccuuuggccucaugcucuaucaccaagucuguccuauuuguuucacauguuucucauuuaacucuuucaucugcauuuccauccuaauucaggucuugauuccccagguguggcuuacuauucaagccuccuagcugcuccuccuccuccuccuccuccucuuccucccccuccuccucccacccccuuuuuuuugagacagggccugguucugucacccaggcuggagugcaguggcaugauggagugcaguggcaugaucauggcacacugcggccuccaccuccugggcucaagugaucuucccgccucagccuucugaguagcugggaccacaggugcacaucaccauacccggcuauuuuuguguguguguauuuuugguagagacagggucuugccauguugccuaggcuggucucgaacuccugagcucaagcaaugugccggccuuggccucccaaaguguugggauuacaggugugagccaucgcgccuggccucaaaccuccuagcuucuucugacuacagcuucacuuuccugcaggcuguccuguaugucacuaucagacugauuuuccuguuuaccccugccuuggauucuguagugugucuacugucugcugcuuuaaggccaggcucucauaccugaccuucaggucuuuuaggaacgucaguguccaauagaaauauaaugucagucauacacauaauuuaaaaauuucuacuagccacauuaaaaaguaaaaacagguaaaauuaauuuuacuaaaauauuuuauguaaccaaaaauauccaagacauuaucauuucaacauguaaucaauacaaaaauaaugagauuuuggcauuuuuuguucugcauccucaaaaugccaaaugcauucuauacuuacaucacaucucgauccaaacuagccacacaucaaguguuaaauaaccacauguagauaaaagccacuguaucagauagugcagcuguagaaugugacuugccaccacauaaacaagacauaacuauguuucacuucuuccuuguuuguuaaaauagggauguuaaugccaugccuauuuuauaggguuguccuaagccaaugugaagugugaaagugcuuuguaagcaguaaaguucuguaagaauguauggaaguuauuaucaggagugaagguuuuuacuaacauaagaauacaauaucuuuggaguaaaguaauuuaaaagaaaaacccauauuaaggaggcaaauuagcuguccugaauucauuugugaaaaaaauuaacucuaagcaaugaauggagaguguaaauguauacucacuaucucuuuauaauuaucuuuuugguagaaauuuaucacauuaauaagauucucuaaauacuucaauaaaucugugggccuuuuuuccuucagcauguugagcaauggacauagggacauuugguucuucucuugauauagggagcuggaccccuaccaaagaguucauugcucuugguaguaaauguagccuacauacuuuguaguacugagguaggaguggcauuaaaauuucccauaucauccaauucauugcaaagaauaggaauuaaccuacaaacaaugucagagauuuagauacagaaacuauuaauauuugggccgggcgcaguggcucacaccuguaaucacagcacuuuaggaggccaaggcaggcagaucaccugagcucaggaguucaagacugcccugggcaacauggugaaacccugaauauacuaaaauauaaaaaauuagccaggcaugguggcacacgcuuguagucccagcuacucaggaggcugaggcacaagaaucgcuugaaccugggagguggagguugcagugagccgagaucgugccacugcaccccagcuugggcuacagagugagacuccaucucaaaaaaaaggaaagaaaaagaaaaagagagagagagaaggagagaagggagggaggggaaggaaggaaggaaggaaggaaacuauuaauauuuguaaaaugcuuucauuucauauucuguauucugacagauuggugaauagcaccacuaacgauaaggacacauuauuuuaaauaaagaugagucauaaagugguacccaaaucuuauccuagcccuuuaccaaaccaaauaguccacuaauuuuuaaaaauuauaccuugaacuaccacauggcccuucagguguucaaauuuaauauauaaccuuuguuaccaguguggaaauaagauugcuaaacgaagugacuccaaaaacaagaaucaauuuuauauaauggcuucaggguaaaggacccccgcccaccauuuacaaguuugccaaagccagaaacuucaacauaaugcaugaccuuuucuuucucaccugucccucuaauuagcuacuaaauccuuaggacuccuccucugaaauacuuccuuaaucugcaaccuccucuccauccccacugcccuaacucagccuuucaucacuuuucucguaagcucuuucagcagucuccaaaccaguuucccugccucaagcuucagccuccccuccaccccacaauuuauucuccaacuaccagcagagaucuuaguaaaauaaagaucugaucauaccacuccccggauuuaaaaccuugaguucuucccagggccagcagauaaaauccaaacugcugagcaugguguacaaagcacuuuauagucagagcccaaauuaucuuaaucagccuugccuccugccaugugcccagagcaaugauaaucagauuacuggugguucucaaguaaguccuauccuuuuaucuguucucuucccuugcacaguccccuccaccccucacaucagugagucucaugaucuucacuccaucccaucaguauuucucaaaugucccacuuucagugagaagccuucccucacucucuggucacuuguucuuucagucuccauaagugcaucucuuauuccuuuguggcaggaaccccucaagagcuaauuccucucuauauccccagcacguagcauucugccaaguauagcauaguuugucaguaaaaaaucuguugaauaaauacaugaaaaaauugauccucuccacccaaauguacaccuuucucuucuaccccaaagaagaaaucuaauuuccuaauucagugugauuuauaaucaacuacugauaguuccagguauuugaaaagauacuuuaaaucauaaugcuuccuuuucacuaaaguucaguuuaucuaguccaauaagauuuuccuugggccauaaagaguuauucucauucccuauauuuccaguacuaaaagucauauauacaauuuggccaaaggagcaccuggaaaguuuuaaccuuuaaaugcuucgaccuauaggauauguuaggaacauuaaaauaaaagacaacaaacuaagcacaucuuuaauuucacaagaauugccagcuauuggaccuggagugaaucuuaaccaagaucaccuucaccuugaaggguuaugcagguuguguucuguuuaacccuagggggcgccacucucacagauuaugaugugaaugacugcaaggugguaucauucucagccuuauacagugucccugcuuaucagaucauccuccuuuucagcuuagguccuaagaagccaacugguuugcucaaggucacacagguauuucauaacaggguucauagccaauaaccugcccccuuucuuacuucccagucauucuacuaauccaaauugcucuggaagaccaugaaaccagaaaagaguguuugauguaguugcauggauaauggacuauaugccuucagcuaaaugugaaauucaaaugguuugguuuaucucgguaucauuugcucuuguuuuccaccucuagcuguacuggccugguuggcauaacuucagcauuuagcauaucacacugcugcucucaggcucaccgagacucaaguggcuguuccacucuguugccacgcugugcugucuucucucuuucuugcuggcccauuccucugugacuuccuguuagcugccaccuucuucuuuuagcuucucuucucagcacuuuuugcugcuuuguuuuuauacccaucucagaccagucagcacgauccuuuccuuccuucuauucuacaaaccaaucaaucacagcauguuggcuguugaccuuggaucuuugguuguuugcugcuguucauagcugcugggcguggcuaggggaugcugcuucuuugccaaaacuuuuuguuucuuuuucuuucucccuuuauucuagaucuugggcuuucugaaugcuugaagauaccagaaggguuauauccaaauaaguguggcucuauuccuauuacucccucuuuacucuugcuuaaaagugaaaauauugcuucgguggaagaaucuugguuagaagaauuaauguagcucagacagucaauauagcuaauugucuuuaccaaggacaaugcauuuaaaaaauaacuacuccuuccucugccccuuacuccaugcucaccaucaaugugaagcuaggguaacagguguguuggcagguuugguugagccugaacagaaaacuggaccucuugagccacaguccuucagccauaauggacgaaguauuuuuugcuucaguucuuugcgcuugaucauuagagcuagcaggucuuuccgaaacugcuugcuuuaguucuaccugaucagugaagauauagaauagaauuagguuaaagagugguuaauuucuuagaguuuugauacuugcuguuuagugauuguacuuuauauauuguucauuguauaaucaagaaauucuuuguaaauguuugguuugcaggcugguuggaaggaaaaucaugcaacauucaugagcgaacuaaaaaaucuucaggcuucuggacugacuacucucggucaggcucuaagauccucauuugauuuguuaaaucucaauagauuaauaucuggaauagacaauuauggacagguaaaaauaauuugagugaguacagcuaauuuauuuugguggcuugggguaagaauuuaaaauugggcaugauuacuaaguuuucugcuacuuuucauaaccuccaaaaaugagauucuuauuaccuuuuaaauauauacuuuuuaaaaaucccucuucuuuugguucuuguauauggcuugauaauagaauagcuaaaauugucuaccaugagauaaucagauguuugagaaugaugugaauaaacggcugagaaauaucggaacaagacaauuggaaagaaacuuucaguguccuuaacuccucugccccucccaauuugaugaaaaagcucuaggauaagaaggcagaguagcauuugcuguugcucccauuguccuuuccuccucuaaagucugugcucacaguaaccagagucacucuccagguugcagcacgcaagucacuaguguccuaucugugccaggauuuugacuuaagugaauggauucaugagaguggaugauaaugccaguaaucuuguaauauuauuuugugauuacuuggaaagcagagugagagagguauuugaauguuaaugguuuggggaguuccugaauuauaagaauuccucaguuuauacugaauguuaccucuucagggguuguuauuuuuauuccuacccauuucguucccuggucauuucuuccuuauuuauccagacaaauuuuaucauauucuugagagaucauuggcaaggcaaauauaaaaauuuaaauauacuuuuauuacuuuacauggcucuaaugcuuuuuaaauguauuuuaggggagaaauccauuuuuuuuagaaccaucuauuuuaauuaccaucacagauggaaacaaguuaacaaguacugcugguguucaagaagaggugagauuuuauuuuuuuuuuaauuuuguuuaaauggcagggaacaugcagcuauuucugugggaggcauuuccaguuaacaguaaguuuggucaaaucauccaucuugguaauccuugaaagacugcuuaauuuuauugaguuacaugaaagaaaaagucaacccuuuaauucuuucuucauuuuuauaugguuuguuaugaugaaccuuuucacauuuuugccuuaucagcuccaucuuccuuugaauuccccucugccuggaagugaacuaaccaaagaaccuuuucguugggaucaaagguuauuugcccugguguugcguuugccuggaguggcuucuaccgaaccagagcaacuagggagcguaccaacugaugaaucugccaucacacagaugugugaagucacaggagguauuggcaauauuuaauguuucugaaggaaaaauucagagcauagaguauauuuuucauuaaaugccauauccagucuuuacuuguuuuccuucaaagccuuuuaacucuguugcuuaaggucaucauugguauauuugcugccaauguaguuaugauuauuucaaguuauauuuuaggauuuuaaaaugcuuauauuaugaaauuauauuugaucaaacuugugcuauuuauuuuuccuucugggauaggucgcuccuacugugugagaacacaaagaauguugaaucaauguuuagaaucucuaguucaaaaaguucagagugguguaguuauuaauuuugaaaaaacaggaccagauccacuuccuauuggagaagguauaguagauaacuuuuuuaacccuaaaguguuauauaggagaaugagaagacauuaaauaaauuacuauagacacagucuucacuauccacgugcauuugagugguuacaaacauacauccaaacaacuaccacacauucacugccuauguauauguaucagguggccaaauucuaacaacuuuaauuucauguugaauguuccuaagaacguguuuccuuuuccuggugcauuuuauauucccuggucccagucuuuggauggcacugacucauucaccucucuauucacaaaaugucuggagauucacuaugguguacacuuaaauaauaaucuuguuuugguuuugugagugccaaauaugcuaagccaucuuuacgaaauauguguuaguuucugcaccucagcaagaaauuaugaauguuuauccaggaacugcucaucuucucuaagauccuacacuaguauuuucccggucacuuuuucacucugaaguuaagaguugagcaaccuuuucuccaaaugagauuucacagaaaguucgacauccaaaacuugaugaaaguagggugacuuuugcauaggggaaguuaaaucguagugaaucucuagaugguuugugaauggauguuuguaaucacuugaaugcaaaugaauuucaaagggaucagggaacuaaacaagcaccauggcaacgcauugcaagacuuccaugguaaugcacugcaagaacagagcuccuagaaagucuauguguauauguauguaaauguguaaguguauauauauauauauauauacacacacacacuccauuauuauuaccacagugauugucuagccugauuuauauguuuuaauugccuugacgaagaacaaaggggucaaaugcauaagggcagaaagcuacacauuucugucugaagcaguggauccuguggcuccugaucuuuuguuguuguuguuauuguuguuguuuugcucuuuaguuccccauccuuuugagaagcuguuggaaaaaauauagaccccuuucccuauaaauacagacauaagugacacauucacaauuuuguauauaaucucagggguuuuuugggccuccaaguuaagaacaucugccauaaaagacugaggccccacagccuauuuuaaauuaacuguguaggaaggccauguuauacugcuagcaauccaaaauuucgugcucacuaucuuagcauaaacugggaacuuacauauugaaauucuaguaggauuuggugucauguaaauggcacagauuuuuuuucuagcuccaguucuccuuuguccagaguucuuaaccuuucagguucugaugaaaguuaagaacccuuuccucagaaaaauacacauugucagaauugugagcucaacuuuggggggauccuccaaagccauuacacuuuuuuucccuacugcacaguggacccauuaaaucuccuagucuaaagaaauuacuuguuuaaaguaaugcuuaaauaaguuauucaaaugacugauaauuuaagaaaaaugagacucaaaucauuaaagcauaucuuuuacaaauauuaucauuaaaaguuuauauaacucugccuugcccugauuugaggcggggggagaaggaggaaggaaaugaaauaugcuaguuuaaaucauuaaaaugcauucaggauacauuauucagcauuauacaacacccauuguccauggaauuuugaugguggauggagaaaccauagugaauuaguccacgauaaacuugauguguuugcuuugugcuccccucaacuauauacacauugucugcauuucuucuaucuuuaagugaauuuggcuaguuuuuauuuugccuuuguggucauugggucuaauuguuuggcaaagaacacuuuuuucuuguauuuggaaauagaaagaauauauaaauggaauuuaugaucuauuuuuaucagacuccagaaauguaaaaacuauaccagggagugaacaauuucauuugccuaauuuaguaauugaauucuugaaaaauaacuguaguguuuugauguuuuuaauuuauguguacgagucucagaaaauuuaaaacuaguuuuaccauaguuuucugcauaacugcauauucucuuacuagguuaagaauggugggguggguguuggguuagaagagauggauuagacgaaaagaguugcuagagagaacauuuagaaauccuaguagagucacuuuuuuuucuucuuccauuuuucaugaaucauuguucuuguuuuauuuuggacuuugcuuucagcuggaaaauuuguacaagaagaucagcagcuguaaaaagaaacucacgccuuaguuugucuuuuguuuaacuuuuagauggacuuauggauucauccaggccaagcaauucauuugcugcucagccauggcauaguugucauaaacucauuuauguacgaccuaacucuaaaacugguguuccuguuggacauuggccaauuccagaaucuuuuuggccagaucagaauuuaccuucacuaguaagugucauaaaauaaaaagguaaacaucauucuggauuuucaauuuucugauuacagugaaccuuuuaaaauagcuuugaggccuuuaugccaugccacaggcaaguaagucuucccuccuuugccuucuaucucuuacuggaagucuagcuuugugccuaaaagcaaaggaggacuuccuuuauuuucugauacuugucauucuucaguugccuucgccacuugagcugcccuuuuuggauguuaaaacauugcuguuuuugaugcuguuauaaucuguuacuugguuuucauuucagagcagcugacuugauuuacguggcaaacacaacgucuaaaauguacuggccuugguuuucaugcacagccucaggaaguuugaacauaguuuacaccuuggauagguucugggaacauauuaaaaucauauucaaaauucuacuucuuccuacuuuucaucuuuuuguaaucaauggacuuuuguagcaauauaccuuucaaugauggguaauuaagcaauauuuaaaaaauaaucucuaagcaaggacuugucuuuuuggucacugcauuugguaggagaggcuuugcuauuacaguugcucccagugccagaucaauuggcuuuuuuuuuuuuuuuuggagggagggcagugucuaguaauaaaggagacgguaugaaacccacucucuuuugucuucuuuccccuuccccaaauuguaagagggccugaguaaucucccuugugugggcucaggaggggacacaaacaaaucacuacuucuucuauuuaacaucuuccuaguucaguucaucuauauucugucucaguuuuagaaauuucugacagugaauugcauuuucuccuggauuacugcuuuuaggcuucugcccuuuuuucagaaguggccaugaaagaccugaauguaagacugaagagcccuuuuggccccugcugugggugaggguaaacgucccacuccucuccucagggcuucaagguguuacaccugugaaaccucagcccuuccaaacucgaguacaggcuuuauggcaaauuuacuucauuuuugcuagcaacaagucuucauucaugucuuuaugacauuuuuaccuguucaaaucuaaggagucagaaaccuuucacaaguuaauuaaaacuaaguugggaaaaaacaaaauagaauaagacauuccaaguaauucacacauagcucauguuaccauuccuccaucuuuaaaaguucauuuaagagcuauuuuucucaacccccaaacaucuuauaauuguaaacuauaaaggcaagugaauauguuuucauuuuuuauaaaggaagcagugauauuuuaucauauucauauuagcuuuacagguuucgcaacaagaauaggcugacccacuucuuacuuugucucugggacuuguccugugucccucucucuccauauugcccuugcuguucgccuuucucucucuggugcucuccaaucacacaagcuaaaccuguuacuuaaauggcuucuccauuaaucugcuccagcaccccagguacacaggccuucgaagcccagcgcaaagcauccccagcuccagcuauucaaggcaaacacguugguguuagcaaugcugcaaaaauccaucugggcccuggcauugugacuagcuuauuaucagucucuaucuugcccucuccaucccucuacuauuuuucaucuugcuuguucauggcuuuagcccucucauuaccuuauuagaaaguugcauggauuucuucauucccagcauaucuggacuaucuguaaccucaugguacaaaggaaugaagggcaggcaauucuuggaggucauaaaauagaucugaaauucaacauucauccuacaaucauaagcacuucuuaaacauauucaaaacaguuuuuuuucaauucacugaaauuuuaguuaugaguguugaaauuuaccuuuccucuuccuaaugucaaguagauaguaaagaaucugagcccucucucccauggaagccauuggugguuccuagagaucuaguaaucuucuuucucaaaaugcuagucuguauuucagugaaaauguaacaaaauauaaaacgacuugcagaauugucagaaauauaagcuugcuuugagaccuaaccauuuuuucugcuuuuuuuaaaaaauuuuuuuuagccuccacgaacaucucauccuguugugagguucuccuguguagauugugagccaaugguaauagacaaacuuccuuuugacaaauaugaacuugaaccuucgcccuuaacucaguauaucuuggaacgaaagucuccccauaccugcuggcagguacuuauccuuaccuauuagcuaaaugucuguaaccacucuaggaucugggaauuguuuuaagaagcuucaaagguuauucucaaaauaauuggacugacugugcuaaugauguuucucaugaaugcugucaaauaagcaacagggccaggcaaauaauuucagacuaauaugaaucauuagucuacuguacauugccauuuaaagcaauagagucugaugaaaccuauauauuugaagauuugggggaccccuugaagucuacccaugcaccccagcuuaagaaucccuaaucuaaagguuguacuucacuucagguauggcgucugcagcugaaacaagguguuuagcccuuacuuugaacuugacagauuggaaguacaggauaguuuaggcagagaaccauaaguccugaaacuaauuucuguauuaguguaauauaauaaaacucuucguccugugguacaaaucacacuaaaaaauguguguaauguggauuuugcaacuuggaugagacaaaugcauagagauaucuaucauacacuggcucuuccaaguguuacacuuaagccagaaggauuugcugauugguuaauagagucaccuauggaauuuaauuuguaaaaauucagagauggcagucacagccuuuuuauguggauacaacaaaaauguccuacacuguaaagauguauguucuauuucuaaacuguagagauguauguucuacuucuauuaauauauaggacucuauagcaaucaguaacuguuaggcucuauuuaugcaaggaacacuuucagacugccaucuguuuuaucuuaaaaugugagauuauugcuacaaguugucuguaagcuacuuaaauucucccaagaugcuacaacuaguuagaaaaaaaggagcaggauuaaagcaagaauguaaaagcacaagaaacagaauaaucucacaaacauaauacugagcaaagaagcuagacagaaaagauuacauauugugugauucuauguuauauacuuucagagagagauaaaacuaacuuacucuguuagaagucgggauagugguuucucuuggggggaugcaagguaguggacagaagaggacacaaggagaugucugguuuuguucucuuucuuucuuucauucuuuuuguuuuguuuuguuuugagacagcguccagccuguugcccaggguggagugcaguaacacaaucucagcucacuguagccucgaccuccuuggcucaagcaaagcgauccucccaccucagccccccacagaggagcuaggacuacaggcacacaccacaauuccuggcuaauuuuuuaaauuuuuuuuuuuuuuuuuuuuuuuagagagacggagucucaccguguugcccaggcuggucucaaacuccugggcucaagcaauccucccaccucggcuucccagagugccgggaugauggcaucaaccauugugccuggccauauucuguuuuuugacucgugugcuguuuacacauguacauucacuuugugagcauucauugagcucuauacuuauaguuuaccccaaaagugcuagaaauguagagauauggauaauagauugcuaauuuaaaauaaagauaugaccuuugaauuuauggguugaaaaacauuuuuauaaugaaagcaaauaaaauuacaaauuauagcuuuucccuaaaauaaccccucuuuucuauauagcacauuucuuggaaaccuucuucagagaaacuuaagaaaugcuguccuugcuucugcacuaccccuuaaauaugucauaugccucuuuccuguacuuuauguuacuuuuuuuagaguauucuuaaugugaugaauuaguguuagugaaaaagaauaaaaugaaccaguagccaggaaauuuggcaaaaccacaauggagaccggagccuaacccuagcucugucaccaacuauguggccuugcacgagggacuuacauugucugaacuagcucuaaagauccuuuggaacccuaaaaaucuaugaaucuguggcugauaaggaauuuggaaaaacucaaggggccaaggaagguaggaaagagaaagagagaaagaaacaaaauucagugcuuuuccuuucaugggaaucauagaucugacccuugacugccuugugcaugugauuuuuuuuaucuuucuuugaugaauuuuuccucucuucuaauauacacacuuaggaaauaaaauccagcaugguuuauugcaguuaucuguuucuauuaucauucaaauuaugacacaaaaucuaguagacucauguuuuaguacaacucauguucuguggggucauaaauuacauaaauuacauuacauaauuauaccaacuuauucuuagugauaauauuauaagaagguagugaauugguaggugauauugguaguacugagaacuagcaagguaaauggauucuguuaaaugucaagguucgacuuuguuguaaaugauucugccgaaggacuuuggaaaaguaaaggaccaggucucuaaaaguauauauuggugguuuggaccaaagacucugaacauggaacagagaaaacauggcagcuaggggaccccaguacaacauaucaacuguaagggggcugaugauacaggaaucacaucaggaaaucaauaaggaguaagaaaauagucauauggaauuaagaucaauguuuuaaucuucacugaauguuuacucuaccagcauaacuuuuuuuuuuuuuuuuuuuuuuuuugagacagaguccugcucuguugcccaggcuggagugcaguggcacaaucucagcucacugcaaccuccaccuccuggguucaagugauucugcugcccagccucuugaguagcugggauuacaggcgcaccacuaugccuggcuaauuuuuguauuuuuuaguagagaugggguuucaccauguuggccaggcuggucuggaacuccugaccucaggugauccgcccgccucggccucccgaagugcuaggauuauaggcgugagccaccgcacucagccacuaccagcauaauuuauaagagaaaugccuuccagguugacccaaaguaucuccuugcugccucaaaauaauuagcaccagugccuggcuuauuauaacagguuacucaguaaauauuuauugaaaaaaaaauggauaaauggguaggggaaggaggcagcaaagaugcauggagcaaagacuuaauaauaguacaaugaagaugguuuacauaauccuuuaaguaggcuuuguuuuuguaauuucaugcuucaggcaugggacuguguucuauuuucuucacagucugcacucugauuaccacuuguucuuuugagaaguuaauuuguuuuaguggcugguuuccucuuagcaguauuucagcuuuauuuuucauuuugcuaaguaaguaaauauuuggguacuguugauguggccuguggucucugaaugguuguugcauaguauaguuucauuucuuaauauaauuuauaggagaauugcgaucugaacauucauauuuaguaggauuuuuuuugagacagggucucgcucugucacccaggguggagcgcaguggcacagucaugacucacugcagccucaagcucccuggcucaagccauccuccugcucagccucccaaggaucugggaccauaggcacgugccaccacacuuggcuaauuuuuuaaauuuguuguagagaugagaucucccuuugucucccaggcuggucucaaacuccuggccucaagcaauccuuccaccucagucucccaaagugucaggauuauaagugugagccaccuguaauccuaguacaugagccuggccuaguauaauauauuuugacauaaccauaggcuaaaaacacuauugcuauuuuaaaauuacaaucaaauugcgccauagaugcugcuauggaauguuacaauggguuugguuugacauaaaauccuuauugucaucacugugcauuacuucauguuauucucagguauuuguuacuagcaguggaaaguacaaugaacuuggauauccauuugguuauuuaaaagccaguacaacuuuaacuuguguaaaccucuuugugaugccuuacaacuacccaguuuuacuuccucuuuuagguaaguaaaacaugugccacugaaucaucuuuaaaauacaacagaaaugaaaaaucgauaauagacuaagcauuuuaaauguagaugacgguaacaaauugauuugaaaggauagaauuugcauacuguuuucuguuuuguuuguuuucuuuuuguuguuuuuacaucaaacagaagagaagcuugacuuucagugugugauucuuaugcuuguucuucagguugcaacuuccaaugcacaccccacccccaauccccaguuugaagugcacuuggcuuuuuuguauaguuugggccaaaaaauaccaaaacagagcuaccauggggugggaguaauggcuugugcuuguuuccccucagaagauaaaugcucuugaggcaucuguuuuaggcagaguagugaguuaagaaaauagguaccagaguaaauucugcaaugacugugguuguagaagcugugauuuccauagcaagguucuaaaaggaacaacucaagaagcuguuacucagauacuaaugaaaauguguguggagauauuuuccccuuauuggaagagccacaucuguuuagaguaauguaguacuuacugcacaguauccuaguuguaaaguuguaaauguuuuuauuucguggaguuucuuaauuuuugcaaaaagggucgaaucuuuacuaaguuuucauacgaucauuaaaacuaugagacuuuuagugcuauaaauacaacauacauugaauauacugaaauugcaauacuuuuacaugucgauuuaagaaguuuaagaaugagucaucguaaauguauuagcaugauuauuuuaaauaaccuaucuacuuuauuucuuagugcaaccuaagagggauguucucuuucuaagagcugauuaucauuaacauaagauauagguuauaucuuucagauuaauaagacagccaguaaaaaagugucuguauuuugcagauuuauuuaucccuuuucuuaaauaagucuuuaugacuucaguuuccacaacuauaaagugaagagauuagacuauguaaucuucacuaacacuguuaaugauauuauuuuucuauuuuuaagugcacuuuuuuugaucuacuuuauugaguuaugcuugacguacaaaaagcuguacauauuuaauguauacaacuugaugaguuuggagauaaguauauacgcauuaaaccaucaccucauucuaugccauaaaccuaucagucaccuccagaaguuuccuccugcccugguaagaucuacccucuuacugaccuuuuaaguacacaauacaguauuguuaacuguagguacuaugcuagaaaacauuaugcugagugaaauaaggcagacacagaagaacagauaccacaugauaccacuuacacacuuuuuauuuugagauaauugcagauucacauguaguuguaagaaauaauauagaaagagaugaccucaaaagcacaggcugcaaagacaaaacuagacacaugggacuauaucaaccuuaaaagcuugugcaucaagggagacgauuaacagagugaaaaggcaaccuauggaauaggagaaaacauuugcaaaucauauaucuuauaagggcuuaauuuccaaaaaauauaaggaagucuuacauuucaauagcaaaacaaaaacaaaacccuaaauagccugcuuaaaaaaugggcaaaggacuugaauagauauuucuccaaggaagagguacaaaugguuaacaagcauaucaagagaugcucaacaucacuaaucauuacagaaaugcaaaucaaaacuacaguaaggcauuacauuacaccccucaggauggucacuaucacaaaaacagaaaaugagaaguguugguaaagauguggagaaaucggaauucuugugcacucuuaggaauguaaaaugguguaaccaguauggaaaacagauagaaguaccucaaaaaauuaaaaauaaaauuaaccauaugauccagcaaucccauuucugaguauauauccaaaagaaucgaauccagaaucuugaagauauauuugcacacccauguucacugcagcauuauucacaauagccaaaaaaaaauccauugauggauaaaugaauaaagaaaaugugguagauauacaugcaauggaauauuauuuagccuuaagaaggaaauuuugugacaugcuacaauauggaugaaccuaguggacuuaugcuaagugaaauaagccaaaugacaaauauuguaugauuccacuuacaugagguauuaaaaguagucaaacucauagaaacaggggcugugugaggggaaaaugggaacuuguucuucaguggguaauagaguuucaguuuuguaaggugaaaagccucuagauaucuguggcacagcaauaugcauacaguuaacacuacuggacuguacaguuaaaaaugguuaagaugguaaguauuacguguuuuuaaacacaauuucuucuuuucuuuuuucuuuuuuuuuuuuuuuugagacagagugucucucugucacccaagccagaguguaauggcaugaucuuggcucaccgcaaccuccaccucccagguucaagugacucucccgccucagccucccaaguagcuuggauuacaggugcgcaccaccacgcccagcuuuuuguauuuuuaguagagaugagguuucaccauauuuuccaggcuggucucgaacuccugaccucaagugauuggcccaccuuggccuccuaaagugcugggauugcaggcaugagccacugugcccagccuaaacacaauuuuuaauaggauuuuuaaaaaagaaauaacacagaaauauccuauguacucuuuauucaguuuucccaaauggaagucuugcaaaacuacaguacaguaucacaauugugauauuaacauugaugcagugaagauacagaacauuuucaucaccacaaagaucccuuaugaggcccuauuacagccacaucuaccugccuucuguacccauccccuccuuaaccacugccaaccacuaaucgguucuacaugucuacaauuuuauuauaucaagaauguuauauaaauggaaccauucaguauguaaccuuuugggauuggcuuuuuucagucaguguaauucucuagagauuccuucagguuguugcaaguaucaauaguuuguuccucuucacugcugaguuuacaaacuaugacauuaauauaccacaguuucuccaccuguucaccuguugaaggacaucuguguuguuuaugcuuuuuggcuauugugaauaaagcuacuguaaacauuugcauacagguugugaacauaagucuucacuucuaugagauaaaugcccaggagugcaauugcuggauccuaugguaguugcauguuuaguuauuuaagaaauagccuaaauguuuuccagaguagcuauacuauuuuacauucccacuauuaguguaugagugaaucaguuucucugcaucuucaucagccauugguguugucaguauuuuuaaaauuuuagccauuuugauagguguauggugauauagcacugugguuuuaauuuguauuucccuaauggcuaacaauauugaucaucuuucuaugugcugaugugaugaugugccauuguauauguucuuuggugaacugacuuuucccuauauuuuaauuagauuguuugcuuuuguuacuguugaguuuugaaaguucuuuauauaucauagauacuagcccucugacagauaggugacuugcaaauacuuauuuagaucuuuuuugaucuuucauugguguuacgcaguuuuccacuuacaaauacggugcauauuuuguuauauuuacacuuacuucauuuuuugagugauugcaaaugguauuguauuuuugauguugguaucuacauguucacugcuaguauauacaaauacaguugauuuuuauguuaauauuguauccugcaacuuuacugagcucacuuauuaguuguaggagaguuuuguagauucccuggaauuuucaacauagacaauuaugucaucugcaaauagagacaguuuuaccuuuucuauucuuaucuuuauguuuuuucuuuucuuuucuugccuuacuguacuguagagaacuuccagcacuguguuuaauggcagugguaagauguauguuccaucggugcuugacaacuaugcacuauucauucuuacauuaagcauaaugcuuuuguagauuuucuucaucaaguugaagaguucuggcugggugcgguggcucacgccuguaaucucagcaauuugggaagccaaggcggguggaucaccugaggucaggaguuugagaccagccugaccaacauggcaaaacccugucucuacuaaaaaauacaaaaauuagcugggcgugguggcacgcaccuguagucccagcuacuugggaggcugaggcgggagaaucacucgaacccgggagguggagguugcaaugagccgagauugugccacugcacuccagccugggagacagugcaaaacuccaucucaaaaauaaaaaguugaagaauuccccuucuauuuguauuuuucugaguuuuaaaaaaucauaaauagguguuaaagcuucucaaaugcucuuucuuuuuuuuuuuucuuuucuuucuuuuuuuuuuugagauggaaucuugcuguguugcccaggcuggagugcaguggcacaaucucagcucacugcaaccuccaccuccuggguucaagcgauucucaugccucagccucccaaguagcuggauuacaggcauguaccacccugccuggcuaauuuucauauuuuuaguuagagacgggguuucaccauguugggcaagcugaucuugaacuccugaccucaggugauccauucgccucggccuuccaaagugcugggauuauaggcacaagccacugggccaggccucaaauguucuuucugcaucauuugauaugaccauaugauuuuucuucuuuagucuguuaaguaugauggauuacacugacuaauuuucaaauauugaaccagcuuucuaucccugaaauaaaucucacuuggucauggcauauaauucuuuucauauauauuacugaguucuaugugcugauauuuucuugaguaauuuugugucuauauucaugaaagauauuggccuguaguuuucuuuuuuguuguugucuuugguuuuaguaucaagguaauacaagcucuucauaaaaugaauugggaagugcuucuccuauucuguuuucuggaaaagauuguguauaauugguauuaauuauucuguaaacauuugauagaauuccugagugaaacuaucugguucuaaacauuccuguugggaguuuucaaauuauuaauucaauuucuuucauaguuauaggguuauucaaauuauguauuucauugagugaaaugugguuauauguccuuuugaggaaucaguccauuuguccauuuuaucuaaguugugaaauguauguguguagaaucauucuuagcaaucccuuaugguccuuuugauguguacagagucuuuagugauaucaccuauauuauuccugguauugauaauacgggucuuaugucuucuuugucuuugucagccuugcuagauguuugucacuuuuauuaaucucaucaaagaaccagcuguuucauuaaucuuaucaauuuuuuuuuaaaauuucauugauuuauuuccuuucuucuuacuuuaaguuuguuuugcuuuucuuuuuugauucuugguaugggaucuuagauuauugguuugauacuuuuccucuuuucuauuguaaguaguacuuagugccuuaaauuucucucagcgcuaauuuagcugcuuuccgcaaauuuuacauguuguccuucauuuucauucacuuuacuuugucuuuugauuucuccugagacuuauuugacccauagauuauuuagaaguguauuguuugauuuccaaguauuuugaaauuuaccuauuaucuuuuuguuacuaguuucuagauugaauuccaucguggucagaggacacaucuguauucgauaucuacucuuauaaauauguugccauuugcuuuauggcaaagcauauuuucuaucuuaauauauauuccagcagugcuugagaauaauguauggucucauguuguuugguaggauauucuacaaguguuaaauuguuccuguugguugaugguguucugcuauauccuuguugauuuucugucuauuugcucuaucaguuuuugagagaggguuguugaagucuccaacuauaauuguggauuugucuguuucuuuuucaguuccaucaauuuuugcuucaacuauuuugcagcuuuuacuugguucauacacauuuagaaucaugguguauucuuccuugauugaucauuauguaauguaucuuugcuaauuuucuuugcuuuuaagucugcuuuaucugauacuaauguauccacuucuguuuuucuuugauguuugcaugauauaucuuuucccaucauuuuacuuugaacuugccuauaacuguuuuguuuaagugaguuucuuauggacagcacauuuuugggucauguuuuuuaauccacucugccaaucuuuguuuucuaauugauguauuuagauaucugcauuuaaugugauuauuguuauguuagggcuuaaguaugccaucuuauaguauuguuuucucuuuguucuauuuuucuuuucucuguuuucauuuuacuggcaucuuuuggguuauuuaaacguuuuuuagaauucuauuuucuuuuacuauaguacuuucaaguauaucuguuuggauagcuuuuuuagugauugcuccagguguuauuauacacaaauuaccacagucuacucguucucauuauuuuacuaauuugaguggaauauagaaacuuuaucucucauuauauucccuuacccuccucuauuuauaauaaaauuaucugaacuauuuuauguacaauuagaaauacaugaggcaguguuauaacuuucgcuucaacugucaaacauaauuuagaaaacucaggaugaaaguccauuguuuuaaaccauauuuuggcauauccuguucuuucuuccugauaauucaagguuuguucuuuuauguuuaauuucuguuuaaagaacauccuuuagcuguuuuuuaaggguaggucugcuagugacaaauucucuuaguuucucuucaucugagaauaucuugauuuccccuucauuccugaaauauauauauacauauauauauguauauacauauguauauauccauauguguguguguguguauauauauauauauauauauauagcuauauauauagcuauauauauagcuagguauagaauucucgguugacaguacuuuuauuuuagcacuagaaaaaugcuguguaacugccuucuguucuuuugguuucuaaugagaaaucuacuuuaauucuaauuguucuuccucuguaagugagguauuguuuuucuuugcuuucaagauuuauuucugccuguaguuuucagaaguuugauuaugaugugucuuggcaugcacuccucugagauuauucuguuugagguucauucagcuucuugaaucuguagguuuauuucuccuuccaaauuuggccgguuuucagccauuauuaccuugaguacuuuuucagccccacuuucuuucucuucuccuuccaggauucuguugacaugaauguuagaucuuuucuuauagucucuuagguuccuuaggcuccguucauuuuuuucauucuauuuucucuguuauucagauuggguaauuuacauuguucuauuuuccaguucauugauuauuuccucuguccccugcauucuguuguugagccuaucuacugagcuuuuuauuuugguuauuguauuuuuuuaauucuaaaauuuccacuuaguuauucuuuauaucuucuauucuuauucucuguuucuuugcauguguuuucauuuguuucaagccugcucauauuauuuuuugaaacauguuuuaugauggccgcuuuaaauuggauauuuuuaacaucucuauuaucuugguguuggcaucccuuaauugucuuuuuaaauuaauuuugaggccaggcacgguggcucacaccuuaaucacagcacuuugggaggccaaggcagguggaucacuugagguuaagaguuccagaccagacuagccuggccaacauggugaaaccccgucucuacuaaaaauacaaaaauuagccaggcaugguggugcacgccuguaauucccacuacucgggaggcugaggcacgacacuuacuugaacuugggagacaaagguuguagugagcccagaucacgccacugcacuccagccuggguguuggagugauacacugucucaaaaaaaaaaaaaauuaauuuugagaucuuccugguucuugguaugaugagugauuuuuuuccuguacauuuucaauauuuuguuaugagucucuggaucuuacuuaaaccuucuguuuuaacuuacuuccucucacaccccucuuggagaaacugggaggugcugccucauucaugccagguagaaguccaggcucgccacuuggccuucauugacaccaaaagggagggaucuccuuguuauuguugugugugaguaggaguucuggauccucccuagaaugauaccuuccuggcuggaagagauaggaaugcuucauuaucuuccacacuugaccuccacugacaccauauggguagaggugaccucauuacuacugagcaguugugaaaguccuauacaacuauuaugggcuaagcucuagggucccaucuuuggucuaaauccagccugccuuccaaauuauucccugaaaauuccuuuaacuagaguagcuggucuuccaguagcuaucaggauguagagcacuuuacaauagcaagacucauccucucaucuuugccuuugcucgucuuucagguaauggaggucagaugaaggcaugacauaaugguuaagaggaaugauuauagugugaucaagcauucaguucucccuuugccuaaaaccuucugugcuuaaguugccauguggugcccuuccccaaacuccucagcacuaugccaagucaaauccugacacugucuuccuggucaccuuuuaguuugcaucacucuauuccucaaaugucaaguguuucuucuguuugaagugucuucugucaccaguaagacauguguggcaucugugccugguccuccuuagccuauaacacuaagacuccaacccugccuagagcaugaugaccuaaauuauuuugguugcccaacagccuucuggauguuucaagagugucuucaagccaagcugaacucuuaccuuaccaugcucuuccuccucucuucacaguuuaguuaguggcaucaccaugucuaugcaaacaucccacaccagaaacucuggaggcaucuuugacucuuccccuguucccuaaucccauacauucagcuaggguccaugccaaucuugacucaguucccauucugcccccuggcuucaaauauccaucuccaggccuuucuguaaccuguguuuucugaggaguauaggguuuuuaacacccuuugaggcuggagguccuugagcuccuaaaguccaaacuugggauuccuugugaguuucugaaauaaacagaaacucaacauuuccauaauuacuuaauucucuggggaguuugacauuuauagugguuaagaguuugggcuggagggcauagcugcccagguaugaaucuggcucugcuacuugcuaguuucaugacguugggcaagauaccuaaucugucuaugccucaguuuccucauuagugaaauggggauaaugauaguacuuaccucaaagggauuuaguuggaauuaaaugaguuaauacaguuaaauuguuuagaacuugccuggcaaauaguaagugcucaauaaaugcuguuguuauuauuacugucauuauuaauaccuacauuaucuuaguagcucucgaaggcacugcuauauuauacuaagaaggcuauuguauaauuuugcaguuuuaguggacagggacaguuaguaaaagggcaaguuaaguuacacagacuacauaaguccagaagcaucacuauauuacugcauaguacaguaauuguucauaacagugucccuuguuuucuuuuuauuaauaccagauuucaaucaaauuaaggucaugaaaguuuaauuacuuaugcacuaaaacuuaccagaaaauauaaaauaucucauuuucuggaauagauaaacgaagcuuaauuguaucaaugagcuaccagaaucauuucauuaaggaggucaccagauuguuguaguuagcaaaggacucucucccaauuaggaaauuaguuuuucuauugagaccuaauaacugcagaaauuagagcauuuguaacaacuuuuuuuuucguuuucuuaaauauaucacauucaauccaccuguucuuuuaaauuaagaacugaggacuuguguaaaaaauaaacuuuaguuccauauuaaaaccaguuaugaucaggaggaagaaagggagagguaugagaauagagaauagaagcaggauacuuugauguguaucagucacuauguaucuggugcuuaacagcuuacacugguuuguuuguuuuucauuuuguacggggcuuuuacacauacauuauguaguuccuuagaauagucuugugguaaggcaauuaucaucuaacccauuuuauagaugaaauggaggcuuacaaaaggcaauuucuccaaacucacugagcuaaggauguggcugagcuugaacucaaacccaggucuucccucucuuugaagaaagaaauggggagaaaggaacuggaagagaaaauaccggucauuuuugaggugcuggcaguaucauuuuacuuucauucuacacucucaucauaucuucuuucaaauguugaucagcuaauuguuuaugugacaccuuuacuguaccauccuagagaguccaugugaauggguauuuaaugccauggaaauaauuugcugagcuacagagguagugacuaaggcagugucaccccaggagcucucuacucuuaaucuagacugcagaagauuuucuuucuucuccugacucccauuuuaaaacucuggcagaaaauaauuagccuaaaugagcuccuugguggaaucauugcacuuggcauuguuagaaaugcaaagaguauuauucacuugauuaucuaaucuauuuauaucuaaaaguuucuccaguauuuacguuuguccguuaguuuccaaaaucugccuaauucccaacagacacaacauaaagacaugguauaacaggauauauccauggucucucauuccuuucugucaagauaugaauggucuuuaaaggccccacuugcugcaaugaaccagaaauaucuucaaaucuuuaacaaaagaccuacauuuuaugacuuuguaaauucauuuaaauuuguuucagcaggagugaauaauuuauuauagcuguaaaaggaaggaaauauguagucgcuuuucuuaacuaaaguaauucagauuuucaaagaauagcccuauuuguaaagaaauuaugcaugugggauagggaugguuuugucucuguaaguaaagcauuuuuuuuaaaaaaaucaaaacuacuaaaaccuuaagacacaaaauaaaggaugaauuuauagugucuuugguaccuauaguauguguggcagauucauguugaugucuggggauuccaauuuuuauauuuuuauuguauuagaaaaauguuuuuuucuuacacuuggaaggaaauaaugagaugugaaggaaauuuucaugcguauauaaaauguauuuagauuauuaaaauaauuaaauuuaagugugaaaagauagggaaugucuacuuagguaaauauuuuuaguucaaauauuuuuaguacaugguauucaagaaacauguuuaguuguucuacagaauuuuaaacuucaaccuaacaucuguacuuacuucuacuagugcuuuuacuaucacccaaugacuuuaggucagugagugaccuaaaguuuggcucaaaaugugugaucauggaaauaaaaaaaaaaugcagaggcagggaaauauggcuaaacaaagcauaggcugauuaaaauuuuuauuuuauuauuuuauuuuauuuuauuauguuuuuuugagacacagucuugcucugucacccaggcuggagugcagugguacgaucacagcucacugcagccucaaccucccaggcucaagcaauccuccugccucaaccuccccagcuacaggcauaugccaucauaccuggcuaauuuuuguuuauuuuuuuuauagagacaggggucucauuauguugcccaggcuggucucaaacuucugggcucaagugauucauccaucugagccucccaaaguguuggaauuacaggugugagccacugcgccuggcccaaaauauaguuuuagagcuugcucaucacugccuagaaauuauaggcuuagcuuuuguuuguauauacuuuguaaagucucuuaccuugaccuuucagcaaaauggauaacacccucuauguuuaaaugaaauaaauguuauuccaucaaccagugaccauggauugccccugaggugaaaauuacuaguuaccaauauguaagagguugggaaaauauuucaaguggaucaaaaucauuguuuuaauauuguauuucauguagcauugcagaugaaagaggaauauguaacuuaagaauuuauuucauuuuuuagaaaaaauacuauauauaauuuugguaaauaguacaaccacuaaaaaagauaaucaaauaaacgccaaugaaauuuucaucuacauuaaaagcugaaguuucuagauguggguugcuugauuauaucuuagagcucaggacuagaaugauguaauauuuuauuuuucuauuacagaugacuuguuuaaaguucacaagcuuaagccaaaucugaaguggcgacaggcuuuugacagcuacuuaaaaacucugccuccauacuaccuauuaguauguauuuguguguauauauguauuaacuguaucaaugauaauucuugucacaagaaauguuagugaucaaaagcuuuuacuguugcaauaagagagauaucuuuuuauuuuacagauauuugugucgucacugucuucucaaaucauguguaagaguuuggagaugucauggcggcacaaaagagagcuguuuucucuauuuuauuccuuuaacugccaugguuauuuuuauaaaacacaucuauguuucucuuauuaaaaguaaccuuaauuucauuggaauuuaagaauaaauagaucuggauucauauauuacaucaacuucccuuuuuaacucuagaaauucucaguaugggguuucccucuggaaaaagaaaaucugaagacauuacaguugccuauugccucuuaaauguguccuagacacagcaugaaguuggggcacugguggugagaggcggaauccaaaaaaauucagaaaugacuuggccucauuuuggauuucauaaugugaaguauucaugauuuugaacugguaauauaaucuaaaucaagauuaccaaaauaauuucagagguugaugugguaaccuuuaagcgaaguuucuagaggugaaaaggcagaaucuuaaaugguaccauuggugucacugggaggagaaauugggguguguuacuguuuaccauggcaguaauggggcaaacaauaaaaugcaaugugaaaugauuugaugauuugggaaauaagauugaacgcaauuuacuuguuugaauuugcuguuacuugcucuucuuaucccacucucuucugauuuuuuuuuacuuucugcuccuuacuucucugcuauuuucauugccacuuuuuaauguuccauguuugguuuuaugugcagcaccuugacuucuaagaaaugaaucaugucccuuugccccuuauaacugaacuuugaguauuuuaagauuuauucuauucuuacuguuguguauuuuguuuccuuauagccauuaaagaaagcacuaaggaugaugggagcuccaaaucugauaucagauaauuuagauuguggacuuaguuacaguguuaucucuuaccuuaaaaaacucagccaacagguaguauugguaaaaacaaacaaacaaaaauccuuugcccucagaagugcauuuccuuauucuuuaguguaauuguaauuuuucaaauuaaauguguauauaucucuacacuuuauggauuaguaauaaugugauucucuauggcuucuagcuucaccauuaagcugcaguuaagggucugucaguaucauuugaugcugugccauuucuccuuuugccugccaguuuguccuacccgcaagcugguugauauggggcagagguuuaauagacuucucucaugggucacauuuugucuaucuucaaccuaguuccuccucagaucacucugggcuacagcaucccuccuguuuagaucagcacacugaggcguggugugauuaaaugacuugucugagauuaguuuucaggcaugugaaggacuuauacucacaugcuagcccuuggauaaagagcuauaugcuuuucccuggagaguggggagaugagaccaguguuccucacacuggagggugauagaccccaaggggaacugaagaguggagcucaguuuccucucuucucacccuccaccuguuccucauuugccauuauucaccuugucccuugccugccccucucuauuaguaccucauccuccacucaccguuccuuaucauacuucucaccucuacuuagcccauucuuguaggauggaaauauuugagaacuacugaguuagaacuuuacuaucauaugaauguguuauguuauaugacaaauuaaugcagcaguuuuacuuaccuuaugcacaaagguauucccagguaggggacaauaguagcauucgcaguggugauaaugcuucaagguggauguguuuggaaguuuggccuuuaggaaauggagaguagugagcaaaacaucagauuucaccaaagaaccaaagugacuccacaauugggaugccgacacaccuugcuaggaacugacaacaacuucaguauggucuggagcuuaccagcuccuaccaguccagugugcuuauaagugcaaaagaaaguaaaggcaaccccagauuucuaaucuaccaagugucccccuaaccuccuuuccucucugcuaauagauuuuuugugguuguuguaaauguuuugguuugguuauuuauuuauuuaucuaucuauugaucuaucgauuuuuuuuaauuugauguuuaccuaagccuuuaaggcugugucaccaagguauggccacaaggaagaauaguguacagagauuuuaauuaaugcaaguucugggaccuuuuggggcacauguaucauuuuacaaaugagcuuucaagaccauuuaaggaaacagaugcuucauuugcucuuaucucauauuucaugacuuaagaauuuuuuagugauaauaaacauagacuuaauuccaauaauuagggaaaauugauaaauaucugucaccaaaccacaagaaauccaaaaucauuuuagguuuaccaaacauugguggaauuccaucuuucugagaaaaagggaagaucauagcuaauuuauaauagcucaaauuacuaauuuaauaacugggucaccaguguuucuugagccauuucagauguauguaaaacacaaaauaugccaaauauauauugcuauaauacacucaagcaguauuaaucaauaugguaucacaaugccuauuaagaggcuuuuuacaaauuacuuacuuaguaauaucuguuaaauuaagcauuaucuucuaagaccuuuuuuggauagucaaauauaagagauaaauaguuuaauuuuuucagaccuuuuuuggauaguccaauauuagagauaaauaguuuaauuuuuucagauauaaugccagucgaugugaucugaauuuuaguacuaguuuacacguauaaauacagucuuaaaccuuuaugucugagucugaaaugaaccuguucacuuagacuagauuuuauaguaacaaaaugugcuuuuaaaugucuaugaaugaaauucuuauucaugguuuuuauucucuccaugauuuuauuauaauuuugacacuagacaagaaaaaaaaauauuauuugucuuuccugcccccuaucuguuugcugugauagugcaaagaagcacaggaaaauguuuaauuauccauuuuucugugauuuguaauugaaaauuguucugugggguucugaaaguauuaucuuucuuaaguaguaaaaaugacagugguaauguagauguuuuuauaacauacuauguacuuucauuuuagaccaaacuagagucagaacgaauacuagcaucaguggggaagaaaccuccccaggaaauuggaauuaaagugaaaaaucauucuggagguggcauguccuugacucacaauaaaaauuuuagaaaacuauugaaagaaaucacaggggaaacugcacuuagacugacagaauugaacaccaaagaauuugcuggcuuccaaauugggcucuuaaacaagguaaauugugacauaaauaguuuguauuuguuugaacuugucugauacauuuaugucuuucauauuccuuuaguuuugaaauaauggacaauccuauuuuggaguuaguaguuaauaauggaccaguuuaggaauugucagcagauaucaauauggaauuaaauggacaagauauguuuuguggguaacgcccaugaaagauaaaggggagaugaagcuggaguaggcaggcagagcuuccaagcuacaaagcuggcccaucaccugugagaggaaggaggaaugaaggagaauugggugugaagaagcucagacacugguguagcuuggagaaagucuuggccagcacaguggggaccucuagcaccaagauuuccuacagaggagggccacacugggcagagcuggccaggcccuaacacccugccauugucuguuacuggcuaugggcagccugggaagggcauggccucagcucagugcugcagcggaucccuauggcaccacagcagcgggaggcucucugcuaacugcacuccuugcaggaucagccauugcuuuccugaagggagaucccagcagcucaccuccccuccauggcugccagaggaauacaucuagaguacgagcagugguccugcaaggcggccacagguaucaaucucgggauuugguguuuuaaaugacauauuugaaaagggauagucccaguggcuuuaauacccuguagguguguuacaaugcagaacaaggcuagcaaguggaauuuugccacugggaaaauucuacuguagucaguuguauugauauaacacucuucaauaacauuuuaagagagauaaguaugacauuucuauauuaaaagccuuaggaguaacugaaauuauuuguuucauuucaaauaggauuugaaaccucagacauacagaaaugcuuaugauauuccccguagaggucuuuuagaccagcugaccagaaugagauccaaucugcugaaaacgcacaaguuuauuguuggacaagaugaagguaaaauaacugugaaauacuuuuuuuuuuuuuuuggaaaaugccaggcaugacuuacaggaagguguuuauugcauaaugaguaggcuauuuuauaguauuuuaauguuuaaaaugccuguuuucacugaaucccuaugucuguuuaccaggcacauuuuuuuuuucaaguuuaaggucaagugugcauuaaucagcacguacacuacacuugccaugcuuuagcuauuguaagcuucaaacaaccccaggaaauagauacuguuuuuauguccaauucauggacauggaaacugagagugaggauuuuuaguaguuugcccaaguuuagccaguuggaaaguggcagaaccuaggucugucagauuucccaauuugcacacccaaacacuaacacucagccuacugugauaaauucaguagagaauaccucauuuaaaugaaaguaaucaaccuaaugguauccaggauaauugugacuauuuacaaauuccauuuacuccauuuuguuaauuuuaaaaaggcucaccuguucacuaaaaugagcaaaucuuauucuggucaauucccugaaauuauacacaaaguuuuguguguaagagggcuuuucuaggaagagaaccuacagauuuaaucaaauuuucagugauuaagaccuacuaaccaagauucucuggaugauaagugaaugccauagagacuagacucuuugaaaugcagaagauauguggugauuugaguugggauggugguguagggucagcccauucucaaaccugguuugaaggcaagggaguuguucugauccuagcgaugugagccuguaggcaguaguaacgguagacuaaguuaugauugggaugaagagagaugauucuagauccuagaaugcuagauucgagacuuuaaauacuauuugaugccaagacacacacugcuaaaccaaacuaugaucaugucuucucgaaaggaccauacgcuucagcuauaagcaucaauuucuuuuccugugauuuugcagauucccuucauaguguuccaguugcacaaauggguaacuaucaggaauaucugaagacauuggcuucuccacugcgagagauugauccagaccaacccaaaagacugcauacuuuuggcaauccguuuaaacaagauaagaagguaggauaccuaugccuaugucugccuaaauugggauauucuugcuauauaauuauuuucuuuuuggcaagauaaauacaaaucagagguucuucauuuguuuguuuaaacaauaaaauaugacacuaaggcucuuagugggagccuccugaugcaagaguguguugguugaauaaagucagagcugccauguauugaguacuaguaggagcugguguuuuaaaugaucucacuuaaugcucacaacuguucuguaagacaaauguuacuguuuguccuuuaaaagggagaaaucaaaggccacaguggucaaacgccuuaccugugacauagcacauaagagcaaggauuugaauccacgucuuucucacuccagaaucuauauucauuccaccacacacuaauuucuuuaauaucgaaaucacaguuuauuuccuguuuccaugauucauaucuguagugcuugaucuagaaaacgaugaaugugucccuugaaauaugaaguacuaagugauguuguuuuacuugaaugguccuacuaaaaaucuaaauguggggaguguguguguguguguguguguguauguguguguguguguguuauacugacuugcccauuaaagcaugaaaacaaaugggauuauagcugcacucauggaggagaccauugguguuaauuaaggcucagaccacacaauaaucucuuuugugacaagacugauugaaagguauuccacgucaccuaaauccucaauuuaucuuucuaugcuucacuuuccucauuuuguagcacuggggauaauaauuacaccuaacuaugcuggacgagguggcucacgccuguaaucccagcacacugggaggccgaggcaggcaaaucacuugagguugggaguuugagaccagccuggccaacauggcaaaacccugucucuacuaaaaauacaaaaauuagccaggcgugguggugggugccuguaaucccagcuacucuggaagucuuaggcaggagaaucacuugaaccugggaggcggagauugcagugaaccaagaucguaccacugcgcuccagccugggugacagagugagacuccaucucaaaaaaaaaaaaaaaaaauuacaccuaauuaacuaauagaacucugcauaauauuaagugaguacaugcacauuguuuacaacaugaacaggcauguaguaaauuaucugaaaauguuuuccccuuucuguauuguuuaugaguaaaaaaucuuuuggaaaagccauuuauuauuauuuuauucaacuaaugagggcacauauucuuggauuauuccuggacaagaacagcucuuggcuaaauuucuauacugcugccucucaucuuuuaucuauccccccaagagugaaaagccuccucacugccugcccagcaccaaagugggcauauuugaaucucugugaggcugcagauggggaggugcauuuuccaccugccugccuuucaacacguacauguagcauacuguacagugauaaucaauguuguuuaaugauaugaguuuggagcauaaaaaaggaaauuauuucccuuaugaagaguugaugcaaaauaguucguacuucucuccuuuugguugaauaaugcugcuuauuugcaaacuuucugauuaaucauuauuguaguauguuuugcuugggacaacauccuguauguuaguuuccuccuuguuccauuuaaauuggauuaaaauugaguugcauauuucuaagaacaaaguuggggugggguaagauaaaucuucggcccaugauuaagguuuauauuaguuaaucuggcaugggauuuaaaaaaaugaaagaaaaaaagacauauucgugauauaaugcaagauugauuauguaugcauauuaagagugcuugcaguuauauaauaguggaauuuuggucuuuaaugaaauacguucauuuauguguuuuuuagggaaugaugauugaugaagcagaugaguuuguagcagggccacaaaacaaagugaaacguccaggggaacccaacaguccuaugucaucuaagagaaggcggaguaugucccugcuguugaggaaaccacaaacaccaccuacuguaacuaaccaugugggcggaaagggaccacccucagccucgugguucccaucuuauccaaaccucauaaaacccacccuuguacauacagguauagaguagugguugugauuuccuuauggcuccuagaggacuaagacgcuaaacaauuuuauuucccuuuuuguguuccuuccuuuguguucaguuuguguucauuaaguaagccauuacuaaaucaucuauuugguagguacaauaaaccccacagggagcagagacccuguuucaaggaucucaaucuacaugaggugaaaaaaauuauaauuauauaguaauuaacacacaguaauuaacaguaaugaauacauugcuuagcaaguaaaugccacaguaauuaauggagaaauggaaagaggugagcaugucugcugcaaccuuuuggaguggcugcaagggugaggaggauaaagcagguuucccuggcaguaggagcaaguggacucagcaagacuggaucugcacuugcucuuuguguuaucaccaccuaugcaugcucuaauccggugcagucugguaucugccuccucgaccccacugaaacauucucaucaaggucacuagugugugcagcacauugccauuccuucuccacagcauuugacacaguuguucacucccuccuccauguguacguugggugcucagacaccauaagcuuauagcuuucuuuucccucuaauagcaacucccuuucauccucuuuuucugguuuugccuuuucuuuccaccucuaaauaucauagggccucaaaacucaauccugguaccucuccuguccuucacugcguucucuuccuaggugaccccaugcagucuuggggcucuaaauuugaccucuagaauauaaauugcuccucaauuucagacucagacuuacuuguggacaugcaucuccacuuaggugucuaauagacaaauaaaacucaguagguuucaugaguuucaacugaacucucgaacuugccccucuccaaaacagcucuacuuguagccuuccacauugcagauaaugacaccauccagauaugugccaguaaagcuuuaacaucugucaggguugaggaggguagagaagcucuagauuguaguguuugcagauuuccuucauguaaauaaugcuaauauuuaucaaagucaagcugucaaccugaggucauugaaccagagucgggaagaaugcucuggagggcaguugugcccuggcuccugccacacuucagcacuauuuacccagcgguucagcugacaaaccauagagucaucaugauuuuucucuuauucuucccucgcuuugauaccuuucacaaguucaggaaacuugauguucaacauaaucccuaaaucccacuauuucucucuaucccuccagugcacacugcuguggccucucaccacacuacuacaauaccuucuuaucccagcuucauguuucuaaucuagcccccaucuaucacauacucucuaacccuguggccagaaaauuaugucugcauguauaucacaucaugccaugucgcuccugaaaaccuguccucaacucuccugagcacucagaagggacccugaaccagcuuuagucugcaagacugcacggcuggccucugucaccuucuccuaacacgggagccccuggggcucccucugcugcugucucccaaaggccuguagaugacuuccccaacaccagcccaaugcugcuuguuucauuugcucauugugcauguacugucugacugccccaugaggaugugagcuccacaagggcagggaacguugcucuggcuguuuacugcugaucuccagcucccgacacacugccugccacagacgaugaauaaaugaaagaggugucagaucuggagugaaaagaaaguacuuuucugacacagaaaagaaggauuaggaagauaauacacuaagagggauuuuuggugauggaguguguauagaacuuucagcacuaauggccgccucuauuuucucagaauguauuugauguaaagaggaggcagguugugguguauccaaguugucuggcuuccagcucaguaaagcauggcagguuguaugugaauuugagaaaucaugaaauaaagugagacuugcuguuuucaacuuguaaagcauaacaagcugacacuaacgcaugaguaccagggaucugugaauguguguuuagaguuguacugucuuacuugguuuccauauguauucauagggccagaaaauaagaggugguuuuauuguauuauguguccuggccucaauuugaggggucucagaucgccaccugguauaucauccugcuuuaugagauaauuuccuagaaauugagcaucagagggauauaccugugggguugacauaauacccuuaccucacagcucaaccucuucauuugguuuccagaugcuacuaucauucacgauggccaugaggagaagauggaaaauggucagaucacaccugauggcuuccugucaaaaucugcuccaucagagcuuauaaauaugacaggagaucuuaugccacccaaccaaguggauucucugucugacgacuucacaagucucagcaaagaugggcugauucaaaaaccugguaguaacgcauuuguaggaggagccaaaaacugcagucucuccguagaugaccaaaaagacccaguagcaucuacuuugggagcuaugccaaauacauuacaaaucacuccugcuauggcacaaggaaucaaugcugauauaaaacaucaauuaaugaaggaaguucgaaaguuuggucgaaguaaguagugaaagaacaucuaucaauaaugcaccaggagguuucucucauucugugauucacuauagauucaagcuaucccuugagguacacugggggcaauauugggcuuucacauaguuuaaggcaguuccucuuguuuuaacuaaaaagguacagucuauauuuuccuguuuuuuccccuuauuucuuguaauguuuccuuuugcugccguaacaaguuaucaaaagauuccuagcuuaaaacaauacaaauuauuauauuaaguucuggaagucagaauuuugaaauuauuuuugcugggccaaaauaguguuggcagaccagcauuccuucugcuagcucuagagagaauuucuuucuuugccuuuucgagcuucuaagggccaucuguauuccuuggcccauggccccuuccuccaucuucaugaaaacacccuuagcacuuuuucuccucucugaccucugcuucugucuuuacauguuuucucucugaccuuaacucuacuguuucaucuuauaaggacacuugugcuuacauugggcccacaugcauaaacuuggauaaucuccccaucucaagauccuuaacuuaauuacaccugcaaaguaaagucuuuuuugcuauauaagguaauguauucacagguuccagggauuaauauguagacaauuuuaagcagcugcuauucagccugcuacauuugguuaguguuaacaagaguugcccuaguagaugcaugcagauauuuugauaagaauguuaaaauacaaacuacaucuaacuuuccacucacgaagaacaauuacuaaggauguacaacaauuaaauuuuauuucccauucaucuuuauaaaaauacugaaguuuuuuuaaauaucuucagaauaugaaagaauuuucauuuugcuugaagaagugcaaggaccucuggagaugaagaaacaguuuguugaauuuaccaucaaggaagccgcaagguagguauaaacaggaacucuucaauuuuuuguuuuuguuuuuagagcaguagggcccagugcaggaaaaagagaggaauaggcucugccuugcuuuuuucucaaacccuggcccucacucauaguuaaggcugucuccagaaguauuuggauuuauguuaucugaacucaacucauucauccuucuacuuuuaucauagccucagguaggcuugggcccucaauugccacuauugguacuugcucuaagacauaucuuuccaugaggacaaucuuuauauuccuauguagauuguaagcuucgauuuguaucccacacagugccuugaacaucaugaguacuuuaaguaucuuuugguucauaaaauuucucuuuauuuucagguuuaaaagacgaguccuaauucaguaccuugagaagguacuagaaaaaauaaauucccaccaccuucacaacaacauuagucacaucaacagcagaucaucauguuagugcaaagaccagugagaaaaaaaugacaaguuuucugugcuguaggauggaacaggauauuguugaagccuccuggaauguuugagucaagggaauugcuuuccagaugcuaagaagcagcaguggggcuuuugaauuuuaugauuaucuggcagugaaagcugggcuuuugccuuaauaauuuuuuaaaguaugaauuguuuuguuuuguuuuccucaauugaggaagcugauguuauuaauucacaggcuaaauucgguaaacaccacugccccuaccacggguaaugagaggucacucacuugaacuuugccauuccaggcauucucagaguggcgaggggccaccugcaaguggagcacaacuuggugcucuuacuguguccuucagaaagaauagguguacagaaaggaaauggcaaucuuaugugugcugaacaaaguuuucaacaauuccuaguugugccuuuuaaaccaugcaauauucaggauaguuugaaucaaagaaguaagaagcugcuauuuggguaacuuauuucucugugggaaggggcagggagagucaccaaacaaucuaccuccaacucucuucucuuuugucuagagacauuacaaagugcacuugaggcugcccccaaccucugacauuuguucuugcaugugaugauagaaagucuucagauggacuuauacauucugugcuuuggaagcacaagaagaacaaaauauguguauauuuccuuuaauguuuauacaaaaguuuauauggagcaguauuguuauguuuguaugaauuugcaaaaauuaaaguguacaaagagauuuugauuuugcauauauaaaauaaaucauuuuauugauuuucacaaguucauuaaugcuggauaaau

SEQ ID NO: 18993 - RNA, 11822 nt, Homo sapiens
gguucucgcggaccuuuuuccguguagcuuucugcuucuucccggcauuccuguuuccguuuucucacagcccucuggcuuuuccaccacugagacacuuugcgcucaggacuucagugacgucaucuuucugcggcgcgcggacacccgccgguggaagaagaaacagcuccgccguccuucgcuucuuuugcugggcugcugcuccuucggcaucauggcgccgucgcuguggaaggggcuggugggcaucggucucuuugcccuagcccacgccgccuuuuccgcugcgcagcguaagugccuggggcacggggaccgcuucgguguggaacccuaggggcggugugugggcgcacuucuaagggaccaucggaccgagugucagauuaaugguccuuugagaccuuacaguuuggggugacuaagaaaaucagugcaggaguucccaguggaagguucggaguuugaauuuggagagaguguggcaccugaaauugcaggaagguuggaaggaggugucugggagaggguucagaauaggagucuccaggaauccaggacaagugaugucagauccagcauggggcagaucaggcacaguugugagauugaggacucugguugcucauggucccacgacaaccaaguggacaacaucuugggcacucuugggcuguccaggcagagacugaguaguuaagugaccgauugccucagggaggcacugugguacaggagaaagagcacuggacugggagucuaaaggacugguuguuaaaaacuugcauuaccgcuacaucugugugacguugggcaaaagauuugugcuacacugcguuaugaaauucaguuuugggucgcuguuugaaauugcgcuguguuuaggugcuagagauacagugaugcccugagccaguucaaagucuaaaggaaaacaaguggaucaagaaguaguuacaauaaagugauaugcuaaaaguauauaaggaugcauggaagcagggacagucauauuuugggggaacugggagguuaaggaaaguauccuagauccuugcugcuuacagugugaucaacagaccagcaucaugagcaccaccuggcagguaauuagaagauacucaggccagaccuguucaaucagaaucuggguuuuaauaagaucccagggugauuuguaugcgcauuaguuugagaaacacuguccuggaagagauuaggauacacuggaguacugugucauuuucuacaguaagcuuuaacuguagaauuauaugauuguggggcgagaagggccuuuggaguucacugaaguccaaccccuucauuuuacagaugaggaaauuccugguuaaagguaguguuagaagcaggcgaggcuucaugcaaacuagcaagcuagcuaggaauugaaccagauaggagauuagucaaaaucgauuuuugguguugguuugauguuucuuuuacacuugucuuuaugacagagcuguagguuaaaacuuaagaaaugucucuaaacacauucuucuucaagagucaauacacaugcacucaaaaacaguuugaauuauuuaguccaaaguacguuauuaaauagggauuguccuagguucaucuagaauuaagauuuuuguauuuuauguuuugggugaugagaaugccuuguggauuugccacugcagugagaccucuuuauauauaaugcucauguuagggagagaguaauauguaacuuuaagacuaagugugucaugucagacuguagcagcagauagcacaauguggugcuguggcaugcucaucuuugcuguaaugaacuuuguuacaguagggcaccagucauuuacuguaucuuguuuaauccucaccucacauuauucucauuuuacuguuguggaaauucagguaaugaaaaaaauagauacuguauuucuuugauucuaagacacccaccauuuuaacacucugaacuugagauauguauuaugaucacugcgggcuucuuuaauuaaaugaaauuauaguaaauugaagagcuggcacugauuuaggcuuaccaguuuccaaauccugauccuuuucuuuuaucccuugcugccuccugagguuaaggcagcagcagcggaauuauaauuaacuaguagaggcagaaauugauuucauggaauuccuauuccaccacugccccagcguauccucucaggagaaccauuuccauaccaguauuauuuuguccauacugugugguuggugguggugcuauuucagaguugagauuuucuguagacuuuacuuuuuaaauaauugugauuucuuuggcgaguuagugaaaguaacgguuuugagaaguuucuaguauuucuauaauaaugaaagaaaaauuauacuaagguauuucugccucauacuugcucacuugucacucuuacccauuuuauaaggugacaaagcaggucaugaugaaaauaaaauaguugacuaagauagagcugacuaccuuagaagauagaagguuuugaggaauccaggauuagcauuacuuuauguagcauauaagucagccacuucuuuuuuuauuuuuuauuuuauuuuauuauuauuauacuuuaaguuuuaggguacaugugcacaaugugcagguuaguuacauauguauacaugugccaugcuggugugcugcacauaagucagccacuucuuugguauauugauuugcuucauuuuaagaaagaaaaaugaacuacaguuuccuuaaugguaugcuucugguuuauagaucguucuuauaugcgauuaacagaaaaagaagaugaaucacugccaauagauguaaguuggucauuuauauuccguuacauguauguuuaaaaucagccacauagcuuguaauaauuuuuuuuuuacugguuuuucguaaaauuuuucagacaugaaauaaaaucugaucuccacuuuucuuuucuuuucuuuucucuuuugagacggagucucacucugucacccaggcuggagugcaguggccugaucucagcucacugcaagcuccgccucccagguucacaccauucuccugccacagccucccgaguagcugggacuacaggugcccaccaccaugcccggcuaauuuuuuguauuuuuaguagagacaggguuucaccguguuagccacgauggucucgaucuccugaccucaugauccgccugccuuggccucccaaagugcugggauuacaggagugagccaccgcgccuggccugugaucuccacuuuucaucacucauaaagcucaaagauuuggaaagguuucucuauuugguuucuagagcuguagucgaaauagucuuucucgaagaugcucuguccauaguaugggauggacuuaaaaaguugauuauuuagcuuuauuucuuagaaaaguucauuuuuauguaagggaaauaaagccaacaguacauuguuuagggacauacauaggugguaaaaugaaagugguuuuaguuuuuuuucuuuuuuuugagacaauguuuugcucuuguugcccaggcuggaaugcagugacgcgaucugggcucguugcaaccucugccucccagguucaagcaauuauccuuccucagccucccaaguagcugggauuauaggcgcccaccaccacgcccagcuaauuuuuuuguguuuuuaguagagacaggguuucccuguguuggccaggcuagucucgaacuccugaccucaggugauccaucugccucagccucccaaagugcugggauuacaggugugagccacagcgcccgaccaggaaaguguuuuuuaaaacuaaaaugauaaguauuccagcaucacucacaauuuuuaucuuuacuagacuugaaauuacacaaguaguaaguucuuuguaacagagucaaacaguaaaaacuaaaacugacccuacacaauuauaaaaacaccaacaacagaagaacuggccccguuccuuggcaguuccacuucuacucccaacaguuuggaguauagcaguaguucagucuucuuccuauacacaaacagcauuauguauguguaguuuuaccuaauccaaacacguauuauuuuuucuuuaaaaaguuauacauguguauauauguauaguuuuauaauuaacuuuuuuauuacuuaacaacuucagucuuacuuucaugacagcucauauagauucuuguuaaaagugccugugacuguguuauauaaaacaagucuucuggccaggcaugguggcucacgccuguaaucccagcacuuuggaaggccaaggcaggcagaucaugaggucaggagaucaagaccauccuggcuaacacggugaaaccccgucucuacuaaaaacacaaaaaauuagccgggcaugguggugggcgccuuaaucccagauacucgggaggccaaggcaggagaaucacuugaacccgagaggcaaagguugcagugagccgagaucaugcacucgagaucugcacuccaaccugggugacagagcgagacuccaucucaaaaacaaaaaccaaguguucuugguagacugguggugggaauguaaauugguaucguauaugauguuagauuuuaauuuaaacaggaaaauagauuguggcuaauuuugacuuugucuguaauuaaauauaugauugaugaggcuguuaacuccuaucaccuuuuuuuugugguagauacacacacacacacacacacacacacauacacauauuuaugucuauuuuaaagaacuuuuuucuauaaucugaacaugcccauaaucccauguugguuaaaauaaaacauucugcguuuuugcucgcucaaccucuuuggaaagcaguugauauuacucaaucaaauugaacaugugcauacucuacacucaguguuuccaugugugaacugggcgacaugcauaugaauauucauguugauugugaagguaacaggaaacaacccacauauccaauaacaacagcagaauggauaaauugugguauuuucauaucaugaaauacaaagcacagugaaaacuggccgagcacgguggcucaugccuguaaucccagcacuuugggaggcugaggcaggcggaucaccugaggucagaauuugaaaccagccuggccaacauggugaaaccccaucucuacuaaaaauacaaaaaucgguugggugcaguggcgggcaccuguaauccuagcuacuugggggcugaggcacgagaaucacuugaaccugggaggcugagguugcagugagccgagauugcaccacugcacuccagccugggugacagagcaagacuccaucucaaaaaaagaaaacacacacacacacacacacacacacacacacacacacaaugacauaauguugagcgaggaaagcuagacacaaaagaauacauuugaguccauuuaaauaaaguucaguaugggcaaaaguaaggcauauauguuuuagagauucauauauauuuaauagcugguaaaauuaucaagaaaaacaagaaacugaguaauauauaauucaggaccauaguuaacuuugagagggaagguaaaggauaucaucugagauugacauguggaacuugaaagguacuaggaaugaucuauuucuuaagcugggugguggguacauggucuuuuaauugcuuuaugcuguguacauaugcuuucugcacucuaugauauauaacaauaauacuggcugggugugguggcucacgccuguaaucccagcacuuugggaggccguggcgggcggaucaccugaggucaggaguucgagaccagccugaccaacauggagaaaccccgucucuacuaaaaauacaaaauuagccuggcgugguggcgcaugccuguaaucuacucaggaggcugaaacaggagaauugcuugaacccgggagguggagguugcagugagccgagauugcaccauugcacuccagccuggauaacaagagggaaacuucgucucaaaaacaaaaagcaaacaacaacaacaacaacaaaaaaaaaacaaaaacaauaauaccuuaaaaauucuuaguugcucuuggaagcagguaauauuugaucauugaguucugaguggcucaguaccauucaguacucagugauuuugcuuauuugaacacuagauuuauuuauugaagcaucagagguauuuuugcagccaauccacagaauuuauagauuguauugugucugaaucccagucauuucaagugagcauugucucccugaugguggcccugagaggacuaccuguuagaggcaaugaagagguagagagaaaauuguaaauauuuauaauaauguuuguguuauuuaguauuaucaaucuuuauacucacagauaguucuucagacacuucuggccuuugcaguuaccuguuacgguauaguucauauugcaggagaguuuaaagacauggaugccacuucagaacugaaaaauaaguaagucuuucucuuuucauaggcauugcauuucauagagguuugcuguauucacauaauuuuaaaaaguauguuuucugauacauaaaaguugguuuuguuucugcauuuugauuacacaguuuguaugaauaaugagguaaaaacauugaggcgguauuugauacuguaagaaaauggaagaugaaugccagauuauucacaguagaaucaaaaaaauacguugcuuaaaauuauugguugguuguauggaugaaaauagauauauagaaaaauaaugccucagaauuuuuaaccuuucuccuuccauuccuuccuugcucccuuucuuccccccucccuucccccuuucacuccuuccaucccucucuuccuaccauccucuuucuauccucuugucccagcuuagucuuuggaagaguaagugguuuucgguuuccccucucacuugaaccuaguaugugagauaagcucugcucccaggcccuuuucuacuacuggauuaaaaguauauuuguuauucugcuuucuuuuuuuucuccuggacuacuucuaagcuauuuucaugagcuauguuugcuuuuauuuuucauauuuuuacuuuccuaaaaucauccuuuagcuuuguucaguuccaucucuggacuuuacccaccuucuugauccuggacaugaugccccuuuacaauauuuucuuagaaggagucacagugaacauuuauguguuagaggaaagucauaucccccuuuuaguucauuauguacauuuuauuuauuuuuauuucuuucuuucuuuauggagacagagucucuaucaaccaggcuggagugcaguggcaugauuuuggcucacugcaaccucugccuccuaaguucaagugauucuccugccucagccuccugaguagcugggauuaacaggcaccugccgccaugcccggcuaauuuuuguauuuuuaguagagacgggguuucaccauguuggccaggauggucucgaacuccugaccugaagugauccacccgccuuggguucccaaaguucugggauuacagaugugagccaacgugccccacccaauauguacauuuuaaggaguuacauaucaggccucuuuuuuguaugggaguaugcuuggauguuuaggugggcugagauuugaguuuuugucaaaggaagaguucuccuauccuuuccaggaaaauaauauugaaaaacaaaaaccauaaaggccacacaccaagguguuugugaacucuuuuagacuacauaucucucacuggaaaaguagaaaggauacuuuacugucaucacugcuugcucuuacaaagagucuaccaagaaucacaggcaaggggccaggaaagaaagaaguaaaacaaugucauuaaguaggugguagaaaaauauguguuuggacaauagcagguacagagggccaaaaggaauuuuuuguugugcuugaaagauucuuggaaaacagaucugugaaacgaucauauggcuugaauaaugagggccaaaugagaauaaucaaagcuguaaucuaugugcugcuuuuuuaaaaagacuauucgacaugcguuacuguuagauuuacaggggagauuaauaguugagcuaguauuuguguuguuauucauaggcauucuggaaggaauggcuggauaaaaaaaaauauuagaagccgggcaucauggcucauaccuguaaucucagcucuuugggaggcugagguaggagaauugcuugauccuaggagucugagaccaccugggcaacauugggagacccugucucuacaaaaaauaauaauaaaagaaagccaugugugguggugcgcaucuguagugccagcacuuggggggcugagaugagagggucgcuugaguccaggaguuugaggcugcagugagcuaugauugugcuacugcacuccagccugggcaacagaaugagacccuaucucuauuuuuuuuaaaaagaagaaauuugagagcuauaugcugcuuuuccagguuucuuauuuucuuuauauaggaaaagagauacaguauaauuauuauuuacagucugauuucauguauuaauacuuguuaaaaaauauaacccauaguaaauugauaauucguuagaagccuacuuauuuucaaguaggguuuuauaaagguuuaucuaaaauugaugcuuuuuucuucuuucaaggacauuugauacguuaaggaaucacccauccuuuuauguauuuaaucaucguggucgaguacuuuuccggccuucggauacagcaaauucuucaaaccaagaugcauuguccucuaacacaucauugaaguuacgaaaacucgaaucacugcgucguuaagauuuuuacaaauuauaauaauaggacaggacacagagcuggaauauuggaguuugggguauaaaacacuccucccugcccccauuaguauuuauauugaucuuucagaccuacuuuaguaaaaaaaaccauggcccuuguuuauauacuguuaauccaaucauuaaugcaguguaaguuauaugugaaaugagucuuugguauuucauauaggaauuauuuuuuuuuucauuuaaaacaaauccacaucuuuuguaaaagccacuguuuugaacacauuuccuugaaaaauguuggugguuuuugugauuauuuauuuuuuuagauuucuuuucuuuugcacuacaauuuuuggaauccuuuuggaaauacugugugacugcuguguuuugcagcaugaauuauaguaaaauggucuucaauucuuaacaaauggacuucccugaugagaccaaaauggugauuuaacaguuuuucuuguguccccuaaaaaguggcucugcuucagaaguacuugccaguuuuuaauuuauuugugacuuuucacccuacccugcucccauauaccuucuaccaucagcugucuuguuucaucauuucucugagauucugugugcagugagcaauuuuugugucagaaauucuuugucagaacaaauauauguaacaggcucaacuuacuguaaagcuacuuguguucucuucauuugucuguaaaaauuucccuaauugauuauauaguguaagaauaguugaagacuaguugaagaccuuuugugauuucauuaucaugccuaugcagaagaaaaaucauugaggaaaauugucauuagccaguuuaacugauucaaacucuguuuauuucauacuaaacuagugaauaagugaaauaaaggaaacucgucauuaaucuaaagacagaguucaaaggaauugggccaaauauauucucaguauuuggaacuaauguuuuuaagguuuuuaggaaaaucaggucauuuaagaaauuguuuuguaguuucugguuuauagcagucuucaaguuuuccaucuucacuguauguugcugaaagugaggaugaggauacagaguugauauuuuuagaaacaguaauuuuacuuuuaaggaaauuggcuagcucuuugagcuagagagcuguaggaagcucaacauuucuuuguagagaacguugcuuuuuuuggauuguacagguauaaaaacauugcuuuuguugaauuguauagguguaaaaagggaauaacuguaugcagguuugaaaaggaaaugugcuuuaggcaugagucauaagaugccauuguacuuguaggcauuuuauuuuccuuuagaaauggacaucagcucuucucuucugacugguaacacauagccccaaagcaugagauuauuuuucauuggguuuuuauuguuguuuaguuuugguuuguuacgccagcccagucugucugcggaacacugacucugcucucuaaugagaacaaaguuagaaaucugccgauaaccuaaaauaauuuagaaaugaauuaaaaaugugaaaucggguuaaagugaugaugauaaaauagcaugcaagaaacaagcuccuuccaucagacuuggcuacuguuuucuucugguacgauuugguuuggaagagccucuuguuuccuucucuuugggguaugucuucguuucuuaauauguuuguaacauuauugagauauaauucacauaccuuacaauucacuuauuuuaaggguacaauuuagugguuuuuaguguauucacaaaguuguguaaccgugaccacagucaauuuuagaacauuucguuaccccaaaaagaaacccuguacccuugagcagucaccucucauuuucucccagugcccaccccauccccgagccccuggcaaccacuaaucuauuucucucucuguagauuugcuuauucuggucauuucauauaaauggaauucuacaauauucggucuuuugggacuggcuucccaaauaugauuuucuauauggagugagaaaauucuucucaucuugagaacucuuauugcugugaaagggagugguugguaaaaucaauagauuucaggcaagagggccagauaccuaacagguuuuucuccgugaaucuuaugcugaguaguuuuuccucauaaccaagcauuuaugauauauuacuacuuauaauacuguggcuagucucuagaauggauguugaaaucuuugccuccucagucgggaagaguccugcuaaaaaucaggcuaaaaaucaggccaaaaaucaggccaaaugacuuggcaaauaauugacaaagugguuuucacgugugucuaucuuugcuagcagcuuguauaccucaggccaggugagcuccccaaauuucuuuuuucauuuacuccagugaguuucugcugucuuuuucaaguauguaccauaggacuuaaaggugauuuggaugcguuguaacacugcuaaauaugcuaaguacagaauuuuaucuacaguacugugagacagucaauuauugccuaggguaguucaaaaauaugaugugagcuaguuaagccuuugcuugacugauuucagugauauucagaaguguguaccaaucaaggcucuuuaaaauacggaacgacucacuuaauaaccagggaaccagccaaauacugugcagccgcagaauaugcauaucaaugaguuggaggugauuauucucuguaacucccuaaugauuguuuucuaagcauuguggcuucucaguggcuugacagcaucuuccugguuguauguggccuguuuacaugauguauugaauaauguuguuuguugugagcaucaaugccuguaacaccaaacuaaacacguguuuuugggauauguuuccaaucuuuaaaugaccuugcccuguccaauaaauaaaugauugucucacccugu

SEQ ID NO: 18994 - RNA, 33127 nt, Homo sapiens
ccggucccgacuccgaugauggcggacggcgccgcagcuggcgcuggcggcagcccauccuugagagagcugcgggcacggaugggugagcgggcggguggcucccgggggugguucgggcccgcgugggaggcaggguucccgcaguccccgggccgucggagcggcgcagcgggcgccacaaaacuuuucccuggagucgccucgugcuaucugguccuccccucacccccgccggagugcccugggaugggacaggggcgggggcgggggguugaaauugucagccgacgccgcgagccgccugagucccgccgccaacggucgaacugccgcugccaacggucugagccccgcggacgcggcgcgaggcaacucacgggcucugcuucgacgggcggggcgggggcggcuggaagccggaccccgcggaccgccccgugccccaucugcccuuggggggcgguggccgcccgcgcaaccgccccaacgaacgcacagcugccugggaugugcgggcgcccgcagggacuccgcgcgccggcgccgccuccgccgccaggcagccuuuccaggcacggaaaguuugaguuaucccccagcccgggucgugggcgaguuuaggcgcuuuuacugucgcaguccuugccucucccaaaggcuuaccuccugcacccucccggucaagguccagggaggaagcugggugaggguggggaugcuuaaaaguugcuuuaaaaguugggaugaaacuuggcucuuugcaucuccugauuugccugcuguagcacaugacuucaacaagaugucaucuucugugggacaucuugcagucucuaggcugaacugaacgggaaucagcacuucagagugcuuuuuccucaacuagucccaucgccaaaacguuuuucccuccucgaaaaccguuaaucuuauacaauuugacagcacauugcuugguccaggagacugcuccacuaccugagauaggauuucuuccuuucaggagguugcuuuuagccuguuagacuaguucccucugcuaugagcgcgaauaaaacgauuuuauuaauuuuaauugaauuucuuagggguuuuuuugcauuugcaauuaaaaaguuagauuguuuacgauugggaagcuauauguuacuugagaagacuuugaaucagcucuccaaagacugugucagaagcauauacuacauacacuuucaccauucauuagggagaaaagaaucuuccuuccgugucuauacuuaugguucaccuagaaagacagucuccaauaaauuguguugcuuauugguaccuguggcucucaggcacugguuuauuucagugauuuagauuaaccagcauuacuccaauauggugaagaagcugugaaccggauaaaccccuaaaagcauuuguauaucagauguuggaaaguguuuuaaaauuauauaugggacagauacuggaauucacagcauuucaaaccaaaaacuuaagagccauguaaaagucuuaaccuaggacccugguuuaaaaccuugcugcccacuucauguuaggaauuguaaauaucgcauguuagacuuuuuucacagagcaccaacuugaccagaacugcccuuuagaucucagcguuuuccugaaggggucaaggagacagauguuuuugcuaaaauguuguuuucaucuucugcuggcagucuggcagcaagaguuaaaacugucuugaauacauaacauauaaaugcauagcacagucaaaauacauuuauuuuauacauuuauguaugcaugcaauagauacauguauauauauauguguuacauauaaaguguaaauauauauuuguugagugauguuuucugugcauagcacugugcugagguuguagcauaccaaauauuuaacaaaacacguguuuauauuuuuaugcagaauuguuuuaaaauaaaaauuuauuugaauauuucaaccagaugagcauaagaaacuugccacugacguaucaccuuucccuucuuguuuuucuaaauucaccaguguuucucaguuuagaauaacuuuuucaaagaauaauuucuaccaaugcagaaaaagcuacggagauugacagcuagauuaucauagaauuuuagaguuggagaaaccuuaagaugaucuugucaggcauccagagucccagcuguaaaauccuggggcacuucugccacuugaaugggcacucucaugaggagcuuaauauuuuuccaaguagccauuccauuguagacagcucuaaaugguagaaaauugucuccaguuuugucuucaagacaugcuaucuuugguuugaacuuggaggucuucugaaagucucagcccuaugacuuuggcuuuugcuauuugaggcaaaauucugugaaucugccugauuuuuaugguucucugauggcagauuucuuuuccuguuauuuuuucuuaauauuucaaaauaaaguugcuuugaaauuuacaguuaaaucaaguucuggcuucaccacuuacuaccugugugaacugggaaaguuauguuuagcuucaguuuuuucaacuauaaaaaaaauuggggaaaauaauuacguccacuuuauaggauuguuguaagaauuacaugaaguaauacaaaugaacuuuguaaauggugaaaugguauauaauauguguuauggaaguuuuuagaaaaguucuauaaauacagauuaagauucauaauucaguuuuaguaauacacuacacauuuucuuauuuaaucucugggcaaaauauaacuuuuacuuuaauuuuggauuuagaauuaguauaaggacuacagaaauaccuugcuguuacuuuuaacugaauauuaaguaaauucccucauucauuuaaaugcauguuaaguaaauucuuucauucaaugaaguugaauaaaauguugacuuuauuauauccagacauaaagguguuaucccauuuucuggacauuuuaaauaauuuuuaaacccuguccuuucuguuaauguauuucuuaccaguaggaauuuggauacaaaggucuaaaaaucagauuugauacuacuaccacauuaaccuuuauaugauucgguucauuauucucaccacagcuacuucuaagguuauuucuguuuaauaagauuuuuaauuagccugguaaaaguauacuuuuuuugagacaggguugcccaggcuggagugcagugggaugcuaaaggcucacugcagccucaaacucuugggcucagccuccugaguagcugagacuacaggcaugcaccaccacacccagcuaauuuuuguauuuuuagagaugggaguuugccauguuggccaggcugguuccaaacuccugaccucaagugauccacuugccuuggccucccaaagugcugggauuacaggcaugagccaccacucugggccaaaaauguagauuuugagggaaauuaucagcuaaauagugucaaauacggacuauccuugggacuucuaagcaggagaacugaauguguaaaaacaauacuacaaguacuuuauuguuuucucugcacucacauaaaaauguugcaaguggguauauaggagugucuauagaccaagaauuuuuguuaauauacuagugcucaaauucagaaaauaauugugguccauggaauugccaguacuuaaauuauuaaggaagcugagaagagucuaauccucaaauuaagcuaggucauauauuaucugggcuguucggccucugggguaaaaaaaaaaaaaaaaaauggugauccuuacggcagcaauugugaugucauuuucaagauuaugcuguaaaauaacucccucaguagcaauuaacaccucagaguucauucauuuuauaaguccaaggacagccccucuauucccucaguuacuuuaacugcccaucuucaacuguuacauuuuucucaauacauagaaaccagacuuguaugcagcaucacaggggcuuacuuccugugcuuuucuacaaaagaagaacagaguuaguuuucaguguuauuuucaauacucuuucugaagaugcucaguauugugggacauuuuagauauagccauguguggaauuaaaggguucagggauuccccuauaauaacucaugugugucauccuggaauuuuaguuuucuuacuuuuccucauacugugcuuuccuaaucuuacacuucacccuuauugaaguuuaucacuuuucugccuguuuacacguuuguuugcaccuuguauaauuuauauuuguuugcuugacaucuaccuagaaugauaccaucucauuggagauuacuucuucuaaaagaauauuuauuucuccaccuucaauaugcaucagaauagagcucaacaauuguagaugccugggccccacagccagagacuggugauggggagcgggcaggcaggcauugcugauuuucuaaaagugaguuaggugauuccagugugcaaccaggauagaaagccccuaauuuagguaauuuauaaauguacuccuuaacauugguugggccugaucuuucacugaguauuucacuguuaacacuuugcuucccaauucagauccauaaauucuuaaccuguuaucuucugaauucccaauuuauggugaaacuuaauuuucccaauuccucgccagcucaguauuucuaacacuugguguaauguuuuguuugagacauuuuuaaaaccuauuaaucauuggcuccuacucauccacaaacuuaugcugccaccgccacuaacaacucaauuaucuuuaugucuacaaauacccuggcccaucauaguaaacacuuuaaauucuuuguuaaaguguuguugaagaucauagguguucaauauaucuuuguuguugacccagaugaaaucagucaugauuuauagaagugauccuauccuuuaucaucaaauacaauuggccgugguuugcugacuccuguguuagcuauccguauucuuaacaucuaauccuuuuaucucccuguauuuuaguugcugcagcaaacgagauugcuaaggaaaggaggaagcaagaugugguuaaucguguugcaacccauuccucaaauauaagaucgacauuuaaaccagguauaauuucucugaugcuuugauagaugucaaagugucauaucuuuaaaauuugauauccuauuaauaucuaacuauauucuuuuuuuuuuaguaaucgauggauccaugcuuaaaaaugacauaaaacaaagauuagcaagagagcgcagagaggagaaaaggagacagcaagacgguauauuuuagaccuuuuuucaaaaaucaaaaugaauuguguuauauauugcaaaguguuuuuaacuuauuccuccuaauuuguuuauaugauagaguauaauuuuuauauuauguauuauuuuggauuaaauccuuuuacuaaaucaggcaagaaggcccaugaaaauucuuugauuaaauuguuuaauuuuugaaggaguaguuuaucuuagcuuugauuuucugaaaacuaaggucuggaaauuucuucaauauuuguaaaaacaaucagaaugggauuucaguaaaagugauucuuuuuuuuuuguuuuguuuugaggcggagucuuacucugucacccaagcuggaguucaguggcgcgaucucagcucacugcagccuccgccucccggguucaugccauucuccugccucagccucccgaguaacugggacuacagucacccgccaccacacccggcuaauuuuuuguauuuuugguagagacgggguuucaucguguuagcccggguggucuugaucuccugaccucgugauccacccaccucggccuuccaaagugcugggauuacaggcgugagccaccgcgccuggccaguaaaaguuauucuaaaaaugaaaauaaauugccaauaauccuaacauagauaagaugaaaagcauguuaccaaguuguaaaaagauuauccuuuuagauccuaauuuauacagagucacacuucagaagcauuuagugagggaaaauuugaauauaggaaaaauuuugcucuccuguaauaugguauaugguuaaguccauuaauguaaaacuggcauguuuaauauggucuguauagaugaggacuuugaaagaaguuuccuaguagaagggaacaaaacauguauccuggccaugcaguuuuuaauaauuaguauuuuaauguacagcauauuaauaugguaggguuugacuuuagcucaaaucagcagaaauaucacaugaaagaaaauauuuuuucuuaauuuggaauuguaguuuggacaggaugagagucauuuggcacagacaauccaguucuccagaguuaaaugaauacucagugaaaaugguucugcaguggcuaccucuguucacuuuuauaauaaaucuuuaguuacuagcacagguuguguuauuuuaagaaagugaaugagauguguuaacuuuuuccuucuguguguguaauguggaaaaccuaaauauuuucuuggcucuuacaccuugaaaauguauuuggaauauuucagccaauaaagaaacacaacuacuugaaaaagaaagaaagaccaagcuccaauaugaaaaacagauggaggaaagacagagaaagcugaaggagcgaaaagagaaagaagaacaacggagaauagcugcagaagaaaaaagacaccagaaggaugaagcacaaaagguacauaauuuugcagccugugcaugagaggauaaacuguguugccugagucuagaauauuguuuucucaggccuucucugccuuacuugcccuguagaaagggaaccaaucccagcucuuucuucuucgcuuccucuuccccucagcauuauauaggcuuuuacccauguccugauaagaugccaggagcugagacccacuagccuagggaauggggagacuuccaaauccaggaacaaagccccauccaccuucaggacuuggcacaugagguaccuguggccugggguuuguucugaguggcucuguuuacuaccaaaaaguauucacuguugucucauugccuacagaauaggggcagaccccacugucugacccucccugacgugcccucaucugaccgauuucucacaacuccuuuaaaagugugacuccccagccaaaucagggcauucgcucuccuuuucagcuucccuggcucccucuggugcacacucacacucucucccucucuacccucugucuccguguuccucacauucccuuuccugacagggccccucuggaugugugguucagagucagcauucuugcucuuguuuuguggcacugcuccucucuuuuccuuucuggauucucuuuuggugucuuuggcacucuguugggaugagucuguggcuuuguuaugcccucucuuuuucacuucugucuuucuucaguuugucuuuugugguacugggcaucuggcuaccugucucauuccguaugauucucucugacaccaaauuuuucucuuguaggucauuucacuacuugacuuggaguaugcuucacuccuucugaaucuagcguggucgcugugacacuguccucuaucuuccuggcauucucucuuucucuuuauuccagggauuuuuuuuuuuucuuugagacagagucucacucugucgcccaggcuggaguauaguggcgugaucuuggcucacugcaacuucugcccccccgguucaagcaauucuccuaccucagccucccaaguagcugggauugcaggcgccuaccgccacgccuggcuaauuuuuguguuuuuaguagagauggggguucacuaucuuggccaggcuggucuugaacuccugaccucgugauccacccuccuuggccucccaaagugcugggauuacaggcgugagccacugugcccagccuauuauagggauucuuaagugucccuaaauaagccuuagucugucuuuuggucucugacucuggccuuuuucugccugaggcagcuugauuuucuuuauucugucuuugucuuagcuucugucuguuuuuccccaucuuuauauccucugccugccauucucucaguguguuguauuuuuauuucccucucuuauuuucugucacucuaauauuugcauuucuuuuucucuccuuuucucuuugguuccauuucucccaugaagcuuccucuugucuuucucugcggugcucaguuuccucccuccucauccauaccuuugcucuuguacgugcuuccucuccagcccugcacccuaucuggagagcuuccugauucuaggacacuucuugugccacuuuuuccccauccaugguguacuauaucucucccuuucugaacccuuuucugugguuguuuaugcucuguuucaugcucuaguauuugguagacucucauucagaauuucugucacuuuccaucaucuucuugaaacaucucucuuauuuuacuuuucugugguaaagagaugaaggccagagaaagagagagaaugaacuaaguaaugauaaacgaagaaagaaccaagaacuaaguaaagaaccaaagaaagugaaauacaaacuguguguagagugagugggaguccauggaggagagagacaagucacagggacugagaccaaaaaauaaagacuaucuuagagaaagaggaagcugccagagagaacacagagaauagaagagaaugcagcaaaaugacacugcagacagaaagggagccacagacauggcaggagaaggggcaaaagaaaaccccagauagcuagugcgggagagucccagacagaacaggggacaugggacacuguaaguaggcuacauauagcaaaagagaggaauucuggagagcagaaaaaaaaaacccagacucaguggugcugaggagggaugaguguggacaggagguguauaugaaaugggauaggaacuucuaugugagcccuggguggccacgaugugagaagggaccuggaagagagcacaguagguaaugcauuuggaaacaguggaauagaaucagaaauaguuuaauaauacaaaguuaaucuuuguuuuuagucuauuauaguuucaggguuucuaaguaauucagaacaacugccuuucuguuagaaaauauaauuuucaaauguugcccauuguaucaacuuuauuuuaagaauugcgguugcuuuucuucucagaagauauggcucaucuccauuuuccuaguacguuuaucuuugccauugguagaaacaguagaggcuuuguaaggaugguguuugcuaugaaacgguuguuguuagggaaaaauagaagaucucugguccuaaaaguugauuugcuuaccugaguucaugguauggcacaguacaaggaugagaaauauuugagagaagagcucauuucuggaaguggaguuguuuugcugcagcaugguauuuacuuuguauagcuguugucuugaccagcuaaaguugaggucaagacaaauauauugauuaucuuuuuugaaacuuuauuuuuauuaguuaacaccagaauuuuagcuguuacagaugugaguauacuagaugauucugguauaaauuuaacuuauaugugugcugauuuuuccccugccucauucuacaaagaauuuaaggugacuuaaaaauacauaccacaccagaugauaaaaauaaaugguugggggaaucaagcagaggggaaaacuaacauaggcaaauaaaacauaagguaugauuagcaugcacaaaaguauaccaaucagucuuuguacaguugcuagaaagaggcuacacauuuggcucuaaauuuccuaaugauacaaacaaagaggaaagcauggucauuuucuuaaugcaagguccauaagauaaaaaaaaaugaguuauuuaggagaagcacugguauugauugauagcugagacauaucuccaauuauuuuaaacuuuuaccugagacagaaauuugguuaugguuuauuuuauaaaccacagaucaaaauuauacuaauuugaugaauauguaaaaauauguuggcuuuuauuuuaaauaggaaaaauuuacagccauucuuuaucguacuuuggaacggaggagacuugcugaugauuaucagcaaaaaagauggucauggggaggcucugcaauggcgaauucugagagcaaaacugguaauuaauacacccauuaaauuuuaaguuuguuuauguucuuguuuaaauauuggcuaugaguagaagcuugcauuuacagcaagauuuuaguguuuguauccuaaacaaaaauacuguauauaguaaauuuaaauuucugucauaugccauugcaaaagaaacaggugaaauguuauaguagauuuuauuuagcucaauauaccuaaaaucuuauuuaaacuuauaaucagcagaaaaaugcugaauaaugacuaagcuuuacacagcuuaucaaaugcauauuuuuaaaaauaagucugccuugucuacuauugauuuaguguaaauuuucuuauaugcacauaauucuacacaauuucagaaaacaaaaguaaaauuuauguaguuuagaaggauuggccaguugccguggcucacaccuguagucccagcacuuugagaggccaaggcgagcagaucacuugaggucaagaguucaagacccgccuggccaacauggugaagccccgucucuacuaaaaaaaaaggauugacgggcagugauauugugaacuugaguaauguaagucugugcuccauagaacuauaucaugaaaacucauuuuuuuuucaguuaaugauucuuuccuccuugaaauaugauuacaguaaguauuaugucuuuucucagccaauaaacgaucugcaucuacugaaaaacuugaacaggguacuucugcuuuaaucagacaaaugccuuugucaucugcaggccuucaaaauuccguugccaaaaguaaguaguuauuucauguauucuacugaauuucuauuaaaugaaaucaguucuuuauauuuuuacaguaccaccuauuuagauuguggaacauuuauguuuauuucagaagagucccauguuauuuuacagcagagggagagagauagucauacuuuuuuuuuuuuuuuuuugagacagagucucacucuguugcccauacuggagugcaguggcaugaucuuggcucacugcaaccucugccucgugggcucaagcgauucucgugccucagccucccaaguagcuggaauuacagaccugcaucaccacgcccagcuaacuuuuguacuuuugguagagacgggguuucaccauguuggccaggcuggucuugaacuccugaccucaagugauccaccuuccucggccucccaaagugcugggauuacaggcgugagccaccaugccuggccuuguauuuucaucaauauacuuguuucaugauguuuguguuaaucauaucagaugggauuauuggaccucaguagcugaaacugaaacauauuuuggucaaaagacacugccauuaaguggcauaauuauuuauuugaagauuaguucauauucuaccaacauauaaaugaaauuguguuuucuacagacugguuagacaguuauucaauuuccauuaaguauugugaauauuaccucauuuuagaaaaauaauagcauauauauagcaguggacagguugaucugcauuacauauaucauauuuguuauucacaauuaucuuagaaaauugacagacaaguauaauugccuuccuuguuuuauaguuaagacuccaagaaauucagugauuucuacucuaacauccuuuucugugguuuauauuuuggucauuugauagauggaucaugauauuuaaguuguaccuuucauuuauaagucaauguuuucccccaaaagcaaauaaugugauaaugauguuuaaugauagacguauugccaaguuccacuuuacaacucuuccuaauggcaauacagaguuguuucaaauacagugaaguuaucuacuaugaauaauucaaaugucuuuuuguuucugguguuuguccuuuuaauuaguguuccuuauuaaaagaaaaaucuauacccaagugugugucaauaaccaugucuggcuuguagcacauggugccucucacugauaauugaaauggauuaggcaacuauacccaucaauccaaaaaaaagaucccuuuucuuucuagaggaaaaaaaggaauguucuugagaggaaaaagagcacaaauuccacaucauucccuuaaacuuagccaguaaaaaugaugaggaaagauggcuuuugugccuugugaauugaauaaggcauaauuauaguuugaauuuuaaaauguuuguuuugcauuauuagguaucucgacaauuuuugagcaaugcugauugcuauacaauuccaguacagcaaaagauuuuggauacaauuuaaaguauaauuaauuguagcaguaguuaaccuuauggaaaagauuuccauuuuugccuaaaacaauauaguuuuuaauauguugaaaaggauuucuagggcgaaaggauuuuuguuccaacuuacauuauguuauuuguacuuuuaggacucuuaaaauuucagugaugagcuugagaggucuuuuauugucagucugaguauaucacauuuucucuuguauuggucugagaaaaguucauccacuuaccaccuccacccucaaugugcuuucccaaagcacuuuuauauauagucuggguuuguucauagauuaauaugggaagauuuucucuggcaccuugcuuauaauaugguaaaauuaauuuauuauucaccaacuaaauccuuuagaaaaauuagauaacauuaauugcaaugccauguuuauguacuuucauuuuaauauaucuuaauuguuccacaagcauugacucuguuuuacuaucuaauugcuuucaggaauuagcaaagauuuaucucauagacauuuauuacauauuuaguauaaugagcaaaagccuuauuaaugagacauguagucaguguggcgauuccucaggaaucuagaacuagaaacaccauuugacccagccaucccauuacuggguauauacccaaaggauuauaaaucaugcugcuauaaagacacaugcacacguauuuuuauugcggcacuauucacaauagcaaagacuuggaaccaacccaaauguccaucaaugauagacuggauuaagaaaauguggcacauauacaccauggaauacuaugcagccauaaaaaaugaugaguucauguccuuuguaggaacauggaugaaacuggaaaccaucauucucagcaaacuaucgcaaggacaaaaaaccaaacaaugcauguucucacucauaggugggaauugagcaaggagaacacauggacacaggaaggggaacaucacacaccggggccuguugugggguguggggaggggggagggauggcauuaggagauauaccuaauguuaaaugaugaguuaaugggugcagcacaccaacauggcacauguauacauaugucacaaaccugcacauugugcacauguacccuaaaacuuaaaguauaauaaaaaaaagagaagggacagauuaugacuucaagauaauaauuaguuaaauuguacugugaaggagcaauuccaaauaaaacuuuuaaaaugauuucuuuauuagcuuuuaauacaagaagguauguguggaagacacuuugugaaauauuuucuuaaagguacaguauguugcacacucugaaaugaugaaugcuauaauuaaugauuucuaggaaauaaaauccauauugacaaugucuuaccuuuaacuugaaaugaaaccuggucaauccagagagaucaacauuuuaaacucagaugaaguucauaaucuaaccuguaauauuuuaaguaacuauuuuaaaucuggguugauucaaguagucuauuuuuuucuacucauugcugauucauaauaacugcucacaccauuuugucauuuuuugcaguaugcuaaugaaggauaccgacuuaaucacaugaucuaaccaccucugugguucaugcugcucaaucacauuauuaauucaaggaauuuuccgaugauacuguguugucaacauguacuuuaguuuacaaauccccaaaagagaaauuauuuuuuaaacagacauuucucaguauucugagcgaggguaucucaagugaaaugaaagugucuacauggaagcagauuauuucuccuugguuugcuuaaaucguggcauuuauaccaauuguuaauauucauuuuuauuuuaaaaauacuaguuauaacuauuuaacuuguaagguccaggaccugagccucugaaagccacuuuuuggccaugaugcagaaaucagaugcuacagcuaucaauaacuuuacaccugauaucaaaagaauggcuccgcaggguaaaacacugacagucuguuagagccuacaaguugauacauguauaacucagauaauuuguuuucuuuauguuaagaacaaauaucuuuuuaucuaaaugauugauauuggaguuucauguuuucaucauuuuauacuggugugugcacauguguguguacauguguguauacguauauaucuuuuuuaaauauaugcauauauaacaaaaauacuaguuauaacuaaaguguaaauuacuuuuaaguauuaggcaucaugucuaaaggguuguauguuuauaauuugggaacuuugaugucagauagugucagauauuuuaccucuuaauuuuuaccauuuucuaaauuuuuuuucauuucagauaaagaauaaacucauuuuaagcuuggggauauagaaucucugcauaauauuugaaauuaagucuuauaagcaagguagagaacauaaaaaauguuugaaaaaggaguaucucacuccugagauaauuaguaguuuaugaaaacuaauauuccuuuuguacuugcucucuagggaaaacagacaaggagagaagcucaucuuuaaauagaagagauaguaaccuacauucgucuacugauaaagaacaagccgaaaggaagccacgugguuaguuacuucuaaauacaaauuuuaaauagugauuuaaaagagguauuuuaugucaacauugaauugcuugaaaaaucauucccaaaauuggaagccaaaauauuccuucuuagacugaaaaaaugugcuuuggugccaugcuuauuuggcuaaagccagaaaaaucugucuuuaaaugaaguauauaauuccugccaucaucugacaagggguggauaaugcagcuggggaaauaaaucacagaauauugguauagauaggaguguacuggaggauuugauucacuuccaguauuucauuaauuuguauuuggaaguuuaaauacccggccacauuucgaacuucaaagcuuugcccuugcuucauagcauuacccacauauauccuuugugcauauuuucacugcugauuauucacagaauuucacagugauuacuaaaguacuucuuuacauaaaguaguuucuuuucuuucuuucuuucuuuuuuuuuugaaauagagucucgcucuguugcccaggcuggagggcaguggcgccaucucagcucacugcaaccuccaccucccggguucaagcgauucucccgccucagcuucccgaguagcugggauuauaggcgccugccaccacgccuggcuaauuuuuguauuuuuaguagaaaugggguuuugccauguuggucaggcuggucuugaacuccugaccucagaugauccgccugucucagccucccaaagugcugggauuacaggugugagccaccgcgccuggccauaaaguaguuucuuucuaacaccuuucccuagcauuuuccuuucacguguauuuguugcuuuuuguuucauaccaaaccauuccuuuacagaagaccuuccaccuaauugauucaggucaaauccuauuagaacaaaugucauugacacagggaucuuuaugaacaugaagauuuauuggagcaagauauuuacaacaaaauuuacuuuuaacaaaaguguuuauucacuuccuuggagccuuuggcaguggacuugaccauuaugauuuucagugcugucuaucuguaggaaucuuucucaaaguuguuuugccaugugcaacuuuuuuccucaagugugaguuccuccauaaauuucauacgguggggaauggcucuguuugaaauguuaccuagauucuuuccuuagaguuauuuugguauguaugcuguggccuuucuccuuuuauucugaggaucucuucuuugacagugcaguccagucagaugacuguguucaguguuuuguguugcugggaaagcugcuguugagagcaguuugcauugcucuuucuugcuuugcauuugugagaccuccaauggaauccuuuggauuuguucucaucauauaucucguugcucauauaucaguucucaagagaauaauuuaaucaguugucuguucagcccaacaaaagcgucauuagccagaagcagaagugcugcuucauuauccagcccuggaaaagaugauccagguaacaggcauaugguggaaagccaggagguguuaaguguuugcauuucaaagcaggcuucaucacugaauuuguugcauuuaggcaucaaaauaguuugaauccguaguuaccauauuagugauuuuacccagcauuugauguugcauauuuauuuuaugacuucuaacaugauagggcaguuauaugggagacagguaauuuguaggaugagauagcuaacuuugaagguguuuguuaaauuuuaaaguucuauggguuuuaaaaauauagaaaaccuucacucauuucaagggagaaaguuuccuacucuaccuuccuuuuuucaccuaaaauauggaagaauagcauagagccacccuucagcuuuuaguuagagaccuaaagauuguucuuaacaugaaacaucuucagaguuguguggacuuucucauuuauaguuuacauauagcauuagacuugccuuuggauagcaagaccaccccccccacccaguaauggaaaggacuaaugcauuguuccuaugauuuuuuuucuuuuuuuuccccuucacuuuuuccuuuccaguauauaucccacucccuuugcuuuuucucuguuaguauuuauaugauuaguaaaacacaucuaaaugcuaucacagacuuucuuguacugcagccuuauuucuuuuguucuaauuccugacuuuuuuaugcccaauuauguguaugucagguuauuuucugccagucucccuuucccaccaaucuauggugagauauuucuauuaccaccauccaaaaaaucucaauauuuugucuuaaaaguuuauagcuaauacaaauccagucauacuauauuuucuguagcacaaacuguugguguaaugugacuguuuaggcacauguagauauguaaauaaaaugcuuucuccacuaaaagugagggacuaaaagauaacauuuaauuuaacuaaaagcuuuauucauaaguagucuaucuuugguaauuugggguaagauuaggugaaaauuugccacccauacuuaaagaugagauggcagauaaauuuaaccaggucuuuuuuuuuuuuuuuuuuuuuuuuuuuuuaguuuaauuuaccaggucuuaaggaagccaccuccaaauaccuuuugaaaaauguuuaauuaggccaggugcggugucucacgccuguaaugccagcacuuugggaggcugaggcagguggaucacuugaggucaagaguucaagaccagacuggccaacauggugaaaccccgucucuacuaaaaauacaaaauuuuccgggugugguggcacaugucuguaaucccagcuacuugggagucugaggcaggagaauugcuugaaccugggaggcggagguugcagugagccaagauugcgccacugcacuccagccugggugauagagcgagacuccaucucaaaaaaaaaaaaaaauuaaucguuuaagcaauaaauauuucguguagaagauguuuuuaaucuaaucccccauuaucccugugcucacugguaacuucauauuuuucuuugcauuuauuuuuuuucacaaaaugaaauaaccugcuuuccaucuucuauguccaaaauauuucauauuauugcucuuagugacugccuuaauauggucuacauuuccuuuggaacauuuggaugguauuuucaauuguuucaguauuauaaacagugcaguaauuagcaacuuuauacaugcauuuuuauauauuuauguaauuuuuuuuuuccuaaggguaaaccuagaaguagaauugcuggaacaaacaguauguacuuuuuaugcuccccagggaaaauauacaaaucuauacucccaccaguugugaugagguugccugguuccaaacauugguauuaaucgcuuucuuccaucuuaccuggcaccaaauauuaucauuuucguccguuucauaggaaaaauaaaauuagauuguuaaagguggaaaggaccuuggagauccaacccacucugauuaaugucuuauuaaguuuuuaguaugggugagaaaaugcucuuucuuacauucuauucuaaaacauuaaaauauggaguaucuuacauaaucaccuauaaugguaagaucucuagcccuggcgaagauguuuagauuacuuuuagaaaggguugaagaucuuguaauuuuuugugaaaauuauucugaaauauaguaugauuaaaauagaaacagcuuauugcaaacaucaacuuuggagaagcaucuuauuuucaucuguaauagacuauugccuuuacaacgacuguuguuaauguugcuuccgaaguagugacuuugugauaguucuguccugugucugucauccauuucacuaagcauuuccuguguuguguguaaucccugugcuuuccuaauaaacaaucucuuuucuguguuccuguucuuauacuguguaccuggugcauccuuuucuugucagauuucuaacuuagggaauuucaugcucuguccucauucaguuacaggcgucaccaauuauguaaugcaguaugucacuguacccuugcguaaauguacuagcgacgaauugagggcuguuauguuucccaugucgacaaugaaaauaccuccucaaacaaaaguagaagagucucccuuggagaaaguagagacaccucccaaggcaaguguggaugcacccccccaggugaauguggaaguauucugcaacacaagcauggaagcgucccccaaggcaggugugggcauggccccugaggugagcacggacucauucccuguggugagcguggacgugucgccuguggugagcacauaugauucugagaugagcauggacgcaucccccgaguugagcauagaagcacucccgaagguggaccuggaaacaguucccaaggugagcauaguagcauccccggaggcgagccuggaagcacccccggaagugagucuggaagcacugccagaggugagcguggaagcagccccagaggggagccuggaagcaccucccaaggggagcgcagaaguagcccccaaggagagugugaaagggucacccaaggagagcauggaggcaucuccugaggcgauggugaaagcaucccccaagacaucccuugaagcaagcauggaagcaucucccaaggcaaaagcgagagacgcuccaaagguuugucaagugccuguuauugacaaauuuucuauuaaaauauguauauuuuguuguauaguucacgauaggucagauuuuacaacauaaccagcauauuauuuacaauauucugcaauauaauuaauaaaauagguuaacucacuuaaacuaggaauuuaaaauucucugauguucauuguaccacuuuuccuccaaagcugaaauauuagugaguuuuuauuagaagggagaaaauguaaguuuauaugaacucuguuucuaaacucugaagaaauguuuuuugagaaauguuuuaaacccugaguuaggauuuggaaauugaguuugguuuugaaggauaauauuucuuuuaaaccuguuauuucugugaucuccuggaauuguguaauguaaauuguuaguccagaagcaaauaucaauguccugauucucauacucuaaaagaaaauugcaguuuaaagaauucuaauuguguuuuauucagaauguuuuucucuucaaaaaaaaaaaaaaagccagcugcaguaaaagaauuguuuguuaguaauuuaccauacuguguuuaucuguucagaaaucagaaauggacaaacaggccuuaaucccuauugccaagaagcgucuaucaucauacacugaguguuauaaauggucaucaucuccugaaaaugcuuguggucugccgucucccaucagcacuaaguaagcagcuuauucgcaacuguuccugauaggcguuuuacuagaacaaauuccaugucaauguuugaugagugaaauaauauaguaugcaugguaacacaaauguaaagggaaaaaagccuguaaaaagggauuuauuuuucagaaaaauucccugauuauaaugucaucucauaauagcaucuuauauuuuaugaaauuguacacugaaaauuaauuagcaaauguguauuacuuuuucucagcaggcaaauccaaaagaacugcccuccaucaccauuaccacuuauuucaaaacagucaccacagacuucuuuuccuuauaaaauaaugccuauucaacacacccugucugugcaaagugcaucaaguacugucaaaaagaaaaaagaaacaguuucuaaaaccacuaacagaugugaggcuuugagccaaaggcauaugaucuaugaagguaaguucuuucacuaagaaguuuaucuuagcaacacagaaaaucuuacuguauucugggaaagguucacuucauuuuauuccccaauugagagaacuuuagggaauuauuuuccuuuuagaaagagagaaucuaaccaaucucugguacauuggaauguaucuucucuguuuguuuguccuugccaaagcuuucuucucaccccuuuguuuugaaaaauccauuuuuggaacugcuuuuaaaagcauaggucuggccaagcaugguagcucacgccuauaaucccagcacuuugggaggcugaggugagaggauugcuugagccaaggaguuugagaccagcccaggcaacauaggagagagaccccuguuucuacaaaaaaaaaaaaaauauauauauauauauauauauauauauauacacacacaaaaaaaaaaauuagcccgauguggaaaggguaggcuauauauucgguuaggggguugaggauaagaguaagccauauuauaccauaaccaccuagcuuaaggugguacacaucuguagucccagcuaguagggaggcugagguaggaggauugccugagaccaggagguggaggcugcagugagccgugauagugccuuuacacucuagucuggaugagagagcgagaccccauaucaaaaaaaagcacaggucggaugagagguuuggucuaggugauuccugagaucccuucuagcucugauagugaugguucuuggagagagcacauccacucguggaugagcagguuuuuccuaagauuuagguucguuuuuauauauaggccauaauguggugucccuugauuuguguaguauuccugaaagugccauauugcuauuuugccuguuacgugcauucuuaauacccauggacauuacuuaauuucaaaaacacacuggggaauuuugcucuuuuacggaauuccacagugaauuuuuuguaacagaaacaaucuuuuaauuacagauuauucauuccugauaugucuucucauuuucauaugauuuauuuaaaauaaauuaguaguuauauagaccaaaauaucaucauaugccucuguguacucaccuuauuuuacugauagucuugguuuuguuaucuacaguuagcuacucuaugaucaaccaaauguauacacuauuaucaagguuuagcuaaauaguaaucauauaguaaaaaugaugcacagaucucaaauguauaccagauacauauuuguuugaguauuuaagauauuuguacccuuuguuuggaccgagcauaagcuugucuuccucuauauucaguauuucuuacucuuuucccauggggucaguugauucaguuaucucaaaaccacuaaaacgaaaguagaaguacauuauuucauuuuggaacaaguagguguuaaaaagaaacaaaaugcuucugcuguuguugggggugcaguuugaacaaaaucuguuagauaaucaccuauaguuugcuugugauuuauaaauuuuggacuacgcacauauauauauauuuuaauguuuuggauuguguugcacuucuuuguuggagugagaguugauuagcucucuuaacuguugcacauauuuauuuaaacuagagucugguaauaagaguacugcagguauuaugaaugccgaggcggcaacaaaaauuuugacagaauugcgccgccuugcucgugaacaaagagaaaaagaggaagaagaaagacaacgggaagaaaugcagcaaaggucagcacaaagucuuccuuccuauacuauaaaucuugaguggggcccaaauuuuugaaagucaaaauuuuacccucaaguuauaaauucucaaagaacaauugacuuucuucagugaggaucagaagugccucauugccugcauaggaagcauuucaagcccuuguaaauggcuaaggacccugguauguggauaaauggcacaguccuuuuuagccuccauacaucaugugccauuaaggugugcuaggaggaugcacagagaccaaacucacauucaggauuugaucucucagcaccagagugguauauaagaacagaucaguucguguucacuagugucagcccuuuauuuaaaagacuuguaacaucaggauuuuuaaaccugaaaauuauacuuacucauguuuuacuuuuucugugaucuuugugacaccugugucucaucaggccagugagucauugcuagaaggauuuccuuugugggcagcaaaucucauguacaguugugugcauucaaauucuagcaaagguuucuuguuccuccaucuugaggacuauuuuaugucgggccuuauaauguaaaccucuguccacuggcugcagggaauaacaacaguacugaauuugcuuuuaaguauuuaguguuauuugaaauaaucacacauuuuccauaugcuuauaugggcuugggaaaaagaagggaauauuaugaauuacaaaaaaaaccucuaacuugaagaauauuauucaucgcuucauauaaacagagcugauuuagcauuugaaagugcugaauacuagggaaccaccagacucuccucuaaauuaucucuguuacccccacgagagauugggugugagcacguguaaagaaggccuuuuaggggaugucaugucucaaagacaguuaaggaaugaguuccucucacguauguguguuuuuuaacaagcaaaguaaucuauuacuugauugaaauauuuuucugcucccgagggcuaguuuuucucuuuaaaaagggguggaauuguguaauuccuauauaguaacaacacagaagauguagugacucugguguggauauaaauuauauuacuauacacaggaaguuucacuauaaaaacucacuagugcaagcugaguaugauagcaaucaagauaaauacuaacaauuauuuaaauacucucagggucauuaagaaaucaaaagacauggcaaaggaagcaguuggaggccaagcagaagaccacuugaaacucaaagaugggcagcaacaaaaugagacuaaaaagaagaaaggauggcuggaucaggaagaccaggaagcaccacugcagguuugcugacuugacacuuuaucaggggaugagaaccagauuauaaaguucagauggaacccagagcaaaaaucucugucucugagaaagaagacaugagcagauucucuggcugcauuuuauuuuuuauuuuauuuauuuauuuauuaauuuugagauggaguuucacucuucucagccaggcuggagugcaauggcacaaucuuggcucacugcaaccucugccucccagguucaagccauucuccugccucagccucccaaguagcugggauuacaggcaucugacaccacgcucagcucaguuuuguauuuuugguagagaugggguuuuaccauguuggccaggcuggucuugaacuccugaccucaggugauccgcccgccucagcuucccaaagugcuaggauuacagguguaagccacugcgcccaaccucuggcugcauuuuuauguuacagucucuauuacccaguaccacugcaggucauugucagccacccucagaaaaccauagaauguuuuccuagugaaauaagcagaaaacagcaaauuguagauuaguaguccuuaauuugaaauccaaauugcuuuaacagauuccacauccuacauugguuucccccaucuugcauucugugguaccauauacaacuccaucaacuggaccuuacaccccuguaacagauaagauaaaccauacauacuucuacaaguuuaaaaucauuaacugaagaaugucucaucuaucuaaagucaagucacuggguaaauaaaugcccaaacugagcucagacuauacucaguuugaauuauuaccauagcccaauuuauauuuccaguuuuuaguguauuauucaccagcauuggucauauguuuuauauaugauuguuuaugcuugcauuucucaggagggugccuucaagaauccucucagugcuuuugagaaaugucaggcuguuggcuccuguuacuguguuaauggauagcuccacagucacauacuuugaauuaggauggugugauguucauaacaaugacccugugguccugaauccucaggauaacauuuagccuagcuuugugcauucuaacuagugcuuugaaaauugacaauccgcaaauaucaugauauaggaacccucauucaaaagguuacacucuuuuguuauacuagauaacauuuaccauugaaauuuuuaaacuagaguucucugaugucacucagguaucuugagauugaaugauauuuuuaugcaaauuuccuagaaaggggacgccaaaauaaaagcucaagaggaagcugacaaacgcaagaaagaacacgagagaauuauguuacaaaauuuacaagaacgguuagaaaggaaaaagguacucgcucucuguuuggggggacuugauucuguguuuaaaacaauguugggcaccugauaucagcauguuuuuaaaaaucacaaaucugauauaugcuaguuccuggugguuuucccacucgauucucuuccuuauccaaggaucugacuucuccuacauagagggcuguccucuuacugaucaugccucccucucauggacccuugguggccauuggccauuacagugaugccucacuauaucaaaccucugguaacaaaacuucucugagcagaaggacuccagucaugguagggguugguagaaguuaagacuuucuucuaaacuggcuggaaauugcagcaacuacauggggagaagcacaaacuguaggccucuuugagaggccaaggugcaggcuauuuuuaagguagggccacaugugagcucaucugcagcccugguccaggcugaguugcugcaaggccuaucugguaguagauuggucaccuugagggggccagggagcugcaacucuccucacugcagggaaagaagugugcacaggagagagaauuccuguccuucccuagaaauauauuucuccuccaccuccuaucuucucucuucauuaacacaaaacaguguggcaucauugagguguauuauuuucauuaacauuggcuucaggaaucagcugaagacuaaagacuaaaauuauguuaaaagcucuaauugguucgcaauaauauaugcuuagucuaaugaauuucugcauaugcaaaauuaggagugagauguugucauuugaauguuuguguuauaacaaauacagcggucaucauucagggcauuuuauagcugaaacugggauugggauaggggacucaacugccaccguaagccuuuuguugguaauauuugugguuuuggagcaaucacugccauugugcaccucugugaaauggggauaaucaacuccuuuaggacaacuguuugguuucuaaucuguuuucauguuugaauuuuuauuuuccuuuaaauagagaauagaagaaauuaugaagcggacaagaaagacagaugugaaugccucaaagguagucuccauacuccuaccagcaguguauaagaaugccucuuguuucacauuauugccgaguuuuucacuuuacccaaucuggugguaaugaaauaaaguauuacauuugcauuucccugauuaucaacaagguugaccauguuuucauaucuuuaguuagcucucauauuucuuuugugugaaauguuuuuuuuuaucuuuugcccaagacuuuuggguugauuugucucauugugguucuuuaaauguuauagauacugcuucuuuuuugguuauguguugcagauaccuucucccaguuuacagcuuaucuuuucuuuuucuuuuuuucuuuuuuuuuuuuguauacaauguguaaugaucaaaucaggauaauuagcaaauccaucaccucaaacgcugaucauuucucucuuuuuuuuuuugagacagagucccgcucugucacccaggccagaguguaguggugugaucucggcucacugcaaccuccaccuccuggguucaagugauucuccugccucagccuccugaguaacugggauuacaggcaugcaccaccaugccuagcuauuuuuguauuacuauuagagacaggguuucaacauguuggccagacuggucucgaaauccugaccuuagguuauccaccugccuuagccucccaaagugcuaggauuacaggugugagccaccaugcccagccaguuuaucuuuucuuaauguugucuucuucuggauagaagcuuuuuuuuuuuuuuuuuuuuuuuuugagauaagagucuugcucugucacccaggcaggaacacaguggcgcaaucauggcucacugcagccuccaccucccaagcucaagcaauccacccaucucacccuuccaaguagcugagacuacaggugcaugccaccacaccuggcuaauuuuuuauuuuuuauuuauuuauuuuuuuguagaaacaggauuuugccauguugucuaggcuggccuugaacuccugggcucaagugaugcacccgcuucagccacccaaagugcugggauugcaggcuugagccaccacacccugcauucugauuuuaauguucuugaauuuaccaguauuuucugaugacuaaugaaguuaggcaccuuuucauaaaugcuuaguggccuguuggagauuugcuuuggugaaguaccuuuucaagucauuugcccauuuuccuauuuugucaccugccuuuuucugauugaauuguagguauuuuuaccuacacugguuaggaguccuuuggauauauauauugcagguaucuucuuccaugccauaguuugccucacacucuccuaaugucuauugaugaaccagacagaaguucuucauuuuaacaaguucaaauuuaucauuuuuucccuuauggugagugucuuuguggucuguuucaucauuauuugcuuaccccaaugucaugucuuuugauggagcacauguauucaaggccuuuuuccuccagauucugugcuuuuuacauucuaugcuacaagacugauauuuugucuguuuguaauuacccaguuguggucauuugcauuaaaugacaugagaauuuagaguagaaaugccauuuucaaaaagcgcugggagucaucaugucaaaguucauucaacucauugggaguuuucccucaagcagcaaccaaaggcugggugcgguggcucacgcugguaaucccagcacuuugggaggccaaggcaggaggaucucuugagcccaggagcucaagaccagccugaacaacacagugagaccuugucucuauaaaacaguuuaaaaauuagccagguguguuggcacaugccuauagucccagcuacuugggaggcugagacgggagaucacucgaguccaaaagucugaggcugcagugagcuaugaucgugccacugcacuccaucuugggcaacagagugaggcuuuguccuccccucucccaaaaaaaaaaaaaaaaacagucaaaaacuuuuuagcuauucacugacuagucccaucccgccuuaguuaagguucugagcaggcagagaacaaaugccaacccaaaguuauauucccuuggcuccugcccagggaaaucuuucauucuugaaugucuuccuagcuaaaagacgcagcuacgggcaccugucccuaucccccguagauucuuggggccaguuaaaagagguuauauuuuuuuaccuuuucguugaaaugacaaaaauuagccaucaguccagcuuugaagucagacuuuguugaaauucuaaaccaggaugauugaauauuaggcauaaucaagauuuccuuuuuuaaucguaggucacagaaacauccagccaugacauauaugaagaggcugaggcugacaacgaagaaagcgacaaggacucauugaaugaaauguuuccaucagguuagucaccauuuaggagcuagacugcuuagguucauauccaggggcuccucugcuuuugagcuguguggcuuugggcaggucacuuaaccuuucugugcugaguuuuucccaucugaaaaaggggaagcuaauguccuuuuccuagaguggauaugagauuucagugagguaaauccauguaaugcuaaaaacagugucucacacauaaacucucaauaaauaucagcugcugcugcuuauuauuuuaaagaccaugcuaauggacuguagacagcagcucuuucucaguugaaugugaggauugccagcauuucauagcucagcuccucaaggcauccauguugaccacagguggaauuccacuuuccacuucauuaagaaaaauugaaaccaugucauaauaagaaugcuuucucaaauguaucauugacucccuuacaaguaggaaccacuuuguaguagcaguaauugccauuugagaaaacacuauuuguccauauuuuuccugccaguggauguugaacaggaaagucagguccucuacuaggugcuggggaugaaggggugaaaagacauggccucagcuugaaggagccauagccagugggaagacaaacauaugagcaaaccauaauacugccacaagaugauuggguugaaagaaguuuggugaaaauacaaugagaacauagcaguaagagccccucagucugccuuagggcauugaggaaagccgaagauagaagguaauauuagagguaagaugaggcagggcaguggcucacgccuguaaucccagcacuuugggaggccgaggugggcggaucacgaggucaggaaaucgagaccauccuggcuaacacggugaaaccccgucucuacuaaaaauacaaaaaauuagccaggcgugguggcgggcgccuguagucccagcuacuugggaagcugaggcaggagaauggcgugaacccuggagguggagcuugcagugaguggagaucgugccacugcacuccagccugggcaacagagcgagauucccgucucaaaaaaaagaaaaauuagagguaagacgaaaugcacaaacagaauugucuaggugagugaucaggggaggggugaaaaucuggagcagucuuaucucuggucauuauucuuuccuagcaaaggaaaaaggacagauuccuuaaacguagccucuuggugccucaagggcagggugagugugugugcugagcaguggccugggacauggcuugggaaacucugugacugcugggccugccucccaggaguacugcugcuugacucuuccugccuucaggcaggcaguacccacuccccaucccaucaggaucauagccuucacuuuuucuugaauucuuuauugaaacuccauauuuaauuguguaauuuuuuuuccuagccauucuaaauggcacaggcucaccuaccaaauuuaaaaugccguucaacaaugccaagaaaaugacacacaagcugguauuucuagaagaugguaccagccagguccguaaagagccaaaaacauauuuuaauggcgauuugaaaaacuucagacaaaaaagcaugaaagacacuucaauacaggaaguaguuucaaggugagucacuuagccagcuuaucuaaauaaacuuggcaggauuaugauugacaaucuuagaaugcuagauaaauaugaucucuugugcucuuaguuuguaccaaacaccaugucacauauuugacuuaacggaaauaaacucauccccacaacagccuugcuagguaaggaucaucauccccauguauaaagacaaggagacugagggucagagaggcuaggggcuuuauuugcccaauauccugcuauuaaagggcagagcccaaauucaauuccagauacaucuggcuccaaacuuuacuuuuguucacauugguuaauguuaucucauaaaguugggcaagaagacauuuauugagugauugcuauauaccaggcauuuuauauuaccuauuucaauuaucaucacaacugugagugugacaguaauauccucauuuuauuauuuuuuuauuuuucauuuuuuuuuuaagaguugagguuucaccauguuggccaggcuggucuugaaccuccuuggcucaagugaucugcccaccucggccucccaaagugcugggauuacaggcguaagccaccacacccggccauaauaugcucauugucaauguaaggaaacaaggucaaaaguuaggucaggagagcaggaacugauucauggaaaggaaugcuacaugggcaauugccugagaagacauucaccugcaaggcccacaggaacaggagucugcugagaggugugaugauguggaaggagcauuagagcuagaggaccuguaccaauucuguuacuacaccucacuggccgcauccuugaccaauguaagggaggggcaugguuucuggaguccugcgugcuuagcugcuccuacuccuggugcuuccgugggaccuagggcuuucuggaauacaguuugaaaaucaguguguccugugaucucuaggguuccuuucagucauccuguucuaugauucugaaauguuuuuuaauuccaaggcauuucuuagaaguuaauuaaaggacaaagcuucuuuuaggccagagccuugguuugggaauaauugggauucuaaccaaacugucucuuuccagaccaucuuccaaaagaaugaccagucacacaacgaaaaccagaaaggcggaugaaaccaacaccaccagcagauccucuguuaguaugaauuaugagcagcagcguaucugugacaagaucaccaacauuguuuaagucacacagaacuaucuuugucacauuuuucuccugacaggcacaaacaaaaucugaaggauuccaugacaucuugccaaaguccucagacaccuuuagacaauaagagaagaagcaaaccuguuucuccucauuuggguaaguccucaucucaucuaccuuuuucuugaaaggcaauugacccugaacccgcuccccuccuucuagccauuccagggcagucuuugcaccauauagcuuuggaagagaaggagaagacaguugugggucugcaggaaugaugugagagucuuccauuaaguugguuuugagaaaguagagaguagaugacuugauucuaauuuuuauguaccacauuucaggccggauauaaaaaauaaguucuggccaggugcaguggcuuacgccuguaaucccagcacuuugggaggccaaggcgggcagaucacuugaggucaggaguuugagaccagccuggccaacauggugaaacccugucucuacuaaaaauacaaaaauuagccgggugugguaaugcaugccuguaaucccggcuacuuuggaggcugaggcaggagaaucacuugaacccaggaggcggagguugcagugagccgagauccugccacugcacucuagccugggugacagaacaagacucugucucaaaaaaaaaaaugaucuuuucaagcuugcaucucagacuccucugagcuccuggucugcugguugcuuggcaagcacacagacaguugcuuagggcagaagauuagggaggucuucggaauaagccucaaccuguuuccaaaaccagaagccucuuguuuuucuuuccuugagaaguucucuuugaaauugagaagcaccuugggccugguuggggacuggggaagugaaggacauuuauaggaccagugugucagcaacuccagaggggcugcugagaguccugggcgugugcccugaagggaggccagggacaaguugcugugagacuagcaucuucucuacugaucuuucuuuuacuuuucccucuggucagauauguaaaccuuacucagccugggagaugaauacaucuuccacucuggauaacucaacuccugggcccaucaguccucaaauuuuucugcuucugacuugaaccugguaaaggaagugacaccgaaaaauugaaagaaacugucaaaaggccacuuugauguauaucucagauguuaaagucaucuuauucucuugugucuaagcaagaguucuaaguaaagagugguuuuuguuuucuuuggaaa

SEQ ID NO: 18995 - RNA, 15380 nt, Homo sapiens
acccccgcgagggaauauucccacgccuuccuuccguuucccucccgggccggccgauccgccggggaccccgcggagcucaaggcccuugaggcgccgcgggaucccaguggcccucgccccgccccaaacccgaccccggugggcgucgacgcgcagcagcagcggguccccccaaccccggcgccccgccuccccgggccucgcgccgcaugccggcgucggcgcuuuuugacgccauagugggcgugucggcgcgacccgcgacgucgccacgcgccgacaauggcggcugcgucggccugagcagggcuuaguuuagaaguaauuuccugacguugccgagggagccgcagucgccucagauccggucggcggcggcggcgguggcggcggcggcagcgcgccugcgcgcucccgcagcgcccuggaccuagcggcggugccgaggcccggcggagcaagccaggugggcggcggcgcggccgagcucacagcaucagcgcgcgcgcgcggugggcgggcagagaggggggcggugcagccgccgagcggccgcgauuucccggggacugcuggggcgcagcggggaggcgggccggggggcggcggggcgcgagcagagcgcgguugaccucccuuucucugcucagcuccagcgucauuucggccucuuaguucuucugaacccugcuccugagcuagguaggaaacaugagcggcaccaacuuggaugggaacgaugaguuugaugagcaguugcgaaugcaagaauuguacggagacggcaaggauggugacacccagaccgaugccggcggagaacccgauucucucgggcagcagccgacggacacucccuacgagugggaccuggacaaaaaggcuugguuccccaagguaggagagugccacgggcgccacugcagagcgggccgccuggccagccucgcggggcacuccuuuuacguuugcuuugcugagauccuugguccuugguccuagcccccuugaauagcgacgcuucuuuuuguuguguuuguuggggcaccgauguguaaaagaacguaaaucuuuaggguagugucuuaaauguaauuuuuaagucuuuucuaugcuuuauuaaucuugucugugaaggucacaguugauuauuacaugacugcuuuuuauugcaaagaggaaaaauaccaagaacaaauuuaguagcuguccauuucugguagccaaccccacuuguccuaggaacucagauguuuagcuuauguacuaugugcaaaaugcaguuucuugauuucuuuuuuaaaguagcuguuuauauagcuuuacuaauugaacuuucuuugcaccuugcuuuacuuuccuaguaaauuuugucccuaggcauauauguuugaaccauauaaccacaggaauaagacuggagauacacagaauacagauggaaaaucuguguauguuuguuuggaauacuuggaaauugcuaaguauuuuuauuucagcuucgaaguaaaauaacuaauguuaaacuugauucuguaaacuuugugguaaaagugcccuuuuaaucuggcucucaugagcaggaaagggcacacuaauagcacacaaauugacuugcaagucaaugauacaaaaccugucuccacugcgcgacuggacugcuauuguaaaaauucuuuugcaacuuuucuuucccauucuguauuuguauauauauuccaaucccuccagauuguuaaaauuuacgauuucacuucuguguugguagugcuaguuugagugcagauuugguuucuucagcauucugaauacuuuuaacaaaggugugauaauggauuaaugugugacuuuauccuuuuauguuguugaagcccauaccucuucaaacuuuggguuuuacauuuuccccauuccaugccugccuaauauugauugguaugaugauauaacuauauuucuuucguuuugcaauaacgcuuuucccccaaaggggaggaagauagauaugaguuggauuugucuuuaauuuguucugauacuaaaauauaacgucauuuaauuugugauaaaguuaaaaugagcauuuaguuuuacaauuguuaaccccauucuuuauauaccaaaucagaguucuguucugugugcucucugcauacagauauuuaaguacuuauuguacauguauauuggugcaucuguacaguaagagaaaauuggauucugugguuagauuauucauugacuguugguuuuuauuguuuuauuaucugguucuuccuuuguuguauguauuuguagccuuagucaaguaguguagagagguaguaauuaauaaaugaaacaacuagaaaaggugccagcaucacuuaaaaugcuuuaaaucguaucucagacuuuugcauugaucaucuaaguacuugugucuuauuuuuuaucaccguaugcacaauuuucuauagaaggugacuauucuugcauuuauaccuuaauaacuacaacuauuauccacagaaacacuuuuguguuaaguuguauaacuaugcuguaaaaacacaauuuaaacuucuuaugaguggaaauaauuuugaauuucucuguccgggucuguugaauugcuuguguagauuacugaagauuucauugcuacauaucaggccaauuauggcuucucuaacgauggcgcaucuaguucuaccgcaaauguugaagauguccaugcuaggacugcagaggaaccuccacaagaaaaagccccggaacccacugaugccagaaagaagggagaaaaaagaaaggcugagucagguaagugguucuagcuuacaaauuuuaaguguaaaaauuaaaaauaugggugugcauagguacaguugcuuuuucgagaauuauaauagcuuugaaggaauaaggugaguuuuuucuuuaagguagugucaguuauaaagaaucaagauaaacuggccaucuuuuuuccagauagggcucuaaaacuaauuauuucucaaaagauuuaaaucuuuugaaagcuggguagugauuugaguuaguuuaucuuggucuuuuaagaguaacagaaaggucguccuggaaguuucaagaaacugcugcuuugucaagauuccauaauaugacucuuaucuuuuuuugcaaguguuuuauuuauuuaauuaauuuugauuucuaggaugguuucauguugaagaagacagaaauacaaauguauacgugucugguauguauaacuuuuuaaacagguuuaagguaggaaauacuuaauuuugagauuuuucacgaagugauuuuuagcuuucaguuucuccagaguccauuuuuuaucauugugucauuuuuuguucagccauuuauauuaguaaggaauauguguguucauuacagaaccaagaaauuuaguguguaacuuugcauaccaaccuuuaggccugguuaauguaacuuacagcagugugucccuucccauucagugaggcccucaagaaagcauaauuuuaauguauauuugaacacacaaaaaugugaaauuucuucaguuccguaaauguaaaacuuuuacauacauuuagaaaaucaacauugcauucaccuaaguuauagauuucuaauugguagaaugcuaaguaauucaccuucauuaucaauuauaaauguuuuuuaauuuuucuuaaaugacagguuugccuccagauauuacaguggaugaauuuauacaacuuauguccaaguuuggcauuauuaugagagauccucagacagaagaauuuaaggucaaacuuuacaaagauaaucaaggaaaucuuaaaggagacggucuuugcuguuauuugaaaguaaguuguaugaucaaauaaguuucuuguaucuucguuuuuaacucaggaaccagggcuauaauuucuauagaugauaaccaacaccaagaacuguucaaaacaggauaugaagaaaacugaaauuucaguuaguaccuguguguaucacauugguaagauuauucacuuguuuuaagaaaauauguuaucagguaaaaguauuauauaaguaugcgacuggagugcuucuucugucuugaaaaauucucacuagaaagauuuuuuuauugauguguacagucaauucagacuacauuuuaaaaauucaagaagaaaaaaagccaguaacauuuuaguuguccauuggaaugaauuacaccaggguucagcaaacucgggcucuguuuugguaaauacagcuuuauggaacacagccacacuaauucauuuaugcauuugucuaugguugccuuuguguuucacugauaggguugagugguugcagcacagaccuuguggccuacaaagccuaaaauauuuacgaacuggcccuuuaacaaaaggauuuuucugacccuugaauuagaccaugaaggagacgauagcuuauucuuacugcuuuaaaauauuuuuuugaaugugagaaaagagagagugguauuaagagaaauuugcagaacuucauguagucauaguaccauaaauuacacaaagaaaccucaaugccagaggcagccaucauuucuggaacaccugccaccuuaggagcauguguuauacauuaucacaggguacagaacaaaugaugacauguacauaagucaaaccuggaaauaauuacagaguaaagucaaaaugguaaagcaaaaguacaaacaccacagguguguugugaguauacaguauuccagugagaucagaagagaguaggauuaagcugacagcuuuuugggaaauagguuuuugaccugaaucuuaaacgugaugguuaugggacaugagcaugaccauuuuaggaugguaguuuuguaauguucaaauguaaggagauuugaggguuuuauaaguucuuuaaggauuauuaaaaaaucugcgaacagauucuuagggaguucuguuagauuuuuuaaauuuuuaaaggaaaaaaauugaguuuugagacccauagaaguacaagauugucaaaacaguaaauugaguuccaggaaaauauagugaauuauuccaggacccauauaugugagcagcugaguucaguuauccauuuuucuuuucuacagguccucugaucuuugacucuguuuguauagggcugauaacuguccuuucucuaagaccuggaauccauacauguauuuaauauaaaguacaagucaucagauaauugucuucuacuucucaguguauuacagacucacaauuuaauggaugaaccaaaaaauuaaaggcugucuaugguguucccaauuccuugagucaucuagucuuuuaaguaagaguauuauagaauuuuaaaagaaauacaccuuagaaaucaugcagauuugcucccuucauucugcaaaugagaaauuguggccucaagagacaaaauuacccaauaauaauauuuauugaacaccuaccauauguuaguccuuauccuuuccaugcauuauuucauuuaauuuugucaagaaccuugugaugaagguauuaacuauuuccauucuacauacgacgauauuggggcucaggaagcuugaauaauuuacccaaguucacacagccgguuagggacagcugugucucagaugcggguuuccugguucagauucuagaguucuuuaucucaaagagagaacgagaucucguauauucauaauauauaaauauaagaauuuaaauuauuuuauguauaaucaucguucaucuaaaaaacuccugaaguuuuauuucguuguauaacugacuauauuuugucuuacauuuauaaagagagaaucuguggaacuugcauuaaaacuuuuggaugaagaugaaauuagaggcuacaaauuacauguugagguggcaaaguuucaacugaagggagaauaugaugccucaaagaagaagaagaagugcaaagacuauaagaagaagcugucuaugcaacaaaaguuuguaauuuuuuucccuuuugaaagguuccauauauucuagaguauauuuuugguaauagccaucuaguuuuauucugucaagugugccuacacauuauuuuaaaauaauuucauuagcucaucagguaccuuuagcaaucuauacaauagguuuagauuuagcagugguggggauuuuaauuuuccagagugucuauuuguaauauaauaagggcuuaaaugagcuaagagaagccaucuguuuggaaaacguugaacaucaaauuaaauaagauaguuuaggcuuauguaccagaaccguuuacuucuguguggauugaaaucagugguaccaggagcuaaauuuuucuauacagguuuguuauaggaauuagaaaugacaggauuuuauaauuguauuuacuguaguuguauguaguauauacauaaugucaucaaguuucuauuauuauucuguuuguuuaauauacuuugaaauauacuaguuuuaagaaauuagucaaaaugauaaauacuuuuaucagaguaaauucuaaugacacuucuaacaccaugcuuaaacuaauuaaauaucauaaaagcauuuaguugugaugucucauuguuuuuacaaguguagguaaaauugauaaccacauauuuuuuaaacaauaucaguaaaauuuaugauuguaacagaguugaguaguuuuauguauuugagugcaguuuguuuuuuauaaugauaaaguaccuaaaaaccaauacaauuuaaauauauuuuuuagccucaagguauaucuuucugaacucauaaauacuaagaauuagagauuuuucaagggucucauuggaauguuuguauaaucagacaacaguugcccugaaaaacauuucaucuggggauuucagauacugggaucauuuugccucugccuuuuauuuuauuuuauuuuauuuauuugaggcaagagucucacucugucacacaggcuggagugcaggggugcaauguuggcucacugcaaccuguaccuccgggguucaagcuauacucaugccucagccuccccaguagcugggauuacagacgugcaccaccacgccuggcugauuuuuguauuuuuaguagagaugggguuucaccauguuggccaggcuggucuugaacuccuggccucaagugauccgcccgccucggccucccaaagugcugggauuauagguaugagccaccgcacacggcccccugcccauuauuuuuauuucagaaaguuuucugacuggaacuaugacugaaauacaguuuguuguuguaaaauccaguaauuaucuuuauuaaauacucaguaaaguauuguaugaacaacucauucuuuucucucuccaacaagucugaagcaaaauuuacaguuuguuguuacugcuucauugccucaggcaguuggauuggagaccugagaggcgagccggaccaucccggaugcgccaugagcgaguugucaucaucaagaauauguuucauccuauggauuuugagguaggaaguggugugcuuacugauagaaaugcugauaggcuuuuuuucucucaagggagccuggagcuugccucgccucaucuuugucuugucaccuccuacguguuugugcagcgaguaguaaaggaagauggagccaagaagcuacuuaagucuuuugauuucccuucccuuuguuuagcccaguauuguuuuaaaguguaucacagauaagacuguuuaauaaccauacugcgccccaagcagcagcuacuugguaugggaaaccauugaaaaauaucaucaucaaaagauuuaugggaacugcuuguggauuuucagugcaagccaacaaguauggccugauuuugguggggaguaccagcuucacaauuguaaaugcaaacuucaguuugguacuaaaaguuauaauauuuaauguccguggaaaauuccaagaacagcaaguaaaagugaauaaguacaucuguuauguaucaacuuuuuuaagugauuuuaaaaaaaguuaauggaacuguccuuccuccccucaaaaaagugaauaaaggagaagcaaagaacaaggaguucugaggaauauugucaucaaaguaccuuguguuacauucugccuguauucuuaucucugucuacugguguagacugacuuuauuguuguggagaaacaacucuuuauucucucccugguucugaaauuagugauagcaaguuauacagaaagcagguuauacagauagcaaguuauacagagaaaaauguucauaacguaaaauuccguuuuuaccaauaaucuaguuguaaauuagugcccauuccugacccuuuugugcauuuaaacagucaaaaugguaauauaauuguagcucccuuagagagggccccaaaauggacaguucagcucuaucucaaugaauaguguugugauaagguuuacuguguaccuauggaguuugggcaucuuuugaggucauuggaaauauacgucugguuuauuuaugagauugauugauaucucuucugacuagaaaucuggaagaauuuugaaauauaacaguuuacaguuuuacaguugcagugauaaugaaguaugguuuauaaacacgugcacaccagaugcauuuugaaauacuguuuuugccagcaauaacuuuaaaaugaaugcauagaauuacaaaaauauuagcugggcaugguggcgcauaccuguaaucccagcuacucaggaggcugauucaggagaaucaccugaacccgguaggcagagguuaugguaagaucgcgccacugcacuccagccugggcaacggagcgagacuccaucucaaaacaaaacaaaauaaaacaaaacaaagaaccagaucauagucauuaaagcagcauauaaaauaaaugcacagauugaucacaauauuuagucugcuaaauacaacuccgggauuuccuauuauuuauuacauuuuaucccccugcuaaauaagugauuuauuaggugacauauuuauuucugugacucgaggucuuugauucacacauuucauacuccugccacccaagugugaauguaaaugcaaaccuaauucaaacuaucuggaaccucugcaaguagaagucuguuguguaauuuuaaucuauucuuguuucuaccuccugccuugcucauugaaauaccuuauuugagucuaaggaucaccccaggcagacuuagcucuucccagcuuaacaaauauucuuuccccaaaaccacauuuauucuaccuugaccccuauacauucccuccagugaauauuuuuaaagauagaaguuucaugcuugcaaauuccugauuuuuuuuuuaaucuucuugguuuaguauaaacauuacuuuggaguuacagagccuuuauacuacccuauuuuguuuccuucauagcauuuauuauuaucugaaguaauuuugacucgucuacuagaaugugagcuccaugacacccaguauuuugucuaccuuguuugcugcuguauucucaguacauagaauuugccuggcacacaguuggcccuuaauauuuaugugaugaagaauugaaagaauugcuaaaugaaacccuuguuauuuacaagccagagucuuuucauucagccaguggauaaaacauuuucucuucagcaucuuugcaaaugaaagcaaauuuucuucuuagaugcuuauuccacaaaggauggugggacauugucuuggccguggcggaauuaguucacaaagaaaugcuuggugaugcuauccuuguuugcccaccuuccuggccucacaugguccaacuagcuugcugagagcgugucaacaagaagagugacaaauaaucuugcuuuuguucacugucucugagcaccugaaccucaguguagaccugugcugucagauaugguagacuguagccaugugugguuaaauguaaguuaauuaaaaugaaauaaaauucaguucaucgcuucuacuaggcacauguagcuaguagcuaccauauuggauaaugcagauauacaacauuuucauuaucacagaaccuucuauuggacaacacugguauagacauuauauaacuuuugauagaaguguccaacaggaaaaccugcuuuuauugcauguuuugggggaguguuugauuugacucaagacuccauaugaaccuaaagaacacacagcagcauugagcuuuuuaguggaaaacaaaaacugaauugucagguuauccugagauaucugaaaggagucagauuuuggguggagggguauauuuugauuccaaacaguuagaagcaacauaccuaagaauacugucugaucugaaggcuaacauuuuuaauguaacuucagagggucuucaguauuuaauucaaauccuuacuuuaaaaugcauugccuggcaaauuugaauaccaggacaugaagagucaaaacucaaaugcauuagccgggcaugauagcacgcaccuguaaucccagcuacuuggaaggcugaggcacgaggaucacuugaauccgggaggcagaggcugcagugagccaagaucgcgccacugcacuccagccugggcaacagaguaagacucugucuucaaaaaaaaaaaagaaagaaagcaaagcacugagacauugguguagaaauggaggugaugccuacccccaccauggaaucacgcuucaauuuaaaaguuguuaaacauguugacacaguuuuuuuuuuguuuuugauauaauccugauuuuccuuggugaauaaaagagagguauuagaaacaguuuaucaaauucuuaaaaagauuuucuugaauauuggcuuuguacaaaagucugugcuauuuucugugagguaucugaaacucaauaaaacaaagguccugccuucugaaagcacucacucuaauaggagcuaaccccacacacacacacacaugucaaaagccauaacuuuuauucucuacuccuuauucuucucaggucugaucauuuuguauaaagcaaauuggcugcuucuccaaaauugaguuuuauaaguggggaaguccagaguucugccaacuguaguuuuagaagccucagauuuaugcaaaugaguaugauuuuauauuuuuuauuuuaaaucagauuucaguaacucccugccagcuuauuuuugcuuuuugaagaaccuuaugggaggaaagccacaauucucuauaguuccucuuuagcugaugagaaaaaugaaagcguguaagaaagauagaugcgcuuaaauguuuccuagaaaguauaagucaccuucaauagaaauuuguagauaggauaucuucauuuauauuuguauauaguugaaauucaagcugauaauguagcuuuuccugagcccuuuuuaugcauugguacuuggagagagauuuguuaauucccagagggaaucuuaaaucauuuuguuguuauagggagauuuccacccgaacucuaggcuacuagaaacagcaguacuugaauguucuuaauaggcucauaguugcaagaaagcaacagcuaagaauguauuuuauugcaugcuuaauaacagcuccuuauuuguaugguucuguuacaaugugguaggagacaagacgaacaguaauccuuacgauguuuauucugugaguuaaaauagcaucuuggaagcacaaaaaucaaucuuaggacacuuagucaauaaaagggauauauugcucucucucucuccauuacaacauuucuguaaauaggaauguauccaaaacacaaagcaaagggcucuuaucagugugauguugaugcccaugcagagcauaggaauuagcagucugacugaauaugcgccacaggacuuccaccaucuucuccugcucugccacuguaggccccuucugcugccugccauacuuguccauuuccuuuguuuaaagcagggcaaaccuauaggaguagcaguguauguaguaguauaauuuuauuugauuuugaguuuuuaaaaaauuguauagaaugaaaaacacaaccuuaagcaaaaccuuuuucuguuuguugauuuaucagaacaagaaauuggauucucaggauuuauaguuaaagaagggagcaaacccauuuuaaucaugcauauuuuucaggaugauccguuggugcugaaugagaucagagaagaccuucgaguagaguguucgaaguuuggacaaauuaggaaacuccuucucuuugauguaaguucauggcuuggacauauggauccuaaagcaauaauuccuccaccuuauaaguucuucucagauguuaguauaccccugaauuuuagauuaauguuuuuauauaguaguccacuaucuugugauaaucaucuauuagcaauaaugagaugaacguggauuacaagccaaggauuugauagauuugguaugccuugcuuauuuuccgucuucauuacccuagaguacaugaucaggugaaagaagguacaggaaaaauguaugagaucucugguucccuauuagucacauuuuccccucuuugugaauuauucucauccuccauauuuggaacaaucagggacaauauucuccuguauauuuccucuucucauccucuuuuuacuuccagaauugacacccaauaauuaagagucaccauuuauugcuuguguauuacaagcuacuuuacauguuaucucacuucucaaaacccuuugaggcagguuagcacuauuacacccauuuuacagaugaggaagcuaacacuuuagaaauugaacaccuggcucaagguuguucauuugguaacugacagagccaggauuuaaucccagggcaauaugacuucagaguuuacacucuuaacaauuauacuguccugcuucucauuagacagggaugucagcagaaacauuuccaaggacauugugcuugguucuugcuagguaagauugagguaaagaagcagcugacugcacgugacuggcugggauaaaauggaagaaagacuucauacauaaagucuuuuacuucagaguaucagagagaacacuacuacuuaccuacuuugugaaauguauguguuuuauuuuuaaucuuaucauucauuccuuuuuuuucuuucuuaucuuucuagaggcacccagaugguguggccucuguguccuuucgggauccagaggaagcugauuauuguauucagacucucgauggaagaugguuugguggccgucaaaucacugcccaggcaugggaugggacuacagauuaucagguaaauuuugcugcuugucaagggcacacacauuguuucauuaccaacaaauacugauccuucagaucuaaauuuuggguuugguuuaaccuauuuaauguaacaaugcuucuuuuauuuuuauuuacuuauauauuuuaauuuuuuacucuuccucuuaauuauuuacagugcugcuuuuaaauaauauuuugcauucagaagauagagaaauguuugagucuuucaguuucuaagucugaaaguuugaggcuuguucagaauagugauaagaaaagaacacauucaaccaaauguuacucuuccuuuguaugcuguaaaguauagacagagcucaaauauuaacuuuuuaagagaugagacauuucugcaguacugugauauuuggccuuuauuuaaguggucuuauuuaaggucaacucuaguaaaucaagauguaaaguuuugaaaacugaagauggaauugcuuucauuuccuaauaagagaugcuuuauaaaauuaagguuguuucaucaauauuagauauguucagagaaguaaccuuuugccugaaacuuauuuuaauggcagucuccauuuauccacagguggaggaaaccucaagagaaagggaggaaaggcugagaggaugggaggcuuuccucaaugcuccugaggccaacagaggccuuaggcguucagauucugucucugcuuccgaaagggcagggccuucuagagcaaggcauuuuucagagcaccccagcacaucuaaaaugaaugcucaagaaacugcaacuggaauggcguuugaagaaccuauagaugagaagaaguuugaaaagacagaagaugggggagaauuugaagaaggugcuucugaaaacaaugcuaaggaaaguagccccgaaaaagaggcugaagaaggcugcccugaaaaagaaucugaagagggcugccccaaaagaggguuugaaggcagcugcucccaaaaagagucugaagaaggcaaucccguaagaggaucugaagaggauaguccuaaaaaagagucuaaaaagaagacacucaaaaaugauugugaagagaauggccuugcaaaggaaucugaagaugaccucaacaaggagucugaagaggagguuggccccacaaaagaguccgaagaagaugacucagagaaagagucugaugaagacugcucugaaaaacagucugaagauggcuccgaaagagaauuugaagaaaauggucucgagaaagauuuggacgaggaagguucugaaaaggagcuucaugaaaauguucuugacaaagaguuagaagaaaaugacucugaaaacuccgaauuugaagaugacggcucugaaaaaguguuagaugaggaaggcucugagagagaguuugacgaagauucagaugaaaaggaagaagaggaggauacauaugaaaaaguauuugaugaugagucugaugagaaagaggaugaagaauaugcagaugaaaaggggcuugaagcugcugauaaaaaggcggaagaaggugaugcagaugaaaagcuguuugaagagucagaugacaaggaagaugaagaugcagauggaaaggaaguugaagaugcugacgaaaaguuguucgaagaugaugauuccaaugagaaguuguuugaugaggaggaagauuccagugagaaguuguuugacgauucugaugagagggggacuuugggugguuuugggaguguugaagaagggccccuauccacuggcagcagcuuuauucucaguagcgaugaugaugacgaugauauuuaaucccuuaaacuugcuuuuuagggagaguccuccaucuacauuugccugugcuucaggguaauuacuaguaguguuacaugaacaugugcauagugguaggaugccaucagauuaaagcauugaaguguuucauuguuaccuguaccuaaugguuuuaaauauauguuaauugauuguuuaguuaaaaugucauaguuacaaugcaaguaaacuggauacuuguucuuuugucagauuuguuaaaugcaugcagaauaauauuuuuaagaguauugauugaaguuugugauauucaucaauaaaaaugaguugauaauaugcagaaacugaaaauugg

SEQ ID NO: 18996 - RNA, 21064 nt, Homo sapiens
cuagaguuucugguucuacucaauugcuucuggagcagagggcaggcaaccucuccccccucucaaauugagggaggggaugugaaauuuaauagcagaaacuaaauauugcaauauaagucucuaauugagaaucacaaaaacaagauaucaugugggagcuagagcuuuuaaguguguguauuaagaaaauggguccccuucugccaggcacaguggcucacgccuguaaucccagcacgcugggaggccaaggcaggcagaucaccugaggucaggaguuugagaccagccuggcaaacguggugaaaccccgucucuacuaaaaauacaaaaaaaauaaaaaauaaaaaauagccaggugugguggcagacgccuguaaucccagcuacuccggaggcuaaggcaggagaaucacuugaaccugggaggcggagguugcagugaguugagauagcaccacugcauuccagccugggugacaagagcaaaacuccauccuuaaaacacacacacacacacacacacacaacaaaacaaacaaacaaaauaaaaacaaagaaaagaaaagaaaagaaaaugggcccccuuccauacccagggacauauuagaaacucaggagcugggcgcgguggcucacgccuguaaucccagcacuuugggaugccgaggcgggucgaucaccugaggcuaggaguuggagaccagccuggccaacacagugaaaccucaucucuacuaaaaauacaaaaauuagcugggugugguggugggcgccuauauucccagcaacuuaggaggcugaggcaggagaaucgcuucaacccaggaggcggagguugcagugagccaagauugugccauugcgcuccagccugggcgacaagagcgaaacucugucucaaaaaaaauaaauaaauaaauaaaagaaagaaagaaagaaagaaacucaggaaaacaggcaaguguguacagaugugcacuacaacuagugguuaugggcuaccaaaacuacccaaaacuucaguuugcuuaaguaggcaguggaggcucccuugccuccaaacaaacuuagagccuaaaaccaccuuaaaaaggagaaagaguuaagagguaagaacuaaugagcuuuucuaaagugggaaaggaguauuucagugauggggagaggggucuccuggaauguuuuugaggccacugagcugcugacagguucagcuuuuggaacuuguacugauaggagugaggaaaaggacacuguaggccauguguuuuuccucuuucauuuaauagguagauagauaagaacuuccauggaggaaugugugaugaggguggggaacaggggaagaggagaacggaugucugcugauaaaaccugcuucacucuguccuugguccucaggaaaacuugaccuuuagcccuggauggcucgagaggggccucugcacagcccaguguggacugaaguuugugcauccagguugggagggcagggcuaagcagagggaccacagacucuggcucugaggauuccaccuguuuauagcccucaagggcccauaggggcauucuugcugaaaucaggcuccucuguucuugaagacagacccauuaaaaugagagaaagaaggaccaagggacggcaaggcgaggaggauuuuuuaggcuuggugaaacuugaacccuagagagcaaagggaagggggccucaggcucacacaaccugagcaaaauaggaaagaauaugcaaggcaaacacccaucucagguccugcagggguggcaggaggaucaggucaaugaaugggacuuugaggccugcagugcgugggaucuuaaggucccuagcacgcuaguacucaaugugugcaguacucaaugucugcugugcuacucauggugaguagcacaaggggcuuuccuucaggggcuaggacaggagcaggcacaauuagucacuguuugggaacagcgccccgcugccaguccugugguaacaaucuagccaggguagcuccugggccucuugaugagaaaggacaggcccgcugagccagaacagaaauuucaccaggggcuuuucuugggccuucagggccacccuguccccaaguugacuuucccacaaauggagcuuuuggaaaacacuuuggcaaguggcacaaagucaggcuacacuuuggugagagcuccauugggugugacaauuuagccuggcuagaccauacuccugaaaguaggagugccauauaagauacauaauguccuauaaaaucugaauugccaauaaagaauauuuuaguauaaguaucucccaggcaauaacugggacauacuuaaacuaagaaaaaaucguuuauuugaaauucaaauguaacugagcguccugaguuuuugaugugcuaaauuuggcaacauuacuugugugaguggcuauuugggucugaaagaauuguuugccagucuggaccagguucaaaaggugaaguguaaucuaccaaagcugagucugaggggcaaggguugaggauuaugcagccuuauagagaaauuccugauagggccggaguggaaggaaagaugaaggagaggggagacauaccuaaggggaugagcuaagguaguaguuaguaagcuggguuguugggagcacccuggaaucuuuuuuuauuuuagagggagucuugcucugucgcccaggcuggaguguaguggcgccaucucagcucacugcaaccuccgccuccuggguucaagugauucuccugccucagccuccugauagcugggauuacaggugccugccaccacacccagcuaauuuuuguauuuugguagagaugcgguuucaccauguuggccaggcuggucuugaacuccugaccucaagugauccacucaccuaggccucccaaugugcugggauuacaggcgugagccaccaugccuggcccacccuggaaucuuuauaauaacauaucuuuauaguuuaaaggggaagagugcagagaaggagcauaaauguuuugcccaagucuaccagcugauggcauuuguccugggaagaaagggaggguagcguuucugggcaagaagaggagcugggugaacgcuaggcccucacugaggaggggcaguugaguugggagggaguccaucucucugucccuccaacccccucaggccuagggaauuggggucacuucccucaggcuuccuggccucacaugccuggcuugguuuggagcugucguugccccugagggcucagucacgcagaaagggucaauaaacuguguaucucuagccaaagaagaaagacaauaaaaccacccucagggucagaggucaccuagucacugauugagauauucacaacucuuuuuccucucuucucaucccuucuuucuccugagacuccuccucccuugacuacuuuuucccuuucuccaaagccaaaaguauccccaaaaauaacugagauguggggcugggggaaaaaaaaucaagccauaugcaaaaugaagcuggaaaucuaggagggugaugguggauaaaaucuacuggucaagaauaccuagccucugcugacacuacaguccaaccccuaguccaggggucggcaaacuuuuucuguaaagggccagauauaaaauauuauuuuaggguuuucaaaccacauucaguaucuguagcauaaauucccccccuuuuuuguccuucuuuuucuacuucugcucucuaacccuuuaaagauguuuuaaaaauaaaauaaaauaaaaccauucuuggcuccuggggccauacaaauacaacaggcuaugggccagauuuggccuccaguuugcagaccauagucugccauucacguccaaaccagcaguuagucuaauucacucccacucuaucuuguugguggggaaagaaaaaagggaggaaagggaggcccuaugcuuuguuuuaaugucaaagcccuuuccucccacccccucacuaggaaauaacuagaugaauaaccacaaaccaagugcaaauugcaacaggcaauuugauuuuacaaaaugcaauuccuaaacuacacaaaguuccuugggaguggagacagcauuuuuccuagggaucaggaauucucccucucagcuugggcaaaagaaaggcggccucugccccucagcgaggaagggagaaagaagaugaaaugguggaauaggccuggacuaaggaaauguaacuuggggacaaaggguuggugggggcuccagaucuaggcacuaaggaugagaguugcugccagaagccauaauguggcccagagauaucuuucccaucacguugggaggauucuuucucaaagcaaagaaaugaaugaacaaauaucucagaauagucuaaggcuucucuccacuugccuugaagcuaauuuacauuuuagaacuaguacagcauuuagcagcuacaaggaacuugggguccuggguaaaugugugcuccaaaaugucaggcaaacuuggcucuccaaauugauucuccuucccccaucucuucaggugucuggggaaggaccuguaaacauaaaucaaaugugucacuguguaucucagccucugccugcaucccccucuucucuugccugggcacuccccaccuacaagguguucugaucuagaaggaaggaagaaguccucuuucaaugugucuugcucuccuggcaccuggagccacugcuagugcagcugggggcuaacaccuagucacccccagagcgguaaagguauuccauggcagcagaaccuagcaggccacagcucgucauaagccuuucacucagauuugccugaggaccacugccuaccacuuggguggggugguucacugcauuuucuauauuucagggacucccuuuauaauuccaaacuggauucugauaguucuaguucaagucccugccugccuccuucaaguucagcccuauuuacuucagccuaugucucugaaguucaaguauauauaucugucugcacagcccugauugacaaguacaaugaaaaugucucauuccugucugguuugcauuucauuacauuggguaacaauaugccuuguauuucagaggacaaaggcaaaaaaaaaaggggggggguuaauuaacaauaucuguuuauucucgauugaauuuuaaagguauuuagggcuuauaaaauaugugucaaaugauaggaccauagugaaaauucugauguggccaauaaaaucuggagcugugugauuuuacgcucaccaaccugcagacacacuugguuggcaagugugucagcauguccuggagaucgauaguucagcuuggccccugaugccaauuaagugcuuuaucuuagcauaaaaauaaagagaaguuaaaaaugcauucuuuucccagcuuucuucccccuucauuuuuuauugccacuugcaguuuuucuuuuaaaaagaucugggacucugaagagaggguggggauuuauguaaagaaagugucauuuaccaggaaaaaaggcgaauaauggugaguuucaaggacauguugcaaugagaaacacuuugugcuccacuagggagagacaggggcaccaaauucagcguccuggaauaauucccuuccuggauucaaagauucauuuauugaaauaaaucaggaagccuuggcagaacggaaauccgcuugcuggguuuaaagggccuuuaaaauguugcgaguguuagauugcaagucuuuucuaaauacaaaacagaagaaaagaccgcagcguuucccuugaacuuaaagaaaauuacuaggucaccgaaucaggauaauuucauguccaccacauaaaauguguuuagaaagaaaugcugcaugauaacacaaugugcuguguauguucuguuuuucggagguucgacggaagagaaaagugcuguggaguugggcucuggguuguaggaagaacccgguccuacccuacugccccucaggacguucuguuucccuacugcuucuucaagauggauucuaaaaaucgggcucaaaagcuuugcugguuuagaagugaucaguuuuucugauuuuauuuacugcuuuagauuugggcauaaaaauaaaucuuuuuccuauuuaccguuugaacucagugugagggaaaggaucccauuauauuuccuauccauacaaacauguggauauuuagacccgaccacauacaacuuggggacacauaaaagagauuuauugguuaauuuacguugccuacuacacauguaaacccuaguaagccaaagcugcugagggagccucagcuauagaaccacgaccccuggguucgaguuguccucccugacuagagcugugacuccugucuccaccugaaaaacgaaaacacgagaguugucuccauccccucaccucugccuguguguaggaaaaacuuuucuccucuuagcuuucccucuucugccaccacucuguucucagacucagcuccccaaagcgcccuguuccccgaaguuguucccagagucuccucuugaaaaucaaguuuggggaggagagaagcucuaagucauaagaaaaacuucgcgauuuuucccccccaacagcagugauuugcuuuguuggggguggggacuuuguuuucaugugcaguaacuagcuuuaucuggagggauuuugcuuucuacccucuuuuaagggucaggggucccccuccccaaauaaggaaacucccacucaaaccaacugaaaccgacuuagaaauggccugccucugaccugcuguucacaaagcccccagccucguccuuuugcgcgcaucugggaccccugcgucccacagaacaacgacacccccucagaaccgcacucucaggaugggcccggcugucccgugaagggcuccauugcccgggauuuuggccuggcugaaucgccucaggucugcccccuuaacaagcauccacccccccggcccccaccuccccacuucucgguugaugaucuaauugaauuaugccuuuuuguuccagggacuacagagcacgugcuggaggcaauuaauuaucggaauguggccguaucaaaacggacacugggcaccggguaggucagcggcggcaacuucccccugccuugagcucaagaccccuucccaaauaggggcaugaugagcucccucggcugccccccuucugagcccuucacccaguugcaaucgcgcaaggcccucgauucucgggguaccuggcgggacuccccggaaacucucgcaucagcgcuggcccggccagagcucgacagccgccccuucccgguccccuagucucgagaaccgcuguccgcgggaccagcucagugaggaaauccaaacuuuuucaaaccaacuacuuagccaagggcgguugggguuggugggaggugaagagagguagagggaagagaggaaauaaaggagaaagugaaaagaaagguggggcgggggggggggggggaagaaaggcaauccuccuuuuuuguaaaccugacuccaggggauucauuugcaugauuuaagcauauuuguucucugaacacaccagcgccccccuacccccccaaagaaacccucugcugagaggcacugaaaccauucuuggagagccuauguucggcagacgcaauaauuuaagucagcagugaacucaccuuccaaccuggggagagagcucuggauguggagagagaauuggggcgaguuugaugggagggggugaauacgguaagaugugcuaccgguaggguguucucccagcaaacuggcuaagaaagaaggugaaguguuggcugggccaggcagacuggggagcaggaagugaaaggcugcaguuauaaagcgcugcuuaaggcggucucuccuggcgccucugaacuugaucagauguucuauuuccuacagagagauggcggccaggcugugaggcugccucaaggcgcagacuuuggggcuuggcccagcuagggaugugacaaucacagccaucuuucucucugccuuuucuuuccacucucuucugcauucuuugcaaaugccuugcaggacacaaaaaugagugaauuuauagccuugucugaaccuggucauuaugucagaaagaccuugcaacagacagaaggcgagaggacuuucacacacaccccuggaaguaaauccuuaagggguaagcagucccugaggucacuacaugcuuuaccuucuccggguaggaguagaagagaguaaagccuuggcuguucagaggaaagaaaauuccaugucacaguccccauucagcaucagcaacccccaacacgacuuuugcauuugaaaauguugagaauucaaagcugauuagccuagugauuuggaaaccacccugauacugugugugucuaguguguuuauuauguguuuaguguguugugugcauguuuugcguacacuggcuaaaaguguucuuugcauguuuuguauuuguggguaugcucgcuguuauguguauuugcucuguuguguuuaguuguguuucuguguuugcuguguugugcguaguuuauguuacuguguuguaugugcuuacuuuguuguguugugugcguauuucauaugucguguuuguuuccuguggugcgcuuguguuuacuguguugugugcuuguuuccuacugugugcuuggguuuacugcguuguauauguuugcugugucgugcccgguguguaauucgggaagugggcagcggcgaguacggccgcugcucacaaacuaaagggucaacgcuuggcgcagacggaaguaacggagaucagcucuaauuguaaucguuucuucuccuuugggucucggacagcugccgacagguugggggcacaaacggcgaacuaucccggccugggucccggccucgaggccaucagaacucgcagugauuggagguggacgcagcggcuggaccgggagcgcgaaacugcugcgcucuccccaggaucugcgcccugcagcuacagaggggacauguucucaagguggugaggcagcgggggcccaagcaggacuggacguugagcgccgcgucuccuccaucggcgcagcagugggaccgauccucgcggggcaaagagcccgcgaggggugggggaaagcccgcgagagucccggcggcgucccgccguuugccggcuggagccuggccccaguuccccgcagccacucaagcccgguggagcccacucgcggccgcccggcagccgccgccucaccugccaggcacccggcggcugcccaaucagcgggggucgcucggccgcggcugccauguucuccgcuccgcgcugccaaucagccucgcggcggccaaugggcaguccggccggaggucaggugaccgcgggccagcuggcuccccauuggcgcgcgccucgcggccucccgcucgguuuaugugcgaggagugagugauugacuuuaucaguccaaggacauuacucuggaggcgaagaggcugggacucgcgcggcgagcggcaagcggcgaguaacgagccugccuacugcccgcugcccgccugcccggccgcuagccggcuccgccacuuggcgcagcccagcccggaggccgguacccagggagccuccuggccccgcgguucugugcacucggggagaggaggggugcccgggacaggauuggcaaacuccgcccuccacuuacuauuuugcuuauuuuucuuugugcgcgccuguuaguuuguuaaaccagaucuaguccgagucuuuucuccucccuucuccucccuccuccuccccccgccaacacccccucccugcucuuucuuccccuccucccuccuaucccucugcaggagacucuugcagugacggaaaguugcagccccugguagcgccuugggggucuccccgcaguguccaaccgccgccaccccuuuccgacuacggcacuucggagaucuccuccuucgccgguacccucucucacuucggccggaucgccugugcccagaacgucccacccaugacgaugcuccuggacggaggcccgcaguucccugggcugggagugggcagcuucggcgcgccgcgccaccacgagaugcccaaccgugagccggcaggcauggggcugaaucccuucggggacucaacccacgccgccgccgccgccgccgccgccgcugccuucaagcugagcccugccgcggcgcacgaucuaucuucaggccagagcucggcuuucacgccgcaggguucgggcuacgccaacgcccugggccaccaucaccaccaccaucaccaucaucaccacaccagccaggugcccagcuacgguggcgcugccucugccgccuucaacucaacgcgcgaguuucuguuccgccagcgcagcuccgggcucagugaggcggccucggguggcgggcagcacgggcucuucgccggcucggcgagcagccugcaugcuccagcuggcauccccgagcccccuagcuacuugcuguuucccgggcugcaugagcagggcgcugggcacccgucgcccacagggcacguggacaacaaccagguccaccuggggcugcguggggagcuguucggccgugcugacccauaccgcccaguggccagcccgcgcacggaccccuacgcggccggcgcucaguuuccuaacuacagccccaugaacaugaacaugggagugaacguggcggcccaccacgggcccggcgccuucuuccguuauaugcggcagccuaucaagcaggagcugucgugcaaguggaucgacgaggcucagcugagccggcccaagaagagcugcgaccggaccuucagcaccaugcaugagcuggugacacaugucaccauggagcauguggggggcccggagcagaacaaccacgucugcuacugggaggagugcccccgggagggcaagucuuucaaggcgaaguacaaacuggucaaccacauccgagugcacacgggcgagaagcccuucccaugccccuucccgggcugcgggaagaucuuugcccguucugagaaccucaagauccacaagaggacccacacagguaagggaaaaaagcaggcgggcguggguuccacuggcgauaccccgucacgcagcggacuuagagcgcgagggagagagguggcggccagggaaaggggcgacgccccgcaacggccgcucgaaaaagaagcgcugucagugaccauccaccccuagcccuccccgucccguggcgccuuugccgaguucuaacuucccgggcagacugcucugcggucucaggaacuaauugggaccuucucgcgcccaggaacaaacuggcgccgccucuuuuugucucccuuucuggguuaccgugaagggacuccgaauguguugagagcauauugcuuacaagcgacuuagcucucggcacacauucguggaaggcaaccauacaaaugcuaaugaaaacuaacuuucgguuacuuccgcuuuuuuuuacacuugauuggcacaucuccuaauuaaaugacugauacuuuugucaaacuauuuuuauuuggaguuccagguucaauucaguccuccgggaggaaagcuaaagcaguuucgugguuuguucagaacaucuuguaaaacugucuggagcccccuggaucgaucgaucuaucuaucuaucuaucuaucuaucuaucuaucuaucuaucuauauuuuuuuccucaaacauuaacuacgacuacccaggcuuuuuaauaucgggcuuagccaaaccgcugcauuugaaagaggcaaauaaaaagguacaaagaggcugaacgggauuguccuguccggggcccauugucccgccgggcucgguuacauugcugaggugguggcggaacguggccgcgcauugggagcccugggucggguaggguggaaacacaacuuaggggaaacuucggaggagccaggggcuuucccuccuugcaagaacaaagacauggucagguuuugggccggccccgccccacccccacccccaccccgaccaccacucccaaacccagcgggcucaaccuacgcucuucauuucucuccagggaaaauagaugcagcagcagcccccaguccgcgcucccuuuccgggaagaccgccgggagcucagucuccugcugcuugccucugagaaacuccggcgcugaccguauuuuaccccccuuggguuuuugccuuuugcaggugagaaaccuuucaaaugugaauuugaaggcugugacagacgcuuugccaacagcagcgaccguaagaagcacaugcaugugcauaccucggacaagcccuauaucugcaaagugugcgacaaguccuacacgcacccgagcucccugcgcaaacacaugaagguaauuaccucuuuauuagcggucggcgguuuguaaacacucggcccgacgccgggccgcggaacggaagcgcccgcgcugccaacccucugucuuccacguuaaauccgauuugcuccagcagugacaccuugaacccauuuuggggaccgggcgggggugggggugagggggugggcgggagugagcaaaguugggagggggaggaagcggagggaacaaucgguuguuuacugggaagcucuagccgagcucgccugggcuugcggggcugccguggccgccucuucccgacucagcccgcggugggaaccgagaguagccgcgccgaacccgagggugggugguucauucgcucuuuggcuucggauaaaacaauagggccgaggagugcaaucugauucccacacauuugucugcgacuucgcagcgcucagggccccugugccaccuucucuguaccugcuuucucaagccgaaacgggcuuggugaaaccugggcccggaguuaguauuuuauaggaccucacaguguacugcuuaccucacuccauccgcggagaaagcauuuuugaaguggcaugaccaaaacggaaugcuuuauuccuuuuccguaacaccagucuuaggagcaaaacugguuuuuggcgaacaucuccggguuuucuagacaucgguaauacggauuuuuuuuaagcagcauuuuucuuuuaagugggucacugggcggucuuguuguuacagugcucgaauucugcucuuguuuuugcuugcacauugccaguuggaauuauauucauuauaauauauacauguuaauuuuagguucaugaaucucaagggucagauuccuccccugcugccaguucaggcuaugaaucuuccacuccacccgcuauagcuucugcaaacaguaaagauaccacuaaaaccccuucugcaguucaaacuagcaccagccacaacccuggacuuccuccuaauuuuaacgaaugguacgucugaggacaaacacaaacccuguuaauuauagaauggaccaaauacauuuuuaaaagaaaacugagaccaaucagauggaaauggaguuuuaaggcaagaggccauauauagggcuacaucuuguuaauugcaauuguccaggaagguuuugggcaagauccaaaaguagccaugcccuuuucucaggauagaaaauauguuuuggcauuugaagcauuuuuuacaaaaucuuuacacuacuuuuucuuccccuuccucuugcucucugcacaccccauucuuaaacuccuccaauucauuuuaacacuuguccuguuucuugagaggaaguuauagaaggcuuguuggugguggugauguuaaacugauggaaauucuuuuucgccuuaguggugauuguuuaaacucucacagucuuaaaccgugccaaaguccuguuaugucuugaacuuuuccucaaagcauuacacuugugaauguauuuuugucuaauagggucgaaacuguuguucaguauuuuuucaggcugaggaugugauguuacucuacacauugugacguuuaguauacaguugccuuuuguaauaacuuuuuuuuuguaaauacauauccauugaugccauauuuaucguuuguaauuuaauuauugcuacaagugccgggaacugaacaauauuuauggauaaauguuuucuaacaaauucuguacagcuuuugauuauaacugcuuuagcauuaaaaauuguuuugaaagaagaacacaauuuacaauuuuggaaccacugacuccuuucucuuguuuuguaacagccuucuucuacaaagaggagaugugagcaaauuaaaucuuguuuguugguauuuauaacucacucagaucccuuuuuuaauuguuaaauuauuuuucuauuacaguauaaauuccuuacagugucaguuuccaucugggaagacucuccuuucuuuaucucuaucucagaugguuguuuaacugcgaguuuaaauguguuuguccuggauuuucggcaugcaaaucaaauauuacugaucaauucaguuaguggccaugacaucucaaucuuguacuucaaagacugagaagcuggauuuaaucaucccugcccuacauauauaaacauaagguaaccuacugaauuuuaugucccuuaguucuuuauuaccuuacauaaaaaugaaaauugcggcaggaugcaugucugucuguucuaucuagagaucacccauauaccuauauauguuuguaucuaugacuuaucuaaucugccuaucaaucuaucuaguagcuaucuauauauuuucaaaagauagcuuaugucuaaaacaguggugaugaguaaggccaguugagcauugcuuacuuaugguuaaagugcuucuuaaaagaaccauaguccauuuacaauuuuggaaggcaaaggcugauuuguuugcuguauauaguucaauucauaauuaucgcaauuauccauaacauuuauauagcgguguaauaacugcagcaguucugaaaugaugcuaugggaaaaaaauugcaaaauauguauuuuuaaaguucaugauuuguaggcaaagauguuaagagcauuguuuccauuaaaaucaauaacaaugaaaaacgguuguuugcuuugugauaaaauguuaacaauccauuuaaucuucagugaagcaacucauuuggacaaacaguucuuuuacagugguuauauggaaaagaaauugauugcuauuuuggggggcuggaguggguagaguauugagaccuuuuuuauuagggugcuguuuguuauugagagcccaaucucugcaugaauaacagaaagguggacauaaggaauuguaaaguauuuagaauguauugaauaggcuuaaguaccuccuuuaaggggcaaugcucuagguuuuugguggcagucaauuugguauuauauaugaucauuuucaauucuagaauuuuguuuauuguucuuuuugaagaaauaaagucuuggcacaucuuauuuauguuauaacauuuuuguauuuggugccugauuuuuuuucauguucaaauaaaucaaucuaaaauugaaaugcuuacagaacuucugaugauuaaaagaaacuuugauucugugaaugcgguugaagcagucuauuuaaguuaucuacugaucuuugucaacagacaauuaguuauugacaguuucuaauugcaaauugcuuuggaggcuauuuuuuguuaguggagaauaauggggucuuuugcauuuucuuccaccaauauccaagccugaaugccaugaacagagauugggaugacuacacaugugaugagcagguaaccuggucagucuaucacucccaacccagacauuccgaucuugaccuugacauugagggugcuggaccagauuccuauuucaggcuuuuuccuucaccucaaaccagagaccauuuuaaaugcucagcaaguucucagaaaguauauauucauaagacuggcucuaaguguguuccauugugaaaucuaaauaguguauuuuucuucugaacuguacaaugaacuuccauaauuuaccacuuucuccaugaguucccucccccacccucaaucuaaccuaacuuuacguggaaguagagccauggguuggauacaggauucaaccaaaaaccugccucccuuucaauuaaauguauuaaauaucuccugagacaaagagcaguuugaucuuuucuuaguuaccugaaauuauucuaccauaaaauuuuacaggaaaguacuugaggguccuaagaggggaagauaucaauuaaaugaaaaacaauuaugauaaccaauauuaggagaauauaaaaguuuugccccuguacaugauuaccucuaauuuggguguagcaugguauuucucaaaaucacguccuccacccuugucaucugugguaaagaaaacuccuuauuuugauagaaagcuuuucacagauuuccccccuauaaucuggcucugggagugcacauuuacacucuugaauauucaguaaacaaccuuagagaguaaguaccccccccaaaaaaaaaaaaaaaaaaaaaaaccaaacaaaccaaaaucaucaaugcucaagcccgaggcaugggccaggcucuuaggaaucaacuuguuacuuucccucuugcaccuuguaagaucuuuguucaaagucccuuuuucaaaaugagugauuuugcauaagauucccacuguuaggcaaaagggagguggcuauuuccacgcaagacagaaguuuggccuucauccagcuuuagaagguuaaagaucaggacaggguccacgcuaagcaggccggucgaucuaaauuacuaaaguuggacaugagugagcaaagaccuccgcucacaaagcaucccaggaaaguuggaguguucaggacuuccucgcuccucccccuucucccuucuccccgccugaugucucugccucuucgcccuggcucucucucccccuucuuaaaaaacucccuaaaacagaggagcaaagucgaagggccucuuaacauguaaguuuguggaagaaucgccagcagcgugcccaucgccugaaaagagagguuaucuuggcaccuagacugcuuuccucucacagguuucugucccucgagucccaagccuccaguggauccuuggccggggccggggcggaggcggcgaggccaggcguuucggaagucggggcuccagcucagcuguccucgggccccucgucggggcucccagggucccuguccacacaccaaguucuugcaagucucugucgaggcucgggcggggggggaagggaccucauuuccuagggucaauucucucgcggucucugcccgcugacccuuugaccuccaccuacagggcccuuggcggccguaagccggcggucgcccgggcuccgaggacgcuucgcgccccaucgccucccagccucauuaggccggcggggcuguaaagcaggaaucagccucugccuaauccggaccuggggucaauacgagcccaaacaauggugagcuccgaaggccacugcguagcgcuggccgcaaacuuuguguucaauucaauuuucuaaagcgguggggguugggggcagggaggcauucguccacccgaaagccgcuugcggcucccggggcucaucagcgaacguccucucucgcucggccccuccagccuuuucgcagcgccugggauagagggggcggcgaggccuggggacugguugucggcccgcgcgggugcccaggggcuggcgcaaaaggggccgcccccgugccgggaacagacuuugaaguggguuuuuagcgcgcacgugugagagccgggccagggccggagcggggacccgcugggaggaaagaggaggcuccggccggggccccaaccccucccccgcuuccccguggcuccggccuuuucaagccgcggccgggggcccguaggccucccacacccacccccacucccgcgcccugcccgcgccgcgcgcaggcgcacacuucgcagccgucgagucggauuuugcagcgaggggguuggggauagaguugaaagccgcuuugcagugccgcggccucggucgagcugggagggaggggaggggagguaugugggaaggggggcugguuuuggggcggcucucgagucgugaacauggcggccggaugcgaacccccgcggagcgcagcaaagcgcagcaaaggcugcagaacuguugcguaguuuaaacucccuuguuauuccucaguucugggcgccucgcgggggaauguaggucguggcgguugagcgcaaaauuguuaaaaaaacggaagcgaagaaguucuuccugggcauucuccugggaaguuggcgugugcuuuuuggguuugggguucccaugggacuuggacaaaaaacccgccagaggccuccccacccaccuggcccgaccuaaaacgcccccuccgggagcugccauggcuaggggaugccauuucgaguuaucaggccccggucgggauuccacagaaccuugagucccuaaaaaugccccaagagcggacaguauguucucuuccaggacaguggcgaagccuaugaacacguaagcaccauuuuccaagaaaaugccccggcuguuagacaaaugugccauugcgaguucgaccccuacacguugcccaggcuccguuuucuguauaucucauuuaaacgugagccuaugaaaauuggcacuguagcuuuggugugugccuuaacagcuggugaucuuauguuaaggggaaaaaaggccagaauuccgaaaacuuuaauucagcuuuugcuuaacugccuuaaugcuggcguugaaagaaccccugguagcucugggaucucgagcucguguuuuguccguagaaaaaugcuucggauucaccuucagaugugucuuuugugaggaaaaaaaaaauguaagauuuuaaaaaguguaguaauugaaccucagcuccucuaggaaaauaagcggcacgaacucuuccagguugggucuucguggagaccaacggccaaacggaaaagucagcccucuugggguuguccagugucacgcauuugggcuccugaagguguggggcaguucccgugggccaccuugggaagggccccaggugggugggcaggucauuagcaaggcuggcccagaucuggggggaaaucugcaaaacagugccuuuaucugcagagaacaauugaugggguugucuuuccuccuuuucagugcacaaagaagacggcuuuggagcaagaauuuggaauaugcauuuaaguugucgugcuuugcauuggaaacccaugggcaauuaaaauaagcaugcccuguaguauuuucuguccuuuucuuaugugugauuccugcaagucaaaggaggccggagccucuucaguaguuuggaaacuuguuuugaaauugccaccaagccgauuuuuuuuuuuuuuucugugggugaaguuuccuuccccgguucacucacucccccauuccccacccccucgcuggaauagaguauugacaucuuugagagaucaaaggaaguaaauggugcuugcuguauacucuauuuuuccauucuguagugugaacccugagguuugagcuuuuuucugguuaaaucucuugguaccaaaaguguggaaaauaaaaaguucauuaaguuaaaaaagcuuuagccaaugguuagacggguuugucccuuuaagagcuacagagcccagaucgucucuuaaauugacuuuaaagucgagcuaagaugcauugguggacuguuuccccuggauaccugcgguguucuuugggucauuugacaugguaaaacugguugauuuuuauagaaguuaugugaauggaauuucugcaaaaccgggcaagugauaaauugguagagcucuuguauuuguuuggaugacgacuccaaaggguacugcuuuuuuaccgagguuugauucugucauaaccauugaaauuuacagcuuggaaaacacuaaguuugcuggaagcauuuaaaccagggaauguucagagcacuuggacuaaugguaacuuuuaacagacgaacauaaauccuuugaauauuagagaaacuuguuucaaaaaaucuguugaaacugaagaaaaucucuuucauuaacauuuaacaaaccaagcaguuuuguauauuuuuaaucugaugacaguucaaccuauuuacacaucugaugaauggagagaaauguaagcuuuauaguaacuauaauaauagcuuucaccagauggcaaauuauaauauuugaucucuaauagggugugugucuugugucauauauuuuauuaaaauacaaccugcgucaagaccauuugaauuugagguguuaaaaauaaaacauuccaucguguuuuauuauaaaccagaguuuaaaacaacauauucaugugacauuuuaugacauucuuuucuaagaggaaauguggccuguuuugaccuaucugcaguucacuuuuuguuuuuuugccaguguuguccugcuugguauccgggacagucucuaauuccugacgaagaacuugauacugacguugguaugcagcagccagcccuccauaacacuaccuauccuaaaugcaggguuaaugccgaaccuacugugcaagaaaugauuuacugaugagguuucaaagaaaaccacaucaauuuggaugucuguuaccuugaagugaucauuuuaagaguaguagcuucuucccuagguauaaaaagacuauuuucuucuuuugguguauuucauccuguguugagcaaucauuugugaaaugaaaaagcaaaaaaacuccccccacuuuaggauuuauaaaugggaagauggaggugaagacuggccuaauucauaacccaguaugcauuaucucaugcauuguguugaccuuggugaaaaucuuuuucaaauaccagcauucuauauguagaacuaaaguguuuaaaacuagaaacaugaauuguuguuuuguuaauuuuauguuuguguucagaaagcaauacccaggaucccuuuaauuuuuguuugacuuaaauaaaaccauuuaaauuau

SEQ ID NO: 18997 - RNA, 21064 nt, Homo sapiens
auaauuuaaaugguuuuauuuaagucaaacaaaaauuaaagggauccuggguauugcuuucugaacacaaacauaaaauuaacaaaacaacaauucauguuucuaguuuuaaacacuuuaguucuacauauagaaugcugguauuugaaaaagauuuucaccaaggucaacacaaugcaugagauaaugcauacuggguuaugaauuaggccagucuucaccuccaucuucccauuuauaaauccuaaaguggggggaguuuuuuugcuuuuucauuucacaaaugauugcucaacacaggaugaaauacaccaaaagaagaaaauagucuuuuuauaccuagggaagaagcuacuacucuuaaaaugaucacuucaagguaacagacauccaaauugaugugguuuucuuugaaaccucaucaguaaaucauuucuugcacaguagguucggcauuaacccugcauuuaggauagguaguguuauggagggcuggcugcugcauaccaacgucaguaucaaguucuucgucaggaauuagagacugucccggauaccaagcaggacaacacuggcaaaaaaacaaaaagugaacugcagauaggucaaaacaggccacauuuccucuuagaaaagaaugucauaaaaugucacaugaauauguuguuuuaaacucugguuuauaauaaaacacgauggaauguuuuauuuuuaacaccucaaauucaaauggucuugacgcagguuguauuuuaauaaaauauaugacacaagacacacacccuauuagagaucaaauauuauaauuugccaucuggugaaagcuauuauuauaguuacuauaaagcuuacauuucucuccauucaucagauguguaaauagguugaacugucaucagauuaaaaauauacaaaacugcuugguuuguuaaauguuaaugaaagagauuuucuucaguuucaacagauuuuuugaaacaaguuucucuaauauucaaaggauuuauguucgucuguuaaaaguuaccauuaguccaagugcucugaacauucccugguuuaaaugcuuccagcaaacuuaguguuuuccaagcuguaaauuucaaugguuaugacagaaucaaaccucgguaaaaaagcaguacccuuuggagucgucauccaaacaaauacaagagcucuaccaauuuaucacuugcccgguuuugcagaaauuccauucacauaacuucuauaaaaaucaaccaguuuuaccaugucaaaugacccaaagaacaccgcagguauccaggggaaacaguccaccaaugcaucuuagcucgacuuuaaagucaauuuaagagacgaucugggcucuguagcucuuaaagggacaaacccgucuaaccauuggcuaaagcuuuuuuaacuuaaugaacuuuuuauuuuccacacuuuugguaccaagagauuuaaccagaaaaaagcucaaaccucaggguucacacuacagaauggaaaaauagaguauacagcaagcaccauuuacuuccuuugaucucucaaagaugucaauacucuauuccagcgaggggguggggaaugggggagugagugaaccggggaaggaaacuucacccacagaaaaaaaaaaaaaaaucggcuugguggcaauuucaaaacaaguuuccaaacuacugaagaggcuccggccuccuuugacuugcaggaaucacacauaagaaaaggacagaaaauacuacagggcaugcuuauuuuaauugcccauggguuuccaaugcaaagcacgacaacuuaaaugcauauuccaaauucuugcuccaaagccgucuucuuugugcacugaaaaggaggaaagacaaccccaucaauuguucucugcagauaaaggcacuguuuugcagauuuccccccagaucugggccagccuugcuaaugaccugcccacccaccuggggcccuucccaagguggcccacgggaacugccccacaccuucaggagcccaaaugcgugacacuggacaaccccaagagggcugacuuuuccguuuggccguuggucuccacgaagacccaaccuggaagaguucgugccgcuuauuuuccuagaggagcugagguucaauuacuacacuuuuuaaaaucuuacauuuuuuuuuuccucacaaaagacacaucugaaggugaauccgaagcauuuuucuacggacaaaacacgagcucgagaucccagagcuaccagggguucuuucaacgccagcauuaaggcaguuaagcaaaagcugaauuaaaguuuucggaauucuggccuuuuuuccccuuaacauaagaucaccagcuguuaaggcacacaccaaagcuacagugccaauuuucauaggcucacguuuaaaugagauauacagaaaacggagccugggcaacguguaggggucgaacucgcaauggcacauuugucuaacagccggggcauuuucuuggaaaauggugcuuacguguucauaggcuucgccacuguccuggaagagaacauacuguccgcucuuggggcauuuuuagggacucaagguucuguggaaucccgaccggggccugauaacucgaaauggcauccccuagccauggcagcucccggagggggcguuuuaggucgggccagguggguggggaggccucuggcggguuuuuuguccaagucccaugggaaccccaaacccaaaaagcacacgccaacuucccaggagaaugcccaggaagaacuucuucgcuuccguuuuuuuaacaauuuugcgcucaaccgccacgaccuacauucccccgcgaggcgcccagaacugaggaauaacaagggaguuuaaacuacgcaacaguucugcagccuuugcugcgcuuugcugcgcuccgcggggguucgcauccggccgccauguucacgacucgagagccgccccaaaaccagccccccuucccacauaccuccccuccccucccucccagcucgaccgaggccgcggcacugcaaagcggcuuucaacucuauccccaacccccucgcugcaaaauccgacucgacggcugcgaagugugcgccugcgcgcggcgcgggcagggcgcgggagugggggugggugugggaggccuacgggcccccggccgcggcuugaaaaggccggagccacggggaagcgggggagggguuggggccccggccggagccuccucuuuccucccagcggguccccgcuccggcccuggcccggcucucacacgugcgcgcuaaaaacccacuucaaagucuguucccggcacgggggcggccccuuuugcgccagccccugggcacccgcgcgggccgacaaccaguccccaggccucgccgcccccucuaucccaggcgcugcgaaaaggcuggaggggccgagcgagagaggacguucgcugaugagccccgggagccgcaagcggcuuucggguggacgaaugccucccugcccccaacccccaccgcuuuagaaaauugaauugaacacaaaguuugcggccagcgcuacgcaguggccuucggagcucaccauuguuugggcucguauugaccccagguccggauuaggcagaggcugauuccugcuuuacagccccgccggccuaaugaggcugggaggcgauggggcgcgaagcguccucggagcccgggcgaccgccggcuuacggccgccaagggcccuguagguggaggucaaagggucagcgggcagagaccgcgagagaauugacccuaggaaaugaggucccuuccccccccgcccgagccucgacagagacuugcaagaacuugguguguggacagggacccugggagccccgacgaggggcccgaggacagcugagcuggagccccgacuuccgaaacgccuggccucgccgccuccgccccggccccggccaaggauccacuggaggcuugggacucgagggacagaaaccugugagaggaaagcagucuaggugccaagauaaccucucuuuucaggcgaugggcacgcugcuggcgauucuuccacaaacuuacauguuaagaggcccuucgacuuugcuccucuguuuuagggaguuuuuuaagaagggggagagagagccagggcgaagaggcagagacaucaggcggggagaagggagaagggggaggagcgaggaaguccugaacacuccaacuuuccugggaugcuuugugagcggaggucuuugcucacucauguccaacuuuaguaauuuagaucgaccggccugcuuagcguggacccuguccugaucuuuaaccuucuaaagcuggaugaaggccaaacuucugucuugcguggaaauagccaccucccuuuugccuaacagugggaaucuuaugcaaaaucacucauuuugaaaaagggacuuugaacaaagaucuuacaaggugcaagagggaaaguaacaaguugauuccuaagagccuggcccaugccucgggcuugagcauugaugauuuugguuuguuugguuuuuuuuuuuuuuuuuuuuuuugggggggguacuuacucucuaagguuguuuacugaauauucaagaguguaaaugugcacucccagagccagauuauaggggggaaaucugugaaaagcuuucuaucaaaauaaggaguuuucuuuaccacagaugacaaggguggaggacgugauuuugagaaauaccaugcuacacccaaauuagagguaaucauguacaggggcaaaacuuuuauauucuccuaauauugguuaucauaauuguuuuucauuuaauugauaucuuccccucuuaggacccucaaguacuuuccuguaaaauuuuaugguagaauaauuucagguaacuaagaaaagaucaaacugcucuuugucucaggagauauuuaauacauuuaauugaaagggaggcagguuuuugguugaauccuguauccaacccauggcucuacuuccacguaaaguuagguuagauugagggugggggagggaacucauggagaaagugguaaauuauggaaguucauuguacaguucagaagaaaaauacacuauuuagauuucacaauggaacacacuuagagccagucuuaugaauauauacuuucugagaacuugcugagcauuuaaaauggucucugguuugaggugaaggaaaaagccugaaauaggaaucugguccagcacccucaaugucaaggucaagaucggaaugucuggguugggagugauagacugaccagguuaccugcucaucacauguguagucaucccaaucucuguucauggcauucaggcuuggauauugguggaagaaaaugcaaaagaccccauuauucuccacuaacaaaaaauagccuccaaagcaauuugcaauuagaaacugucaauaacuaauugucuguugacaaagaucaguagauaacuuaaauagacugcuucaaccgcauucacagaaucaaaguuucuuuuaaucaucagaaguucuguaagcauuucaauuuuagauugauuuauuugaacaugaaaaaaaaucaggcaccaaauacaaaaauguuauaacauaaauaagaugugccaagacuuuauuucuucaaaaagaacaauaaacaaaauucuagaauugaaaaugaucauauauaauaccaaauugacugccaccaaaaaccuagagcauugccccuuaaaggagguacuuaagccuauucaauacauucuaaauacuuuacaauuccuuauguccaccuuucuguuauucaugcagagauugggcucucaauaacaaacagcacccuaauaaaaaaggucucaauacucuacccacuccagccccccaaaauagcaaucaauuucuuuuccauauaaccacuguaaaagaacuguuuguccaaaugaguugcuucacugaagauuaaauggauuguuaacauuuuaucacaaagcaaacaaccguuuuucauuguuauugauuuuaauggaaacaaugcucuuaacaucuuugccuacaaaucaugaacuuuaaaaauacauauuuugcaauuuuuuucccauagcaucauuucagaacugcugcaguuauuacaccgcuauauaaauguuauggauaauugcgauaauuaugaauugaacuauauacagcaaacaaaucagccuuugccuuccaaaauuguaaauggacuaugguucuuuuaagaagcacuuuaaccauaaguaagcaaugcucaacuggccuuacucaucaccacuguuuuagacauaagcuaucuuuugaaaauauauagauagcuacuagauagauugauaggcagauuagauaagucauagauacaaacauauauagguauaugggugaucucuagauagaacagacagacaugcauccugccgcaauuuucauuuuuauguaagguaauaaagaacuaagggacauaaaauucaguagguuaccuuauguuuauauauguagggcagggaugauuaaauccagcuucucagucuuugaaguacaagauugagaugucauggccacuaacugaauugaucaguaauauuugauuugcaugccgaaaauccaggacaaacacauuuaaacucgcaguuaaacaaccaucugagauagagauaaagaaaggagagucuucccagauggaaacugacacuguaaggaauuuauacuguaauagaaaaauaauuuaacaauuaaaaaagggaucugagugaguuauaaauaccaacaaacaagauuuaauuugcucacaucuccucuuuguagaagaaggcuguuacaaaacaagagaaaggagucagugguuccaaaauuguaaauuguguucuucuuucaaaacaauuuuuaaugcuaaagcaguuauaaucaaaagcuguacagaauuuguuagaaaacauuuauccauaaauauuguucaguucccggcacuuguagcaauaauuaaauuacaaacgauaaauauggcaucaauggauauguauuuacaaaaaaaaaguuauuacaaaaggcaacuguauacuaaacgucacaauguguagaguaacaucacauccucagccugaaaaaauacugaacaacaguuucgacccuauuagacaaaaauacauucacaaguguaaugcuuugaggaaaaguucaagacauaacaggacuuuggcacgguuuaagacugugagaguuuaaacaaucaccacuaaggcgaaaaagaauuuccaucaguuuaacaucaccaccaccaacaagccuucuauaacuuccucucaagaaacaggacaaguguuaaaaugaauuggaggaguuuaagaauggggugugcagagagcaagaggaaggggaagaaaaaguaguguaaagauuuuguaaaaaaugcuucaaaugccaaaacauauuuucuauccugagaaaagggcauggcuacuuuuggaucuugcccaaaaccuuccuggacaauugcaauuaacaagauguagcccuauauauggccucuugccuuaaaacuccauuuccaucugauuggucucaguuuucuuuuaaaaauguauuugguccauucuauaauuaacaggguuuguguuuguccucagacguaccauucguuaaaauuaggaggaaguccaggguuguggcuggugcuaguuugaacugcagaagggguuuuagugguaucuuuacuguuugcagaagcuauagcggguggaguggaagauucauagccugaacuggcagcaggggaggaaucugacccuugagauucaugaaccuaaaauuaacauguauauauuauaaugaauauaauuccaacuggcaaugugcaagcaaaaacaagagcagaauucgagcacuguaacaacaagaccgcccagugacccacuuaaaagaaaaaugcugcuuaaaaaaaauccguauuaccgaugucuagaaaacccggagauguucgccaaaaaccaguuuugcuccuaagacugguguuacggaaaaggaauaaagcauuccguuuuggucaugccacuucaaaaaugcuuucuccgcggauggagugagguaagcaguacacugugagguccuauaaaauacuaacuccgggcccagguuucaccaagcccguuucggcuugagaaagcagguacagagaagguggcacaggggcccugagcgcugcgaagucgcagacaaaugugugggaaucagauugcacuccucggcccuauuguuuuauccgaagccaaagagcgaaugaaccacccacccucggguucggcgcggcuacucucgguucccaccgcgggcugagucgggaagaggcggccacggcagccccgcaagcccaggcgagcucggcuagagcuucccaguaaacaaccgauuguucccuccgcuuccucccccucccaacuuugcucacucccgcccacccccucacccccacccccgcccgguccccaaaauggguucaaggugucacugcuggagcaaaucggauuuaacguggaagacagaggguuggcagcgcgggcgcuuccguuccgcggcccggcgucgggccgaguguuuacaaaccgccgaccgcuaauaaagagguaauuaccuucauguguuugcgcagggagcucgggugcguguaggacuugucgcacacuuugcagauauagggcuuguccgagguaugcacaugcaugugcuucuuacggucgcugcuguuggcaaagcgucugucacagccuucaaauucacauuugaaagguuucucaccugcaaaaggcaaaaacccaagggggguaaaauacggucagcgccggaguuucucagaggcaagcagcaggagacugagcucccggcggucuucccggaaagggagcgcggacugggggcugcugcugcaucuauuuucccuggagagaaaugaagagcguagguugagcccgcuggguuugggagugguggucgggguggggguggggguggggcggggccggcccaaaaccugaccaugucuuuguucuugcaaggagggaaagccccuggcuccuccgaaguuuccccuaaguuguguuuccacccuacccgacccagggcucccaaugcgcggccacguuccgccaccaccucagcaauguaaccgagcccggcgggacaaugggccccggacaggacaaucccguucagccucuuuguaccuuuuuauuugccucuuucaaaugcagcgguuuggcuaagcccgauauuaaaaagccuggguagucguaguuaauguuugaggaaaaaaauauagauagauagauagauagauagauagauagauagauagauagaucgaucgauccagggggcuccagacaguuuuacaagauguucugaacaaaccacgaaacugcuuuagcuuuccucccggaggacugaauugaaccuggaacuccaaauaaaaauaguuugacaaaaguaucagucauuuaauuaggagaugugccaaucaaguguaaaaaaaagcggaaguaaccgaaaguuaguuuucauuagcauuuguaugguugccuuccacgaaugugugccgagagcuaagucgcuuguaagcaauaugcucucaacacauucggagucccuucacgguaacccagaaagggagacaaaaagaggcggcgccaguuuguuccugggcgcgagaaggucccaauuaguuccugagaccgcagagcagucugcccgggaaguuagaacucggcaaaggcgccacgggacggggagggcuagggguggauggucacugacagcgcuucuuuuucgagcggccguugcggggcgucgccccuuucccuggccgccaccucucucccucgcgcucuaaguccgcugcgugacgggguaucgccaguggaacccacgcccgccugcuuuuuucccuuaccuguguggguccucuuguggaucuugagguucucagaacgggcaaagaucuucccgcagcccgggaaggggcaugggaagggcuucucgcccgugugcacucggaugugguugaccaguuuguacuucgccuugaaagacuugcccucccgggggcacuccucccaguagcagacgugguuguucugcuccgggccccccacaugcuccauggugacaugugucaccagcucaugcauggugcugaagguccggucgcagcucuucuugggccggcucagcugagccucgucgauccacuugcacgacagcuccugcuugauaggcugccgcauauaacggaagaaggcgccgggcccguggugggccgccacguucacucccauguucauguucauggggcuguaguuaggaaacugagcgccggccgcguagggguccgugcgcgggcuggccacugggcgguaugggucagcacggccgaacagcuccccacgcagccccagguggaccugguuguuguccacgugcccugugggcgacgggugcccagcgcccugcucaugcagcccgggaaacagcaaguagcuagggggcucggggaugccagcuggagcaugcaggcugcucgccgagccggcgaagagcccgugcugcccgccacccgaggccgccucacugagcccggagcugcgcuggcggaacagaaacucgcgcguugaguugaaggcggcagaggcagcgccaccguagcugggcaccuggcugguguggugaugauggugauggugguggugaugguggcccagggcguuggcguagcccgaacccugcggcgugaaagccgagcucuggccugaagauagaucgugcgccgcggcagggcucagcuugaaggcagcggcggcggcggcggcggcggcggcguggguugaguccccgaagggauucagccccaugccugccggcucacgguugggcaucucgugguggcgcggcgcgccgaagcugcccacucccagcccagggaacugcgggccuccguccaggagcaucgucaugggugggacguucugggcacaggcgauccggccgaagugagagaggguaccggcgaaggaggagaucuccgaagugccguagucggaaagggguggcggcgguuggacacugcggggagacccccaaggcgcuaccaggggcugcaacuuuccgucacugcaagagucuccugcagagggauaggagggaggaggggaagaaagagcagggaggggguguuggcggggggaggaggagggaggagaagggaggagaaaagacucggacuagaucugguuuaacaaacuaacaggcgcgcacaaagaaaaauaagcaaaauaguaaguggagggcggaguuugccaauccugucccgggcaccccuccucuccccgagugcacagaaccgcggggccaggaggcucccuggguaccggccuccgggcugggcugcgccaaguggcggagccggcuagcggccgggcaggcgggcagcgggcaguaggcaggcucguuacucgccgcuugccgcucgccgcgcgagucccagccucuucgccuccagaguaauguccuuggacugauaaagucaaucacucacuccucgcacauaaaccgagcgggaggccgcgaggcgcgcgccaauggggagccagcuggcccgcggucaccugaccuccggccggacugcccauuggccgccgcgaggcugauuggcagcgcggagcggagaacauggcagccgcggccgagcgacccccgcugauugggcagccgccgggugccuggcaggugaggcggcggcugccgggcggccgcgagugggcuccaccgggcuugaguggcugcggggaacuggggccaggcuccagccggcaaacggcgggacgccgccgggacucucgcgggcuuucccccaccccucgcgggcucuuugccccgcgaggaucggucccacugcugcgccgauggaggagacgcggcgcucaacguccaguccugcuugggcccccgcugccucaccaccuugagaacauguccccucuguagcugcagggcgcagauccuggggagagcgcagcaguuucgcgcucccgguccagccgcugcguccaccuccaaucacugcgaguucugauggccucgaggccgggacccaggccgggauaguucgccguuugugcccccaaccugucggcagcuguccgagacccaaaggagaagaaacgauuacaauuagagcugaucuccguuacuuccgucugcgccaagcguugacccuuuaguuugugagcagcggccguacucgccgcugcccacuucccgaauuacacaccgggcacgacacagcaaacauauacaacgcaguaaacccaagcacacaguaggaaacaagcacacaacacaguaaacacaagcgcaccacaggaaacaaacacgacauaugaaauacgcacacaacacaacaaaguaagcacauacaacacaguaacauaaacuacgcacaacacagcaaacacagaaacacaacuaaacacaacagagcaaauacacauaacagcgagcauacccacaaauacaaaacaugcaaagaacacuuuuagccaguguacgcaaaacaugcacacaacacacuaaacacauaauaaacacacuagacacacacaguaucagggugguuuccaaaucacuaggcuaaucagcuuugaauucucaacauuuucaaaugcaaaagucguguuggggguugcugaugcugaauggggacugugacauggaauuuucuuuccucugaacagccaaggcuuuacucucuucuacuccuacccggagaagguaaagcauguagugaccucagggacugcuuaccccuuaaggauuuacuuccaggggugugugugaaaguccucucgccuucugucuguugcaaggucuuucugacauaaugaccagguucagacaaggcuauaaauucacucauuuuuguguccugcaaggcauuugcaaagaaugcagaagagaguggaaagaaaaggcagagagaaagauggcugugauugucacaucccuagcugggccaagccccaaagucugcgccuugaggcagccucacagccuggccgccaucucucuguaggaaauagaacaucugaucaaguucagaggcgccaggagagaccgccuuaagcagcgcuuuauaacugcagccuuucacuuccugcuccccagucugccuggcccagccaacacuucaccuucuuucuuagccaguuugcugggagaacacccuaccgguagcacaucuuaccguauucacccccucccaucaaacucgccccaauucucucuccacauccagagcucucuccccagguuggaaggugaguucacugcugacuuaaauuauugcgucugccgaacauaggcucuccaagaaugguuucagugccucucagcagaggguuucuuuggggggguaggggggcgcugguguguucagagaacaaauaugcuuaaaucaugcaaaugaauccccuggagucagguuuacaaaaaaggaggauugccuuucuucccccccccccccccgccccaccuuucuuuucacuuucuccuuuauuuccucucuucccucuaccucucuucaccucccaccaaccccaaccgcccuuggcuaaguaguugguuugaaaaaguuuggauuuccucacugagcuggucccgcggacagcgguucucgagacuaggggaccgggaaggggcggcugucgagcucuggccgggccagcgcugaugcgagaguuuccggggagucccgccagguaccccgagaaucgagggccuugcgcgauugcaacugggugaagggcucagaaggggggcagccgagggagcucaucaugccccuauuugggaaggggucuugagcucaaggcagggggaaguugccgccgcugaccuacccggugcccaguguccguuuugauacggccacauuccgauaauuaauugccuccagcacgugcucuguagucccuggaacaaaaaggcauaauucaauuagaucaucaaccgagaaguggggaggugggggccggggggguggaugcuuguuaagggggcagaccugaggcgauucagccaggccaaaaucccgggcaauggagcccuucacgggacagccgggcccauccugagagugcgguucugagggggugucguuguucugugggacgcaggggucccagaugcgcgcaaaaggacgaggcugggggcuuugugaacagcaggucagaggcaggccauuucuaagucgguuucaguugguuugagugggaguuuccuuauuuggggagggggaccccugacccuuaaaagaggguagaaagcaaaaucccuccagauaaagcuaguuacugcacaugaaaacaaaguccccacccccaacaaagcaaaucacugcuguugggggggaaaaaucgcgaaguuuuucuuaugacuuagagcuucucuccuccccaaacuugauuuucaagaggagacucugggaacaacuucggggaacagggcgcuuuggggagcugagucugagaacagagugguggcagaagagggaaagcuaagaggagaaaaguuuuuccuacacacaggcagaggugaggggauggagacaacucucguguuuucguuuuucagguggagacaggagucacagcucuagucagggaggacaacucgaacccaggggucgugguucuauagcugaggcucccucagcagcuuuggcuuacuaggguuuacauguguaguaggcaacguaaauuaaccaauaaaucucuuuuauguguccccaaguuguauguggucgggucuaaauauccacauguuuguauggauaggaaauauaaugggauccuuucccucacacugaguucaaacgguaaauaggaaaaagauuuauuuuuaugcccaaaucuaaagcaguaaauaaaaucagaaaaacugaucacuucuaaaccagcaaagcuuuugagcccgauuuuuagaauccaucuugaagaagcaguagggaaacagaacguccugaggggcaguaggguaggaccggguucuuccuacaacccagagcccaacuccacagcacuuuucucuuccgucgaaccuccgaaaaacagaacauacacagcacauuguguuaucaugcagcauuucuuucuaaacacauuuuaugugguggacaugaaauuauccugauucggugaccuaguaauuuucuuuaaguucaagggaaacgcugcggucuuuucuucuguuuuguauuuagaaaagacuugcaaucuaacacucgcaacauuuuaaaggcccuuuaaacccagcaagcggauuuccguucugccaaggcuuccugauuuauuucaauaaaugaaucuuugaauccaggaagggaauuauuccaggacgcugaauuuggugccccugucucucccuaguggagcacaaaguguuucucauugcaacauguccuugaaacucaccauuauucgccuuuuuuccugguaaaugacacuuucuuuacauaaauccccacccucucuucagagucccagaucuuuuuaaaagaaaaacugcaaguggcaauaaaaaaugaagggggaagaaagcugggaaaagaaugcauuuuuaacuucucuuuauuuuuaugcuaagauaaagcacuuaauuggcaucaggggccaagcugaacuaucgaucuccaggacaugcugacacacuugccaaccaagugugucugcagguuggugagcguaaaaucacacagcuccagauuuuauuggccacaucagaauuuucacuaugguccuaucauuugacacauauuuuauaagcccuaaauaccuuuaaaauucaaucgagaauaaacagauauuguuaauuaacccccccccuuuuuuuuuugccuuuguccucugaaauacaaggcauauuguuacccaauguaaugaaaugcaaaccagacaggaaugagacauuuucauuguacuugucaaucagggcugugcagacagauauauauacuugaacuucagagacauaggcugaaguaaauagggcugaacuugaaggaggcaggcagggacuugaacuagaacuaucagaauccaguuuggaauuauaaagggagucccugaaauauagaaaaugcagugaaccaccccacccaagugguaggcagugguccucaggcaaaucugagugaaaggcuuaugacgagcuguggccugcuagguucugcugccauggaauaccuuuaccgcucugggggugacuagguguuagcccccagcugcacuagcaguggcuccaggugccaggagagcaagacacauugaaagaggacuucuuccuuccuucuagaucagaacaccuuguagguggggagugcccaggcaagagaagagggggaugcaggcagaggcugagauacacagugacacauuugauuuauguuuacagguccuuccccagacaccugaagagaugggggaaggagaaucaauuuggagagccaaguuugccugacauuuuggagcacacauuuacccaggaccccaaguuccuuguagcugcuaaaugcuguacuaguucuaaaauguaaauuagcuucaaggcaaguggagagaagccuuagacuauucugagauauuuguucauucauuucuuugcuuugagaaagaauccucccaacgugaugggaaagauaucucugggccacauuauggcuucuggcagcaacucucauccuuagugccuagaucuggagcccccaccaacccuuuguccccaaguuacauuuccuuaguccaggccuauuccaccauuucaucuucuuucucccuuccucgcugaggggcagaggccgccuuucuuuugcccaagcugagagggagaauuccugaucccuaggaaaaaugcugucuccacucccaaggaacuuuguguaguuuaggaauugcauuuuguaaaaucaaauugccuguugcaauuugcacuugguuugugguuauucaucuaguuauuuccuagugagggggugggaggaaagggcuuugacauuaaaacaaagcauagggccucccuuuccucccuuuuuucuuuccccaccaacaagauagagugggagugaauuagacuaacugcugguuuggacgugaauggcagacuauggucugcaaacuggaggccaaaucuggcccauagccuguuguauuuguauggccccaggagccaagaaugguuuuauuuuauuuuauuuuuaaaacaucuuuaaaggguuagagagcagaaguagaaaaagaaggacaaaaaagggggggaauuuaugcuacagauacugaaugugguuugaaaacccuaaaauaauauuuuauaucuggcccuuuacagaaaaaguuugccgaccccuggacuagggguuggacuguagugucagcagaggcuagguauucuugaccaguagauuuuauccaccaucacccuccuagauuuccagcuucauuuugcauauggcuugauuuuuuuucccccagccccacaucucaguuauuuuuggggauacuuuuggcuuuggagaaagggaaaaaguagucaagggaggaggagucucaggagaaagaagggaugagaagagaggaaaaagaguugugaauaucucaaucagugacuaggugaccucugacccugagggugguuuuauugucuuucuucuuuggcuagagauacacaguuuauugacccuuucugcgugacugagcccucaggggcaacgacagcuccaaaccaagccaggcaugugaggccaggaagccugagggaagugaccccaauucccuaggccugaggggguuggagggacagagagauggacucccucccaacucaacugccccuccucagugagggccuagcguucacccagcuccucuucuugcccagaaacgcuacccucccuuucuucccaggacaaaugccaucagcugguagacuugggcaaaacauuuaugcuccuucucugcacucuuccccuuuaaacuauaaagauauguuauuauaaagauuccagggugggccaggcaugguggcucacgccuguaaucccagcacauugggaggccuaggugaguggaucacuugaggucaggaguucaagaccagccuggccaacauggugaaaccgcaucucuaccaaaauacaaaaauuagcugggugugguggcaggcaccuguaaucccagcuaucaggaggcugaggcaggagaaucacuugaacccaggaggcggagguugcagugagcugagauggcgccacuacacuccagccugggcgacagagcaagacucccucuaaaauaaaaaaagauuccagggugcucccaacaacccagcuuacuaacuacuaccuuagcucauccccuuagguaugucuccccucuccuucaucuuuccuuccacuccggcccuaucaggaauuucucuauaaggcugcauaauccucaacccuugccccucagacucagcuuugguagauuacacuucaccuuuugaaccugguccagacuggcaaacaauucuuucagacccaaauagccacucacacaaguaauguugccaaauuuagcacaucaaaaacucaggacgcucaguuacauuugaauuucaaauaaacgauuuuuucuuaguuuaaguaugucccaguuauugccugggagauacuuauacuaaaauauucuuuauuggcaauucagauuuuauaggacauuauguaucuuauauggcacuccuacuuucaggaguauggucuagccaggcuaaauugucacacccaauggagcucucaccaaaguguagccugacuuugugccacuugccaaaguguuuuccaaaagcuccauuugugggaaagucaacuuggggacaggguggcccugaaggcccaagaaaagccccuggugaaauuucuguucuggcucagcgggccuguccuuucucaucaagaggcccaggagcuacccuggcuagauuguuaccacaggacuggcagcggggcgcuguucccaaacagugacuaauugugccugcuccuguccuagccccugaaggaaagccccuugugcuacucaccaugaguagcacagcagacauugaguacugcacacauugaguacuagcgugcuagggaccuuaagaucccacgcacugcaggccucaaagucccauucauugaccugauccuccugccaccccugcaggaccugagauggguguuugccuugcauauucuuuccuauuuugcucagguugugugagccugaggcccccuucccuuugcucucuaggguucaaguuucaccaagccuaaaaaauccuccucgccuugccgucccuugguccuucuuucucucauuuuaaugggucugucuucaagaacagaggagccugauuucagcaagaaugccccuaugggcccuugagggcuauaaacagguggaauccucagagccagagucuguggucccucugcuuagcccugcccucccaaccuggaugcacaaacuucaguccacacugggcugugcagaggccccucucgagccauccagggcuaaaggucaaguuuuccugaggaccaaggacagagugaagcagguuuuaucagcagacauccguucuccucuuccccuguuccccacccucaucacacauuccuccauggaaguucuuaucuaucuaccuauuaaaugaaagaggaaaaacacauggccuacaguguccuuuuccucacuccuaucaguacaaguuccaaaagcugaaccugucagcagcucaguggccucaaaaacauuccaggagaccccucuccccaucacugaaauacuccuuucccacuuuagaaaagcucauuaguucuuaccucuuaacucuuucuccuuuuuaaggugguuuuaggcucuaaguuuguuuggaggcaagggagccuccacugccuacuuaagcaaacugaaguuuuggguaguuuugguagcccauaaccacuaguuguagugcacaucuguacacacuugccuguuuuccugaguuucuuucuuucuuucuuucuuuuauuuauuuauuuauuuuuuuugagacagaguuucgcucuugucgcccaggcuggagcgcaauggcacaaucuuggcucacugcaaccuccgccuccuggguugaagcgauucuccugccucagccuccuaaguugcugggaauauaggcgcccaccaccacacccagcuaauuuuuguauuuuuaguagagaugagguuucacuguguuggccaggcuggucuccaacuccuagccucaggugaucgacccgccucggcaucccaaagugcugggauuacaggcgugagccaccgcgcccagcuccugaguuucuaauaugucccuggguauggaagggggcccauuuucuuuucuuuucuuuucuuuguuuuuauuuuguuuguuuguuuuguuguguguguguguguguguguguguuuuaaggauggaguuuugcucuugucacccaggcuggaaugcaguggugcuaucucaacucacugcaaccuccgccucccagguucaagugauucuccugccuuagccuccggaguagcugggauuacaggcgucugccaccacaccuggcuauuuuuuauuuuuuauuuuuuuuguauuuuuaguagagacgggguuucaccacguuugccaggcuggucucaaacuccugaccucaggugaucugccugccuuggccucccagcgugcugggauuacaggcgugagccacugugccuggcagaaggggacccauuuucuuaauacacacacuuaaaagcucuagcucccacaugauaucuuguuuuugugauucucaauuagagacuuauauugcaauauuuaguuucugcuauuaaauuucacauccccucccucaauuugagaggggggagagguugccugcccucugcuccagaagcaauugaguagaaccagaaacucuag

SEQ ID NO: 18998 - RNA, 8825 nt, Homo sapiens
ggcacaggagccaagccgccauggccuaccacagcuuccugguggagcccaucagcugccacgccuggaacaaggaccgcacccgugagugcuugcugggggccgguggguggcugcuuccaccuccugggauggggaccagccagagcacacauggggacucuggagcagccaggcccccggaccaugggcuccauguggcuguccccuggccucaccccugggucuuccagcugaccaggggccuccuggguuaaaguuuaaggagggaaugggccaguugcgguagcucaugccuguaaucccggcacuuugggaggcugagguggguggaucacuugaggucaggaguuccagaccagcuugggcaacauggugaaacccugucucuacuaaaaauacaaaaauuaccugggcgugguggugggugucuguaaucccagcuacucggggggcugaggcacgagaauugcuugaacccaggaggcggagguugcagugagucgagauugcaccacugcacuccagccugggcaacaaagcgagacucugucucaaaaaaaaaaaaagagagaaagaaagaaagaaaaagugaccaagaaaaagccuuucggaggagaugacauuuugacauuuacccagagacccagagggggagaggaagggaacugugccccagcuggggaggggcuggcaggugcaggggcccugaggugucagcaggagcagcgaaggguuccugguuggccagagcaauaggguggggagaggucccaggguucauugcugcgaguaaaggacagccaguuccaggagaagacaggguggccuagcagggccugaaggacuucagggggccccugcaaggcagaagaggagagacugagucaugaaaggugagguguuguugccuaggugcacuguguaguguguccuggcagagggcagucauggagagggccccucaaucucccuccaucuccccuucagagauugccaucugccccaacaaccaugaggugcauaucuaugaaaagagcggugccaaauggaccaaggugcacgagcucaaggagcacaacgggcaggugacagguaugucaggguggcugggaccaccguccugaaaggaggugguggguuggggggguggugcaaggcagggcauggccacucauuguggagcaucugcccacucaccgugaaacccggauucaaacuggcuucaauuuuaaggggacuguguuggcucauguuaccaaaaacucacaggguugagggcuucaggagaggcuugauccagcagcuccacaugaccaagaacccaucuuuucugccucuuggcuuugcccuccagcauguuugcugauagcauggagggcucugacacucccucauaagcucuaggagugcccccuggugucacucuaaauaagcacuggaucucaguaaaaagugcuugcugggccgggugcaguggcucaugccuguaaucccagcacuucaggaggccaaggcgaguggaucgcuugaggucaggaguucgagaccauccuggccaacaugacuaaauguugaaaaauacagaaauuagccgggugugguggcacgcaccuguagucccagauacucuggaggcugaggcagaagaaucgcuugaacccaggaggcggagguugaagugagcugagauugcaccacugcacuccagccuggauggcagagcgagacugugucgcaauaaaaacaaagaaagaaagaggccgggugcgguggcuugcgccuguacucccagcacuuugggaggcggaggcgggcggaucaccugaggucaggaguucaagaccagccuggucaacauggugaaaccucaucucuacuaaaauacaaaaauuagccaggcaugauggcgggugccuguaaucccagcuacuugggaggcugauaugugagaauugcuugaacccggaagauggugguuccagugagcugagaucgugccagugcacuccagcuugggcggcugagcgagacucugucucaaaaaaaaaaaaaaaaaaaaaagauuggugguacacaccuguagucccggcuacucaggaggcugaggcacgaggauugcuugaaccugggaggcagaggcugcagugagcugagaucaugccacugcacuccagccugggugacagagcgagacucuguuucaaaaaaaaaaaaaagugccugcugggcagauacagcuuccaccuggaugguggccuuucagccucucccauguggccaccauacagccaccucugccugagugucaucagccuccuguguucccuccauccccccacaggcaucgacugggcccccgagaguaaccguauugugaccugcggcacagaccgcaacgccuacguguggacgcugaagggccgcacauggaagcccacgcuggucauccugcggaucaaccgggcugcccgcugcgugcgcugggcccccaacgagaacaaguuugcugugggcagcggcucucgugugaucuccaucuguuauuucgagcaggagaaugacugguggguaccuaggcagggccagagugggcuguuagggaccgggggcaggacuagaguguccccgggaagcaccaaaugggaugucaggaccccuguucccaucacccugggggaguccauccucuccucucugggccucauucaugaggcaagggccucucugcagcguccggauguucucacugccagugacacccaccacaccagaaacacaucugggggcaccucacuaagcccugcacacacauuaguccugacuucccugcagcuccguggacugggcaucggucacuguccccacuuuacagauuagcaaaggcccuguagcagucacuuucucaaggcaccacucacgagcucgcagccacaucuuguuccuuuuuuuuuuuucagauggagucucacucugucacccaggcuggagugcaguggcacgaucuuggcucacggcagccucugccugccggguucgagcaguucucugccucagccucccaaguagcugggauuacaggcaccugcuaccaugcccggauaauuuuuauauuuuuaguagagaugggguuucaccaucuuggccagguuggucuagaacuucugaccucaugauccacccgccucggccucccaaaguguugggauuacaggcgugagccaccgugcccagccaauuuuuuuuuuuuuuuuuuuuuugagacacagucuugcucugucguccaggcuggagugcaguggcacaaucucagcucaccgcaaccucugccucccagguucaagcaauucuccugccucagccuacugaguagcugggacuacaggcacgcaccaccacgccaggcuaauuuuguauuuuuuaguagagaugggguuucuccauguuggucaggcuggucuugaacuccugaccucaggugguccuccugccuccgccucccaaagugcugggauuacaggcgugaaccacugcgcccggccauauauauauuuuugagacaaggucuugcucugucgcucaggcuggagugcaguguugugaucauagcucacugcagccucagccuccugagcucaaguaauccuaccacuucagccuccugaguagcucggacuacaggcccaaaucauuuauuuauuuauuuuguagagauagggucuugucacguuguccaggcuggucuugaacuccuggccucaagcaaucuucccaccucagccucccaaagugcugagacuacaggugugagccaugauugccaguccacgucuuaguuuuuaaucuccccugcauggcugagggcagaggccagccaggagcaucugagagacccaaauuugcaucccaccauggccaguuaguaguugugugaccucuggugauggcaucacuuugcugagccugcucugagggugacuguguggccuaaaggauagagggcacagaguucccacuccagaagcgacacagcacaucccugccgccccagggcccugacggccuugugggcuggcaaugcccagucgccucucuccugggucuuuggugggcugcagggagcagugggagccuggagucccuggugcugagguccaugagucccaccugccugucccucucucccugucugccugaccaccguucccagguggguuugcaagcacaucaagaagcccauccgcuccaccguccucagccuggacuggcaccccaacaaugugcugcuggcugccggcuccugugacuucaagugucggugagacagggcgccaugggggagggcggggcugacgucaacugacugcugacaucauagcggggagccgcaccugaaagcucuacaccccagcuucuagacacauuccagaccugcuaccaguggaugaccugggcgucgguugaagguucuaguuccuggggaacccuucaugucucagcuggaugggccucugcccaccucuuuuauuuuuuuugagcuaggggcuugcucuguugcccgggcuggaaugcaguagugcaaucauagcucacugcagccuccaaauccuggacucaagcgauccucuugcuucucagccucccaagcaagacuaccacgcccagcuagacaggauuuuuuuuuuuuuuuuggagacggacucucgcucuuucgcccaggcuggagugcaguggcgugauauugacucacugcaaccuccgccugcugaguucaagcgaucaagcgauucuccugccuuagccuccugaguagcuggaacuacaggcgcaugccaccaugcccggcuaauuuuuguauuuuuaaauguagagacggguuuucaccauguuggccagacuggucucgaaccccugacuucaagugaugcaucugccucagccucccaaagugcugggauuacaagcuucagccaccaugcccaggcaccuguuaacccuuuaaaaaaaauuuuuuuuuuuuuuugagacagucucacucuguugcccaaacuggagcacaguagcgcaaucacagcucacugcagccuugaccuccuggguucaagcaauccucccgccucagccuccugaguagcugagaguacaggugcgcaccaccaugccuggcuacuuuaccucuacuuugccuaucccgguaggaucuuuucagccuacaucaaggagguggaggaacggccggcacccaccccguggggcuccaagaugcccuuuggggaacugauguucgaauccagcaguagcugcggcuggguacauggcgucuguuucucagccagcgggagccgcguggccuggguaagccacgacagcaccgucugccuggcugaugccgacaagaagauggcgugagucgaggccauccccaggggaggaggugagugcagaggagugggacaccgugacucacagcucucuccccucagcgucgcgacucuggccucugaaacacuaccacugcuggcgcugaccuucaucacagacaacagccugguggcagcggugaggaauagggaggggagggaggguguguggucacagcaggccuccgagagagcccagcaacucucaucuccucccuccuuucuccugccucccuccuuuuuuucuuccuugcauucucucauguaccagaauugggcagaacagguuggguuaugcugcaguaaccaaaagucccuggcugcaguugcuuaacagaguaaagauuuggccaggugcgguggcucacacuuaaaaucccagcacuuugcgagguugagguggaaguaucacuggaggccacgaguuugagaccagcccgggcaacacagugugagacccuugucucuacaaaaaguuaagaaauuagcugggugugguggugcaccuguaaucucauaaucccaguuacuugggaggcugaggcaggaggauaacuuaagcaugggaggucgaggcuucugaacugagcuauggucguaccucugcacuucagccucggcgacacaaaaccugucucaaaaaaaaaaaaaaaagagccaggcccgguggcucacaccuguaaucccagcaauuugggaggccaaggagggcagaucaccugaggucagggguucaagaccaaccuggccaacauggcaaaaccccaucucuacuaaaaauacaaaaauuagccgggugugguggugggcgcccauggucccagcugcucgggaggcugaggcaggagaauugcuugaacccagaggcagaaguugcagugagccaagggugagccaccgagacuccaucucaaaaacagaaaaaaaaagauauuuacuucuugcucacauuuuauguccaguguggguguugugaggugcucugauggaagcuguccccagcaugcugucccagaugccacgagggagccggaaccugcggaaucaugcccugggucuuaacauuucugcccacauuuuauuggcaggugcaauggcaaggccacgccuaaugcaaagggcgagaguucggggugugcgguuccuccagguguccaggaagggcacugcucucccuccccuccgcccacaucugucaagucccuuuucaccccucugcaaacauaaugggggugccagggccaggucaggcuugcuuuuugccuagaaaagcaaacagcugcaggggucuccccuagagcagguguaacuggcugggcaggacagaaggcgccugagcucccagggagucccaacgcuggccuugcugggggagguggcagcccccagcaucacccccgguuuugauacaccugcaauucgggccucccucgcuguggcccgucuguauccuugagcuggcaucugccucccgggcggccagacgcccgccuggccuucccuccggccucgguuuccccuccgcggcgcuccaauggcccccgcccuccgcgcagggccacgacugcuucccggugcuguucaccuaugacgccgccgcggggaugcugagcuucggcgggcggcuggacguuccuaagcagagcucgcagcguggcuugacggcccgcgagcgcuuccagaaccuggacaagaaggcgagcuccgaggguggcacggcugcgggcgcgggccuagacucgcugcacaagaacagcgucaggugagagcgggagccgggccggcgggugggcggggccucggcucgcccagaaacagcgucgggugaggaaggggccuggagucuuccuccuggggcauugugcugggaccuugaggacuggggacccggagggaggguaggcgugcccucaacucgcugcgccggaacggcgucugaugagcggcgggcccggacacgaggggacggggccgauuugugggcggggccuuggcgccguacuaaaaccgcguggggcggaggccggcagaggucgcguagcgggcccaggguagggaguggcuuugacucgcugcggaauaacaucguuaguugugggcggggcccaucuugaucucaccauagcagcccaggugcuaguggagccugggagggacacggugcgaccgacauaagacggggucgaccucuuuagguugcauaaaaauagcaucagauggggcugagcagcuagccucgcucugcauuuccgggacuuagguggggacugucguagggcuggccccuacgguucucugggguggccaggcagugaccagcgggcuuccugggcggggucacagcuggggcgggucuauugcuagcacuuagcgaggugggggcggagcugagggucucuccgcagccuucuauggaucuagggugggauggggaagaggcucuucaaagcccaaaagcugccagccacacguguccaccccgcggcgaaucagagggagcgggagcuguauggcaagacuggccaagcccuucggucuguaaaaccuccuguguccgccagauccgauggcuuccucagaugaaacaccuuuguccagcuaucagcuuagucccuggcugcccccacccccaucuccuuuuuuguccuguccagcugcacugcuggcacuguguacacuccgcagacacacgugucuuuccugccucccaggacuugaguguccugucccauuugccugcaccucgcaugccacuguccccaaggcagaacugacuucuaagcccacuacacccccucgguacuucucacuaaagcccgcuccccaagaagucugggagcgccugguggacagggugggccugagcccagcgccagcacagguugaauucauaagcuccucuuccucuuugcagccagaucucggugcucagcggcggcaaggccaagugcucgcaguucugcaccacuggcauggauggcggcaugaguaucugggaugugaaggugaggcuugccccuccuggcuucccgccaugccucccaggucaacccuuuccccccauccccacucccuggagaugacccccauccuucacuccugcagagauggcacugcauggggaugaggggugggggcggccccuugacaucugggccuuggugcucacuggggcacccgucuucagggccgggauuccaacccagcugacagacuccaaaacugcagguucucugcccucugcugugcuggggcugagaugggugaucaggucccugggaguggggugccugcaggacagcugagaaccagccuguccguucugccucccugcagagcuuggagucagccuugaaggaccucaagaucaaaugaccugugaggaauauguugccuucauccuag

SEQ ID NO: 18999 - RNA, 3684 nt, Homo sapiens
gggcccagcuagagcccaggcagacugugaaugcgaccuguucgagagaacucaucaggugcgagaagcccgcggguuccugcugauuuggcgcggagcauuuugauaagccuacccuucccgccggacucgcuggcccacaggcccccaagcuccgcuccgacggagucccagggccuuuucaccguggccgcuccagccccgggagcgccuucuccucccgccacgcuggcgcaccuucuucccgccccggcaauguacagccuucuggagacugaacucaagaaccccguagggacacccacacaagcggcgggcaccggcggccccgcagccccgggaggcgcaggcaagaguagugcgaacgcagccggcggcgcgaacucgggcggcggcagcagcgguggugcgagcggagguggcggggguacagaccaggaccgugugaaacggcccaugaacgccuucaugguauggucccgcgggcagcggcgcaaaauggcccuggagaaccccaagaugcacaauucugagaucagcaagcgcuugggcgccgacuggaaacugcugaccgacgccgagaagcgaccauucaucgacgaggccaagcgacuucgcgccgugcacaugaaggaguauccggacuacaaguaccgaccgcgccgcaagaccaagacgcugcucaagaaagauaaguacucccugcccagcggccuccugccucccggugccgcggccgccgccgccgcugccgcggccgcagccgcugccgccagcaguccggugggcgugggccagcgccuggacacguacacgcacgugaacggcugggccaacggcgcguacucgcuggugcaggagcagcugggcuacgcgcagcccccgagcaugagcagcccgccgccgccgcccgcgcugccgccgaugcaccgcuacgacauggccggccugcaguacagcccaaugaugccgcccggcgcucagagcuacaugaacgucgcugccgcggccgccgccgccucgggcuacgggggcauggcgcccucagccacagcagccgcggccgccgccuacgggcagcagcccgccaccgccgcggccgcagcugcggccgcagccgccaugagccugggccccaugggcucgguagugaagucugagcccagcucgccgccgcccgccaucgcaucgcacucucagcgcgcgugccucggcgaccugcgcgacaugaucagcauguaccugccacccggcggggacgcggccgacgccgccucuccgcugcccggcggucgccugcacggcgugcaccagcacuaccagggcgccgggacugcagucaacggaacggugccgcugacccacaucugagcaccggccugcgcucguccacccuuguuccccacccccacccccacucccgccccgcacccccaaguugggacgccuuguuuagcuuugcuugccugggacuguugccuuguaccgaugauggggagggcugaaaguuuugcuguagcugucggguuuuguacaaaagcaaaaauaagucaggagcagcgaaaaugggacuucuagagagcucucuugccccacgccgcugcuccuuucaccuuuguaggcugggaaucgcuguguuauuugcaaagaaaaaacagcccccacuccuccuccugaguuccaggguuauucuguuacauuugaaaauguugucuuguuaguuugcaguuagccaaggagugaaugggagaaacauaguaucgggugaggccagcuggagaacugcaacgccuacgcccccagucgugucgcgucuguuuuccucgugguuuuuuggggcgcugaccgcuccaagcagcgcggcagcuaaagccaauguuaauuuauagccaggugugcgugugucucccgccucgccgccccuggccgcgggacagcuucuguccaaucauguugaguuggugauuucugccgugaucuguuugauauuucuucgcgcuaauguguucagauuucguuuggguaguggggaggggcuacuuuguuucaggguuuucaagcuuuuacucuuaauuccuaaaugagaucaauaaauuuuauaaccaacaugauggaguccugauaauuuugcggcccugaaacuuuuuugcagguuggggaggaaccaacacucgguuuuacaacugagaucccauccuaggggcggggugggaccuggggggaggcaagcauaaucugaaaugguuuccuuuuaacuacuggugauccaccauacaccagcuuccaauauucucaacugaaacucggaacagaguuccgagucuuccaggagcgucucccgagagcgggcacacaguaguagcuaaugcgcagagcccgcggccgcgcacuuguugaucgcagugagcgucugcugaaagugucugcugccgcagccacgcgaggcggggcuggaaaggcgcggccgcugaaaccgaccaaaaacggggcacuuuuaccuuugugcacuggggcgggaagacauuugagccuagcugaaauauuuacaaaacgaaaacccuucggaaaucucgaugauccuauuaaaaauaaaugguuacagggauccccagcaggaaacaaauacguuucaacccugguagcugaaccgccggagucaacauucagcgcuggaagauuugguauuaaaaaguacuccuuagauuuucaaagaucuccgaaacuccucccaggcguuuuguuuuuaacaugucaacucaguccaccuauuuguuuuccagagaaggcuccuuuucauccagagucucgagcccgcuuucuacuccaucccccuccccacuccaucccccuccccacuuuccuccagucccugacccuuggccauuccacugugccccccgaagggccuuuaguuucgcgcccagccacacggccccaguguaucuguuuggggccuaggaagaaaacaaauagaaccaguguuuuuuuacccccuccucagcuguuugaggugauuuccuuaaucccuuuaauccuguuaccucgcuaucccagaauaacuaaacucagccuuuccaauaagcuuggccuggugcacuguuuuuauccucauccacuacugaccacagguuucuuugcuugagguccgcugggacccuaggcgacagagucucccguaaauugguccgaauuccacauuuccagccggcuuccuuugugugggccagucauucaccugcgggccggggagggccugguggggggguggggagggggcuuucugaggcuucgggggucgugcccgcuuuuuacacaucacugcggauccuggagacuaaacccacuccgccucuucaagaaaggucgggucucccugggaaggcagcaccagcccccuaagacauuuccacugccaacccucaccccccgcauuccaucccccacugugcagcauggggugggagggggccggcguugauuuacagacccauacgcuuugcccuccacccaguccuccuccugguccugccgcgcguccaggcucggguucggguucagucuuagccuugguaccacucccccuucucccaaucccagggccacagaccucgccccccucccggcugguuggugcuucaauccuugcugcugugauuggagcaaaccugcaagcugccuggucag

SEQ ID NO: 19000 - RNA, 1024 nt, Homo sapiens
caugccucgagcuccaaagcgucagcgcugcaugccugaagaagaucuucaaucccaaagugagacacagggccucgagggugcacaggcuccccuggcuguggaggaggaugcuucaucauccacuuccaccagcuccucuuuuccauccucuuuucccuccuccuccucuuccuccuccuccuccugcuauccucuaauaccaagcaccccagaggagguuucugcugaugaugagacaccaaauccuccccagagugcucagauagccugcuccucccccucggucguugcuucccuuccauuagaucaaucugaugagggcuccagcagccaaaaggaggagaguccaagcacccuacagguccugccagacagugagucuuuacccagaagugagauagaugaaaaggugacugauuuggugcaguuucugcucuucaaguaucaaaugaaggagccgaucacaaaggcagaaauacuggagagugucauaagaaauuaugaagaccacuucccuuuguuguuuagugaagccuccgagugcaugcugcuggucuuuggcauugauguaaaggaaguggaucccacuggccacuccuuuguccuugucaccucccugggccucaccuaugaugggaugcugagugauguccagagcaugcccaagacuggcauucucauacuuauccuaagcauagucuucauagagggcuacugcaccccugaggaggucaucugggaagcacugaauaugauggggcuguaugaugggauggagcaccucauuuauggggagcccaggaagcugcucacccaagauugggugcaggaaaacuaccuggaguaccggcaggugccuggcagugauccugcacgguaugaguuucugugggguccaagggcucaugcugaaauuaggaagaugagucuccugaaauuuuuggccaagguaaaugggagugauccaagauccuucccacugugguaugaggaggcuuugaaagaugaggaagagagagcc

SEQ ID NO: 19001 - RNA, 8304 nt, Homo sapiens
gaagacauuaucaggaaggcucucaugggaagcuuugaugacaaaguugaggaucauggaguugucaugucccagccuaugggaguagugccugguacugccaacaccucaguugugaccaguggugagacacgaagagaggaaggggacccaucaccucauucagguacagcuuucauuuuagugcuuuucugcugcuuuuccccaaaaaagccaguuuauuucccaaauucugaugcaucacuaagacauuucauuuaugucuuuaugugcucagagucaccucuuaggguuuccguuacuuaaaaaagguuuuugaaaaccuacccagacauuauaauaugaacagaaauaaaauggaagaaaauuuuuacccaaagugucacccuccugggauguccauuuuuuauuuguuugcaccuaguccucaucuauacauacugcauuguaauuguaacacaaauauaauguuuuugaauaaaagugauuuaacuguaaaaauuaggcucaguagaaaagaaacauaagccagccgggugcggugguucacgccuguaaucccagcacuuuggggggcggaggcgggcggaucacaaggucaagagaucgagaccauccuggccaacauggugaaaccccaucucuacuaaaaauacaaaaauuagcugggcaugauggcgugugccuguaaucccagguacucaggaggcugaggcaggagaauugcuugaacccgagaggcggagguugcugugagcugagaucacaccacugcacuccagccuggaaacagagugagacuccgucucaaaauacauacauacacagacacacacaauaaaauaaaauaaucguaagccauaaaaaaagaguaggaaaaaagguguaaucauagcacuuugggaggguaaguuggguggaucacuugagcucaggaguuugagaccagccugggcaacaugaugaaaaccccgucucuacaaaaauuacaaaaauuagcugggugugguggcucacgcuguagucccaguuacuugugggggccgaggugggaagaucacuugagcccaggaggcagagguugcagugagcugcaauugcaccacugcacuccagcccaggugacaaagugagacccugucucaaaaaaggaaaaaaaaaaagaguaggaaaaagggaagaaaaagaaacaguucuucagaucacaucauccggaaugcuaaugcuuguaucugauaagcauuguuucagacaugucucuggauagccagauaagaguugcuagaaugagauuuuauacauucuguuaaaaacaagcacacaaaaaaaccauaauaauccuaagcuuuaaucuuacaaccuuuuucuuaauauuuugagaauaucucuugugcuuuucaaaauuaccugaaguucagcaguauuucuguuuuaguuuagauuuauuuuccuguuaucuucaagcaaaagaucuaucucacuaugguuaagaaaaagauuaaagagauuagaggucuuaaaaaaaaaacuauacauguuaacuuuaagaccuuccccuuucuguucuuaccuuccaauuuuuauuggcuuuaaguguguguguuuuaagguuauaagacuggugacuuagucaauuacaauuguacugguuguauaggaauuuggggcagugugaaauuguuuugcuggggcugaggaaaaaauuugcugaugaccugggcucugaucucuucugagcucuuuuugauguuuucuuuuagagcacagucagaggugucucacuucugugaaauucugcugaguucaucagcuacacagucuggaaaaaucaaaagggcuaccaaaacuugcugagccucugcucaaguccuguaguagcaugaagaagcuuuguucugcaguuuuuccuuuacauauuauuucuuugugugguguauuaauuccaguugggaaagggggguuggucauuagugaaguaugauuuuugucacccugccuucuuucuuuaguaguuucuguacucugaggccaguaaagaaggcuugaugucccagaaauuucaguuccuuaauuaccacauuuuaauggcaggaggacgaaccuuguuuuuuguuuugauuguuacaagugaaauccuggcuuucuuuuaaaugcaagcauaccucguuuuauugugcuuuuuuuuuuaacugaagguuuauggcaacccugugucaagcaagucuaucagcauuauuuuucuaauagcaugggcucuccuuugugucugugucauauuuugguaauucucacaauauuucaaacuuguucaugauuauuaucucugugauggugaucagugaccuuugauauuacuauuguaauuguuugggggcaccaugaggagcaccuguauaagauggcaaacaacccauaaaggugguguguguccugacuccuccacugacugguuguucccugucucucuccuccucuggcucccuuauucccugacacacaacaauauucaaauucggccaauuaacccugcaauggcuucuaaguguucaagugaaaagaagaaucacuaagucugucacuugaaaugaaaaguuagaaaugauuaagcuuagugagaaaggcauguugaaagccaagacaggcugaaagcuagaccucaugugccaaacaguuagccaaauugugaaugcaaaggaaaaguuuuugaaggaaauugaaagugcuauuccagugaacacacaaaugguaauaaagcaaaacaguguuucgugacacacagaagauuuuaguggucuggauagaagaccaaaccagccacaacauucccuuaagccaaaaccuaauccuaauccaagcccuaacucuucaauucucugaaggcucagagaggcgaggaagccacagaugagaaggcugaagcuagcagaggccauucagagguugaagaagccgucucuguaacauaaaagugcaaggugagggagaaagugcugaugaagauguugcagcaaguuacucagaagaccuagcuaagaucuuugauaaaggugacugcauuaaacaacagaucuuccauguagacaaaacagccuucuacuggaagaguccaaaacuucaaaagacaggcugacucucuuguuaggggcuaaugcagguggugacuuuuaaguugaagccagugcuccuuuaccauucugaaaauccuaggccacuuaagaauuaugcuuggucuacucgccugugcucuagaaauggaacaaagccuagaugacagcauguguuuacagaauggcuugcugaauauuuuaagcccacuguucagaccuacugcuuagaaaaaauaauuuucaauacugcucauuaacaauccacuuagucacccaagagcucugauggaaagguucaaggagaugaauguuguuuucaugccugcuaacacaacauccauucugaagcccauggaucaaggaauaauuucuacuuucaagucuuauuauuuaagaaauacauuucauaaggcaauagcugccauagugauuccucugacggaucugagcaaaguaaacugaaaaccuucugaaaaggauucaccauuuuagaugcuauuaacgacauuuguaauucaugggaggagguaagaauaucaacauuaacaggaguuuggaaaaagaugauuccagcucccauggauaacuugggaggggaucaagacgucaguggagggagucacugcagguguaggagaaauagcaagagaggccggguaugaugacucaugccuguaaucccagcacuuuggguggcugaggcaguagaaucacuugaacccaggaguuugagaccaaccugggcaacauggugagaccccaucucuacaaaaauuuuaaaaaguagccggguguggugguguguaccuguggucccagcuacuugggucugaggugggaggauugcuugagcccaagaaguugaggcuuuagugagcugguaagccgugauugugccacugcagugcagccugggcagcagaggugagacccugccuuaaaaaaaaaaaaaaaaaaaaaagaacaagagaacuaguaguggagccugaagauguaacugaauugcugcaaucucaugaucaaacuugaaauggaugaggaguugcuucuuagggaugagcaaagaaagugguuucuugagauugaaucugccccugaagaugcugugaacauggcugaaaugacaacaaaggauuuagaauacuacauuacauaaacccaguuaauaaagaaggguuugagggaucaacuccaauuuugaaaguucuacuguggcuaaaaugcuaucauugcaugcuacaaauaagucuuucaugaaaggaaaagaaauugccacagccaucccagccuuuggcaaccgccaugcagauuagucagcagccaucaacauggaggcaagaccauccaccagcaaaauaauugugacuuacuaaacccucaguaucucugagguaugccuguaguauuuuauuucauugaguaccaggaucuggauucuucauguuaccauucugcuuuuuuuucauuuagcaauauauaaucauuagcauuuugguaauuuuugagaacuuaauauauuaauacuuuaacuugaauuucacuuucaggaggaguuugcaaaccaaagcugaucagcaagucaaacagcaggaaaucuaagucuccuauaccugggcaaggcuacuuaggaacggaacggcccucuucagucuccucuguacauucagaaggggauuaccauaggcagacgccagggugggccugggaagacaggcccucuucaacagguaaggauucugcuuuaacuuagaaaaugagacagagcaauaauaucaaugucuugguuauuaguucuucaaaauucagcaacucuucuaauuuggaaaccuauauucccauuucuguaucauuaauauguuccacuuucccgaauagaaguauuuuuuugaggggucuuguucugucacccaggcuggaaugcaauggcaugaucauggcucacugcagccucgaccucugaggcucaggugauccucucaccugagcgacccaaguagcugggacuacaggcgugcacgaccaugccuggcuaauuuuuuucauuuucauuuuaauuuuuauuuuuuguagggacaaggucucacuacguugcccaggcuggucucgaacuccugaacucauuccuccugccuuggccucacaaaguguuaguauuacaggagucaaccaaugcacacacccagaauagaaacugaaugcacauauaaccugaaacauuuuuagaaugcaaagccugauuaccauaaacaaaggaagagcuaugaaaaaauaaucucaaccauucuccucacuucuguauuacacugguagcgaacauugacuauuugcaaagcaaauaaggugguuuuaguucuuuugagaacuguaccugaauguacccaugccacuucuaagaguacuucaccuuucauauugguauucuuagaaaaaguucuuagggaaauacuaagaaaucaaaauuagaaaugagaagacuaguuuaaaaagccaucaucuagcugggcgcgguggcucaugccuguuaucccagcauuuugggaggcugaggcgggcagaucacuugaggucagaggugggagaaucacuugaaccugggaggcggaaauugcagugagcugagauugcgccacugcacuccagccugggcaacaaaaagagacuccaucuuaacaaaaacaaaaaaagccaucaucugucuguacguucacuacauuuacacaaacugaugaaaaacaauacuccaggauacuuauuauuuucuauuuugugccuauuuguaaacuuaauguauguaauaacuaugaucacaguagcuuuaaaaagcaacagacuuuuaaaacugggauauuacgaauuuuagaguuucagagaauuauaagccaucuuuuccuuaggauuaaauacaaauaugucacugaaaaaaaucugaaaugugcccuucccuguaagauauauguaaauuauaucaggcuuuugcauuauaaaacucaugucacaugcaaagugguuguuuugaguuugaaagcuuacagcccagaccagugguugcugcuucucagaucucuuagggaagaauuaauuaggccauacaugagauuuauuauuugauuaaaugguuauguuuuauguuuuuggguuuuuuuuuuuuuuuuuuuggagacggaguuucguucuuguugcccaggcuggagugcaauggugcuaucuuggcucacagcaaccuccgccuccuggguucaggcgauucuccugccucagccucccgacuagcugggauuacaggcaugcaccaccacacccggcuaauuuuguaagaugggguuucuccauguuggucaggcuggucuugaacucccgaccucaggugaucugcccaccuuggccucccaaagugcugggauuacaggcgugagccacugcgcccagccuguuuuugcguuuucuuaagcuguaggaggcuuucuggggacaguuaaacaucuagaaacugaugaaggguagcaguguucauuaauuaccucauuucucaaucuuguagacuuuaaaaucugcccagugagauucagcagaugacuugcauccugcugccccucagucugcagacguuccuggguacuuguccauugucgucugagaacuauacucuugcauuucucuugaagaguuaagaaagcucuugcuauaaccugacucugugauucuccauggaaacaucugauauagacuuaacuaaaaaucuagccugggcuuucucuucugggcucagcagcccucacucauaugcuacucauguuacucuucuuuuuuggacccgcacugacugcuauauaucauuggcuaggauuuaaguggugagacuuuggccauuccguguuguauucauuuugcuuucauggugucacaugaccauuuuacaauaauccuauucuacuccauccuacaaaaguuggauuggaugaaauaccaguuauguucaugacaaugaaaaccuaauuuuucuuuugucaggcucaacucaguuuccuuauaacccucugacuaugcggaugcucagcaguacuccaccaacaccgauugcaugugcucccucugcggugaaccaagcagcuccucaccaacagaacaggaucugggagcgagagccugccccacugcucucagcacaguacgagacccugucggauagugaugacugaacugcacaaagugaggggaacagggugcaggagagggaucucuaguuuuugugguuuaauuuuuaguagcaggucaaaaaccugcccuccugugacuuauucccugagacuuuucaggagagccagcccacagaugaugaagaaaugauggaaguucauuuggagagucaaaugggaaaaaaacaaacaaaaaacugccuuugauacaggcaauucaguggacuauaauaauaguggaggguugagauguagaguuuuuaaaaagugaacaguugcuguucuuacaucuguaaagaaaaccauaaugucuuuaaaucacucuucuguaaauagaugaccuuuuugcaguguauauccccuugcuguaguaucugguguacuuauguucaaaucagcgcaucaacuuugggggugauuuuuaaaaaucuuuuugucuaucuaucuuuuuaacccuagccuucuaaacaaccucauacagcccaguuacauaauguuggcugucacgggcauuguacuuuuaucugauauuguuuccucuaaauucagcuuuccagugauguuuaaaaucuugugaaaauguuuagauuuuuaacacagacccugucauaaaaucuguacauuagggucaaaagguaaaaguaacaaauucugccauauuguaaauuuccagugcaggcuuuaauuuuuuuuuuucauuaguagcacugaaaaaauauuacugcauggguauguucuaguucaguuuauaaaguuuuaaaggcuuauuugaggcauaccucacuguuacgcacacugguaauuuaaccaugccccuaaguauuccuuuucuccugcauuugaugcagcccaacaaagcuuuuguuuugaaauaaauuugacuacccuguccauagcuacaguagauuauuugugguuuaaggcuccuggugucucagguuccaaaggaaaagcuuacauauuuuucccuuaguuugaauauaugauugguuggguuaaaagau

SEQ ID NO: 19002 - RNA, 1605 nt, Homo sapiens
auuuuuuuaacucucucuuauaagcaccaauuuuuaauaucuaagucaauuuuuggggaaagaaacaccaucaagaucuucccuccagcaaaacaacgauguucacuccuccaaauauccaaacugaagaucuaccaaaacaaaaacaaaaacaaaagcccacagauaaauaaaaaggaacaaaaaucacauucuaaugggggggucagugcauuuagcagucuucgcugugcugucuaaccauccuucagcugacuuucaaaaaaaacacccuaagcucaucaaaauauacauuuuccauuugcuuuuuuaaauuaaaaauaauuacuaaaaaaaggaaaacuuuaaggacuucacaaucaauugccugacucauuuugaugucauguacagcauauggaggucaggaaggcuauuugcagcacaugugauuaggggcuacugaucuucaggguuuagcuuucuuccaaacaguguaaaauacccacaauuccagguaugaagggacacagaugaucuccuuugaaaauuccacaggacaauacaggcgccccagcuguucuucauagagcgacagugcuucuuucagauugacacaguuccccuguguaaaauauuucccauccuguuucaacacuuucauugagaggucaagaaucagucugagaaacucccauguggaaucuucuucuggagacguggagauuggaacagcugucaaaucauuaaucacauaaucaaauucucucccuucuuugguguaucucuucaguaccgggauacagucuucuauuagaaccugauagcagucuccuuuaagauugucuaagacaucgccacacguuuuucgcauguauuucuuacacccaucaaucaucauuuggucagucucuaccauagugaccaucuuugguuuuaguuugacuauuucacacaauaugccucugucuccaccucccagaaugaguacaucuuugccaguguaaucuucuuugccacugcccaugauggcccggguauaugccaaaucacucucugccaaauuaacauccccacuaagaaugagaauauuuccaaacugcuucgaguguagaauuuuuauauuuugauaaggugaaucuucaucauauaccacuucaucuaugucauauucaaccaggcgcccaucggcggugggccaauaucugucgauggcucuccucgcacuaugggugguaaucguuucacccgcccaguacuguccugacucaauucuuucauucuuucuucuacuuuguucaaaauacugucgaucucuucuuugccuugcgcaucaccaucauaacucugaagguccagcaacaccaauccauguggguaaauucucauauuggcaaagcugccauucuuguuuguguagguugcuaaauagccaugguccugccaggugugcaccgacuccgccauccccugcuccuggaaaauggacuggaggccuuuuagaauggucucaccaucagcuuuggcacugagcaugaagucgagcgugcugugccgugcugcugccauagugaggcgaggcccugugccaugccugggggagcggccgcgggagacuggggggcc

SEQ ID NO: 19003 - RNA, 7096 nt, Homo sapiens
uucacagcugacugauugcaguuuguuuuuccagaacuucgagguaguccgguucugauugcggcuuagcuugcaguaaagggugguuggguuuugacugccccacaaagcauuuccugggaguuccauauaaaacgguuuuauugauucugucuugguuuuggcgucgagauucauaggaaggggcaaacugccuuuuagguaagguacaaaaguuauaguggacuaggccugcgcugggaaguuccuugacucgcucagcaauauuuugauacagcagcucaggcucucuugguguggccugcuuuucuagcagcucaguggcacuuauuguguaagcagguguggcuggcucuucuuuuuucuccuccagguugcuauagcugaacucuugcagguuucgguaauaggcuacugggucuccuuccuucugcauguagaugggguuuuggcacaucugacccacagguggggggauauaguuguagacauggccgucuguuuuaucgugagucucaguguuguaagacccauacuguaauugaaaggagcuuacgucuaaguuguugguauuccugggaacgcucggcacucccuuucggcguuucaagacaaagacgaauaaaccagccccaaaacagacagauaagaugaaaacaacaagcaaucccagaauuaagacagacaguggaacuucaguguguaguucaggauaggaacuaggagacacacuaagcgaccgaggugugucuguauugugauucauugacaagacgguuccaucugacaaguuugggcugucuggacagauagccucccuccccagaaauuuuaguaucuccccugcaugcuuagcaggagauucgcaagucaccucauuaaugaugacaggggaauuggcauguucuguccagucuuucagccccaugaugucacagguacagucccagggguucuccugcagaucuaucuggaugaaagccgggagcugauccagaaccccuuucacgggcaggugagaaaaaugguuguuucucagauucagccugguuagggccguccccccaaauauauuaucagguaaggaccgaagaagguuguuguucagaaacaguagcuguagguuaaucaaagcaucaaaggucagaggcuuaauuuccuuaaugacauuauacucuaaauagagauauugcaagcucugcaguccaucaaacauagaaggguacagcacuucaagguaauugccauucagauaaagucugcguaaacuggucagguuuguaaaggcaccuuccugaaugacugcaauccuguuguuuccuaagugcaguaaguccaaagaacuguauucuaagaggucauucuuauagacaguuugaagauaguucccuguuagguagaguuucuuuggacuggucgguuugggcugcaggucagagauauuagugaacuuccuuucuuggcaguuuacauucagaccauugucugagcucugagaggugcagacacagcugcugggacaggugagaggcacaggagacuuggucugguacaccaugauggguccaaaacuuugccuguccuuugacacagucacucgaggaguuggacgauuucucauuuugggcggccggcuggcuuucggagcccugguuggguugagagcaggauucauuguaggugacagccuuuggacgugggugucagcauggcugccccucugacuggaaucacuggcacuuuuucugggacagaggucuugccuggucagcugggucacgucuuucccaugcaaccuaaagggagucucacagacaaucucucccacaaaaacaguuauggugucuagccaggccuugagaggaaguaagucacaagugcaauuccauggauuuuccuccagcugaaucuccaugaucccuccaauauguucaaggacgccagcaaaaggcauuacuuuuagccuauucccccugaggucuaagugggucagcaggacaaagcggaacacauugcugggcagugaaagcagaagguugucauucaggaugagcacuuugagcuuguuaaguuugcugaaugccccagccucgauggcacugauguaauuguagucggccuggagauacuccaggcucuccaggccuaggaagguguccucccucaauaucucaagcuuguuguuguugagaugcagucuuuugagaguuuucaggccacugaaugcccccguucggaucuccuguaacccguuguuaccuaggugaagagucaccgcguuggaguaauugacaaauucguuuggauacagucuugucaagagguuuccauugagaaaaagcugauagauucgauacugggggggcuggagcaggcuaacuguuguaaauccuuuguucucacaguugauauucaguacguuuuccuuuucuucgcacagacagcggaucuugcaaaugucuuuggcaguuuugcgacucucugucuguaagaucccggccacgguuaacacacugaggaaccaaacgccgcucagcaucuuuaggcaccuucggugucaacucagguaccuacaggcaaaccuuaggugggggcagggggaagaagcgggugcagggaagaaagaaacaaggaagcccgauuaaaaaugguaaagcaaggaggcggagugggagcgagggagaaugaggggguuagcaacacggcagaaugaaaucauugcauuuuccaaagcgguuucuuuucuccgcucccuauucccccaucccgaggccacccacacacgcgccccgggaacacacaugcuugcaccugauuucccggggggucgcagccagccgccaagucauuaguaaccgaguuguccuacuaaauccugcccaucuccuccuccccugggguaucucgaagagaucucgggcagcucgcccgucuugagcucccagcagaaaucgcaaucgcuuuaggaaaaaaaaaaaaagcgcaaaaagggggugggaaaaucaggaaucagggggcuggcggcagguguagaggagagauagagaugggaaagacagugcgagguggggguuacucacacaucaggagaagacugaaucccucuccucugcaguccaccaggaguuuagcaucuucaggaagugggagaacaagguaaaauaagacgcugcuuccaggggggaugcccugcuuuuuguugguugauuuaauuugacugggggugcgcagaaauuaaaaauccgacaggaggcaggagcggaagagaagaguuggagcugagggaagccgagcugccagggagggacuggggugcgauucuguagggaggucggagagccggcuggcccggucggcgggcgaaggcgacgacggagccugggcgcgcguuuccaauucgguggcgguggcagcagugcgucuagcaguuugaaucugagaggcuuugcaggcuccccgggacaggacuagggugacgucacgggggagggggcaggcagaggauccagggcgcgcggugggggaggguugggcagaugcuucccuuccuugcaaguggcuuugcaaagcucaauucccggcugcgucaguugauucugaacuacuccaccuccaaccuggcuggcggcaggagaagcuccugcagagggguuucucaaggaggggcccugcuaauggccuggcaccuccuugggccccucuguguguucucucucacuccucccucuuucucucaccuacacaaugccuauggagggcaggggugggggugggggguucuucucccagauucccaagcaagggagaagcgugugugugugugugugugugugugugugagugagagagagagagagagagaguguguguguguguguguguguguguguguggugugccucuuugcuacaggacuggugccccacuugccagcuccuagcucagaugcucucugugcagagaguggggugugugugcaugcaccaaugugucuguguaggagggugaggaguucucuuaggggauuuauacuuuacauacagagcccugauucagugcuaagagaauuccuuucuggguggugacccaccaaacauauuugccuggacucugaaagucagcucaauguuagcuuauagacugagaaaaacaaaaacaaaccccuuuucucccugagguuuauacuuagccagauaaugagguuuaaacgugcacuucuugccuggaggaaggagaaaagaagugggugucagaaaagcacugccaggcugagccucagcugggagugggagccaaaggaagggugguugagcccuccaggcugcaggggcaggggagcuaggagaaaagaggaagcuggugcaggaagacuggcuccugagaaagagaggagauggaaaaggaauccuggccugagaccgagcuuaccuggguucugaucuggcucuguugcuagaugugccacuagcuucuggaucuuccuguguccaucugcaaaaggcagguagguagacuguaugggcccucccagcucugauauccaaugcggguuuaaauagccuuuccagagcauugcuaauggccagguguuggauuuuugccuucauuaucuguuuucuccuuaauuaucuuacagcuccuuggacccaagagucuuccauuguggaaucaauucgcaagggguaaauaaugucugcuguugccuggaaaggccuugguugccucugguaggaagggggagaugggucaggaaaaggagggaaucaaccagggaaaaggaguugaccaaaugaugugccugucccacaaaacacuucagcuugcuuucccggagucccacugccuggccaaauguggaauagauaaacacacagauacaacaaaccacuugagaacagaaugacccuugcuucuccccuucuccuuccuuguuaagccuagguucuaggauuguucccuuuauacaagcuccuuucucuccgggaagggcggggguaguuuauaaacuuaggcacuagggccaccuguagcuggugaucugugcauuauuuucuugagcuuucucccuuucuccuucuucuucuucuaagagccuuggaccaggcaucagaagcccccuuacccucuaauucuugcuuggcguuuagcaaaauacuuuccuucuggagacucaaauuuuccuucuccauagagaagggcaaacuugagaugagcucugaggcagagggacagcccuguggauggccucccacccuguauugcaauugcaucauuagauggaagcagucugaugcagugggagcacaauuaagcucccuuuccuagcaaaggaggcauuuguuucuauguauuuccaaagguuaaaagcacauaguuccuagagcaauaagauuuauucauucagucauucauucaacaaacauguauuaugucaauauuuaacugaaguaaagacgugagagccgaacaagaccuuagaagucagguucauuuuacagaugaggucauuucuuaaccagggaaagugcugacuuacucaagaaacuacaaauagaaacaaaacccagggauuaugagucccaguccaucaucuuuccaaaaagcacacuacugcuuaauaugaauuaaaaaucuacuuaaacguaaauagcagugguaguguuuuacuuaaagguauccuuuuuauuaaaaaaaaauguauuugaaagugaaacaucaaauacuaguuucgguucucagauacaguaauuuccuucaagacauugaugacgcuuucaauauuccuugaggacagauuauuuuugcgaagaauuucagagacaggagagagauucagagagaaagguggaggugguugggggcucaugagauucuugagaccuacagaaucaaggaaauucauggguaaucuaacugugggaagcgacacucggacccuaaggaggucuucguuccugccuguccuugagaguccacagcugcuuuccaaaacguaguuacuaggaacaaaucagccugaaacgcgauaaccacuuuaaguaaguuucauuuggccccgugucuucugaagaacugccgcagcacuccgcuagggagagcgggcuuuuaaggcuguggaaagguucagggugaacugggaccccaagggagggaaaggcggucauuaaaauaaggaaaacgcucccucuccuugcugaggcaagggaggcuuaaagacgaacuccgucgccugucucacucgcaucuaaccgaguagagccuggcucaggucuccaagccuuccacaggacacggugggugccggcgggcuuacagcccaccuccgucccggccgcccaucaggccacgagggggcuaagaggaguccggggaaccagagagggggcacugcuugcccgcagccucuucuucuaaacacccgccgcccgcaagccgggucgaaucccauuuccgaagggcgcuuccgggagaccaggugucuccgagcguccccgaucgccgguaacugggcaccggccgccagcgcagcccuaccuucccugccccuaccugcuagacgccuggugcggugcccggcaugcggaccuacagccgcgacggccacucgggcugcccucgccaugggacuugggcacugcaggccgaccggaggcuucuagcucgcgccgggugcgugggcccucccuggccgccugugccaccccgcugcgcgaggcgcggagcccgaccacgcccgcgcggacggucccggggugaggaaucuccaguggggauugaggguagagggcggccgccagcgagcugcccuccgcggauggcgcccagccuccccacgcuggugccccucgcaaggagagguggccgggaaaggcaacggacugaggaaagccggcucacuggccgcgucgccaccgcgucccugagugcucagaacuuaccgagcgagcgcgccgcccagaucuuuucccggaggcgcccgcagcaucugcgacucggggaggcaaaggagccggcaccgccucggacuggcgcagcccaggagcgagagcaccgcggggagcgcgggcggcgcccccagggcaggcagauccccacc

SEQ ID NO: 19004 - RNA, 1345 nt, Homo sapiens
cgcccgugcccaucacgagcgccaccagcaugucugacaaacugcccuacaaagucgcagccuggggacgcaaggcccuggacauugcagagaacaagaugccaggccugaugcgcauaugggagcgguacuccgccuccaagccacugaacggcgcccgcaucccuggcugucugcacaggaccguggagacugccguccuaaugagccucaucacccuggguacugaggugcagugguccagcugcaacaucuucucuacccaggaccaugcggcugcugccauugccaaagcuggcauuucagccagcacuggcauuccaguguugccguugccaaggcuggcaugccuggaagggcgaaacagacgaggaguaccuguggugcauugagcagaugauguaccucaaggacgggccccuuaacaugauucuggaagacgggcgaccuuaccaaccucauccacagcgaguacucgcagcuccugcugagcuuccgagguauauccaaagagaccacaaucgggguccacaaccuguacaagaugauggucaaugggauucugaaggugccugccaucgaugucaaugacuccgccaccaagagcaaguuugacaaccucuauggcugugggagccccucauaggugguaucaagcaggccacagacgugaugauugccggcaagguagcggugguagcaggcuauggcgauaagggcaagagcugugcccaggcccugcgggguuucagggccagcgucaucaucaccaagacugaccccaucaaggcacugcaggcugccauggagggcuaugaggugacuaccauggaugaggccugucaggagggcgacgucuuugucaccaccacagguuguguugacaucauccuuggccagcacuuugagcagacgaaggaugauaccauuguguguaacacuggauacuuugauguggaaauggaugucaaguggcucaacaagaacacuguggagaaggugaacgucaagcugcagguggacccguaccggcugaagaaugggcggggcaucauccugcuggcugagggucggcugguuaaccuggcuugugccaugggucacccuagcuucgugaggaguaacuccuucaccagccaggugauggcgcagaucaagcuguggacccacccagacaaguaccccguugggguucacuuccugcccaagaagcuggaugagucaguggcugaagcccaccugggcaaguugaacaugaaguugaccaagcugacugagaagcaggcccaguaccugggcaugucuuguuacugccccuucaagccagaucacuaccgcuacugag

SEQ ID NO: 19005 - RNA, 1345 nt, Homo sapiens
cucaguagcgguagugaucuggcuugaaggggcaguaacaagacaugcccagguacugggccugcuucucagucagcuuggucaacuucauguucaacuugcccaggugggcuucagccacugacucauccagcuucuugggcaggaagugaaccccaacgggguacuugucuggguggguccacagcuugaucugcgccaucaccuggcuggugaaggaguuacuccucacgaagcuagggugacccauggcacaagccagguuaaccagccgacccucagccagcaggaugaugccccgcccauucuucagccgguacggguccaccugcagcuugacguucaccuucuccacaguguucuuguugagccacuugacauccauuuccacaucaaaguauccaguguuacacacaaugguaucauccuucgucugcucaaagugcuggccaaggaugaugucaacacaaccugugguggugacaaagacgucgcccuccugacaggccucauccaugguagucaccucauagcccuccauggcagccugcagugccuugauggggucagucuuggugaugaugacgcuggcccugaaaccccgcagggccugggcacagcucuugcccuuaucgccauagccugcuaccaccgcuaccuugccggcaaucaucacgucuguggccugcuugauaccaccuaugaggggcucccacagccauagagguugucaaacuugcucuugguggcggagucauugacaucgauggcaggcaccuucagaaucccauugaccaucaucuuguacagguuguggaccccgauuguggucucuuuggauauaccucggaagcucagcaggagcugcgaguacucgcuguggaugagguugguaaggucgcccgucuuccagaaucauguuaaggggcccguccuugagguacaucaucugcucaaugcaccacagguacuccucgucuguuucgcccuuccaggcaugccagccuuggcaacggcaacacuggaaugccagugcuggcugaaaugccagcuuuggcaauggcagcagccgcaugguccuggguagagaagauguugcagcuggaccacugcaccucaguacccagggugaugaggcucauuaggacggcagucuccacgguccugugcagacagccagggaugcgggcgccguucaguggcuuggaggcggaguaccgcucccauaugcgcaucaggccuggcaucuuguucucugcaauguccagggccuugcguccccaggcugcgacuuuguagggcaguuugucagacaugcugguggcgcucgugaugggcacgggcg

SEQ ID NO: 19006 - RNA, 39248 nt, Homo sapiens
gguuucaguguuuacacccgcagcgggccggggguucggccucagucaggcgcucagcuccguuucgguuucacuuccgguggagggccgccucugagcgggcggcgggccgacggcgagcgcgggcggcggcggugacggaggcgccgcugccagggggcgugcggcagcgcggcggcggcggcggcggcggcggcggcggaggcggcggcggcggcggcggcggcggcggcugggccucgagcgcccgcagcccaccucucgggggcgggcucccggcgcuagcagggcugaagagaagauggaggagcuggugguggaagugcggggcuccaauggcgcuuucuacaagguacuuggcucuagggcaggccccaucuucgcccuuccuucccucccuuuucuucuuggugucggcgggaggcaggcccggggcccucuucccgagcaccgcgccugggugccagggcacgcucggcgggauguuguugggagggaaggacuggacuuggggccuguuggaagccccucuccgacuccgagaggcccuagcgccuaucgaaaugagagaccagcgaggagaggguucucuuucggcgccgagccccgccggggugagcuggggaugggcgagggccggcggcagguacuagagccgggcgggaagggccgaaaucggcgcuaagugacggcgauggcuuauucccccuuuccuaaacaucaucucccagcgggauccgggccugucguguggguaguuguggaggagcggggggcgcuucagccgggccgccuccugcagcgccaagagggcuucaggucuccuuuggcuucucuuuuccggucuagcauugggacuucggagagcuccacuguucugggcgagggcugugaagaaagaguaguaagaagcgguagucggcaccaaaucacaauggcaacugauuuuuaguggcuucucuuuguggauuucggaggagauuuuagauccaaaaguuucaggaagacccuaacauggcccagcagugcauugaagaaguugaucaucgugaauauucgcgucccccuuuuuguuaaacgggguaaauucaggaaugcacaugcuucagcgucuaaaaccauuagcagcgcugcuacuuaaaaauuguguguguguguuuaaguuuccaaagaccuaaauauaugccaugaaacuucagguaauuaacugagaguauauuauuacuagggcauuuuuuuuuuaacugagcgaaaauauuuuugugccccuaagaacuugaccacauuuccuuugaauuugugguguugcaguggacugaauuguugaggcuuuauauaggcauucauggguuuacugugcuuuuuaaaguuacaccauugcagaucaacuaacaccuuucaguuuuaaaaggaagauuuacaaauuugauguagcaguagugcguuuguugguauguaggugcuguauaaauucaucuauaaauucucauuuccuuuugaaugucuauaaccucuuucaauaauaucccaccuuacuacaguauuuuggcaauagaaggugcguguggaaggaaggcuggaaaauagcuauuagcaguguccaacacaauucuuaaauguauuguagaauggcuugaauguuucagacaggacacguuuggcuauaggaaaauaaacaauugacuuuauucuguguuuaccaauuuuaugaagacauuuggagaucaguauauuucauaaaugaguaaaguauguaaacuguuccauacuuugagcacaaagauaaagccuuuugcuguaaaaggaggcaaaagguaaccccgcguuuauguucuuaacagucucaugaauaugaaauuguuucaguugacucugcagucaaaauuuuaauuucauugauuuuauugauccauaauuucuucuggugaguuugcguagaaucguucacgguccuagauuagugguuuuggucacuagauuucuggcacuaauaacuauaauacauauacauauauaugugugaguaacggcuaaugguuaggcaagauuuugauugaccugugauauaaacuuagauuggaugccacuaaaguuugcuuaucacagagggcaaguagcacauuauggccuugaaguacuuauuguucucuuccagcaacuuaugauuugcuccagugauuuugcuugcacacugacuggaauauaagaaaugccuucuauuuuugcuauuaauucccuccuuuuuuguuuuguuuuguaacgaaguuguuuaacuugaaggugaaugaagaauagguugguugccccuuaguucccugaggagaaauguuaauacuugaacaagugugugucagacaaauugcuguuauguuuauuuaauuaaguuugauuucuaagaaaaucucaaauggucugcacugauggaagaacaguuucuguaacaaaaaagcuugaaauuuuuauaugacuuauaauacugcugugaguuuuaaaaguaaagcaaaaguaaacugaguugcuuguccagugggauggacaggaaagaugugaaauaaaaaccaaugaaaaaugaacugcuguggagaaguguuacauuuauggaaaaagaaauaggaaccuuguucaucaaauugauagaaaagcuuuuaaaacuaaacaaaucaaacaacuugaguauaauggaauucagacuuugauuugccuaacauaaccaccauauuugcaaggacagcucucuaucuucugguguuuauucuuaaaaacuuaaaaguuagauuuagcgaucaccagagccacuacuuuuaugcuuagguauuuguuugacuuagaaaaaauuggucacguguaccacuuuauagugcccugcagguguuaagauaugaaggcacuuugacuuacaccucauaaaaucuuuacaaaguauuuucuaaaugaauaaugaugaaauaaagucuuuauucuaggugcaucugccccacauaauuuguuuucuuuggacuagaaguuuugauguguugagaaugguaaugaauuaacuccauuuuaaauguagaaugcguaucacuccaauaugaaugcccuaaugaauccuaagauuuguagguuuuguguacuaguaugaaaauuacuaaagauggaaaaaucacauguuggagacauaagauacaaaccuuuuuguuuucugaaaauacaaccucugauuucugauuccuuguuguaauaugguguaauuauacuagauuguaauuuuguuguuagauuauacuuuuuuaaguucaguguuugaggacagacuuucauuugguuaguaguauuauggcagcuagcagcuaaauaugauaaaguguacaaucaaaaggauauuuuuaaugaagauauuaguggucuaacaugucauuucagauacauagcugaaauguaguaaaaucaguuuuacuacaaauaaacuugcauaagguuuauaaauuuauaaguuuauaaaucaacuuggguaaaguguaaauaaacuugcacucgugguuucucugaagucuccugagcuaacuuugcauaaagguguuauucuguacuucgaggaagugaauuauuggggucaaccacauuuuuuuuccuuccuacagucugauugcccuuuuuaguuuuuaggaucuuuguggcugcaucauuuuuccccuuuugaacugugcauuuucuaaccccauacuuaaauauucucauaaccuccaaauuauuaauuagaugcaacauucagugguauauuacuggaguuucugauuucugcccacuauaggaaugugcuuccugagaagauugggaucgugauuauaauaauaguuaacaggggaugaguacuuucuaggugccaggcacuguucucucugauacuuuauuugauguauuguuguuauucccauucuuuaaaugaugcacagagagguuagguaagugacuuacuaccaagugucagggccauuaagggucaggauucugaauuccugaaaugaugaaauuuagcuugaagaaauugguuugauuuccugcuuaguuuucaauuucaugguggucuuugauuguauuuugugcuauaacacugccuuagcauccuauaacuauaguuacaguguuauauuaccauuuuuuauuguuaauacaaagccaucaugaaauaauucaguuuaugugccagcuuuuuuuguuacuaauucuugaaccuuggcgcuguacuucuucauguggaugccuguuaaggaaagauaaaguuagaaaucuuugacccugcuaggaaauuugucuuuguuauauugggagcucauaaaacugaaguauucaaaaguuagaauacauacacacaagaaaaauuaguaacuaauuuaauaauguuuucuuugcacaugucucuguugucuuuuggucagagugaagcuaaauguguuuuucacauaauuuguagccuauaugaaguccuggacaugugguaugguuggaaggacuguugaugagguuuauugucucucuuuauucuuuuauguuguuaguguccccauacaacggggcggggggaguggggacaaaaugauaacuugcuuuauauaugaagccuuggguuugaaucauacuguuaucacauuuccuaugucccuauccugucuccugcagguuuucuuucuugguuuucuuuuuugguuuucuuucuuccuuucuuccuuucuuuuccuuucuuuccuuucuuccuuuuuucuuuccuuuucuuuuuuccuuucuuuccuucauuucucuccuuugcuccuuuaguuuguuucuuuguuucuuugguuuguuucuuuguuucuuugguuuguuucuuuguuucuuuaguuuguuucuuuguuucuuuguuucuuucaacaggucucacugucgcccagguuggagugcaguggugggaucucagcucacugcaaccuccaccucucggguucaagccagucucaugcuucagccuuccggguagcugagauuacaggcaugugccaccauuccuggcuauuuuuugcauuuuuaguagagaugagguuucgccauguuggccaggcugaucucaaguuaucugccugccucagcccuccaaagugcuggaauuacaggcaugagacaccggguccagcuuccagcagguuuucuuuaggagggauauuuuacaaugcuguaaguuuuuccuaacgagaauuaucauagcacuacauguucugucuucaguaagugauacaagcuuacugaugauguuguaguuauguucauugguggucggguguacauugaaacuuuaacacauaauagccucuccugugagcagugguuccuguugguaagauacuuuacuaagggaaggaaugugaggugucgcuggggagaguuuacccaaauaaggauggacuuucugucuuuguuucaucaguccugguaauagaauguuugaauagauagcucuaggcauuacauacuuucauaaauaugauuauuguaauuaccucuuuggcccaguugcuaguaaauuagggaccccuuaaugauuuauuuccuguuuauucacccugaugaagaacuuguaucucuuuuaaacuguacuuuaucgccuuucucaaauuccaagauucucaucacauuuuuuuucuucccaaacucuaaauaaccuuuuaauauuaaguaucuuuguggaaacauuguuuucuuuuucuaucccaauuuuuaaagcuuuuuuaaaaaaaagagugcuuuuguugggauguacauuuuccaaaugcaaaaacauuuaugauucugugucucuuauaaaauaugacacucucuacuuuucucucauuuauuuagugccaccuauguguguaauuucauuacccacagcagucuuaggaggcuggucgaguuccuuauuugcagaugaggaaucugagguccagagaucacuucuuggugagagucucacagcuauuaaguauuagagccaagauuuugaacguaggucugauucacagcaaaaccguuaaccacuaaguacacugacuccaguaagagcccuaguccucacccaauacacuuuaauuccccugugcauucauucaaauucauugaauuugcugccuuuggaaaccucucaggaaccuccucaaccucucuucucuacagacaucagcuuugccugauagguagggaucauagcaaaacacaguuuuccaagguggugauagguggagugauagugcucuggagauggccaaagaaggaagguaugaguguaucugugggugggugagugguggauaaggggaaggacagagccaaaagcgacggcuauuggaaaaacuaugaugagaaacaggaagauggaaccuuguuggaauuagugaaagaccuuagaauucacaggagguauuuguccuucacgcgaguguagaccaaacguaaccuaugaguuucuuuuauuccacuuauuaaagcagcaaccaaagguauuauauaccuucuguauucacuuaaaaugacugauuuugaaaaagucaugcaaacauccauuuacagauaagccucauuaacucaaaggcaguggcccuguugggcucugaugauuacucaaaccauuucugacacucugacacuacauccggaaaucauccggaaaugcauucagagccugcaaaagcuuuuuuuuuuuuuuuuuuuuuuuuugaauagcuacagcacuugcagaucuuccuccuuugagagaauauuugauuuuaggaaauaagcaaauguagauaaguaugauucaacugggcaauaacuuuuaggcaaagagaaaaaaacaaaauauagcaauguaguaauaaggcugauauuauagugcuuuuaugaugagucugaaaacagucuccaacauuuguaaauguuuuaaaucgggucugucuacuacaguagcccuuaagccauauguagcuauugagcacuugacauguugcaagagugaauuggagacugauuuuaauuuuauuuaauuuuaauguaaguagucgcacaugacccguggcuacuaugguagauggcauaguuuuagacaagggcaguagucuuggguagauacuugauuuacuuagaacauuucuuuaccuagcuguaacaagguucuaauagcugauuaaaggacaacauuuuuagcauguaauauacaguaaggaacuaauguuaauuacugccaagauguauaaacauuaugaaaccuuaaacaaggaugaacacagaagcaguggcccuucuuuguaaauaaggggucaguuacuuccuaauaggugucuuaguuuuaguuaauaaucuaauagcacccccaaaaagcaaacuguuaauuuguuauuagccauccuguaaagacaagggagaaaucggggccaggagaguccucuuucccauucuccauaauuuuuacgaccuauagaaauaagagccuaagagugaccaguuccugcaaccuaacucaaaauuaggccucucuguugaaguaauagugaggcaaacaaucccuugaagcacuggggcaugcacccuuaugaaaucuaauaauucuaaaauaucauuggcaguauuaagcuagaguucucaaaauaugcuguagaaaauauuggucauuuaaauauagcugaguaaaaauaagcaagaucaaaaugauaagaaaauguugauuucuccccuuuugaaccaguaacuaacuauaaggguauauacccaugcuuaacuuaaaaauaauuauuuagccaccuuggguauagcacaacauauggaugccauuauaguccaccuugaucuuacaaggaagcuuucuuuuagcguagcuuuacuuuuauuuaagcauuauugaagaagcuugguaucucuguuuaaguugcuucuguaucaguguuuuccagggcccugucucagcuuccauaguuuuccuuaagagcagcuaauuaaugcuucacuccauaugcuuuaauuugauauuuugggaaguuucauuuuuuaaaauaaucuuuuuauaucauaggccuuugaagacauauuuguuuacaaagacaucugcauugaaccauuuguuuuuaaaaacauguaucgggcauguccuauauaccagaaacuaugccauuuacugaggacaccgaaguuagagaauggucuuaauccgaacuaguuauugucucacuauccaauauggauaucaaacauucagcgucaugaggauuuacuacuguguuuucucccaagaguuuuauaauuuuagcucuuauauuuaggucuuugaugcauauucauugauuuuuuuuuguaugcaguaugagguaaagguugaaacguauucuuuuugcauguggguguccacuugucccagcuucauuuuuugaaaacacuauacuuuccccauugaauugucuuggcuucuuuguugacaaaggauuuauuauuucugccacaacccagcuguuucucacugucuaaaccuuuaugccugcugccccguaggcuuaguggaaugccucuccauccuccacucucuuuuguuuagcuaguacuuccuuauccuuuaaggggucaguaggaaccucaccuucuucaguauguuuuccuuugucuuaucaaccuaccaccaucacccacacacauaccuuuucccuaaggcugggauaggaaccucuuaggcaaugaucuauuugauaaguacucacugaguucauacuagacacucugcaguauauccguaaaugaaguaaaaccugacaccacccucagaaaacuuacuguuagugagaaaaugggcuauaauaauagagugggguaaguuuauuguagggauaagcauaggaugcuaugagaaugcagaggacaggaauuuaaccuagacuucucaguucucccguugaaguugacaucugaacugaaaucuggaagaccaguaagagauagcuauguaaaaagaggggaaggacaauaggaaagaaggaauggagagaggcccagaaacuacagaguauggcacaaguaguuuagcauuguugggucacaaauucuaaggauaugaaagauaaaguugaagaagugguggggcuggggaggacagcuccuguagagccuuuuacagcgggagaaggaguuuggcuaugguccugcaggcagggagaaaccacugaaggggagaaacauacagaauaaauuugaguaagaagcuuaaaucuccccaagcccuuuuaaaauaaauuaagauauaaagccuuuggguuucuuuaugcuuuguccuauucuucuaauuguccaaaacaaaacaaaaaccuuccuuuucuguaccuauuaaaagguuaauuuuauaaaguuacagacagcaugcugauuaaagaauucuugauaauuagcuauuuugucugucuuuguguagauuacuaacaauugugucaucagauuuaaaagaucuaaaccucuggacuuuauauauuuuuucuacaaguacugugagauugagaacuuaauucaacucuaguaacuggacuuuuuaguguuguuugcagcauaugauuguuaaagaaaguuuaguauauuugugugugcguauauauauauauauagauagauagauagauuugagguuauauuuaaucauugacuauugguauucuaagauuuuaaggagagaaagguagguuacaauauauggcugauauaugguucuggaacaauuuucuuaguuuucaguaauucuaccuaaaauguacguccagcuuugcacucacuaccacauuguaauuuccaguauacuugucuauuuuucgagauguugaaaucuguggagaauuuuuucucauguuuaguguuuuagcuauguuuaucucuaggguauagcacauacaagguggcaauauagaugugcuuaaugaauaaaaugaucuucaaaaacugaccuucauuugaaguucuauuuuauucauaaacacauaaaacguuugguaucacuguaaaauuuaacuaaaaacaaaaacuaucuuuaagcucacaaguuaauuuaacguuuuuucuuacacaggcauuuguaaaggauguucaugaagauucaauaacaguugcauuugaaaacaaguaagugucucguuauauaauuuuaaugaugagguucuuuaauauuuuaugcuaauucuauucuucauuuuuuaaaaauucaaguccaguuugagugcuuuucaggaauggaucuucauguuacugacugagaaguuucugaacaacucaguauuaaacuaauggaaugacuguuucugcuaauguccuggaggucccuuauuguaugguauugauccuuacgucuuaauucccuugaaugugaagaaagaaaccagagagucuuguguauuaguaacuggaaguucgcauaggaguauuuguaaauuuuaaaaagauaguaaugaaaagauucauggguauugcuaaaaaguuguaugugaguucuuuaacauuaaaucuaaaacugaugguuuuaguugucuaguauauuuuauggaaacagucauguuuaccuauuaucugauuuuuuuuaauguuucauauguucagcaauagcaguagcugaucuuuucuguucucuuuugcuagaugaagaaauaaaaacagucauaggccuaggaauauuaacuguaugaaagcaucaauaguauagauguuaacauuuuauuggagaacacaagucucuugacuaaauguuuugaaugcuaauaaaggcuauuuucaggguagcuguugguaagauuguaaaguacauauaaacuccuuagucaaaguguagauguggcuaugaucuuaggauuuuacuaaacucugauggaugguuaacaguuaucauuuuuuuggcucuuauauaccaagaaaauuaauaauauaucaaaagcaggcugcaaaucuauagagacagaaaguagauuagugauugcuugugcuggggcugguggggagaacauagcuaaagaguacaggauuuuuguguguguggcaaugaaaauguuguaaaauugacugguaauuauugcacauaacuguaaaccuucuauaaaccauugaauuguacauuuaaauugaugaauuauaaugauauguggauuaugucugcuaaaauguaguaugugacccaggcauacugagcaauaaauacacacaucuugcuucuaaaguuuaaaaccaggccuguguuucagugucuagaaaauauauuucauaauugaacuuagcagauucuuuuggcuagcaacaggacaaaguaguauccuuagaugccugaaacacguguagggggacagagauaaaaggauuaaaagcaucuaacccuauuucuggcucuggacuaauaaucgcagaccaaaauacaaguuugaauaguagaauaccuuucccugaauacauaaagccaaaaguuuuaguauuugucucuucgcuguuucauauauccauggcuaugcaauagacaacagcaucacaccaacagaggaaucuuugauaacuuggaggguauuuuuuucuuacaauuauacacuuuaucuacuuacuuacaucacuagguaaaugcuguuucccauaaagggagaguugucuuuauuugcuacucuuuuaguuuuuccuguagucuauaaucuaaaguguuaagcaaacacucauuuccucuaugcauuuaagaauuugucuaguuuauacauugauuuauuagaucacuucuuuuuaauuuucaaucagauuucuaccauaaacuuaaaauuauuucaucuuuggaccuuccaauuauuuaucuccuguaccauaucugcaugaaaguuucucuucaagcucuuugucauccugggaguuugaaauagaucauugauuuucccuuguguucauggaguauguuugcaauacaacacuggguuugagcacaucaauaggauuuaauaggucuccaccaaaguaaucucuuugcccuuccuuguguguuuccuuuuugguuuucuguuagaaacaaaacgaaaacaguguuuuguaaaacaccagauuguauuuacccuuucuuuccuuucaaucaggaagaagcuccuguuacugauagcagauuguuuuaggugcuuuguuuuuaggugcuuccuaaaccuuccauaaagcauaaagguguuuucauauuucacauuuuuuaauaaggaauuugaauuuuuaucuguauacacuuaaaaucauuauuuuuuccuuggaaccauugaguuauauauuauuauaugcuuuaaaaucaaauuuagcaaugaauguauaacaucuauuagguguguauaauaacucagaggaggguucaguuaauuuaggcccuaaucagauuuccacaaauucugacuuaauauuugcccgcuuauauaacagcucuucuuuaacaaaaacaaguacuuuucucaauagaauuuuacuaagaaagcucuuuaguaaaacaucgacauuauacauacaacauaucucaguaucugcugaugaagaacaccaaaaagaacccagaugugacugcuccggaaguugaauccucaguauuuuugcaaaguuugucuuucaguauuuuauuugugugugugugugugugugugugugugugugucuauauauauauauauuuuuuuuuuuuuaaagacaggaucucacucugucaccuaggcuggagugcaguggcaugaucauggcucacuguaaccuugaacuccugagcuugagcuauccucccaccucagccucccgaguagcugggacuauaggcacauaccacugcaccuaauuuuuuuuuuuuuuuaauaauuuguuguaaagaucaggucuuaccuuguugcccaggcugcucuugaaguccuggccugaagcagugcucccaccucagccucccaaagcucugggauuauaggcuugagccaccgcauccuaauauuuuauauuuuuauggauauaaaaaauaauuugguaucuuucagaguuguuuaauaucauuuuaaauuuaaaaacauaggcaacuuaaacuccuauaggcugucuccaucggguuucugugguuuaggagaccccaccaucccagugcaugcugauaacgucauacugaucagcauccagcuacccacagcaagaauugaccaccucgugggaucuaaaauuuaaagggggaaaagugaguugugaauugcuaaugugcugauagccccauuuugcuugggaauuagagggcaguuuuugugguccuuggaaugugguuaaaauucuucugcaaguggaagcauauuuauauuacuaacaauuacugguacuaauauucaaauauugaaggaaauuucuguuguggacuuauguuuaaagcucuuagaaguugaaauuauuggaaagaagacuuguuuugaaaaucauaauguugcuguauuguguuuagagaaauauuccaaacgggaguaggcugcugugcugcaugcagacuuugcugaaauguuacuauauugccguuaugucccacucagcaaaaacugaugauuuuaaagcuuuugcuucuugaaacuagaaaaagaggggucagccuuaaccaaaaguugauggcagaguggucauuauuucaguuaaacaugaaaagcauguuaaauaauuguauguuugcuuauuuacagcuggcagccugauaggcagauuccauuucaugaugucagauucccaccuccuguagguuauaauaaagauauaaaugaaagugaugaaguugaggugaguuuucccugccauaaagucauuuagcacugaaagagugggguuaauuuaucuguguuuuuuuuuaauacuuugucuuuaacacuguuuaaauuacuuugagaauuacagcuggaauggacacgugcuuuugacuaacucaucuuauuaauaauucaaaaugauacaugaugcuuacauuuggcuauuugagcaguacucagagcauguauuugaaagucacugccgcaaguuccuuugcccacuaguaauucuuuucuccuucucucaauuucugaaucuuugaauaguauguuguuuguuuacaacuguguccccauuguaagcaaaauggauuaugaaaauuaauuuuacacaggaaagaaaucaugcuuuauuacaaaauaguauacuagaauuucuuuaaguagcagugaaucuucuugguauauuuuuaaaaaccuacaagcuuuaguuuauacauauugguaaaaucucuuuuucacagguuauaccgugaacuaccugcuuaucucccguugagcucuuugaccaaaaugugcuauggagaucuaacaugugaacagaaauguuguguuugugauuucuuucuccauuagaaauugguuuuguauuuaaggcgcuuacagugccucauauaguuugugugguaucuucucuccuuuguauccuuucacauacuccauuuugagcugcuucucuucuuuuucuacaauaauaagcauaaugccuuacuauuaguuaauaauaguugccguuccaugaauauuuguaguaugaaggaugucgcuaaguagacauuugugcaggugaggcagagugguucuagguccuguccuucaguucuuuauuuauuuauuuauuuauuuuuugagauggagucucacucuugucauccaggagugcaauggcgcgaucuuggcucccugcaaccuccgccucccggguucuagcgauucuucugccucagccuccugaguagcugggauuacagucgcccaccaccacgcccagauaauuuuuauauuuuuaguagagacgggguuucaccauguuggucaggcuagucucgaacuccugaccucaggugauccacucgccucggccucccaaagugcugggauuacagaugugagccaccaugcccagcugguccuugaauucuuauuugcugcacuagguaguaaagguguagcaaaaacaggacagaaucuucugccuuugaugaaaucacauuccaguaaggauagcuaauaugacagaugugagucuuaaagaaaaaaaaagggagaggaugaaaggugauuuagggacaggauugcuguuucagagaguagucagggaagaucucucaauguccaggccuguguuuuucucucuacaguuuuaaaguggacauaggauauaguguuauuuauuuuccaaaaauguaaccaaucucuacuagguguaagcagcugggcuugguuuugcaagggaucuuaauagggaacagaaacacuguguaugcuuagcuguccacuuccccagaagacuguaagcucucugaaggcaagacccaggucuuuggucuguauuaggaguacccagaauaguguuugauggagggaugaaagggacuuuuucuccccagcuuggucacuugacagaucgggaccaaugagauaccauugcuaggaugaccucacugucuuacacaccgauucguugagguaauuucucuggcuagaguaguugagaaagauggaagcaagagggaaagguauguuaaguuguauucagucacuguauugugugaucauuaacuuugguuguaaaagggagacaaguucgagcuuuuacucuacuugucagcccuagacuuuguaccucucuuggccucaugucuuuaucccccuugucuuucuuauuucucuuuucugcuucugaguaucccugucucucuguccauauauacucuguugucucuuuuccuauuaaccuugauuugcuagggucuucaugaaagguuccaugcuguacaucuuaagugaacuuugaaguggucaucaaagagaucaguuagaagaacugaucugcagugugugacagaccaggaaagugauauccagaggauugccaccaugaaguugucauuuuuaguggagaggaagcaggagaccagaaagugaccaaggaucuguccauuuaguuccaggagauaugacugccagagugguauccuuagugggcugaauguucaguggucuuacuuuagugaccaagcaacaagacaguagggcauggucaguaacuuucagucaauuuuugcuuacuaggauaaagcaaaaauaagcuuauacauuuuuagauacauuuuuuguaacuugcugaguacccaaggaaagugugcuuguauuuaugggcgucuauuuucagagcacuaauuauugcugaauuagaacagaaauauaggaaaacugauuuuuacaaggagcuucaaagcaaucucagguaguuucugauuauguaucucugccuaccucgggguacauagacaggguuacaauuugguugaggauauaugacaugugguuuuuaaagacaccuaggggcauuuuaagaaaauuuccucgauaucugaaaaucuguagauuucaaaauuauguuaaucaugaaauauucuguguuguaauuuuuguguagguguauuccagagcaaaugaaaaagagccuugcuguuggugguuagcuaaagugaggaugauaaagggugagguaggaaaaugccuauuuaaauuuuuuucuuauauuguuuccuuuuuuuaaacccagguuguacauucccguguggauuucuauuuugaaguaauaucuaauuuugaguaauuuaauuaaaauguuuucacuauguguucaguauguuucuguuggucauaaauuuuuucacauagauuauuuauuuuaaaauaacugaauagggagaacuucuuauucuuacuuuaaaaauugugauuagaagugacuuuuauuuauuucucaguuuuaugugauagaauaugcagcaugugaugcaacuuacaaugaaauugucacaauugaacgucuaagaucuguuaaucccaacaaaccugccacaaaagauacuuuccauaagaucaagcuggaugugccagaagacuuacggcaaauguaaguugauacacaagaaaugcugagaacuuggaagugauaugcaauuaguuuagaagaauuucuaguaguuuaaaauuuuuuaaacuacuagaaauugauuuuaaauuugguggacuuuggcaaaaaugguuugguuugcaagagcaauggagaaaaaacuuauuuaacuuuuccuacuuauagaaucaaggcagccuugcgcuuguuuaaacuuacuuggcuauacacgugucugauguacauaauguacauuuguuuucuaaacuaacuuuguucauucuaagauuuaaaaacugaucaaacaaaugugauaauucugucauaagucacaaacuauaaacgauuucuccguuuuuuucucuuuuaccuaaaauguuuucagauaaauguguaauaaguagagccaaagaagcuuuaaaaagucaucucaucuuacaauccuugaucuggaauaaugcuuaaagacuauagaagagacgcauuuuuauuuuuuacagauuuuauuaagugaauacaguacguuugauuuggacauguuguugaacauuaaauugcaguucagaauacauagaaauccucccuuuucuagagauuguguauguguguaaauuuuugugccuucugguucauguacguuuccuucucucccucaaaucguuuagcaguuucuuaccccauucuccgugaugugcuuauuucauauugcaugccuguaucaaaacaucucauaugccccauaaauauauauaccuacuauguacccacaaaacuaaaaauuaaaaaaaaaggaaaaaaaaaggccugcaacaagagaagaagaaagaaaucagauacccuguagguagcuaucucccaaaaguuuucaauaguugacuuaagaaaacuacugacuuguauguaacugaaaucaggaaaccuguaguguagagugguuccccugaauaugucucuuuugguaaucuaagcuguauuucagaaauguacagaaaaggagcuaagcuucuaaauggauauagcauauuuugcauaaaucaaauuuaauaugaauccaugauucuuguauguguaaaucugccugcauuuauuuaugucaguaguugguaauuauucaucuuaauuuuuuuuuuuaaauuucuaggugugccaaagaggcggcacauaaggauuuuaaaaaggcaguuggugccuuuucuguaacuuaugauccagaaaauuaucagcuugucauuuuggugagcauuuuugaguuguuuauuuuuaguuuaauucaucuggggcaauugccuugauaauaauguuguuaauuuaaaucauuuaguccaucaaugaagucaccucaaagcgagcacauaugcugauugacaugcacuuucggagucugcgcacuaaguugucucugauaaugagaaaugaagaagcuaguaagcagcuggagguaugucacuuucccuagcacugcuuguaaggguaccuaggaacgauuaacuguaucauuccacaacuugaauauggggagcuugucauuuauuuacugcuucuuaacaauuccuuagguucuauaguuggaaaauuguacaaagcauaaucauacuaaaguuuccaugccugagguuucaaaauuaaacagcagcuuauguauauuaagggacuucugguacuuucacuuuuacuagaaguuuaucaaaguugcuaauaaaaugcggcaaugcuucuuccauauaacauguugucauuaaaaauacuagagaauauuuaaauaucuaaucauauuccucucauuauguauguuuaucuuuguuuaaaaggguauagaacuucuucauucuaauugguugucauucuuuaaaacuccugucuucagauucccgccagaggcuauuucccuaacuuacuauuuugucucuuaaggugcauuuuaucuacuuuuauuaauccuccaauaauuuucaucaccauauauuuguuuucauugauaacuaucaaguacguccauccauuacuauagaaacuaaguggaucuuagaugaaugugccagcucuacuauauuccugucaaauuccagaguucgucaucauuauucauuagaaggaaaacaccacacauuugaaauaguaaagaaaaaaaggaguuccaaacugcauuuuaggagaaaagguagucaagacuguguucuuauaaaaacccugugaaauuugccaccugucaacuugauguaugaugcugaacucuuagcagaaggggaaaaguuuaaucuccuuuugccacuuuguuuuuucuuaaggccauggaggucuguuuaauuggucuuugcucucauucuuucuugaugucccuguguucaugauuuugugguuccuucagugauucucucauaacuuuuagcccagagcugccuccuuacuuugauugugaguauuaugaaaauauacucauaugccucuuaaacaucgaauuauucuuaaaugaucuaucauacuuuuggcuaaccauuuaucagugaauuaucaaugaaaaagaacgaaccagauuaaugaaccaggacucaaaaaacaugacuucuugaaaaguccuagaauuauuuuauagauuuuauuacucuagucuaaaaaaaauggguauugcacuuuuaaauuauuuaugcuaguuguauucauucauucaaauuaucaggucuguugaacaaugagaaacuaguaugcaugccuaucuuucuucacuacuaauauuaaagagauuuacauguuccuauaagaaauucccauuuuucaacaugagccacuaauacguuugguuuucauuaauggcaugcuagaacugaacacuaaauuuugauaaugguauuuaaagacagugguuauccacaaguuugggaugucaguguaacuuaguuucgucaucacuggauauuuacaagugcucaucauaauuguggauccagaucacaaggucuuacggacucuggucucauguuagcuuucagaugcuuacuaaguuuuuaauuuuugacauuuuuugauuauucaguuuaacuacuguaccaacaauuuuugauuccuuagguuuugagggaggugucauuuuaaugucauuucaacagaggaauguuuagaccacaguaccuaaugauguuauaaaaaauggcacuguuuccagaaaauauauacugauaccuuuuaauaaaaaugaagcgaauaaaauuuucuauaaagaugauauuuaaacauuuuuuuaccuaaauaaguaacauugaguuugucagaccgagugagcugguuuuuacuggggaacauuugaccugcuucuuaguuauuauauugcugaugucauugguuaacuaaggcagccuugugauaaguuuucagcaguuaccuuggaaaaugucaacaaguucuuuccuauuaacaaaaacauauaaaaugucauagaccuuuaguaaccuaaaaaguacuuaggcugugagagguauuuucuaaaaccuguuaguuuuaaccuaaaacuauuaauaauuuauggaccccucauauacagggucaagauaauuuacauggcuggccuaaauacaguugucguaauaguugauaaaguguauucaucagacguccauuucucuucagaguucaaggcagcuugccucgagauuucaugaacaguuuaucguaagagaagaucugaugggucuagcuauugguacucauggugcuaauauucagcaagcuagaaaaguaccuggggucacugcuauugaucuagaugaagauaccugcacauuucauauuuauggagagguaaauauuuuacugcauaguuuuuuuuuccccaaacaaguauuucagcuggcuaaucuuuugucuuaaaauguuuccccuuuuauuaggaucaggaugcagugaaaaaagcuagaagcuuucucgaauuugcugaagauguaauacaaguuccaaggaacuuaguagguaagucagaaguaucuguugacauauaguacaacaacuaaguuuagguaaacaguuuauuuauagugauagaauuccauuuuuucuuacuggaggguaucauuuaauugaaacauagucuuugaaauaugaucuguucuuuuuuuuuauuauuuaaguuuuaggguacaugugcacaaugugcagguuaguuacauauguauacacgugacaugcuggugcgcugcacccacuaacuugucaucuagcauuagguauaucucccaacgcuaucccuccccccuccccccaccccacaacaguccccagagugugauguuccccuuccuguguccauguguucucauuguucaaucgaucuguucuuacagcauacaaaaaaauauuuguuaaguaugaugcucaaagguuacauuuucagaagguauucaaaagagauugcuuuucuaguucaaaccuacuaauaccugaaaggauaaaucuugcccagcccuccugacuguauaccuuuuauaucuuaaaauuaaauaauuuuucaaaaugaaugauauuuggggacuuuaugauuugaaauagauuuguauuugaucuuucuuaugggacuauaaaaugauagcauucauuuuaauuaucucaggguugaagaucugaacauagguuacuuaaaucuaaaaagucccaaagcuagaagaaacuucagaugucucugggacuuucugcaaagucaauaguaauucuccauuuugacuugaguaguguuuuaucaccaucaccaucgugaguaucagcaaauauuuaggagcucuucaccaauacuccuaaaugcugcagauaucuuuaguagaacauaucaaaaccaggugcaguuuuaucaagaaagcuacauauguuuuuaauuuguaaauaaaauugggacauacugccuauauguuuuuuaucuuuuaaacuugagaucauggccauuuuauauaaaguaauacauguucuuuggaaacuuuaaagaagaaagcaaggacuucucauacauucuguuuacguaguuucaaugcuaauuuagccugcuuuuuugucagcauagacucauaaacaucuuccuugucauuaacaaacacuagaaaugauaaauguaucucccaaagaaaauuagcuugaagauaaagugcaaauaguaggaaaauaaugcagaaguguuagcucaacuguguacuacagacaacuggagaaauguguuuguaauguuacuaagguaacuugcauaccaauuguauguguacagaauguaugcauagcgcaagauaaagugcuaaucucaagacaguugggugaugaauaauauuuauuuucuucuuuacagcuugucaagcaauugcauaccuuuuguaguuagaaagguuauuguaaauuuaggaauucuuauggaaaaagagcugguaguuguuuuguuuuuuuuuuuuaauagcaaaugaguagagaauuaugugucagauucauuaaaguugguuuugaagauggcaugaugguaguggggaaagugcuugggcauuggaguuggaucuggauuucaguccuacuuuauucuuugguggcaaugugagcgugggucacugucuuagccccccugagaauuauuuuucuuaccuaucaaaugugauaauaggauccaccucauagaguugaugugauaauuaaauuggaagauauaguaggggacaauucuggacacaguaggggacucuguucuucaccuuauucaaaacaacuccauuucaguagaacagaaucacaguaaauugcucuuugggauuuggaaauaaguguaauguagaauuggauuauuugcuauuaaauauuaaaaguagauucuaccugugguuaccuggaaagaagaggaucucagaaauaaccagaaagacugcuaaaaguaaaucagccuuguuuuuguuuuguuguuucuaguuaguaaaaugagauaauucuguuuuagagaugguccacugcaacacugggaacguuggaacuuuucagaaagcauuuuuguguaagauucugcaaggcagaucuuuagagaggugucauaaucaguuuugcauguguuuuguuugagucaaccaacguuauuugugaucucuauuuuucacaaacucucuuugguaugugcacuaauuuaucuuuucauuaaaauuggauucuucacucacuaagaaugaauugguaugacuauucagucagcuauaguuaacacacaguacuuaggauaauuaagauauuaucuuaauaaaaacauccccaaaucucauuuuucauuuuguuaacucacuuagaucuuuauuaaagucaacauuaauucaugaaaauguaaguguugcaguuuaaaaucaaacugugugaagacuccaaguagcuucucucaccucaccuuuccccuuuucguuauagaagaacagaaauaauugacagaaggaccuagaccaagaauccugauuuaauggugucagaucuguucuaugaccagucaaagaguuucuaggggugaaugaggcagccacacacagcaagaaugucaaagcuaugcucugauuacaagagccacaagaauuuuuugugagaaggcuuuucacugaguucuuaucuagcauuggcucaaagcaaauuuuugcuuccaucuuuucccccaacuuugccuugagcuuugccuuuaaaggcgaaaaggaaaaaauggaagaugagauggugagggcaagcacaugguggauguggccaauguaaggguacuuagguaccuugggugagcccucagaaucagauguaguucacauguacauuuccagaauuaguaauucuuaaguuuguaaugucuugcuuuaccacucgugucaugaugcaaaugaaagcagucauuuuccaguaauguauaugauuguaaaauaaauaaggaaaugaucaaguaccuauuuuuuacugguacuugaaaucccaaguuuuaauagauguuacugaaaaauacuuaaauugguuuaaagcuuuuucauugugguuuugaguuaucuuaaaguggguuuucuuaaucuuuuacucugugacuaaucccuucacuuuuuaauacauugcuaaaguuuguaaguaaugcacaggagugauacucuguuaacacauugaccuugaagaauuuguauuccuuuuggauguauguauagcugcuuaagccacuuucagacuuagauuaucuuuuauaaaugugccuuccauacagaauucugaaaauauuuaccauggacaaagaagcagauuuaaaucagguacagacaagaauugaaaguguugaauaagugaauauauuucccauucucucuacuuuuuucuuaauucuuauagaacuuugcagaaagaaugauacauaccacaguaccagcaaguuuaaagcguacccuuuugugcaaaaauaagagguuaucuuugaacugccuuaaaaauccaaaauuacccuaucaguuugcaaguauuaaucaacucugguaccugaccaaaggaguuuaaacaaugauguccuaauuaaacagaaaaccagauuaaccaucuuguugaaaagagucucuacuuugguuuugaaaucuuacaauucaauacauacacauacacauaaaaauaucuaucuauaugaauguaauaguuuacaguagggcugugcuuacugcuuugagguauguguuuuuaaaaccaaacuugauuuauuuauuucuuaggcaaaguaauaggaaaaaauggaaagcugauucaggagauuguggacaagucaggaguugugagggugaggauugaggcugaaaaugagaaaaauguuccacaagaagagguauguuacagugcgaauauuuuguggcacauauaauaaaaguaaaaguuuuuuaugugauauguugaggaccucuaauaugugcauaaagugaaugcaaauauucugauuaucaagcaugccugcuguaauuaauguuauaauuguagauaauggcccuucucuguccucuaaugcagugaguuuggauuagucacuuuauugaauucuuuuuuccugaucuuuaaaauggguaguuauaaauuuuuaaauaugagacauacaucacugggucgaguguuaauggcaauuuaauaaaauaauauauauguaaaugcuucguaaagcacuuuguaaauguuaauguugcugacaaaagcaaaauuggaacacagguuuucuggcuuucaucuuuucacuuuuuuaguguggggauuguguaguauguguguuuauucugugugcuuuaaauuuauuucugugcuuaauaucucuuccccauccuccuuaccuuuaaauucuguaacccuuuuaucuucauaaauauaugcuuuuuguagcagcuuuuaaaguauuugcaugggguagagaggugaggaugcaccuuucugugcaauaguacucuuaagauacugucucaucaaagagccguaauuuucacauauugucuagcuuucuuuuugaaagauucuuuuagcuaaaguuaaaucuuuuuuuucugcguacaauuuguauucgguaauuuuauaaaccaaaacuguuuauaauaacuuacauuuuuuaaaaauaugaugauugauaacacuaauagagcuaaauaaagucuuaaauugguccuuuuuuucucuuuuguguuuucuguuuuuuaccaaggaaauuaugccaccaaauucccuuccuuccaauaauucaaggguuggaccuaaugccccagaagaaaaaaaacauuuagauauaaaggaaaacagcacccauuuuucucaaccuaacaguacaaaaguccagaggguaagaauuacuugucacuuugaauuacaauacaaguaauuugucucagaugucacaauugguauuuuggauguuuucucugguuagacuuguaggcuacuuauguucuauuuuuuuuccaaauguaauugccagcuuaugagauacuacaaauuagugugauacauacuuuucaauuuauucacaguaacaacucuuaugccauaaacacaaaauaaugggguugcauuuaguggucacauuuuucuuuugacaguggacucucuuuuuuccaugccuucucucuuuaaauuuugcagguaucguagcucaaaauacaccuucuguuaguugcauuaguuacuacuugaaccauauuuuagaaacuaauuuucucuguuugaacuaaucuguuuagaaauggguuuaaaaguccugcagugaaaguccugcguucaggcuucuguguaucguuuguuauaguuaaugacaucccuugcauuccuuauacugcuuuagguguuaguggcuucaucaguuguagcaggggaaucccagaaaccugaacucaaggcuuggcagguaggaaaacauuccuugagaaauacacuuucaguuuauauuuuaauguuuauuccccuuguuaacaaagauuacaaaugauccucaggauuagggacuggagggaggaguguuuguggguauguggauccauugcccuggaguuaaagcuuaaacaccuucaugccgcuuguaaggcuuuuccuaauuacuugucuaguuaucaucuuuaaauuaucuucucccuugcacucuagagaaccuuaagccauacugaaguacuuugaguucucugaacauucucgugcuuauuuugcuucuagacauauguacagguuuacucugccuggaaugcuuuuucuccuccacaugucaccucauuuugaccuuauuccuuacaaagcuuuccuuguguacuugccgaagauccccacccccuugacugguucaagagccuuccccuucuguuuugcaaugugcucaccccuagcauagcacuuaaacauagauguuuauuuguugaucuccucaaccacauuguaaguucuuugagggcagggagagcuggugagaacuguuuauggaaaaaaauguuguggacucauggauuaaaagcaaaggugccauuuuacaaagaggacuauaacggcaaguggauuggauaugucucauugccgggcagcccauuauuccagaacacagaguaacuuuuuucugggguccguacuaaaggccaucauuccauucuugccuuucuucauuuuaauuuacuauucaggucuacucgugaagugcuuaaauuagaguggcccuugggguacuccagcaguuuagacauguugcaagaaaagauauucguaaauaauuugcuccgaagucaaucuaacuaaaucuguuacauaggauuuuaaagcuauuuuggugauauuugacccagagggaaggguguagcauucauuccaucacaugguauuuugggaaauaauacaguuaaaggcuuuuguaacaaauaaagcuuguuggagaaaaacccaacaugcagaaaugaauugccaguuauuaauuugcacaauuguuucuagguuucccuauaacuugugacaagaaguaguuguuuuuuuuuucccucuuaauauauauauauaugggcuaggaguacagacauuuagcauaugccuuuuaaaaaucuguucuuauguuaaguaguguccauagagagaaguucaaacuuuccuugugauucagccuuuuaaaauuuucagaguacauuauugaaauguguaugggcuugauaaaacuuaaugcuugucaauguaccuauuuuuuugucucacagauuauucagugcauuuuuauccugauguuuuuguuuguauuuuguguguacucuauuuacuugguuagcagaaaugauuuacuuuuuacuuuuguacccuugguauuucauuuugauuuuuuuuuuaagaauuugaucggccaggcgcgauggcucaugccuguagucccgacacuuugggaggccaaggcaggcagaucgccugagcccaggaauucgagaccagccugggcaauguggcgaaaccccgucucuacagaaaguacaaaaauuuagcuggguaugauggcaugcacguguugucccagcuauccaggaggcugaggugggaggaacaccuagggccuggggaggucgaggcuacagcgagccauuaucaugccacugcacuccagccuggauaacagaauaaaaagacccugucucaaaaaaaaaaaaaaaaaaagaggcggaggcgggcggaucacgaggucaggagaucgagaccaucccagcuaaaacagugaaacccugucucuacuaaaaaaacaaaacauuagccgggcguaguggcgggugccuguagucccagcuacuugggaggcugaggcaggagaauggcgugaacccgggagguggagcuugcagugagccgagaucccgccacugcacuccagccugggcgacagagcgagacuccgucucaaaaaaaaaaaaaaaaaaacaaaaaagaaaaaaaaaaaagaaaaaauuuugaucaggauaaagccuuucauaaaugaauuagagcaucuuauacuacucauuuuguuuauacaucucaugguaaagcuuguauaauuuugaauuauacauuuugugauuuugcugauacugaauacuagucuuuauaauaaucugauacguuuaaaagguugcuauugaucuauucguauucacaguagauguguaaaguaguauaucaacuacuuuuguuuucauauauugauuuauauuuacagcaaacauuuguauaccugcuguucaccagauccugugcuagggaauuagucguuauuugcauuuuucagauuaaucuaucauuacuuuuauaggaucauuguugcaauuucuuuuucaggguaugguaccauuuguuuuugugggaacaaaggacagcaucgcuaaugccacuguucuuuuggauuaucaccugaacuauuuaaaggugagaacagaaagaacuuuaacuucuaauccuuuuguacuaaaauauacaaacuuuauaguagaucuuucagcaguuaggacucauucuagccugugcaaaacacuguaugacuugucaaagguaauagagaaaauacguuguuuggcuuauaauuuuuuuaaaaauggaagucuuuauaaauuuaaguaccaauauaccaguuuucaauaaaauuuuauacuucccuuuauucuucucuuaaacccuuacacucaguuuaggcaauccuguacauagccuguuaauccauuugauccuuucuagcauuuugguuuuuuccagacaaaaaucugugucuauaacucuugccuuuauuguuccuuuuaugucauuuaucaaggaaaucuaagcauuucaugaaguucuuuguuuaaauguuuacccuauuuuucucuuuacuguuauucaaaauacaaacuauuugugucuucucauaaauguucaguuuaguuagugugaugcgguuaugccuccuuaaaauuucaaacuggaagauaggaacgaggaggcuacaagguguaguggagcaagcacuggaugggcaaugcagcaauuuacuuauaagacuucagcaaaugaacuagcugugugacuuuaggcaagucacuucccuacacuagaugcuucuugaaauuccuuuuggccaaaauguucuauacuuuaaugaaauggaaacugaucuacuucauuuucauaauguuuuauuuguauccauacauaucaaaauuauaauguagcugguauuaaauguuuuuaaaaagcauuucaacucuauuuauggcauuaagaauuuuuuugcugauuucuugaaagaaauaaaaaguacaugauuucugcuuguguguaaauaagaaugaaaggaagaaaaaguguaauacugggcaugccauucauucuuaugguggccaguuaauuaaaaguggaaagguuucauccagcaagguuuacauggguaggauaccucuuugauuuuuuuuuaaguauguuuauguguaaucucucugugugugugucucucucguaauuagcuuaaaucaucaugaaggccuggagaguuaggauugcauuguaucaaaucccuuguucuuuugacuaauguucuuucuuagauccuuugauuuauucucaagaauaucuucuuugguuaucagcagcugcccuguugccauucuuuccaucaccagaacuucccucguuugggccuggcaucucucaccaaaaggugacugcuuugccccagugggauaaccuggacuacucuucuguuuugcaagauauuccuauuccaugagcuauuacuauaccuuuggaggaagucacucacucagcugcagucucuccuuugcucaaauucuauguaaaacagauucugguguaacuauguaaauugcuaaugauggcagagcacagaugaaacggaccaaauccuuaccugaccuuucuuuuccagaagcugccacaaccaagauuuuagaaacuuagcuuuacaggagcuucuccaaugacuguucauguagacagucucuaugauaaccucugcuucacugagacgccuacuacuacuauaguuaugaaucugauuccccguagccaguaaaugagauguuuaugaguggauuggaaggacagugguuagaaaugagguuucaucugguuuuaacagaacccaacauacuggaagugcuuuuuguaagggucugucauuggaccccagguguauauuucuaucaacuaaauguauacuguuucucguacuuguuguagcagaguuguagucuuuaggaaguuuucaaggcaugauguaagaccuagcugucuggucagcuauuaaauaguuuuguuuuccccucaugaggaauagucagcauuuucaguugaugaaaaaaucauuguuccuuaaccauaguauauguucuuuuaaaacaaaagauggcccaaacucaaugcuuuguaaauuaagauauuaacuggcaaaucuauuuuaaucaagauuauuuacaaugugugauuuuuuaagguuagcugguuauaccuugaaugucauuuaucuauauucauacauuuuagcauguuuuauuuaauauccuaucaugaagaaguccccaaaauagcauaucugugccuuagcaguagaauaauuggauaauagugccaaauuagacaacuuuaaauuuuauucaguauaauuuuacugcugaguguuuuuguuauaucucuaauucuugacaucaauaaucuguuaucuguaguaauuuucuuuuuaaggagaucauucaauuuccugauaauucuguguaacaguguuuacuguaaauuuagaacugaaauugaaauauuccaguauauuuuuaucugaugaaaaggagaaagguuuuauuaaguaaaaugucaaauuauuuuuacuguuaucuuguauauuuuaaauaggaaguagaccaguugcguuuggagagauuacaaauugaugagcaguugcgacagauuggagcuaguucuagaccaccaccaaaucguacagauaaggaaaaaagcuaugugacugaugauggucaaggaaugggucgagguaguagaccuuacagaaauagggggcacggcagacgcgguccuggauauacuucagguacaaacuaagcauuuuacucaguaacuuuaucuguuccuagacuuauagcugcuaaucucuaauauucauuagaaccccauuauaacaauuugccgcuacaugguuuccaauucacaguggguuaaauuguguuacaggagacauagaguaaaaaccugaugauaaacacguagaguucacagggccggugcaaguucuguucaugcucugauuggggguaaaucugcaaagcccuuguguguugaugauuuucuuaaggccucuccugauuuuauaacuguauagucaaaacuuuuuucauuuguguacuguggcucauuuuuauuuugucagguaugugcuggucauacuugcuggauggacuguguaaaucaggggucugccucuuguggcucauaaggugauuuugagugacauggccaaagucagcccuaggcacagucaagaaguaggcgaaguuucucuuugccuucccagcuuuucuguccgugcuucuuucuucucucccaguaccuuucagugaaccugauccccaccugccagugccuacugucuuucuugcucaacaguguaucuccuuuguaacuugcuaaugaugguauaagguauaauccauuucacgcauauuugcauuucaaaaaggaacucuuuaagauggaaaagccuucaagauccacaggaaugaagcuauaauggugaagcuauaauuggucauuagcuccaacagaggaagagagagguaguagagcugauauucuggaguuggggagaguuaccuacuccuaaggccaaccuugaaccuaaccccuaaccccucucccaacagucuguucuuuuuacucaugaauuucugccucaccguggagcucuuuuucuccgcuccuguccucuaagucguuaaccccuucaggcauaaugaauuuauuauaguaauucuuuauuaaugaucaauuauuguaaugggagugggagggcagguuguggaccaaacaucaggcaagcauguaucugccuucagcuagauccaauccaugacccacaagagacccuucccugaagcaguugccaugguggccuccuuugccacccucucagaaaugaccaaaauauauacauuccccucuguccugggccaaaucuugcuaaaaggagcucucuuuuuagagguuuuguuuaucaggguaucacacuuaacugucguggauaaucuuuuccuccagagaguauagauguuuaaaggaacacagcuauuuaaugauauggcacaucaagguuugaacuuagguggcuaauaacauaccuuuuuaaaaaugagaaugaaacauguuuauaaccaaaauuaaccucaaauauugcaaagcccuucauuuugaguuuaaaauuuuguuuuaugaaauggaaagugauaauacucuuggugggcuuauaaauugggaagaguuuuggauuaccccugaaacgucucuggaagcuucuguuaacccucuuuuuuuuuuuuuuaaagucagacaaugguauauaacuuuuaacucucgauaggaacuaauucugaagcaucaaaugcuucugaaacagaaucugaccacagagacgaacucagugauuggucauuagcuccaacagaggaagagagggagagcuuccugcgcagaggagacggacggcggcguggagggggaggaagaggacaaggaggaagaggacguggaggaggcuucaaagguauggagaucuucauuaagaaaucaaagugaauuguaacagcugucuugaaguuccaugagaaauccuauugaugcaaugaacuguuaccaagaucccaucucucccguuuugugcugauaccauaggaaaggaucagccuuccacuuguguagaaagaaagaauauuaggcagccuuccuuaugguucauacagauauaugaauaaaugcugauaacuaauucagcaucuuggugggucuaaacagcaucccuucauuaacucacauugaccuguagaugcagaauuauaauaacugugaaauauuuucuguuacuuagcagcaggcuagauuauuagccauuguguaacuggaaucacugggguauugauuacauuucagauucugugguugguuuaaauagagggugugggaauaaagaacuuccaguaagcauuucagaaucaguaacuguugaaccuuuugaaaauauucucauaggaaacgacgaucacucccgaacagauaaucguccacguaauccaagagaggcuaaaggaagaacaacagauggaucccuucagguaaaaccugucugccucuuuucaucuuaauuguuugaauaugguaguuugagauuuaugaguuuauuuuacuuuauuaaaaacauguucaaagauuacaaauccaguuuaugugaaauauuuuaccuucaacauuacaauuguagucaaucuuaguucuuugugacaaguauacaaauaagaggauuucucuagagaauaugcagucugaguauuugugaagaccuugacagccacacuaugauuuuauuauuuauuauuuauuuuuauuuuuuugagacgggaguuucgcuuuuguugcccaggcuggagugcaauggcgcaaucucggcucagagcaaccucugccucccggguucaagugauucuccugccucagccuccugaguagcuggaauuacaggcauccacuaccaugcccagcuaauuuuuguauuuuuaguagagacgggguuucaccauguuggucaggcuggucuugaacucccaaccucaggugaucugcccaccuuggccucccagugugcugggauuacaggcgugagcacugugcccagccacacuaugauuuuaauaccacauugguagaccugcaaucccccagagaaggaacauccugggauguacuuagagaccucaguaaaccuuaugugucuuugcucccccaaauuaacagggauaggguauucucuuugaauagaaaauaaggaaaagaaggugucugucuuacaacuaauaaucaugauagacagagcugaugauauucagcuagucuccaugcuuggucagucaucugcuuauuuacagccaggaccuaguccgaggaucucuucucaauuggcugucaccagugcuaaaccaauuguuaaauaauuuuaaaauuaucuccugagcacauccaggcaccuuugcuaagugcuuuguguauguuuuaucucauuuaaucuuacagcaacccacugagguaguuuuauuauuccacuuuauaggugagugcacuguagcuucaguccuuugcccacagucacauagcuagcauauguccaaaugauagucaaaccuuagugucugauucucugaaucuauguugucgucuacuuuuucuguaacuuuuaauuauuaaguaguuaggguuccuuccugacuauggauucauuugggaccaucacccaagauuagugagagauacuuuuuaagacaaaguuuaugauggaauauuucuuggaauucauagcagcucaaaguaaguguuaacuauugguggguucuuaaggaccagcauguccaagggauagauagauugguaaauuacuguauguaccugucuuuuacaaagcuauaagauauuuaaguacccguuuuguaauuuuccacuuaaacugauauguuugaugaacuuggcagucuaacugcauugguuaaaaggaugcacauuuauauuucuaaaugaaauggaauacugaauuuaaaaggugauguuuucucuauuaaguaugaaaauagauacaaaucuggccaggcgcggugcucacgccuguagucccagcgcuuugggaggccaagguggucagaucaccugaggucaggaguucgagaccagccuggcuaacauggugaaaccccauuucuacuaaaaauacaaaaaauuagccagacguguuggcgggcaccuguaaucucagcuacucgggaggcugaggcaggagaaucgcuugaacccagguggcagagguugcagugagccaagaucuugccauugcacuccagccugagcaacaagagcaaaacaccaucucaaaaaaaaaaaaaaagggccaggcacgguggcgcacgccuguaaucccagcacuuugggaggccaaggcggguggaucacaaggucaggagaucgagaccauccuggcuaacauggugaaaccccaucucuacuaaaaauacaaaaaauuagccgggcaugguggcgggcaccuauagucccagcuacucaggaggcugaggcaggaggauggcgugaaccugggaggcggagcuugcagugagccaagaucgcgccacugcacuccagccugggcgacagagcgagacugucugggaaaaaaaaaaaaaaagauacaaaucaaaguacugaauccuugguaacgagacauuuaaaacacaugcacauacccacuacuuaaacauacuuugaaauuacaaccauuuggggauguuuuuagcauuugugcuugaaguagaucaauauuuguaguuguuuuaguuccauuugucacuguuaacuuucauuuguaccucuggaauuagcagugcuguauucagcauuggcacuuaaaauauuuuauagcucuuagaacacuauuuuuuaaauuacauugaucuuuauacucuccuaggauuccaguccuuccacaaauuauuauaugcaguuuucuuuauacuguuccauucuucagacagaguucagguuguaggaucaucugaauuuucuuagugaaauacaagccaguagaaaccaaagcucguguuuuucuacuguaugacuaugggagcucucaguauagagaaacuugaucauaccugugauagauauaaagauguaaauuaaagucuaguuagugaguuauuugaggguaaagccagaauaggaaaacauuuuguuucucuuuuccugggcuucacaaucuuuggagaauaacuaauuuuauuuuaacucuaguguuagaggcauguaugucuucugguaaucaguaauaguaauucauuuuaccuguuuguuucucacuguuuuauucuacuuagaagaagacaugauaggauugugaguuuuucucuaacuuuggaugcagugagaugaccaguguguuccaguuaaagaagaagaguguuuuaaaaucauaaaccaaauaaagaauccuaccuuacauuaauuucuugcacuucuucuguucucaucuccauuucucuuuuuaacauguggaauuuacacuucagguuuaaauuucuugucaggccaauuacagauuacaguaggauauggucuguguauauaacaacuauaacuuguuuuagaucagaguugacugcaauaaugaaaggaguguccacacuaaaacauuacagaauaccuccagugaagguagucggcugcgcacggguaaagaucguaaccagaagaaagagaagccagacagcguggauggucagcaaccacucgugaauggaguacccuaaacugcauaauucugaaguuauauuuccuauaccauuuccguaauucuuauuccauauuagaaaacuuuguuaggccaaagacaaauaguaggcaagauggcacagggcaugaaaugaacacaaauuaugcuaagaauuuuuuauuuuuugguauuggccauaagcaacaauuuucagauuugcacaaaaagauaccuuaaaauuugaaacauugcuuuuaaaacuacuuagcacuucagggcagauuuuaguuuuauuuucuaaaguacugagcagugauauucuuuguuaauuuggaccauuuuccugcauugggugaucauucaccaguacauucucaguuuuucuuaauauauagcauuuaugguaaucauauuagacuucuguuuucaaucucguauagaagucuucaugaaaugcuaugucauuucauguccugugucaguuuauguuuugguccacuuuuccaguauuuuaguggacccugaaaugugugugaugugacauuugucauuuucauuagcaaaaaaaguuguaugaucugugccuuuuuuauaucuuggcagguaggaauauuauauuuggaugcagaguucagggaagauaaguuggaaacacuaaauguuaaagauguagcaaacccugucaaacauuaguacuuuauagaagaaugcaugcuuuccauauuuuuuuccuuacauaaacaucagguuaggcaguauaaagaauaggacuuguuuuuguuuuuguuuuguugcacugaaguuugauaaauaguguuauugagagagauguguaauuuuucuguauagacaggagaagaaagaacuaucuucaucugagagaggcuaaaauguuuucagcuaggaacaaaucuuccuggucgaaaguuaguaggauaugccugcucuuuggccugaugaccaauuuuaacuuagagcuuuuuuuuuuuaauuuugucugccccaaguuuugugaaauuuuucauauuuuaauuucaagcuuauuuuggagagauaggaaggucauuuccauguaugcauaauaauccugcaaaguacagguacuuugucuaagaaacauuggaagcagguuaaauguuuuguaaacuuugaaauauauggucuaauguuuaagcagaauuggaaaagacuaagaucgguuaacaaauaacaacuuuuuuuucuuuuuuucuuuuguuuuuugaaguguugggguuugguuuuguuuuuugagucuuuuuuuuuuaagugaaauuuauugaggaaaaauaugugaaggaccuucacucuaagauguuauauuuuucuuaaaaaguaacuccuaguagggguaccacugaaucuguacagagccguaaaaacugaaguucugccucugauguauuuugugaguuuguuucuuugaauuuucauuuuacaguuacuuuuccuugcauacaaacaagcauauaaaauggcaacaaacugcacaugauuucacaaauauuaaaaagucuuuuaaaaaguauugccaaacauuaauguugauuucuaguuauuuauucugggaauguauaguauuugaaaacagaaauugguaccuugcacacaucaucuguaagcuguuugguuuuaaaauacuguagauaauuaaccaagguagaaugaccuuguaauguaacugcucuugggcaauauucucuguacauauuagcgacaacagauuggauuuuauguugacauuuguuugguuauagugcaauauauuuuguaugcaagcaguuucaauaaaguuugaucuuccucugcuaaauugauguugaugcaauccuuacaaaugauugcuuuuaaaauuuuaagcuaggaaaagaaaucuauagaaaguguucuguuacaaaauguaacuguuaccauuggaaauuucacgucauaggaaguuagccuuuaucuaccaacuuucaagaacuuguuuaauaaagcgaaaaacucaaccaaaugguacaaaaccacaguguaccauuaaaauaugcacuaagucucuuuuuuacaaaggcuguauucagcaaggcgcuaacuugcuuaaaugugaauuacuaacuucuaaaacuguacuuugauucacauguuuucaaauggaguuggaguucauucauauuacaauauuugugugcuaaacguguauguuuuucaguucaaagucaugauguuuuuaaaaucuuauuaaaguuucaaaaaucugaagauuguuuaucuagauguaaauuuuuauuaaaaaguugcacuuaugaaaaagcaaaaa

SEQ ID NO: 19007 - RNA, 6193 nt, Homo sapiens
uauaauggcacagcaguuuuaauacaaccaccaaucuucacaaaauaauuuuaauacuuugugccugggcuagcagcaucuugcacugugacauuccuauacagacauaagcauuuuauccaaguacaaauguuaaaagcagaguaacuuaagcaauuguguauacaaagguauacagacacuguagguuauuuuucuucuugaaucauuuuugcugcauaguaaauugcaauuacaugucaguauaauguuacugaucuauagaauacacuuugaacugugagguauggcagcucccuaugagagagagcuaacauguaaaccugaauauuuugagugauuuuuguuuuagcugccacagaugggaaagacaaaaaaaaaaaaaaaaauuccagcauucaaagacccuagagacuuacuuuucuaaucaauuaaaaaaaaaggucuuucaguacuucucaucuauuuucuagcauucccuuaucggagcacuguugaacaaagaaagaaagaaaauacugaggugaagcuauguuuguuaugggauuauggauuaaaucaguuauuuaaaaaaaaaaaaauccgccagguaacugcucauuuacuuuacaucaaguugagaucuugauacauauauauauauaucucaacuuuauaauucaagauugcaguuaaauauuucuaauucacuugaauuaccauauuaauaagacaauuagaaaccuuauauuuucuuaauacagacaugcuuaacauuuucugacauuacuucuaaacucagaugaagcauaaacucuccccaaaacugcucuaaaaguuaagugguugaguugguagcaaaagcuaucaugguuuaacauuuccaccacagaguagauacaaguaaaggucacugcaguuuaaacaucuaacagguaagaaauuaacaugaaccaacuaacugaaauuagaauacugccauuccauguuugaauauuuucaauacucaaguuucauauuuucaaaauggacaguaauacaguuucccuauguuuugauacaauuucacuauaaauuaugggcccagauuacacuuuuaauguuggaauuggguggucacucauacauuauuuaaauacucuagaagauaaaucaugaucaguuaaauuuaucauaguuaacuaucacaaaacaucagugguaauaaaagaaucacagaaauggaaucaaauagaauaaagaauaggaagagcuaccagaacuacuuaaacauuagguggacagacaugcaagaaaaaacaaaccuguaauguucuuauaugaaauaauaaacuucaugguuugucuacauuaauauuguacucagccaggcgcaguggcucacgccuguaaucccagcacuuugggaggccgagguggguggaucacuugaggucaggaguuugagaccagccuggccaacauggugaaaccccaucucuacuaaaacuacaaaaauuagccaggcaugguggcaugugccucuaaccccagcuacuugggaggcugaggcaggaaaaucacuugaacccaggagguggagguugcagugagccaagauugugccacuguacuccagccugggugacauuagagacucugucucaaaaaaaaaaaaaaaucuaucuaucuauauauauauauauacacacagaguacucaagaugaugacagucccuuuucccaguguuugugagagacuguaauauacaguacugggcaggcacuucagugacaacauaaaaauuacaguggauagaaaauguggaaaauuaccagcuacaaauuaucaauaacaaaaucuguucuuuuggccagacuacuagagaggauauauguauauuuaugaaacaaguuuuuaaaaccuaaacuuacuauuaugaagauucuuuuaagcagaguuucugcuaaaugaagcaucauagauuauuauuacacuguaagagaucuuugcugaccugcccaauagugaucuauauacaggaaagcuguguuaucuggaacuuuuaucaacuggaauuuuagaaaacccaaugcgaaucuugacuccacuagaccacuguacaucaaaagaccuaaucacaaagcagaauacuggacgacaacgagauuaacaauaugcuguuuucacagugguaagauaagagaagggaaggggagggaaaucagaagagaaauaucaccugggucaauaggaauuaacucuuaauuaacaauuuuaauuaaucuccacucucccacuaugcuggguaagaaagcuuuuacuguauuaucacaucauagagaggaaagcaaagcaaguaacuugguguaauagguuacuuugcauaguaccucuugguaccaagggaacauacagaaaucauucccauuaguaaagcaccucaagagaggauugagaaaaguuagauacaaaggaguuuuguuugugcuacccuaaagucaucaacuauaaaaaguuaaaaacacuccucucuucccuuacauacuuaaaauagcaaaaauguuuucuuagaacuuuuauacacacaaacuaaaacauagccaaaaauccauaaagugacuuuacuaaagcaaauuauggggcagaucuggacuaacugaaugucaagaauggauuaaaaugcuaauuuaaaauacacuagucucccacaaaucaccuuccccaaagaaaagcuucuguuugagccggaacaaucucacagaaucauuaagacaacauaaaaagaaagaguaaacauucuauauuccaaauaauuuacuaauauuucuuccagccucguacuuucaguuuaaacuaauuuaugguuuaaaaagaaaggaaauuacacaaaaauguuaagaacuuuucaguguucuacauacuaauuuagaggccaugaggauuuaauuauuuuuuuuaaaugaugcaaggcacuuuucuuuuuuggggcuucauuuagaaaaaaauaaugcuacauugguuuauuagauucuauuuagaaucauuuuggacaaaggaaaaaagggcuggacaacucugaaaagaacaaauacaacguuuggcuuuuacugccaaaaaaugcaaaaaggaaagucacucgaaaaucuaacacuauccuuguguuuaagcacuugguacuauaaaucaaaacguuuuccuuuuaucauggaaacuguaguuuuuaaaauauagaaaaauuaggaaaguaauaagaaaggaagcaauaauuagaucaaguuaaaguaaggacagcuaauuaggaucaugauuuaaagauuaauaauggaagaaguauaaaaaauaaaaugguaauuaagcuauuaaguuauacuaaaaaagaaauguggcagauuccugcauuuuguuaauguuucuguaagaggcuccaucauaaaauugaacuguaaaauuauguuaaaaauguaauauauagaacagaaaaaugaauuuuuagcaaaccuuagcaaauuuuguuauaaauuacccaaacuuuauaaacaauccccccauacuugcauuuuguuuaaaguaauaacuuuauaucauacaaauaaauuucaaguaugaaaagugcauuauugcaauaauaccucuuugcaaguccaaaauucuugguuuauaauaaaacuuguaaagcaugugugugugcgcgcgcauguguuuuuaaaaaaaggaguaaaaccaucagugucaucuauugcagaaguccaacaucuuaaaauguugcucaacaaguugcagagaaguaugucuggaagcaacauguaauugaaaaaaaaacuacuuauguuuuuaccauuuuacauuauaauuuucucuuguauuuucuccuucccaaauagaaauucacacucuaugauguugcucuucaagucagccauucugugcagucgccacuugcaugguuccaaaaucauccucuucuucauguguucucuucaaacugccuaaaaguuauugcaugaagauuaaaagggcacuaaaauaaauucauguuaaaagguuacagcaaguaaaauuuuguuauuaagugaucauguauacacuaugaaaauuccacaacugauauagcaaaauuuaguaaauuccuuugugauaaauuaccuaaauauuauaacuuuuuaaucuucaugacaggauauauuuuccuucucaaguauuaugucuuagguauugcauauaaaauaaauaauuuuugaaauagugugaaaauagaccuuuucaagagauaauacauaaauguuuaguuaucaaguuaauuguuuuuuaggcaccauaaacaugugacuuagggcauaaaauuuaggaaauuaaucuuguauuuguauaauuuuuuguagauaaucuuuuugcuuucacagaggcuguuaugaagagcagcugaaaauauuuuuccacucaagcuaucgaagucuagguugggagaaaggaaggcauguagcauauaaagagauuuucuuuuaucuauucuucauaccagcaucugcuaguacagaaaucucccacauagaaucaaagcuaucucuguauccccaaaaguuauaaucaagaaauuagacucucaauggaggaaaacuuuagggaacaguuaaaccagcagagggucugcuguguuuuuugccuaacaauggcaugaccuuaaacuuaugcccuacaggacuguuauaucaugguaauaauaauguuaauucagagggcauauucuaauugaagaauguuucacuauaaaauucauaaagauaaaaauauaguaucaauacaauugaaugagauaaaauauccuagcccucaggcuaaacccagauacugugauuaaguuucagaugaagugcugugcuucuaugggaacuccaaaugacuagggguuaaaggaagagugcauuaaucaucaugucuuccugaggagaugacauaugaaccaagaauagggagacuaaaugugaugcauuuuagguggggaaaagaagacacacacaggaaaccaucagcaguuguuuucugaaaugcagacauaaagaagaacaaugagagaaagaaaccaaaaaaucagaagggcauauggcauucuauaaacuuuuguaggaaugaagccaaaggaggcuuuggcaaaggaaaaauaucaauauuagaaauaucuuucaugggaauaagucuggccacaauguacagaacagaccaaauaacaagaguuuggaaaggaggcaaauccggaccugaacuagauuaaggucacuauuaaaaaaaggaaggaauguuaacaauacugacaaaacggacccuauaggauguggagagcaauuauuagacagauguggcaaaggaaaugaaaaagucaaugacaauuaggaaguugagccuuggggaugaauauacagucauauuacucacuaugggcagugcaguagagugcaaagaguucuauacuuguggaucagaucaccuguccucaauuuccaggucagugcuaaguauauaagcuguucuuacuaccuuauauaacuguugguucaaagauugaagugaacugcaggguaggaaaaacuggaaauaaaguaaaaaugccuugugugcuuuguugggagagaaacaaaggugauaaacacagguagcaaggucuugggaaaggaagauuuuaagagcaugcuuggauuaacuuugaaaauaaggggcuuaggguacuucugaaauagcaacagagggaggaaaggauggaaauauugauggcaagagaaagaagcucacauuagccaugcuacacgcuguauuaaccgcccucuacuuuuaauaagaucaccuaagcguguuuagggccccuucuccagauucguauuauuuuaaucuuuacaacacggauguacuacuacuugaaagacuuaagcuuauuauaguacacauuuauucauuauaaaaugaauccuucuggaauuagcucaauaguuuaacaaguuuucuaaacaauuuaaauuguucaguguaacuuguagcaaguucuccaccuuucauuaucuuucuucccaaauuucuccaaaaagaaaaaaauccuuaccugugguaccagaaugaacagauaaugaccuuucuaucuggaguggugacaucaucuguauuguuaauuuugcuagguagauggcuucauauuccuaaaaaaaaaauaaguuaauuaacuuaauuauauauuuacauucuuggaua

SEQ ID NO: 19008 - RNA, 819 nt, Homo sapiens
uuaucgauuuguuauucaaaaaaucuuauuucugacuggauucagacuuagaaguagaagcuugcagacaggaaagccugcauuucuuagcaauuuguuccugacgcuucuguuuagccuccuucauucucuuggccaaaaguuaagcauauucugcagccucuuccuaauuuuucuuaguaugcugcuucuccagagcaauauggcaccauuugugcugcaggacacauggaguaauaagacgcugaauuuugggugcuuugguccuagguuucuuaccuucuuuguuuaaaggcuuucuuacaacauacugguggacaucaucuucuuuagagagauugaaaaguuuguggauucugcuagcucuuuugggccccaggugaugaggcaucguaguaucagucaauccuggaauauuuuuaucuccuuuuuuuacaauaaccaaguuagagcacuccgauuggcauccacaaugcaaccacgaacugauuuucucuuucuuucuccaguucuccuuggucuguaacaggaaugccccuuacucauuagcaggcggacacggccaugaaucaagacaccccucuucauggggaaccauuguuugucauucccaccacugauuaggaccacauaacccuuccauucuucaaccagagcaucagcagcaacuucuguggccauaugcuucucauaaaaagugcagaguuugcguuuaucauccacuucaaugaguuucuggcagccaguggcugggaaagagauguccagcuucaucuugaagcaggugaaugccuccaaggcaccacgaaaaagagccca

SEQ ID NO: 19009 - RNA, 26642 nt, Homo sapiens
uucaucuccaguuuucacauguuccagauuuuaugcaaugagcauauauuacucugauaaugggguggagagacacaguaagcauaaaaccaaaccccaaacaaugcaaaggaaaaugaauauuuauucaauguccagauuggggaggggucuguguguuuaacaggaaaagauacagaaaaaaaccuaucacacaggaaaagauaaauauguuugauuauuuuaaaaggugaaacccauaaccaaaauuuaaaggcaaauucacacaaguggaaauacagaugcccaacuaucguacaaagagaaccaugaucaaggucacuaacaagcaaagaauuuuaaguuuuuuuuguuuuuuguuguuuuuuauuugagacggagucucgcucugucacccaggcuggagugcaguggcgcgaucuuggcucacugcaaccuccgccuccuggguucaagcaauucucugccucagccucccaaguagcugggauuacaggcgcccgccaccacgcccggcuaauuuuuguauuuuuaguagagacgggauuucaccaucuuggccaggcugguuuugaacuccugaccucgugauccacccgccucagccucccaaagugcugggauuacaggcgugagccaccgcgcccggcaagaauucaaaguuaaaacagguuaccacuuucaccuauuaccaucagguugcuuauuuuuguuuuauguuuuuuauuuguaugcauguuuacuuuauguuucaguuuacuacccccuaaggcagcaagagagcaggaagauaagcaaaauagagauguuuuugacaacuuggcacugagagacuauccuaagggaauaaucugaaauacauaaaaacauuuuauucacaaaauuggucaucacagcauuauuuacaauacugaaaaucuggaaauagccuaaauuucuaacaauugaaagaagguuaaguaaauuauaagacuacacaauaaaauauauuaccagcaauauaucuuugugaaaaucuauaauaaccacacauaauacuuaguaaaaaagaacauaaauuacaugauaaagaauaugaucagaacaaugcaaaaaauucacacccccaaaaaagacaagauauuauauggcaauuucgugguaaaauauucauguauuugugcugcauuucuaauuuuuccguaacugacacaucaguuuuauaauuaggaaaaaaauaccuuuuuaaaguaaagcgaacacaagauucuuuagcaauguucauuccaucccacaauagagucuagagagucacaaaaaccucagccuccuucgggagggggggagcuugguagugaaaaauggucaugaaugaaugggugaagagagggaugggacaaccuaguaggagggagguagggauaggcaagggaaagguggggaccaguagucauacuggucagccaaggaaaggggcauuguggagucagggaagacucugacugcucaacagaggucugucuagacccaguaguaggcacugacgguguuaucaaaggacaggaucaaagagagauuuuaggaagacacguggauuauuuuagggacaggggaggaaagaggagggguggguaaacuacuuggaaagaaagggagaaggacugagaagauggcaaugggaguggggaggaaggggcugauugccuuugugaccucacuaccaaacauacuuugcucaccuccagauaagucuuuguggggcaaaugcaggauaaagaaacagcucauaagaggcacuugccaacauccaacaaauucaguucaaaaccacagaaaaucuaggagucuccaaagaaaaucacaguccugcuguguugccgaggcuggaauacaauggcacgaucuucauucacugaaaccuccgucuccugguucaagcgauucuugugccuuggccucccaagaagcugggauuacaggcaugcaccaccacacccggcuaacuuuuguauuuuuaguagagacgggguuucaccauguuggccaggcuggucuugaacuccuaaccucaagugauccgccugccugggccucccaaagugcugggauuacaggugugagccaccgcauccgacuucuaacgcacuggguuuuaacaagccccucaaguaguucugaugcucccucauguuugugagccacugaaugagggccaugcaaaaugucuagaaucacuaguucugcugucagcuaaaccacaugaaagaaccccugcucaugugaaagagagauuucuacaaauaaagugacgggaggaccacuaauaaguuauguccagcuuagugggguuggggaaagguuauaugaagcaacaaagauacaguuucucuaagccaaguaaagguaaagaacuguggagcaggcgauaaagccaaaugcacugaacuaugucauaaggaauuuacaggcuguauuguaaaagccacagugaacaugaugacagcaacaacgaggaugaagaacagcaaagaaaaagcugagggaaaccaucgaccaaagcaagcggaggcucaaaagagagacgagcuucaggaucaggaaaugaacagggcccuucagucacggagaagucguuguugccagaacagucagucacuuaacugcuuagaagaucaccguguuaccauauaaccucuauuguaggcuaauuaauuuuuaaaaucugucuaaaauuuacugauuuuaauauaauaucuugucauuuuuggcaacaauacacugaaguaacaauguaguuugcuguauuuuguuucacaaauauuuaccuggaaacacuggagacuuuguaaagagaaaauuacuaaaaauuacuccuucacuacaggacaguagauauuuaauauuuauuuagaaagcuauugacacuucugaugacuacugauaacugagaagauucaacauguuauaaauaugagcuguaaauauuccaucccuuuugagauuauauacacuaagcuuuuuacuaccacuggccuuucuggauacuuucauauuuagagaauauagaacuacauucugggagauugacaaugaccuaauauuacacuaaugaaaagucuucacaguccucaaaauaauuuagaauuuaauguuuucuuuaauaagcaauuaaaauggaauauuuucugccuccugaauaaauacaugucuguaaccaaccaucccuaaagaaggauacuaauauauuuugagugauucaauccacccauggauauagucacaucuuuaaauguuuuccagugugaacaacagucuuuuaauagauggccauugaguucaagggucauauuauuugcuaacaaauuauuauuugggccagaaaguaucugaaaaaaguuuaaccaaauuuccuacacaucucauaucucuaguuuauuaagcauuauuuauuauuugguguaaaaauucuacauuaauuacuucauacauauuuuaucuugagauuaugaaaucccauggucuuagaaacaaaagauagacuuuaagacacuggcuucugcuauuuuuuuuuaacuuuagauuugaaaaagaaacauggauuacauguuaacauaauauuuugaauauauagggcucauaagauauauuauuaaauuauaaacaaaauaaucaggaacuuaguguggugccuaguuugauauaugauuacuuuuugaaaugcacuaaauuccacaaauaaugaaaguauucuuuguguauaauguuauguuugguuauuauguauggucuucguauccaaagguaugacauaacuugaguuuguuugcuuuguauuuauucaguaaauaagccguaacuguuuuaaaaagagggaaauuaaaaaaaaaacugguccaauuaccaauuauaaauuuuaauaaagacuaaacgaaaagguuuggcuguuacauauucucaggccaaauuguugaugcauguuuggauuaacuagcccucaggcugcuuccaauauuauggguaaucacaaaacgaccagcucuaacuccuccucucaccagcuggaagggagcacaucacauuugccauccaugguuggcaaaacucaaggcaucaacaacuggaaaagaucuccaccuugggaaucauuauacauauugugauccugcaaugggucagaauccacaaaauacaguuccccugcauggaugucagaaaaguuagcuagaaauucaucaggauugaagccaacccacacaguauaccuauagucuauggugcguauggaauagcccaugaucuuuauaucuuuuaaacucggcuugucagaauuccacugagggaugucugaaggccggggauacuggcuauaggcaaucaguucacggggauuaccagggagguacggauccucuuccaagucacggaaucgaaaaugcuucagaagguucuugccuucucugcacagcucaacgugaaaugaaggaacggggcagcgagguggaaccugcaguccugcaaguccagccagcgugggaaaaagagacacaaguuccacaagguccauggauugccugccugaaacaggaagcgacagagcagaauggguuacauuauaaaagccugccauggccaggcaggagcaguaaaggaaccugucugggcuccauauguuuucuuuuuuuaauuuacaacauuuaucuuuagcaacagacguuuagaaacaccaccucggcaccucacccugcauuaauuacucauccaaucaaauagcaggaugcaaaauuagggccccacgaggcuguuggcgcuuuuuaaaacaaccugaauuuuggaaccaccgauuuaauaacugacucagacaaggaucaucaauuaaggcuacaaccacuagguaaaagagucuguugaggaacaggauauucugacucccacaggaucaccccacacauuacucccuucuggaugucugcauuagaguuaucuuugcauuuuauuacgaucaaauacacacaccaugacauuuaccaucguaaccacuuuuuaguauacaguucaguggaauuaaguacacuuauacuguugugccaucauuaccaccaucuaucuccagaacuccucuuaauuuacacaacugaaacucuguccccauuaaguaacaacuccccuuucuccauccucacccagcaacuggaaaccaccauucuacuuucuaugucuaugaacuggacuacucuagauaccucauaggagugggauuauacaguauuuguccuuuugugacugacuuuuuucacuuagcauaauguccucaaggcucauccaugauguagcaugugucaguuuccuuccuuuuuaagacugaauaauauuccauugcauggacggaccacauuuugucuguucuucugucaauagacaucugaauugcuuccacuuucugguuacugugaauagugcugcuaugaacaguaauguacaaccuuugauugaauaccuguuuucagcucuguggauauauaccuaggaguggaacuucugggccauagaguaauucuauguuuaacucugaggauccaccaaauuauuuuccacaguggcugcaccauuuuacauucuuaccagcaaugcacaaguguuccaauuuuuccauauaaucacuaacacucuuaacacuuguuucauucuuuuuuuuuagacggggucuagcccugucuccaggauggaguucaguggcgcaaucucggcucagcucacugcaaccuccgucucccagguucaagugauucuccugccucagccuccugaguagcugggauuacaggcaugcaccgccacacccagcuaauuuuuguauuuuuaguagagaugggguuucuccuuguuggccaggauggucuugaucuccugaccucgugauccgcccaccuuggccucccaaagugcugggauuacuggcgugagccaccacgcccagccuuucacagcuuuuguuguuguuuuuuauuaauagccauccuaguggguaugaaguaguauuucauugugguucauccauauuuaaagucuaaauacuguacuuuauauugauuccuguuaaaauugaaauuggauuugcacuaccauucuggcccuucuggaucuuuaagacagugcuuuaucaugcuugauuucauuuucuagacacuuaauuuuuaaguaaaauaaaaagaaaacaaguaaagaaaguugaaaaagguaccuuuacaauggcaagaucuggcugaugcuagcuagcucuucaaccgaguguucaaacuuacaauacuaguaacgcuggccaugaagugcccccaccaugugacacaaugggagaauacaacagcccauguagcacacgugucaaaaauguuacccugaauguagucauguggaagcaaucagauaaauccaggcugugggacacuguuauaggacaacuggccuggauacuuauaaaaagaugaggucagggagauaauggggccagaacauguaaggccacugugacgacuuuuacucagaucaagaaggguacauaagaggcuccugugccgggcugugacaugacuugacuuggguuuuaauggaaucacuguggcugcucugaggaggaaaaccuccaagggauccagggcacaagcaaggggaccauuuagcaagcucuugcaguacuucagcacaagacaguggcagucugguccaagacaguggcaggcgaaguggugggaagugguacacagagucugaauggagugugacaggcuuucucauagacugaauauugcauauggaguaagagaagaacagggguugagauuauuccaugauuuuuuggcaugagugacuauucucauuucuugaggacaagaagaguguugaaggaaaagcugaagaugaaagaugugaaguccagcuuuggauauguuaggcuggcuaagugggaaagacuauuggaaacaaaagucugaaguucagggaaaagacacagcuagagauaaaauuuggaaauaaacugaaaggccgugcaguuacaucaauuucuaaauugcugaacacuucccaacaaaaguuucagaaaagauucucaaccaaucagaagaucuuucccagcaaacaaagggcuaaaaucaugccuugaaacuguuuaaccuuucuaucaaugacaugaaagaagacaggacaugcagugcacaaaaaucaaagugcaaaaaauaaaauuggguaguauaaagcaagcucagaaagauccagaaaggcccgaaugaugguccagaaccaagacaaauuuaaacaggaaucaauauacaguacaagauuuagauguuaaggauggauuaaaugcuuaaguccagaaagggggcaaucugguuuagcauaguucauagaagaggcacuccaaaaagagcaaacgucauacgucauuucagagacaguguacaaccugucccugaaaugcacugggcagaucaagucaggauagaacucacaagaacccauacagguugcccacacauccaggagggguaucugguccaacugguauucuggaagugcuuucucaaacugaaacuuuuuggaagacagagaccaggacaaccacgcgucuaaacacuaccuugugacgaaugguugaagggcuggggauuucagccuagagaagagaagauauugguggauggacagggucgggggcaucagugcuguuuucaaagcuuugaaggacuggcacauggaagucaaaguaaacuugcccuucacugcuggggagggcagaguagaaucaccugguagauuuuacagaucuagugguucacuagauugaugagcugucaaaauggaaaaugugccccccacaaagaaggcugagucccuaccaaaagugcgcaucgagggaaaggauucuccucgucuguuacgggggcagccccuuacucuaagcucuggagcaggcucuuguagacuguaccacagcccuccccaucuuggggaugcaccuguuccuuuguccaucaucaucccacaaggcuccuuguggacaggggccauacuugucaauucugguucugucacucuuuccccacccagaguaugggagauguucagaaagcgugugcugaccacaaaauguugagaagaaauuccaacacaaggcaggaagggggggucuguguaacccccaaagccuaugauucaauaaagugguucacauauaaacuaaaggugaucuuacugucaagcaauaucauuucagcauauuuuauaccuggcuccaucaacugugaggcggaaucaaaagggucgagguaagggaaaagcuucucgccugccuccggaagugaagccguccuuccaggaacauagaauaucaggggaacauggguagcaacaucaaaauugcuguauuuggcccauucuccauguucaccuagagcccacccuaguucauaaaaagcacagaaugacagaaaaugaauaaucaucauaccacagcuuguuuauuuuagauaccauuucauuuccuguuguaaaaaccagaggaaguagaaacucaucaccuagaagaaaaauauucacuuggaauuaccacagaaaggguuauuucaacugaaugcugcuuuauucaaaaucagguauuuguccucaugaggaaaccuuuaaaaaagaaaaaauaauuaaauucccaaacucaaauaucuuaacaaacuacuagcaacauauaccuaacguaggacucuguggcgguucccacacaugcguuccuccccugcuaagacaugcucauucuugacaggcugggaacccugaaagcuguagugucaccacugcccuguccugugccuaccugucuuuugacucaugcccuacgaggucagguuuucaguuugggguaugugccaccuaacagugagcuguggaacugcaacacacucggcaaauucaaaaaagacaaggacaucuucguugauuuuuaagacauaccauagauaggguaaaccaaaaccucucauuucagauccuuaaccucaauuaaaaacaacccuucaugccuauuuaaaacaucccuugcaaaagaugguuugaauauuccaaguuggaaauacccagucuuuuaaaguuacagcacccuuuuugauacaaaaaaugugcaugacagaaauuguacagugaguaguguuauaaaaauaaccaaacacaccaaaagcugccacggguaaauuugagaaaguguugaaauguaccgcacagcaugagaccuugcuggcuccgucuaauagaugacgcuggggcugcaaaugaugucccagccuuccagggccuguggucuccagaacagggcugaaaccuguucugaguugacagugcuuucccaaggagaccccaaguugagaggacccucuuacccacucaucaauaaucaaagcagacuugaugcccaucagagaugcccaaugauucuggugagccguuccucccucuggcugucaguacuggggaguaugguggggacuuucagauagcucaguggagcucagaaagagagggaguucccccugacacccgccccagucaguaagccccggggccugaggggcauccccacugcucgaccucuccacucucucggggaggacgaggcagccuugacccacgagggcugaugaauggguagguuaucggcaggcuccuaggccaccagcuuagaggucacauugucccuuuuagauucaguguggcgggaaucuaaaaggucaaggaucgagaagccugcaggauggcaacgugagggaaccuggcagugcgaccucaggaauccacucccggaacucugacuggggugccuguggaggcucugaagguacagcagccaggcgcucuguggcauucugaauacuggcacgcagccuucggccucugccagcuuuugugagcugcccugcaccaggcagagggggcccccaggccuggcacagggucugacacauggcaaaugcuacagaaauagcuguggaccgccugacugcaagaucguauugaacaucuggugccgggccucagccugugcugcugcagccaggagcaaauacggggaagucuggcuaaggagaacgcgugccugugugggccccaaggauccaucuccagaucaggaggaacaagcccgaugaccuugacaggcagcucaggagguuucuggcuccugccccagaggcccaagaugaggacguggcaacauagggaggcccagggaaugaugagcucagggagagguggccagaccaccugagacaccuguuaaagugcacuuucccaugcccagaacugcgagcuccugagaccaguugcagaaaccagcauguuuuacuggcucccaggcgguucugauggaggaugucccaggaggggacucugagaugggcuauuuguaaucuacggcaacugccucacaacagaguguguucguggagaagaggaaacugggcaccgagggcucagaagcagauggcagauaaucaggaauaugugaaaaauuauggcaccuccauauauaauaaaauauuacagacauuucuaagggaaaagguaggcuucugagaaaugacacagagauugccuaugacauuaaguguacaaaaccagggaacguuaacaguacacacagaacaagcaaucacaucuugugacauacauguuacaaacauacacauguauaacauauaucccugugugcauaugugcacaacugauggcuggcagauggaucccuaauccauugucaucuguuagcccugagcaggugggagaaaagggcaggauguucuggcccugaauuacaugcucuguauccuuuuuucuuuucaugauaagcacauguuaugauuuacuauuauccuauuucauauuugaugauaugaaaauuauuuuccuuucucuaaguauaacaguauuaugguuauacuucaaaagaggcaauauuuuucagagacagugaucggaaaauggaaccaucugggauuugcuucgaaacaauucagagaugggggagugggugaggaugagaggaacaagacuaugugagugggaaacggggggagcugcuguuuuauucccugcucuuggaauguugaagaauuuaaaaaaugcuuuuaaaaagauaguuucauuuuuggaaaaguaggaaacagccuuagggggagauaaagacuugaaaagcccaggcucucggcagagaagacagcggggauaggggugggagggcuggagccaggcgugaagagcuugcugggcucugccaggauuguucuggauccucuccacccaaacuaaaaguccuccaacccuccagguuaaaaauggggguuacaagagcucugccacacaaauggaggguuccugcugcauucaucaagaaaaaaaaaaaaguugcuacaagacccucccccacccacccacaccuauccgucaagcaucuaagacagaggucucaggacuaacaagcugaucauaaaaaugccccaggaucccacuuuguuugugaaccacugguucacaaaagagaacacacccauguuuaugucaauggcaauuuugcaaagcauguuucacaggaaaguucagauguuuugacucaccagggaauuucaaaaugcuuaccaugauccgagguaaaugcaaugauggugcuguuggccagcugaagaucguccaaagcacucaagaggcggccgaccuguguauccaaauaugacacagaggcaaaguagcucuggcggauuuuccgcugcaaauugaaaaaaaauaaaaaugagagugacugcaauuuaaauugccaaggcauacagagauaaugcuugccugugcaucucucccaaucccuaccccuuaguugaugcccuuaaugauuuucucagccaaaauguaacacuccuuucccuaccaucagcaucacuucacccacagagucacagcaaaaucuguaggucuacaaauaagauacauuucuaagcaaaucagauuucacuuuagggcacagaucacaguggaugaaugugucaccuacugcucuguuguuuuaagcugaaauguauugucuccuagcucuggaggcuagaaguccaagaucaaggugcugggagggccauucucucccugaaggcucuaaguagaagaaucuugccucucccuagcugguggugguggcugucagucccuggcauuccucagcuugcagcuguaucacugugucuccaucuucauguguucuucccgugucucucuccccucuucuuaaaggacaccgaucauauuggauuaggagcccaccuuacuccaauaugaccugaucuuaacuaauuacaucugcaauaaaccuauuuccaaauaugguuacauucagcaguacugggggguuaggaugucaacagcccuuuucagggaaaaaaaaauucauaauuuaacacauaacagcaacccugacugagccuuucccucugaucacuugcuaacccaacagcagauuacaacugcauaucuucaugaacuauggccguuacguggagcucauuucuaacaaacugucagcaggcaggagaagagcaaaggagauaccagagagcagcacguccuucacagucccugaacccaagaggcacuuugggaacagccagaucaugcccugaaguaaaugagccaccggccccuccugggcugacucucauucccaaccugguucacaaaugcuaaggacaaaaauuaaucuuccaccccaaagaggggugagaagagagccgugucuucgcagaccagccccugacuuaucagcuggacccaccagcuucuucucaucacugccagggugaggacaaucaugagacucacccguucucacuugcagucaagagaaaagauauacaucuagccuuccagcaggauuaugcugagcccuggccuacuuauacuuucugguagaugaagucuucagucugaaaccuguggaacuuugguccuccuggggaugaaagacaccugucaggauggcuauguccuauacaaagguauucccuccuuccuaugcuagccccuggacguaaggcaauaagcagacaagguccucacccuugaugagccaccccauccagugaggacacaaucauggagacaagaaaaugcuuaauuaucagugaggccugcugggucuguccugcagacccuggccuauggaugaaaugaguacucagacacagguaugcagcauaagagcagcuagguuacugccuggcucuaguggccagagagcagccccgagaagcuggagcugcuggcuuuuauucagugcaggcauaaugccaaaaaccuagagccaaccugcagguaauuaacauuuauuguuccccuuucagggaaccucacaagcacagacgaucaaaggucaguuccuggucaacauaaguaaacaagccuguuuaagauaaauucucccacacucccuuguaccuacuccuugcccucugccucaggguuauagaacagcuauucuccccuggggcucugcagaaccuucugaccuuucagaagguuugcauccuuucccuauaguuuuucccaccacucugaccgaucccccacagaggcccaggggugacacaggggaauaagcccucaaaucugccugggagauucagggaaggcuucacagaggaguuagaauuugacaagaagcaccugcagucagacaaauggggcucagaugcuccaagcaggggcugcagggcacggaacaguguggaguugugacagagcagguugcauuuggggccaaugaaaggcccaugugacuggagaaucaaaugggagggcagaggggugacuagaaaguuagguccgggccagauaauauggaccuggugggucuauccagggaguggagacuccaaguucuaggccaauggagucacugaggucuuucaaggcgagaaauugacaugaucugggcuucaaguuauuaagaguccuguugcaacaggacacagacacagauuccagaggcuuuagacaaaaugguacuaggccacugcuggguacauaagaggugcucacuacacuugcugaaugaacaaaacaaagcaaggcccacugaggugguccagaacaaugugcugaaggauccagaggacuguguggaugugagaggaauucaggggcaucaagcagacaugggggcagggagcagaggaggaggagguguugaggaacccaagggugacuccagguuucacauucagcugguggcauaauucgcuggcauuugggggcagggggcgcaagaggaggaggaggaaggagaaaaggcagggcaggggugguggccugaccacgcggaagccuauggagcugaggucuccagggucaucugccuaggaauggcucucacaggcaggucaacacacauaucugaaaaucaggagagaccugggcugaagggguaguucuggagucaucugccaaggcucaacugagcccagcaggggaagaagagguggaaaggauauaguggggggccugggaaguggcaccuaaguggcagacacagaaaggauugggaggccaacagucccagaagggguggagcuggccaacagugaggaagugacacagagcucaaggaaggucaggaccuacacagauagauuuuacuggccaccaaggucagugcugaggugagaguuuaguggauuggggagguggaagccuguguagaggauggugaagaacaaauggacaaugaggccacagacacagccagaacagcccagugugcacucgcucugccuuggaggucaguugaaggaguggaaagcagaaacaggcaggggcaagggggcuggcacuuuugcagcugggagggaugagaguggauggagaggcugcaggguagguaggugagaaggaagaucuugcucauucugcuugcagacgugggaagcagggacagugguggggaguugagggaagaggccucgagcccagaacaugcauacacaaaauuccaggucucagugacagagauuauuaauagagcccauucagcaaguacacacuagguggcaucugauccugugaacggcacauuaaggacuccaagacucagaaagguuaacuugcccagagucacacagcugauaaggggcacagccaggaugcguacccacauccacccuguccgauccccuaccucuggcuguccaccagcuuccauuucuacaagaggaaaggugcuauccacugagaaauggggcacagggguggcaaaggccuggaggggagcagugaaagggaguagagaagaggucaugcaaacggagcagcugcagaggacaagugaggugagcugagcagagagcuugccugggcugcuggggcuggaggcggggcaucugagggccucccugcuucgugggggcauggauuuucuccagcagcuuucaggacuuggacuacagagcagaggguguggcuggagugucugacgauaaagguacugcaggaggggcaaggauaaauggacaaguauggugagcugggcggcugggaaguacaguaagucaccugccaccaggccuuagcuauuuagggaagcaacaaagccaacaggaccuggacacaagggggagauagaaauccauacucuagcaauccccgugagguagagcaagggaagugcuaggagaagagguuguggucaguauggugacucggaaggagcaggcaacaaacuccugaguguggccccugaggucacuggcucauguagagcugaguuagagggcuggagcugaagagaucccagagcugagucucaagggugcagugagaugggcuuggaugcggacauccaaagcuacaagaggacagugagcaggccagaguucaaggggaacacagggcugagaccagcacaugcaggcaucagggaggcccucugagucaugcuguccacuguguguaaggaggggacuaagagaacuugaaggagauagcuccgugcagccgacacgguccuagauacuucuacaugcucucuuugguucuugcugaaaaucucuaaaguagguguuaucauggaaaaacuuuaccuaccuuguuucaguuuuauagagaagaaaacucagggaggcucagggagguaacaugacuugacagagguuaggcagcugguaugagguagaacaugaauucgaacccacacugcugggaaccaacagauccaaccauggggcuuuggaguuacagucccuggggaugaauuggcuccacccagcacuaauuuugugcugucagacaagucagcacaccucccaugccuugaguuuccucaccuagacaacagagagcagguaccucacuaaguccccaugaggacuaaaggcgauaccacacaugaaucagcgcccuuccuggcacacaguccauuuugaagggucauuuuaagugaccaucacuaauaaagcauccaggugcagccucagagccaguucaagccacuucaccaucaggagcccagaaacacaaaauuagaaaacaaacagauggaugcauugcuuuccaaacucucagugaaacaggaaucaaauacauuugaggaauguacaccucucaccaaccaaacucuuguugugcaaacucaggggccaaguaaguuuggauagcaagggauaucuguaugcagugguuuuguucuguguuugcuuuaaacaauacucuacagcagaggcucucaaacuucugaugaaucagaaucaccuggugugcuuuuuuuuuuuuuuuuuaagaaaugucgguugucaggucaaguuccaccuccagcuuccaauuguguaaaucugagugggccaagacuuugcauuuccaacaagcccucccagaaauucuaaggcagguaguccaggaugcacacuuugaaaacacugccaucuuccauccgcuauagcuugccugccacagcauucaugugguaagagaagggcaggguucuguguggaauauuccagaaagagcauuagucaauguguauucugcucuccagggagaaagggugacugaugagucagugugaggauucuaauugugugguugcuccgccccuaaaucauggcaaaggaaugccggacaucacagcuggguggcacuggccaugauggugucccaguucccucugcaccaagggccuguucaccaagccacccccugagagugacagcuagccaggaugggcuuucccacagagggaaccugcaaguaccagcaaaccaagcauucugggcugcucgggaguugcccaucacucuacaauuaaugagcugucaccugaacaguauccccuggguuaggaacggucacccaggcugguuccccaccucuguguccacacacaacaagucaccaacucucuggacauucccuucuuuagaaaguaagacacugguugggagaguccugauccaggcaacacugccuguguccuaaauaccuauaggacaccuccaccccagcacuuugccugauaacucacacaaagaaagcucuuaauaagacauuauagguggaguugugucuacugagaagagugguuucaccuacgacacuaugucaucaguguccaauacauccccaaacuauguccuugauaccugaaaguccacaggaauuggaccauacggcacacugauguuuaaggcuuggacgucuucccguugccugauguccauccagggguuguaggccacaggggguaggccaucagggaccucgggaucgggggccagggugauguucuccaagggauacaacuucugaaauuccuuggggaaaaacacaaagccacaaaguugucacucuuuuagcaaaagcacaagcuuguggcucuaucacugucuauacugccuuuucucuaagccugggaugcauuugagugguggcucacuagcauuccccacgugcucggcccugaccuggaaguccagccuuaaguuacucucaugagaugccaauggcaaugaaaucauacgacuucuguuuccuacaaacugagcagcaacaacucucuuccuucauacaaacagacgcccuucuguuccuguccccaccuccugccuggcuagaaaaguguggugagguguuggguucccaaaaccacccucagguucagcaauucacuaggggaacucauaggauucagcauuuagucucacucacagcuaugacuuauuacagugaaacacacucagcaaagaaaaaaggcacaugaggcaaagucuagaggaaacuaggcacaagcuucaaguccucuuccagggaagucacauaggauacuuacuucucccagcaacgaguugugugacaauacaugugaaaugcugcuaacuagggaagcucauuaaagccucauuauccaguuuuuauuuggggcuggucagguagguacuaucugucuggaacauaucaaaauuccaggcucccagaaaaaaaaaaacaaacccaaggguuuaucaucaaccauaauguuugucuaaacgguuuaagcauaguaagccaauucugggaauagugagaacacuucagaaaucaaaguucccagaugccagccaagggcuagacuuauaagcaggccuuucaaagaaucacagccaggccagcuuuguuaacuguuuucugcaaagaggcaggagaggugaaccucacagccuucuucuaucaagggggcugacagcuccuacuaggaaagcaagauccccugggccaaucaaagcaagauaccugcaacaucaaagagcauacugcuggucucuacucucauuacaugugaggggcauucucugcaaagucaaaaggaugggaugcucaggcccucauaaaacaugauagggaaaaauggaaaaggauucuaaaacagaaaagacuacaugcucuaaaugacauacaagcaaguacaggauuugagguuccaagaagcaaugcagugcuuuguguuuagaugaucuaaccugacaggcucagggggaacaggcaguuuuugaagagaguuucacauucccuggggcuguuuuggaagggccaucccuuauuacaggcuuuggcagccagcucugauucacuacucuguggugaucucaccauccaacccaacaucugcucaauaaguucaaggaaaggaaaucaaacccuccaguggagugaagcggaaagccaagcauuucuuacaagauucuuacauguucuuggccuugaccucuaaaucccaucuuuacuccacugaggacacuagugcccaucaggcaaccauggugccuggcgauggcaggauguagccaccuucccugugcaaaucccucccucaacaaacaacacagcugucacagcugugcuggaucagcccucaaccagcucuucaccuugggguaucugaaggggauguguggcuuaugauacccaacggccaggaagaaaggacuggcugacguuuucaucuuuuccaacaacuguauggcuugcucagugcucuguuugucaggcaaggugcccucgggaacauccagcacauccacagggcaaagcagguuggcauggaguucuccaucuggcccucgacaugucuuucaaaacaaaauaauauaacaucagcuuuuuaagugcaagaaaugaagccaugaaggcuacacacacagauuuaauguucacauaaucagcccuucacguguuagucacucagacugaacagagacaucagaaguagaacuaagacagaaaagguguuucuuguuuuccaggcaggggccagaaauccacuagcacuugguuucuugcuacuaauacucuuucuccagaucauaacuaauuaaaagaaaccccgauagacuaauuauaaaaaaaaauccaucucuaauucaacaauuaaaaaaugccaauuaaaaaugggcaaaggauuuggauagacauuucuccaaagaugauauacaaauggccaauugaacauggaaauguggcuaacaucauuagucauuagggaaaugcaaaucaaaaccacuucacacccaaaaggaugguuauaauuuuuuaagauggaaaauaacaaguguugacgaggaugcagaaaaauuagaacccucucacauugcuggugggaauguaaaauagugcagccacuuugaaagccagucuggcaauuccucaaacaguuaaacauaguuauuauacccaaaaaaauuaaaaacauaugcccauaaaaacacuuguacaaaaaugucgacggcagcauuauuccuaauagucaaaaguagaaacaacccaaauauccaucaagugaugaacugauaaacaaaaugugguacaauagacaauuaugcagccauaaaaaggaaugaaaggcugggugcgguggcucacaccucuaaucccagcacucugggaggugaguggauugccugagguaaggaguucgagaccagccugaccaacauggugaaaccccgucucuacuaaaaauacaaacauuagcugggugugguggugggcaccuguaaucccagcuacucggaaggcugaggcaggagaaucaucgcuugaaccugggagguggaggcuacagugagcugagauugcgccauugcacuccagccugggugacaagagugaaacuccaucucaaaaaaaaaaaaaaaaaggaaugaaguaccaauuuauacuguuauguggcugaaccucaaaaacauuauucuaagugaaagaagccagaaacaaauggcuacauaguguaugacucuauuuauaccaaauggacaaaauaggcaaauccauggagaccaaaaauaguucaguuguugucccacgcugggugcugagacaaaaugaggaacgacugguaauggguacaggguuucuuuugagagcgauaaaaaugaucuaagaucgauuugggugauggcugcauagcuccgugaguaugcuaaaaaccauuaaauuauauacuucaaaagggagaguuuuaugguauaugaacucuauuuuaauuaaaaauuuaaaaagaaaaaaaaaacccauuucaaauuucaaagacaggcuaaggcuuguaagugacagggucccaaucaacuugauaaggugacaguccauggaauuuccagaacuucagcuacacuaggcacagaaugaaaccuccugcuuugcuuccuaaaguagacaugcuggccgugagaccaaaguuaguucugaccaugauuuguauaccacaaagaccgaggggcugugucagcugcuguuccaucucaaagaguguugccuuuucacagcccugccuugcucaccccacccuugggcaggacagcccagcacccgccucagaccacuuguucaucaucuauauauacacgauuugcagcacucgagggagauuuaguauugucagacccaccacuuugagaagaaauggguagggggaaguuagggcagggaccuggcauucguaagugaggccacuaaaaagaagcaagauggcuucagggaauuaagaugggaucuucccuauucaagccacaagccaaaggccagagcucacaguuuucacuguauucugaaauggaaagcugucaagaacuuagaacaauaccuuccaccucacuuccaaauccucacccuucccaacacgauguuuacuaaaaccucagagauacauuucaugucucaguuccccagcugguuuucugaguuucuuaaauguggguuuuaguuucauuuauacauuugggauuccucuaaaccaagauuuucuuuguagguuacuuuuuuucauaaugcucuaaaaauucaaaaccccuaucagaggucucagcugcugaacauacacauuaggucagagacagauacacggcaugccuuucucccauucugggcugaggcuccuggagcucagccucuuuucucccucccaugucucagcaucuccuacaacucucagucucauccagcgugagcacuggggagcuauucaaugagucugacacguuagagcccaagguuuuagaacaaguagcacccaccagcuucuagaaugaagccacugcuccugucgggccuaaugcugaagaucccaacacuuacuucugucaaaacauuaucacaaaugaaacccacaacuucgugguauauaaccagcuucacagaacaugcaguauacccaguaguuuaugugacaaaggaaaaagugguuccucuucagaaaugucccuuucacagccuuaccuuaguguuuucauacuucucagaggaaggaugauaagguggaaaagaccagcuauacggagaaucaucgguaugguuagaagauaucccuuggaaaaaaaaaaagguuguuaaaacaugaugagucuuucaacaccccacuccccauaauuaaaacucuguaaacaaaugggcaaguggaaccucccuucuuuggggcucaguuuccucaucuacaaaaguccccucuaaagccaaacucucuaguuucuauuugagaacuaagcaucugacuuccuggucccuaagcccugaugauuugugcuaggcucuguggaagggacccacaaggacaagaucagucagcuccuuagagcccaugcugaaaccuaucucucacccuaugaaggaggcagcagaggcaucagcaccaucagggagccgaugggggcaggagagggaggcucagggaagguaugugacuuaccuaugcuaaccagauauuagauaagggagccaggacucaaaaccuuguuuuagaauuccaaguucaagugcucauucaugaagcagaaacccacccuuaagcuuaguaguuuauaguuuauuugugaagacaguauaacagcacuggaaaccaaggaaggacuuccagcuuucaaaagcaucgaagugccaagugggggauccuccaagcacagagguuauugugagucaggugaggacuggcagggaggacuucuaggagccagugaggccugugagggaucugaagggaagugcugccuauagugguuagcugggaguggaggggaucacaggcagaaccucgugagaaagcaucagcagcagucacacagugggacucccauagggaguaccagaagagacaggaauggagagaaagagggcagcggguggagggccuaugaagacagcaagcacuguggaaagagcacacaggaagccaacaaccacagguccaaauccugaugcugccucuuagcauccuugcaaccucuggcaagcuacuugacucccaugagccuucaugucuuccuugggaaaugaugaugaugauaaaaacccaccuugcuugcuguugggaggauuaaaggaguggccagcaugguaaacgguacauaccuggcacacagugguggcuacugucaucuugaagcaggcccaaugcuaacagaaaaaggucuugagaacaaagauucagcugaaaaauguguucccacaagggcugcagggaaagguuuauucucugagaaggacauggugcuuagagccuggugccaaaauccaaucaucaggagggaggaggucaagcaacaucacucaguccuugccugguuuccccucccaaagcacaaucuccucccucugcuguguuuccuccucucuccaaaaucaucacuucccuccagcugcauuugggcaagggguaugguaaugagaacaccaaacugcagaaaguucuccugacacuggacuuuuggcugugcaauaugauuccugacagguucaccucugaaacuggccugacuuaguagagcugaaugucacucucaaccugggcuggccagcugagcuccugcagaaggcugccaagccugccgguguaaccacugagcaaagggaaagagacugaaaacauucgucauucccaaaugauaagcauuauugucccuauggugcucuugucuuccaauacuuuuuucuccauuuuuuuucucaaauacucaugcauuacuucuauaaauaaaaaguuuuaaaguuuguuugcuuuucacuauccccauauuggcauuaaagagagccaguuuaucaggcagcauuugagguaaggaauguccgucucugggacccuauagauccuggguaccagauuacacucaucuuucugacuuaauuuccagaguggauagcagccccuaccuaagcacagcccccucauugggcaauaagucagcaacagcaaugcuggccacacgggaggcccucagguguccucaccccaccccuagguuuacugacagguacccugcaggggagaggguggggcccugagcuggacuccacccaacacugccaccuccccagccuguguccucccuaccacccgaggagcugaaagacccaacagcacacccucagugguuucugaaaggaagcaaagcucuuucuacccuuuuucacuuugggugaaaacguggcuggguugacaagucaguuuuuuagaaaggaagcacugacuagcgagggacucgcccagccagaagagggcucugcaaagacagccccauccccaggaugggaaugcuggauucagacaccacaaaccaagagaacccagacucuggacauggagcaguaccagggugaaagacuuuucccaccgacauggucacauagccauucuccuugaaguacugggggaugguggagaaguuuccagcgugcacccuccaguaggaguugaagucguacaggcggguggugucaggucuccugccagugaggaaagaaacgcggcucggggcgcacacugcuugcuguuagggagcagaagcagagguaagcaucgccacagcaaaacaugucugccaucucuuagguaaccaagcaaccgcccucccgaggcuccuagcaaacagcuugguagcugagucaugcagagcucaaaccagacacugggauuugggugucaccuaggcaacagacugcuuccgggagagaaaagggaagcaaucagccccugaaaccagcagaugcuuaucuccuccuacgcaauggccuccccaggcacacagagcggccaguguugcugggggcagagccaugaggggguucagggagcagggccacccuggcuagcucucaccugaggcccagccugcagaccugugggugcccuucugcagcaccccuuccuucugagcaccaggcaagcgcccguucugggagaaagcuggccagggcugccaugaacacaucagggccagggcgcaccuugcacccaaggagaaggccacccuugaaggucaagcuuucccaugaguggaaaaccagauuuucuccacuaccauuuuccagacuaugcuucccucuaacaagaugucccgcacaaucugugccaucugacaauagcugaagcuccccgcccccaacccucagugcacgaagcagcacacacccacagcuagagguucccagacauaccugcgcaaaggcauucuggaagaggaggcugugggaugccaguuggucaauauuuggggaccucaccagcuuauccccauaacagcccagggaggggcgcaggucauccacgaugaugagaagaacguucagagcaucuacacaggagggaggggcuuuggugagguaaccugcacugacacugaacccucccucaugguaggugcuagguuacuaagaggcccaaggcuggacccugcaccuuaacagccuagccagggagggcgcugugccucagcaagggugggaguggggcucgaggaggaagccugaguccuggguggcaggguuaggcuuuggucauggccuccaaccugggugaggaagcgagauagugagugaaagaugguggaaaggaaagaugaauuuaggaaaaaaagagaaugauguaugcaggaaaggacagaugguuggauggaggaagauaaggaggaaaagaugaauagcugaagggaagaaaggauggagagaaggaggggagaagagagagaaauaugaauggauagaagguaaaagggacggauggaccaauggagggaggaaaggagggggaaagauggauggauagagaugggaaagauggggggaaagaggaagggaagcacggagggauaggagauggauggaugaauagauggaaagagggaagggagggaugaagggacgguaggaaggagugaaaaauggagggagggaacgaaugauggaugaaagaaggaaugguaggagagaggaaggguaaaaagaauggauauaaacaaagaaggaaggaaagaaggaaggaggaaggaagggagggaggaagggagaagagauggcagggagggcgugggcggcaccuguggucgaguuggccugcguuucggauccgagggcgacgcagacggagcucagaaccagacccagccagagaaggccucggccgguccgggguggcggcauuucggcuucgacgcggccgcuucagagcggcggggacaggcugcagcagguggcgcaguuagcagccgccgccgcagccacagagaccuccucgucgggaacccaugaagacugcgcaacacagccgccgcccgggcccgcaggcccgggcgcuggccgcagcgcgagug

SEQ ID NO: 19010 - RNA, 26642 nt, Homo sapiens
cacucgcgcugcggccagcgcccgggccugcgggcccgggcggcggcuguguugcgcagucuucauggguucccgacgaggaggucucuguggcugcggcggcggcugcuaacugcgccaccugcugcagccuguccccgccgcucugaagcggccgcgucgaagccgaaaugccgccaccccggaccggccgaggccuucucuggcugggucugguucugagcuccgucugcgucgcccucggauccgaaacgcaggccaacucgaccacaggugccgcccacgcccucccugccaucucuucucccuuccucccucccuuccuuccuccuuccuucuuuccuuccuucuuuguuuauauccauucuuuuuacccuuccucucuccuaccauuccuucuuucauccaucauucguucccucccuccauuuuucacuccuuccuaccgucccuucaucccucccuucccucuuuccaucuauucauccauccaucuccuaucccuccgugcuucccuuccucuuuccccccaucuuucccaucucuauccauccaucuuucccccuccuuuccucccuccauugguccauccgucccuuuuaccuucuauccauucauauuucucucucuucuccccuccuucucuccauccuuucuucccuucagcuauucaucuuuuccuccuuaucuuccuccauccaaccaucuguccuuuccugcauacaucauucucuuuuuuuccuaaauucaucuuuccuuuccaccaucuuucacucacuaucucgcuuccucacccagguuggaggccaugaccaaagccuaacccugccacccaggacucaggcuuccuccucgagccccacucccacccuugcugaggcacagcgcccucccuggcuaggcuguuaaggugcaggguccagccuugggccucuuaguaaccuagcaccuaccaugagggaggguucagugucagugcagguuaccucaccaaagccccucccuccuguguagaugcucugaacguucuucucaucaucguggaugaccugcgccccucccugggcuguuauggggauaagcuggugagguccccaaauauugaccaacuggcaucccacagccuccucuuccagaaugccuuugcgcagguaugucugggaaccucuagcugugggugugugcugcuucgugcacugaggguugggggcggggagcuucagcuauugucagauggcacagauugugcgggacaucuuguuagagggaagcauagucuggaaaaugguaguggagaaaaucugguuuuccacucaugggaaagcuugaccuucaaggguggccuucuccuugggugcaaggugcgcccuggcccugauguguucauggcagcccuggccagcuuucucccagaacgggcgcuugccuggugcucagaaggaaggggugcugcagaagggcacccacaggucugcaggcugggccucaggugagagcuagccaggguggcccugcucccugaacccccucauggcucugcccccagcaacacuggccgcucugugugccuggggaggccauugcguaggaggagauaagcaucugcugguuucaggggcugauugcuucccuuuucucucccggaagcagucuguugccuaggugacacccaaaucccagugucugguuugagcucugcaugacucagcuaccaagcuguuugcuaggagccucgggagggcgguugcuugguuaccuaagagauggcagacauguuuugcuguggcgaugcuuaccucugcuucugcucccuaacagcaagcagugugcgccccgagccgcguuucuuuccucacuggcaggagaccugacaccacccgccuguacgacuucaacuccuacuggagggugcacgcuggaaacuucuccaccaucccccaguacuucaaggagaauggcuaugugaccaugucggugggaaaagucuuucacccugguacugcuccauguccagagucuggguucucuugguuuguggugucugaauccagcauucccauccuggggauggggcugucuuugcagagcccucuucuggcugggcgagucccucgcuagucagugcuuccuuucuaaaaaacugacuugucaacccagccacguuuucacccaaagugaaaaaggguagaaagagcuuugcuuccuuucagaaaccacugagggugugcuguugggucuuucagcuccucgggugguagggaggacacaggcuggggagguggcaguguuggguggaguccagcucagggccccacccucuccccugcaggguaccugucaguaaaccuagggguggggugaggacaccugagggccucccguguggccagcauugcuguugcugacuuauugcccaaugagggggcugugcuuagguaggggcugcuauccacucuggaaauuaagucagaaagaugaguguaaucugguacccaggaucuauagggucccagagacggacauuccuuaccucaaaugcugccugauaaacuggcucucuuuaaugccaauauggggauagugaaaagcaaacaaacuuuaaaacuuuuuauuuauagaaguaaugcaugaguauuugagaaaaaaaauggagaaaaaaguauuggaagacaagagcaccauagggacaauaaugcuuaucauuugggaaugacgaauguuuucagucucuuucccuuugcucagugguuacaccggcaggcuuggcagccuucugcaggagcucagcuggccagcccagguugagagugacauucagcucuacuaagucaggccaguuucagaggugaaccugucaggaaucauauugcacagccaaaaguccagugucaggagaacuuucugcaguuugguguucucauuaccauaccccuugcccaaaugcagcuggagggaagugaugauuuuggagagaggaggaaacacagcagagggaggagauugugcuuugggaggggaaaccaggcaaggacugagugauguugcuugaccuccucccuccugaugauuggauuuuggcaccaggcucuaagcaccauguccuucucagagaauaaaccuuucccugcagcccuugugggaacacauuuuucagcugaaucuuuguucucaagaccuuuuucuguuagcauugggccugcuucaagaugacaguagccaccacugugugccagguauguaccguuuaccaugcuggccacuccuuuaauccucccaacagcaagcaagguggguuuuuaucaucaucaucauuucccaaggaagacaugaaggcucaugggagucaaguagcuugccagagguugcaaggaugcuaagaggcagcaucaggauuuggaccugugguuguuggcuuccugugugcucuuuccacagugcuugcugucuucauaggcccuccacccgcugcccucuuucucuccauuccugucucuucugguacucccuaugggagucccacugugugacugcugcugaugcuuucucacgagguucugccugugauccccuccacucccagcuaaccacuauaggcagcacuucccuucagaucccucacaggccucacuggcuccuagaaguccucccugccaguccucaccugacucacaauaaccucugugcuuggaggaucccccacuuggcacuucgaugcuuuugaaagcuggaaguccuuccuugguuuccagugcuguuauacugucuucacaaauaaacuauaaacuacuaagcuuaaggguggguuucugcuucaugaaugagcacuugaacuuggaauucuaaaacaagguuuugaguccuggcucccuuaucuaauaucugguuagcauagguaagucacauaccuucccugagccucccucuccugcccccaucggcucccugauggugcugaugccucugcugccuccuucauagggugagagauagguuucagcaugggcucuaaggagcugacugaucuuguccuugugggucccuuccacagagccuagcacaaaucaucagggcuuagggaccaggaagucagaugcuuaguucucaaauagaaacuagagaguuuggcuuuagaggggacuuuuguagaugaggaaacugagccccaaagaagggagguuccacuugcccauuuguuuacagaguuuuaauuauggggagugggguguugaaagacucaucauguuuuaacaaccuuuuuuuuuuuccaagggauaucuucuaaccauaccgaugauucuccguauagcuggucuuuuccaccuuaucauccuuccucugagaaguaugaaaacacuaagguaaggcugugaaagggacauuucugaagaggaaccacuuuuuccuuugucacauaaacuacuggguauacugcauguucugugaagcugguuauauaccacgaaguuguggguuucauuugugauaauguuuugacagaaguaaguguugggaucuucagcauuaggcccgacaggagcaguggcuucauucuagaagcuggugggugcuacuuguucuaaaaccuugggcucuaacgugucagacucauugaauagcuccccagugcucacgcuggaugagacugagaguuguaggagaugcugagacaugggagggagaaaagaggcugagcuccaggagccucagcccagaaugggagaaaggcaugccguguaucugucucugaccuaauguguauguucagcagcugagaccucugauagggguuuugaauuuuuagagcauuaugaaaaaaaguaaccuacaaagaaaaucuugguuuagaggaaucccaaauguauaaaugaaacuaaaacccacauuuaagaaacucagaaaaccagcuggggaacugagacaugaaauguaucucugagguuuuaguaaacaucguguugggaagggugaggauuuggaagugagguggaagguauuguucuaaguucuugacagcuuuccauuucagaauacagugaaaacugugagcucuggccuuuggcuuguggcuugaauagggaagaucccaucuuaauucccugaagccaucuugcuucuuuuuaguggccucacuuacgaaugccaggucccugcccuaacuucccccuacccauuucuucucaaaguggugggucugacaauacuaaaucucccucgagugcugcaaaucguguauauauagaugaugaacaaguggucugaggcgggugcugggcuguccugcccaaggguggggugagcaaggcagggcugugaaaaggcaacacucuuugagauggaacagcagcugacacagccccucggucuuugugguauacaaaucauggucagaacuaacuuuggucucacggccagcaugucuacuuuaggaagcaaagcaggagguuucauucugugccuaguguagcugaaguucuggaaauuccauggacugucaccuuaucaaguugauugggacccugucacuuacaagccuuagccugucuuugaaauuugaaauggguuuuuuuuuucuuuuuaaauuuuuaauuaaaauagaguucauauaccauaaaacucucccuuuugaaguauauaauuuaaugguuuuuagcauacucacggagcuaugcagccaucacccaaaucgaucuuagaucauuuuuaucgcucucaaaagaaacccuguacccauuaccagucguuccucauuuugucucagcacccagcgugggacaacaacugaacuauuuuuggucuccauggauuugccuauuuuguccauuugguauaaauagagucauacacuauguagccauuuguuucuggcuucuuucacuuagaauaauguuuuugagguucagccacauaacaguauaaauugguacuucauuccuuuuuuuuuuuuuuuuugagauggaguuucacucuugucacccaggcuggagugcaauggcgcaaucucagcucacuguagccuccaccucccagguucaagcgaugauucuccugccucagccuuccgaguagcugggauuacaggugcccaccaccacacccagcuaauguuuguauuuuuaguagagacgggguuucaccauguuggucaggcuggucucgaacuccuuaccucaggcaauccacucaccucccagagugcugggauuagaggugugagccaccgcacccagccuuucauuccuuuuuauggcugcauaauugucuauuguaccacauuuuguuuaucaguucaucacuugauggauauuuggguuguuucuacuuuugacuauuaggaauaaugcugccgucgacauuuuuguacaaguguuuuuaugggcauauguuuuuaauuuuuuuggguauaauaacuauguuuaacuguuugaggaauugccagacuggcuuucaaaguggcugcacuauuuuacauucccaccagcaaugugagaggguucuaauuuuucugcauccucgucaacacuuguuauuuuccaucuuaaaaaauuauaaccauccuuuugggugugaagugguuuugauuugcauuucccuaaugacuaaugauguuagccacauuuccauguucaauuggccauuuguauaucaucuuuggagaaaugucuauccaaauccuuugcccauuuuuaauuggcauuuuuuaauuguugaauuagagauggauuuuuuuuuauaauuagucuaucgggguuucuuuuaauuaguuaugaucuggagaaagaguauuaguagcaagaaaccaagugcuaguggauuucuggccccugccuggaaaacaagaaacaccuuuucugucuuaguucuacuucugaugucucuguucagucugagugacuaacacgugaagggcugauuaugugaacauuaaaucuguguguguagccuucauggcuucauuucuugcacuuaaaaagcugauguuauauuauuuuguuuugaaagacaugucgagggccagauggagaacuccaugccaaccugcuuugcccuguggaugugcuggauguucccgagggcaccuugccugacaaacagagcacugagcaagccauacaguuguuggaaaagaugaaaacgucagccaguccuuucuuccuggccguuggguaucauaagccacacauccccuucagauaccccaaggugaagagcugguugagggcugauccagcacagcugugacagcuguguuguuuguugagggagggauuugcacagggaagguggcuacauccugccaucgccaggcaccaugguugccugaugggcacuaguguccucaguggaguaaagaugggauuuagaggucaaggccaagaacauguaagaaucuuguaagaaaugcuuggcuuuccgcuucacuccacuggaggguuugauuuccuuuccuugaacuuauugagcagauguuggguuggauggugagaucaccacagaguagugaaucagagcuggcugccaaagccuguaauaagggauggcccuuccaaaacagccccagggaaugugaaacucucuucaaaaacugccuguucccccugagccugucagguuagaucaucuaaacacaaagcacugcauugcuucuuggaaccucaaauccuguacuugcuuguaugucauuuagagcauguagucuuuucuguuuuagaauccuuuuccauuuuucccuaucauguuuuaugagggccugagcaucccauccuuuugacuuugcagagaaugccccucacauguaaugagaguagagaccagcaguaugcucuuugauguugcagguaucuugcuuugauuggcccaggggaucuugcuuuccuaguaggagcugucagcccccuugauagaagaaggcugugagguucaccucuccugccucuuugcagaaaacaguuaacaaagcuggccuggcugugauucuuugaaaggccugcuuauaagucuagcccuuggcuggcaucugggaacuuugauuucugaaguguucucacuauucccagaauuggcuuacuaugcuuaaaccguuuagacaaacauuaugguugaugauaaacccuuggguuuguuuuuuuuuuucugggagccuggaauuuugauauguuccagacagauaguaccuaccugaccagccccaaauaaaaacuggauaaugaggcuuuaaugagcuucccuaguuagcagcauuucacauguauugucacacaacucguugcugggagaaguaaguauccuaugugacuucccuggaagaggacuugaagcuugugccuaguuuccucuagacuuugccucaugugccuuuuuucuuugcugaguguguuucacuguaauaagucauagcugugagugagacuaaaugcugaauccuaugaguuccccuagugaauugcugaaccugagggugguuuugggaacccaacaccucaccacacuuuucuagccaggcaggagguggggacaggaacagaagggcgucuguuuguaugaaggaagagaguuguugcugcucaguuuguaggaaacagaagucguaugauuucauugccauuggcaucucaugagaguaacuuaaggcuggacuuccaggucagggccgagcacguggggaaugcuagugagccaccacucaaaugcaucccaggcuuagagaaaaggcaguauagacagugauagagccacaagcuugugcuuuugcuaaaagagugacaacuuuguggcuuuguguuuuuccccaaggaauuucagaaguuguaucccuuggagaacaucacccuggcccccgaucccgaggucccugauggccuacccccuguggccuacaaccccuggauggacaucaggcaacgggaagacguccaagccuuaaacaucagugugccguaugguccaauuccuguggacuuucagguaucaaggacauaguuuggggauguauuggacacugaugacauagugucguaggugaaaccacucuucucaguagacacaacuccaccuauaaugucuuauuaagagcuuucuuugugugaguuaucaggcaaagugcugggguggagguguccuauagguauuuaggacacaggcaguguugccuggaucaggacucucccaaccagugucuuacuuucuaaagaagggaauguccagagaguuggugacuuguuguguguggacacagagguggggaaccagccugggugaccguuccuaacccaggggauacuguucaggugacagcucauuaauuguagagugaugggcaacucccgagcagcccagaaugcuugguuugcugguacuugcagguucccucugugggaaagcccauccuggcuagcugucacucucaggggguggcuuggugaacaggcccuuggugcagagggaacugggacaccaucauggccagugccacccagcugugauguccggcauuccuuugccaugauuuaggggcggagcaaccacacaauuagaauccucacacugacucaucagucacccuuucucccuggagagcagaauacacauugacuaaugcucuuucuggaauauuccacacagaacccugcccuucucuuaccacaugaaugcuguggcaggcaagcuauagcggauggaagauggcaguguuuucaaagugugcauccuggacuaccugccuuagaauuucugggagggcuuguuggaaaugcaaagucuuggcccacucagauuuacacaauuggaagcuggagguggaacuugaccugacaaccgacauuucuuaaaaaaaaaaaaaaaaagcacaccaggugauucugauucaucagaaguuugagagccucugcuguagaguauuguuuaaagcaaacacagaacaaaaccacugcauacagauaucccuugcuauccaaacuuacuuggccccugaguuugcacaacaagaguuugguuggugagagguguacauuccucaaauguauuugauuccuguuucacugagaguuuggaaagcaaugcauccaucuguuuguuuucuaauuuuguguuucugggcuccugauggugaaguggcuugaacuggcucugaggcugcaccuggaugcuuuauuagugauggucacuuaaaaugacccuucaaaauggacugugugccaggaagggcgcugauucaugugugguaucgccuuuaguccucauggggacuuagugagguaccugcucucuguugucuaggugaggaaacucaaggcaugggaggugugcugacuugucugacagcacaaaauuagugcuggguggagccaauucauccccagggacuguaacuccaaagccccaugguuggaucuguugguucccagcaguguggguucgaauucauguucuaccucauaccagcugccuaaccucugucaagucauguuaccucccugagccucccugaguuuucuucucuauaaaacugaaacaagguagguaaaguuuuuccaugauaacaccuacuuuagagauuuucagcaagaaccaaagagagcauguagaaguaucuaggaccgugucggcugcacggagcuaucuccuucaaguucucuuaguccccuccuuacacacaguggacagcaugacucagagggccucccugaugccugcaugugcuggucucagcccuguguuccccuugaacucuggccugcucacuguccucuuguagcuuuggauguccgcauccaagcccaucucacugcacccuugagacucagcucugggaucucuucagcuccagcccucuaacucagcucuacaugagccagugaccucaggggccacacucaggaguuuguugccugcuccuuccgagucaccauacugaccacaaccucuucuccuagcacuucccuugcucuaccucacggggauugcuagaguauggauuucuaucucccccuuguguccagguccuguuggcuuuguugcuucccuaaauagcuaaggccugguggcaggugacuuacuguacuucccagccgcccagcucaccauacuuguccauuuauccuugccccuccugcaguaccuuuaucgucagacacuccagccacacccucugcucuguaguccaaguccugaaagcugcuggagaaaauccaugcccccacgaagcagggaggcccucagaugccccgccuccagccccagcagcccaggcaagcucucugcucagcucaccucacuuguccucugcagcugcuccguuugcaugaccucuucucuacucccuuucacugcuccccuccaggccuuugccaccccugugccccauuucucaguggauagcaccuuuccucuuguagaaauggaagcugguggacagccagagguaggggaucggacaggguggauguggguacgcauccuggcugugccccuuaucagcugugugacucugggcaaguuaaccuuucugagucuuggaguccuuaaugugccguucacaggaucagaugccaccuaguguguacuugcugaaugggcucuauuaauaaucucugucacugagaccuggaauuuuguguaugcauguucugggcucgaggccucuucccucaacuccccaccacugucccugcuucccacgucugcaagcagaaugagcaagaucuuccuucucaccuaccuacccugcagccucuccauccacucucaucccucccagcugcaaaagugccagcccccuugccccugccuguuucugcuuuccacuccuucaacugaccuccaaggcagagcgagugcacacugggcuguucuggcugugucuguggccucauuguccauuuguucuucaccauccucuacacaggcuuccaccuccccaauccacuaaacucucaccucagcacugaccuugguggccaguaaaaucuaucuguguagguccugaccuuccuugagcucugugucacuuccucacuguuggccagcuccaccccuucugggacuguuggccucccaauccuuucugugucugccacuuaggugccacuucccaggccccccacuauauccuuuccaccucuucuuccccugcugggcucaguugagccuuggcagaugacuccagaacuaccccuucagcccaggucucuccugauuuucagauauguguguugaccugccugugagagccauuccuaggcagaugacccuggagaccucagcuccauaggcuuccgcguggucaggccaccaccccugcccugccuuuucuccuuccuccuccuccucuugcgcccccugcccccaaaugccagcgaauuaugccaccagcugaaugugaaaccuggagucacccuuggguuccucaacaccuccuccuccucugcucccugcccccaugucugcuugaugccccugaauuccucucacauccacacaguccucuggauccuucagcacauuguucuggaccaccucagugggccuugcuuuguuuuguucauucagcaaguguagugagcaccucuuauguacccagcaguggccuaguaccauuuugucuaaagccucuggaaucugugucuguguccuguugcaacaggacucuuaauaacuugaagcccagaucaugucaauuucucgccuugaaagaccucagugacuccauuggccuagaacuuggagucuccacucccuggauagacccaccagguccauauuaucuggcccggaccuaacuuucuagucaccccucugcccucccauuugauucuccagucacaugggccuuucauuggccccaaaugcaaccugcucugucacaacuccacacuguuccgugcccugcagccccugcuuggagcaucugagccccauuugucugacugcaggugcuucuugucaaauucuaacuccucugugaagccuucccugaaucucccaggcagauuugagggcuuauuccccugugucaccccugggccucugugggggaucggucagaguggugggaaaaacuauagggaaaggaugcaaaccuucugaaaggucagaagguucugcagagccccaggggagaauagcuguucuauaacccugaggcagagggcaaggaguagguacaagggagugugggagaauuuaucuuaaacaggcuuguuuacuuauguugaccaggaacugaccuuugaucgucugugcuugugagguucccugaaaggggaacaauaaauguuaauuaccugcagguuggcucuagguuuuuggcauuaugccugcacugaauaaaagccagcagcuccagcuucucggggcugcucucuggccacuagagccaggcaguaaccuagcugcucuuaugcugcauaccugugucugaguacucauuucauccauaggccagggucugcaggacagacccagcaggccucacugauaauuaagcauuuucuugucuccaugauuguguccucacuggaugggguggcucaucaagggugaggaccuugucugcuuauugccuuacguccaggggcuagcauaggaaggagggaauaccuuuguauaggacauagccauccugacaggugucuuucauccccaggaggaccaaaguuccacagguuucagacugaagacuucaucuaccagaaaguauaaguaggccagggcucagcauaauccugcuggaaggcuagauguauaucuuuucucuugacugcaagugagaacgggugagucucaugauuguccucacccuggcagugaugagaagaagcugguggguccagcugauaagucaggggcuggucugcgaagacacggcucucuucucaccccucuuugggguggaagauuaauuuuuguccuuagcauuugugaaccagguugggaaugagagucagcccaggaggggccgguggcucauuuacuucagggcaugaucuggcuguucccaaagugccucuuggguucagggacugugaaggacgugcugcucucugguaucuccuuugcucuucuccugccugcugacaguuuguuagaaaugagcuccacguaacggccauaguucaugaagauaugcaguuguaaucugcuguuggguuagcaagugaucagagggaaaggcucagucaggguugcuguuauguguuaaauuaugaauuuuuuuuucccugaaaagggcuguugacauccuaaccccccaguacugcugaauguaaccauauuuggaaauagguuuauugcagauguaauuaguuaagaucaggucauauuggaguaaggugggcuccuaauccaauaugaucgguguccuuuaagaagaggggagagagacacgggaagaacacaugaagauggagacacagugauacagcugcaagcugaggaaugccagggacugacagccaccaccaccagcuagggagaggcaagauucuucuacuuagagccuucagggagagaauggcccucccagcaccuugaucuuggacuucuagccuccagagcuaggagacaauacauuucagcuuaaaacaacagagcaguaggugacacauucauccacugugaucugugcccuaaagugaaaucugauuugcuuagaaauguaucuuauuuguagaccuacagauuuugcugugacucugugggugaagugaugcugaugguagggaaaggaguguuacauuuuggcugagaaaaucauuaagggcaucaacuaagggguagggauugggagagaugcacaggcaagcauuaucucuguaugccuuggcaauuuaaauugcagucacucucauuuuuauuuuuuuucaauuugcagcggaaaauccgccagagcuacuuugccucugugucauauuuggauacacaggucggccgccucuugagugcuuuggacgaucuucagcuggccaacagcaccaucauugcauuuaccucggaucaugguaagcauuuugaaauucccuggugagucaaaacaucugaacuuuccugugaaacaugcuuugcaaaauugccauugacauaaacauggguguguucucuuuugugaaccagugguucacaaacaaagugggauccuggggcauuuuuaugaucagcuuguuaguccugagaccucugucuuagaugcuugacggauaggugugggugggugggggagggucuuguagcaacuuuuuuuuuuuucuugaugaaugcagcaggaacccuccauuuguguggcagagcucuuguaacccccauuuuuaaccuggaggguuggaggacuuuuaguuuggguggagaggauccagaacaauccuggcagagcccagcaagcucuucacgccuggcuccagcccucccaccccuauccccgcugucuucucugccgagagccugggcuuuucaagucuuuaucucccccuaaggcuguuuccuacuuuuccaaaaaugaaacuaucuuuuuaaaagcauuuuuuaaauucuucaacauuccaagagcagggaauaaaacagcagcuccccccguuucccacucacauagucuuguuccucucauccucacccacucccccaucucugaauuguuucgaagcaaaucccagaugguuccauuuuccgaucacugucucugaaaaauauugccucuuuugaaguauaaccauaauacuguuauacuuagagaaaggaaaauaauuuucauaucaucaaauaugaaauaggauaauaguaaaucauaacaugugcuuaucaugaaaagaaaaaaggauacagagcauguaauucagggccagaacauccugcccuuuucucccaccugcucagggcuaacagaugacaauggauuagggauccaucugccagccaucaguugugcacauaugcacacagggauauauguuauacauguguauguuuguaacauguaugucacaagaugugauugcuuguucuguguguacuguuaacguucccugguuuuguacacuuaaugucauaggcaaucucugugucauuucucagaagccuaccuuuucccuuagaaaugucuguaauauuuuauuauauauggaggugccauaauuuuucacauauuccugauuaucugccaucugcuucugagcccucggugcccaguuuccucuucuccacgaacacacucuguugugaggcaguugccguagauuacaaauagcccaucucagaguccccuccugggacauccuccaucagaaccgccugggagccaguaaaacaugcugguuucugcaacuggucucaggagcucgcaguucugggcaugggaaagugcacuuuaacaggugucucagguggucuggccaccucucccugagcucaucauucccugggccucccuauguugccacguccucaucuugggccucuggggcaggagccagaaaccuccugagcugccugucaaggucaucgggcuuguuccuccugaucuggagauggauccuuggggcccacacaggcacgcguucuccuuagccagacuuccccguauuugcuccuggcugcagcagcacaggcugaggcccggcaccagauguucaauacgaucuugcagucaggcgguccacagcuauuucuguagcauuugccaugugucagacccugugccaggccugggggcccccucugccuggugcagggcagcucacaaaagcuggcagaggccgaaggcugcgugccaguauucagaaugccacagagcgccuggcugcuguaccuucagagccuccacaggcaccccagucagaguuccgggaguggauuccugaggucgcacugccagguucccucacguugccauccugcaggcuucucgauccuugaccuuuuagauucccgccacacugaaucuaaaagggacaaugugaccucuaagcugguggccuaggagccugccgauaaccuacccauucaucagcccucgugggucaaggcugccucguccuccccgagagaguggagaggucgagcaguggggaugccccucaggccccggggcuuacugacuggggcgggugucagggggaacucccucucuuucugagcuccacugagcuaucugaaaguccccaccauacuccccaguacugacagccagagggaggaacggcucaccagaaucauugggcaucucugaugggcaucaagucugcuuugauuauugaugaguggguaagaggguccucucaacuuggggucuccuugggaaagcacugucaacucagaacagguuucagcccuguucuggagaccacaggcccuggaaggcugggacaucauuugcagccccagcgucaucuauuagacggagccagcaaggucucaugcugugcgguacauuucaacacuuucucaaauuuacccguggcagcuuuugguguguuugguuauuuuuauaacacuacucacuguacaauuucugucaugcacauuuuuuguaucaaaaagggugcuguaacuuuaaaagacuggguauuuccaacuuggaauauucaaaccaucuuuugcaagggauguuuuaaauaggcaugaaggguuguuuuuaauugagguuaaggaucugaaaugagagguuuugguuuacccuaucuaugguaugucuuaaaaaucaacgaagauguccuugucuuuuuugaauuugccgaguguguugcaguuccacagcucacuguuagguggcacauaccccaaacugaaaaccugaccucguagggcaugagucaaaagacagguaggcacaggacagggcaguggugacacuacagcuuucaggguucccagccugucaagaaugagcaugucuuagcaggggaggaacgcaugugugggaaccgccacagaguccuacguuagguauauguugcuaguaguuuguuaagauauuugaguuugggaauuuaauuauuuuuucuuuuuuaaagguuuccucaugaggacaaauaccugauuuugaauaaagcagcauucaguugaaauaacccuuucugugguaauuccaagugaauauuuuucuucuaggugaugaguuucuacuuccucugguuuuuacaacaggaaaugaaaugguaucuaaaauaaacaagcugugguaugaugauuauucauuuucugucauucugugcuuuuuaugaacuagggugggcucuaggugaacauggagaaugggccaaauacagcaauuuugauguugcuacccauguuccccugauauucuauguuccuggaaggacggcuucacuuccggaggcaggcgagaagcuuuucccuuaccucgacccuuuugauuccgccucacaguugauggagccagguauaaaauaugcugaaaugauauugcuugacaguaagaucaccuuuaguuuauaugugaaccacuuuauugaaucauaggcuuuggggguuacacagacccccccuuccugccuuguguuggaauuucuucucaacauuuuguggucagcacacgcuuucugaacaucucccauacucuggguggggaaagagugacagaaccagaauugacaaguauggccccuguccacaaggagccuugugggaugaugauggacaaaggaacaggugcauccccaagauggggagggcugugguacagucuacaagagccugcuccagagcuuagaguaaggggcugcccccguaacagacgaggagaauccuuucccucgaugcgcacuuuugguagggacucagccuucuuuguggggggcacauuuuccauuuugacagcucaucaaucuagugaaccacuagaucuguaaaaucuaccaggugauucuacucugcccuccccagcagugaagggcaaguuuacuuugacuuccaugugccaguccuucaaagcuuugaaaacagcacugaugcccccgacccuguccauccaccaauaucuucucuucucuaggcugaaauccccagcccuucaaccauucgucacaagguaguguuuagacgcgugguuguccuggucucugucuuccaaaaaguuucaguuugagaaagcacuuccagaauaccaguuggaccagauaccccuccuggaugugugggcaaccuguauggguucuugugaguucuauccugacuugaucugcccagugcauuucagggacagguuguacacugucucugaaaugacguaugacguuugcucuuuuuggagugccucuucuaugaacuaugcuaaaccagauugcccccuuucuggacuuaagcauuuaauccauccuuaacaucuaaaucuuguacuguauauugauuccuguuuaaauuugucuugguucuggaccaucauucgggccuuucuggaucuuucugagcuugcuuuauacuacccaauuuuauuuuuugcacuuugauuuuugugcacugcauguccugucuucuuucaugucauugauagaaagguuaaacaguuucaaggcaugauuuuagcccuuuguuugcugggaaagaucuucugauugguugagaaucuuuucugaaacuuuuguugggaaguguucagcaauuuagaaauugauguaacugcacggccuuucaguuuauuuccaaauuuuaucucuagcugugucuuuucccugaacuucagacuuuuguuuccaauagucuuucccacuuagccagccuaacauauccaaagcuggacuucacaucuuucaucuucagcuuuuccuucaacacucuucuuguccucaagaaaugagaauagucacucaugccaaaaaaucauggaauaaucucaaccccuguucuucucuuacuccauaugcaauauucagucuaugagaaagccugucacacuccauucagacucuguguaccacuucccaccacuucgccugccacugucuuggaccagacugccacugucuugugcugaaguacugcaagagcuugcuaaaugguccccuugcuugugcccuggaucccuuggagguuuuccuccucagagcagccacagugauuccauuaaaacccaagucaagucaugucacagcccggcacaggagccucuuauguacccuucuugaucugaguaaaagucgucacaguggccuuacauguucuggccccauuaucucccugaccucaucuuuuuauaaguauccaggccaguuguccuauaacagugucccacagccuggauuuaucugauugcuuccacaugacuacauucaggguaacauuuuugacacgugugcuacaugggcuguuguauucucccauugugucacauggugggggcacuucauggccagcguuacuaguauuguaaguuugaacacucgguugaagagcuagcuagcaucagccagaucuugccauuguaaagguaccuuuuucaacuuucuuuacuuguuuucuuuuuauuuuacuuaaaaauuaagugucuagaaaaugaaaucaagcaugauaaagcacugucuuaaagauccagaagggccagaaugguagugcaaauccaauuucaauuuuaacaggaaucaauauaaaguacaguauuuagacuuuaaauauggaugaaccacaaugaaauacuacuucauacccacuaggauggcuauuaauaaaaaacaacaacaaaagcugugaaaggcugggcgugguggcucacgccaguaaucccagcacuuugggaggccaaggugggcggaucacgaggucaggagaucaagaccauccuggccaacaaggagaaaccccaucucuacuaaaaauacaaaaauuagcuggguguggcggugcaugccuguaaucccagcuacucaggaggcugaggcaggagaaucacuugaaccugggagacggagguugcagugagcugagccgagauugcgccacugaacuccauccuggagacagggcuagaccccgucuaaaaaaaaagaaugaaacaaguguuaagaguguuagugauuauauggaaaaauuggaacacuugugcauugcugguaagaauguaaaauggugcagccacuguggaaaauaauuugguggauccucagaguuaaacauagaauuacucuauggcccagaaguuccacuccuagguauauauccacagagcugaaaacagguauucaaucaaagguuguacauuacuguucauagcagcacuauucacaguaaccagaaaguggaagcaauucagaugucuauugacagaagaacagacaaaaugugguccguccaugcaauggaauauuauucagucuuaaaaaggaaggaaacugacacaugcuacaucauggaugagccuugaggacauuaugcuaagugaaaaaagucagucacaaaaggacaaauacuguauaaucccacuccuaugagguaucuagaguaguccaguucauagacauagaaaguagaauggugguuuccaguugcugggugaggauggagaaaggggaguuguuacuuaauggggacagaguuucaguuguguaaauuaagaggaguucuggagauagauggugguaaugauggcacaacaguauaaguguacuuaauuccacugaacuguauacuaaaaagugguuacgaugguaaaugucaugguguguguauuugaucguaauaaaaugcaaagauaacucuaaugcagacauccagaagggaguaauguguggggugauccugugggagucagaauauccuguuccucaacagacucuuuuaccuagugguuguagccuuaauugaugauccuugucugagucaguuauuaaaucggugguuccaaaauucagguuguuuuaaaaagcgccaacagccucguggggcccuaauuuugcauccugcuauuugauuggaugaguaauuaaugcagggugaggugccgaggugguguuucuaaacgucuguugcuaaagauaaauguuguaaauuaaaaaaagaaaacauauggagcccagacagguuccuuuacugcuccugccuggccauggcaggcuuuuauaauguaacccauucugcucugucgcuuccuguuucaggcaggcaauccauggaccuuguggaacuugugucucuuuuucccacgcuggcuggacuugcaggacugcagguuccaccucgcugccccguuccuucauuucacguugagcugugcagagaaggcaagaaccuucugaagcauuuucgauuccgugacuuggaagaggauccguaccucccugguaauccccgugaacugauugccuauagccaguauccccggccuucagacaucccucaguggaauucugacaagccgaguuuaaaagauauaaagaucaugggcuauuccauacgcaccauagacuauagguauacuguguggguuggcuucaauccugaugaauuucuagcuaacuuuucugacauccaugcaggggaacuguauuuuguggauucugacccauugcaggaucacaauauguauaaugauucccaagguggagaucuuuuccaguuguugaugccuugaguuuugccaaccauggauggcaaaugugaugugcucccuuccagcuggugagaggaggaguuagagcuggucguuuugugauuacccauaauauuggaagcagccugagggcuaguuaauccaaacaugcaucaacaauuuggccugagaauauguaacagccaaaccuuuucguuuagucuuuauuaaaauuuauaauugguaauuggaccaguuuuuuuuuuaauuucccucuuuuuaaaacaguuacggcuuauuuacugaauaaauacaaagcaaacaaacucaaguuaugucauaccuuuggauacgaagaccauacauaauaaccaaacauaacauuauacacaaagaauacuuucauuauuuguggaauuuagugcauuucaaaaaguaaucauauaucaaacuaggcaccacacuaaguuccugauuauuuuguuuauaauuuaauaauauaucuuaugagcccuauauauucaaaauauuauguuaacauguaauccauguuucuuuuucaaaucuaaaguuaaaaaaaaauagcagaagccagugucuuaaagucuaucuuuuguuucuaagaccaugggauuucauaaucucaagauaaaauauguaugaaguaauuaauguagaauuuuuacaccaaauaauaaauaaugcuuaauaaacuagagauaugagauguguaggaaauuugguuaaacuuuuuucagauacuuucuggcccaaauaauaauuuguuagcaaauaauaugacccuugaacucaauggccaucuauuaaaagacuguuguucacacuggaaaacauuuaaagaugugacuauauccauggguggauugaaucacucaaaauauauuaguauccuucuuuagggaugguugguuacagacauguauuuauucaggaggcagaaaauauuccauuuuaauugcuuauuaaagaaaacauuaaauucuaaauuauuuugaggacugugaagacuuuucauuaguguaauauuaggucauugucaaucucccagaauguaguucuauauucucuaaauaugaaaguauccagaaaggccagugguaguaaaaagcuuaguguauauaaucucaaaagggauggaauauuuacagcucauauuuauaacauguugaaucuucucaguuaucaguagucaucagaagugucaauagcuuucuaaauaaauauuaaauaucuacuguccuguagugaaggaguaauuuuuaguaauuuucucuuuacaaagucuccaguguuuccagguaaauauuugugaaacaaaauacagcaaacuacauuguuacuucaguguauuguugccaaaaaugacaagauauuauauuaaaaucaguaaauuuuagacagauuuuaaaaauuaauuagccuacaauagagguuauaugguaacacggugaucuucuaagcaguuaagugacugacuguucuggcaacaacgacuucuccgugacugaagggcccuguucauuuccugauccugaagcucgucucucuuuugagccuccgcuugcuuuggucgaugguuucccucagcuuuuucuuugcuguucuucauccucguuguugcugucaucauguucacuguggcuuuuacaauacagccuguaaauuccuuaugacauaguucagugcauuuggcuuuaucgccugcuccacaguucuuuaccuuuacuuggcuuagagaaacuguaucuuuguugcuucauauaaccuuuccccaaccccacuaagcuggacauaacuuauuagugguccucccgucacuuuauuuguagaaaucucucuuucacaugagcagggguucuuucaugugguuuagcugacagcagaacuagugauucuagacauuuugcauggcccucauucaguggcucacaaacaugagggagcaucagaacuacuugaggggcuuguuaaaacccagugcguuagaagucggaugcgguggcucacaccuguaaucccagcacuuugggaggcccaggcaggcggaucacuugagguuaggaguucaagaccagccuggccaacauggugaaaccccgucucuacuaaaaauacaaaaguuagccgggugugguggugcaugccuguaaucccagcuucuugggaggccaaggcacaagaaucgcuugaaccaggagacggagguuucagugaaugaagaucgugccauuguauuccagccucggcaacacagcaggacugugauuuucuuuggagacuccuagauuuucugugguuuugaacugaauuuguuggauguuggcaagugccucuuaugagcuguuucuuuauccugcauuugccccacaaagacuuaucuggaggugagcaaaguauguuugguagugaggucacaaaggcaaucagccccuuccuccccacucccauugccaucuucucaguccuucucccuuucuuuccaaguaguuuacccaccccuccucuuuccuccccugucccuaaaauaauccacgugucuuccuaaaaucucucuuugauccuguccuuugauaacaccgucagugccuacuacugggucuagacagaccucuguugagcagucagagucuucccugacuccacaaugccccuuuccuuggcugaccaguaugacuacugguccccaccuuucccuugccuaucccuaccucccuccuacuagguugucccaucccucucuucacccauucauucaugaccauuuuucacuaccaagcucccccccucccgaaggaggcugagguuuuugugacucucuagacucuauugugggauggaaugaacauugcuaaagaaucuuguguucgcuuuacuuuaaaaagguauuuuuuuccuaauuauaaaacugaugugucaguuacggaaaaauuagaaaugcagcacaaauacaugaauauuuuaccacgaaauugccauauaauaucuugucuuuuuugggggugugaauuuuuugcauuguucugaucauauucuuuaucauguaauuuauguucuuuuuuacuaaguauuaugugugguuauuauagauuuucacaaagauauauugcugguaauauauuuuauuguguagucuuauaauuuacuuaaccuucuuucaauuguuagaaauuuaggcuauuuccagauuuucaguauuguaaauaaugcugugaugaccaauuuugugaauaaaauguuuuuauguauuucagauuauucccuuaggauagucucucagugccaaguugucaaaaacaucucuauuuugcuuaucuuccugcucucuugcugccuuaggggguaguaaacugaaacauaaaguaaacaugcauacaaauaaaaaacauaaaacaaaaauaagcaaccugaugguaauaggugaaagugguaaccuguuuuaacuuugaauucuugccgggcgcgguggcucacgccuguaaucccagcacuuugggaggcugaggcggguggaucacgaggucaggaguucaaaaccagccuggccaagauggugaaaucccgucucuacuaaaaauacaaaaauuagccgggcgugguggcgggcgccuguaaucccagcuacuugggaggcugaggcagagaauugcuugaacccaggaggcggagguugcagugagccaagaucgcgccacugcacuccagccugggugacagagcgagacuccgucucaaauaaaaaacaacaaaaaacaaaaaaaacuuaaaauucuuugcuuguuagugaccuugaucaugguucucuuuguacgauaguugggcaucuguauuuccacuugugugaauuugccuuuaaauuuugguuauggguuucaccuuuuaaaauaaucaaacauauuuaucuuuuccugugugauagguuuuuuucuguaucuuuuccuguuaaacacacagaccccuccccaaucuggacauugaauaaauauucauuuuccuuugcauuguuugggguuugguuuuaugcuuacugugucucuccaccccauuaucagaguaauauaugcucauugcauaaaaucuggaacaugugaaaacuggagaugaa

SEQ ID NO: 19011 - RNA, 3932 nt, Homo sapiens
uccagcaaauuguggcuacuaauuugcccccugaagaucaagauggcucuggggaugacucugacaacuucuccggcucaggugcaggugagguugucaugggggccccccccacccaagacggcaacaggucaugccugugggcaguggucaggcagucuccuguguuuacugagcauguacugagugcacccugccugcccugucuccacccagcuggcuccaaagggcaaugcugaggagaggaaugggguccgugagcugccugguuaaggagagcucaugcucggaggugaggugaaggcugugagcuccagaaggccccagggccgccugcugcacgcaggcucauauucacuaggaauagcuuuacucacuaagaaaccucuggaacccccuucagaagguuauuugacuccugagccucuguuuucucaucugcaaaaugggaauaauaccuugaccugauaagcuuguggagcuguaaggcagcacagagccagcugggguguagcucuuccauccaagcucccuuccuuacuuccccuuucccugugggggacugggggagagaagucccugagcuggagguggucagggaagcuucacagaggagguggcucuugaguggaccucagaagaggggugagagagcuaaggaaggaggcugaggucaucccuggggaagugaccuagcggaggccugagagcugcaagguaggauaucuguuguuggaagugucuguuguuggaagugggggccuuuuuuucagggaggguggggccagagaagugugugcccugggauaaguaggauaaccacaguaguuaugccccuaagggaugcccaccccaccccuguggucacagaaaagcuuucccagguggccuaggcaccugucucguggcuccagagaccaggcugcaccuggacacacacaaugggaagggacagcucuccuuguccauuuuccaaggagcuuagccucagcugccuuguccagguacuagccucccucauagccugagcuuggccagcccaggugcucuggagccucccccgacccacccaacacacucugcuucugguccuccccaccccccaccuccccaacacacucugcuucugguccugcaggugcuuugcaagauaucaccuugucacagcagacccccuccacuuggaaggacacgcagcuccugacggcuauucccacgucuccagaacccaccggccuggaggcuacagcugccuccaccuccacccugccggcuggagaggggcccaaggagggagaggcuguaguccugccagaaguggagccuggccucaccgcccgggagcaggaggccaccccccgacccagggagaccacacagcucccgaccacucaucuggccucaacgaccacagccaccacggcccaggagcccgccaccucccacccccacagggacaugcagccuggccaccaugagaccucaaccccugcaggacccagccaagcugaccuucacacuccccacacagaggauggagguccuucugccaccgagagggcugcugaggauggagccuccagucagcucccagcagcagagggcucuggggagcaggugaguggccucugcauuccuugggaaauugaguggguugguccuaaugccuggcacuuggcaggcccuacaccugugcccugcgggcaucucguauuccucaccaggaagacagggcacaggggcccgccuuccccuacccccagggccucgcccagagcaggacagacuaacuaugagaucagagcagaagcacccuuaaagaucacccaagagagggcuccccaaacucacaauccaaacuugcagccccugcugcaagagugaacguuauaccaaguccaauuuuuuauuuuauagcuucgugggaauuuuacgcuuuacacuaaaauaagucugcuuauuuccauacaaaaaugugugcuuuguaucacuuuuugugauauccaugccaugguccagccaggguccggaguugauguggcaagaaggccuggcuuucgggcccugugcgauccugguuugggugcaucugagugggugguggcaaagaucagggaggcaggagcugcuucugggucuuguaguggagcugguugcugcugcuggcggugaccuggccaacccaaucugccccugcccucccacaggacuucaccuuugaaaccucgggggagaauacggcuguaguggccguggagccugaccgccggaaccaguccccaguggaucagggggccacgggggccucacagggccuccuggacaggaaagaggugcugggaggugaguuuucuuucagggggguaguuuggggugaauugcugcuguggggucaggguggggcugaccacagccaaggccacugcuuuggggagggucugcagcagagcccaaggagccgcugagcugagcuggccccgucuaccugcccuaggggucauugccggaggccucguggggcucaucuuugcugugugccugguggguuucaugcuguaccgcaugaagaagaaggacgaaggcagcuacuccuuggaggagccgaaacaagccaacggcggggccuaccagaagcccaccaaacaggaggaauucuaugccugacgcgggagccaugcgcccccuccgcccugccacucacuaggcccccacuugccucuuccuugaagaacugcaggcccuggccuccccugccaccaggccaccuccccagcauuccagccccucuggucgcuccugcccacggagucguggggugugcugggagcuccacucugcuucucugacuucugccuggagacuuagggcaccagggguuucucgcauaggaccuuuccaccacagccagcaccuggcaucgcaccauucugacucgguuucuccaaacugaagcagccucuccccagguccagcucuggaggggagggggauccgacugcuuuggaccuaaauggccucauguggcuggaagauccugcggguggggcuuggggcucacacaccuguagcacuuacugguaggaccaagcaucuuggggggguggccgcugaguggcaggggacaggaguccacuuuguuucguggggaggucuaaucuagauaucgacuuguuuuugcacauguuuccucuaguucuuuguucauagcccaguagaccuuguuacuucugagguaaguuaaguaaguugauucgguauccccccaucuugcuucccuaaucuauggucgggagacagcaucaggguuaagaagacuuuuuuuuuuuuuuuuuaaacuaggagaaccaaaucuggaagccaaaauguaggcuuaguuuguguguugucucuugaguuugucgcucaugugugcaacaggguauggacuaucugucugguggccccguuucugguggucuguuggcaggcuggccaguccaggcugccguggggccgccgccucuuucaagcagucgugccuguguccaugcgcucagggccaugcugaggccugggccgcugccacguuggagaagcccgugugagaagugaaugcugggacucagccuucagacagagaggacuguagggagggcggcaggggccuggagauccuccugcagaccacgcccguccugccuguggcgccgucuccaggggcugcuuccuccuggaaauugacgaggggugucuugggcagagcuggcucugagcgccuccauccaaggccagguucuccguuagcuccuguggccccacccugggcccugggcuggaaucaggaauauuuuccaaagagugauagucuuuugcuuuuggcaaaacucuacuuaauccaauggguuuuucccuguacaguagauuuuccaaauguaauaaacuuuaauauaaag

SEQ ID NO: 19012 - RNA, 35284 nt, Homo sapiens
uacggaagcccggaaggaggggcagggggcgguggcucagguuucuccgggcggcggcggcggcggcgacggcgacggcgacggcagcggggacggcagcaguagcgggagcagcagcguggacgcggcuggcgcuggcgccaugaacccgcuguaaggcgcaggcugugcagcacggggugcgggggaggaggaggaggacgccgcggugaaguucuccgccaugaaccugaggggccucuuccaggacuucaacccgaggugaggcggcgucguuggcgcccccgggaguccgcgcugcgggcucgggcgcgggcugguguucggcuccggggaggcacggcgggcgagaugcugcagcccgaggacccgggcgccugcccgagccucccugcgggugcaagcgguccccaggcaaaacagucggccucggcgcccgcccgcuuccuccucccgugcccggugcuuucagccccugcccggccacggccggaagggcccggccgcgagccccguccugccccaagggaaccccauucuuuucugcuugcugucccucauuggugucccaacuucuucgucucgguuccauccucuucugcgccgcugcgggcccuccauucuccgcgucagggccgucucacucgacccaacaccccuacccccaccccagcuguuuccuccaguuccucgcaguccuugggguuuuccuuggguuuaugcccaucccucucuuguuugcuucuuuguugaacggauaccugaaacacuguugaauccuuggagucagugucgggguauggcaauaccuuauauaaugcauuucugggugagccugaucauuuuccauacucauuuucucaucagucuucacuacaaguuuauuugcaggaaguagauauugcuguccuucuuuuccagauggggaacacccaguggacaguguggagaaaacacuggcuaagcacucaagcgccuguccuugcacuugcccgacuguuuuguaacuguucuuuaccccaggcugugagcucccugaagcugagaccaucuccugcucaucucaguguccccagcgccucccacccaccguaucuggcacauaguaggcacauauaaaauguuuguggaacuaaacugagcccaaagacuuggauuggagacgaggccauauguaacugggugauucucugcccuucuuuggcccuucuguaaaaugaggaguuggccuaacugaucucuuaaaugcacuacucuccgaaaggaguauccguuucccuuauuugccaguugggaagacgugcucaguaaauauuugugugcuguaaccuaugcuaggugcuuuagaugcuggcggucucagcauggggugaagaagggcuuguacacuuaagaugccuuacaguacugugcagugcuguacugcgggggggccaacucuggggaccuaugccuuggcugcuuguugaggaugaaaggaaguuuuaggggaguauuuguauguugagggugcagucucccuagggauggugacauuuuaacuugugagucauugugacuuuguaugugcucuuauuccacuuugaguucauguucugguuaggagugccagugucucuaacacggugcagacauuaucauuguuggcuucgaaggcauagaggagguaacagaacuaacugcagucccuuccucugcugcaucaggggguuaagauuggucugcaggguaguaggguuggugcuguggcuggacaagcccuguaugucuucuauuuggagauggugauaagaaaguuaaguaaaaacugaauuguuuugugcccuugggcaacucacuuaucuauuguuuuaucuguagaaugaguauaaucucucagugggguagggaggccaauuaaggauugauuacaaagugccuuacaaauagaaagcuacagugacuuguuugcaaggugacagagaauucagaagccucaagaaacugccuuaagugaucaaacaggcuaacagaguugccaaagcaaaauagugcugcacugauacuaccuuuaaccguuuuuuccuuuagcccuuuuccccccaaaaaaauuaguauaugaaauuacagugaaauaccugguaucuaagcagauuuauaguaauucucaacauauucaucaaucucuuaauucuaccugcauuaaaauguauuucuaccugaaaaguuuaaaggucuuuuauacugugccauuuuccugauucauuguugccagagguagugaguuccuuaauuuuacagauauuucaagaggacauuggccagguauuauugguaaaucagauuuguuuuuuuagcugguaguguuucaccucuccugagcacuccuaguuuuugacagugugcuuuagucuccuuccaugcugaggaaggccuucucuauaggagaaagaaaacugagggguguacacaggaaguuaccuuaugcuggggacucaaaccuugaugcuacugcuuugcucccugccucuauuuuugaaccaauucaacaucucccuccuaccccaggaccuugucacacacuguucucuuuaccaggaauguuucccucucuuuuccucuccuccagaccuagugaacuccuauuuauccucacuuggcacuugcuaagggaagcauuccugacuucccugaccagauuuacugcucccuguuucuacaguuccuguaguauuuacuacuccuccaucauagugcauauuuguacccuugugucugucuggaugcuuauuugauuaauaccugccucccccacuaaacuuuaagcuccauggggucaaggccgugacugugucaguaucguagccugcauacuuggaauaguaccuggcucaauaaauauuuguggaguaaauaacugaauaacucuccagagccuauaagauaaaucuagagcugcugcuuucaaucacugcuuuccugguggucuguggccugguucucuuucuucucacacucuucccaccuucagagugcagccauugcuuuggagagaugggagagaacauggcacuaaggcagaauauggcuauauuuacuuugaagagcaugucuuugucauagaaauagucacugucaugguuuggugggucccaaggcaugggucauggcuccagauccccuuuccagccuuuuggaucuugguaagucugaacccacugcugcguuggcaaggcucuggaaacuauagugacagagaaugauucacaagugucaacacucagauguacagggcugccagcugacccacucuaccuauuuccaucuggcacugaacugguugaucaugaacuucuuuucauaauugcuuuuuaguuaugcagguuaagacaugccgaaacagauguaccggacccacaaacaaguccuuccuugaaugccugaggcuuccuaacagugaaagagcccuguucuuagaguaggcaaacugauucugaggcauuguaggugguagggaucugguaguagguagcauuaggugggcucccggcacucaccauggagccuugaaauuuucugcuacuuugggggaguugcugguucagagaaggcccuuccacccugguagccauguggcacuggaaggcugugaaaacucugcugggccuucuuagucaucuguugugagcuccugaugggagugugguguaucccucaggugugcuagacuggaacaaaggcugagaaguguugcucuggggguuccaacuugugggcaugggguacugaugagaucaguaguguuuggagacuucuguaugcuccaucuucagaagacauucuggaguccauauaaguuaucuugucucuuguuugaagcaggaaaaaggaaugcgauugcugguaauauaguucacuaaagucagcuaccuggccucuaacaguuauuugcaaaguauauuauaacauugauuccucaaacaucuagauuccuaucucgugccaagugauguacuaggugcucuaaguacaaaaauaaaggaauauaguccuccucucaaugcguaagccuaguggaagaagcagaaaugaaagggaaauaagaauucaauagaguaugaggcauuacagugaaagaaaccaaaugucuuagaaguacaaauggcagagcuacuaauucugucucgagcaggcagggaagagucuauaguggaaaugacuuuugagcuagauuuugaauugagcuagucuuuugagccagacuuuugagcuagaauuguaggguugucaucagaccagagaguaggaaggguaccuugugaggaagagagagagagaucagauuguuacugugucuauguagaaaaggaagacauaagaaacuccauuuugaucuguacuaagaaaaauuguuucugcuuugagaugcuguuaaccuguaacuuuagucccaacccugugcucacagaaaccugugcuguaaugaaucaagguuuaauggauuuagggcugugcaggauguaccuuguuaacaauauguuugcaggcaguaugcuugguaaaagucaucgccauucuccauucucgauuaaccagggacacagugcacugcggaaggccgcagggacaucugcccaagaaagccuggguauuguccaagguuuccccccacugagacagccugagauauggccuugugggaaaggaaagaccuuaccaccccccagcccgacacccguaaagugucugugcugaggaggaguagugaaagaggggggccucuuugcaguugagauaagaggaaggcuucugucuccugcucaucccugggaauggaaugucucuguguaaagcugaccauucccauucguucuauucugagauaggagaaaaccacccuguggcuggaggcgaaguaugcuggcagcaauacugcucuguuacucuuugcuacacugaguuguuuggguaaagagaaacauaaaucuagccugcgugcacauccaggcacaguaccuuuccuugaacuuauucaugauacagauuccuuugcucacguuucccugcugaccuucuccccaccuguugcccugcuacacuccccucgcuaagauaguaaaaauaaugaucaguaaauacugagguaacucagaggcuagcgcuggugcggguccuccguaugcugagugccgguccccugggcccacuguucuuucucuauacuuuguuucugugucuuauuucuuuucucagucucgucccaccugacgagaaauacccacagguguggaggggcuggccccuuucaguaucucagaagggacaaaguacacaaaggcauggggucaugauagugccugguauguucagguagugaagagguccaugugguaugagcacugcagaugauaugugucguaugaauuaaaaauacauaguuacugcaaauaguuuuuacagguuauuguuuuuaagaaagcaguaucuaaugcacgaguguacugucaguacugucaaugaacuacuuaccacucaagugacugcuuaucuguuguucuguccucucaagccaccuacagucagaaaauggucuugauuuuacugauguugcuguuaauaauagcugugacuucuugaguacccaccacaugccaggcccaauguaggggcuuugcauccauuauccaugaucuuuacaacaacccugcaaaauuagguaucagccuuauuuuaaagucuugacagcuugugacuucccugaaguugcauaggcaggaagaaucuaagucaacauucgaauccacgucagucucaugaagccugugcucuuuccugcgugccaugccauaguucuaguuaagugacaacuccuuuccuccaugacauuguagauccaguaugcuaaggaacccucuauuuacaaauuguaagugauuaaacaaaacaaaccuguuaguggcgcuuauacauccaaaugaguguuguuauucaaagagguuacuuggggaaagagaauguauacaccuauuccauuguucauacuccuuguuacucaucuggaauucccuuuaaagucaguuuacauaucacauaagaagauccaucucauugcuuuaugaucaucuaucauuuucaaccaaaauaguuccaccuaguuugaucacacaucuuauucacuaaccuuggcucugacugacuguuugccauuuccaaaauuugaauccacccucagugaaaauuuagcaccauuugggauagucagaagaucagacugcagguucucaaggugcuuccaagaagaaagcuucaaagaugauuugaguaaugaaguaccauuggaauuacugcauugccucccaaggggacugguuaaaggagagaaaucucauuugaauguauaauuuccaguuuuaaaaguaucauuccuauuacuugauaauuacacacacauuguucuuagcuguguucuuugagggccaggauuuggaggugcugaauuacgugcugaaugaguggauguuggguacaaauagacaucuaccacugggaagucuuuguuguacaggagagaccguggauugaaggaguuuuagauaguuuccuaggacuccagaaguuaagcuuuuuaauauggagcuugaguuuucuaaucauuuugccugauaugucaugccuguacaagaugacuggaauuuaagacaaaagccucgaacucuggagauagaugcuuuauaaguggagacucauacuuugucagcuccaaccuaauagugacaacaaugauugcuaaaugagauuauuaccuacaauguggcagaacuuuugucuuucauaauacugcuaaagcuagaauggguaaaauguaucauuuacacagugcuuucacauacccuugucuuaaugaaucaguauaugaggaaucagaugaggagacagaccugggggaaaauaacucacccaagaccacaccgcugaugaauggcaguugaggaacuuaaaugcagaucuuccuacuggccugggcucugcuuuuauuuggcuuuugugcuuuuuuguaucuacugguuaaaugcucuuaaacauuuuuuaucuuaauaaaaccagcuaaagucuccacuaaaagacuuuaaauuugguuaauaagguguaagaggggcaguucccuugauaguuugugaguaugucagguugucauuuggagccauucugucaagcuuuagacugggaugugccauccaaaguuuguguguguguaugugcuugugcguguguacgugcaugcaggcauguguuaaugcgcguguaugugcuccagugaagccagcagcuuccacuggaaaaaaacugauaggucuaaaaagaguccagcugcauucuuaugauaugcagaaaacagauacuagaacuuuuacauucagagucaucauuccuuugcuaaguauauucucucucucccucccuucuuccuuuucucccucccuauucucccaacccugcaaaguggagagagggaauuugagccugagcagaaagcuccauguaaauuucagagaggauacuagcuuuggcccagguagcacuacuuagugauucaucguauacuaacacuacagauucaaaugagaguggaauaaauccauucuaaagguguaacuggaaaagugaauuuuaagaaguagugauuaauguuaaaccagaaccucccauuucucccagguuuguggagaauuaagcagucuauuuuuauacuuggaaucuggucugaauguuucuugaaaaguaacucaaaguaguuuaggcuaugaccauaaguuauuuuuguaaauacauuuucuuaucacuguauuauugcauauuauuguguauucuuuugcaaaucaggcuugauauuuccuuuuggcuaugcagucaccuuuuagacuuugcuugcaaauauauugauauaguuaagauacuauucuuucuuuccccaacuaggaguguguaugaauuacaucuuuugaacuuacugauuguauuacuuuguuuuacuugaucaacuuuguaguuuaauuuuuuuaaaaagcuagcuguugggauuacugaucaguuucauuuuuauaucuauauuucuacuuuuaguuuuauuauuuucauguuuuggcuuuuuccccaaauuucuuagaaacucaguuuacuaguuuucuuuugccucuuuuuuuuuucuuuguuuucuacuuuuacuuaaacauuuuaaaugaacacauuuucucuugaguuuuguuuuggcagcugcccagguauuuuuauguuucaauuguauuuuaguaacucuacuaaacugcuuaacaaaucaguauugaaaaugauccauuuuuugucaguguuuuuaugaauuguauaaaaugucaaccucuggucucuacugauuacaaucuaccuuacacacucauauguaucuucugucacucuuguugagaaaaucugcaguggccccauauuaccuauuaauaaauuccaaggacuuuaccuugauauucacauuccccuaccauguuaccacagccaacuucuggcuuauuccccccaguacccuuucuccugucucugcagcacccuacccaccacgauuuauagaaaguauucuguguguuccagucugcuggaauuggagaggggaggauaaagaggggaugagcaauggguacaauaauacaguuagauagaaauaauaaaucuaguguuugguagcacaagagggcaaauauaguuaauaauguauauuugcaaauaacuaaaagaguggaauugaaaugugccuaacacaaguaagugaucagugcuugaggugauggauaucccaguuacucugauuugaucauuacacauuguaugcuugcaucacaguaucacguguaccccauaaauaggcacaacuguuuuguauccauaauaaauaaaaauaauuuuuaaaaaauuggaaaacaucuuauucccuuugucuggaauuccuuauucccaacuuguugcccagauuccacuucucuucccaucucucucagggaaauuaaucuuccaaguccccuaguuuaccauauguaguuacuuguugauacaucaucucccucuguuccuauuagucugagcaucuugagcgaacgcauuguugcuccuuuuuauguaucucacacauuucaggcacucaaauauuuuuaacaauuguaaauuagauguguguuuauuguguauugcugccccaugauccuuuuuuucucccuggaaaaacuauauauauguaaagcaaguauguuuucuuguucugcuacguaauuaucuucauauaagcuugcuguuuuuuaaauuuucucguucugcuacuuaauucucuucauauaaccuugcuguuuuuuaaaucuacucuuguguucauuuccguauuuuccuuaggaacuuugucuguuuuaucugucaugauuuaagaguagcaugaggaagcccacaauuaaaauauuucuguguauccuuaaaaaagaaaaauuguaaaauuauuuccauauuccauggucauguuagguuuuuguuauuuagguuuuccuuauuaguccuuuuagcauuuuaauacuuucggcuuugaaaucuaauuuaucuaauuuuaaagauaguaaauuguugcucuugucuucauccaggcgugcuaaaccucugucaucugauuucugauaguugguucgacuuuugacuuugguuccaagcguaacucuugaauguaacagguuuacuuucuuaaucuaggaagcaaccuuucuuuuuacagagcugugguaggcagaauaaugacgcccccaaguauguccacauccuaauccguggaaccagggaauauguucuguuacauggcaaaggggaauuaagguagcagauggaauuaaguuugcucaucagcugaccuuaaaauagauuauucuggauucucuggcugagcccaauguaauuacagggcccuuaaauauagaagagggagacagaaaaggaggucagagugauucaguaugagaagaacugcauucuccauuguugacuuugaagauggaggaaggggccaugagcuaaggaauguggcagccucuagagcuagaaaaggcaaagaaacauucucuccuagagccuucaguagcauaguccugcugacaccucaaguuuagcccagcgagacccauauuggacucugaccuccagaauuguaaggguuaugccuuuuaaaccacuagguuuaugcuuuuuaaaccacuagguuuguggcaguuuugaauggcagcaauaggaaauuaauaagagaacauucagcucauguauauuuuucuaacccuaguauuugaaucaugaauuauauuuuguggguccuuuuguaaguuuaucuuguuuucuauuuuucauguaauagacauaaaauuuuaaguuuccuuuaaauuaugucaaaaaccacauaaaauaaucccuuuuccaacauuuaaaacauuuugguacuucucuuuucuuuaguuccacuacucucuuuuuuuauuaaauaaggaaacuguuuuacagaggauaaugaaguuagcuuacagcauuuaccaccccccccaccaauuuacuuuuuauuuauagucugaaaauccuuuaggauaaaaauuaccuguacauguuaucuaauuuacauaugaauccugugucgucauuaucuuagcauuuguuaauguuugaauccacuaauuucuuuuuuaaauagucuguuuucaaguccauuguuucugguaauuauauuuguagccacaggcuuuaguugacaaauugguucugauuuuuuuagauuuuggaauauuucccucugcuuuaagagagaaaacuucugccucuacuaauuguguacuguaauuguggugauaacuccauuucuauuaacuugugaaucaccuugacacaggcucucuucuuguccaaagucuaagggaugaagucauuuuuaucuugguuucuuuaaauguucuuucuuuguagcagcuuauaaaagccuguuuuuguuuucgaguauuaauaauauuagcuaauguguauugaguacgcugguuaucagacuguuucccacagaccuugggagugggccuugagacccuuuccagguaucugcaaagucaaaauuauaauacuaagacauucuuugccuuggucgacauuggcacuggugguacaaaaguagugcaucaaacagcuggugcuggagcacaaaucaggacaguggcaccagcugcacuagucuucugucacuggauucuucaccaccacgugcuggacuugcaguuaaaaaaaaaaugccagcuucacuuacgaauguccuugauaaagcagaaaaauauuaaucucauuuaaucuugaccccugaaugcacaucuaguuuaauauuccaugugaugaaaugggaagaaugcauaaaggccuguuguaugcugaagugcaaugguugacucaaggaaaaacgugugugccugaguuacaagcugcuguuuucauggaguaucauuuuuauuuggaaggacaacugacagacaagacugugguuauuuguguuaugguguuuggcagacauuuucuugaaaaugcaggaagccacaauaaacauacgugugcaugugucuuuauagcagcaugauuuauaguccuuuggguauauacccaguaaugggauggcugggucaaaugguauuucuaguucuagaucccugaggaaucgccacacugacuuccacaacgguugaacuaguuuacagucccaccaacaguguaaaaguguuccuauuucuccacauccucuccagcaccuguuguuuccugacuuuuuaaugauugacauucuaacuggcacuauucacaauagcaaagauuuggaaccaacccaaauguccaacaaugauagacuggaucaagaaaauguggcacauauacaccauggaauacuauacagccauaaaaaaugaugaguucauguccuuuguagggacaugggugaaauuggaaaucaucauucucaguaaacuauugcaaggacaaaaaaccaaacaccacauguucucacucauagaugggaauugaacaaugagaacacauggacacaggaaggggaacaucacacucuggggacuguugugggguggggguuggggggagggauagcauuaggagauauaccuaaugcuaagugacgaguuaaugggugcagcacaccagcauggcacauguauacauauguaacuaaccugcacauugugcacauguacccuaaaucuuaaaguauaauaauaauaaaaaaaagaaaaaaaaagacaaaaauacuauaauaaaagaugcuucuaucacacacacaaaaaaagaaagugcaggaagcaaaacuucaaggaaaacaacucaugguauuuuuuguaaaugguaaaauuugaucuuucaugggaaaaccagaauuuuugaaaaguuguaucugcuaccaugagcuugacaaccucccaguaauuaaaauauuucugaugaaguuggugaagauaguaaguaaugugauuuuuuuugcuauuguauaugaaaugugucaacauuugaaagaucuuuauaacucaguaaaccaauauuuuccagucgaccuacauugcauuauacaauaaugcugggauaaaagauucauugaaaguauaagagagaccaguggauuucaguguagcagaguacaaaaaggucauugauacgauuucagauuccacaucauaguuaaccuuuaagaaacuaccacuuguugaguuuuaguguccuguugaagaacgucuaccauuaucugaaagagcuauuaaaauaguucuuuucuaacuacagaucucugugaggccagauuuucuuuguauacuugaaccaaaacaauguauugcaacagaaugaauguaaauauagauauuagaaucuaggugucuucuaugauaucauacauuaaaaauuuugcuaaacuguagaaacagugucgcuacucucacuaaauuuguguugguuuuggaaauguuuuuaaauaauguuauguauguuaguauguaauguguuuauuauuaccuucgaagaguagauauuuuuugaauaacaacuguaucguaaauauuaaauaccaauagggauaacccauaucaaccagagcucuuugggauccucaguaaguguuagaacugaaaaggaguucuuuuuaagaguuaaacgucaaaauuuuugauacuaaaaacuuugagagccacugauuuagugcuuuauacaaagcacuuguuauacucauuaucuuauauucguagccaccuuaugagguacauauuauugcccuaacuuuauggguaagaauaccaugacacaaugaugcuauguauauuuuuuuagcaaccccucugaaucucaugaucuucccagcguaguuuucucucugggaggcuugcuuccaaguuuaauuuuguagguccagucuucuuacaacccuccucccuuuuuuccaaucgaaguuucuuauguuauuuuucauaguacaaaaacaguacacguaccuuacagaaaacucagauaucauaagcaaaagaguauaaagacuauccuuaaucuucccgaguggagaccuguuagcugcucagcagauauuuauacagaugcuuuucuaaacauguucauuuaucaguguaaagccgguauaguauaauacucaauuagaaggauuuuggagucaaaugguuugacucccaacucugagcucuuagacaaguuauuuaacaucugagcuuucuguuccuuaucuguaacugcacugaucuguuuuucugugucuagaguuuugcccuuuccagaaugucaaauaaguagcauuguacacuaucuuguguuuuccaucugaauuauuuuacuuauagugcauuuuagauucaucaauguuguuguugucauccauaguuuguuacuuuuuacugcugauuaguauuccauugaacggauauaucaaaauucaguuaaccauucaccaguuuauggaugugugaguuguuaccaguggcaauuaugaauaaagcuucuuggaauauuugaauacaggccuuuguguggacauacguuuuccuuuuucuugaguaaaauaccuaggugugggauugcugggccauagaauaaguauacacuuaacuguauaagaaacuuccaaaauguuuucuaaaguggcuguacuauuuugcauucccaccagcauauauaagagaucuaguguguguguaaucuuaucucauugucauuuuaguuugcauuguccuaacaucugaaaauacugaguauuuuuugugugcuuauuugcuuuuuguaugccuucuuugaugggaugucucugaauuuuuuggccauuuuaaaucggguuguucacuuauuuuuuuaguuguaaaaguccuuuuuauauacuggauacagguuacuuugucagauacguguuuucagaguauggucucccaguuuguggcuuggcugucauuuuguuaaugauagguaucuuuuggagaguaagaguuuuucauuuuggagaaguccaauuucauaucccaucuaagaaauguuugccuaaccguagguugcaaguauuuuuuuuucauauguguuuuggacauuuuauaguuuuguguaugacauuuaggucuaugauccaugucacauaaauuuuuguauauguuauaagguuaagagucaagguguacuuuccucauuuauccaguuguaccaccauuuauugaaacauaauuauuucuccauugaguuguuuuggcaccuuuguggaaaauuaacugacucuauauguaugggucuguuuuccaacucucuaguacguucuauauaucuauucuuaugccaguacuacauuguguuuauuacuguagcuuuauaguaagcuuugaaagcauguaguauaaauuguccaacuuuguucuuuuucagaauuguuuugcccauucuagguccuuugcacugucauaugacuuuuaaagucaguaugucaauuucuacagaagaaccugcuggcucccaauuuucgcugggauugcauugauucuuuaaaauaauuugguuaauuuggugugugugguaggcuaaaucaugacccacaaagauacccacuuccauggaaccuguuaaagaucuugagaugaugggguuauccaaguggggcaauaaaugcaaucaaucacagguucccuuaaaagagggagauaauauuaagaggagaaggcagugugguggaaacagagacagagauuugaagauuuuaugcagcugguuuugaugauagagaaaggggccaugagccaagggaauacagcucuggaaacuggaaaaaaacaaguaauagauucucccauagagucuccagaaggaguagguccugcugacaucuugguuuuagcccagugaaacccuuuuuggaccucuggccucaggauaauaaaugugugccauuuuaagucaccaauuuugugguaguuuguuacagcacccauaggaaacuaauacacagaggauguaaaucuuaacaguauugaguguucuaugaacacaguauaugucuccauuuauuuagaucuuuaauuuuucuuggcaguuaugaacugaaugugucccuuuaaaaaucacaaguugacucuaguccccagugugaugguauuuggagguggggcauuugggaggugauuagguuaugaggguggaacccucaugguuggaacuagugcccuuauaaaaagagaccagagagcuaacucacucucuuuucaccaugugaaggguauugagaagucugccaucugccacccagaaggcagcccucgccagaacccagccaugcuggcauccugaucuccaacuuccagccucuggaacugugaggaauaaauuucuguuguuuauuagcuuccccacaguccuaccaguguuuuguagguuucaguauauagguuuugcauauauguuguuacauuuaucccuaaguguuuuauauuugugaugcuauuguaaaugguggauuuuuucauaaacuuuuaauuuuugaauaguuauaaauuuauaggaaaguugcaguaaaugauacauauuuuuaaauuucuguuuccaauuugugauagcuacuauauagaaaugcaauaauuuuuguaaauuuaccuuguguccuucaauuuuguuaaauucacuuacuagaucuacuagcuuuuuuuuagauuacuuaggauuuccuacagggaauaucauguugccuauagauaaugacagguuuacuucuuucuuuuaaaacuauauucuuuuaauuucuuuuuaucaucuuauuguuguggcuaggaccuuuaguacaauguugaauagauguguugaaguggacauacuugcuguguuuccugucuuaaggggaaaguauugagucucucaccauuaagcauuauaacugcagguuuuucauagaugcucuucuuuuccuaauuuguuuaacgcuuuuaacuugaauggguagcaaauuacgucaaaugcuuuuuacacaacuauugagaugaucauaugauuuuucuuuuucagccugcuaauaccacgaagguugcuaacugauuuucaaauguuaauccaagauugcaaucuugcaauccuagcuaaaccacaccuagucguaauguaguauccuuauauauugcugaauucaguuggcuaaaaucuuuucaggauuuuugcaucucuguucaugagagauauuggucuguaguuuucuuucuuugucaguuuuguuaucaggguaaugcuggcuucauaaaauaaauugggaaauguuccccccucaucuuuuuugcaagaguuugugaagaauuggugguauuuccucauuaaauguuugguagauuuugccauggccugacauuuucuuucugaaaaagguuuuaacuagaauugcaguuuccaugucuuuguuucaagaaauuuccuggcauaaaguuguuuauaauauccccuacuuaucccuuuaguauuauuaggauuuguagugauaucccuguuuucauucuugauauuaguaauuugagccuacucuuuuuuacugauuauucuggcuguagauuuaccaauuuucuuacuuucucaaagaaacugcuuuuaguuucauugauuuuuuucucuaaucccuuuuuacuguauuuuauugauuaaugugcuuacauuuaucauuuucuucuuuccauuuacuuuuuaaaaauuuccuuccguuucuuacauggagguuccuuaccuccauguucuuucuaguuucauaagauagaaucuuagauuauugacuugauaucuuuucuaauguaaguauuugaugcuaaaauuucccuuaaguacugcuuuaguguaucucacaaauuuugguauauuguguuuuugccuuuaguccaaaauauuuuucaauuuucuucauagucuuugaccuauggauuauuucgcaguguggcauuuaauuuucaaguauuuugagaauuuuccagauauuuuucuauuguugauuucuaguuugacuccauugugcuuguuuacuuuguaugauuucaguccuuuuaaauuuguugagcuuuguuuuauggcccagaauucaaucuaucuuggugaauguuccguguguguuugaaaggaaucuguauuuugcuuuuguugggaggaacucauuaauauuaauuaggucaaguugguugauaguguugcuacaaucauauauauccuuaguaauuuucuguuuauguguucuauuaguuacuaagaaaggaauguuaauuuccauuuauaacaguuugauuuuuuuauuucuccuuuuagauugaucaguacuuucuacauguauugugaaacuuuguuauuaggcauaugacaaauugaccccuuuaucauuaugaacuaccucuauuugucccuggaaauaguccuuguucaaaaauauacugugucuuauguugugguaggcagaaugccccacccccacaaauacacagauacccaggcccuaagcccugaaaccugugaauauguuauuauuuuacauggcaaaggggacuuugaagcuauauuuauuagcauucguuucugcuguuaccaugacaaauuacucucaguucuuuaggucagaaguccggguacagcacaacucagaugggucuucugccuaguuucacagggucaaaaucaaagugucaggagggcucuauuccuuucuggagccuccagggauuaaucugcuuucaagcacauuugggcuauugucagaauuuaguuccuugggguuguagggcugaggucccauuuaccuugcuggcugucagcugcgaguuauucucagcuucugaagccugccugcauuccuuggcucaugguuccuuaccuccauguucaaagccagaaguaacaggcugaauccuucucaagucuggaaucucucugacuucugccucaucucucuuccaccacauuucucugacuuacucuucugcuuucuuaagggcuuaugggauuacacugggcacaccuggauaauccaguauaaucuuccuauuguaaaguuagcugauuaguaaccuuaauuccaucugcaaagucccuucacaguauuacucagauuaguguuugauugaauaaucaggggacaggaauccugggaaacuucuuuagaauucugccuaccaaccacaguuauggaccuuaaaauagggagaguagccuggcuuaaccagguggacucaguuucaucacaugaacucuuaaaagcggagaacuuucucucaguggaagcagaagcgauauggcagaaguagugagaaaacaucccaagcaugagaaagauugaauaugcuauagcuuguuacuggcuuugagauguaggggccuauuuacaaggacccaggagaggccccuacuaucgcaagaucagcugcugcgugacagcaagcaaagagacacauaccucaguccuacaaccacaagaaacuggauucugccaacaaccugaaugagcuuagaaguagauucugccagaguccccugauaagcauuccaccaacagacaucuuuauuucagccuugugagauucugaguagagaaaccaaccaagcccgucucgccuuuugucauauagaacugugagauaauaaauuuacguuguuuuaagcugcuaaguuugugguaauuuguuacagcagcaauggaagacuaaacagauauuaauauagucauuccagcuuucuuuugguuaguguuuauuugguauaacuuuuucuuuccuuuugcuuuuaaucuaucugugucuuuauagauagauaaagugggauucuuacagacagcauauaguugucuugcuuacuuauccaaucugaucaucuuugucuuucaguuggccauuuauauuuaauauaguuauugacaggguugaguuuuaacuguuuucuugcugcagccuggaaacugccucugaucugcaaacuggggcaauaguaggguuuaccuccuuuauuuccuccuucucaccuguucuccacugccuguugucaaugucugaaaacuguucuuuuguagacuguaucaagcuucuuauuuaggcgggaagguaaauuauauuccuauuauuaagucaaggcuggaaauagagguccucaagaguauaauuucuaauuauuucaaggacauccucuguagcaauucccuuuuauaugagacgugagcauguguguauguguaauuuauucauucauggaaaguauaauacauacacuaaaauguucaugccauaugaauaugacagauggcugccuuuuuagaaauagaaucaguuagugauagaacuugaccauuuucagagcaugucagccuuuuccagucucugugucuugguauagcuaguuccuucugccuggaauacuuccucaucucacuugcuuuccugccuggcagcuuccuacuugcccucuggaaccagcucuagggucaccacaucucugcuucugagugccuccucagacacagucuguauuuccucuuccaagcucucaucacaaacauugugcuguauuauauguuucuguguggucuuccuucuaugaggaagccuuggaaagcaggagacuuauuuuagucuucuuuauguuucuuuuauucccaacacauuaugucugccccauagaccuuuucaauaaaugauuauugaguuagugacuccuuuuacaugcugacaaauguggcucuuauuacuccccauuucaguaucacauauuuguaaaagugaauccuucuuaaucguuuuacuuuucuccuaguaaauuccucaucuaugccugucugcugcuguucucugugcugcuggcccuucguuuggauggcaucauacaguggaguuacugggcugucuuugcuccaauauggcuguggaaguuaauggucauuguuggagccucaguuggaacuggagucugggcacgaaauccucaauaucgguaauacugcuuuauacaacccauuggucucuagcaugagggagcaauaucuugacuuuucucacuuuugaugaaguaaggaccauuuuauuuucuaccuaucuggggucuuagaacuauaguauaagcuaacagaucucuucuguguuuuugaaaauuuagucuuugguauguauuuucuuacaaaagcagugccauuuggggguaaguugccagccagcucacagaugccuauauaauccaaaaugcacccaaaauacagaacugguaugccauacuagacuaagcagcaugaaaccacccuguuuuuaggaaaagacacucauauuauguuuggucaugaaagaucuuucuccaauacaguuuuggaacuggggcuccccuugucccacccuccuagucccagagcuuuaggacuauuagcaguguaggggagguggcuugaccaggagaccaugagucccugagacagcagcuggggaaugaggaaagucaaagauuggaugccgagaaggaaagcagagccuuugggggcaggggagagggguacccuuuaccguuuccaacucuugcccucccugcucuuggaugccuccgcuggcccaaauuccugggaguuggcucacgccagcaugcaaccugcuuguugcugggaccugcgagaggcuuucccuucucugccacagagacuguaacuacauaaagggaaaaagggggacuuaagacugggaggcuauuaugaaccuccacugggaaaaugaggaguacaggaauucccagaaggcagcugcucaugugggaaaaguguaaaguugaaacuaccgcaccuuuuuuuuuuuuuuuuuuuuuuuuuugagacagaguuucgcucuuguugcccaggcuggagugcaauggugugaucucggcccacugcagccuccacaucccggguucaagugauucuccugccucggccuccugaguagcugggauuacaggcaccugccaccaugcccagcuaauuuuuuguauuuuuaguagagauaggguuucaccaugccaggcuaguuuugaacuccugacaucaggugauccacccgccuuggccuccugaagugcugggauuacaggugugagccaccacguccggccacuacaucaacuuuuuaaauuuuuguuuacuaaauaugaaaaugauucagauuguguaaauuacauaucacauacaugucuaagaacuguaaaacaguuacacagagagccuuggcaggugagggacauucauguauagcuguuucagaguucuuagauuuuuuuugaaagauugaugaccuguguggcuguauguguuuuauuuuuuuaugagauauuuucagauaucuaauauuaauugcuucucaaagaaugcaaaguuaaauaaacauuuagguucuacuaauugauauuuagaauauauucaaacuucucuuuguuggucuuauuuaagauguuuugagcaaggaaaggaauuguguaugugggguugaauguaaggaauguacaggcguggucauucucauguuaacauuaaccaguggaacaugguuggguccuacaggaauaaccucugauagcauuuucucuaugaucuaacuuccgguguauuugucacccacaauacauguauaucauaaauguucaucuguauuuugaauaaacauuguaggccuuucagaugcauuauagagccuuuuccugauuagcggccuuaccauugcucaauuguagaucuguuaagguuauugugcaugauacuuagcuaauuaaacugauuuuguuugagaacaguuuuaacucuuguucuucuuucucuuucaucugcagguguuaauuuaucuuaauggaauagaaaggaaaaugaaaaucauuuauacguuuuauuugcauuuaaaaauagcaccuaacaauaguuacuacuaucuugaaauauaacuggcacuuguucauagaacuagaguuauuuuuauaauauugugugaagggugguuuacaugguuucuugaaaaaugaggaucaugagacuuaagggguauuugccugguuuuagcagcagaagcaaaucagcuugaauaaucuuggaaguaacucuuguuguugaauuuaaagaugugaacagaaguguuuauguacauugucagggaaauaagaacuggcuauuacuuuugagaauauccuuauacgguuaaaacauuaaauucugguuugguuguaauguucauuuuguauuauguaguaguucuucgauguuucagagauugccuaccaaagcuuagguuuaaguuagcuuucuaccugauuucccuuugcuuuugucaaauuuucaaguaaaauucaaaguauaaauauaaguugguauuugcccugaacugcuugcuuauaguggagauucugaacugaggguguuuucuucuucucucccuuuuuuagagcagaaggagaaacguguguggaguuuaaagccauguugauugcagugggcauccacuugcucuuguugauguuugaaguucuggucugugacagaaucgagagaggaagccauuucuggcuccuggucuucaugccgcuguucuuuguuuccccggugucuguugcagcuugcguuuggggcuuucgacaugacaggucacuagaggugagauuucauauauuuaagaauguuuuccacuuugggaggucaaggcagguggaucacuugaggucaggaguuugagaccagccuggccaacauggugaaaccccgucucuacuaauaauacaaaaauuagccgggugugguggcaugcgccaguaaucccagcuucuccggaggcugaggcgggagaaucucuugaacccaggaggcggagguugcagugagccaagauugaaccauugcacuccagccugggugacagaaugaaacuccgucuuaaaaaaaaaaaaaaagaauguuuucaaaaguaaaauauuuugcucaguuauucagaugucaauuucuuacccuuuguuaggaagagcuugaucauuaccaacucuacaucaugagacaacaaggcaacaaaagaugauggaaauaacaauuuuucuuucuucacuuagaacacuagcuuuucacccaggacaucagccuucucccagcuucacauccuguaucaaucagacagaaacagaacugauagguuagauacagauauauguauaaagagaguuaaggaacuggcucacauuacuguggggcuggcaagucugaaaucuccagggcaggugaacaggcuggagaccuaggaggaguugacacugcaguccuggcacagaauuuuuuccucuccaggaaaccacaguuuuugcuuuuaaggccuucaccugauugcaugaggcccacccaugcuauggaggguagucuccuuuauucaaagucaguaccuucacugcaacagcaagcuuaguguuugauuaaauaacuggguacuauagcccagccaaguugacacucaaaacugaccaucuccccaccucagaccccaugauuuagcaccuccccugcugucugguuagcuuauccugaugugccccuguguuuguuuauucauucaauaaacauuuaucaaguauuuacuagaugccaagcccuuuuucccuaagcauagaggauaugcagaugaauaaaauaccaggacuaguaauaauaguaaugaaaguaauugcagauaacguuuauugagcacuuacugugugccaggcauugugcgaggcacauuacaugugguaguuuucuuacuaacuaacucugugagguagguccagagaagauaagucauuuguucauggccacaugugaaggggcaggaccaggauuccguuugagucagcccgacucuaaagcccgggcacauaacuacauaacugcauagaagcugagggcccaaagcugaauacugauggguugaggggagaacuagaggcuguagaugccugguuuugagccguguggaugaagagugaagggagaagacugcaguuggcuuaggaaguaaacauagcagcuguagggugggucaggcauauaagccuagaccccagguaugggcgugaggggaagguauguagacagagggacggugauggagcaaggcccugugggacucagggagaaugggaccuagagcaccaggaaggguuuggccuugaacaaggggagcuauucccugauuuucaugcugguggaaaggccacagcauggguauagugguagguaggagugagccguggagggagaguaucugaugguccacuuucacccucccuacaauucccaguuuauaucagggacuugagcauccauggauuuugguauccacaggggguccuggaaccaaucccccacagauacugagggacaacuauacaaggacuaggacugcauugggccugaauuacagaaaguaagucuuucauauauucacacucuaggcauuccugcccuuggaagaaacaacauaccaggagcugagcucccuccuccugugaugcaagaacaguaccuauguuggugaggggguggucuggaguaggcucauacagagaugggaaggaggaguugagggucugccaggaagcccuguguugggagggaagggauggcauuuuugggacacauugaagccuagaggcaggaaacacuccaucagcugaguggacuguggcgauucagauccgacgggagcacaagguggaaaggaaggaacugugggaguugagaagagagggagccucuacagagggauuggggcaaauaggggccacguccucagcccacagagcaugugcugaagugccccaggcaccccagugcacucacagggcaccaggggauaguggacauuuugaggaaaacaguaauaccugacauuuguugggacaccauacaaacuacuagcuugaaauaguuuacagguuuauuuuuaggccacacugcauuccuuucagugacgucguaucuuuaagaagcuggguuuucagcaguugcugugaaaacaaaaaaggcuaaugcugugugaaaauccgggugaagaacagguaacgagugggagcaccuugucugauuccaaggcgugggaaauggugagcuaccugacaggcacacgcaucccacugggaauuaguuuugguuauuuaagaauaauauuaacauuuuucuuuagauuuauaugaauuauuuuuucugguggcuacuuagaaauacuuacuaaguuagacguaauuacuuaaaucagugcaacuguuggcauucccagccacauuagggauuucuuuuggccuagaggucuauggaggaauuacuaaauuccccauguaccuauguacugagaacuuuugggaagcucugggccuggucccagauuucaauuuugugggcaagaauguacuuuaccagagugaggagcagccugcagggcguuugggcuggaggcgggagguuaguaagggguugcugaagugguaggcggauggugccgaagaaggccucacuaggcagucaucaucaggauaggaagugggcacgggauucaggagaaaucuggacuuuacaguggacaggauguggugacugaacgugacagugugggaaaaagaaugcagggugauucccgggcucauggcuugagaaaugagaccacuguugugccuccaagugacaugggaggcuauagaaagugacaugggaggcuauagaaagugacaugggaggccauagaaagugacaugggaggccauagaaagugacaugggaggccauagaaagugacaagggaggccauagaaagugacaugggaggccauagugacaugggaggccauagaaagugacaugggaggcuauagaaagugacaugggaggcuauagaaagugacaugggaggccauagaaagugacaugggaggccauagaaagugacaugggaggccauagaaagugacaugggaggccauagaaagugacaugggaggcuauagaaagaggagauacaagguucuaagugcaggcgauaaugaucucuauuugggacuggcuucauuugaggugccuuuaggagagccgaguggccuaugcacagcugggucugcuaugcagcaggaaggcuaaguuggagacagaugugagaacuaaccaugaaggagguaauaaugcagaccaagggucugguugaaauuucuucucccccaguccagggugcagcgggugagugaaaauauguguguuugugugucugucuuccuagucgggagagaagacugaguuuguggcucugcggagcaucaccauuuaaggagggggaaaaggagacagaaggaauuaccagaacacuccagagggcuccaagacuguauggugggauccuagauggccaggaggaggggagcaaaaaggaaagagucauccacaguaucaguaggaugccaguugaaguguuuuugcugccucccgguuaucggugacuuugaugaaagcugucuucugguggucauggggguggaggccagaucacaaggaagcugggaaugguagaugagauaguaggggcuugcauauucauuacugucucgcagagagaaaccugaggcuaagaggggucuuggaucaaaggaugggguggguuuaucugguuucggggcuuuuguuuuuaaugagaaggagucauuucugugcugcuaggagggaucaauggaauaggugggguuaaagauacaguacggaaucuacaguugauggcuugaugugacaagguccucaaggagccugaaaggaaggggugggguccaagggcaaaaccgagguaugagaagaaggaugcacaaggaugguuucgaguagacaguauuguugguagggacaugaaggaagcuuaguggucuauugcagcuagccuguguucccagugaaccuggaaacaagguucucaucugugcucaggccucaggccagaaagggcaaggcagcagaggggcaaggcagcagaggggcaaggcagcaggcugagccccauuuccccuugccauaauacugcugugccccucugguaccgaaaaucaggaguuuccagugcaauauaauauuauacaaguuacacuguauuauaauguguauugucuuuuaguguguuaaccaaauuacugcaguauuaaaugcaaauuauacuuuguuuaacugauucuucucuucauuuuuaguuagaaauccuguguucugucaacauucuccaguuuauauucauugccuuaagacuggacaagaucauccacuggcccuggcuuguauguaacuuuuaaaauccuuaaauaaacuucuuuuuuauuauaaaaguaauucauauucacuguacaaagcuuggaaaagacggacaagcagaaguaauagccuaauagucacccauaaucccaccauggggagauaacaugguuaguguuuuuaugucuguguuuuauacaaacaguuuggauauaacugugugcaccauuuuguauccugauuuuuuuguuuuaauguuguaucauaaacauuuuaucauguuaauaaaaggucuuuauaaacaugacuucuaaaguuuaauugauacaaaauauucuucaagugcauguaucagaccauccucuuauuucuaaaauaugguauuuccauuguugccaguguugaaugauuuuaaaucauacugcaguauauauguuuaugcauuaaaauuuuugccuuuuguuuuuugguuguuuucuuaggaaauaguccagaaauaguguuacugagcuagagguugggaacuauuugagauuccuauauacguauacugcacugccaacuugcuuuuccaaaagccauaccuggccaggcgcaguggcuuacacuuacagucccagcacuuugggaggccgaggugagcugaucacuugagcucaggaguucgagaccaaccugugcaauguagcaagacccugucucaaaagaaaaaaaaaaaaagccauacccauuuacacucuugcuggugguggcaucuaugucaugcuucuaaacugugacuucaguuacugggcauuugguugaaauuaacugugaauaaauggguagauggaugcagagauagaaagauaaguggcaagguagaaauuagagaacacaguauagauuccacuauuaaaugcauggaaaaaagauggagacuaaaggcagaagaguuccauugccacugggagguaaggucaugcuaguguuuuuguucgguuuuauuuucucuguuguuugauguauaauuuugcauacaauauauuuuauguauuaaauauagcuacccuuaaaaagugaaaaguauaguaaagaauugggagcagagaagaaaugaagggaaccuaaguauacuccauauuuaaagaugggaauaaucacuucugcccaaagucuuugauaaaacauucauaauaaaaaauauucagucacucauccuacaacuucacagugcuguaucuggagaauggucauuggguucaaaacuguuucuguugugacgugaaggaaacauaucuaaacaagaccaaauuuuuucguauaagauacugucagggaaaaaaaagauuaguaauuuugagagcuuuccacaaaugagaagaaagauuuuuucugcccuucauccucuguagaucccaguugaugaagcagucugaguacauguuucccauagugagcaagagaaaacaaggaagccuauugagaucuaacauuccacccaugaagggaacuucaguaaaaaggagaaucucaucacagaauggggaacggggaagaaaggcugugcauagacucugcagagaaaccuacaaucaagaacuggucaggagaaguaaaauucguaugccaacucaaaucauagaucuaaaagaaaauguaaaacuauagaucuguuaggaaauaacauaggacagaaucuuugggguuugcaauuaggcagagaguacuuagaaauggcacuguuaauaugguccauacgagagagaaaucauaaauuuggacuuccucaaaauuaaaaugaaaugaagacaggccacagacugggagaaaauauuugcaaagcacacaucaaaacacugacuugcacccagaacauacagagaacucuuaaaaacucaaaacugcaaaaagaaacaccuaaaaauuggcaaaagaguugacaauuugcgaaggggauauacacauggcgaaaaagcacaggaaaagaugcucaacgccauuacagguuagggaagacaaacuacaaccaggaugagggcccgaaacacauggcuucagaauggugaaacucagcaacacugacgaggccacgugccugggaggaugcagaggaacugggacacuccaguguuacuggcgggaaggcaggugguacgggcacuguagaaaaugguuuggccaucucugaugcaguuaaaagcgcacuucccgugggacuuggcugccccacuccuggguauaagauuuacccccagagaagugaaagcgcgcagccuuguagaaacccacacaccaguguuuguagcagucuuguuugcauuuuggauagcggccuuguuugguuuucacaaaccacccucagcggacagucagauaaacuguaggcauccauacaauggaauaccacucagaacugagagggaacgaccuguggauacagggagggaacaacuuggaugaaucucauuagagacauuauguggauggcgggaagccagucucaacagguuacuugucucgcgaugccaucuacauaaaguuccagcagagacaaaaguacagugacagagaacagaucaguguuugccggggcuaaugguggggacggugugauagugaagggacagcacggagaguuuugcagggugacagaccucuucugcauccugccaacggcugugcgaaucuacuugugugaagacucagggaacucacaccaaaggaagacggucacuuuuccuacuguaugauagauaauuaauaaaaagggagaacggaggagugucgucccaggaggcagggcaggagggcgaagacgugucacaggggagccuggccaaguggcgcccccggaacucguccucugggcuuguguguggaugagacaaggucuaccugguacgacagggacauacugggaaugcgcccuugccguggaggcggggacccggcagcgcuacguauccagcaucaaccuguauccagcaucaacccgccaaguucacuaacuugguaggggugagguuagggauccuuaggagcccaggcagccagacuuucuggggagcccauucccauuuguguugccaaaguacccccagcagguugugggaauguugccugugaagagagucuguuggggugagaucuugugugugugcacagggugacaguugugucccauuucccgggaagcugugauggcagcagaaccuagaggagccugagagagugugggagagugggccucuggaagaguagaggcugcggagccaggugcagggcugucugucacccaaaggaagagggacugaugacucacugagcguguguguccccugguggcagcaggccccauagugaacauaccauaccuuuucuguccugagcgaugcucccagcaguccugggagauggaacgguccuuauucggcucacgggaaggaccgccuuaacuggacagacacagcaaggugcuaaagaugccuuccaucagaggccagguuggaagcucuaaagagacuucucuugcuguucucucacccacccccagguugugugugucccgcuguggauucucauguccuuucugugccuggugguccucuacuacauugugugguccgucuuguucuugcgcucuauggaugugauugcagagcagcgcaggacacacauaaccauggcccugagcuggaugaccaucgucgugccccuucuuacauuugagguaagcguuccacgggaagccucuucagccccugaagcuugcgcuuccccugacaggauucugcaccccuagaaaggcagccucugucccucgagcucacagugagcccacuccaggagaggggagagaacacagccaucuccgagagggagcuucggugaaaggagagcauccuuccuuucucuugggggcagcacguggggcuggcagggagaagagugcaccuuuuuagccauggugccucuguauggcuccaguuuccacucuggggaaagcagagugggaugucagauuuguguauuggagucacguggagaauucuagaaugggagcuguugacuccuuagaacaaacacccggaggaguuugccauaaaacugcuggcacugggaacuuuucaaguggauaggcuauugccgagcucugaagagggacauaaaagcucauuucgagcuuuccccagggauaggugguuuccugccuuuuucuggcggugcugauguucccucuugugggagcucacgcggggguggggugguggggaggaacugccuaaugaagucuggcuuccgccucugcccauuuucggugcuggcaucaaccgggacuaugucucuuucuuuagauucugcugguucacaaacuggauggccacaacgccuucuccagcaucccgaucuuugucccccuuuggcucucguugaucacgcugauggcaaccacauuuggacagaagggaggaaaccacuguauguacucagcauuucagaaguccuuggugugugucuggggggggaccagggagugggggggggggcggauagaagucuaggaagggaugaguccccgagggccccaauuuagaagcuugugugggaaagugagggcugaggaaauucugggaccuucuaagggaagggcaugccguaacucugguguucugcuggccugcaccgggacuuuucucgcagugcacgcugccauuugagguagaaccagacacggcaggcaaccucucagagaucccguucccuccucugcaaaauggggaucaagacagauucuucccaggcccgggaggguuugauggaaaauccacaucucccacccaaaccugggauucauccuaggucccuguuggccucucugccucccccauauccuugcugccaucacccgagucuugccugucuugccuugcuaacacucuauuccccuccaccugcuugcugaggcagacacuuccaaaacgaucucugcagagggugccuuccuggcaaggcugugggcuccauggcacggaagcccagagcauugcccuucggaaagccaguggguuugggggcagggccucacugcagcccagcagcccgggcugugcuugcuguuugugccucugcccccuaccccgcacccgggagcagggagggcuugcaccgagcugacacuccaguagccuacagagaggaguagugggacugggaaaguggcuuuaagguggcuccaugaguucaggcccccuccuggccaggacccgugcaugacuaccgcccucacggauuccagagggugacagaaaucuuguucuuggguggcacugucauccaugaguuuauccuggcuggagaagauuagcggaagacaccguagucugcgcaccacagauauuuugagacucacuggagcaguaguucucaaacuugggcauccagcagaaucccaaaagggccaggaaaaggggaccgcuggagcccacccuagcccgacucaguuucuggaggucugggcuggggcccgagaauggcaucccuaacuaggccccguggacgcugucccugccgguccgggaaccccacuccaagcaccacagagcuagcauuugcacuucuuccccauuuuggguacucaagcccuguucaggcuuugugacucaggagucuggauaaaguauguuaugacauuguaggagugaaacuucuuguuacggaaagaaaguuaacaggaaggucaguugagccucgugugugaaauaaaaaauucuuauuuuucagggugguuugguauccgcaaagauuucugucaguuucugcuugaaaucuucccauuucuacgagaauauggaaacauuuccuaugaucuccaucacgaagauaaugaagaaaccgaagagaccccaguuccggagcccccuaaaaucgcacccauguuucgaaagaaggccaggguggucauuacccagagcccugggaaguaugugcucccaccucccaaauuaaauaucgaaaugccagauuagaugccacuuccggggacagagcuuaaguggacugggacgcacucucuccgccuuccucugcccccucguucaccccgcagaccagaaccaguacuggagcugggucuccagguacguccaucucaugccuuguuugcauccagcgccuaucagccacucaccacgacgggacgcggaaguggcaggugacgggggugugugccagcagaugcggaugccaggaagagugugagaacaggggugggauuaccgucugucugggaggggcuccagguaccccucuuccccgucagacccacugggagauggcugcuugccaggcccccagaaggaacaucugucuauacggugcugaaaucccaaucaaaaguauuguuuagaaauguauuucuccacagggcugaccuccugcagcucgcugagcacucccagguccucagcacucccaggucguggcuggggcagucaguaggaacuguaacuaugucucugaugcaccacguguuuagacacagcacaguccuuuuuucuguuccuacuguggaaguaguuucucuuugggcaugcugacagcaguuuuucauagccucacggaugagcccuuucuacgggagugacuccaugcuuguauacagaguauuuauacaaauguuuuagcaucuucauaugcgguguuaaccccuaguucuguacagcauauucuguucaaguauuuuuuuacaagcuugugcuguaggcacaugccuucugcugcagaaguggacgcccguggcacacuccccccccccccguggggugccacgccuucaugggacauugccacuucugcccuggaacucgugcagguacguaguagcugcuacugccagaacggcaacaccaagcaagagaugguccaugcuuuucugacguucucagaauaguggcuagcuucaaaccugacaagcgcugcuugaagccggaacacuagagaauguugcugagagcagaaacggccacgcgggucacgacuaugcgugggaaagucucaagcuucccuccugccagcaacaagaaggcuuuggaguaggcaugauguuuucacgugugcgugccguuucuccaagcacugcagguuccaccgugugucagaggcugcaaguuuaacauccuccugccugaaaacaaauagguccuuugcugaaaagaggguaaaaaaagagcuuugaucuucucagccaggagaagagggugguguuuucacgcgggcaacugcucgccggccuacaugggguuaauucaagucugcugcgagcacgacuccgcccuuggcacuggccuccagcaagcccuguucucuuugggguacaggggaacgggaugguuuagacuuuccugcucaguguguaaaaaauguagcuaaagccacuauuuuugcucuccuuaagcuguucaauaaaccgguuccucauuuuacacgugcaugaug

SEQ ID NO: 19013 - RNA, 110567 nt, Homo sapiens
cauuacuuggcucaaacuuccaucuagcaccuggcaaaauagaaccugcugaccagcggggccuccucaaggaggcuccaacuuaacauugagcucugugagaaaguggaagcaaaauaccagugagaagcaauagcagucucgucugcccaggagcagaguguacagguuggcuuucacggucuccuggagccccacugcacaugugccugcagaucacuggcagcucccagagagaagcugggggaagcuucugaucccuggggcccacaaggguaaugcucucucugucugggauguagaucccaggucuccugcauccagguaagcucucucuguccugcccccauuaggcugggcucugucuucuccugcuucgggaaugauagaaauguucuauuucuugauugugauggugaacagacuggguagcacauccuuguuauuuucacggcaagcaucaccacucucuccccuucaagaccccaguccucuuagaaaacaaccaacccaccaaccaaccaaaaagagauagacaauucugggcagccuuaggaaucuuaacugaggcuaugucuucuugucuucuucccaugcuuaaaucucagcuuuuuuuuuuuuuuuuuuuuuuuuuugagacagagucuugcuuugucacccaggcuggagugcagugcagugaucuuggcucacugcaaccucugccuuccggguucaagcgauucuccugacucagucuccugaguagcugggacuacaggcacgugccaccacaccuggcuaauuuuuguauuuuuaguagagacgggguuucaccacguugguuaggcuggucuugaacuccugaccucgugaucugcuugccucggccucccaaagugcugggauuaaaucucagcuuuauugggccgggcacgauggcucacgccuguaaucccagcacuuugggaagcuguggcagguggaucaccugaggucaggaguucaagaccagccuggccaacauggugaaaccccgucucuacuaaaaauacaaaaauuagcugggcgugauggugcacaccuguaaucccagcuacuugggaagcugaggcaggagacucacuugaaccuggaaggcaaagguugcagugagccaagauugugccacugcacuccaaccuggaaggcagaguaaaacucugucucaaaacaaacaaacaaaaaaaacaaacucagcuuuaccgaaguauaacuuaucugcagugaaauucgcccaucucauguuuauaguauaaugauuugggggcaauuguauaugguuucaugaucgugucaacaaucaagacacagaacauuucuaucaaucacccccaaaacuuuccucuugccucuuuggagucaaucccccacccaccucuaggcugaccucuggccccagucaaccauaaaucugcuuucuaucauuauuguuuugccuuuuccaaaauguaauauaaauggcaucaugcaguauauaauauuuuguguacaguuuauuucauuuagcaugauauuuuugagauucauucaaguuguagcauauaucaauaguucuuccuuuuuauugcugaguaauauuccauugggugcauauaucaccauuggcuuagcuauggguuuaaucaguggggauuugagaugcuuacauucuuuuacuauuuuuuauuauuauuauuauuauuuugagaggagucucacucugucgccaggcuggagugcaguggcacgaucucggcucagugcaaccuccgccucccggguucaagcgauucuccugccucagcuuccugaguagcugggauuacaggugcacgccaccaaggcuggcuauuuuuuguauuuuuaguagagacgggguuucaccauguuggccaggauggucucgaucucuugaccuugugauccacccaccucggccucccaaagugcugggauuacaggcgugaaccaccgcgcccagcuuuugacuauuauuuuugaaaggcugcugugaauauuugaauacacgucuuuuugugaacguauguuuccauauaucuuggauaaauaccuaggaauaguauugcucggccauauguacauuuaccuuuguaauucacugccaaaccauuuuccaaaggggcugcacuauccugcugaggcugcuuuuuaaauacagacugggguuggggaggaggagguaggcagagcugcuuugcaguucuccuagauucagaaguuagaccuggcauucaugugcuucacaacaagcuuaugaaggaguuaaugaauaaaacccauuucacagaugaggaaguagagguuuggagagguguacuugcccgaagucacacaccuaacaaauggaagagcuaggauuuaaacccuggaaccuuugugucagugcacaggggcuuacccccuauccucucccaucucucuccccagugaucaccguggcaacuugggaauucugcugccuugacacucuauacaucacauuuacaucuauccucaaggggacacaacgacccugggagguggcauucaaccccuuuuuuucagaggaagcaguuaaugaucagagaggugaagugacuuucccaaggccaacagcuugccuauagaauuucugggaccugaaucagguuuccuaguuccaagugcuuucugcuagagcaugguaacccacagcuacauuuaaaauuuuucauuccuaauuuucuuuuucuucagccuucucuuuccucaguaagaaugccccucccuuuccuccaccuuccccugccucaggcccaauacauugaaccugguaggauuaaguugaggcaggaguggggacuggggagaucagagcauagaggccaagggagaaguagcaggaaacaggccauuuccucgcucgggccugcuucuuaucuaggaggugagaggccagagguggagguaagggaugaagccaaccaaauccagagugcaggcuccuccuggugcugccuagccugccucccccaacugcagagaacaggaugaagccucugaagguaggaggugccuccagcccuccagccugugccuuagcaaaagcgggaggacucugggggagaggggcggaaacagguguaggcugugcuacucagaaggguuguggaagaagcagccugaggucgcaucuauugcccccuccucucuauuguccuggagcccuggagagggaggccagccaucuucucacaggccuccugcaugauggggggguguaugugugcaaaaugcagggaagccugaagauuccuacacacacacacacacacacacacacacacacacacacacugaaaugugagugcagccccagccuggaagagggcaggcucagucaagaauacagcgaugucaccaagggcaaggcgguaaccccuccauaguguacaaccuuguuuguuuguuuguuuugagauggaaucucacucugucacccaggcugaaguguaguggugcaaucucagcucacugcaaccuucaccacccggguucaaguaauucuccugccucagccucccgauuagcugggauuacaggcgcccaccaccacgccuggcuaauuuuuuuguauuuuuaguagagacgggguuucaccauguuggccagguugguuucgaacuccugaccucaagugauccgcccgccucggccucccaaggugcugggaucacaggccugagccaccgcgcccagcccauaguguacaaccuuuacaguuuucaaagugcuuccucaucuguugccucauucgaucucugcaccuacaccgugagacaggcacggcagggguuacucucuccauuucacaggccaaaggcuaaucuucucuacuggcccuuucugguugaauugcaucuuucuagagguggggcugggcuggggcuggacccuggaaaaaucuucaggaauuaccuccuuaggaugagaccaucccugcucugcaccuuccccaccuccuaacccccagcuccucccagcuccaucgaaaagcuuuggccucaucuugggacacuuaaccaggccuauuauaugcaagguaucccaggcagcugcugcccucccuccacccauccccauuuuccucuaucccucugcccuaagauucacagauaccaggaauccagaguuauucagcagcccaccagggagccucucuagcaugcaaauuuacugagcgugcuuugaaauucagcacaaaagugaaugagauucaaaggaguucauagucuggggaggggaguuggcagagcagacguguaagcaaaugaugacaucaguacaacaagaagggcugggugggggagacuucuaauugugcgggggcccaggagcagcugcuauucugcugucuuuccaggaguuuggcaaauccaggagagaggaccaaguggaaagggcuggaggaaagaaaaaacccagugcaucaaguucccuggaacuaggccagagcuuggggugaagagcaaaaagaggcacacugggagaaguggcuaaagaguggguuggguuggauucuggauggcuuuguuacucuucuaagaagucuagacucuucaauaaagcauauauauaugcauauauaaaugauauaugaauauauguguauaugugugugacuauguagaaacacacguacacauauacacugguaucagguaaaaugcuguuuuuagaugcuggagaacuaacacauacaagagaaaaaaaacaggucaugauaaagucauccuauuuacucgaacugcucauguauaaguauuaugcaguacaaagaauauuaugcucauuuuucuaugugccagguugucuuuucuuuuuuuaauuuuuuugacacgcagucucgcuuugucacacaggcuggagugcaguggugccaucucagcucacugcaaccucucccucccggguucaagcgauucucuugccucagcuucccgagcagcugguauuacagacaccugccaccacgccuggauaauuuuuguauuuuuaguagagacgagguuucaccaugucguccaggcuggucucgaacuccugaccucaggugauccgccugcguuggccucccaaagugcuaggauuacaggcgugagccaccgcgcccggcccagauuguuuguuuuauuugauuacacaaugaauucucuucuugaaguuugccuuucuucucuuuuuccugucccuuucuuuuuacuguaucaauaguugucugacccaaaccucaacaaguagaaggaauuuuggacugaaauguuuccguucacuaagucucaauugcguucuuggaaaggugcuggcacagcugagggacaccccagcuguuaguugaguuugugaauugcagauccugccccagagucagugaaauuucuuuuucccuuauacuaucucaacuuuacgcagccaacccuguguacccaauaauagcucaauuuaguggcauccgcuaaagucuuguauagagaaguuuucccucuggauuuccccuuuacugaagaaaaauggggagacccagacaagggucccgggacuacgcuucccagccgccuccgcccggcgcccaguccaacuucccuuacagggauggccccuggcaucuuggccccgcccauccccagcaccauauugcgaacuacaauucccagcugccuccaugcgucggacccuucaaaaugggcuucccagcagccucucgggcgaagagccccgcccuucggagcugcuccccaggucgacccggcgcacucuuccugcccccugccccgucacgugaugcagucccgccaaccggcacggggaggcgggcagcgggcgguggccgggggcgggcaggccguggggggcggaccccagagggggcggagcagggcccggcagccgagcagccuggcaacggcgguggcgcccggagcccgaggugggugcgcgcucacggcuggccuggcucggagccgggcacugcggggacccguggugaggggaucgggaggaggaaguugggacuccuugggccagcgggucgcgcggggccuugccgcaccgucaggguuggguggggguuucguccaagcgccgucgcuguccccgcggggcagggcugaggccagggagcagcaggcagguaccuccggcuuccucccguucuccccgcccaagguggccggccggcggcgggcgaaggucgggacggggguagggguuggcuggccguggagcugggggcggacgucucagccacugccuggacuuugcuuccccgucccggggcggugagugggccgggcguccgcccugccuccccggcgacgcuccgcggcugguccucgccuuggcccuccgcacggagcgggcguccgucgcauccccggugggcccugcggagcggccgcagcccggcacuggccgcgaagccucgauggccgcucucggccaguguuucugugucauacacgagagguuuaucugcuuuugcaacaguugagggaagaucuuagagggaacgguuaguucccugauacgcagucggaaguauguacaggcacgagcaagcgcccguggccggguugccucccuuaacugucuuuugcugcgcucaggaagugaaaacuaauuuuaguauuugccuaagcaaguaagaagugaaucugcugcaaaaauuauauuagagcuuuauagacgcacgcaucguuugaggcgaaguggguugcgacugguuuugaaacagauacaccagaucuucacaagaauaaaauuauagcauuuuagaauugacuggcauccugaaguuuacauuguucauuuguuuccuggaugggggaacugaggcccagagaggguaacuaauaugucccgggcuucagggcaacuuaauggcaaagcuaauaucacaagccagcucuuuggggguaucuuggugucugucuagucuggauucuuuuuaccacagcucaguauuauuccuugugaaauaagcaccuuagagucuugagacugagccagcaauuuugcuagacugcaaaccauuuugaauuuccuucaaaaucgguuuaccaaccaaauaagacaaucaggccuguuacuuugcagacacguuugccuucauccaacauauauauugggcacgaucauguauucaccagauuugauucugaauggcuuuuggcugcuucacaaaaucaaaucuacuuuucagagauuccacaccaugggggagauuugaaccaguggugcugccugcagcaccaguguauaguacccucccgggugcuugaggguggauaacauucacggggggcuuguagauucuaguguaguuaguaaaugauuggucucuuuaacuuaaaguucuaacuacauuuauuaaguugucgaugguuucauucauucaucaaacacaagaaugccaacggugggcacugggaagacagcaaagagccccacugcugaggucccugccuuauagaguuuauauguggggaggcacacaauaaaaaaauaaacaaugauauauuuucuggcagagaugagcgcuaugagaaaaaauagagcucugaaaccuuacaaugacaguaaaacaggcuggcaugauugagaaugacuugggcauuacuuugaauuucuaguuuuagauugccagcugcugcuccaguaaaggaaauaaauccaaaaguaaaucucugaaucaaagagauuuuuuggagucaucauuucuccaaugagugucuuuuagaugguaagcucaucccagccucauuuuuacucacauuuccccccaccccgacaugcaaacaguaagugauuucaaauaccuagagagguauuuuucaaauccuuugcuguuuucauaguuagauagcugacuguagcuacagaaagcucugcugaggucaauauugguuguugauuucaugccggugucugcuggacucucaggcuaccuugcacaaggguuucucuuccugugcaaugguuuguacugugaaccucuuaucugaaaugaucaucaguccuugugugguuuguaaagaaacuaguucauuuugaaauagcucaagagaaaagaagcacucauucuuaggaacaagagugcucgcuaauaaaauggcauuaaugagaguugacuguaaaaguucaucuguuuaauaccuucuaaguucucucauauucuguauguucaauggcuucaaagcaaaauuuuaaacuuuuacaggucugaaaaauaauuaaaguuacaaaaaauacuuuaauauuuuuuguuccaaaaugagaggcagauuaacaaaauguaguuacuuagaaaccacugaaaacacaugguucuugcucuuauugagggcuccaaaauaaagagaaaaguggagacucucaacgauuaauaggugacauuuuaaagggguaaccagaggauuucaaaggcuggaguuucucauuucuaaaguuuauucgauuuuguaacagaauaauagauuguuuucauuauucuuuaguaauuuuccuuuccuguuuucgaccucuuugaaguucugcuuucauuauuuucuaguuuucuaguucuuuauuuccuuuuuggcagaugugggggauagggaccgucauuugccuagaagauuuugacucuggauugggcagccugccccaauuugaauccuggaccuaauauuaucugugugacuuuaggcaagguacuuaacucugugcuuuaguuuccuuaucugucaaaugagaauaauaauaguaccuuucucaaaggguugcuggagggacugagugaauaaucuaugcuaagugcuuagaaaagugucuugcauguaguagacacuaaagaaaagcuguuauugacuugaacgauauggaacucuuuuguuuuuaagaaaauacauuauucuagcuaugucuuaauaaacuuuuggaauccaguagcuugcuuuucucgacauuucucugcauuuccuuguuggcacgagcuuuugguuccaggcgacgcuggcagcaguguccuccguucuugcagugcuauauucccuuuaccauuuggacuuagaaauuucuugaggccaaauuuuguugcuacaaacaauaauagagcaagagaggccuucuucuaguuuaucugccuugaaagugagaguguaucaggagacccaguaggaguuacugaguuaggucccguugucauccuguaguugggggaagauuuuucauuggaaaucuuugcaguguauuuuuccacugugaguaccacgacagucucaucuuuuucuuuuuaagaauguggaggcaucucuuuagauaauuggcauuguguacuacuagugcuuucuauuucuaccagaggaacuaugguaaaugagccuuuuguuugugugaggugguagaaagcuuccugcauuuggauuccagaagcugaguucaggucccaguucucuuccuuaacucugugucacuggacaagucauuuaaccuugcugcuaguggcucuuccaucuguaagauagagcuaauaaaaccugcccugccaaguuuccagaguucgucagagaaucaaaugugccucagagcccuuuguaaagugugcagcauuauuauuauugcaugaauguguuguauaagcaguugcuauuuggagaacugguauaagagggcaguuguccuuccuguucuuggacugucuucccuguggcuguagguguggccucucugccucaaucucccucuucugucaucauuaaaauaugcagguauuuauauugccucuuucauaggggccugaugucacugguauaccauaacaaguuuuuguuuuauguauuccuaaaaugguaguaguguauaaccaacaaucacagggugacagcaaggcaagcucagccucagggaauguugccugccucucccaagugucucagaauggaagacuuucucuuuuccaaucgagaccugaccgcagcuccugaguccauacuagacuggaugcuugugcuucugggguuagaauaaaaagcgauccaggcucuggggaagagaugguugauagcuccccaggucuguaccauccuccuugcuggaacagggcaggcuccugagugauagggcaggcgccugagcggccuuuucucguuaaaguuguuucucaguaucuugaaaugucucuguaaguugcacuuugcaaugaauuucauguacuuguauuaguuuaguauugcuguuccuugacuguuugucuuaauagguaacuccuacauauuucaguauguuuuucauuuucuaugauuguaauaaaaagggcgagguuggagauauuuuuucugauugucugaaaccuaagaugguccuauacacacaguagacauuuaguaaacauuauuuaacuugaacuagacaaaggaggccagcuuagaauuguucacacaugaucauuguaaccaauucuguugcaugucuagagaucaugcucccugucugccagaugaaauggagcucaugcuuaaccuuucuugccguggucaaacagcaaaugagaaaguucuuugaaucagucauugucuugccacccuuuucuucucagcuucuugauuuuugaacucuuggcaugagcaguuugaguacagauuaguuuuugcuuugcuugcuaguauguuuggggugggaaguugaagggggaauaauugaaaguaaaaauaaaaguuguuuguaacucauucaucucuuauccccuugccuccaaacccugacagcacacagcaaugcccuuucuuuagcaugugauaauuguuauauuuugauagcauguccuugaacuuuuuugugagaaggaagcauuguuuauuucccagagccuuuugcuuggaauguaauggauugcuacaucaguuauccuuuccccuucuugggagauguagaggcagagguggguuauaagguagauucuuagcaucaggugguggugcuuuaaauucccuuauaugacuuuuaaauugcuuuauggcccugagacaacuuagguggggauuuaggagaauagguacuaugcuggaauccagcaggccuggaauuggcccaagcucuuuuacugaaauaagaaauguaccugccugcacagcagugacccuuggccaugacaugaaauauaccugcgugucaguacuguuuguggauaacaguaagaaggaaaguuugcacuugguuucagugagaccccaggagggcgcugcgguuaacacggguuaugugacuaggaggauaugagaaaccccagccaguauuccauuuugaguuuccugguucugagguguuccuugcccaugucagugguucuggaucugggagagaaagcacaggucccuacugcccuaacaaagggaggacugaccguuggugcuggcccccaccucuuugaaucccuugcuuggagagagaacugauuuuuucaaaguugaagcugagucuaacucugcuggacauguccuuccuucacuauaucaacucuaauaaucuccccagagauucccauuacgccuauggcaugaaacagguuuuucuuauugauggggauugcccuugcuccccgggagcuggugaaacaggcagaauuucaagccccauccucacccacugagacccaccaccgacuccuuaagcugaaugugaauuuuaaugaggcccccaggugauuuugcaguaaauuaaaguucggaaauagucuaauaguaccagcucauauccuggcuucccaguccuuuaagauagcgcuagccaauagagaauguguaauuuaaaauuuucuaguagccacauugaacaaguaaagaaacaggugaaaucaauuuuaauauauuuaacacagcaugugcgaaauauuucaaugugucaucgacauaauaaugacacguuuuuccuuuuuugguacuaaauugucaaucagguguauauuuuacauuauagcccaucucaguuuggauuagccacaguucaaguguucaggagcuacagcuguggagagauacauuuggucuugauuugcugaggauuucaucagauucacugucaaugcuuaaauagccgccucagucauaauuuacauuaauauuagguguaaucuuugccaaguccuuagcccagugcuuuuacaucaggucucauaugaauccucacagcaucgcuuugagguaaaaacuguuaagauccccacugaguuucagagagguuaggucuaagcugaagcguuuaggaagcaguaauaucaggauuugaacccaggcaagucugacuucuggguuugcagccuccgcugcaacuuccugcagcucucaugacuacaggguuuuuucucgguuucaguuuuuaguuuuguaagccauauuaaaaaggcaccauugguauauguaugaaaugcaaucuucuuucuugaggggaacuucaaagaacucgaggaaugccucuuucuucucuggcuuuucagagcuggugcagagucccuaaacagaaguuuccucauagagggaauaccacggaccaggagauugccuuuccugcugcucauuagaaucacuuggggaguuuuacauacuugcugcccugggcaucgcccacagauauucgaacuuaauugaucugggcugagacucuugacaucugcauuuuuaaaaaguggucccagcgugcagcacuaccaggagcgcuucuccaacuucauugccuuaugaaucaccuggacuucgaguugaaacacagauucugacucagugguuccgggaugggcccggagagcuuuuucuucucauuuccaucaagcucccaggugaugccaacaguguugcucuguggcucccacucagagcagcaagccacaucauaaucaccugagggguuuuugcaaaacuacaaauuccuggcaucaugccuggaguuucugauucaguaggucugggguggggcccaagaucuuuacuugagaaggcucuugcuuucaauguuucaccauaaaguauuguguuuacucuagguuuuguguaggggcacuucuaguguacauuuuuuucggucauaaguggauguugaguuuuaucaagccccuuuucuuccuuuauggagauagguuuuugguuuguguuuuuguagagagggcuucuuacuguguuacccaggcuggucucaaacuccuguccucaagcaauucuccugccucagucucccaaagugcuuaggauuacaggcgugagggagaaccuguguuuucccuccuugaacuuguuaaugugguaggcuauuuuaagggauuuucuaauauaacuuuguagcauuaacuaaguuuguauugcugggauaaacucaacagggucauguucuuucuuacugcuggguuugauugcuaauacuuucuuuaggauuuuuacaucuuauauacauaagauuugguauuaguuuuccugugcugucuuggucuaguuuaguaucaugcuuaugcuagccuuauaaagugaguugagauauucccuuuuucuguucucuggaaguuuguauaagauuggaguuacugguuccuugaauguugcuagaacuugcacauggagcugccuggggccuggaagauuauaaacuaccagcaaaugucugccaaaucuauagcugugucugucuuuucauuccugcauccuacuauuguuuguuugugcccuccuuuuuucuuuauuagucuaaccagagguuugucaguugugguuauggcaccaacuugauaauauaauuauguucauuuguuucccuuuuagggcuuuuccccugcuuuuuugauuaauuuuuaacgaguaaaaacuuuauaugauuuugaagucacauuuauuucaagguauauucagaaaagucuugcuuucaccccaucucugaccagguauucuguuucuuucccccccguagaugaucaaucuuauuaguuuguucuucuaaguaucuuuugcaaauuugagcaagcacguacauguauuuuccccuuuucuugcacaaaaacauauuucauacacuauucagccucuugcccuuuucacuuaaagaauauaccaggaaucauucuucauuuucuccuccuuucuuuagauuuauucugcuguuuggauguuucaaaacauaguauuuucaugauuauuuaguugugauauuuucuauuaugauuauuucauucaccugcgagcuguuuagaaguauauuuuuacuuacaaauguauuuucuggguauuuucaaaacugauuuacaacuuaacugcauuauggugaaagaauaugaugugaacacucguaguucuuugaaauuugucaaggauaggcuuaugugguauuuuuguggcuggcuucuuucacuuagcauacugcuuuuuauauucauuuuuguguuguugcauguaucagcaguuccugacuuucuguugcugaguaguauuccauaguaugguuauaauguaauuuauucauucaguaguugaucauuugaguugauucaguuuuuggccauuuugaaaaaaagcugccaugaacauucacauacaagucuuuguguggacucaugcuuuuauuugcuucguguaaauacuuagguguggcauugcugggccauauguuuaguuuauguuuaacuuuacaaggaacugucaaacuguuuuccaaaguggccaugccauugugccauuuugcauuccuacuggcuuuaauugucugccuuuaaaauguuagccauuugacuggguguauaaugguaucucauuguauuuuuaacuuacaaauuccuagugacuaguaauagugagcaugucuuuaugugcuuguuggccauuaaguuuaucuucuuuggugaaggauuugcugaaaucuuuugcccauuucuuauuaaauuggauugucugucugaaguugugaggguucuuuuuauauucuggauacaaguacuucaucagauaugugauuugcaagcauguucucucaaacugugguuugucuuucauuuucuuaacugugccugugccugugcaagagcaaggaguuuugauuuugaugaaguccuauuuacuuuuuccccuguuaugguuugaguuuuuguguuuuaagaaaucuuuacuuaaccuaaguucacaaaaauuuuccccuguguuccuuccagaacuuuuuuaguccugcucuuauguuuagaucuguuuuggcagacagaucuuuccaaccccugguguuuauaccugugugauccccuucccuugagugugagcaggaccugugacuugcuucuagaauauagacuagaauauggaaaaaguguagggauucuacagauauaauuaaggucacaaccaguagauuuugaauuaaucaaaagagaaguuauccuggguaggccugaauuaaucagcacaaaacccuuaaaagaaggucuggguccuccccgaggugagauucucuuugcugacuuguugaugugagcagccacauugaggaaggccacauagaaaggaacugcagguggucucuaggaacuaaaagcugcuuagcaaaaagccagggccuucaaccaugcagccuaaaggaaaugaguucugccaacacucugaaugagcuuggaagcagauuuuccccaguugagccuccagaugagaaugcagccuggccauuaccuugauugcaacuuugugagacccugagcagaggacccagcuaagcugugccuggacaccugacccacagaaacugugagaugauaaaugugugcuguuuauggcugcuaaguuuguuauucagcaauauaaaacuaguaugucuauguuccauuucaaguuaauuuuguauauuuugugaaguaaggguaaagauucauuuauuuuuccauauggacaucaaacuguuccagcaucauuugugggaaaaggcccacacauuuugguaauuuuguugaaaaucaauugaccauugcuaggaccucaaaaagaagggccuaauuauagucucuguucuguuccauugaucuguaugucuauccuuauaccaguacugcagugucuugauuacugaggcauuauaauaagucuggggaucagguaguggaaguacugcaacuuuuuuuuuuuuuucuuuucaagauuguuuugaauauucuuggucgcuugccuuuccauacaaauuuuggaaucaucuuguccaagccuguugggauuuugauagggauuucauugacuuuguagaucaauauugacaucaugacaauuaggagucuuugauccuugagcaugcgauauguaucuauauaucucuaucuaucuaucuaucuaucuaucuaucuaucuaucuaucuguauauuuuuguuuugagauggaguuucgcuuuuguugcccaggcuggagugcaaugguguaaucucagcucacugcaaccuccgccuccuggguucaagcgauucucccgccucaaccuccugaguagcugggauuacaggcacccgccaccacacccagcuaauuuuguauuuuuaguagagacgggguuucuccauguuggucaggcuggucuugaacuccugaccucagguaaucugcccgccucguccucccaaagugcugggauuacaggcaugagccaccacgccuggcccaagcaugcaauauuucuccauguauuuaggucuuuaauuucucucagcaauguuuuguagcuuucagugugugauucuuggacguauuuuguucaguguuucccuaaguauuucauuuuuuuugguauugcaaaugacauuuuuaaaauaaaguuuuuugagacagggucuuguucuguuaccuaagcuggagugcaguggcaugaugguggcucacuguagccucaaccuccugggcuaaagugauccucccuccucagccucucaaguagcugaagacuacaggugcaugcccccaugcccagcuaauuuuuuuuuuuuauguuuuguagagauagggucuugcuguauugcccaggcuggucucaacuuccugggcucaaguaguccuccugccucagccucccaaagugcugagauuucaggcaugaacuauagcacugggccaguauuuuuauauuucaguguucauauguucauugcuaacaauacaaauauaauuaauuuuuauauuggcuuuguguuuuaugcagccuuacuaaauuuacuuauucuaguaguuuuuuuguaguauucuuaggauuuuuuuugcauacaugauuauguugucuguaaauacaguuuuacuucuuuuuuccaauauguuauguguuuugaacuugcuagaagcucuaaaagauguuaaauacaagugauaagagugaccguccuugccuuguucccacucuuauuggugaaagaagaaaugcuuucuaagugugaugucagcugaagguuuuucauaggugcccuugacaauuccugauuuccugaggguguuuuuaaaaaucauggauagauguugaauuacguuaauagaagccacgucucagauacaaucuucaggaagauagcacaccucaugaauagucuuacugacuauacauaucaccacauuuauacccauucuuaaccaccacuacccagcuuuuccuccuagugucgauaacagaauuuccaucuggaucuugggaauucuuuguggagcagcauauacugcuccuucaaaagacauagaucuucucugcgagauucacauguaucauuauuuuagaacuggaauuucuucauccucucuuuccuugccauucuuuuaacacugguuuugguucuucuucaucuugccuuuuuuauuucugccuuuuuuuuuuucagguuauuucugccccaucugugaaaccuugucugccaauagugccaaguuauaaaaauauguacguucaguccuuucaccuucuucuguaacaaggauacgugguuguuuguauuugugacuggaagaaguaacugcuccaaguaugaagauaacuauuguccauacucucuaggucauggcaagucuuucuccuucugauucucccaggauccuaauuaagccaucuuuggggauucccuuugcauacuccuucucuacuauggcaaacugccuguugggcaagcugcuacuccuacugcuuaucucugcuaaccuucaaggucaaccugcucuugcaaguuaggacuaauuaagauguaucaagcccaacauucucaacaaucaaaagacccuaggcagcguuccaaaagccccauguagaggaaggucaggaaguuccaaauccaaauuauucaauguauuuuggaacucuucuuuggauugacuucagagaccaggcaccuuuaaaaaaauauccucgcaccuuuaaaaaaaauauccucaaaggcucuaggccaaaaucauuuuguaucaccucuauuaauacauagaaugggcaccggugcuguauggagcauugguuuugguuuaaaaauuaagauaugguuaaaguucaugagaugguaccuuauguagcuuuaaauuccaaaggcaguuucaaaagaauaauucaaagaauacuuugaacaguggccacauugcuggaauuuguguacaccaucaaaggggacuacuuugaagaauaacucagcuauauaugaucugacaggcuuuuuaacaaaugccucauuacaugauaguugcaccucaugggguguuuugugcacuaguaauaaaaacuuucuccuuuuaaaagauaguuuuaauaaagacuaaguggauacaaauaaauaguagacaaucaaggguugugcuguuucagugacucacagacauggauuucaggggaaaaagccuauuuguugacucaucuuuaaagugaagucuaggguucuucuuugugaccaucagauuuuaucacguggaugaaauuccgaaaagauuuuuuuuauccagcugugcaagcaggaggcaugauguccucauuuuaauaugaucaucuaugagagaaugagaaugacagauaucuaucuguuaguggaugagagggccggucagauugccuagauuucaguuccaccuuugacaguuauuagcagacaaauuguuuaaccuuccuguuccuuguguuugucaguugucauaugaugauaguaauaccuaguugccuuuuaagguuuugguggggauuaaaugacuuaaucugugauuagaacaaugucugacagguaguagaugaucuguaaaugaaagccgugaucauuagcauaagcagauacucuguuuugcuuuaauuguaucaccucuguuauugucuuuauuacuauuuaaccuuuuuuauacauauuaauuaucuuuauuguuaucuaaacauuuguuugucaucuucccaacucaguuuuuagcuccuugaagacauaucucaaauuuuuuugguugaggggagggggaacucuccauugugguccagaguagcugcccacuauauaguuacugauugugaacucuuuggaaacaagauuuaaauaaugauauaugcugaguuaggaguaucucagaaugauuggcuuguugucauuucauuauuucuucuaaaaaaccauauuauuauuucaguacuaguuaauuucauagguauucauugaaugcuuauggauagauugacaaaugaaauuguucugaauguaaccauauguugacaugaccauuuuauagauuguuaauuucuguagccaaccuccugccuauuauggguugaauuguguccccuaaaaagauauacugaagcccuagucccuauuuccucagacuggggucuuguuuguuacugcaguuguaguuaguuaagaugaggucaugcagcacuggaguaggguggacuccucauccagcaugacugggguccuuaugaaagaggaaagcaccaugugaaaacacagacacacagggagaaagccaugugacaacaggcagagagauuggaguggugaagcugcaagccaaggaaugccaaggauugcagccaccaccagaagcuagggagaggcaaggaagcauucuccccuagaggcuccagauggcacauggccuagcugacaccuugauuuuggacuuugggccuccagaacugugagagaauuuauuucuguucuuuuaggccauccaguuugugggacuucuuuacagcagccccaggacaccaauagacugcccaucugcuugaauuagaguguugacaagcuugggauuucauuucaaacgguggauuugccuauguuuucaucuauuauccaucuucuccagauacuuugauuuaaauauauaaauauaaauacauauuuauauauuuaaauauaauuuauauaauuuauaauuuauauauuuaaauauauauuaaauuauauauauuuauauauaaauuauaaauuauguaaauuauauauuauauaaauuauaaauauauauaaauuauauauauuauauaaauuauaaauauauauaaauuauauauaaauuauaaauauauaaaaauuauauaaauuauauauaaauuauaaauuuauauaauuuauauaaauuauauauaaauuauaaauauauauaaauuauauauauuauauauaauuauaaauauauauaaauuauauauauuauauauaauuauaaauauauauaaauuauauauauuauauauaauauaauauauauaaauuauauauauuauauuauauauaauuauaaauauauaaaaauuauauauauuauauauaauuauaaauauauauaaauuauauauauuauauauaaauuauaaauauauauaauuuauauauauuauauauaaauuauauauauuauacauaauuuauauauaauauauaauuuauauauaauauauauaauuuauauauaauauauaauuuauauauauuauauauaauuuauauauaauauauaauuuauauauauuauauauaauuuauauauaaauaauuuguauauauuauuuauaaauauauaaauuauauauauuauauaaauuauauauuauauauaaauuaauauauauuaaauuaauauauauuuaauauauaaaauauauauaaaauauauauuaaauauauauauuaaauauacaaaauauauauaaauauauaucaaauauauaaaauauauauuaaauauauauuaaauauauauauauauuugauauauauauauauaauauaaaauauauauuaaauuaaaauauauauauuaaauauauguuaaauauauaaaaauauuuuaaaaauauauuaaauauauauauuaaauauauauuucccauaccugaucuggcagcaaauauauuuuuauauauggcagcaaauauauauuuucauauauauauaugaaaaucuggcacaaaaauacgguucuuauaugcaugcuaggaaugggagacguuuccaaagaugcuuauaaaagcacuguuuauaauugaaaccuggaaacagcucaaaugaucacugggaggagaauggaaaaaccaagugcaaagcaguggacugcuaugcagcugugaaaaugaguggaacacaacuauaugcaucaacauuuaugacucucucaacacuaugugagaaaagcaaguggcagaagaauauauaaugauuccauuuacauaagacuucagaaacauggaaaaucauauuauuuagggauguauacauguggaaaauuuuaaagauaugcaagggaauuauaaaccuaaaaaucagcccuagggagguagguuggaguaccuuuaaugacugaugacuaacuucuccaaagucaugaaaguuuaugagggugaugcuacauuuguuucuucacggaauacugaguacccaaacugugcuuugugcuggugccagaauggaaaacaugguccuuggccuuaggaaguucuagaaaucuaagagacgggacacaaaauaucaaggcauaaguacaggguaagaaaugaaauacaaucgucccuugguauuugcgggaaacugguuccaggacucccgaggauaccaaaauccuuggaggcccaaguccuugauauaaaauggcauaguauuugcauauaaccuugcauauccuccuguguacuuucaguccucuauagauuacuuauaauaccuaauacaauggaaaugcuauguaaauacaaauaaaaauuaguauuugaaguauuuuucuauuuguauuauuuguauuuguauuauuuuuugucauacuguuuuuuguguuucuucccaaauauuuuugauccgcaguugguugaaucccuagauguggaacuccuggauguggagggcugacuauauuagaaauauguaugguguacagagaaguggagagagagagagagagagagagaaagaguguguguguguguauguguguguggggggaggucaggaaaagcuuuccauguuuugaaguagguaaaugccaacaaagcauaugccaacgaagccccugcuucugccuucaaaugagaguaccuagaggaauuguuucaaauggcagguuaucuccaaccuuuucuccucucuucaguuuucuagauacugugcacauccacucuagaguuccuuuuuuccucccuccuccacuacugauucugcucagaagaaucuucaucaguaaugcccaaugccugggcuuuucuuugggguccuuuagcccagaccugagaagguucuuggaaaguaaggagauguuuugaucuggcaccuuuguuacuaucauaguuauaacuauuuauacguuucuauucuucaacaauuacuguuuuaacuuuugcuaaauaaguuacuguuuacuuauaaauuuaaaauguacuuuuugugaauaguucucacaggggaaaauaguucaauaaaaugcaguuuuuuucauugagcagaucagcuggguucaugaguuuuggaauuggcagaugcacgggaacuugaucuuguuccuauuuuaaaacuuuguuuacuggcagguauuugacuguuaaaaaauccauuggugaguuuaaugaucuguuuaaaugugugcaguauugcuagguagccuuuguacauuaaaaacagauaaccugauaguaguugacuuuucuaauaguuuacuuaccauaucacuuucaauuuaugaauaauuucuaaaguuacccuguuccauggccacagcucaugccacuaaagccaaucagcugucuugaagaugugccauuugucgugaggggaccaagaaauagggugaagagaucagcccaaauccaucacuagccacuggaaaaaaugauucaaaaugcauucuccacugagucugaauuacauuauuuuuagccaaaggucuuugcaacauuuaaagaaauagggguagguauaucaucauguuuaaaaugaauuguaaauaucaaaauuauacagagagugagauuuuaaaugaaauacuauauagcaucauauaauuuucaaagaggaaucaucaaaccaaauacacuguagcccuaagauuugaagugaccaagacaaaucaagaagcucuaaugcuucuguuacaugugucuauguggacaguaaaccacuuacuugggggauccuuuuuuggaguaaauauaguuagauuuguagccuauuuuuagauaucugagccugaauagaaaguaaugagaugagaucuguauguuaaguauuucacagaaagauucccugggcuaggagucaaguguuuucuuuuuuuaauggaaggaggcauauuugaagguaaacuacuguaaggcugauuggagucuuggcaagguuagauugaucaucuuagaaaaccugugugcagaaugguuaggcaaucaaggauaugguauauuuuguggacaaccaaccuaacauauuagcaccaguuuggggaaugacuuaagaguucacugggcugggugugguggcucaugccuguaauccuagcaccacaggaggaggccgaugugggcggaucacuugaggucagggguucaagaccagccuggccaacguggcgaaauccugucgcuacuaaaaauacaaaaauuaucugggcaugguggcgcacaucuguaaucccagcuacucaggaggcugaggcaggagaaucacucaaacccaggaggcagagguuacggugagcugaggugguaccacugcacuccagccugagcgacagagugacacucugucucaaaaaaaaaaaaaaaaaagcauaaagcaucucugguaggaggaagggaacugguauuugagcaucuuuguuaugccaucugcugugcuauaauuuuaccuguuccucaugacagcacugugagggcuggcgucacacccauuuuacagacuggaaacugcaguaauuaagugagagaauugggaucugagacacaaauuggucugaauacagaaucccuuccuuuuuuucaacuguaucacacuguuuuguaggugggcgcauaguggcauuuugacaagcucucaauggugggguuaauagcuuguuuuuuaguuuaagagaauaugauuauuauguacuucggcugaagacgguucacaugggaauuauuuuaacagcuuaaugcagggcgugacagccuguuuuuguaaauaaaauuuuauuggaauauagcccaucauuuauuuacauauugcugcuucagugcuacaacgcaguacugaguaguugcaacagaaaugucuggguaucuggcccuuuacacggaaaauuugucagucccuuguucaaaggaaaauguauaaaaaugaaccaaacuucugcuuuugcagaucauaguuuauuuucaugugaguugagcacuucuuccccccaaauaaacaaauauauguguuaaauugaugguguaccuggucucaaaauggcuggaauaugaacauuuaucuugguucacagugauuugguugaggacgucucaagguauguuucauuuuuuugcauccuagguggccuacaauccaagcuacuuuaaugcaaaaaaucagaauaaauuuauaguaaauccuguguuuacuggcacuccagguacagaacucugugaaugguucucauugggggugacgcucccccuagaggccaaauuggaaaugggggcauguuuugguuaugguguaauucauugaaaaauacauuauuuuauuauaaaucacuguccuuuuauuucuccuuuauauuggaguuaguacaguauauugauuuuguaucauguuuagauugaggauauccaugguuuucauuucagccuagcaaaggggacuuuacagaaauuuguuuuauaaaaagggaguuucgggucugaugguauugagcaccacugccaaagagauuuggcaucuuuuugaaaacagacuucuaaguaaggacaacuaccuuagaaagaccuggaauucugaacggagaggcugcuuguucucugacaaacuuuagaagucaaguuuuaagucucaguauguuuccauaagcagcaucuuuccagagaaagagcaugauugaacuuaacguaaaugccaacacagagucauaaaccacauuaaaggcucaucaaaagacaaaagcugcauaccuuugucacuguuuuguuuguauacagaaaaguucagaaaaaccacucagggccauugaucucaacucaggugacgaugggaaauagagcucuccgugguguuuacaguuugcuugcaaaggcccuaugaggcagagaucaaaauuauuuucuaguucugcugcuuuuagauucuuaacauaagcguuaaaauggcaugcauuuuuuaauguuuuuaguuaaugugugcuucagguuuguguauuguuguuuuucauauucaacagaaaaggaaaaacaguuccuuagucuggaaaaagggcgcagugaaagagguuuuuguaucugccuccacagauucaacugaccaaucccagcccccuguacugggacggcuguaccuuaauuugaaauguucauggaaaagucuauaagggaagauagcauuacucaaauuauuuucagugcaaaucguuucaaagggguacaaguuaacccugcaguuaacuacauaacaguauauacacuuaaauuugcugcccagaaccacccugccuggaccauccugaucagccaaggccuugucguaccauuucaaacaugaguuuguaugaacuuguggcuuaagugaaauauuacacugccaacaacuguuauguuccuuggccaauccuuaauugcccaguucauucacucauuuaacaaauaccuguuaaauaucuuuugggugccaggcacuguuacaggugcuguaaauaaauaaaacauaaaauucuuggggcuuagaggccccaaagguugguuggcuaggugaguugaguucucuuaacuauguuucuuagucucaagcuguucuacugagauugggaccagucacgugcaaccugguuuccuuccagagaccacuuagaagcacuuuucuguagguagaagggacucugcaaugcagggagaccuaggcuagaguugucccugccaguaagucacuccaggaccuugucacacacccucuaggccccccgcaucuccucuguaauaggagaggguugggcuuaaaucaucucaaagguuauuuugggggaucaaaagugauagaagucuaccucugguuagaaugcuguaguuaacauauauauacggaaucaacuuuuaauuuuugcuuuaaagccaagguagccaaaaaucaacauuuuuuuguuuguuuuuuaaauaaaaaggauaaaaaaacuugauuguuagggcuuugggaugaaauacucuguaaccaaaaggguagcugauuuuuguagacuucacuauagcuucuaauuaucauccaacugccuuuacacuaacauagucauuuuauacacgaagauauggaugagcuuucuuugcuugguaaguuagagacagcccagggcuuguacacaccugucuaguacauuuuccaaaguacuacacugcuuuccauuuuccuauuagagucauuauugucuuuuuuuuuuuuuuuuuaagcaaaaagcacuuuauaacugaguggcugcuagccaugcgcuaucccuguauuaguuaacuuuucuccuaguauuuccaaggucaggacuaauuuguagaauuggcuaagacauuggcauucacuagcuauccuuuugugcucauaaaaauuaaaaauuuuaaaaauacuaguaauuuguuaacagauacacugugugguuccaagcccugcaugaauguauuaauucauuuguuucaccuaauaauguugauguaaaauggggguaauagcaaccaaagcccagagaaguuaaauaaccuacucaaggucaaauggugaguugcagaguuggaauuugaauguagucagcugcaacauuugugcacaccagcaugaugcuguuccagcuucuauaaucuucagggaucaaucaaaaccauucaacaaagagaggcucacugaugagauuuuaaaguaagccucauuguggaacuggcacauguuaucuggaccuuuggauuucucggauguauacuugauccaacuauuaacaguaguaguagugucugguguuccucuaaaaauuagagcuuuagacauaaagacugcauauuguucgguuucauuuauaugaaauucccaaagugggcaaauuuauagggauagcaaauucgugguugcuggaggauugggaguggugggugacugcuaauggguauggggugggguuucucuuugggaugauaaaaguguucuaaaauugauuguggugauggguggcacaacuuuggauauacuaaaaaccuuuaaauuguacacuugaaaagggugaacuguaugguaugugaguuguaguaaaacaguuaaaugaagggaaaaugagggauuucguccuuuauauucauuuuaaauugaaauuuuuucaugaaaaucagaaauagcaggaagacucaucauucuuuuauggcccaugaauaaacaggguggugacguugacugaguugacuguacaaccaggauuuuagauuuuuucuacugacuugauaguaagaauuuaacuuuuuguuuuaaaauguugacuuacauuagugaagcauuuuaaauauuaaaguaucuauacuaaaagguaguuuuauaucuguuacugaagaaaaucugccccuaauauauagucuuguuuugucaauagaaaaauuucagagcagauacaucugacuugcuccauaguucaucucauccauucugcuaucucugagaauaauggguuauuuugcuuggacaugaacuuaagguuagaaagguuuuucaaagcauauuuuacgauuuugucugaauuuaauucauuuuaguguuauucauuaaucuuuuuaaaaaguuacuuuuaauuuugcauugugcuaccuguagguaguuucagcucuucuaaguugaguaucucuuucuauaaagacguauuuugcucuaauuguuaauuuucaagcaucagugguaguugccuaguuccaguguucugggauuuggugaacuaguauacauguuugccccaucaugacauuucacaguauuguauauuugccgcauaaucauucaccagauaguugugaguuccagugugcgccaggauacagccacgaaccagacagacacaagccuuggccuuguaguguugaacucucacgggggaauccugacaguccuaaccuuguaagauggccccuaucuggccaucuccccaccucuucauccugguggcugucuuuuucugugacuucgucaccuuucuugacuauuucuuaaggacaguagccaguacugugaagcuguuaaaucccacuagauuuugugccaagguguguuaacccauuuaugccuaguguuccacuauuggaacgcuaagcuugugggaguuauuuacauccugcugcucaaggucaucaccaaggucugauuuuucacaaaaauaauuugcaaccuccggcauaaauggguuaauguucuccauugcuggauuuuguuagugugucugguugcucuuaauacagccuggcaaaaagauauuuauaaauauccacagucaccuuguugaauuggaugugguuuaccucccgcugacuuuauauguaucuaucuguguccuaaacuuugauaaaauaaccaaagcauuacuuaguguucuguuguugcuguaaucuucuuaagucuaaauaaauccuugcguuaaaaugguauuuguguauguucugaauagaaugcuuucauuuaugccugaauugugaugaauaugcauuauuuaaaugaaguauauacuuucccuagaaaauacugauuaaaucaaaucuuaccaauuugauuucagucaaauccaugccacucuaaacugccaucauuuggagaaaacaaaauucuuaauagagaaaauagugugaguuaaauuguccauucuuuuuucauucugcucggcugccucuaaauuaucuuuaaaaaauaaggaguauggaaauuugaggccuguugcacaauuaauaaacauuaaguuuuuuuagauggcaauuagagcacuacgaauuaaaauuccuggaauguguauggcgucuucugcugagcucccccuugugcauuuagcuccccuugucuguucuccccuaguccccugcaccuuuauuggagcucucacauacugccugugcucugguucaucguuucuaugucuuauuaccacuggggccuaguauggaaauagaaccuguaaaguaguaccguuugcucucaguugccauauuuaagucucagaugucacauauguuugaaauugcauacaaauucaguugauauugaauguuguguuucuugguagaguuuccaggauggcuucugcaucaacuucuaaauauaauucacacuccuuggagaaugagucuauuaagaggguaaguugaauuuucagauuuaucugucucuuuccuugcauuuauuuugauauuugaauauuaggucauuuugggcuggccuauugaauuaugaauuuuauuauucauucacauauaaauacauuuauacaugugguuucuuuauugucucaccuuguucuagaaaagcuuuuuuuuuuuuuuggagacagagucucgcuccguagcccagguuggagugcaguggcaagaucucagcucacugcaaccuccgccucccagauucaagugauucuccugccucagccucccuaguagcugggauuacaggcgugugcuaccacacccggcuaauuuuuguauuuuuaguagagacgggguuucgccauguuggccaggcuugucuugaacuccugaccucaggugauccacuugccucggccucccaaagugcugggauuuacaggagugagcuaccacgccggcccagaaaagcuuuuagauagaauaccuuauauguguuaagugaguuuuacauuuguaaauccuuucacauaacuucauuuuugaaaaccucugucucgugaaauuacugcuagaccucauguuuaagguacuaggcaauccuccaccuggaaagguugcugaaggacauacuggaaggcuaaggccugcugagcaggcugcuacgccuuccuaauuauuggcauuauuuucuaauuaugauaaaauuguugcauaaccaaaacaaauacaacuuuaacagaaaaugguucaagguauccagggggagauuguguaauuagagggagauuuuggaaugugcauucaaaggaagggauuaauuuaaaauaagcuuuauucauggcccuuuaaggcccuaagauuauccaccagaaaggcuaauuuauacucccaccagguggauagagaugccuaagcaaucagaagggagcaaaaggugaucuuuucauugguauuucuugauuacuaaugagguuaaccuuuuuuaaaaaaguguguuuauggucaggugagguggcucaugcuuguaauccuagcacuuuaggaggccaaggugggaggaucacuugagcucaagaguucgagacuggccuaggcaacauagugaaacccugucucuaccaaagauacaaaaaauuagccgagugugauggcgugcgcccauaguuccaacuacucaggaggcugaggugggagauuguuugagccugggaggcagagguugcagugagccgagaucucaccacugcacuccagccugggcgacagagugagauccugucucaaauaaguaaauaaaaguguguuuguuauuaguuugcauuucucuugugaagugauuguucauguccuuuauuuggcuuuuggggauuuugaggggaguucuuauugauuauguguuccguguguguguguauauguguauguguguguauaauuuuuuuuugagacagagucuaacucugucccucaggcuggagugcaguggugcaauccuggcucacugcaaccucugccucuuggguucaagugauucucgugccucagccucccgaguagcugggauuacaggugugcaccaucacaccuggcuaauuuuuguauuuuuaguagaguugggguuucaccauguuggccaugcuggucuugaacuccuggccucaagcuauccaccugccuuagccucccaaauugcugggauuacaggcauggaccaccacaccuggcuuguuccuuauauuuugauaaucagcucuauaauauguuacaagucuucuuccugauuuauuguuggccuuuuaauuguauuuaugguauuuugauuuugaaauacugaaguuuaaaguuuuuaugugaucacauauaucaaucuauauuuucuguuuugggugccuacaaggaccauccucaucuccaagauuauauguuuuuauuguauuuaaguauuuuuauguuaccagaaucaguucuaaacacaggaguaauuucaagaauguaacuauaaauccuuuguguaaugcugcucugguauaauguauagccuauguuaaucccauguuauccuguuuuaaucagacauucacuucccuuauuuugugguugaccuagaacugugguauuuaaaagguauacugaguauugcauuugcucguuaugccuguuuuuaguuagugagagggaguguuaaagggugauaauuucuuuccucucuuacaauuuauauaaggugugugguuuugcuucucauugaggaaggcauuccuggcugagaacaguuugucuugcccagcugguuaaaauguuuagcuugcaaguacuagaaaauuuuuuaaauuggcuaggaauuuucauucuugccucugaaugaaaaaaaaaaacauuaaagauucagcauaacaccccucuuugacagcuuauaucucaccugaauauacaauucacauuucucuuguuucauaauaauucucuccauuugcauagccucugauaauuuacagaagugugcacaguagcucacaccuguaaucccagcacuuuggaaggucaaggcaggcagaucacuugaggccaggaguucaagaccagccuggccaacauggugaaaccccgucucuacucaaaaugcaaaaauuagcugggcgugguggcacacaccuguagucccagcuacucaggagaccgaggcaugagaaucucuugaaccugggagcugggaggcagacguugcaguaagccaagauugcaccacuguugccuggcaacagagcaagacugucucaaaaaauaaaagugugcuuguauauauauuuuuucacuuaauacucacaaaacugcucuaacggaagcaugaguaacuucacuuaugaaaugauugcagugugauuuuggacaacaaauagaaaaaaaugaaauacugcugaaaaaaacuuuuugcccaaacagauguuagugaugugccucaaaugucaucagacuagcaccugcaacacaucuucguauuaauccacuagggcagcugaauaaccugaaagacaauggguagcuauggcaaauuaggcucugcgaacucgccugcagguuguagugguuaauauuacugugcccaccuagcagagcuguggaagugauugaaugaggcacaugcuugggaauaccucuaaagccaggaagccuagagaaauaguaaagugaugugaagaauuuguacaaauggcuccuaagacuuuugccagcucaaaaguucucugacagaccacucuuaccucuuauuaggacagggaucuuaguaaaugugaggaaguaaaaagagaggaagggucuuagugaaauaggaaacgcaauagguaaucacaaugauuuucgggcauuguaauaggauucuggcuaauggcugugcuguuauucaguuaagccucuguggaauugaaguuuuccuuccuacucuucccaaaagauggcugaauaugaaaaaaagaaagcugcuacaguguauguguaucuauagaacacacuuaauguuuacuuuuuaucacuuucccgaaagcuguuaacuuuaaagugcuuggaaauguaguuuaaaaauuaauauuauugaaaagcaugcuagcauuauuuaauacuagaaguugacacaucuaauuaauguuggugccagauuguaacuuuuuuguuugaauuuuugugccaguuuucccaaaugcuaaaucucuaaugcuuuuucuuuaaaaaacauauuucuaguggcuuguauuccuaguugcuuaaaaacaguguguaaauguaacgucauuacuucugaugcaucuguuuuguuucuagacgucucgagauggagucaaucgagaucucacugaggcuguuccucgacuuccaggagaaacacuaaucacugguaaggaccugcugacauaagauuugcauaacuugaggagaagucuggcaggaucagguggcuucagucccgcuuacucuuuagcagucaggcuuagacaaauaggcuaccuuuguuuagaagcguuaacacagaacucucugcaucccuuucuugauuaaagaguucuuucgagagcuucaugcucacaaggguagugauauucuugugucuguaccaaagacugagaaugauuuaggggaaaaaaauguggauuaucucuugaaagucucucauuggagccauaagcucucaugguuuaagguuuuaagagcaaaaugauuuccagucaaugaugcaugcuuuaaaaugauaaacuuaaaggcuugaaggcuuaaucauucuccucuuugaaauauaggagaacauauugcuuuaaaauaucuuucauucgucagaaaauggaaguuaguauuuagguaauauuuugauguuauuuuucaugauaaacguauacuaaaaggaagggaucaacuuuggaagggcuagaucacuacggcuuaagaauauagaagcaucugacagcuucuaagccaagugcuaauguucugggcaaauuuuauauguggauuaacacccuccuuucagacuucaauguauuugaagcagaugugaugaccauuguuccagggaaccuuuugauuaauucagaucuggguuguuuagcuuaaauggcuaaaaccucgugcuaauuagauggcgggccuaagcgagguaccuuugggaauuagccauacaccaugagaaauucucuucugaguccacaaacuugcacacauucuagucuugaaauggagaccagugggauguguucaucccaauuucuggauaagagcaaagaagauauuuuacuuuugaucgucuucauauaugaaguuuuggugguagguaucagcgccugaaccuuaacccaggugguaacuaauggaacuagcauaaaguagcuuuauuaaguauuuuuuauuuagaacuugaagagaaagggauuucaaaaucauuacgagucauuaacacauucaaggacaucccugaaagaugagaggcauauuucuauuauaauuaauuauucugauuuagcuucuccuuauguuuauucuaccaaagauguacuauucuuucggccaccuguuuuauaucacuucaguguuugaaaugaaccuagccaaacucuauucuagacuauuaaaaagaaaaagguuuggugcgguggcucacaccuguaaucccagcacuuugagaggccaaaguaggaggaucacuugaggccaggaauuggagaccagccugggcaacacagcaaaacuucaucuuuacuaaaaauuaaaaaacgagcugggugcaguggcgcauacccauagucccagcuacucaggaggcugaggugggaggauugcuugagccugagagguugaggcugcagugagccaugauugugccacugaacuccagcuugggcaauagagcaagacccuaucucaaaaacaaaaaaagacagaauaaacuggaaagauuucuacugcugacauuuauuuauuaaaaacaugauuauguuucugugguuagagauugguagccucaucucucagucuagugguuaguccgugagacugucccaggugaguugccguccucuggcugaaguagcucaaauaguuaccuuuacaaccaccuuaggguagcagcagcaguauucucauucacuucuauugucaccuugccccagguagugacagcauugugggaaagcucagggaagcacuguuagugccuggaggugguguggccccacuaguucucccacuaccccaacucaacccagcacgguaauguagaaacauugccagugcuugcuuucagccuuuucaguaauuuuuaaaauuguaguuauucuuagcugaauaguuuauauuaaauuagugccauuuguuguguaucuugguaucuauuuccauuauuuuaggguacuuuuuuuaucuuaauagacaaagaaguuauuuacauauguccuuucaauggccccauuaagggaagaguuuacaucacaaauuaucgucuuuauuuaagaaguuuggaaacgguaaguagaauauaagaccauaaagaugacccuaacuguuaaagauaaugcuaaauuguuucucuucuacuuugcaagauugacugugggucaaauuaacaugggguauauuugcuucucaacucuuaauuuuuugcuuaugcaaaacucauuuaacacuaacacuuguauauguaaggaacagggucaauuaaaaaaagucuuaucccucauaauggugggggagggguuaguaauuguaaccauuugcuaguuuggagaaguuagguguagaacagugguucuuugccagaagcacauaugaaacccacuuauggagcuuaacaacacaguauccauaaaaguuaaaaauaaaaaaauacagauguccucgauagacugcaucagaauauccagaccugugguccuggcacaguuauauuuucuaaaauaucacagaggaagauagugaugugaauuucugggugaagcccagcauucuagaacuuuuccagguguucaaugauaaagcaccagguagcaguguagaacuaggaugacuaugguauggcuuacugccacucuaccuuuucaaucccugaccaugaaagguuugucacagcauuuugaggaauguuccaucacuaggacaauaacauggaaaagagaugccccagaaagggaagagagagugaguagcugcuguggcugucacugaaggacuuccaguggaugugguggguugucauugcccaggucagccugaaggggagguauauuuugauaggaugugaauggggaaagagguccaggguucacagagaguagcccaucagcagcuucuacacaggugaccuugaggcugucggggaaauguagcuuuuuuauugcuuuuaccccaccauuuuuuaggacaguucuaaucuagauuaguuuguaucuuuuaaucuuuuuuucuuuuaugguguucauuauuaugucugaauucugaaaaaaugcuguuuauuauccccauugccuuagcugugggagcccacuuuuauagcugccccaacuucuggaaucuccucuggcacagugcuuguagggacauguacauggaucaggccacagggcauuuuauuuaugugacucuguucaaacuuuuaaguaagaguggagaugagugaauguucuagauuuccagaaugggaaagaagauucugaaaauuaacaacagcgagcugcauguucacccuuggcaacaauuggcaaaaauucuacaaauaaucauuuuaaacaugauuuuuaaguccuuagaaaagaaaccaaccauugggaguguuauugacacauugucuugauggaaccaaggccauaugacagacuccgguaaagacaccugggccaaaugguggcaguacacuuagguggaguuacagccuauggauuucaggcuuaaugcuaggaaggguggucgcuaacaucuugcuguguagggcccuuccuuuccagcauuucugaugcaaugcagaggagcacauagaagacaugcauuuccaauguaugaaaaaccccauacuagccaaugugugcuaggugaugggaucaggguuugaaaugaucuuaacuugguaggauauuggagcaaaacuaauaauauaaaauugauauagauaacaauuacucaguuguuaucaguaaaggauaggaggucugucuuaacggauccaagcuuauuugaaccaguaauuggauaugacugauuaaaaaguuaauauuccccuaggcugaguuaacagaaguauaacauaauugccagacaaaauguaacaauagccccaucugaaguguuguauuccaagccagaugccaaguuuuaagagggacauuaacaaacugaagagaguucagacacagauaaccagguuagugaagggacugcaguuggagcagugaucaaaauaaaugcugaucuugucugaagaaaagaugacuaaaaagggacaugauggacccaucuuugaauauuugaagugccuuucuguggagcagggauucgauuuauucuguauagcucccaagggucaaauuaggauagauugaaagauuuuaugcuaauauaugugagaauuaucaaaaguugcaauuaaacauuauggucccuuuugcugcuuguacucuuggcuuuuugacucacccuguguagccaguuccaccuuaugcugucacugaugaugaacuggggaaguuauucaaacugaugauaugacaagguuguguauguagugugaccucaacuacgaaaaacaaaaauuaucuguagaaaagaggcuggaaagaaguacaccaaagguuucaguauuugggcuaucugaagaaagggauuaugcaugucuugucuucuuccuuucacuugucaauauuuuucaaaaacccagaaugaacauguauuacuuuuacaauuggaagaauucucagcaaguuuuauuuuuguuuguauaugaugcccuagaggauggaguuagugcugagugggugaauaaaaugccugucugacacugacuacuaacuuauuucuucuuccacuaaguuuuacauaaacauuuugagcaauuggccacaacauuuaguccaaguauaaaagcaagcagcugacagcagaaaacaucauauaaagaaugccauuuaaaugguuauacaggagucuaaaaacauagucaucauaguguuucuucaauuaaaguccuaagcaagaacauuaacuguggauucugcugcaaacugaaaaaaauuuuguugcauguuugacaaaaagcugucaucucacuggcguuuugaaguggacaccuguuuguuucagguauguaaacacugcaguaggagugaugaguccagauguguguggucugauucuggagucagcucugcuauuuuguaaggagucaagggcagauucccugccuccuguugcccagagaaguagagaaacaguguccauguccugagauugccacaguggccugcuucuaccuagcccuccuugccuggucugccccugcauucuggcccacgccccgucuccagcguguucguccuuagagugaggccgaccagcuuauuucucaguuccaaaacuaucaucgguucccuguugcccacagagugaaauccauucucuugguauggccuaaaaguccuucugacuccuccaaccuugacucacaucacuucuucccaagugcauuguucucaaacuacgcagagccuuuccuucucccaucaugcaugugccauucucacggaaccuggaugcccuuucuccaccccuuucagaagcugcuagucauccuucagaaccuaccucaagagccacacccucucuggagucuuccccagcuucucuugaaggaaucauuccuucuuugugucccugcagccuuuucuucaugccucuguguuauuaacacauugcuaugaaaccuucccuggcccuuuagcuaaacuuuuaauaugucuuuucuguguuuaauuuuucucuugagugcuugucacuguguccuauguuauauauuucacugauucaucuuguuuguugucucucuaaggacaaggaugcuugucugucuauucacugauguucuuucaguucuugggaaggagucuggcacauugaagaugcuaagucaguguguguugaaugaauggauucugucauauuuauuugcugcuaugucuguggucuuaucaaaugcugaguccauuugguccuucaugccuagcuaguacaguguccugguagacaguaauacacaguaaaaguguauugagugaacuugggaggaaaugggcuccuaaguuguuagugcugcucagagggcaaaggccuagucacugugguuugaccacaguauggcuccugcuacauuguggcaucuugaauacuaacauugcuucuggauuugagaaaucccauagcuaccuuuuggccuugaggguacuaaggaauuuggcuuuggguuaauguugugacuauaguagggccuacuguagguaggugauacccuguaaucugguagacuaccaugaguaagacugcuuucaggauuccuuccaggagcacuuuguguuuaggugcucuagugcaugagaaagauaccuuaacccucguucauucaggcauucaugucuucauuccagaaacauucacugagcaccauggugaauuuaauacugugcaaggugcauaauacuauacccugaggccugcauaaccucauaggauauagaguugaguaauugugguauaauaugacaaagccuacagugguaugcauagugcugugagaaggaagaagacguacaagggaaaagacgauuaugccaguguagcaagucauagaaugcuuuauagaggagaugauacuugaaccaacucuugaagaaugguaacaauuuucuggacaggaaggaaaaaggagcauaucagguagagaguuaccgugucuauaugguacuuuucuguaucgcauguauaacaauauggaaaagcaccauuuguuaugaagaugguugaaugaucgguuggagcuggaacauuggggguugauggaggaguggggaacagaagaggaugaggcuggaagaagagccagcagccuuaagagucucauaagucacaguuaagcaguaugcaaguuacacagacaaugacauauccaaugugauuucaggaagagaacuccagcugcagugugugugugauggguuaggggcgggagagacugaagucaggaagcccaacuaggaaguuauuuuaguuuccuagguaagugauaagggccuuaauacagucauaguggagauagaaaagaggggacagccaugagagauuuggagggcuugaguggccauuuggaagauggaguugaacaaacuuucacuugaaagauaggagcugcucccauucaucugaauagacauauuacaggagaaggaauauguuguagauaagcccaauggggaaauuagucugaaggcauggacuuacagcucuacaacuaccacguggaaauggcucagaagcaguuggaaaccugacucugaagcuucugaagucauuagcauauugguagcacuaaagaccacagacauucaugagcugggaagaguauguaacauaaaaagauaugggcuaaggagaggaccccgggggacauggacacuuuuccauggugcggagagcgagaagagccaguggagacaaccaaguggcagcagccaaagcaguagaaaaucuuuggauaaagggcugugauggaagucaguaggagagagaaucucaagaaggaagggagcagaccauggugugaaauguugcaaguuucaguaagauaaagaaugaaaagaggccauggaguguguggccaggaggaggcucacaggagccccagcgagaacagauuccauggagaugugaguccuugggucuuucucgcaguccucuuccaccuuggucuuucuguaaagauucugcagcuuccaggccucagcaagcugcucugcauuuauucuucuccccguggcuuuaagcuacccccuuggcuuuagucacuuccaugcacaugaaauuguauaguaacaaagcuccuuagaguuuacccagccuuuuuccauugacucuuucaucugagcaugacaacagcugacagauaggcaaagcagacgcuacccuagccauguuuuuuccccuagugcuaccucucuuuugagccccaguuucucuuuccuuacugccugcuggagaucccuugaguuuucaccuggcaucccagacucauggucaagcugaaauuguucaacucaauugucucccucccccgaguuccuucuuuugguguucuuguuucucuuaauggugccauuuucuucucaucacccuggagucuccucugucuacccauccccacuucucuguagacuucaucacauuugccucauccuuucuagucacguugcccuacccucauccucggugucugucuccuaggcccuggcagucuccuucagcuaggccucccugacuucugcaucucucccuucuauucuaucugcucccuaagacauaccugcaaucuucucauucccuuacucagaaacucuccuuuccuaccuuaucgcacauucccuagccagguguucacgguccucaccacucugcugccaucuuaucuucccagcauugcucuuucuccccucccuuguguauacaccccgugcuuuggcucccauaagcaacuuggucuuccuaaacaagcccucugccuccucaccuguggacuucucgugcagccauuuugucccccuagagcauacauucauccccaccccaucucugccauuugcccccgacuccucuuaaaaaucguuccgaaguauuugcuauagaaagcuuaugaaaaauaacauaaaugucuguggguccaccacccagcugaaggaauuccauccuuuccucccucuucacagcagagguaaucaccauccaaaaguugguauuucucacucguggucauuucacacaucccuuuuuaaaauagaauggaauauaggaaauguggaggaagcuaaaggaaugggggcuuuuaaggcuuccaguggagcagauccuaacccuuggucaguauaauuuggcucuagguucaggacugcuggcagggugagaaacauguuggauauagaguuuucauuuucugaagacaagucagaaacagcacauucuuccuggauuaaauucaaggacaaauuuguuguuuggcuuuucucuaaaagauagugacacagugauucaauucuucaggcaguguauuacccaaagauucuugaauccuuuucaauuugauggcucuuuuguugauucucuauaaagauggagcauacaguguuaacuuuuaguugguaaaagugcuucugugaagaacuauauaauguggccuacuuuguuuuucugaugaguugccagugcaaagguaauauuuggagaaucaagacgaguaggcaguuuacaugucugucaaacucugucucaaauaccugguuaugaaauggcuuucagaugggugcuggguguugugccaucuaagagcuggguguggaacaagugcagcaguacucggguuuccucaucucuauugguggcugucauuggaucuguaagccuuggauacuaccaggaagggaggcagaguuuaccuuucagugugagcauuucaaagccagaccuauauucuuuuucagagggaaggccaguccacuuaauuacaagcacagccaaaaaggauuccuguaguauuuuuuccuugaagaaaaaaaaaaaaaagcauuggaaacuuuucaagacuguccuuuucagguccuucucucuaguggauuuggcaccucuuuucauuuuaugguaggugaaauaaugcuaaauagacuauaauaaaacacccuagucuguccauaaaucggaacaucagugggagcauaggaucuaugcuauagguauuauuuuaaacuuccagucuuaaaucaucuucuuauauugcugcugcaaaaugaaugccuucuucacauuaaaaaacaaaacaaaacaaaacaaaacaaaaaccuaauuccugccaguacccuugguuccuuugucccuuguccccaugcuaauccccaaacuuuagggucuguaagcuacuaagcucugauguugaaagucacauaacagguuuaauuaauuaguuccacuacaaguucaggcuuucagaaagggucucaucgcugcuuuggcaauuccuucggucucagauugacuucucacuacaccuuccaccacuacagugacaaaccuuucaugcucuuuggcuaaccucaucucuuguucuguugaaaaguccccuugucaccaccuaaggaggucuaccuucacccauuuuuuccuccuucccucgcaucugagaggaaggaaucagacaucuuauuuuccaaagugaaucccauucuuuacaccuuucuccucuggagucuuaguuccccauugguuauucugugucuuacauuuuugguuuucaucauuuuugauucuccuuccccccgcucugugaaucugcucaacuuccuucccuuccuuccuucccucccuucccucucuucccuuucuucccuuccuucccucccuucccucucuucccuuccuucccucccuucccuggguucccucccuucccuggguucccucccuucccucgguucccucccuucccuucccuccccucccccuccccucccccuccccuccccucccaaaauggacagagcuguccauuuugagacagcucuguugcccagguuggagugcaguggcgugaucucggcucaccgcaaccuccaccucuuggguuccuuggguucaagagauucucccgccucagcuucccgaguagcugggauuacagacauguaccaccacagccaguuaauuuuuguauuuuuaguagagacauuguuucauuauguuggccaggcuggucucggacuccugaccucaaguaaucugcccaccuccgccucccaaagugcugggauuacaggcgcgagccacugcacccagccuugcccaaguaucuuuauuugaaaacaccuucuuguauuccugcuaccacugauacuaucauccucuuucuuccccuuauugcacaaacuucuuuaaaaauuaguccacacaugcugcuuccacuuccguacuauugacuccuuacuucuuguggucuggcuucuguucccuauugaaacuacuuuacugcucaauuccaguggccuugguugaguucuugacuuuuaaauuucuaugcagggauugauucuguugacugcuccuuccuuuauccuuuucccuauacauuccuggcucuccucucauuucugccucuugccuucuaugcggcucauuuuuucuuuccuaccuccuaaauauuauuuuccccagaguucuguccucacccucuuuuuucuccauugucaguugcuuuccaauucucuagcuccaguuccaaucuuucauucuguauucauugaguaucugagaguccaguauguguuaagcacuaugccaggugcuaggauaugauggugagcaccgcaaacaguuucucccucacgaagcuuauaguucucaugggauugauaaacauucuucugauagucacgccaauauauaauaacaagcugugaucaguguugcgugggaguaguacaggggcacaacaguuugaggagccugggaaauuguccugagaaaaugcuugaccuggggucugaagaauacauauaaguucccuagaugugagucaggggcuggggaggugagaagaagcugagagaacagcauaugagaggaccugagaccaaaggaagcaugaaaaaugacaguauggcugaguugggggagaauggcaagagaugaggugagagagguagaugguggccagauguccucggccuugcccacccuguucaggauuugggguuuuuauuuuuucauuuauucauuggauugauugauuugagacagggucucgcuguugcccaggcuggagugcaguggugcaaucauagcucacugcagccaugaccuccugagcucaagcaguccucccaccucaacuuccugaguagcuaggacuauagcugcacacuaccauggccagcuaauuuuuguauuuuuuguagagauagggucuugcuguguugcccaggcuggucucaaacuccuuggcucaagcgauccgccugccuccgccucccaaagugcugggauugcaggcauaagccaccaugcccagcccuuuaauuuauuuuuuaauugacaaaaauuguauauaucgugugcaacguguuuugaaauacauacacauuguagaaugagucaaucaagcuacuuaacauaagcauggccucacauacauauuuuguguggucagaacauuuagaauuuacucucagcaauuuucuaguacacaauaguuguuaguuguagucacuuuguuguacaguagaucucuggaacuuacuccuccuauuaacugaaauuuugucuccuuugaccaacaucuccccauugccuuccccaggaugaugaugaugaugaugaugaugauuauuauuauuauuauuuuugagaugaagucucgcucuugucccccggcuagagggcaauggugugaucucggcucacugcaaccuccgccucccguguucaagcaauucucuugccucagccucccgaguagcugggauuacaggcaccugccaccacgcccagcugauuuuuguauuuuuaguagagacgggguuucaccauguuggccaggcuggucuugaacugaccucaggugauccacccaccucggccucccaaagugcugguauuacaggcgugagccaccaugccuggucaggauuuggguuuuuagaguucagcaaugagaagcuuuugaagcuuuucacaccacuuucaaaguggugugagccaaggaaugauaacaucagaugugcucuucuaaaagaucacccuggcuacucuagggggaaugaucguagauuuugagaccacugcaaccacggcaguggcccagagaaguugcugguagaauuggagugguuagcagaguugagacugauuuaagagguagacauaggagacuggcuuaaggauagcagagaaggggaugccaggggugacuucuagguuucuagcuuucguaaccagccacugagauagggaacuuuggagaauaauguaguuuggagagagaacugcauuuaguucuggacauuuuuaguucgagguacccuugagaucuugucaguucuguauauccagccaucuccuggguaucuguacuugguucauuuaucauaaucucaaaccaagaguuucuaaaaucggccguguucaucuuucucuaaaacccccuccuguguucuucacaucuuuuggugguaccaccacuauuuaucccagagaucugggcccaaagcugauucaucuuugagucuuccccaguggcuagucucuuuugcuuucuaccucgguccuucucuacuucuagauccucauagccucucacuuguacugaaguaucagcuuucaugguuuugaggagugguuguagcccacuucuugcuaguccagaaugcucagugcugccagaugaaucuucauaaagcaccaguuaaucauggcauuccuguucuccagaagcauccuuuagaucucagucucccugauccuagccguguaguacuccccaggaaauucccaucaccguugcugaaaccuggccuauauuuuuuuaaaauaaacucuccaugcuuuucccacaugugcagcugaugugacucuuacuugcuucucaaaugccaaucuccaguugcucuugauccauccuuuaaggaucauuuuuaaugcagucauugccacagaaccuucaugcuaucuaaucaucagauaugguuugcccuccuuugaccuccccuuucacuuuguguggacuuugccuauggcucuuggcacuagcaaccuggcauuguaguuacuugaguccaugugucuuaucucccagauagagcuaggcccugaacuccaugugggcaacucugcuucuuaacuucaugaacccuagggcccaguagaguuucuguuacuuaguguaugagacagacagacagacagagacagagacagagagagagagagagaaagaaagaaugcauuauuuuagguuauuuaacuccccuauuuucaugucaauuacuuuagguaguuagaaguacaaggcauagacuuuugaguuagaaugggccuuugaaaauccuuaaauauuuaaugauauuuagauacugaugacucagguauccagaaaguucagcuaauuugccuauuccuggaucuugcaguuuggccugcuggguuaucugaccuugaaugugucauucagggagaauguagcaaguaaccuuauuagacggugggugccuuuggucagaagcuggcugguucuccucagcgaccuguuuucuuuuuuucuguguagggccagggcucuuugagcuauacaguuuccucuguacagagacaaagaguagcaagguguuagcucacuuuuaauucuuccacuuuuuucaaacauccuugcuuccauguugaugcuagaguaucagacuuauuuagugucuauucuguguauuuuauguauaaauuugacauuuaagaauacaguucacagacacucaaaugucaauaugguauaucuaagcauaauaacagacugauacuguguuuuaaauaacugcacuguaucgauaaguaaauacaugaaaauaugcugcuuauauacguacacuguuacugaguaguauuuuucucuuugggcauuuagguuucagucaugucaugaggugucuuaccccgugacauuccuccuuauagguacaaacaguaagaucuguuagaugcuugcuagagcauacugauccacuauauuugaagagcacaauuacaucuuccaaauacuaagauauucuuugccauaauaauaauaacuuccauuguuuucuagcuacuggcaucaggcacgacgccagguacuuuaaacucauuuucuguaaucaucucuacuuucagauaaaugugacugagugauaguaacucaccacuguuaucagcuaguaaaugucaggauucagauugagccaguuuuguccgccuuaagagcuuguacuauuuucucuacauuaugauaauuauacucguacacuuuuuugcuuuuuuauuuugaaauaauuaugagcucauagaacuugcaaaaauagaagagguccuuuguaccuauuacugaguuccccacaauaacuauaucccuuuaucaaaaccaggaaguggauuggcacaacuagacugaccauacuugaauuuuagcaguauuuuucccgcacucacuuuuugugugcuuuugugcacaguucuguagcauuugaucccagguaaccaccaucaauaaucaagacauggaacuguucugucaccacaaaagaacucgcucgugcugcccguuuagagucgcgcuaucccuccccucaaccucugcaaccacuucucuggguucccucucuacaauuuugucauuucaagcacauuauauaaaaggaaucauauaauaccuuaccuuuuaagauuggcauuucucagccaagugugguggcccacgccuguaaucccagcacucugggaggcugaggcagguggauggcuugagccucagaaguucgagaccagccugggccacauggugaaaccccaucucuacaaaaguacaaaaauuagccaggugcgauggcauguaccuguagucccagcuacuugggaggcugaggugagagggcuaccugagcccagggagguugaggcuguguugagaucacaccacugcacuucagccugggugauggagugagguccugucucaaaaaaaaaaaaaaagauuggcgauuuucauuccacgugaugcccuuaagauucuuccagguuccauguauccauaguucauucauuuuucuugcugagugguauuccaugguauggaugcucgcagccuuacacuuuuugaauuucuagauaacccaugagcugcauuuauauuuuaugaauaacugcuuauuuucuguauuguauuuuaauauaaaaggccaggagcaguggcucacacauguaaucccaauacuuugagaggccaaggcaggaggauugcuugagcccaggaguuugagaccagccuggacaacauagugagacccccccaccaucucuacaaaaaauacaaaauaauuaguugggcgugguggcaugcaucuguggucucagcuacucccagcuacucaggaggcugaugugggaggaucacucgagcccaggaguuugcgaccagccuggacaacauaguaagacucugucucuacaaaaaacuuuuaaaaaauuuggcugggcaugguggcucaugcuuauaauccuagaacuuugggaggccgaggcagguguauuaccugaggucagggguuugagaccagccuggccaacauggcaaaaccccgucucuacuaaaaauacaaaaauuagccaggcaugguggcacaugccuguaaucccagcuacuugggaggcugaggcaggagaauugcuugaacccaggagguggagguugcagugagcugagaucgugccacugcacuccagccugggugacagagugagacucaucuaaaaaaaaaaaaaaauuaaguguggcugguggugugugccuguggucucagcuacuuggaaggcugaggugggaggaucccuugagccugggacgucaaggcugcagugagccacuguacuccagccugagcaacagagcaagaacuuaucucuuaaaaaaaaaaaaaaaggggggaaagaaaagaaaaacuuuguagccccaaaagguuuuuaaggaacaaaaaaccaaauaacccuuaaaaauuuuuuuucuuuauuuuucaaacuuaucuaucacaauaugaaagaaaaguuuggauuaaaaaugguguagcccuucaugucuuugucccuguaaauagauauuucauguuauuguagucaccguguguguuguaugcugcuguuucccacuuaaacuuacuuuuccauguaccauaauuauuuuaaaaacuguauacuuguuccagcgaguugacuauaauuuuuucuacccuguuaucuaccucuagcuccauugaacaucuuccuucuguuaagugauagccauaaguucuuaguagcgaaauuauuggaucaaagaguaggacaauuuuuauggcacuuuuaauguguguuuucaggcauugccucgagucucaacccugcccuauacuuacuaaacaaguuauugaagcuuugaaaaacuuaggaaauggggauacuucaccuauauccuggagcgguugugaggauaaaaugagaugaugcgugcaaagccccuaauguaguaccuggcacagaagagagguauuuccuacauggcagcugcugugaugaucuccuggugaugauugugcuauuacuugacuaacaugauuccaucaugccagcagucuucuagaccacuugcacccagcguuggauagcaaaugauggagaagccuugcugugcauuaaggcccuucugcuuugggaaaugcacgcaugccagagacaagcaccauuuccagaugcguggucucuagugggggaauacauauguguaaauucgugguaacaaggcagagugaagcaagugguuaacagcagucggaaucaagugcuauggaacuucugaggaaaaagugaugaauucugccugaucuaauugggaagcaaggccucauuagaggugaugcuugcugagccaaggcgaaagucauggggacaauuuugguagcugggaaagacagaucauucuaggcaaagggaacacccugagcaaagcagguggcuugaucguagaugaagcaucugaagaaugaagaaguuuacuuaguuggagugcagaauaucgugggagagaaucccacagaaacaggcuggaagugauaucacggacguccuggaaauguguaccuaggaguuuagucuuuacuccagaggcagugcacaauggcaaauguuuggggaugcauuuugauugcauaauugacuguuuuaaugcuugcucugucaugugugaucuguaucauauuuuuguucauaaagugcuaaaagggccaagguaaaaucacucugaaagcauaugguuguuuuuauauguuuuuugauguuuuaauuauacugacagaaauacugacuacuguauuuuuguccauuacaggauucuucucuaauacuugauguuccucugggugugaucucgagaauugaaaaaaugggaggcgcgacaaguagaggagaaaauuccuauggucuagauauuacuuguaaaguaagagauucgauacuuucuuaugcaaagaacaaggcacguuaguguugaaugauaguagacaauuaauguggauuugaaaaaaaaaaaucaaaaucucauguucaucuaaggcccuggaaaugguucuucccuuaagaacaagcuuuucaaaagugccugggaaauagugcccacgugagggacccacugcaaucaccaaauacaaggacucgaggaacuggucaguuuguuagcuugacugagugggaagagaacuuuauagauaaaauuucuuaaaccacuuuaguuuuugcuccagcuugcuccuggcgccccuucaugucauauguuaacaugaaggaaggaggaauagaagagauuuugcccucuguuaacgggauguguccuuaccucuaauaaccuucguaacuuuugcuuaggucauuuucagagguacacuuugcugugauaguaaccauguauugaacauuuguguccauccaaacacaugcuaggugcuuugcauuugauccucaagugcaacccucugagauggcgugaugggagcccgaggcuccaaagaguuggguaacuuugcuaagauaauuucugaaggcugggacccaaaagguggggauguguucaagcgucucgugugacuaugaaccaccaguccagugcagggcuuugcagacuuuuucugugaagggcucaguagcaaauauuuuaggcuuugugggccacaucagauuucuguuguguauucuucucuguguguuguuuuuucaacccuuuugaaguguuaaaaaaaaaaaaaaacagucuuaauuugaagaccugggcugaaguuugcuggccccuggccaauccaagucguucauuguauugauagagaagugaggccuuugcugugugagauuacuugccuuguguugccuagggagccagcggaagagccagaaccaaaaacuaagucuccuuuuucuagucucauacacugcgauuucucaaaaccaacauugugugcuuauauuuggauuaugcugcaauaugguguuuuucuuuccguuuauaaaagaucaagacucguuuuuucuaucagaaacuaaaggauaaugccauuauuaaaucuuaacugaaauucaccacuaccauccaccucagcuuuuuuuuggugguguuuuaauucgagcuaccuuaaugcuuuaucuauuaucccagcuacugucuacccuuuggggccuagaaacaugggaauuuacuuugaaggaagacuuuuguauuuugcauaaaaggauuuaugggaguagaguguuuaauauuagagugcucaagggaaaaugggguugcuauauugacaguuuugaggugacuuucauucuuacaggguuuaaaaaaaccuauuuucugccuuauaauaggaaaaacuuguacuuaaauaucaauccccccaaaauuaaugagacaaagcacauuuucacccuugacuauuuacgaacaaaaggcguaggaacaacucaccaagcauaauucugaaauguuacauauguauauuuuuuggaguuagcaugagcccaaaggugauggcuuagaacaauguuguagcacaaccuuuuaacuaaauugucuccccagaaacacugacgucacagagucauauuccauuuucucaguaacaaaccugacauugauauaaaggaaaucugcuucggugagauaaaagacucacuguccugucucucauaggucaacuuucgccugcagucaauaaccaugauacaaccgcauuucucucuugaaacaaguaguuacaacuccuauaaauuuggcuaugccagcaaugcacauagagauuucugcuugccaguagcaacuuucccaugguagauacaagucccagaggauguuguccagcagcaggagaaagguaguucugaauaugcaaauucuuacccugcaggccccauaccaaccccuggugccuguguggagucuuucaaacaaaaaaaagugaaguaaaaccauaccaccacaaagccuucucuuuccuuccccaccucacucccauguacucgccuuaaagacauaguguggcauuuugaagucagcagucauguguguuguuucuuuagaaaugaugccucaauaaaucaacucuucagagucguugcagcagggauauguauucuucaacucuuacuguagugaggcuuggaacaucaccauaugacccggcuguuaaaaaggcugagggucugacuaggagacucuuagcccauguggaucuuucccugaugagucaaacucugaggagaccagguggaacuuaccaguuagucugugcuccuauuucuguuacagauuuggugaucugccgccugugagucauuugccuuuucuacuucaguuuuguuggcaagaaauaauauucugucuuuaauugcaucuuaaucagauggcaaaaagaaguuacuugaaucacuugugcuuuggcacauuaaaaguagcuguuugaaucacugauagaucagaauaaauauucauguagagauggucuaauuucuggccaagcagugaagagaacgauguuacagaguuaccaucugacuugcggcuguuaggaagaaaguuccucacagggccugagcccugagaaugcucagcucuccaguauugcacuuguggcuggucguaaacccuuguaaugcauaucaucccauugaaaugauuauuccccuuauuuaacuguucauuucaucacaaaccaauaaccaauagcccaauuuucuugggaggugauaugaauggguuguuggacuuuauucugugacaugcuuuuuaaaaaagcauggaaucguggagcuggcaaggccuaguagaugucaucuguauacagagugcucaaucucaaguucuuuauuaguggucucagacuuuaguucuucauacuucauuugcugcuauuuguguuugagaugucuugugaaggccauagccugugcugguccuucagacugaagacuugggaagcguuaagagugcucuugagauaaggaaggaaaaagcaccuugaaaaaaaaugaagacugugauauccaagagggcaacaacuaggucuguaccgcuccugaaguggcuccaugguccagcacagcacuccuuuaucugaaaugaaaguuuaaagugcacugcagagcauaggguuccaaugcagagccaucacucagucacagcacuguaauugacuuuuuuuuuuaagauacaaccuuaaaaaacuccagucuugaaaauaagauagaauguuacaucuguauauauaauacaaauugacauuuaaaggagcuuauuugguuuggauuugguuuaagacaaaguuuuccugcuuauugaacagauauguauuggaagcuaccuuuaaaaucugguuuugacuguuuauuuuuaguucccaaaaguguaguuacuacuaauaugggcuacuuuaauguggcuuauauggaacucugugaagguaaaauuguagaauaaaaauauaugacuugcaugagggcuuaaaaugucagucauuuaggaagagagcuucuguauuuuaaugacauguuugacaauguugagauuauauuugauagcagguacucuuuagaaaaguuguuugaauaaaauaguuuuauaauuaaaaaaaauaucagggccggaugugguggcuugacaccuguaauccuggcacuuugggaggccgaggcaggcagaucaccugaggucaggaguucgagaccagccuggccaacauggagaaaccccaucucuacuaaaaauacaaaaaauuagcugggcgugguggugcguucuguagucccagccacucaggaggcugaggcacgagaaucccuugaacccaggagguggagguugcagugagccgagaucaugccacuacacuccagccugggccacagagugagacuaugucucaaaaacuaaauuaaauaaaauaaauuuuaaaaaauuuaaaaauaccucagaacccagugaaaguagauggaucaucguagauguugugcaaggcaagguuugauuuuuuuuuccuuuuuauaaaaugaauuuuagcucugucuucuccuuagugcuaguugcuuuaucuugucuucacauucauggcuaugacggaaauauuuucagguguucuuaagccagauauaccaaauuaccauauaaaacaaagcaauuuuguaauaauuuagauuaauugcccuuuuagguaagugaaucuucucccuuaauugaauggaagauuucuugcuaauuaacaugacuuucuuugaagacugaacugucauacuucuccuuugcccccaggacaugagaaaccugagguucgcuuugaaacaggaaggccacagcagaagagauauguuugagauccucacgagauacgcguuuccccuggcucacagucugguaaauuccagugcucuccucagcgugggaagguucucagugccuccucugugaaaacugccugcaaacugggauccucuuucuuuuaaugucuguguuguguuucccagugugaugugucugcagagguguuuauuaaauaauuucaucauuuccagagggaacaggucucuccccugucagucaacuuuggagcuaaugagcaaugagugucaggcuuuuguggcuccaauuguaaaugggaacaaacucucugagccuaaaugccauuugaacaaauacagaugugugguguagguacugcaccaauagcugaauaggggcaguuuuauuuuugaaaagaauaaccuuucaaaugucauuugauagcauuuauuauguaauugucaggaccaauuuauuaugcauuuaauuaguuguaaucuaugacuuaguccaaaggugauucaguauauguaccuaaaacuuuuccuuccucuucaccaaacuacuggaguaaccuuacucuuacugcaugacugaaauaaggcuuucuaugaguuuugcuuguagaacaaucuuucuuuauauccugccucggccuugccuccuuuuuuacugccgugccuugcuugaaucuucuaaccccaguccuccuccucaguuugacuugaacuuagaugcaaauaccugcuaaggggagagugaaaaaauaauuauuuacaacauauacuguauaaaugccuuuaucuuaaguauaggaugaucauauugcagacuaaaccgaaggugauggaagggacccuuaaguagaagaggcauguguugaacgcagaugaaaauguaaugcuugggaacaaaugugcugaucucauaauugaaucuauuuucagccuuuucuaaguuucugauuaaauaugugauuuuuaaaaauaugucuauauuagaguuuuuaauucuauuaggauaaaaagagagucugaugggaacacaucuucuuaauuauuaugaaagugagaaugugagucuaauugaugaaaguucaauuaggaaauguguucugucuugauuuaugcauaucuggcccuaaauuaucagaaauugacagaauggcagguuugaaggagcugaagccccagucugucuccugcaagaucuugcuucaucagacauccccuuucucugguaucuucuguuucuucuaggguauacuccccuaaaaaagucaagugcuggaccagcuuuccccuuauacuacugucccaucuuucacuucauugccaaacuucuggaaagaauauucuagccuauccucgucuccagugcauucauuccuccaacccauuccaguauggagcucauuacuggccaaaucuaguggcucauuuccaucucauucuguuugaucucuuccccagcauucaacaauuuugaccaucgucuucuugaaagucuugguuucuguauuccugcaccaucuugauuguuccuuuccagucuccacuaccucugucuuuuccuuaaauguaaauaugucuucacucucaucccucuucucuucucaucuuauuaacuuugccuugaugguuucguuuaguuuaaagucgucacugcuauguagaugacuucuaaaucuaacccugauauuguccuugagugaguccaaugagucuaacccucaaauuccuuccucugggagucugagaaucaugagcucaucuggcgcaguggcucacgccuguaaucccagcacuuugggaggccgaggaggauggaucacuugaggucaggaguucgagaccauccuggccaacauggugaaacccuguccuacuaaaaauauaaaaauauuagcuggguguagugcugggcaccuguaaucccagcuacucaggagucugaggcaggacaaucgcuugaacccgggaggcagagguugcagugagcugagaucgugccauuguacuccagccugggugacaaaagcaaagcuccaucucaaaaaaaaaaaaaaaaaaaaaaaguagaaucacaaacuucuuguugcccugaccucuuugcaguucaugaaaccuaccuuucauccuauauguccugcaaguuugaggauccccaguuguuuagguuugauaacuugaagucagcuuuucaguucccccccugcuauuccucccauaggcacaucaauucugaauccuguaaguucuacuuaguagcaacacccagcuauuuccucucuuuucuacuuaugcuuccuaccuuaauccaugcuuccaaacuggcuuccuuucuuucaguuucuuccccuuccagcuaauccuacacaaugcugccaguuguuguuuguuuuguuuuuaaauaugaucauguuacuguaucauccucuaccccccaaaaaacaaacccccaguuacuuuucauagcuugugcccuacacugcagcugcacagggcugcccuaugcucuucuagcacacacaguacuuucuugguucagauuuugcuguccccuuuaccugcaguccccucgucucuugcuuacccaucuuccacacacuuagccuucaacaucuuaaucuguccuguguccuuuuccaggccauaugugugugcccccagugagaguucaucuuaccgcucaauuguuagucuuugcaaguuccucuaucagagcacuuaucucagugugccuuauggaauaauuuugucauaacuaccuccuaccucccccuaccacugccugauaaauuaugagcuuaucaaggcagggaucagccuuuauuucucucucuacugucagcacagugacaucugcaugggaguuuuguaaugauggcuuucuucuugaacucggguuaguagaaaggaaggaaaaaucacuauauggaaacaaaugagauggauguuucugaguauuacaaaucuaacaccaaaaccuagaaaucucuguugcuguuauuggagucauccacagagggcuugauuucucaagucugugguacuuggccauauuuuucauaccugugcugagaaucccugcuucuuguuuuaggaagucaauaaaguaagaaacugccaaaaaaaaaaaaaaaaaagucaacugaauugcucauaugaaguuuuggaaggugacauuaucuuagguuuuaaucacugaaagucauccuuaaaaaaaguuugccagucaccaauacaaugcaagauacagauugaaacagaucagcccuugacccugcuuuuggaauagcagucccugauauucaaguccacaugugcaacuguuucaucagucaaguucauuucaugucuuguguuggguggugucaggaugcagugggggcagucaaggauuuaguaguguguaggaugagugauaccuagucccauugagggaugugacagucaaacaguagugaugugacaaauauguuuagccccaacauaagauaguauacauucauuugugcaagagaaacgcaaaggaaauccacgggggacucacaggaagaagagaccacaucuaaccaaaauuggaaaggccuacauggaauugauaguuguuaguauagggccuugaagaauggauuuaauuuccagugaaggacuucugaggucuggggcuugagugaugaggguggggcacuguccacagaguagggaagucagaaaaagauuuuauuugcagaaacagguggaagaaaggggaagggggaggaacaaugaguucuguuuuggacacauagcauuucauguauuuugacagaauugacagcaagccacugaaggccugccccucaguaaagagucuagagauauagauuuggaauagugguucuuaagucauuugaaguuaugggcuccuuugagaauacgauguaaauuauaguuucuuuuccccucaaacaugcagucauguacaaaaccuuaccuaaaauuuuagaggacuucuggccccucugaagccccuuuguagggcccugguaaaguaauccugguauguaauagagaaguccugaaccagaaucuugggagaggccaucuuuuagggagugaagauaggaaaggagccagaaaacggaaugguuacagaggcgagggaagagccuggaaaggauuaacaggaugucaugggugucagugcugggagagcuggggagauggaucacaagcucccuagggaccugacccuaacugaccugcuuaaagucgggaccuccuuuuauuaucuuugcaacucuagugccuaguccagugccuggcauacguuuuuguuuuuugggguuuuuuuucuuuuugagccuuuauaaaucucagaaaaugaucucggggugacggggacaaacaccaguuugcagguguuuaaaggaagcauaguugguuuaaaaaagaguggcaggcauguugagggaagaaaguuuuuaccuuagaauuugaaaaaggaaaaugaauauauuuguggaaagaaaucuugccucuuuucaaggcaagagagagaagggaucuuuucuugagcaggauccugaagaaggcagagggggaugggauccagcccaguuuguggggcaguuugggaaaggagaagggaccauuauuucugugagacaggaggggaagaaaaguuuccaaacugucacaguggggaaugugggagugugccaaaaagggcuuuccuaggagguaacauaagccugauugccuugaacaauacaaagggccccugcuugaaaaagaucacuuuguuaauauuauuggaacuguucagccagcugcagauuaucuuagugauuuuuauuggcauuugaagucagaagugaacuugcuguugcaucuaugaaauggugucuggaggccaagcaagcuggguccugacuccggccaggucaugaauacaccaugagugggcuuuuucauuucagaccaccccuuuggcucucucuggccuccugucccauuaguauuuucaccacucaguguuuucaagucacgacuuaacacuuugaauugaacuugagcuguucagcaacagaguucaccccaaaccauuaacuucauuguuucuguguuaugucaaucugguaagaugcgcacuuuuuuuaguaacauuucuauuuuggccaaaaauagaaauuuauucauuuauuuucuuuuuaaaaaucuauuugcuuugcuuuucaaacacuagaaauuguacugaauucucauaaauugcaugaagcucaauacuaguucuagguaaaugauauauuuuaauaaaugucaguguuucugauaguauggcgauuuuuuuaaggcagaaauuaaaaucauguauaacugaacagagccugauagugcuacagaaagauaaagaguuugauuguuggggugauaaguucaauggcaaaguuguucuuuuguugauuuucuuuauuguuugcucauuuuuuacucagaugggauaaucagagauaauacacauauuagaugagaguuuuuuaaacugucaauccuaaccuauuaaugagucauaaaaucaauucacuagguugcagccagcauuuuaaaauagaauagaauagaauaagagcauaacauaauauggauaaguguggcuacgugaaacauuucucuccgguguauguguguauugggucaugguguugaagugcauugcuuaccguuaaucgugguccaaaaaguuugaaaaacaccauuuuagguaaugguagaauauguagaauaaacugcacuuuaaguuauuguaggcgugaauauagucacuuaaaucugccuuuauagcaguaggcgcacauggauuuucuugaauuuuaagugaagguuuagaguuuaugaauaaacuugugggauauagacucacacaaaggaaggcuagggcuagaagaaaugaagccugagaccugggugccaggcucauagcagccacugauggggagacccugugaggggacacguuugcagagccuuucuggugugugguaacaagcaugugccauuggaguccaguggucuaugucugaauccagcucagucacuuaccugcuuggugaccuuggaagucacauaauguuuaugugcuucuguguucucaucuguaauggagauaauaacagucucuaccccguugggguuuugugaggauuaaauguaaagugcuuacgacgcugccuggcacgcaguaaguacccaauaaaugucaguucuguucuuagugugccguuuucccagcagguguagagaauaaggaugacuacccagcacacuuuugcccaagacuauuaauaaaguaaucgugauaacauguggggcacuuuaagcucuuucaaagaaagaugcuauauauagauuaguauucuuauuaacaaaccauugguuguaccuugagaaaagacucuuugaaagucagagcauaauauccagaaagcaugugaccuagaagggugagauacggggggcagugauauguaugaaaagaauucuuuagaaaugguuuuccauguuuuucuuuccaucuuuugacccugcucaggcuuacugcuuuuagggaaacauggcucauucagguuuuuguuuuugcacuugccgcuuuccuuucacauucugcaugaagcucuuucgcaucaaaauauuucuguuauucugugaacugauuagcagucauauaguugcgaaauuuuuguuuucguguguguggugggagauauuugaccuucuuaugucagucagaaaagacacaggugagguaacuugcucuugguaacucuaauuucaggagagaagcagcuggguugcacagccuuugcuguggagaccagcagccuucugaggacugcugguguaguacauuagauugcaugcaaaggauggaagcaaggucuuccagacagcagcaccuuugugagcagggcucaucagcauuugcagguguuuguuacagccgccuuugguuuucauagucuuugcugcuuauuucuuuuugccuagcuuuggugaaccacaucaagcccugccguguggcuuaaacacuaccauaucuaccccauguccucucuugcucuacuccaguugugcuuacuuguaaaaagauuuucauaaaaguuaguagagugcguuauggagguauauaucuuuuaugaucauuugaaugacagguauaaaugauccuaugaauggagaauuaacauaggauuuuuuuguuauuguuguuuuuguuuuuugagacggagucuugcucugucacccaggcuggagugcaguggcaugaucucggcucacugcaaccuucgccuccccaguugaagcgcuucuccugccucagccuccugaguagcugggacuacaggugcucaccaccacgcccgacuaauuuuuguauuuuuaguagagacgggguuucaccauguuaagauggucucaaucucuugaccuugugauccgcccgccucagccucccaaagugcugggauuacaggugugagccacugcguccagccaacauaggauguuuuauuuugugccucagaaauguggaaauuuuuauaaauugcuuugcaauuuuaaacgaggcuuaaauuuaguggacccuuacuuucugggcugauuauggaauuaauagauaaaaagaaacaacucauuuucagagggacacugaaaugaaguacacacacacaugcuuuuagccuagauguggccuaaugacuaaaaguuaugucuuaguuaucuguuuccuuuuugggcaggacuguuuuuucuugaaucaacaguaaacuuggcaaauugacacacuaguuaugcuuuuaagucuccuuccuuccugccuccucuaagacuugguccucuauucucguugaucucucugucuccaccaccuucucccucucagccuugaaaugugcuugguucuucucccuauugccuguccucuggaacugacauuucaccuggucuccuguagcauuguugucuauggucagaagcguagaauuccccgcucgcauccauucacuccauaacucauugcaaucagucgucuagcccgcucacuggaguggaaugauucuucugaaaaugaccgaagacccuacaaguuagaaaacuugguagucuguuagaccauaugccuuucaacugcaccaucguuugacugucaacuaucccaccccuuccuugcaaaguggugcuuuuaaaauauugaguagauacaagaggauauuuauaaaauauguauaaaaucuaaagaaugcugauugauggaacuuuccuuugucucuccugagauguaagcuggguaauuucuucaguuuuaucuucuacuucggcugugccugaucugaguuuuuguuugcuaaaauuuccauuguuauguuuuuuuaauuauaaaaguucuauuugauuguuuuucagaucuguuuggccauuauuuauaaucucuucuucugugcucagauuucucauccucuuuuugacuuccgaaagcacauuaaauguaauuuauaauaugcaucugaugauuacaauacccgaagucuuuguggacuuuucuaccacagguguguguguuugcuggcucauggcacuuuguuucugaugugggugugucuugugauuauugccugcaaauuccucuuccuuggaaguuuaucugugggaauacucugagcauaugacugaaggcaauuuuaccaagagaggauuuguguuucuuucugccaggcaucuugaagcaugacugguuugggacgcuuaugaauuaaauucucagguuggauguuuuugggaccauccaaguuuugugaguuucguccacauacuacuuaagggcugacuugugacuacaaauuucuagugggggaugguggcagggauuuguuuccucccuugcuuagcaccaauaaucuagacaggaagguucucuugaaguccccaggugguccuuucccaugcauccuuccccugaguguagcacuugggagguuuccucauuuugguuuggccaggucuucaggcccuaucuccugugccccaagaggccaugaaaaccaguucuggaaguggccugaaagugaaagccaguguguuccucuugcugucugcauuccuguuugcaguuaguuuuuggcuucugaguaaaaaagucucuguuauauccagcauuuuuagguguuuucagcagaagucccauuaugguauaaagaccaucacauuugcagacaccucucccucuuuuuuuugaaaccuaacuuuccccauagcuucugagaucuaaguccucugccucucacuucuuuucuggcuccucugcauccuucuaccaucuagacauggguuuucuacaaaagucuguccuugcucugaauuaugcccugggcaaacucauguccacgaacagugccuuucuaagcauggcuuccaaauauaaagcauggcuuuauauuucccuguagcuguuauagaacuucaagcaacaccaaaagaucuguuuaaaaugacucucauaugccccagaaacccacuccucuguguucccaguuacucuuaaugauaucauuguccucuuguucauucaaauuugaacauucgaaaucaaggccaucagagguuuucauuucuuccuuuucuuguuuucuuuuuuuuuuuuugagacagggucuugcucugucacccaggguggagugcaguggugugaucacagcucaccgcagcccgcaggugcaugacucuacaccuggcuaauuuauuuuucuuuucuuuuagauggugucucacuguguugcccaggcugaccucaaacucuugacuucaagaaauccuacugccucugcccccuaaagugcugggauuacaggcaugagccaccauaccuggccccuguuucguagcauguacuaaauccaggggauucugccuccccagccugacuuaauucauaucuucaucuccucucuucuaaacuguuggaacauuguuaggaggucuuucuaccuccauucugucuccuaucccuugcccgcaaacuucaaccaguuccucccucucugucagugugaaggcagaccucugucucuuucacaguguggcccaccucucuccguuguuuguuauccgucuucacucaguggaguugaguguagacugagauguucgccaguggccauauauucucugaguuuggcugccauuugugccuuuuuguugucgucuuguccagaguugucuuauccuuccaggguaguucagauaccaacaacgucccuccaagccccaucugucaagaaguuaucugggcauucucugggccucauaguacuuucucucucccaccuguggcacuugcugcuauccucucuauaugcccuccucaucucucuccuuuggaugacuuccaacuccuuaaaaacagaggcugugucuuccuugccuuuuucuccacuucauaccuuguucauaguagagccucaguaaauguuuaucgagugaauauacuaauguaaacagagcgaauuaaucggaaucaguagcaaccaagacaucaaugagaauauucugcuuuuuagaaauagcauuuauucaauaaauauuuacuuuuuaauuuaaguuguaaauagguaauauauguucaugauugacaauucaggaacuguaaaaggguauacaggaaaaaaucucccucccggcacacuucagcuaccucauugcccuccucauagacaacccagguuucaguuuauugugucuccacccagugauaguuuaggccuauacacuuaacugauucacaugccuucccccuuaacccuaaugguagagagcuauauacacugucauguaccuauuuccauccaccaauagacauugcccagugaaugugcuucuccacccuaugaucuucauuccauguacuaccuuaauuccucauugccauauaugguaacguaacacagguuugagggauuaggacauggacaucuuugggaagacauucuucuucuuauuuuuuuaaacagagucuugcucuguugcccaggcuggagugcaguggcacaaucucagcucacugcaaccuccgccucccggguucaagcgauuuucgugccucagccucccaaguagcugagauuauagcgugggccaccacacccggcuaauuuuuauauuuuuaguagagaugggguuucgccauguuggccaggcugaucuugaaccccugaccucagaggugaucugcccuccucagccucccaacaugcugggauuacaggcaugaggcccagcccuggcugggaggucuuuauucugcuuaccauagcaacccaguauguuuucugaucuuuuaaucuuuuucaaucuaauaggugaaaauguagcuuccaguuuuauuuugcauuuaucuuguaugaguaaaauugaauaucuuuagguuugagcuauuuguauuugcauuucuccauucucuguaucuucuaccuauuuuuuguuuggauguuuggucuuuuucuuguuaguuguacguacuuuuuguguaauagcuauagugauguuuaauaugagugacuaauauuuuuccuguauguuuuuugacuuuaugauggauuuugcuauggagacuuguuuucuauuuauuugguagcauuugagagucuguguugaggggcucuaaaaccacccccacguguggugauucgauaacaggacucacuggacucauauuguacucacagguauggcuuauuacagcacaaggauacaaaacaaaaccagcaaagagaaaaggcacauagguugaaauucgggggaaaccaggcacaggcuuccagaguucuuguccaguggaaucaaacaggaugcacuuaauuccuccagcaaugaguugugcagcacauaugagauguugcccaccugggaaguucauuggagacuuuguguccacaguguuuauuggggcuggccauguaagcacccacugccuagcacaagcaaaauuccaggcuuccagaagaaaagcaggaguucaguguaaaccacauuguuuauacaaacaguuugggcacagugaaccaaucuuaccagugagggaauggugagaacucugcugaaauccagauuaccaagugucuggcaagggccaaccauguaugcaggccuuucuaaggagggcagccucaggccugccauguuaauucuucugcacacuuuucuuuuauagcuucugagcuuucuaucccaauuaggaagaucuucccuacucagacuucuaaggaauuaucucagccaggcguggugagucacgccuugcaaucccagcacuuugggaagucgaggcaggcagaucaccugaggucagggauucgagaccagccuggccaacauggugaaacccugucucuacuaaaaauacaaaaauuagcugggugugguggcacaugccuauaauuccagcuacucacgaggcugaggcacgagaauugcuugaaccugggaggcagaauuuguagugagccgagauugcuccacugcacuccagccggggcgacagaaugagugagacuccaucuccaaaaaaaaaaaaaaaaaaaaaaaaacaaauaaaauaaauuaucucauauuccucuaguaauuugguuucuuccuuaagauuuaaguauuucaucuauuuggaauuuauuuggaguuaaaguauaagauaugaauccaacucuuucuuccccucuuguugcaauaucauuuguugacuaguuugcugauuugaaguacuguccuuaucucacacuaaauuccucugcauguuugauuuuauuucuaagagguucucguugcauuaauuauucuauucaugcaccaggugugcucuuuuaacuauugaagcuguauaagauguugcacuguaugguagaacgagccuccccuuguuccucuucuuuuucuuuuccuuucuauuguugcuuaagcaauuacagaaugcuacauuauggcugugcucagggaucuagagcugauacccacuuccuguucccaaggagugcuguuuuccuggguaaugcaaacaaacagaugcauaugauacaguggugcacaggaugucacaggagcacaaaggagggcuuccuagaggauucagauucugcaagaugaguaggagcauuugucaggcagaaauugacaugucauacugaaggaacagucugugggcaugcaaagaggccgcacagaugcaggcugaacucacaugcaguuugguguccgggagcacagcgugcauguggggguaccaacaggagauagugcugggggcagaggaggcugggucaaagauugcagagccuaacauuccccacucagaaugucugcuuuuuaucugaaggugaagggagccauuuaaugguuuuaagcaggaacguggcaugauuaaauuuccauuucaaaaagauugcugggcugcagugugugcagaguagguggaggggacgggaguggaggagagaggaagaccauuucuggggauuuuugcuagucaccccaguccuugaugaugagggcuugaaguggggcaauggacagggacuccagaugaugcuuuugagaaagauucagaugguaaaaucaguagaauuuggugguugacugaauguaguuaugagggaggaugggaugauagggaagaauccacccuggauaaccagaccgaugguggggccagugguugagauggggaacauaggaggggagugaggaagagguggcaaguuccauuuugguuauguugaguugagagugucugugagacagccaggcagagauaccuaggagacagaugaccacauagauccagagcucuggccuggggagagcuuuauuugguacuccuggaucacauccacaucacaucacuagcauuuucauagauguggccaaaauugccaggagagagaacuacagugagaagagggacaauguaugaacccucagaaaucucagccuuaaaugauuaugauaguggacaaguuguaaagaauauucuuuuuuccaaaauaguuucaaaugacauuucaaauguacauuugugguccuuucgugaacaaauaaauagguacguuuauauaugaagacaaugaugacacaggaauaucaagccauuucccccagagguacugauuuagucaguaguagaaauaggauuaggagaacuguuuaugcaaacagaaguauaauugguaaucuaugugcuagcugcuuuugaccuguuaucuuuugucagguuuuuggaauaacugcgucaaaacugauauaaaugaacuuacugugucaagucgugugaaauauacagaaagcauuaucuagcauuagggcauuagaauuauaaacuuuaccacauaucaguacguccuaugguucuuuaaaauuuuaggcuuuccccuccaauuuuaaugaaagcauuuuuuucuuacaugaucaagucuuguuucuaaaguuuaaaagaugaaaaugagguaauuuuacauuacuguacccuuaaaugguagauggaagcuuuuuaaaaagaugagugucuuuaauuucagaaaucaaauucaaaaaaaaaaaaagcuagcuucaauuccuguucaaacguugcaaaauuuaauccagaaagaagcaguugggccagaugccguggcucacgccuguaagccaagcacuuugaaaggccaagguggguagauugccugagcucaggaguucaaggccagccugggcaacauggugaaacccugugucuacuaaaauacaaaaaaaaauuagcugggcguggugaugugugccuguagucccagcuacucuggaggcugaggcacgagaauugcuugaacccaggaggcggagguugcagugagccaagauggcaccacugcacuccagcgugggcgauagagccaggacucugucucaaaaacaaaaagaagcaguuaguaagugguucccugaaguuuuaaguuuagguauuuggagacauaggucauuaagagucaucuuccugaaaaaucacauucaucaguugugccauugggugcuguuaacaucauuugaaaacacuuuuaaauguucauaguuuaucaauuuauuccccugauuaugagcuggagagagccuaugacagugacagacagcuguccguccucaaaggaaacucaagaauuaacauuuauagauucuguuuaaauaaacaaaaaauccaaucuagauguuuuaaggaaaucagugcaucuuuauauaggugccauuuaaaaauaauggcuaauuaagugaaagcuaaaaucuguugucauuucagagacuuuacccccacaaguuacaaugauaaauguagcuaaauuaaaaugacaaguuauauucccuaugucagagcuguuuuuaucccuggugugaaaucagagaguuucaucucaaguuuguccuuuaacauuuuucaaauguuacauugugcuauuuuuaauccggaaacaaugcacaugauugcuuuaaaaaaaaaaagucuccauguacaguaucucuugacuaguacggaucuagugaauugugaauugaugaaaugcccaaauacuaauauagagcaaaauuaaggaagacaugacuugcucacuugaggaaggugaggguggccauuugagaguaucuucugucaguuuccugauuuugauauugugcuaaaaguuauacaagauguuaacaccuggagaggcuggcugaagauuuacuucuugugaaucuauaauuauuucaaaauaaucuaaaacaaacuaaaguagcuccccaacagcuugaccacacagaauccuuaggcuacauuccugagaguucugguacaucccacauggcccuucuaggaccaaggagguagaaagucacccccuagagauucugauucaguaggggugaggcagggcacagggcaugguuuagccucuggaaaaagcagcccacuucacccccaauucugaggcagagccguagauaaggaccacacccuagaagaaagccacguaggacuugcugaagcaucuacugaaaggugaugcucagcaaaacaucuucucuguccuaagacuuugcucaauugggacugaaucguucuugaauuuuccauagucgaugaaaucaguacuuggacguguucauugaguaagcuuuaucauuacccauuuagcaaacaagacgcgcuugaugguuauaguggaaaauacuugagagccagcucucuccaugugauuuagaguucccaaauuaagggucaaaauugacccaagguuauauuuaagaauaauaguugaaagugucaacacauuaauaaaguguuaaagaauacauugucuggaagagaaaguaaaugacagcuaaaaaccucaagacguauaaccuauucacuucagguuuuaacaauuuugaaauaggagcuuuaauuaggcuuguaacaaguuaccacuuguaggggauuuuaugcuuuuugauaaugagguacagaugaauguguuuuguuauugcuuuauuuuuguuuuuguaauaauccaacuuuauguuacucugagagccuauauucucuuaaucuuuaagaaaaaaagaaaauauaucugaaaaguagguccucguacuuucaaguucagaaaauggugguauuggcucuuucagacugcucacuucaauugagccaaguagcuuauggaaaacuuaguuuuuaaauaaaaacaccacauaaacacuaccuaguaaugcuuuuugaaaaauguuuuucuguguuuguaagcuaauuuauuugaauggugaaaauauugguuuaagcacccagucuuuucuacccuaagcuccaauuuaauauuagauguguugcuaugugcuucacgaggagaaauauuuggcuguugugcgauucauaauucuuccugaaauaucugggguccaagccuggcucuuagcaucaagaguaaacugggaguuguuuuugucaccaauucuaauagacauguuucggguuaaaggauaccaguuaguugacucauucuggauauuagucagaaugugaaguaucaucauagaagugaucucaucagagaguccaucugaugugugguuaccauggggacauugucucagucucauacuaaugacaaaaaaaaauugauguugcuucuguucagguucuuuuauaaaacauauuaaggaaguuagguagauaauuuuuguuuaggccauauagcuuugauuuucugauaacaauuuuauaaacuuagaaauuuucauguaagauacaggaauacuggaagcaaaaaaaagaaggugcuuuaaccuuagggauugaaaaaauaguaauuuagguugaaaaugcugcuugaaaguuaaugcugauagcauuacuacacaugaugauuuuuucuggaaggaaagcuuuaucugggccuucaauuuaggaauuuuucucuuugguuuuuaaaagcugccauauucacuugagcuucaugggaaagaugcaaauaacuaaaacaaaugaacaaaaaccauguugaggucaggaacuuauuucaagaaagcaaguucuagguuuucuuuuaaagugacaguagagccuuaggccucaaaccaucuacaaccauguuaacaguacaucacucaaaucauucaacauuccugaauguuuaccugugccaaguacugaccagcgcaguaucagauguucacaguaaugauauauugccaagagaaugcuuaggcaugucccauauauucuguuuauggauaaaggagugcaccaaacauuuuagugcuauuuucgcccaaagucccucugucuuuaauuuaaacuuaacagaaaucacuuauuuuucccagugguacugaauaauuaugcauugcuguggauucagugucagguuaaagccucagugcaucgcuuagcuaggucagcaucauuaccagugugugcuuaucaugccagccauccagaauaaacagcacuugggccuagcgcugccagaguugagaccugcagagugugcugcaugccugggaaaguuugagaagacauuguggagagcauguucuugggcaguuuucaccuuaaaccucuugccauucacaugcagaaaacuguugcugcugaaagaugcuuuuccagaaauacacuguguuguaggggagggaacacugguguucaaagugauuagucugaugacagaggaaaaugguuggggagggagcuacauagaggaaaagugcccagacgcagcgccuccagagaagaugguuguacaggggcugugugggccuucaugucuucauucggucagcgagccuguguucugccucccucugaccaggcgccauuguaguuacuggggauaaaggaugggaaugaagcaaguguguacuuucauggagcccauguccuaggggaggggauaguacauauguacagugaacaaguacauauguaauaugucaaauggucauaagugauagggaaaaucagaugggaauagggagugcuguugugaggguaacauguuuuuuuguagggugucggagaaggucuuacugauuaagauuauuggaucagagaugugagagaagacaagaagccaugagguaaacgaauuccaggcagauggaauaguagccgcaaaggcccugagaguggcaugugcuuggugccuuuagggaguggcacaggaggcaggugugacuuacguggagcgagugagucugagagcagagauguggcgggggagauggccagauggcagacagcugcauaagccauuggaaggacuuccaccuuuacuccucgcaaaguggaaagcuacgggaggauuuggggcaaggaaaggacuugaucugaccuaugacacugucacucugacuugagaaguacaaagaugaaagcaggggagcaguuagguuuuuauaaucaaccaaguaagagaugaugguggcuuggaccugggugguagccacguggugacaaagaugaauccaagguuuucagcucaaucagcuggaagucauguacugaaauggggagacugugggaagagcaggacuggguagggggagccaagaguguuuggcuuugguuguguuaacuugagaguucuucagaugccucuuaggcagucugguggggugguagaguggacacuuggauagccaagucuggaauucagaggggaugcuggagaaugauagguccuuacuagucacuagaguauggaugguauuugaagcuaucaaauguaucaacagcacguugagggugaguauauauagagaagaggugagaggucugaguccugccauuucacagaaaccagggcauugauucagaauucacagagaacaguuagcucagaguuuucuuaauauccuaucuuuuuaaaaaauaaacaugucauuguucccuuuugagacaguugcaccguuuaacaauaauuccugaauuuuauuuuucuuccuuuccuucuuucuuuuuaguggcuuguaccugaucaauugcuaauacuguuuaaaauugauaggcacuuuuuggucugguaaucugauuuuuuuguggaacaucauuaaaagaacaauugagagauuuauagccauagaaaauugaggcuucuauuacucaagauagaaguuagcguaagucugaucugaguuuuccacuguuuuuuuuuguuguuguuguuauaagccuugguguggguuguaauuucauggucggcaaaucuggugaaauuuauuuugcgagaaaucaaaagauguacuauaauaguagacuguuccuucacgcugaacuuuauuuauuuuuugccuuuucuagccauuauuugcauuuuuaaaugaagaaaaguuuaacguggauggauggacaguuuacaauccaguggaagaauacaggaggcagguaagauguuagaugcuauugucugguaugugaugaaccugaaacaugcauuaugacaguaugucaucagccaugcuuucugaaaaucagcgacauccuugcuaaauaucuuuucaaugguggugauauuauccacauuuuguacaauauaucucauucuaucuauuacuguauaacuuauaagcucauuccauugccauaugcaagcugcaucgaagacugggucacuaaauccuauuuccuucccuauaugaagagcaucaauucuguguuguuuaugaaaugaauuaaauacuuaggauuuagaaaagucaaacauuuuagaaguuacacuuuaggacuugauauugcuauguauaugcauguuugggagcuuaacuauuaccugcaguuagauuuaaauuauauucauuucaguuugcagauucaaaugaauuagaacuguuuuccuguagugaugucuuuuucaaggaagcuuugauaaguguacauuauaauugucuuuacuguucucuuauaugaaugucaccuacaugcauguuuauuugcuauaauaaaggcaagaggcuuggucucauauugcuguucaggaacaaaagucucuugcaguauuuuuguuaagggaauucugugcauaauauguaacaagagccacaguuugaccucugguauaaccaaaucuguaggcagcuaggaguugugugaugggauuauucacaauucuuguucuacaaagcucuuaagauaauugaaaaguuuuguugaaugagauuugagaaucagaucaaacccauuugcuuuauaugaaaagguagugaauauaaaguaaaaucguagaacccuagacuugagaagaaccaucuagucaccaccuucaccaugaaaaaccuggauugguuuccuuuuuuagucuuaaucaacgguuugcauauucaugaacagauuugacgcucuggaauuugggugcaggaguuuagcuuuagaacauaugugacauaguauauccuguugcuuccauaagucacguuuagacuguugaguuuucuaaggcuuugcacuacucccauuuuaauggccucaguucuggacuagcuacugaggcggaagaaggaccaugaaaacauuuugcauguuuuggagaccucuguaaaugauguauuaaaauauuuuuaccuucuuuuugaaguauuacugauaacauuaagacuuuuuuuuaguucaaagcuucuagcuugaaacaaaacaguuccuguuuuuaagauugcaugcauauaugaacuguugaagguauuuuguucuagacugccauuauauucaaucuuuuuuucuuauaacuuucugaugggacuuauaacugucuaauuggacucagcaucagacucaacaucuguuugguccguggucucuagggccagaccuaaagaaaagguacaaugucuguccccaaagcaaacacccacauagcucacuuuuguguguguaucugugcauuugugagaauggggagagaauauuccaccaccucuggaucuuuuccauacuaaauacaauuuugugggggagaugauaggaugggaggugucuucugugucucccugucacauuagcagucugcuuaaaaugcaaaugacuguauuucucacacaaacuauagggcaaucaucgauuccgaacaacuugauugaaaaaaaacucaucggagguggcgaaaugagccuccccagagggaucuuccuuuacuuccccucaugauuuucuucaugagcucagccucuuuccacuuuggagcagacugaagcauucacucuauuuugagcagggagaggaaguugccugaucucuuuucuacccucaguuagagccagauuaagaugaagcaggguauuuuuuuaggggaugggaggggugcaugggcgggggaugaacuuggguuuaucugugugguacagguaguaaagaauauguggacacaaaauaaaggaagacgaauuccuuugaauucaagagaaucuguauuuacaaaguauaguuuagaacuguaaaaaccaccaguguuuugucuuguguucuuacguugucuggauuauugauuuggcacccuuauuauaaauagguagaccgucaucacccuguggucaaagaggcaugugcacauauugcuagaaggaagaaaagaggcccaaggccaaauccagagaugaggucaagcaauacugacuugaauuucuuuuuuuccucacagggcuugcccaaucaccauuggagaauaacuuuuauuaauaagugcuaugagcucugugacacuuacccugcucuuuuggugguuccguaucgugccucagaugaugaccuccggagaguugcaacuuuuaggucccgaaaucgaauuccagugaguacugcaauuaacguuucucuugaagagcaccuuuuaguccauaagaaugguagucauauaacuuagagaaacgguccuuuuggaauucuaucccaaaaaauacuuacuaagugcuuugugaguacaaaguaccauaccagacuggagaagaagugugccgucaccugccuucuaggagcuugcaacuaaggaucaagaaugaacgcaaguaaagagcucucuacgagagaggggcugcaaguaaugggaaccaagugcuguguggaaggaagcaaggaaagacaggcucuuuguggcuuuugucuuuguggcacaguacaugauacuauaugauaggcucuugauaaaugucagauaaaucaugcuggaaagaacacacugucuuguuauaaaaugugucagcacagacuuugacauacacucaccacgagcucacccccaucaccuuugcaggcugccccaauaccauugucuaacuggagucaaguauagauuauuccagacacuauccauacgguaucacugcaccuaguucacaaagcucucuuuugguccuuaaauauuaauggacaugugauacuaucuaacauugacaaaaauugacuaaaaauuuagguauucuccccugcuaauuuucagggucugucauaaguaccuugggguuuuuuuuuuccccuaauaaguaaauguuuaaaaacaaagguugaagaaauuaagacuuaaugucaccuugccuuuuucaagucuagacauuuuuuuuccuuaaaaggauauuugugcaaaacuuuuguauugucagccuaauaugaauuguaauuuuuuuuaauucacuuguuauacacuucuagccauaaaaccgcagaagugaugcuguguucucagugcaccaccuuaggagacaugcuguugauuugucccguuauuagugauguuaacugugauuauucugcuaaggcagugucugucauguuuuuccacuauagcacuacuauuuuacccauuaaaauuaauaaaugcuuuauguaaugauuuuuuuaauucacuugcuucuccaguuaguagugucuguucauaucuucgcgauauaaauuguacuugaaaguauguucuuuagcucauguuguuagaacaugaugcuaaugaagcuaggguuacaaguucagucuuccugugcucuguuuggacaugcucuucuguaccauagccacagacuacaccccuacccuggcuggcugucugucuugcuaaugcaugccuugcucacaaggacaacugggcuaggguagccuggcucaguuuuguucauguauucauucaguucauauuuauugagcaucuaccgugucauuuguguaugugggugaauucuaugggauuugaaacagagaaaauugaacaacugugcccuuucuaccaugcuugguugccaucuugauccaguaguccccauuauucugaaugaaugagugucuacuguagagcagauagaauuucuuaacuuuuuauuuagucauguuauugauccuucuuacuuuaucauggccaccaauuuguauuuauuuuuucuaaaauggcuuuuauagggaagacuaaguuccccaucaccucuacauauuuauagauuuacuauuagguacuauuaagcgugguaauauguucuuugcaguaugcuuucuaaccacccggcuguuggcuaagucucagagcuuugcuuccacccagaaaacauaugugccuuuaaugugaaaucauuaauaucugauaguugguucuuuuuauaaaaccucauguaaaaauacaaaaggaagugacaugaaagagaucuuauuuugcauguaaauaagauauaaacuauaauaaaauauugcuggguagagaaauaaucaaugugcauuaaauguuuccauuaauggauauguauucucuuauucucaaacagauuucucuuaauuuuaugagucuuuaauguaugaguaaugcacguucauuuuaagcauuauaaaaaauacugauaagcaaaaaggagucugccaccuagugagaaccaguguuaacacuguugguauauauccuuucagacuuccuucuaagcauauaucuacacacacacacacauauguauauauauuugaaaaaagugaaauuauucuauaauuugugucucagucuauagaaauuauucuauaauuugugucuuuaucuagcaauaucuuguaaacaacuucccauguugcuaaauaugauccgcucauaugccaguguguagauguaccaugauuuaaucaguuuuccauugugagacauucagcuucugcuuaaucuuuugcuauuguaaguaaugcuguaauaaacaucuuucagugguuagauauuuguguacuuaauuaucuauggcuucuagauaugaauuuuaauaagaauaauacagugccauauacuguaaaagcacucaugguaguugacacugugaaaugaacauuauuuguaccuguuuagcucuguaauaagcauccuuuucaaaaaguaguaagaauccccccuccugcaaagaaauuaagaggagaaacaacucagaggaguagcauuuccuaacauggcaccacaaagagaauaggggucgggaggccauugccuauggcccgacugaaauuuacaacuugaugagggucuuucucaauaauaaauaauuuuuauuuuuaauaauuucucaaauuauuaaaauaauaaaaaauauuaaaaaauauuuuaauaauuucucaaauaauaaaucuuuuaaauguguagcaaauugcuccuuuaaaguggucucaugucucuugucucucuugauaccagggccauagagggaaaggaaggcagaucucauaugugcugugcauuauagauuggaagguggagguuuaggucccacugguaccuucuccaaggcucccaguucugagccuuuggacucuuauuaggcaggggcuacaaugguguuuuuaauugaucucuagcauggugcaaggaccauauuuguucugagaaugaauaaauauuacuguauaaucuuuucucaauaaccuguugucauuauaaacacucauuuuuauaaacaucaauguuugucauuugccaucaugggguagguaacuucagagacaucagggaauuugguguuauguugagugagcccacaugauuaagcuucuuucguucuuuguaucugcauuuuguaguuuuugcuaacugacuuuccuggcugcugggccugccucuauaagcuaacacgagccaguguuuauugcagacuuucugggcauucuucuucaggccaccgagcaacccuaugagauuauauuauucuccccauuuuauggaagaggaaagggaagccagagaagcugcgagugaaaugccugagguuagaaccacggcagagauggcacuagaccccaaaguccacauugucgcccacugugcugcaguucuccagcuucccauuuuuaauagcuuuauugagaucuacuucacauaccaaacaauuucccaucucaaguguacaauucugucguuuuugguauauuacauuauuagcuaccuuuuacguguauuacuuuucacaugcuaugagcuuggcaaccagggagcaaaugugcuagacuuguguauaaaguuagagaagauagguucugaaucagggcuugaugaggucuccuaggcauuggauguccacacugcacuguggagacgagcagaucuaugcucuuugggcuguccugagaucaguuuugcucugcucagguuuucuuccuuccuguguuagauucuagaauugagacuguugggaaaaugaucuguagacagaguugguauuaugagaaacauauuguaccagagacaauuuccuuuaccucucacuuuuugccaaagcugcuucuauaugauaacaaauccagugcaagcuacauaauuaaaauaggaucaagcuuucaauuuccuuuaagugauauaacuauuuuuagguaagcaauuaauuuauauuggauguggugcuaauuaagaaaagacugguaauuguacuuguuucugaguuauauuauuaaaugcaugucucugggcacacacacgcagugagauugcaagugaacaaguauucuauuuuagcacaaucagauucacuucuugauaaccgucagugcuuuacuguuuuacaguuuuaauuguuugcuuggagauuugcuuucuugauagcuuaaacuuucugacuuaaccauaggugcugucauggauucauccagaaaauaagacggucauugugcguugcagucagccucuugucgguaugagugggaaacgaaauaaagaugaugagaaauaucucgauguuaucagggagacuaauaaacaaauuucuaaacucaccauuuaugaugcaagacccagcguaaaugcaguggccaacaaggugaguggacuuaaugaugugcuggacacuuagcuuacauauggagugcaguguuuucugugaauguuuuugccaugauauagaaacacguggguuuaaauuaauaguuaagaaaaccaguucucuuagacagaaaguaguuuuaaucacaaaacuuaaacaaaauugaauauaucaaaaucaaaugcaaauaaacuuuagguaaauaggcaugucuagacuguaaugaaauuggguuuuggccaggaccuuggcaggaaaaaguuagauucucuuuaaagcccuuucagcuguggaugaucacucauuguguacacuauuggggcaucuguaagaagcuaugggaagcuguaauuauuaaaauacuaaauuugcaugcuuacucaaacacucccucccccauacccguauauacucacauauguguauucucauuuacauaagauaauucaagaaaugaguagguccacguaugugaguuuuccaggcacaaacauauacacaaaguugaccguuuucaaagaagucugucucaauugacuuuuugcuguaagcagaauaugcugaaugcacuuaaaauugauuagggucaucaugaacaucagugacugcauaguguugccuucagaagcugcugcaagguguauggcuguuugcuugcucuacuaaauggccccagauugaugugcauuuuacguucuauuucuccuuuuuguuguuuuucuuuuccuucuccucccaucauugcugucacuuucaaaugcucacgaggggccugccccaaauugcucacucccauuccagcuuucagauuuauuguuucuccucugcuguaagcuuaaauuucaucauauuuaauacauugcuuauccugagguuauuugucuagcaucuucaauuauucagaacauaagacaagaaccagaaagcaaaacaaguucuugagcagcucagauaggugcagcagcuuccuaauagaaucugugauaucugucuggacuaggaugugucagacugcaugcaugcagagcucaacucuucauuauuugugcacagaucuucuguccuacacauuuaauccugggccaccuccccauccccaugcaugcuuuuaaaccagcuauuuguuacuacgguuguuuuuugguccagagaugauuuugaaauuauaugugaagcagucaguaaguuaaauugacaaguaaauuaggaaucguaagugaaacacucaggaaauuaaaucuaacucuaaauaucuucuuggauuguccuuaauuuuauauaucuguguaccuauuaucuuucauauauauuucagggugaauauauauauauauauauauauauauagcaauauuuucauguacauauuuagccugaaauagauaugauauagcauuacaaugaaguauuuacaaagaauauuuuagaauauuaaaaugcaugaaauggauacacuaauuaaagcucauuccagcaacagaauuccugaaggccuuuuuaacacucaggaaacaagcuucuauuucuaguccucuuaggagucgagggaaggaaaauaucagggaaaaagccuaagcuuuacagaucucugucauucuuuuaaaaagcucacuuguuucucccuuccucugcugugucucuccgcuagucgcuaauauccauagcaacaggcccguagaccuuuacaucaucguccuagguaaucuacauuguucuuuuuuguugaagaaaggaaaaccaaaaagaauacuucaaaaguaaccagagauguagaauuugaacuuucaggaacucagugugugcuugacuaauugauuguugcccuuucugaccuucuguucuccuuggaccuaauuguuccucccuuacggauauuuagaaauuuacauccccagaugcaacaagcaacggcacaucauuuuaaauuaaacaaaauccaaggauugguaagaucuagcagcaagccgcuucuauuuuuguggcgguacaucgugaugaauuaauguggaacugugcuaaugucuguuuuuaccagaaacauuagcgaugaguaauaaaguauauuuuuccuuuuauuuuuucacuuauuuucaguuauuuaugaagagaacucuaguuucaagaaucucuuugaaaaucaccauaacuauuuaaaaaccacauguguagagaagcaggaagaggagaaaguggcccacuuaaauaauaaauugcuuauuuauuagcuaauaacuuuuuuaaaacaacacugugaauguuuacugucuacuuaccagugauacuauuuagagcacgcucuaaagaaauauuucugccuaacuauauuuucuugccuagagucuuuagagaccaagaucucuggcuuuuaacauaggucuccaaguuugaaaccuaaauggaugguagccuuacuucugcaggaaaccuuuuucugugacuaccuccaggaaaaaacaaaaacaaaaaacaaaaaaaaaccuaaguuucuuuggcccuucuauccauggcuacaagcuuauauuccuuccauuguuguuaauaaagagaaaauaggcauauuguagcuauggcacauuugucuggugacuucuccuuuccucuucagccccaggcagauguuucccuguucuguuccuacaggcacucuggaguuaguauaauauuguuuucuuugcaagucucagaacuguuuaacuuuuucuuaaagggccaaaggccacguguucuaugccauuucaaaacguuuaagcagaaugcagccagauuccuaaaugaaaccauagcaucucuuuuugucaguguggaaaaugggcacucuucaccaugcugugaagaugaaccaaagccugcccuggcaaguuaauacuuguaguugcugcaguaggcgguagccaucuugucuccucuugaaaucuucuauucuuucagagcucacuaugugcagugcucucucauugguguuugcauagcagagaaauagucaugguuuaguagaaaaaguucgagcuuugaagccagacuuagacuuaaauuccacuuauuaccuaugugacuuaggggauaguuaacuagcgucucugaguuucuguuuucucauuggcaaaauggggacaguaauaccuaucuugcagcacugcugaagagagaaaauuauguaaagcaagagucacaguaccugggaugucauaggaguucauuaaacaguggcuggcauuagcuauuauaauagagugugguuccuuuaauaguaugagaccuagguaauauuauccccuauuuuacaggagaggauguugaggcucagaaauguuaagugccuugucccagaucacauggcaaggagaagcugaagcugagcuaucucagccugggucugucuccaaagccuguuguuuuccucuaaugcaucacguccuacgugagugcuguuacagugccagaggugccugcugcugccucagucuggcugccucccgccuucccccugaagaguacuauuagagauacaaaacuaauggagaacgaggaccuuucacaaccugcuuuugccuuuccagauccggaagaagagcuauuaauuauagagcauuuugaggaugauuuuuuuccuuaggaauacagauuccccaggaaauugccagccuucugucuuuuuuucaacucaaaguaugacuaauguuuuugagacuuguuguuggcuaggaagucaagucacaucaauuauucauuuaaauuggaggguuugggguuauuuggaggacaaauaacuagaaauauuuguguaaguuucugaugaaauagaaaacucaacugauuguuuguauuucauguuguuucuuaggcaacaggaggaggauaugaaagugaugaugcauaucauaacgccgaacuuuucuucuuagacauucauaauauucauguuaugcgggaaucuuuaaaaaaagugaaggacauuguuuauccuaauguagaagaaucucauugguuguccaguuuggagucuacucauugguuagaacauaucaaggcaaguauauuuugugaaaauauuuguguauauaaaaaagaauguaauuguuuaguggaauggacauauuuuuaaauuccuuaaaaaaauggacauugagagauaaacuuuguaguagaggaccacauuuaacaguuuuauguugcuuuauaauuugcuuaccuaaauuaaagauuucacaucaucacuccagaauauauuuagaguuugcaaagacaucucuuuccaucuuucaguauuaagucguucagucuuucaugcagguuuauuuaggaauagccaauuuauuaucuaaccauuacuggauaugaccucuuuggaccuagauaagaggugguuaguuuuguuuuuuuuguuguuuuuuguuuuuuuuuguuuuuugaaacuaaucucaaaugacuuauuuuaaagaauugguuuuguguuuuauuauguucaauccuuuauccugauaaaggcagcaauaauccuccacuuuuuaaaaaguacuugaagugaucugagggaacuaacacuuuuagaaaccauuuaguucuguacacaaacaaaaagucagcuuuaauguauaggugaauuauuaagauauauucucuagucaaauuuuguuuuccaacuuacccuucaucugcaagugguggcaugcucuucucagcuagcgaggcucacccucuuggugucauccuacauuucuuuagcuccugcacugagcuaaucaucaaguaccacaggcccuuccuuggaaacaugucugucacucucauaguccccucacccccacacuggcagcauucaaacuaggccauuacuaccccuaucuuugcacucuuaaaaugguucuguuuucucuuccuucccucucguaucuauucuauaagcagcugacagaacauuuuccuaaaauauccugcuauuccaaaaccucugggggcucccaacagccuaaccugacagccacaccccuguucaucuggcuucugcagguuuguagauuaaccugcaacuacagaaauccuuacucuuccuaauuccaucucacuuaugccuguuucugggccuuugucuagguuguccucuuucucuagaauggauucccccauccuuccacuuucuucaaggaccagaucaaaucccaccgaaucucaaagggaauguuccuuccacugacuuugcuauacauuaugucucuuuuuacacauaccuaucaucucuucaaucauaugugaaccuccuuaaagucuuauaccauuuucccauucacaaggucuaacauaaaaaccaaaauaaaacuuuuuauuuuacaauaguuuucaauuuacagaaaaauuguaaaagugcuauagaaaguucccauauacccaaccgaguuuuucuucuuauugacgucuuacacugcucauaacuauggcaugucacauuguacaguauacuagucacaacuaaugagccaauauuuauacauuauuaacuuauuauuaauaaaguucauacuuuauuuggauuuccuuagcuuuuaccuaauguccuuuuucuguuuaaggaucccauccagguaucacauuauauuuaguugucacaauuagguuguuuuuuuuuuuuuuuuuuuuaacaauucauuggugaggaugacaaauucauaaaaaaaugaaaggcaaaauaaaaauaagauuugauugggaccuuggucaagagaaacaccaugcauuugggguagugaugggccguccaccugguggugucuagcaggcaggcuuucugcaaaguagaacccaaaauagagacuuaacacagagauguugguuuggcagucagcuauugggcaacaaacgcaagcaaagcccuuuaauguagauucugagagaggauguguggggaaaagaucagaggacuuugaguggagcuuugggccuguuuguauucagggcaggaggugagaaguggagcucagugaaggaggcauaccagagaaauggacaucaaaggaggauauuggaagguaaagaaagggucuuaagaagaaagggucagugguacuugaaggagguuuauuagcgagguccuuuaugaccuugggggugucuagugauguggugggugugagugagaaaauagagguaaugaauaucaacuguucuuuuaauaagagagagaguuaaggaagggggaaguguugaggaucauaugacuaugagaagggcuuuucaagucaugggaagcuucagccuguuuuguagacaaagagaaaagauuuacuucaggaauuuuuuuaagggaaauaaucacacaggucugaaaauaugaauauacuagaaugcuuaugauaguggaaaaacagagccagcaugguggcucaugccuguagucccagugcuuugggaggucaaagugggaggaucgcuugagcccaggaguuugagaccacccugggcaacguagugagacccugcuucuuacaaaaaacucagacaaacaaacaaaaagacaaaaaauaguuguaguugugcacaacuguagucccagcuacucaggaggcagaggcaggaagauuguuugagcccaggaauuuucaggcugcagugaccuauuaauaugauuguaccacugcauuccagccugggugacagaacaaggccccaucucuuuaaaaaaaaaguggaaaagcauuggaaagaaccuaaauguacaagaaaaguuauauauauauacauauauauauacauauauauacauauauauacguguguguguguauauauauauacacacacacacacacacacacacacacacacacacauacauacagaauuuagaaagguauccaccaauaugugaauaauuauuauuucugaguaauagggcuauguuuucuccauuuuuuuccagggaauauauauuuucuaaauaagaagaaaagcuuuuuuuuaaaagagagagcacagguacaggaguuauuggcaagguggcucagcugcuacucugagcuagauagaaggaagagagacugggugagaguaggucuuguucaauggcucagaugucugaggaaguuaggagguaaggccaucugcaaaagaugaaguauggaaguuagcacuuaaggaaugugggaaauguuuuaagagaccucucuaagguuuuauaguuuugucuauagcaaaggggauaugaaagaaaugaaagaaacugucauuguucuguacagaagccaaaggaguuaccaggagacuggggagucuagguggacacuuguaaugauaucugacucagggcuucucaggcaucagucacaucauagcaauucagacagugaagcagaguuguggauagccuugaguuggaccuugaauacugguuggaacgaggggaaauccauuccccgccucuuccagcuucuuguaggcauaucauuccauccucugccucuguggucacauugccuuccccucuucugucuguaugaaaucucccucugccucucucuuaucaggauuugugugauguaauuuagggcccaccuggauaauccggaauaaucugucuucucaaaaucacuaaguugaucacaucugcaaagucccuauuaccaugugagguaguauacacagguuccagggauuaggacguggacaucuuuggugaccauuauucagccuucuauacuaucuuauagcccugggucugcugacagguggcauggccaucacuaaccuguaaucuggugaaauggugucaccauucaauguaugaaagcggggcaagccuuuugcaaugagaaaaucaccauccuuagcaugccucucaaaucaucauuccaguucacugacagccccagcaggguggaagaaggacucuguagugucuggagcuuguauuuccucuuuguccuuuucaauacaauacucuuccccuauaguccugcuucuuuuaaaguaucauauuguuuuggccuucuuggauggcagcuagcccucauugagccuaugcucaaugugagcacuuuauggggagcaucuuuuaguccaagacaagcuaguggggacauggcucauuucuucacaguagagagagagaaaccaugguuacucaauuggcccaaagcacgagauaucaaaaguggaaugagguuucaggcccaggucuucugccauagagccagugcucuuaacuaccgugauguauacugcuugauggcugucauuucuuucaucagucacaaguccaucagauuauuuaaguguuuuuaaaacucugguauaguuuuauuagauaauuauagcuguuucugucagaagugaucgugggaauuaauacuuaauuggaacacagcuaacauuuuugaaaauaauuggcugagauugaguccuuuuuauauuauaagugagggaaguaucucgagugagaguugcccucuguaaaaaugcauuagaaccccaacuucauuaaauuggacucaagugaucuaguauauuaccauugcuucucaacagcccuuucuucagaaguacuucaaaugaaaauuguaaacaggauuucaaggagaauacuuaaaaugcuugaagaaauaaacggcucuagucauuuuaggaguaauggauuuuguacaacuaauugauguacauccuuaggucccuuaaccuuuccuucuuggcacuacuuuauccacuuaucuuuaguuacauuguauauguaaaacuaaugaaguuacauuucuuuauuuuuauuuuuguagauucaagggguaaauguacagguaugucacauagauauugcauaguaagguuugggcuucuaguuuacccaucacccgaauagugagcaugguauccaguagguaauuuuucaacccuaauacaucagaucuuucacuuggucugccuuuucugugaauuaguuaaaauaagcgaauuuccauuuccuugaauuggguaaaaugacuauaauacaugucuguugcauggcuguuagaauuuggaagcuccguggaagaaaucuuuuaaaaaccaacccaaaauuacauaauauauacaaauuguugauacgcaugugaaaagauggaacucucauacauuguuucugggaaugugaaaugguacaaccacuuuugaaaauaguuuggcaguuucuuuaaaaaauuaaacauauggccaggcacaguggcucacacguguaaucccagcacuuugggaggccgaggcgggaggaucacgaggucaggagaucgagaccauccuggcuaacacgaugaaaccccaucucuacuaaaaaauacaaaaauuagcugggcgugguggcgggugccuguagucccagcuacucgggaggcugaggcaggagaauggugugaacccaggaggcggagcuuguagugagcugagaucccgccacugcacuccagccugggcgaaagagcgagacucugucucaaaaaaaaaaaaaaaaaaauuaaacauauauucaccauuugauccaaccguuucacuccaagauauuuuacccgagagaaauaaaaacacugugucccuucaaaaaauguguaugcaaaaguucaugccagcacuauucauaguaaccaaaugcuagaaacaaccaaaugucuaucaguugaugaauggauaaauaacguggucuaucuauauacaauggaagguuaugugaccaugagaaggaaugaaguacugauucgugcuacaacacaaaugaaccuugaaaacaugaugcuaagugaaagaagccaaucacaaaaggccaccuauugcauuauccuauuuauguaaaauuucuaguaaaggcaaacuauagagacaggaagcaaaucaguaguugccuggggcucaaggugggagaaagauugaccuuagauggcacaaguaaacuuuuugggugaugcagguguucuacaacuacauuauggugauaauugcacaacuguauaaauuugcuaaaucuuauugcacucacacucaggauggguauauuccauuguuuauaaaguauguuucuguaaaugcaugaaucaucaaaaaaugacaucauagcaauaacuuguuauauacauaaauuuauugauacuucuaagucucaaauuuuuacuagaauacuuucacuuuaaguacccuacugauuaugagccagauaagaguugauauauugccaauuuaaaggucaaaagguggauuucacuguaucagacuuuuacagucuagacgcgaccuguugggucagugauuuuuuuuuuaaucugaucacaguuauggauugaauuuuuguccugcaaaaauuuauauguugaaguccugacccccuguaccucagagcgugacccuauuugaaaagaaggucuuugcagacauguuuaguugaaaugaaacuguacuggaguagugugggcucuuacuuuguuaugacuagugcccuuauaaaaagaaauuuggacacagacacacacacacagugagacugccaugugaagauuggcugccccaagccaaggaacgaccagaggcuagaagagugaccuggaaaagaucuuuaguggugagcauggcacugccagcacugugaucucaaacuucuagccuccagaacugugagacaauauauuuuuguuguuuaagccucauaguuucugguacuuuaugacagcccuagcacacuaucgcaaucacauccaugaaaauaaguuugagaugcaguuuggcuuuugguuuguuucaguuuguuuuuuaacaccugggcacauucaaaugcagugucugcagcaaaaguaacuaucaucagagugaacaggcaaccuacagaaugggagaaaauuuuugcaaucuacccaucugacaaagggcuauauccagaaucuacaaagaacucaaacaaauuuacaagaaaaaaacaaccccaucaacaugugggcgaaggauaugaagagacacuucucaaaagaagacauuuacgcagccagcagacacaugaaaaacugcucaucaucacuggccaucagagaaaugcaaaucaaaaccacaaugagauaccaucucacaccaguuagaauggcgaucauuaaaaagucaggaaacaacaggugcuggagaggauguggagaaauaagaacacuuuuacacuguuggugggacuguaaacuaguucaaccauuguggaagacaguguggcgauuccucagggaucuagaacuagaaauaccauuugacccagccaucccauuacuggguauauacccaaaggauuauaaaucaugcugcuauaaagacacaugcacacguauguuuauugcggcacuauucacaauagcaaagacuugaaaccaacccaaauguccaucaaugauagacuggauuaaggaaauguggcacauauacaccauggaauacuaugcagccauaaaacaggaugaguucauguccuuuguagggacauggaugaagcuggaaaccaucauucucagcaaacugucgcaaggacaaaaaacccaaacaccgcauguucucacucauaggugggaauugaacaaugagaacauuuggacacaggaaggggaacaucacacaccagggccuguugugggguggggggagggauagcauuaggagauauaccuaaugcuaaaugacgaguuaaugggugcagcacaccaacauggcacauguauacauauguaacaaaccugcacguuguguacaugcacccuagaacuuaaaguauaauuuaaaaaaaaaagaagaaaagaaaacaaaugcagcgucuguagaggacgaucaacagauccugcagcucuuaguguuuccuuuugauaaaucuuuguucuggacguuaauauuuuaaagcauggcuuuuucuaaguuuaaaaacuaucaaauguaagcaguaucuuauaacucccuacugacucacguauuuuucuuugucagcucguuuugacaggagccauucaaguagcagacaaaguuucuucagggaagaguucagugcuugugcauugcagugacggaugggacaggacugcucagcugacauccuuggccaugcugauguuggauagcuucuauaggagcauugaaggguucgaaauacugguacaaaaagaauggauaaguuuuggacauaaauuugcaucugugaguaaacaaagcuaauuucuaaaaauagaucacuaccauucaggauuuuaaaacuaguuguuaaauuacauauucaguauuacaaugaaaaucugaggaguguaauaaaaacuuuacgcguuugaaaaugcaugaugccuuggguagugaaagucuuuuuaagagauauguuuauccaucugcacuguuugcaguuucacuugaaagcaauacaaagaaucuucauagaaauguuuacauugaaauuucauaagagaaggaagacagacaauucuuucucaaauaauauagcuauuagagucaaauauauuuuauagacuuuuaguugaggcuuuuuauuucugauaugcauuuuaaaaaucaucgagagaugaauaaguucaaaagagcuauuguauaacaugaugacuguaguuaauauauuuuugaacaauguuaaaagaauggauguaaaguuuucuuaccacaaaaaugguaacuaugagguaauguguaugcuacacauuaaacagacagucaauauauauaaauuucucucucaauuaaaaauaaauaaaaauuuuuuaaaauaacccccccaagaaaauuuuuuuaaugaaaucaucaaaagaacauacuaaaauucauauuccuaggucuuauuuccagaugcccucugaauauacauuuugacccagcuccccagugauucucaugaaggggaucuguaggcuacccuuucagaaacacugcuauguauccuuuuagccuucacccagguuucauagugugaauaacauuuucaaguagaaagaaucauuguguuuuuuugcuuguuuguuuguuuguuuguuuguuuuugagauggaguuucgcccuuauugcccaagcuggagcgcaauggcgugaucucggcucacuacaaccuccaccucuuggguucaagcgauucuucugccucagccucccaaguagcugggauuacaggcaugcaccaccaugcccagcuaauuuuuuguauuuuuaguagaaauggcguuucaccauguuagccaggcuggucucaaacucuugaccucgugauccgcccaccucagccucccaaaaugcugggauuacaggcaugagccaccacacccagccauagaaagaaucauuguuuaguaaaugaauacauugugagauuuuuugguuuugucuuguuuuuaagagagaaagaacauuuaauucuaaucaucauaccuuuuggacaugauuuuaagucuugaaacuuuaggauuguuuucuucgcgacugaaagaacuagguugaguguauugcuaacauacuauguaggauaaucaugcccauucuauccauagcuguucaggacuuguacaaaauucugauuauaugaaauaauuguaauaaucaccuaggaugaugauucuuuggcaauuuuuauugguauuuuacagacauuuauauacuuaauuuccauuauuuugaaaccuuacauugccuauauugccauggaaguauauauuauuuccucucugagaaacuuggcauuuagaaggcacauugcugaauuguauugucacauuuuguguuauaugcuuucucaguuuuguacccauuaauuaaaacaaauuaucuucaucaauuuauucagcgaauaggucauggugauaaaaaccacaccgaugcugaccguucuccuauuuuucuccaguuuauugauuguguguggcaaaugucaaaacagguaaggaauaugagggaugaaaauacauucaacucauuguuuaaauuaaacauuuuaauauaaugauugggauuugaccccaaaauaauacaggguagagcuagagaugaagcaagacugggcaugugugaauacuugcagaagccagguacaugagcguucaccuuuuuauuccugcuacuauugauauaucugggauuuucccuaauaaaguuuuaaaaauuaaguauuuaacucugaugucucuacuaguggaauugacaauaccaagucgucguuuauauacauuuuacacugacccuuauauauagcugugucugcuaucucauaauagcuuaaauaacuaaacuacacuguaccugcaggagaacccagaaaaucagccuguuuaucucauuuuccucuuuauugcuuuauuuaacacuuaaagugcucagaccuauauaaacugcuaaaaaaagaacaacuguagugugugugcagauuacagccucugcuguccuuccuagagcccuacaauguggcagcauuuguuuacuucuacaguguaucuuucuaauuuuauaaaguuucagucccaguuuuucaugcuuuguuugcuuguuuuuguuuaguucccuacagcuuuugaauucaaugaacaauuuuugauuauaauuuuggaucaucuguauaguugccgauuugguacuuucuuauucaacugugaaucugcucgagaaagacaggugaguuaaaaugcuauuuuuuuugauacauuaggcuugccaaaauguauguagucuaccaugaaauauaaaaaauaugauagcuuguaagacacugucuuugaccucaaagaguaggaauuacauuaaagguaugcauuuuguguuauauaaaggaauaccugaggcuggguaacuuacaaagaaaagagguuuaauuagcucacaguucugcaggcuguacaaggagcauagugccggcaucugcuuaguuucuggugagagccucaggcugcuuccacucauggcagaaggugaaggggagccaguguguagagaucauaugguggaagaggaagcaagagagaggggagagggugccaggcucuuuguaacaacucagcugucuugguaacuaauauagagugacaacaaacaccuaagagagagcauuaaucuguucaugagggaccuguccucaugacccaaacaccucccacuaggucccaccuccaaaauuggggaucagauuucuuuuucuuuauuuuuuuguuuguuuguuguuguuguuguuguuugagacaggguuucacugucgcccaggcuggaguacaguggcacaaucuuggcucacugcaaccucugccuuccuggcuuaagcaagauucucccaccucagccuccugaguaggugggaccacaggugcacaccaccacagcuagcuaauuuuuguaguuuuaguagugaugggguuuugccauguuaccugggcuggucucgaacuccugagcucaagugauccacccgccucacccucccaaagugcugggauugcaggugugaaccacugcgcccagccuggcgaucagauuucaacaugagguuuggagagaacaaauauucaaacuaugacagagguucccccaaaaguaaaaauauagcuaccauacgauccagcacucccacuauuggguacauaucuaaaggaaaugaaaucaucaugucaaagagguuaucugcaaucucauguauauugcagcaguauucacaguagccaagauauggacucaaccuguguccaucaacagaugaauaaagaaaacguaguaccuauauacaguagacuacuacucagccauaaaaaaugaaauccuaccauuugcaacaacauaaguaaaucuggaggacauuaugcuaagcgaaauaaaccaggcacagaaagacaaauaccacaugauuucccuuauguguggaaucuaagaaaacuugaaccuauaguaacagagaguagaaggguaguuaccaggggcuggggaagggguaagggaaagaggaacauaguggucaaaagauacaaaccuucaguuauaaguacuaaagaccuaaugugcaguaugguaauuauaguuaauaauaauguauauuugaaauuugcuaaaauaauagaucucaaguguucucacugcaaaaaaaauugguaacuauaugaggugacagauguuaauuagcuugauugaggugauuauuucauaauguauacauauaucaaaauaucacaucguauaccuuaaauauauacaguuuuuauuugucaguuguaaauaauacugggggaaaaacacaauuguuucugggaaaagaggugagagagagcacuuuuuuucauaaccuugucaaacuauuugacuuuuuaaacuaugugcauauauaaaaauaaaaagaguaacaugcaaauaaauacaaugugguauauagauuuuggcaucaaaaagguacaacugagguuuuagguggauucagagaaaggcaaaauuaugcugucguuauucaugaaaugaaauacauauguuuaagacauuucuuuuauuuuucuuuugagauggaguuucgcucuugucacccaggcuggagugcuguggcgcgaucacggcucacugcaaccucugccccccagguucaagcaauucuccugccucagccucccaaguagcugggacuacaggcgccugccaccacucccagcuaauuuuuguauuuuugguagagacggggcuucaccauguuggccaggcuggucucaaacuccugaccucaggugauccgccugccucagccucccaaagugcugcaauuacaggcgugagccaccacacccggccacgaaauuucuuuagucacuuauuuugggauguucuuuuugguuuccaguuuuagcuuauugcucuuuucuuauuaaagucauuacuaggaaaaguuucagauucuaccuuugguaauuuuaauucuuguauuuuuauuucccuagcuuugauguuuuuuuuuuuucuuccucucucuaguuuauggucaaaauuuuguaaacgccugcaauaaaaagcaaugaaaaugugaauaucuuuaugagauggcaacacuaggcugaaaagcuuagacuucguguagucaguuauccagauguuuucaaagauauggauguugacaugauguagauuaaacaucuggaugguugauuaaaauaacuguguccagaugccuacugucaaguagacacagauuaagauuucauaguuccaacaaauggaaaaguuuuaaaagucauugggaucuuaggauaauuuuucuuuucacugaauuaaaaagaguauaccacccaucuguucauaaauguuuuaccuagcugggaauacucuucuuuggucagugaauugcauuuaaugguacaguauccugcgccccugucuucaggcagaaauaguggcucucaagcuaggccauuaccuaugcaaauaucgauaaguggcugccaagcacucacuggcccaugaggcuuuuugagcuauuaugaggauaauguaaaugugugauucaauuugaugcugaacuguauugcuacaggcugcaaaaugguuuguggauuuauguguguuuuuacuuaggcucuccacuuucucucucugucucucuguagaagguuacagaaaggacuguuucuuuauggucacugauaaacaguaauaaagaaaaauucaaaaaccccuucuauacuaaagaaaucaaucgaguuuuauauccaguugccaguaugcgucacuuggaacucugggugaauuacuacauuagauggaaccccaggaucaagcaacaaguaagugaaguagcacuguuaaaagauagcaaugucaacugcuugccuuagauaauguuauuugguauggauuuuuuuuaacagcaugaagaaaaauaucagacucuaaaaacacacuuauuguuaaacucaaccuuaauuuaaauuuuuuuuaauuacuaaaccauguguuuugauguuaagcugcaauucuucugccaaugugauauaauuguuuacuauaaugcaagcugauuuaaagcucuagaaaauuugaguuuucauagccagagauuuccuuugaucacuugaaguaguuauucauuauauagacauuguuugaaaauucuuuacauugacuagacuuagaugauccuguuaagaaaauguuugcuacucucauucagguguaugcacuagaucagcuaacaucagauugcuuuucacugaggguauuuacuucuaaaauaaagauaauuacucugucaaugguaguaaauucaguuggccauuuaucaaacaaaaauggaaacaaugaguuugaagugaaagacucuacauuuuguuaaagacacacuugggcuuuccauucucccaccuccacuccauccauaaucagaaggaaaaacagccugcaguacuucaguuuauugauuuguucuaagcauuauaaauauucaguauuugugaugguucuuuguaaagguuugcacauuuuccugcaguguggguggucgacuaccuguucucacaguucagucuugcauaagcaccagcuuuaaugccagaaauaggcuggccacagcagggucccauagcuguggccucucucucagauuguucauuccucucaggcaguuggcugcaugccagucugugcccuaccuccucacuggagaagugcccauuucaagcuggcacccucauuucaaggucugugcuacucacgugaaaggcuuuugcaauuugguaaugguugaaauguguauucuuuuggaaagugacagauuccagggcuugagaacauucacuuguuuaguuuggaauuugagaagcacaugggaggaauuuauuuaacaguaguucuagcauuuuggaauaucaaguaaagaauaaauaauaauccuuacagaauucuaacugcuuuuacaagagauguguuccuuauuaaaaaauguuuuuauagaugagcacuguguuuguccuauaaaauaagccuuuuccauauuugucauggcuuguuuuuaaaauauuggcaaugagaaaguacggacaguuuuuguguaaguccuguaaucucuucucacccauuuguacuuggagaaauucuugaaauucaaggaauuuggagcaguucauuucugaauuccuaaagguaauaaugauaauugugugacaggucaaguuugaggguacaucauuagaagaacuucuuagaauguauuuaucccccuuagucucacagaucuuggcaaaauggaacuggccuggagaggagugcucauucucugguagggguuuuuacuucgagacaggaauuggccuauauuaugaucuauuggcaugaauucagaaaagaaauaacuuauccuuucuauguggauuuucugaauaugaaggauccuacacacaucuuuaucucccuaggcacuuuguguuuucaucuaccaaauauugaauguucucaugcgucaggcacuagggggaugcagagauuaagaagaaauggucuccgcccaugaguagcucccaagcugguaggggcggccagaaacauaagccaaugguuauaaugcacagggauaaguguaagaauaaaaguaugaauuaaguacauuagguuugcuuaaagaucugcuuauguagaacauuauuucauacagaaauagauuaaaucgcauaggacuuuuaaaaguacauaauauaaaccuaaaagaauguacuuaaccacuuaaaaguuaaauuguuauucaguugugugagccagaagguauucaaacaauuacuggccaccuguaguauucacagcacuauggugguauacuaucaauguugaaagauacaaaagaauauacagccucauaaugagcuguuagccucaaagaaggcaggauuagugugcuuuuaaaagcaaaagccaccaacccuugcugacauaaaaucucagcagaguuuauggaaagaccaaugcuuacauuugaaaagcuaucaauaagcagaucugguacuuuuauuuaauacaaggaaauuacucaugucaaaagcauagucauauuacaaaccugaguaggaauuuuggcugccagugaccaucauacgguacucuaggaaccacugcauuccauguagcuguuaaucaggguuacacuggauguacugaaauuuuauauagugguaacugaaggaugagauucaggacaaauauuagcagguugaccuguguggcauuuguuucagucauuuuugauagaaaaauuuaaagggauaugaauaugaaaauuguuugaagccuacaauacuuccauaaugagcugauugccuaucuucuuuuccaugccaagcugagacauacuuuauaauucauuucccaagugagaaguugagguauaauauuuugucacuuggcuugaaguuuucauuucuuguugucuuuguauucuaucacaaauggacucuucucuucuuuuaccugcucuaagugguuuguguuugucuguagcccaauaacuucuauauauuuuauacccauuacuugacugaauuaucuuuuuauuucuaacaguuuuucuguuuacucuuuucaguuuucugaugauacagucaugccaucugcaaaaauuacuguuacccgauuucuuuuucuuaucuaauugcacaugcucauuguaauauucaagcugauucuaaauucuaauacucauauuucaaagggagguuuuaaaaauagccacaguuuuggaggagaauaucaaggaagaaccugcccugcuauauagcaagacuuauuuggaacagaguagagcccagaaacagaccugcgucaauguggagacuuggaauaguaagaagguggcaauguaacacaucccuaugaguggaauguucaguaaauggugcugggacuggaaaugaaaguuaacaugucaaaacagaacuccucauguuucccccaaaaccuccuccuccugccaucuuccccauuucaguucgugguagcgccagccuagucgcccuggucaggaaccuuagagucauccuugacaccuuucucucccacaccccauguccaaucaaucugucaggagagcuucuugggcucugccuucaaaacacagcuagaguccaagcacuucucacugagcucccaccaccaugcuggugugugcugccugccaucucccguguguggcagcgauaaccuucuagcuggacccccugaugcuaccuuuacuucuuucuacucuucucagcauggcagccaaagcagaucaugccacucgccugcuagaaacuggccagguagcugcucaccucacccagagucaaggcgcaaguccuuacaauggucucugaaaccucgugugacugccaccccaccccuuaccucugugaccuccuggcauccucaccaacaaccuuucucacaugcucagcuucagccagacuggccucugcucuucuucaggcacucagguauccacuugacgcccuccuucaucucccuuaagucuuuccccaaaagucaccucuucagugcagcucacucugaccauccaguuuagaguggaauccuguuacccugcucuagucuucuguagaauugaucaccuucaaacauucugugaaacucccaggaucguuauguucguuguuuguccgucucccccugcuagaagauaaaggccauaaaaauagguauuugggccuccuuuguucacugcuggauccugagcaccuagaacagugucuggcccucaguugaauuuuaagagaaaaaugggcaaaggauauuagcaagcaucccacagcacuuacuggguguuaggcauucuaccaagcguaaugcuauauaugcauuuuugaaaagcuuccacugccaggccacacacuaaaagucacagugaucauagggagaaugggauuaagaggcuucugcaauccuaugggccuuuguaaccagagcacuaaugaaagcagcaaucgcaguagaaaugugggcacgguuccaugucugcugcauuuguaccuggcuuuagcugauucacgccuuggcugccuguaguggguagaauggugugucccccaaaggacagcgacccacagccugugaaugugaccauauuugggaaaaggaucuuugcaguugugauuaaguuuaggaucucaagaugagaucauucuagauuuagggugggugggcccuaaauccaaugacagauguccuccuaagagaaaggaggggaagauuugagacccagacauagaggagagaaggccaugugaaaacaggcagagauugcagcgaugcugccauaagccaaggaacaccuggagccacuagaagcuggaagaggugaaaaagaauucuccccuaaagccuccagaggguguauggcccugcugacacccuaauuuggggcaucugcccugcagaaccaucagagaguaaauuucuguuguuuuaaaagccacgcaaguuuguguuaaauuuuuuagggcaaccucauggcucaugcucccuucucuaggauacagguucuagaaagugucugcuucuaauagagaccauucuccugaacauuaaaaauuggauccaggccagauacaguggcucacaucugcaaucucugcacuuugguaggcuaaggcaggaggaucaccugagcccagaaauucgagaccagccuaggcaacauagugagacccccuccuccaucucuacaaaaaaaaaaaaaaaaauguuuuaaguagccaggcauggcagugcaugcuugcaguccuagcuacuuggccagcugaggcaggaggaucgccugagcccaggaguucgagguuacaguguucaagauuuugcugagcuacgauugcacugcacuccagccuggcaacaaagugagacccugucucuuuaaaaaaaaaacagaaacguaauacuaaaccgcagcauucuucaucagugcauugucuucacagcuuccuuguuggugugcacagcuucagcaaauaguucaacacaguagaaagcaggaugguucuggaaaccacuacauguggaaggcacuucuguagacguuuggcuuuuuucuuuuuuuuucuuuucuuucuucuaaaaaaaaggguggggggauacaugugcagaacgugcagguuuguuacauagguauacgugugccauagugguuugcugcaccuauugauccauccucuaaguucccuccccucaccccccacuccccaacaggcccugguguguguguuccccucucuguguccauguguucucaauguucaccucccacuuaugagugagaacaugcaguguuugguuuucuguugcuguguuaguuugaugaggaugauggcuuccagcugcauccaugucccugcaaaggacaugaucucauuccuuuuuauggcugcauaguauuccaugguguauauguacugcauuuucuuuauccagucuaucacugaugggcauuuggguugguucuaugucuuugcuauuguaaauagugcugcaguaaacaugugugcaugugucuuuauaguagaaugauuuauauuccuuugaguauaaugggauugcugggucuaacgguaugucugguucuagauccuugaggaaucgccacacugucuuccacaaugguugaacuaauuuacacucccaccaacaguguaaaaguguuccuguuucuccacagccucgccagcaucuaucauuuccugacuuuuuaauaaucgccauucugacuggcaugagaugguaucucacugcgguuuugauuugcauuucucugaugaucagugaugaugagcuuuuuuucauaucuuuguuggccgcauugugugucuucuuuugagaagugucuguucauauccuuugccuacuuucugaugggguuguuuaucuuuuauuuuuauaaauauguuuaaguuccuuguaaauucugaauauuagaccuuugucagaugaguagauugcaaaaauuuucucuuauucuauagauugccuguucacucugaugcuaguuucuuuugcugugcagaagcucuuuaguuuaauuagaucccauuugucaauuuuggcuuuuguugcaauuguuuuugguguuuuugucaugaagucuuuccccaugccuauguccugaaugguauugccuagguuuucuucuaggguuuucaugguuuuggguuuuacauuaaggucuucauauauugcuuaagcuuucuagaaagugcuugccccugaucccuucaaaacauuaacuuucuggaguacuguucuguuguauaucuugaccugggugugauuaccuaaauguauacguaugucaagauucacugagcugaacaucugaagauuuugcacugugugugguuuauaucucaguacaaaacuuuuaaaacuuaacaugcugggagagucacguuaugcuccagccugacuucugccuuuguaucaacaucaaucccuuguuuacucaucaaaguagucaccauuguagcaaaacagaugcuauuaacucacuucacucacacaaugccaugugagggcuaugcuguuuugauucccauuuuacagauagggaaauggaggcacacagaaggugagggggcaaacccagcauucauacccaaggcggagcauugcagagccgcuauggcugucagccauguauucagaugggcaauaagcacaugaaaagauguucuagcagagcaauacaaacgaaaacuaccgugacauaccaugucacagcccucaaauuggaaaaaagaauaauaaucguaugcucccaaguucuagugagaaugcagaacaaugggaacugccagguaucaccagcaggagccucucugcaggcaauuuggcagcaucuggugagguugaaaagaccauauucuacuucucagcaguuccaccccuaggaaaauuccuuagagaaacacucgcauaugugcuugaggagauguguacaaggauacucaguacagcauugaacacacuaccgaggagcccuggaaaucacugauuacccaucagccugggaagggguggagaaacugguuuauuccuucaaugcaacuuaacaaggaugaaauucagaaaacauguugggucaaaaugucaauugauaaauaccagaugguaccagugauguaaacuuugauaaaacacaaaguaauacuguauuuuguugcuggauacucacaggaaaagugucacaaaucugcacaaaaaggaaggucacauggcaacuugagaagaguugucccucagagugaaagaggacagugggucugggacgggcaacacgggagacuggagcugugucucggcugacacauuuucaaagauagugacacgugugaggaaauguguacauuagguauuucuuggugaacaaauacuuaguacuuggguguuuaguacucuguguuguacuuuccuguaugugucaaugaggcaguaguuaaggaaaguauguauuaugguaaacuuugaguaaagggcuuauuuacaaaucagcagucacagcagauggguggaacacgugaguucucaugacgugcguggcauaaaguguaacucaagucucugguucucuccagcagccgaauccaguggagcagcguuacauggagcucuuagccuuacgcgacgaauacauaaagcggcuugaggaacugcagcucgccaacucugccaagcuuucugaucccccaacuucaccuuccaguccuucgcaaaugaugccccaugugcaaacucacuucugaggggggacccuggcaccgcauuagagcucgaaauaaaggcgauagcugacuuucauuuggggcauuuguaaaaaguagauuaaaauauuugccuccauguagaacuugaacuaacauaaucuuaaacucuugaauaugugccuucuagaauacauauuacaagaaaacuacaggguccacacggcaaucagaagaaaggagcugagaugagguuuuggaaaacccugacaccuuuaaaaagcaguuuuugaaagacaaaauuuagauuuaauuuacgucuugagaaauacuauauauacaauauauauuuugugggcuuaauugaaacaacauuauuuuaaaaucaaaggggauauauguuuguggaauggauuuuccugaagcugcuuaacaguugcuuuggauucucuaagaugaauccaaaugugaaagaugcauguuacugccaaaaccaaauugagcucagcuuccuaggcauuacccaaaagcaagguguuuaaguaauugccagcuuuuauaccaucaugaguggugacuuaaggagaaauagcuguauagaugaguuuuucauuauuuggaaauuuagggguagaaaauguuuuccccuaauuuuccagagaagccuauuuuuauauuuuuaaaaaacugacagggcccaguuaaauaugauuugcauuuuuuaaauuugccaguuuuauuuucuaaauucuuucaugagcuugccuaaaauucggaaugguuuucggguuguggcaaaccccaaagagagcacuguccaaggaugucgggagcauccugcugcuuaggggaauguuuucgcaaauguugcucuagucaguccagcucaucugccaaaauguagggcuaccgucuuggaugcaugagcuauugcuagagcaucauccuuagaaaucagugccccagauguacauguguugagcguauucuugaaaguauuguguuuaugcauuucaauuucaaugguguuggcuuccccuccccaccccacgcgugcauaaaaacugguucuacaaauuuuuacuugaaguaccaggccguuugcuuuuucagguuguuuuguuuuauaguauuaagugaaauuuuaaaugcacaguucuauuugcuaucugaacuaauucauuuauuaaguauauuuguaaaagcuaaggcucgaguuaaaacaaugaaguguuuuacaaugauuuguaaaggacuauuuauaacuaauaugguuuuguuuucaaugaauuaagaaagauuaaauauaucuuuguaaauuauuuuaugucauaguuuaauuggucuaccaaguaagacaucucaaauacaguaguauaauguaugaauuuuguaaguauaagaaauuuuauuagacauucucuuacuuuuuguaaaugcuguaaauauuucauaaauuaacaaagugucacuccauaaaaagaaagcuaauacuaauagccuaaaagauuuugugaaauuucaugaaaacuuuuuaauggcaauaaugacuaaagaccugcuguaauaaauguauuaacugaaaccuaacacuguuuucagggcugugagugugcauguguuggaaaugugcaugguggccaucugauuucuuugcccgggucugcuucauguacuuuuuaucucac

SEQ ID NO: 19014 - RNA, 4831 nt, Homo sapiens
cauucccacaccuaggagguguccgacacaugccuguugcauacaggauaacaagcugcggcccauguacucuuuuuugguucucucuucuguguagcacaauggagggagaaugcaaaaagcaggaccacacaccuacuacccuccgagcacagugcacuuggaauggauucacuuccugcucagcaacccccugugagguccccgugaggcucaggacccugcugcagaucaggcggugagucacugccagagacgggaucuggcccugucgggggcauccuuccacaacuacacgcacugggcagcaagauuucaaccaagucacugcuucucugacccuucccucauucucuacgucguggaauugcugggagcguuaacugggaucauguguguacagaacccacuggcacacaagaggacugcagguuauaggcgcugucgcugugguuuccaucaucaucaugauguugcagguggcuucgccuacaugagugagaaccugaccacaucugggaacagaucugucgcgcaguuuguagguuuuaggaaaggucuguuaccugccucacgcggcgggcaagaaucugagccugggugcaccccugugggacaccacucuaacccucucugcugguucagcauuucuucaccucugcaaccugcugcacaagggggagcguggcagggguacgggggucuccugcaguaaucgagaggcucuguuuagccaaaggcacuccagaucaggcaugguucuguuggauuuucugcuaauguucaugacacuccaccaaccacccgggccuuugagucaccaagaauaucaccugguaacccuaugugauuucaguaacauagugacuucugacacucuguagcccaucuucccuguugccaaaauagaugaaauagaagccacccaggacagaauaacucagcaagaugccuaaguagaaauacacaucagugaagaggaaggugcuggaagggggauguaggcuuugguucccaaguugaccacugacuggaaagaagugcuugaugggccccuguguuuagcaucucaaauaaugcaccugaagucagaaaggaggacagugcuggaccuggacuccagugacagggcagcaggucacccugcacauagacuucuugggcugaaagccaggaaagaagaugcuaaugggaccagcaaccucucacgcucacucauaguuccugggcacauggaccauuucaaagacagcucgccuucaaacucaguucucaucuggggaaggauucaaucuagugacaagcaguuauuagauuaauaacuuaaagaucaauuaauaacaagcagggacaugucuugcagagcacaaagucuaaagggagagauaaauguaauuuuuuuuuuuuuuuuugagacggagucucacucugucgcccaggcuggaaugcaguggugcaaucucaucucagcucacuacaaccuccgccucccagguucaagcgauucuucugccucggccuccugaguagcugggauuauaggcgugcaccaccacaccuggcuaauuuuuguauuuuuaguagagacaggguuuugccauguuggucaggcuggucucaaacuucugccucgugaucugcccaccucggccucccaaagugcuaggauuacaggcguaaguuacugugcccggccagaaauguaaauuuuuuuaaaaagaggaagaaggaagcuaaguugaugccaggagcucaggugguggccaaguggcagagggcguggggagcuggagccaucgggcagccacagaaggugaugucugggcuguuaggcaggagcaaaaggccucucuggaggaagguggagcguggacacaaggcagacugaggcggggagaguagguagaaagcugucccaauaucccagaggacuggguguggaggggagaccugagggagaggccaguggggacaggacagguuuagggugggcaggugugaguccucuguaggcugaggggcaagagccaccacagggagaaggaauaaaugcagguucaaggggcuggagagagcagaugugcagggggaacuggccugcagcagaggggcgcaccucuucauucacucaugcguucauucagucacaucugucgagucuccguuaguugccaaacaccaugcuagauccugagggcccugugguuucaaagccugugguguguaggggcagcaggcaggcaaacaggccggugcaguaucgagugucuuggggaauucuacagacugauuauuagcagcgccuccacucucuuucucaaaguacgcuaguuugggcaaucaacauagggccgccagagcacuaggugagcagggaagagggcgcucaacgggaaaggcuccagggcagcacaagucccagcagcucccuggcuagugggagagggacacagaugcaagucucuccuauccaaggaagacucugggaagagcugaaagaggugaucaaacacuaguuguuuucauacaugugaagacacaaagggcggcucauucacacgggggaucugcuucaagcaggggcagggcguguacaggggagauguggcuaagggcacccuaggaugcaggagcaccccugcagccaggacuccuucccaacuccccaggcccagcguacaaguacuaggcugaaugagcacccaucacaguguucuggaaaacacuccugaggucguaaggguggcagggccaacucagaggguccagaggagaaaagcauuugcaguggaagcuuuguggaacaaaauagaaagccaucuaggaaagaagaggcaagugaugacuagccuggucugugguagagggcaaaggauccagugaggaguggccaagcagcggccuggggcagcggggcgcacccagcagauggagcauggagcuaaggccaccagugagggagcuuuccagcuggcaggccgggguacuauagugacguauccuugagguuccagggccaggcagcugaaaaggaacaugagcaguucagacugccccauggcuaguggaguguggagacgaucuagagaucaugaagacccuaggugagagggaugagggagcaggaggauggagaggaaggcagauuucuguaucauuggcugacagagcaaugcuauuaaacaaugcccuggguacacgcuccugauggacugcaguuaaacucugagaguauucaagucaaaagaaaaaucucaggccuggcgcaguggugcacacccauaaucccagcacuuugggaggccgaggcgggcggaucacuugaggucaggaguuugagaccagccaggccaacauggugaaaucccgucucuacuaaaaauacaaaaauuagccaggcauggugcuguacaccuguaaucccagcuacuugggaggccagagcaggagaaucacuugagccugggaggcagggguugcagugagccaagcucaugccacugcacuccagccugggugacgagcaagacuccgucucaaaaaauaaauaaauaaaaaagaaaaaagucucagcagacaguuaucuguccauggagguacaggcugccucuaucugucuucuucaccacccagaaccaaccaugcccuggccacccauguggagacugggggugcggggcaggacugaauccaaaccacgacacaguggaggauguggggagcccuucaggaacccgcagccagagcucagccacugaacacaaagagaggacacaggcuuggcggacuggccccuguagugcaccauucucuaauuuuguucaaucucagaaaauauuacagugaaaaagugugguggggaggggcaaacucucccccuucuucaaaggggcaccuguucugugauucaagcaccugcccuccuacugcuggacuaacagggucuauacacuguagcccugaugcaucuuccacacgccuuucuaccaccucuacguggaaacagggaaaagggcugccaccccaacccccauaucugcagguaaaguaguuuauaagaagaagggccaagcacuggagcacauagcauuuuauguaccucaucaguacgagacagaagugcuaagacuuuuuaacuguaacccagcaaacaucaucagaguuggcguauggguggaaccuccuggaacaugaaugcaaaggauugaacccugacaggagagggcagaagacggucaguaugguauguuaauaucuaccauuaacacauuuucauaccaccaucuuuacuuggaaaaaaaggcaaacucucucauucaugaaaagaaaaacaaaaagauaccugaggucucauccguggauuccaucguacauaauaauuuacccacaauuccaaaugacucagacuagcaacaggauauaacacgugguuuucauaauucacaaagaagggauuagaaaacucgucuagcuggcuauugauauacgaccauaaagauaucgucuuuguauauacauccugaaaaacaaaaaagaacauuggaaauaaacuuuucuucauaucaucaagaauuaguauuacaccgagaaaaggacuugaauaaugaagugaauucaaacgcugaaaaauucaugaaugucuacuaggucccagccccaccuucuucccacucauggccucauggugggaugaaaugaaaacacacugcuugcuguccuggaaaaacauauugcugaaguuagguagcauccgacaacugugucuauggaaaggcagagugagaacuuucuaacaaccacaggaugauaggacccaccaauaacaaauaua

SEQ ID NO: 19015 - RNA, 10796 nt, Homo sapiens
cgacgauugcggccuggcgaucggggcacugcggucguggcgcgcgaggcgcggggcgcgaggccagcccuggaacggcgggguguggggggcgggcagcugcggagcccccagaggaaagcaggggcaggcaggggggugccgagguaaugggccgggccugggcgcccggcugcgaggggcggggguuccaggcgcacuucggcccuggaggggcgggcgacagggugcccggggcggugggagggcagcggggaggggaggaagggagggaggagacggcugggccggaccggggggcuuggccgacggggagcaggugggcggggacagggccccugcuggaagaggcgcagcagcgagguggcgggcugcgugcgcaaacagggcggccgccuucugggcccggagaacggugaggccauuuggguugggugucccagucccgagggcacgguucgguauccagggccaacgagcugggugcagggcauuguugaggagggaagaucuagaggccuguccgggccaaggggauggggcguauugaacagcuccgggagaagaguguugcugggucagggcgcugguguccagcgaaggugggcgaggacaggcacuuucagggcuggccugaguggaaagggacaagggggccccagaguuugaguuugagcauaauuugggaguugucgugucacugggugggucgaugagucaugcgauuuggagaacccuuuccuggcgaucaguucugagggauggaaauaaagucuaggguuuggagaagugguuuggaggccaugucuugggacaccaggugcucugguggucaccaggcuucaugugagggacuuugggaguugugucccagaggccugagauucagaagcuucagucugggguggaguuaagcaaggucuuugugguggccaguucccugccuuccuuccuuuccaggcugucaggauucagcuguguuccugcggggaguggguuaaaaauuccuuccgccuacagucagcuuuacaguauccaccaggggcaugggggacauauacauguguggcugcagcaucauucuuugucguggagcccucacgauugcuuccuuauuguugccauaguaacugucuacugaugguguauuuauaggggaagaagcaggcgcuacauuuuggggagggagggggaagaggccucguggcaggcagcagcagcagugaagguggcuacagaauugcuaauggagugggccaugccaugggaacuguuuuggggguguuccuggcucgacugaagcuuaaaaaugaacuggugacuuuagcaggugcgucaggauaacauguauucgggucuaugauaggugugacauauagccaccuuugaccaaggcuaggugugugggggacaaaagauggauauauguaaucuauuauguaaauuuuucuccauuuuuuuaaaaaaccacugcaguuuccuuugauaagcauauuuuucucucuucccuuauuaagacuauaugcauucuucucaaacccagauacaacagcuccauuuuucuucaagcaaaaaauccuugccaugaggcauacuauauccacacccucaccacauaaagcucagguauccauaaugcaagcagaauuuugagaucauauuccaucuugguucugacaaacauugagggccaacugucucacaaggcaggccaucuguugacaaauucacauguugauaguuuugagggagauuguugcaggguucaaaagagaaagccccuugauguggcguuuccacaaauagaugucagaucugcuguuuuaccuuuaauuuucuuuucuuucuuuucucucuuucucucuuucuuucucucuuucuuucuuucuuccuuccuuccucccuccccuucccuucuccuucuuuccuuccuccuucccuucccuucuccuuccuuccuuccuuccucccucccucccuuccuuccucccucccucccucucucccucccucucucccucucucccucucuuucucucuuucucucuuucuuucuuucuggcuuuguaacccaggcuggagugcaguggcgcaaucucagcucacuucaaucuccgccucucugguucaagcgauuccccugucucagccuccagaguagcugggacuacaggcaugcaccgcagcaugccuaacuaauuuuuguauuuguaguagagaugggguuucaccauuuuuuggucaagccagucccaaacuccugaccugaggugauccgcccgccucagccucccaaaguguugggauuauaggcaugagccaccgcgaccagccuaaauuauugauuuauauccuaccuguuugccaaaaggauuagguggcauauuauaaaugcacaauaggacacuggaaacauaaauagaaagcuguauaccacaucgcaggacagaagcauaugugcuuaacagcugggcuuccagggugccugugcuugacuggcaauagugacgcugaacuuccuggcagccuaggcaaaaaggagggcucaauggauuccacaguucacgugucuugcauccaguuagucaucaaaccagagcuucugcuuggggaggggagcaguggggugauugcucccagauguggacagcucagcaagggcucuagaauguguguaugagugggcguguguauuguggggagggacagagggagcagugugcugugaccaugguuuaaguacuggcuggauagcuccuuagcaggagaaaggcuuucugacaauagcucacauuaggggcaacucuuguaguuagcgucucagugucgggcaucuaaauucaugucuuggcacucuacugccaugggcuuuaaugcaaagagagaagagaggccugguuccagaagauuccagguaucuugccucuuugucuggugaagaugaacacagcgggucaccuggguuugggccuucugauuaugccugggaauaugaagaaugcagcauuguugugcauggaggaugagacccuguagaagauguguccacugaagguugcuauaggcuagucccagcagggcagugacuuuugagaugguugaugcuguguuaagcuuuguuuucagggaacaugcuugucauuggagguaucugugacucaccauugugcucaaaauuaguugugaauucugguccugccacugucacuguugauuugcuuaaccuugucugagcccgucucucugggcuguaucuccucaucuaucucugagguccuuuccaauuggaaguugcaaagauucauugaggggagcaaggaaggaggagccucagccuuuaggagcuuuccuuuuuaaaagaaaaaggucaacccuugguucuuauagaugcucagaacauguucuugggggaaaacgcugaaagguuugcuuugggcccuacugggccuggggaggucucuggagaagagcuuggggcagaaugagaagcagcggaagccauggguggcugcauggaggacgacgcaccccacaaggugcugcuucaaccuuuugaccacgccagugggaggggggcacaucccagagccaagagugugcccuguaaauuucuagaugugguuucacugcaacuuugcuuuucucuuacuccagagaagugagacccugcagcugagggagcaucauggcaggugaguuuuuccaggccugggcagagccguggagggccaugccuagggguucaugagucagguuucaaguccuucccagcuucccugcccccuaccccccaagugggccuguagccauuuuccaaauggcugaguagcaguuuugcccucucaacucuuuggcucccuucugaaguauaugucacuuguagauguguaccuacccaggcuucccugagugacacuaacgugacaggccauagggccuggggaagggugccugccugcuggcaaagacaugccagcuugggcauccagggggaguugcuuuacaugggaaccaggaagucccaccucuaggugaacaacaggagcaaacgucaccucuucuuucauccuucacagucucaacuuaggcuuaugugggugcagagcucaagcuauucuggucagccuguuuguagcugggugucucucucuggaauaaguagauaugcccaccauccaaagacgguauuguagggagauucugugccccgucuguaaaagcuuagacucuccaucugaacccugcuacuucccauccccagaggugcucuuaggcucguguaugcccacuugucugaucuagccuaggcuggcuuugcauuagacuuucuugaacaagacuauugaugccagaccaccugguggcacagguggauguucagguggaggaacaccacccugguagagucuucuaggauuaucugguauuaguuccaccaguaucagccuuaaagaggaauacauucucauugcaagggcuccaacuuucacuuuucaaggugaugcagaagauacuggagcuuuagucacugaacauugccuacuuacaauucuuauucuuucuuguuccugugcaacgugcacuuuccuugcaguuggcuaccauuuucuuccauguagccagggaccuaaaccuuguuggggcugugguauucuagacagguguaucauggcaccauagaaugucagcccuuccaucccuuucacaaagggccggccauguccuuugaucagaagccuggugucuugccugcucacucggccuuguuucccugcauaauuaugcuucaguugcugggcugggccugguuugaaggagccccugggcaucuccccauuccaggccucaguagggcucucuccucaguguuucuggaggccaaggaugcccauucgguccugaaacgauucccucgugccaaugaguuccuggaggagcugcgccagggcaccaucgagcgagagugcauggaggagaucugcagcuacgaggaggucaaggaaguguuugagaacaaagagaaaacggcauguaccacccuggggcugguucugggaguaggaguagccucaggaauagcaagaacaggcccugguaaugcagaccaaucagaagcaaggaaagacacccagccuaaggcauagccacuagggccaucacggagcagauaaaguacguacagucccauugccugacucuuuugggguccuccucacuugggagcauuguccuuugcccuugguacauucugcugccucucugguaacucugugagacaagucagauggggaaggguaggaagcaccagaguuacugaaggccucugagcccaccuggagcuugagcuucucuuaaguaccacuuuuucuuuugcagauggaguucuggaaaggguacccaaaugcagucuacucuguccgagaccccucgcagagcucagaugccauguauguggugguaccccuucuggggguggcacugcugauugucaucgccuuguucaucaucuggaggugccagcugcagaaagcgacccgucaccaccccuccuaugcucagaaccgguaccuagccagucgcgccgggcacacccucccccgggucaugguguaccgggguacugugcauagccaaggggagccuucugggcaccgagaggcagcgaacagcccccagguggugcuggggcccagucgggggggcaggaccacaguccggcuagagagcacccucuaccucccugagcucucucucuccagacuguccagcaccaccccuccccccuccuacgaggaggugacugcgccccaagagagcagcagugaggaggccagcgugucuuacagugacccacccccaaaguacgaggagauaguggccgccaacccuggcgcugacaaguagugggacguuugugcccuguccuggaugaacgccucuuuccgaggucuccuauuuucuuuuuaacuuuuuaaagacugugccaccacaaaacagccuuagccuccuuguugccaaauaauucccuaacuguggaguuuuaggaagucaguugucagagacagguggggaggguggggguagggaccacgcaugagucgaagcccccgggaagagccaaaggccaaagugcccaacucuuugggaugacccccaagccuccaacauccugucuuuccaucaggaacuggcuucucuuaugccaaaggaauaaccccauugaguugauuguggccagaauguccacaggccuggccugggggcugugggacuggcuggaggccugccugugucuagagcucugggccucagggguaagggaaggaagccagccuuucagcaccccuuacccuccacaguucugugauuucuguccuugcuuacauuuggaggacagggacaaggacugagcaaaaacaaaaugaaaaaaucaugacaaauaaauaauuaacacaauagaacaaaacucuagcacccgggccguucauaggaggccaagggaaauuuaucacauggaucugugauguccgccuccccuaaaaccuguccccacacuccuggaaggaggacagggugugugaaggaugagggccagagggcuggguggcagaguuuccucuuccacauugaccaaggggcccacguggacucugccauucaguuucuagugugcuugucucuccagacauguggaccagcuguguucaaaccacuacccacuggcaugagccuacuuuuugcgaauggugcauugaaauugaacuucagauugaggauuucuccuuaacgauggugcgcaucucaggagaagauccuaaagugucccuuuuaaaacauuuauuuguggagaagcccguggccugggguugaaggcccauaugggguuugcucugcuguugccaggugccagucuguuuucagugaggcuuuggacagcaguggggcagaaggcaccugcccuuuaacugucagugaccaugcuagacacuguugauaccaccucccccuacuuccgucuccauccuccugaccucaacaccaaaccauuucuccucuguggugcuuuaaaaauuguagcaaauuuuuguguggugcaagaaugcauggccugcgucuauuggcaaccacagcaauuuaaaauccacugagcugacaagcuuuuuucugucaaaauaucucucuaaggcagacauugggacucauuuccuugaaugcagcccugccuucaggccacagaggacuucuggaggcugcucuagcccugaggacuugcccugggacgugcuuccaguuagaaggcuugugucccuaccccagugaggccaccagcuuggaccacuccacccuguggcugggguuuuccauccuucccccuaccucacaggcccguuggaggcugacugagcaaaugccugcgaagugcuugaauugccggggagccagcgagguuugccuuaggaagagucuucuagaaagguguagguuauaagggagcagucuuagcugaggcccucauaugccucugauguugagucuccacuuggagagucaaucucccgucaguugacccuuuccauccucucguccucccuuuccagagcucccugaugccagagaugcuggugaaugcaggugacauucuaccuuucguuuccuugucuuucccuccccugggccuucagcauugcacuccugcccuucaucacaaagggguuuuuggcuuaagaggccccugcuuuuuccauguugggggaccuggggaagccugaagcucggggcuagcccuggcucucccaguauuucuucaaguaggugccagagugugaccugggagcaggugagaagaaacuuaucccaauaugucuacucaguuagcacagagccaggcaugagcuccacugaucagagccaaagggaguuugccaagaaaugcccgcugccuuuggcaucugaguugcagcugggugguaaugggagagagcaggaagaggcccaaggccuggcccauggagggcaacauguguccuucaggggcugaggacaggccgugggaagagucacaggagguugcuuaaggccugugauguucgguucagaugcuucaugguguucugccaggugggguugcaccacggucucugggaugguuucugcagcacauuguagaaaaaagacuguacagcacacagcaggcaucacuccuugcgaugcacacuuggauuuuaugaaugcccuguacauaucuuuucaaacucuguguuuguauggagguggauuugauacaaugcugacucuuucguggcuacauuuuugcuguuuuuggacuucuauguguguguguguguguguguguguguguaucuaugugugcacguugccuuuucucauugcuuaucugaaacaauagccggugugcagcuauauuuguaccaggagggauccggucugaaaagaggaaugucaccuccccucgcagggcugaguagccugaugacagggcccugagcaaggaaacguggcauuaacuauauuggacacccaacccccaaaguugucacuguuugccuccuugaaaaaggcuuuggaagaagacaaagcagcuccauucugcaggucuccacccuaugcaacccccgcucacacgcccuuuuggcauggugccccuggcccaggcuucuguucugugggugucagcagcugaaagaaaucugaguacuccugggcaugguuuuuuuuuuuuuuuuuuuuuuuuuuuuuuuuuuuuuuuuuuuuuuuuuuuuuuuuguguguguguguguguguguguguguguguguguguguguauggaaagaugugugacuauugacuuuggguaucgcgggacuaguuaauuagauguuuuucauuuuucaaaaagaaaagguuuuaaaaauuuucuugaaaugugacugucacuuguuuucaaccaaaaacuuuuuaagauuuuuuaaaagaaaaaucgaaauccugucccucccccgcuucccaucgccuccgguuuucaaaaugaaagcacaagugcaagaguggggugcacaggugccuggcguguacacaccacccacacagcugcguccagcccuggcugagggagacgcagugcugagcagucagccccgggaggccucuuuuucaacuuccaaucccacugccaugaaugugaauuccuuagggugcuuccaaaaacaggagucugccugaucuguuggacauugccuuuuugguagcccgaauaugaggaauucaggacaggaaagugucuuuuugucaaguagucagagccggaugcuuccccucucccaguggguggagcaucgcaacccccagccagaguugaucuuuugacaacccagugacaucccaugagaaggaagaaaaaaaauucaacacugccucuagauuguuauuuuguccaagagagagaucauggagagagucucucucgcucacggaggcucugucuuucuaggaguaugugugugugcugucucauguguggacacucacaguugaggcugagauggauaucuuggcagcagagcugcuggucuagguggcuuuucagcuugacaaguaaugaagcuccauuucaggacuucaucgauuccgaaacaagcacagccccccaccccccgccacggaacucuacuaauacuaaucacuauaauuagcuaauuuaaaaguacgguaaucagacugcuugcaacuauuuuaaaagcccauuaauuugaagcccacuacuucagaacuucgagaaaaucacaacuuaagacaauucacaguagcugugauucuggcuacauaaaaauauuugaaauauucuucccuuuagucaauguucagggucuuuuguguaagagaaauccaguuuaaaaugaguacccuuuucaaagaaaaggcucaagauauuaaggaucccuucaccgugccuucagcuuugcaguucagcacuucucguauguacagggugaucucuuguucucucuccaucacagggauguuggauauugcagccuuucacucuacuccguuauuuauccugugaauaacauaguuugugaacuagacugcaauuuaaacuaauacacaugauguaucuuucuaaauauucuguaaagcagaugcuucgcugucagacuggccgcuccaucauucgccuccaaauauucaaacgugggagcuuuuccuuucagacugugggcagcgagucucucucuagcaagaauuuaucugacaaacauacccaaauagcacacccucucaagcucaaugccucaacaguuguuucacuguacugauaucugacugcugaacagugccugcccuucacccacccccagcccgagcauuaacacagaucuucaggauugggacaaaucccccagcugcuuuugccucucaauccaucuccccucaucgauaccaauuucccaggccugaacacaucuguuauuuugcucugacauugugaauuugugacaguggaaacccugauaugugcaacugagcuuauagaaauaauuacugugaaauggauuaauuuugauaccacuuuaaacugugcuuguauucauguguugacccuugucagcugggaaaucuguacauucaguauaugucagcauuucauuggagccugggggcaacagacaaacuugcuucugauuucucucucucucucuuucuuuuuauaauuguugaauuuggcuguuacauuuugucuccuucuuuacaagaaaacaauaauaauaaagagcaaauggcauccacuugaau

SEQ ID NO: 19016 - RNA, 10796 nt, Homo sapiens
auucaaguggaugccauuugcucuuuauuauuauuguuuucuuguaaagaaggagacaaaauguaacagccaaauucaacaauuauaaaaagaaagagagagagagagaaaucagaagcaaguuugucuguugcccccaggcuccaaugaaaugcugacauauacugaauguacagauuucccagcugacaagggucaacacaugaauacaagcacaguuuaaagugguaucaaaauuaauccauuucacaguaauuauuucuauaagcucaguugcacauaucaggguuuccacugucacaaauucacaaugucagagcaaaauaacagauguguucaggccugggaaauugguaucgaugaggggagauggauugagaggcaaaagcagcugggggauuugucccaauccugaagaucuguguuaaugcucgggcugggggugggugaagggcaggcacuguucagcagucagauaucaguacagugaaacaacuguugaggcauugagcuugagagggugugcuauuuggguauguuugucagauaaauucuugcuagagagagacucgcugcccacagucugaaaggaaaagcucccacguuugaauauuuggaggcgaaugauggagcggccagucugacagcgaagcaucugcuuuacagaauauuuagaaagauacaucauguguauuaguuuaaauugcagucuaguucacaaacuauguuauucacaggauaaauaacggaguagagugaaaggcugcaauauccaacaucccugugauggagagagaacaagagaucacccuguacauacgagaagugcugaacugcaaagcugaaggcacggugaagggauccuuaauaucuugagccuuuucuuugaaaaggguacucauuuuaaacuggauuucucuuacacaaaagacccugaacauugacuaaagggaagaauauuucaaauauuuuuauguagccagaaucacagcuacugugaauugucuuaaguugugauuuucucgaaguucugaaguagugggcuucaaauuaaugggcuuuuaaaauaguugcaagcagucugauuaccguacuuuuaaauuagcuaauuauagugauuaguauuaguagaguuccguggcgggggguggggggcugugcuuguuucggaaucgaugaaguccugaaauggagcuucauuacuugucaagcugaaaagccaccuagaccagcagcucugcugccaagauauccaucucagccucaacugugaguguccacacaugagacagcacacacacauacuccuagaaagacagagccuccgugagcgagagagacucucuccaugaucucucucuuggacaaaauaacaaucuagaggcaguguugaauuuuuuuucuuccuucucaugggaugucacuggguugucaaaagaucaacucuggcuggggguugcgaugcuccacccacugggagaggggaagcauccggcucugacuacuugacaaaaagacacuuuccuguccugaauuccucauauucgggcuaccaaaaaggcaauguccaacagaucaggcagacuccuguuuuuggaagcacccuaaggaauucacauucauggcagugggauuggaaguugaaaaagaggccucccggggcugacugcucagcacugcgucucccucagccagggcuggacgcagcugugugggugguguguacacgccaggcaccugugcaccccacucuugcacuugugcuuucauuuugaaaaccggaggcgaugggaagcgggggagggacaggauuucgauuuuucuuuuaaaaaaucuuaaaaaguuuuugguugaaaacaagugacagucacauuucaagaaaauuuuuaaaaccuuuucuuuuugaaaaaugaaaaacaucuaauuaacuagucccgcgauacccaaagucaauagucacacaucuuuccauacacacacacacacacacacacacacacacacacacacacaaaaaaaaaaaaaaaaaaaaaaaaaaaaaaaaaaaaaaaaaaaaaaaaaaaaaaaaccaugcccaggaguacucagauuucuuucagcugcugacacccacagaacagaagccugggccaggggcaccaugccaaaagggcgugugagcggggguugcauaggguggagaccugcagaauggagcugcuuugucuucuuccaaagccuuuuucaaggaggcaaacagugacaacuuuggggguuggguguccaauauaguuaaugccacguuuccuugcucagggcccugucaucaggcuacucagcccugcgaggggaggugacauuccucuuuucagaccggaucccuccugguacaaauauagcugcacaccggcuauuguuucagauaagcaaugagaaaaggcaacgugcacacauagauacacacacacacacacacacacacacacauagaaguccaaaaacagcaaaaauguagccacgaaagagucagcauuguaucaaauccaccuccauacaaacacagaguuugaaaagauauguacagggcauucauaaaauccaagugugcaucgcaaggagugaugccugcugugugcuguacagucuuuuuucuacaaugugcugcagaaaccaucccagagaccguggugcaaccccaccuggcagaacaccaugaagcaucugaaccgaacaucacaggccuuaagcaaccuccugugacucuucccacggccuguccucagccccugaaggacacauguugcccuccaugggccaggccuugggccucuuccugcucucucccauuaccacccagcugcaacucagaugccaaaggcagcgggcauuucuuggcaaacucccuuuggcucugaucaguggagcucaugccuggcucugugcuaacugaguagacauauugggauaaguuucuucucaccugcucccaggucacacucuggcaccuacuugaagaaauacugggagagccagggcuagccccgagcuucaggcuuccccaggucccccaacauggaaaaagcaggggccucuuaagccaaaaaccccuuugugaugaagggcaggagugcaaugcugaaggcccaggggagggaaagacaaggaaacgaaagguagaaugucaccugcauucaccagcaucucuggcaucagggagcucuggaaagggaggacgagaggauggaaagggucaacugacgggagauugacucuccaaguggagacucaacaucagaggcauaugagggccucagcuaagacugcucccuuauaaccuacaccuuucuagaagacucuuccuaaggcaaaccucgcuggcuccccggcaauucaagcacuucgcaggcauuugcucagucagccuccaacgggccugugagguagggggaaggauggaaaaccccagccacaggguggagugguccaagcugguggccucacugggguagggacacaagccuucuaacuggaagcacgucccagggcaaguccucagggcuagagcagccuccagaaguccucuguggccugaaggcagggcugcauucaaggaaaugagucccaaugucugccuuagagagauauuuugacagaaaaaagcuugucagcucaguggauuuuaaauugcugugguugccaauagacgcaggccaugcauucuugcaccacacaaaaauuugcuacaauuuuuaaagcaccacagaggagaaaugguuugguguugaggucaggaggauggagacggaaguagggggaggugguaucaacagugucuagcauggucacugacaguuaaagggcaggugccuucugccccacugcuguccaaagccucacugaaaacagacuggcaccuggcaacagcagagcaaaccccauaugggccuucaaccccaggccacgggcuucuccacaaauaaauguuuuaaaagggacacuuuaggaucuucuccugagaugcgcaccaucguuaaggagaaauccucaaucugaaguucaauuucaaugcaccauucgcaaaaaguaggcucaugccaguggguagugguuugaacacagcugguccacaugucuggagagacaagcacacuagaaacugaauggcagaguccacgugggccccuuggucaauguggaagaggaaacucugccacccagcccucuggcccucauccuucacacacccuguccuccuuccaggaguguggggacagguuuuaggggaggcggacaucacagauccaugugauaaauuucccuuggccuccuaugaacggcccgggugcuagaguuuuguucuauuguguuaauuauuuauuugucaugauuuuuucauuuuguuuuugcucaguccuugucccuguccuccaaauguaagcaaggacagaaaucacagaacuguggaggguaaggggugcugaaaggcuggcuuccuucccuuaccccugaggcccagagcucuagacacaggcaggccuccagccagucccacagcccccaggccaggccuguggacauucuggccacaaucaacucaaugggguuauuccuuuggcauaagagaagccaguuccugauggaaagacaggauguuggaggcuugggggucaucccaaagaguugggcacuuuggccuuuggcucuucccgggggcuucgacucaugcguggucccuacccccacccuccccaccugucucugacaacugacuuccuaaaacuccacaguuagggaauuauuuggcaacaaggaggcuaaggcuguuuugugguggcacagucuuuaaaaaguuaaaaagaaaauaggagaccucggaaagaggcguucauccaggacagggcacaaacgucccacuacuugucagcgccaggguuggcggccacuaucuccucguacuuugggggugggucacuguaagacacgcuggccuccucacugcugcucucuuggggcgcagucaccuccucguaggaggggggagggguggugcuggacagucuggagagagagagcucagggagguagagggugcucucuagccggacugugguccugcccccccgacugggccccagcaccaccugggggcuguucgcugccucucggugcccagaaggcuccccuuggcuaugcacaguaccccgguacaccaugacccgggggagggugugcccggcgcgacuggcuagguaccgguucugagcauaggagggguggugacgggucgcuuucugcagcuggcaccuccagaugaugaacaaggcgaugacaaucagcagugccacccccagaagggguaccaccacauacauggcaucugagcucugcgaggggucucggacagaguagacugcauuuggguacccuuuccagaacuccaucugcaaaagaaaaagugguacuuaagagaagcucaagcuccaggugggcucagaggccuucaguaacucuggugcuuccuacccuuccccaucugacuugucucacagaguuaccagagaggcagcagaauguaccaagggcaaaggacaaugcucccaagugaggaggaccccaaaagagucaggcaaugggacuguacguacuuuaucugcuccgugauggcccuaguggcuaugccuuaggcugggugucuuuccuugcuucugauuggucugcauuaccagggccuguucuugcuauuccugaggcuacuccuacucccagaaccagccccagggugguacaugccguuuucucuuuguucucaaacacuuccuugaccuccucguagcugcagaucuccuccaugcacucucgcucgauggugcccuggcgcagcuccuccaggaacucauuggcacgagggaaucguuucaggaccgaaugggcauccuuggccuccagaaacacugaggagagagcccuacugaggccuggaauggggagaugcccaggggcuccuucaaaccaggcccagcccagcaacugaagcauaauuaugcagggaaacaaggccgagugagcaggcaagacaccaggcuucugaucaaaggacauggccggcccuuugugaaagggauggaagggcugacauucuauggugccaugauacaccugucuagaauaccacagccccaacaagguuuaggucccuggcuacauggaagaaaaugguagccaacugcaaggaaagugcacguugcacaggaacaagaaagaauaagaauuguaaguaggcaauguucagugacuaaagcuccaguaucuucugcaucaccuugaaaagugaaaguuggagcccuugcaaugagaauguauuccucuuuaaggcugauacugguggaacuaauaccagauaauccuagaagacucuaccagggugguguuccuccaccugaacauccaccugugccaccagguggucuggcaucaauagucuuguucaagaaagucuaaugcaaagccagccuaggcuagaucagacaagugggcauacacgagccuaagagcaccucuggggaugggaaguagcaggguucagauggagagucuaagcuuuuacagacggggcacagaaucucccuacaauaccgucuuuggauggugggcauaucuacuuauuccagagagagacacccagcuacaaacaggcugaccagaauagcuugagcucugcacccacauaagccuaaguugagacugugaaggaugaaagaagaggugacguuugcuccuguuguucaccuagaggugggacuuccugguucccauguaaagcaacucccccuggaugcccaagcuggcaugucuuugccagcaggcaggcacccuuccccaggcccuauggccugucacguuagugucacucagggaagccuggguagguacacaucuacaagugacauauacuucagaagggagccaaagaguugagagggcaaaacugcuacucagccauuuggaaaauggcuacaggcccacuugggggguagggggcagggaagcugggaaggacuugaaaccugacucaugaaccccuaggcauggcccuccacggcucugcccaggccuggaaaaacucaccugccaugaugcucccucagcugcagggucucacuucucuggaguaagagaaaagcaaaguugcagugaaaccacaucuagaaauuuacagggcacacucuuggcucugggaugugccccccucccacuggcguggucaaaagguugaagcagcaccuuguggggugcgucguccuccaugcagccacccauggcuuccgcugcuucucauucugccccaagcucuucuccagagaccuccccaggcccaguagggcccaaagcaaaccuuucagcguuuucccccaagaacauguucugagcaucuauaagaaccaaggguugaccuuuuucuuuuaaaaaggaaagcuccuaaaggcugaggcuccuccuuccuugcuccccucaaugaaucuuugcaacuuccaauuggaaaggaccucagagauagaugaggagauacagcccagagagacgggcucagacaagguuaagcaaaucaacagugacaguggcaggaccagaauucacaacuaauuuugagcacaauggugagucacagauaccuccaaugacaagcauguucccugaaaacaaagcuuaacacagcaucaaccaucucaaaagucacugcccugcugggacuagccuauagcaaccuucaguggacacaucuucuacagggucucauccuccaugcacaacaaugcugcauucuucauauucccaggcauaaucagaaggcccaaacccaggugacccgcuguguucaucuucaccagacaaagaggcaagauaccuggaaucuucuggaaccaggccucucuucucucuuugcauuaaagcccauggcaguagagugccaagacaugaauuuagaugcccgacacugagacgcuaacuacaagaguugccccuaaugugagcuauugucagaaagccuuucuccugcuaaggagcuauccagccaguacuuaaaccauggucacagcacacugcucccucugucccuccccacaauacacacgcccacucauacacacauucuagagcccuugcugagcuguccacaucugggagcaaucaccccacugcuccccuccccaagcagaagcucugguuugaugacuaacuggaugcaagacacgugaacuguggaauccauugagcccuccuuuuugccuaggcugccaggaaguucagcgucacuauugccagucaagcacaggcacccuggaagcccagcuguuaagcacauaugcuucuguccugcgaugugguauacagcuuucuauuuauguuuccaguguccuauugugcauuuauaauaugccaccuaauccuuuuggcaaacagguaggauauaaaucaauaauuuaggcuggucgcgguggcucaugccuauaaucccaacacuuugggaggcugaggcgggcggaucaccucaggucaggaguuugggacuggcuugaccaaaaaauggugaaaccccaucucuacuacaaauacaaaaauuaguuaggcaugcugcggugcaugccuguagucccagcuacucuggaggcugagacaggggaaucgcuugaaccagagaggcggagauugaagugagcugagauugcgccacugcacuccagccuggguuacaaagccagaaagaaagaaagagagaaagagagaaagagagggagagagggagagagggagggagagagggagggagggaggaaggaagggagggagggaggaaggaaggaaggaaggagaagggaagggaaggaggaaggaaagaaggagaagggaaggggagggaggaaggaaggaagaaagaaagaaagagagaaagaaagagagaaagagagaaaagaaagaaaagaaaauuaaagguaaaacagcagaucugacaucuauuuguggaaacgccacaucaaggggcuuucucuuuugaacccugcaacaaucucccucaaaacuaucaacaugugaauuugucaacagauggccugccuugugagacaguuggcccucaauguuugucagaaccaagauggaauaugaucucaaaauucugcuugcauuauggauaccugagcuuuauguggugaggguguggauauaguaugccucauggcaaggauuuuuugcuugaagaaaaauggagcuguuguaucuggguuugagaagaaugcauauagucuuaauaagggaagagagaaaaauaugcuuaucaaaggaaacugcagugguuuuuuaaaaaaauggagaaaaauuuacauaauagauuacauauauccaucuuuugucccccacacaccuagccuuggucaaagguggcuauaugucacaccuaucauagacccgaauacauguuauccugacgcaccugcuaaagucaccaguucauuuuuaagcuucagucgagccaggaacacccccaaaacaguucccauggcauggcccacuccauuagcaauucuguagccaccuucacugcugcugcugccugccacgaggccucuucccccucccuccccaaaauguagcgccugcuucuuccccuauaaauacaccaucaguagacaguuacuauggcaacaauaaggaagcaaucgugagggcuccacgacaaagaaugaugcugcagccacacauguauaugucccccaugccccugguggauacuguaaagcugacuguaggcggaaggaauuuuuaacccacuccccgcaggaacacagcugaauccugacagccuggaaaggaaggaaggcagggaacuggccaccacaaagaccuugcuuaacuccaccccagacugaagcuucugaaucucaggccucugggacacaacucccaaagucccucacaugaagccuggugaccaccagagcaccuggugucccaagacauggccuccaaaccacuucuccaaacccuagacuuuauuuccaucccucagaacugaucgccaggaaaggguucuccaaaucgcaugacucaucgacccacccagugacacgacaacucccaaauuaugcucaaacucaaacucuggggcccccuugucccuuuccacucaggccagcccugaaagugccuguccucgcccaccuucgcuggacaccagcgcccugacccagcaacacucuucucccggagcuguucaauacgccccauccccuuggcccggacaggccucuagaucuucccuccucaacaaugcccugcacccagcucguuggcccuggauaccgaaccgugcccucgggacugggacacccaacccaaauggccucaccguucuccgggcccagaaggcggccgcccuguuugcgcacgcagcccgccaccucgcugcugcgccucuuccagcaggggcccuguccccgcccaccugcuccccgucggccaagccccccgguccggcccagccgucuccucccucccuuccuccccuccccgcugcccucccaccgccccgggcacccugucgcccgccccuccagggccgaagugcgccuggaacccccgccccucgcagccgggcgcccaggcccggcccauuaccucggcaccccccugccugccccugcuuuccucugggggcuccgcagcugcccgccccccacaccccgccguuccagggcuggccucgcgccccgcgccucgcgcgccacgaccgcagugccccgaucgccaggccgcaaucgucg

SEQ ID NO: 19017 - RNA, 3831 nt, Homo sapiens
cucuucggcccugcaccaauagggagaggcggcgacgagcggacggccaauggggagcggggcugcgcgcgcggggcggugggaacggcgccgagucaguguacacgucgguugccuaacaaccggcagcggacuccuuuggcuauggugagugcugccgcucugucgcgccccacgcccagcggcugagcccuucccaggccccagcucggccacgccgccucuccugcgccuuucucggcuuuagcgcaccagucuuuccuuugagcucuuucccgggagaguaggguacagacgcuaaccaaccuacugggccugcgcuucgcugcugccuccucuucacccacaacaggcccacacccgccccucgggcuccccuugcauucccugauccccucggugaaccucccugggcaaaaaagacucgaaucccucacaggccccugacucucucagaccuuggcccccuggccuccucauucugccaaaauuuccacacacagcugggaaaagguguaucguguucuguuacaauguuuuuuacaauuuaaauacaggggcauucaggggaugcuuuagcuucuuggagaaggcacgaaggugccagauggauugaguuuuauuacucgguacugacacaauauacaucuuaacaacuuacuaauauuuggccaaaucuagaaguaauugggaagucggaguacuuacugggaaggggaguacugggagugggcaucguaagacuguuuucagaaccaggauccccacguucgggaagagcugauuaucucuaguuauucacagucaucuucuugacuggcucucuuuugggaugauuuucaguaagagguguccuuacugaacaagugaucucccugcuucuagaaacaacaguaaagaaaagggagggguagaaguucauggaaagauucauuguucuugccaguaaacccuguuaucuuucuuuuuaagcaaagcuuuggaauugguuauauaaaugacuuuaaaaauacauaugggugucuguaacuauguuauguaaauauggacuguaugauauauuauugugcuuguguauugcauaacauauaaaggccuccaacuuuaagaaggcaaacauggcaucaaguucucagcgaaaaagaaugagcccuaagccugagcuuacugaagagcaaaagcaggagauccgggaagcuuuugaucuuuucgaugcggauggaacuggcaccauagauguuaaagaacugaaggcaagcucugugcauuccugccguacugcccuuccuuuccucugccucuuccuugucaucucccuaucaccucucuaccccuuuugcccucuucucccugcaguaaguaacaggggagguuguacugugcuguuuuccugucuuuacuuacuuugaguauuauucaauaaaauugauugcaaauaucaauuagaucaaugucauaguguuccccaaucauauuaacaugaccacaucagaugcuggcuuaaugcucucaacacuguuauuuuugcuccugcuacuuuagaugugcuuauugagacgauccuguuuucuuuauagguggcaaugagggcccugggcuuugaacccaagaaagaagaaauuaagaaaaugauaagugaaauugauaaggaagggacaggaaaaaugaacuuuggugacuuuuuaacugugaugacccagaaaaugguaaguagcuaagacaauuaucaugguauggagccccagucaucugcagagguccauggcgucuuccuguuaaaacagucaugugaccacagagcaguccagguagcaacugcaucaggaggccugcccucccaucauguuacuuugggcucccaaaacaagcccuugugcuucuuucucaagacuuccaagcagauaccucuucccacagaauuccaaaucaguuaggaaauagauaugggauagggagagauauagcgauagguagcaaacgucaccuuggauggagugccuggcuugccugguguuucuuugaggccaaaaugggcuuccugacacuugccgcaagucuagacucgaguuacauuguuaaaaaggaaagggugaccugaccaggcaguggcagggcuacaggacaguaguaaccaaccguggugucccccuacucauguguuuuauguucuacuuguuaagucugagaaagauacuaaagaagaaauccugaaagcuuucaagcucuuugaugaugaugaaacugggaagauuucguucaaaaaucugaaacgcguggccaaggaguugggugagaaccugacugaugaggagcugcagguuuguaaugcaucacacuggaacuuaaaauucccaccuuugagcccucugugacuuuuccauuacauuuucccuagugugagcaccucuuugaagaaaagccaguguacuuugucccucugcagacaacuuaauucuccuuuaauagucagacaaaccuaugaacccugcuuccagaaaaaugcacauaugcacaauuuugcuuacuauuuuagguuccaggaaucccucuagucaaggcaaucuucaaggucccucccaggugauauguuugacaaaguaugaguugguuuucaaauaacuuuucagaaaccaagcuauuaucaggaguagcauacuggcauuggguggacuacaaugaucuauucacauagauacaaauuaucuauucacauagauuaaaagucuauugcuugccaggcacaguggaucaugcauauaaucccaguacuuugggaggcugaggcaggaggaucucuuguggccaggaauuugagaccagugugggcagcauagagaccccaucucuaaaaaaaaaaaagucuauuacuuagucaccuuuuggcauuaguuuauaaauuaaccugaaucuuuacugucauauaggaaaugauugaugaagcugaucgagauggagauggagaggucagugagcaagaguuccugcgcaucaugaaaaagaccagccucuauuaagaucagugucuucuuuuucuacugcaagcacauguaacuagauuuagugccugccauggugugaaaucuggcuuuugagaacacaaacuuuucccccacggaccucccuuuaucacuuuaauagugaccuugagccuauuuuagccguuuggaaguguucuuugauauuacaguucuuuguaaaaugaccugcgaauuacccuaauucucaaaagcaaaacaagagcacacaagcgugaagaaaaggaucuuaaagcuuugagcaccugccauuuugccuugcaucguuucccucgucaugcauuuccacauauccacaaacacagaacgacuuuagacaagcacauguuacaccuguguugccacaagcagucauucuugacggcuccaguuuuuauuugacacuugaguuuaguuuucucuuuuauaaacccagugaacuccugcacuggcauuuggauguguguuaaugcuauuuguuuugucuuaaaaguaaaaccuuucucaguuugaacuuguauucucuaaggaugaguucuuuagcuuugcuuaugaguuccucuucucaauuauuguguugaaggcagccuauuagauacaaaacuccuuaccagccuauggacagaaaaugaauaauccuuugcuacuuuccuggcaugaauugcuuuuugccuuggaaggcugcugguuuguaaaacuagcagaauuuuuauaucaccuaagccuaaaugaugcucuaaaaauaguuuuggcaaagcuaagacuggaaaagagucuuguuaguaauuugugcuugaauaaaauggggagagccagg

SEQ ID NO: 19018 - RNA, 75454 nt, Homo sapiens
uguucuccugcgggcggagcccaguccgcgccuccucgccucccugcgcgcuccccgcugugcaccgcgccccgcgccccgcgccugccuccccggcccggcccggcccggccgggcgccguccacccgagggagcccgcgcccugcgacugcccgacccuccacccgccccacgagccgggcaccggugccagguagggcugucgagucgccauuggaugcggcccugcuuggaggcaguggggggcacccaguccgugcccagcuggggacaagucagggccucaguuuccccauccauaacccuuaccagcuccaagcaucucucuucggguuccccccgggagucaguggauuucugguuuucgcugugagugaaaagacugacaggcagaggaggccagcguccccuacagaggcaagugucccccuugccagccugaucccucugucuugcccuuuaggaaagacacgguuuaauuguuaguaaacggcgaggggccaggaugcucugagaguugacugcaggccuuuaagaaucagggaaucucauaucccuccgucccccugugcccauuuuauagaugaggaaacugagacccagaggcuggcucacccagaggauccccucaaucgcccuggggccugugaggugcaugugcuggguacagggcaaucuuggggagggccaugaggaugguggcugcucacacucagacagaaggcgccgaaucaggugucacuggguguuaucgacaggaucggcacugcaccagcucuguggcuggauuguuuugaugggggcagagggagccaagagucuguccucuuuggaaaggcagagggauaccuugccuuacaaaaaggccgaaagcucaggugcuccugccugaucugccacuucugagcuggggacaccuggguacucugucgguuuaagggggugacacgucaagcugccucccacccagggcugcuggggacucagauaaaguagguggugggugugucccggcuuugggacaucugaggcaugguaggaguuguguucuugcugagccgucggcacgaagccuuggcaucaugggaggccccaaagcugugagccccgagagagggccucucacaccccauccagcagugcuugaggcuucaguaccuggacuaaguccugccuuggucucauggcccuucagacuucuggcugucguaccuggcugggggcgggaggcaggggugcacagguugauaggccugaacagagcugcagagguccugccuucccagggccuccgcuccucaucugaaaaacaaggggcagcucagaggccagcaaguggccaagacacagaugcacagaugaggggccagccuucuggcaggccuuggugccuccgcuguuccccucaucgcucccaggccacuucaggaugggaaggaacagaucccucucaccugccccuccuuccagcaauucccagccccuggcuggaugcugugcauucagccguguggagcugauggaaggcacucagugcagggccagacacgcagcaggugcucaagaucuguucauuuccauccucuggacacucaugacucaagcaacagagguggcccaggaccacuuaggauguugcagcuccgaguagcaugaaaacauuagggguuccucaguccuggagcagcgaggcaccccuggcugggaagaucagggaaggcuuccuggaggcgaagggcuuggaagcaggaggaggagcucggcagccaccaggucaaggcccgcacguccuuuggagcugcuggagucuaaccuccccguuacuccugaaagaucauaaaccacuucuugcugagcuccugcauaugggggcccacagagaaaucagcuccaugccuugcccugaggagugacagagaggccaucugucaguaagaaguugccaucugaauccaaauggcagcagugcuuguccaccucacuuccugcucagcucaaguccagacuccagaaaaagccuuucccacgugaggccagugaugccaggggcagccagcgccucagcucagccucccucagccugacuugugcuccuugucuuccugcccaguguccccaaggccuccugagaucuggcagggcagggacucugggucccuagcacugggcccaggaccuggccacgauaggcaucggcacuuguucccugaacugucuucaguugcaugccaagcaaacucccccaauucuggcucggugcauucuggaagccagaagccugccuuccuccuucccuacucaagcuuccacaggugacugcccccuuuggugcggguuuugcuucaagccacaacuuauaaggugccaggucacauguaacacaagcuuuccuucuguugcugagcccugaggcugcccccacugccagucccuggcggcaugggacaggaccagugccagagaggagagcugcucuccagugcggcaaccccuugcaguccgggccuuugggcucucauguuuagggucaguccagggacuuugcauucguuaccacugugcccauagugaaccggcugaugccaagacaagggcagugccaucaggggaccagucccugagagaugcucaggagagguugccaucauugcuuccaaaggccgggaagaggaggaggggcugaacugucccacaccuggucagguguguggcaggugaggguggcaccuucauagccuagugguuaagagaauggcucagaggucagccuggguucaaaccccagcucagccaccauccaguugugcaaaguucggcccuucaugcaaccccuugaggccucuguuuucucaccaguacugaaggguggcuaaagccaggagcaccugcugcacugggugccugcaagugcuagguuccuggcacagaggugcucugucacggaagguagcugagccaggacuauggugcccuccuucagggcugugguggcaaggagugaagugggacuagguggagagagagaugcugacugggaugugggccccuaccugaggaaaacaguuuagaaauuacugcugaugaugcaaacaguaucuacccacauuuaaagugacucacuaaagaacacuuaauucuuagggugauuucucaugccuacuaaagucugacucgcuuucuuuuuuguuuucacuuuuuuuuuuuuuuuuuguuagagcuggggucucgccuugucacccaggcugguguacaguggcuagucacaggcaugaucauagcacaccgcagccuccaacuccugggcucaagcgauccucgugccucagccucccgaguagcuggcacuacaggcgagugccaccaugccagcacuguuguuacuuuuuaucuuuaauuuuuuuuuuuuuuaccuugaauugauuuaaaacucauagaaaaguuguacgaaucgugcagagaacuccugaagccuuaucugaauucccgcuauuaacauuuugccacauuucucauuagcuuucuucacuuguagccuuuggaugggucagagggugggcagggcuguugucaguucauuuuuccaaagggaaacugaggcacagagagggacuugcucaagugccauugauuagaaacugagccagauuaacuucucucagggacacauauugaugcauuuggcagguguuuucuugaucacuuucuguguugggcgcuggggcacagaaaugacugagaacugacagcaaagugggagggacaggucugaguggagaagagacuggaaaaggaaaagacaagaggcccuguggguaucacucucaaugucggagguggaaugcaggaaggaaucugcagcuuaagcgugucucccagggaauuugacugccgaagggucccagaggccacuuucagaaacacggucuaggcuuuuccuguugggagugugcucauuucucaccucaaaagggagcuaggaacugggagggugccugccuggagcagggagguggguccaggccagccaagagagcaauuccucacccacucauuaacgcccgcugagccaucccucuucccgcagagcugcccuuggggcugcugcugcugagauggcggcagagcucugaagccacgcccugggucagagaggagacauagccucuggggccagugggcaagcccuaggcugcuggugguugcuggcgguggucccuggccuuggccccaucuguaggcccagcucgggcacccaguccgggccccuuggucuagucccugugaucuuuggcucagcacgccacuuugugaugacuaggucaguuucccagagagcuugauguggcgaagaguugcuauggagagagcaagcacaaggauuuuaaucacaagaaccggcaucccuggugaaaaugcuuacaucaggcagugccugcuuuaaacugaaauaaaaauaaaaauaaaaauaaaacccaaaaccccaaaccaggacuugcuucaccacuugugccagcgaucccuuacucaugcuuucauuccuuugggccugagccugggcaccuccuugggaaaugcagugcucuggcaacauuccgcuaggccgauccccccagcacccagccuggcgguuagggcucugaaaaugcuuguugcauacauggcagugugauccugggcaagugcuuucuucucucuggacuuccuuauucuuauccaaaaauaggggcaguguuagagguaagggugggguugaggggacucugggucuagagugggcagaaagaugagaaagaggguugugggaggggagaaggaggauagggagucagagcuuugggggaaguggggaggcagcgggcucuuucuguuccuuuugcuccuaacuagugaucaccugcaucuaggacagaaggaauuagcuuuggcugauguuagucaagggcaagaaggagugacuuccugucacuggccugcucuggcaaagacugaauggauggcagcagugguguguguguaggcggggguguuccuaggggagagcgaaagaggguaaaagaaaguggccgagugcgguggcucacgccuguaaucccagcacuuugggaggcugagguggguggaucacuugaggucaggaguucgagaccagccuggccaacauggugaaaccccgucucuaucaaaaauacaaaaauuagccaggugugguggcaggcgucuguaaucccggccacuagggaggcugaggcaggagaauugcuugaaccugggagguggagguugcagugagccaagacuaugccacugcuacuccagccugggugacagagcgagacucgucucaaaaaaaaaaaaaaaaaaaaaaaaaaagaaaaggaaaaaaaagaaagaaagaaaguagggggagagggagaggugcuguggagauuggagugugggcuccaugaccucugagccuccucugaucucacuggcugccuugucugcaaaugggacuagcaucucugcaugacugggauuggcugaagaccacauugguucccuggcugcagagacaacugcaggaugagggguacagaagcagccagggcccuacaagagggucccugcccagcccucuguucuccacagagacaucuccaagggcccuugaagccaagccagcccugaaauggcccaguucccugaacggucgcuuguaucuggcucucugagaacgagaaaaugggcgcaugaaagccaggaggaaucccgaggccccaaggagcgguggguggcccagcugccuucuccccuccuccucacccccagcgccccaccaccuugggaaggagcuggccugccuuaaaagucugccucccagggccccuccagugcagacgccgagaagucuagaugcugggguguuaggggugggauggggagaggugaaauuccagacuuucaugcagaagucauuuaccuguaaagcacauuuacaaauaccacccccgccaugcguucuuuuuccauauuauauuuuccccucugcaacucaagucuuuuucagcucuuuuuuuuuccacuugcugagccuuuuuccugccacccuguuggccuccaggcgagagccccugggacuggagcaucccaggcaggucgugcacucuggcucuggcaagaggggcccagccuaggccuccugggagcugcacgcugagcagcagacuaggaggcucagacgggauccagcugcucagcccugcccacggucccuaaaucaccguugaagugccccaucccccuggaucucagcaacuccuggaacagcagcuacagccgcugcagcggugccuguggcggugccugcuccauccccuucccagaggaaagcaaccugucugcugacuguugccuugccagcugcugagacuccagugcaggagacugggaaucagaauguccugauucaccagaccuggccacaggaggcugcuucaucaaauggaacguuucaucauuccaacccuuuugguccagaaaaucagcacccgcaccggcuuaaaucagccuggguccaaacugagucagccaagugcgugccuugagaaaggacggggugagggcaucugaguggggguggagguggugcuuccugacuuuauaauuccucaggcuuguccuugcacuucccauggcagccuccagggggagucugugccacagccaaggcucuccccacugcgcuaggcuuuugaccuuagcccccuccccgggaaguaucauugcuugggguccuguggccuuggugaugaccggaggggcugcacugaagccuacaccuuccucacaugaccaggugcaggggccagggagcauuuugagaauggggcuuccuuaagcccauucccccucccaugggcacagagcauucucuuuuaccucaaaguuuagaagugaaggucagggagggugagugacgcguccagugacuaaaacccagguccuuggacuccucgucaguacuccuuccuuugcuccagaguuggaagagccagcauggauguguggcuuuguggccuugaccaagcccuccacaucucugacggcaccgcugugcccgucucaugacaugacagaugauaaggcauggcuggcucugcgccggggccuccugaacaugucaugccccuacuacccucucagcaucuguuucugcugccccaucuggcucagggcugcagucuggccgcagagagggaagcucucuaaggaaggagaaugggcugggagaagccaccugcugccccuuguuuagcaggcugcauucccuagcaagccagcucugacuaucucagugucgcccuucuccuggucacccagaccgcccuguuccuggggcagcucaugacacugcgagggguuugugaagggucuuucgugggagggcccuuacucagagcucacaggcauuugcucgaaagacagcaaaagaggaccuaagacauggggacuuuucuuugagucuuuuuccugacacuagguccaguggaggcucuuugcccaaauggaacauuuacagugagaaauggacaggagccucgacacccccacccuaugcagaauuugaccuccaccccuauuuuaccaaggcaagcccuccagcaaaugaagcugucagacaggcuuggggggggggcggggucacagccugggagggaacugccucccucucaccccuuggugcuggugcuggugguccccagguugaguuggaccagaauggagggguggagggacuccccuccaggggacuccccuccccuccagggacuccccuccagagucccuccccuccagggacuccccuccaggggagcuaccugggcuggcugggcucuggggcuugggcagccuggagccuuggguuuguaaagcccaacucuggcucuuguaggaggacuggggggaaagguguagcagcuggggucacccuugcacauguguuuuuccaugguuuggucauugccacccuuaucgagugguagggaacccagacaccaugaggggagaaaggauuugcccagggcagcaaagcugggaugagucuccuucccagagaccagccaucuucucugaggguuccagcaggcaugagccccagcagguaucuaagcugagggaucagcacugccuggguccgcccaucucuaggagcaaguucuugggagacaagggaguuaucccuucaccacuuaccucaugaccagaugggaguacuuauguuucugcuggagugaugggggcaggccuaugugcugguccccagcuauauucugggccucugccuccauuaaagcuccuugucccagagccacgugaaagugcuugcagacagagcuuuccugaaacacagccagagguuuccuaaaacauagcaaucagccucugcagugggcagcccaagucuugauggcuucauccacuuguacuugacagauccauauuuggucccuguacuugacugcaggggcagcacucugggcugugucccccuucuugcccuguccagcuguuucuuuaugcugacuccugacccaccccaaagggguccacacagaucugagcugugagugaucccugugagccuagcugagguuggcacacgugggguggcagagcugggugucugcucagcuccuggaugcaaagcaucccaauucaccuuugggaaagaagcccuucugcuugcaccucugccuguggcacaccugcuccugcuugugcauggcgcccagugcccagcacacaugcacugagacaagcccugacaccugugcccucuggcugcaucucauccaugagcagcgauauucagugcuccgggaaggcaaggcugaaggcguuuugcucccuugcccucccaguuugcuuaggaggcccugccuggcguccuacuucccuucugcacaguuugggagccauccuaauccccugcgagccagcuucucugggaggugccgcccucggggagucaggcagcggggaaguucuacaaaacuuucucugaguuaguccucucaucuuggaggcugagcacguccuguggugugagagggagucuuuucuccugccgcucccgucuguguccaucuccucacgcuccagcaccugcgucauugccugcugccgcccccgcuccuccagcgcacgggaaucugcaugcaucagcccccugcgucagcuccccucucacuccacucgcugaugacaccaggcuugcuguggucgggauaacaggcucuguucagccaccucauuggcuccucgcuccuaucuauccaaucagggccaggggccccuuccuucgagguugcugggcaaccuucagaggccacagaggcagggagaaagguagagcaggaacaugcccaugggcauuuggaggccaucugaauucagggaaggccuguccucaucucccccgcccagcccugccagggacacuuccucagauugccaucucucagcccacuuggccagagacaggaagagggagaaagaaggggaugaagggcgggccggggcaucugccuggugucugagguggccuggccugugcaagaggaguuggacuuggcccugaacugcccugggacaggcugguguugccugaguacggggcuuugcucagagucagcacagagagggguacuguggaguguggccacaucuuguggggcuucgggggugcaccacgagggacaguucaugcagagggugucagaaaagccaaccauuccuuugguggcccaggccagguccuaagcaggaugauauggagauuuccaaaaaaccagaagucuucuccaaaucaagguagaaaugagggccaugguacugaaaaggccuagaguggcuguccugaccagaaaugugcccacacaggccaucaagacacccgugucauggcaugagagauccagagaggcacauguucuagcuugguguauccugucaggaagagacccagugagcaggcccacagaugccaccuuacagaugaggagaccuagacucggagagugggaugucacagccaugugaggccacuuagggaagaggagcagagauguaagcacaggccacagcccauggggacaguguuugcuuuuggguuguguggccucucugggugucagggcuaauggacuuugaaagaagccugaguucgcagaggaagaggaagacuggaagacuugggcagguagcaagccccuggcaccacuuucaaagguggcuaaggaaggaacauuugcucuccaucuucuuggcaggguaaaugggaaggugcagggaaccccaguuacagcaguuucuuuuucuucaggaacuuuuucugagucuuucucaggcacaagcccagaggcaugagagagcuugacauacuggacucagauggagagugagaguguagggcugcgggaguggguggccugcuccgugggguccuggagucacauguggcaggccucuguggcugcaucaggccgagcagcacaggcaggcacggugcagcugggugagucugaagugucuccucccuccagcgggugagcauugcugcuggggcccagcgguuuggaggaagccauagaggcgacuggcagugggugugccccaggagcacucgaggccgucgugcaugggcuuaccugggccacugcguggcugggacucagagcccugggaguguggccagggccagacacgggcccacuccuggcugacucugcugaaggggaagcaggagcauuggcacagcucuugugcgugggcugcacacgguacugcuggccuucugagaccugaucccaggagugugcaugcagggugcccgccugacacagggguggugcuccagcaagggaagccaguguuguuauugcuucccagaggacggcaugguucucaucgcagagcggagcccaggccacugucccagugguugggucuucuggccgcuuugcugggaccugggugcagcccuggggagggcuggaguccugcacacaggcucuggaggcuucacuggcuucccaaaugggguucacauccgcuaaugacugccccggagagcggagagcugaggguggcccuggggcagcagccaugguggccagaggguuuaucugccaggccucuguggugggugcucucucccuggguagacugggccuuuccccccacccccugcugccacccauaugaaagcagacauaggcaucgcauguccacaccugagccauaaccggucccuguaccaggcucuucagauauucuggacgugagccucgugagcagggaguuguccuugcccccuggaguacuuugcuuucuguggaggucccucuggcugacuugccaugggcuggggagccagggcgggauugcguggggugggagaggagccaucagugggccucaugugcccuccugucccgucaucucuucccugggccccguacaugugugaacggagaagccggccuccugcuuccaggggugccaccgccacugccacugccgcugcagcaaccucuguuuggcauccggcccgaaacaccccugccugcucuccgcuuccuucuccaccccagcuugugggaaaagacgaaggaggccccgggaagaggcccaggcugcagcacugcguggcccaaagcagugcacagcacagcugggccccagaggcugagggccugcccuugcugcuguggggauuuccuccucggagugagcaagcaagagaagucccugcaucuguucauucuccucaccucccauccuuccuaggcacugcuugccuggcaucaacucuuuuuuuuuuuuuuuuuuuuugagauggagucucacucugcugcccaggcuggaguguagugaugcgaucucagcucacugcaaccuccgccucccagguucaagcaauuuuccuaccucagccucccaaguagcugguauuacaggcacaugccaccaugccugguuaauuuuuguauuuuuaguagagauggaguuuccccaugucggcuaggcuggucuugaacuccugaccucaggugauccacccaccuuggccucccacaaugcugggauuacaggcaugagccaccacguccggcccugguaucaacucuugagacuaaucccuuggcugcucaagcauacuccacucgcacuucauuuggguaaaccaccgucgggcucaucuuuagcacacagaagauacacguucaugacaggaaaauuagaaauacacaaaggagcaaaauauuuugguguauaucuuuacagauuuuuuccccugugcauuuuuauguaaauauauuuugacuuagaugacaccaucauacacauccugcuuuacgggcugcuuuucacugagugauguauagaaacuguacacaauacagguuuauaaagcauguuaaauacuacaugucucaguaugauuuguaauagcugcauaguauuugcuugaauggauagauuacaauauguuuaaauaugauugaugggcauguagauuauugccacauuuucacccccauacucaacacugugaugacaccuguuucauauacaucuuugcuguacucgugcaauuucuuccucaggcuacuuggcugcgaggggaauuacuggaccagcaggccugcccuuaagccuuuugauacauacagaaacucauucugucgagauuccugguuucccuucccacaagagccaccaggaagccaccucuggagggguccacauuccauccuucaaggcugcuuacauccguagcaagggucuuccuggcugucacugaguggagggccacucugcccugcucucugugaagggcuggacaaggggaggggacgguggaucugggaggagaccuggguccgagcagggguagguggcuucaggcaaucacucccugguggggugugcugggcugucacagggugccugggcuugguccuugcugagguugggggaggagcagggcuugccugggaagacuuggaucugcaggucugugccuggcugugggaguuaggggaggggagcacccaguaggagcagggcuggccucgacgugccgggcccugagggagaagcagggcuuagcucggcggaaguuggaagggcauuucaggugggcggaccaguauaagcuaaggcacaggcauucacuuggcagggcuaccuuccagggacuccaaggcacauggucugcuuggagcacagugucggcauuggggggaaagaggcuggcucaggggacuggugauuuugcucccagucuuagaaacaguguggaaccaucaggugcugacugagaauugaaggcugaugugggccaagugggauuagagaccaaugaguguugccuggaggaggugcagauaaaggcagcaggccagggaccagggaggaggucucaagggaucguggccuagaccagggcaaauuggagggagaagucagcucuguagaugggauguacauuccaaccucauuugcccaccccacccaccccaccccgccccaucccaucccaucccaucccaucccaucccaucccaucccucccaucccaccccacuacaucucaucccaucccauccaucccaucccaucccaucccaucccaucccaucacauccaucccaucccaucccaucccauccaucucaucccaucccaucccaucccauccaucccaucccauuccauccauccaucccaucccauccaucccaucccaucccauuccauccauccaucccauccaucccaucccaucccauucaucccaucccaucccauccaucccaucugauccguccaucccaucccauccaucccaucccauccaucccaucuaucccaucugauccgucuaucccaucccauccaucccauccaucccacccaucccaucccaccccaucccacugccugacacucaucacuuuaaaggcuccuugucccaaagaacugccuuacacuucaucguguggaaagacucuacuuuggcagagauuuuucugacucuuucauauuuauugucucaucaaaaaagaaauuucacuugugagacucagccaggcgugagggaaaggagcccaugcagaagcaccagcccuggucuuugucuggcaauaaacccggagucuucugacuggagucucagcuauaaagacgggacugaaggcagcauggugcccucugcaggggacggaugguguucccacccagcccugcccuccuuugccaugggucccucugccucugucauucugcaugugcaaaagugucugucuugacuuuggaaguggcuuauuugguccugauuuggcaggaaacuucuaggcaauguggccaucagguuugacaagggguaacugaugaguccuugugccugguacugggccugggauggaguccacccccgaaacuguggaugaccgucaccugcuugccacgcucauauguggaagcugguggcuacagucccugaggccuuagaaaggaguacgucuuugaggugcccagcgcaaaauaagucauacuagcuaguacagccuagcaagguuagaaggaaccuaaagacgaaagacuaggagguccuccugcaggugaaaagcugaggcccagaugaagugaggaacugucccaaggucuguagucagucaguggcacccagagacucugcacaugugcccugcccauggggccacuccacagguugcugggauggggacaguuaggccuguauggcccuaggaacaccuguggagugagcgccacucaacagaacucuaacguggcagcuuuggugcagggcugggcacgcggggcucccauuugcagugaugaggugccauuccuggcacacagcaggcucgggcugucugggcugcucguucagugcaguuuauggaagagccagcucuugcugauguggcaaauuugguuugcucucgucccccugcccugcccauuugagugugccccugaccuccacagaaacacauccaggcccugccagcuggcagcagugcugagcuggucagacccuagcccuggaggggcccaggggaugaaaggcccuggagagaaaggcucuucugcuuugugacuaugccagcacaaccagggcccugcuuccugucaugcccacaagccugagcccccagccccuauuuugaggcccaaggguucggcuguggccacucagggcucccugcagcucugggucgcucccagccuggagagccagcuucaucacccugggcccuucuccggagcaaauggcccucgagaccaccacagcucaccccucaugggcacgagagggcagcacugggcucaagggcagagaggcugaaggcaguguggcaccgucugggcagcaugagcagcaccgggcucagggguagagcagggcgagaagacacagaggaagaggaagcagagcucaaggcagcugugggccagggcguaaggaagccuaacuuaccacauugccacacucgccuguucccugagggccacuaggauuuggcaguggggcccugggcuuuccccacugaagguggagccaacccccgaaggaaacagggcugcacaccccagaccauucuuggcgcuguuugaggaccaccgcgccucuccuagcagaugacuugagagcuacugcugcuuggcuccuuuucagguggugccggguacuuauaggagcaucggcgcauuccauccucacagcaguccugaaagguagaauuuuuuuuuuaacuaucauuuuacaaaugaugaaacugaggcagcucggagagguuagcugaccugcccaaggucugucagaaaacuccuaaggggugagaagcaagguccaaccccaaagcagcuggucccccagcccgucccucuccacaggccaucugccugcccugaagcuguucggcuuuggaugcacucucucccacccucugaguccaccagugccagcugucuuccccacaccccccagccugagccaggcuguuagcacucuguaggagggcucauguucucccguuaucagugaucgcuuugaacagacagucccuggcagccccugagcuccacauucucuaggugagcagcccugggcaggcaggugggugugccgcugggcagcagcagguacagugagugcuggcccccuggcuucugcccauacuuagcacuccaccaacgcuugccacccccgaugugcagagggcagucuggaugaucuugguguaccaggacccauauggucaccugcaagacacuacaaaugcaugaagugacagcauuugcuuaccuuuauccccagaagcccugcugaaucaagugagaggagagcugcggagcaaucaccaugaguaucucagcucuuggaggccgcaccaaaggugaggccugggcucccugguuucccaggcucuguuuggggcuguuugcuuccaagccugccccuacaggccacaagcacugucccagcagcaaagggagagcagcauacugggagaacuggaaaggaggucgaggguccuggggcugcauuccucuucugaggcgguuggcuuuucccaccacagggaagccucugccaccaggcgaggaggagcgcaauaacguucucaagcagaugaaagugcgaaccacgcugaagggggacaagagcuggauuaccaagcaggaugaaucggagggucgcaccauguaaggcaaggaggcggggagggaccgcagcaacgugggggcgcgcaauccgugggggaccgaccauaccuggggaugcgaaggggcuuccaccauucagagcuccgccaggccauguggagggcagagcgugggaaaggcuauccagcaaugucacagggugggagagccccugggugccugggaaggagaauguguggcagaaauggcaggacuugcugggcagccucuaggauggaggccacaggauggcaggugacagggagucucggagccaauccuucaggaugccucuuucccccagagagcugcccucaggccggagucgcgccacauccuuuucaucagcuggggagguuccgaagccuagguaagagguggugcucagguggcuggugggucagccccagggacucuccugcagcuuggggccagcccucaacagggaggggugggcaguccacaggggacagggaugcagccccagccaagggucugcaaugaguaauuugaaaucugcaggaaggaggggcuucuccacugcaccuuccuuuugggaaggggaguguaggagucacuugguccaggcccuuggccuggcuguguggcuguggggcagcugacuucccugcugggccuccguggcuccagcuguuaacugggauugaaauugucuuuaagaagaagacgaccucccacccauucccugcagggagugauacugccucugagaugcuuugggcagcuuccagagucacagugacucacuccugcaggucacccugacugcuugaguguacuugggacucagcaugccuguagagaggcacgaguuugcucugacugucucccaaguuuaccgugacauauuuugucagcugaccaaggagaacuggcuucucucucuuuugggggcuuuuccauaacagugucuaggggggcucugaagcgugggcacacccugcuggccucuggaggaacugcuccugacagagaaagggaacugaaauucaggcucgcuccuugcuccaaacagccggcaggcggcuucucagggggugguagaggcaguggcggccucuggaagggagggccucaaguuuacagccagcacacagggcuaccuuuaguaacuacggucucucugucaccccucgaugacucagcgcccacuaccugccaggucccaugcugggcacagaggaugcaggaguggucaagacaaaggcccugucuuugggcaacugacgucccagcaggggacucaggcaggacccuaguaaacaguucaauacaaaagcgagaacccccaagugugccugcaacauggccaccucugggaggcuguccccuguuagagauggagauugugggguuggagacuaccggaggcucuguguugcccuugacccaaaccccgaugcuccagcccacauccccuccacugcaggacagaagggucuacccugaccccuugacuccuccccuaacucugaggaggacucuuugcaggggccccuaacuccugcccggaggccagaacuuccaggcugaccaccccuggcugucagcucccugcccgcucgucuuggcugcccccugaguuaucugagcccccucaguugcugccaagcaggaggucccaagcacccagagccuaauguuucccagccgcugaacaaggccuggccgcgcccucucgucucaaacuuccaccaagacuuggggugugggcaugcaaggagcuggagcaaagagggccccgagggacaggaagggggacagcuggcuucggcuggcugcugccugggcucuccccuucaagcccucaugcaccuuccugguggaggcuguugagggagaucaggucagaccccgggcugaggggaagccucuggcucugacuggggagccuccagcuugcacugguucagccccaagcacagaggaugggagggcugucagcugagagcagugcuccgucggcgcagcacugggaacuggcuggccaaggagaagcuggacuuuggagaggccaucaagcugccuuccuaggcaccugccaugaggagucaccuggggcacuuuuccugggggagcaugagggaaauaggcagagcauagcgggcaccugaucaggggcacagggggcuggcaccccucguuucugcuguacugggacaccuggagcacuugccagccaaucuuauuugcuaucguuaagggcaggauaaaguaggaugaccucagcccuccagcaagccucgcuucacuccaccccuucuucucuucggcaggccuccgagcacaagggcucccacuggcuacaucauccgguaagugaccgcaggacucugccggccuuccugugcccacucacgccaagcccugacuucuuaccccuccagucccuccagggagcucaccggcaucuccugggcucucuuucaggggaguguucaccaagcccauagacagcucuucccagccccagcagcaguuccccaaggccaacgggacuccaaaaagguauguccaugggguguuggccagucggccaguggggaggugugagggccuggucugggcuccuggcagagacagugcucugccuaucaggacuguggggccuuggaggugccagcuuucauccuggguagggcaggacccuggagagcaggguggggugaccagaggagaugggcuggggugggacuggcagucccaaguggaugugugggucucugggagguccugggccacuaacaguguccuuguccuggggucaguccugacuaggccuggcuaaugggacagagaggugcaggaguuugggaggggcuggguguagagucccccuagccuggcagugggcacccuugacuugacuugcugauggcauugagaaggcugaaguugcaugcaauucaagcaccuuggcaucaggcauugccugggacuccgucagacuggaaaggccaaggggacccggaaacaggaagcaaagacacaggcaagagcccgcugggcuguucccugaagcucggugggguuugccuacacagcugcucugaguggcgcaguuccgggugucugucagggccaaaagcaaagaggaaaggcucccaggcagcuccugguccaccucucauguguccacugggcuguguggccaaaucuggaggcaggagggagccugcagguagacacauggaaccuucuccucucuagugcugccagucuggugagaacagcuaacgcugguccuccccgccccuccuccucuggcuacaagaugaccacugaggauuacaagaagcugugaguaugcaacgccaggcucagcgugguucccuccuccaaggaacaaguccaaacucuggguccacugaaggcagcugacuacuugccaccgagcacagcccgggaagucccgccugccugacacucccugccaguugcagcuguggccuggagcccaccagaggguaacaagccccagaaaacuggauggcugugcacauugcacgucugauccgaggcagagcggagaccgcaggaagcuuguaggaggggccccacggaucuggggaaagggucaugggucgugaggcugcugcuggcuggcugugcuuccugggcuuggcccugcacccggccgagccucaggugcucugccuggcugcacugggcugggggccuggggauccucagggugcugcugucagucugagcauugugugccuaaaucugagcugcuucuuggauagaaaccuucggguuuucccuuagugcuccccuuggggucccuuucaaagccccccaccccccacugcaugcucagggaggaggguucucuggacagaggugugaauugugucucuaguucccaggggaccacaucuuuccguuguuugucccuugccuccaucauccaggguuggggagcugcuggguaaccuuucuggggaaggggagaggcucgaacagggagggaggggagagcuggucucagggaggaacaaguggcaugaccuaaggcccaaaggcagagauauugacuugccucgucauuguuguugaaagccaggaagccaagcugcugaggguggcagccuaugacaggaaagcgccucuccccucucuuagggcacccuacaauaucaggcgcagcucuacaucaggggacaccgaggaggaggaggaggaggagguggugccauucuccucagaugaacagaaacggagguaauggaauggugccuuuugggcaucccggggggcagggcaggagccugagucuucgaagacugcuggaaugaauuguacugguuggggugacaaaaugcacaacacguaggccaucagcgguagcccacggagcaugagaauaggugucauucucugagugccagaaccacccacucaguguuggaccagcugaggggcccuugagaaccuucugugggguagaaccuagguaauguggguccggggaaaagccuccucauguggaggcucuucagggcucuaaaucgguuuguuagaaagggcccugagacaguugaacaaaaauauucagggagaagccaccugcacagugcccucuaucugcaugaucugcaugccuuggggguucugaaugccccggaccccaaacugagcuccaggcaugcacagcagugggagugugccccaugcugcugaaauucuacccuagucucugcgccaagcugcccucguccacacaggccagcaaaguuccauggacccuugccccuccucaguccucuguccauggggacugaccacauaccacccagugcuggugaacuaugacaggaaggguuuguuaagcaccuuuuguaugccuuuggcuuggggccuguacagcaguugggcccugaggaaauaaagcccuccccucccugggcucagccagccaccagguccauaucugcugacccaucuguggcgcaggaaucacagcaaagccccauugccaaaggcccuggcagauuggcuauccucagggaacaguucacaguggcaggggcccccaggccuggguggagcaaggaaaagagccagaagcuaggagcugccuagcauugaaugccagcucugccaccugcuaggugagugcucuugggcaaauaaugaaagcuucuuggacucaguuuccucaucuguaaaucacagaggauacuagcgucuacuuuccuggauugagaagagcaauaagccaaugcgaggauguuggcaucuggcgcagagccgggcacaugccacaugcuccauaaacaugggcugcccuuccuucagguucuacauuuccuuugaauaguccuuggagcaggugcaaaucugguuucucucaccccuugccucccugggguggcccuaagucaccccgaguccaucccaggcuaggcuggcagagcauguccagcuuggcacccaucagaugcucccccaucccgugucaccccaggucagaggcugcaagcgguguucugaggaggacagcuccccgggagcacuccuacguccugucagcggccaagaagagcacugggugaguugccaccaacuggcuccaggcucuaggacagcucuccucuccucagagcuccagccuucucuggcugaugaaaggguggguggagagaucacccccaagggccuuccuagcugagccuucucagauucucagauguacuuucuagaaaauggagaggucuggcggcuaccaccagggacagugaagugccgggaauggagagggcccaggacccucugagguagagcggucuugaugucaccugcccacgggcucugcccaaagcauugccuuucugcuuccuuuccagcaguccuacccaggagacacaggcaccguuuaucgcgaagagguaagugucaucaagggacaccuuggaggccuguuacuggccacaggaaggccuuccgucagcagggguguagugugggagcuguggagaggggauguggaugugggggacuacugucccugagcagggggaguugugaggggcugggggcuucugucuggaggccuggcaagcaccuggguggcugugguagcauauguggucaagcucuuccauuugccaauggcuaauggggcugggccccugacccaacguggagcauuuccaaggcccucugggaguuguuccccugccccuguugcuugccugaugccuugccuucugcucucauccaggaucaaaaccugggccaucaggagaacuuccccugggaggugacugugacauuggagaugggcccuaaagggugaacagggcuuaacagggaaugaucagaacgucgggauacuccagcugaaugagggaggggugucaccauuaguugagacagggcaccuucuggaggaggaaaauauucgggggaaagcaagaaagaaacuucuggaaacuugaauuugagggacuuccaguugaguggacagggaaggccucucucugugcugagguggcuagcuggggacugcaaacccaagagaagacagcaugccaacugccccaggcagagggccccagugcacaggcccggggugggacuagcuugcuguguuggaagaccaggaaguuggcaggaauacagagagcagggaugguggcagcacaaaggaagugacagagaacggggggcggugggggggucuuccuggcugcauuugguuccugugguuucuguaacgcaguaccaaaaacugaguggcuuaaaacaucagaaagggauucucucccgguucuggagaccagaagucuagaucaagguguuagcaggguggguuccuucuggaggcuuugagggagaaaccaucccaggccacucuccuggcuucugcuggugguuggugauccuugguguuccucggcuuguaccugcaucacuccagucugugcgucugucuucacauggccuucucuucucugugugucuguguccagauuucccucuucuuacaaggacagcggucauuggauuuaggacccauccuacuccaguaugaccucaucuuaccugauuacaucugcaaagacccuauuuccaaauaagguuacagucacagguuccaggggacaugaauuuuggggggacacuauucaacccaguaugcuguccuuauccugagcuggagucacugaacccccagccugggccaccucuuggccgugauccugaaggguugggucaguuagacgccacuggaagcauguucuuugaggccuccaagcucuagggcagccaagaagaccacgagcgcuguuucucuucuugcucaaaggguggaggugguggaagaggacgggccuucugagaagagccaggacccaccugcucuggcaagauccacuccuggcucaaacagguaauccauugcgcucaucucugccuggggcugguggcugccauaccugccacucagucacugaggaaccucagucagggcaccuccaugcugggcuucgagaucaguguccccaugugcccagugacaagacgggacaaagaaaucaguaagagcccaucuggcuggaugucccagggcugaaaggagcaaaacaguccagccccccgggagagagcaccuggcucuggucugaugaguacguaucugugucaccuuaacccuugcaccacugagccugguggcaacuugaacaccccaagaaaaaguaccauccuugggguuugagagggccagccaccauggcaguagcaugccauugucagacuugcuccuugcacuccaauaaguuagccacauucagcaugcccagggaggaggcucugacaucuccagagccucucacagccaccuucuuugccagugcggauggaggcaggaccaaagcgucucgggcaauuuggaucgagugccugccaaguaugccuagccccgcugggagccaggagcucaggugggugccgagagcugacucuggcuugugagugggugugauggcuucccgccagccuggcuggcugguucugccagcuggggagggucuggcaguggggugauggggcaaggacaggcugagcacuggugaucucacuccaggaagggccgugauuugucuugauuucugaucccugagaaucugggcagauaauggugcucucuugucuguggacaacuaauaccuucuuguacuuugugcagaauggugcuaaguccugcagggagagccaccaccugcuguugcugcuguuuaaagugccugccuggauugagaccuuugcucaaaucuaggucuccuaagagcugcaucucuguagcacccuuggaagaccccugcauccagaaggggagagggccugucccuaccggucacuucccaggcccccaagggcuguucaggcucuccuaauaccauagcaaucccccaauuugagcuccacagccauuuauagacaggugaccacuguccucaggguuacuuccucagucugggagggagacagaaaugcuggcagagggagccaggagcaugaggccagcucccuccauggccccaggcagcagacugccagggugcuucuccuuuucacucucucccucucuugaucuucucugguugucugacucuccccauaagaacuuugguccauagaagauguggaaaggaagauuugagaauucuuuacaaggcaauaucuagggcagagcuccccagucuuuuuggcaccagggauugguuucgugaaagacacuuuuuccacgggacggagcaggggaugguuucaggaugaaacuguuccaccuuagaucaucaagcaccggauucucauaaggagcgcacaaucuagaucucucacaugugcaguucacaauacgguucgcgcucucaugagaaucugcugaucugacaggaggcggagcuaaggcaguaaugaucucuagcuuaccuccuacugugcagccugauucccagcagaccacagacugguacugauccucaggcugggguuggggaccccugaucuaggggacuuggcaauugagggauaugggggcaaaggcugccacaacaaaguauuguaccacacccuggggcgcuuaaaccacagaaacguaucaucucccacuucuggaggcuagaagugugagaucaaggugacggcaagguugguuccucuugagucucucuccuuggcugguagacuccaucuucucccugggcccuuauaugcucaucccugucugugugugccugcguccuaaucacuucuguuuuuuugagacagagucucacuccgucgcccaggcuggagugcaguggcacagucaccacucacugcagccucgaccuuccaggcucaagagagccuccagccuuagccuccugaguagcuggggcuacagucacaggccaccauacccagcuaguuuuuuuuuuuuaaauuuuuguagagacaggguuucaccauguugcccaggcuggucuggaacucuaggacucaaaugauccuccugccuuagccucccaaagugcugggauugcaggcaugagccaccgcgcccagacccuaaucacuucuuauaaggacauugguccaacuggauuagggcccacccuaacaacuguauuuuaacuuagucacuucuuuaaaggccccaucuccaaaugcaguaacauucugaggucaugggggaguuaagaccucaacauaugaauuuuggguggcacaagucagcccauaacaguauacaguucucauuucuccuuauuucucuuuuaaagaaaggcaauaaaugguuucaggugccuuucuguuuguucguuuguuuguuuuguuuguuuuugagauggagucucgcucugucgcccaggcucugucgaguacaguggugugaucucggcucaccgcagccuccgccucccggguucaagcgauucuucugccucagccucccgaguagcugggauuacaggugcacgcgaccacgcccggcuaauuuuuguauuuuuaguagagacggguuucaccauauuggccaggcuggucucaaacugcugaccuugugaucugcccaccucaggcucccaaagugcugggauuacaggcgugagccaccgcgcuuggccucaggugccuuuuagaagauaauauaggaggcugggcaugguggcucaugcccguaaucccagcacuuugggaggccaaggcaggaggauggcuugaagccaggaguuugagaccaaccuagguaacauagcaagaccccaucucuacaaaaaaauaaaaaauaaaaauuaaaaauuaguugggagcauugauguacaccuguagucccagcuacuugggaggcugaggugggaggacugccugagcccaggaguuugaggcugcaaugagcugugaccgcacccuuacacucuagccugggugacagagcaagacccugucucuaaaacaagaaaaaaaagagagaaagaauggaggagaauuagauugugcuguauuauagauuuaaaaggcacuuugacauuuauuccacaaaauuccuuucgauguuuaauccccaucauaugguugucauugcaagguggcuuuuuaaguuugcucagguugccauaacaaauaaaggcuagagauucaggguccggggcaagcucccaacaggaggcucagcuugaugcuucugauaguucuuuccuccaauucuggucacucaauauuuggagcucacccaggcagcuuccaggaaagcugcuggcugauccugacccuggagggccgucuucucugacccuaccacguuaggugcugcacuggaccaagcagccaccaucaguacucccaggcccagcuccuaucugccuggugucugagaagcccagcccgugaggaacaaugacucaaucaaacucaggguccugcagcacuucagaaaaggcugguuuguggcagaguggaagaggagaaugucacagccuuguccccaggcacagaccuaucgaggcuacccucuccccacccccugcccugcccuguuucccuuagcuacagugcaaaggucagcuccucauaacucuugccccccuugcaaccugaacccaguuuagggacccucucuuggagaaacugguucuacacaugcaccccuucucggcccccaggccuggcugcuuuacccgaagcacuggucaagcuugccucaccugaccagggcauggccuccugggucccgguccuaggcucugcccagcaugcugccuggcagagcgucuggggagcagggaguaggagcacagcuucuggcacaggacaaaacccuggcuuugcaucagacugacugugugaccuugagcaagucucuucaucucuccaugcaucaguuuccccguggauaaaauagggagagcaguaauagcuacuucccaaggcugucccaaaugcuaaaugagaucgugcaccugaaguacuuaccacagugccugggugcugguauccucgggggcucccagucauaggcgugcugagcugcagggcccuuauucaaauacaggaagagaucaauaucuccaccugcuggcauuugagggaaauguggccaaaggcagugaaaaggagguauccccucgccccacauccccgccuccucgcucuuuggcagaaugagucacacacuguuuggcacaggccacaguuggucgcauucccacagguggcugugaucaguuuugggcuucaggcuucagcagaugccugccucucuuccuugggugccuuccaagggugugcagccuuccagcgugguccuggacuucagcuuggacuggagcugucugugguugagagucuggggagaugguaggguagcggguugugggggaggagagacccuuguauuaguuuacuggagcugcuguaacaagguaccagaaacugaguggcuuaaaaccacacgcauuuauccucucacaauucuggaggcuggaagucugagaucaaggugucggaagggccaugcucccuccaaaggcucugggggaaaaucuguuccauaccuuucucuuaccuuuuguugccugcaauccuugguguuuccuggcuugcgcccgccucacucccaucucggccucugucuucgcgcagccgucuucccucugugucugcccacauugcccuagucugacaucagucacuggagcaggcuggggugacacuuuguucccauuuccucugugacagagccagaaacgccagugagaaaauauguugugcuugccugugacaucccuguucccuggcaccaccugauuuaaaugaggcagccagggguuuuauacugucaucauaaaugacaucauccucaacaacgaugucaucgucguuaucacgagaggagauggggagaagucagagcugucugugugucuagggccccuccuggcuuucaugaugggagaggccuuguccuugguagcccuuccauuucccucuggucacuuugagcacuccaggcccuggccaggguggaaguggagggacagagaugagcagcccgcugacccagcccuccauggcucauuccuugcuuucaccuuggccacuccauccccuaccccuccugggaccccugaguggccucuuuaaagugccagucugaaccuauaaaccccccaccuccacuucaagcccauccugcaucuucccuuugccauaccagaucuagucuguacauucaggaccccugccagccucuaccuccuccuccucccccgaucucccuucagcuggccugggucgggcuaugccuccaugaagcuuguccacugcucccauggcuaaaccuguucugggcccugcagcacagcaaggucaguuuccaugccucucugccccugccugacccugcugggcccagagcuucaccagggcaggccuggggcucaggcuugucugcacuuccagggcccagggacaaaggcaggagugacugcaauguggcuuggaauuaggcuuugcuccauggaccuaaggaggucugguuuggggugaaggguccacccccagaaagccugggagcucuauauucucucuggcccuggccacaccauggccaagccugcugggcgucaugccuugcaguacggccagagaaugcaucagacuuggagggauguguguccgggguggccuguggucaucugggggagggcucugagcguggcuggcaagaggaaagcucaaaggggcccuuuguccucauccccgagucugcgacauccccucccacugguuuucauuccauauuuggucuguggguuuucucagucucucguaccccucaguccccaccaguccaugaaugcagaacuaccccuggccucacaaauggccacuuuggauacccugguggggucacaggcugcgguugccccugcaaaugguugguagaagcacggguugggagguuucauuucuacccagaagggcccuugcugugccugagggagggcugggcucaggucaggggugggagaccggggaaggggccuacaggucaguggcccgagcucagcugcagcaccaacaaggcucaaggccaaggaggagaugagagcacaucaaaagggggcagugggucugggcggcccaccgcacucaccagcccaagaagggggagacuuuucucaccugcaacccacugggucucuccuuuggcccgcagcucaagaggugaggaaauuguccgccugcagauccugacacccagggcaggacuccgccugguggccccagacguggaaggcaugagguauggggguccugcugcuguccuggcucccuggacaccauucuagagauggaagcagcagccucagguggcaaaugaugaggccuagggccggcucugccacuguagggccaacagguugaugggaggcauggucgaccuggguuuucugccccaucucauucuuucacucagaaaaccauuauggagcaagcgcuuagucuguguaagggcacaggcccgacccugggacacaguagugaacaggacccccuggcuggaauugccaucugccuggugggggaggcagacgccgacaugagcaugaaugaggucagccagagaugcugugugccaggagccccugggaagugacagcucaacccugccaauugcugaagaugggaccagucagccgugcuggggauguuggugggggugggaggaggauugggucuaaggagcccgugaaggccacugaggccauugcccugccugugugagagggccacugggaauagaguggggucacugggucagaguccacagcucuccaugccacuaggcucugugcuggggaggggugggucaaggaggccacaaccagcagggagcacgaggggcucagccucugcccuggggugggggucagacagccaggugacaugcaggcaggauucgggggcugggguggaggcuaggagagauccgagcagggagacugggccccuaccuugugaaggccagggacuggggagagaagcgggaguguacacugaaggucaucccuuaaucccugggguggcaggaacuucgagcagaggccucucaacaguguggugggugggagugcuuggggagggcuuccuggaggaauugacauccaagaugaguccugagcgaucucuaggucccuuuacccuccuccuuggcuccucccacuuuaauucugcccccaaggcaccaaguccuguccacuuuauuuuagagauguuuccaucccuauugcucugccccuggcccaggccuccacugcuacucacccaguugucugcgaccguuuccuacugucccaucccuggacucccuuccacaucuaccugggugauguuuccaaagggcagaaguaguuaugccagcccccugcagaaagcccugcaaagccccucccacuaugcucugcagccugaacucaguaccuggccccaccugcaggcuccucccucccugggccuuucucugugcaggcuggaggcucugccugagaugcccuuuccccucuucaucuuucuguuccaccucaaauguccugucuucugggucauguccuucuccugaguuucuuccccaggcagcaucugagggcuugucgauucugcauggcagcauccauucugcauggauguagauacaaucacuaugcccauuuuacagauuaagaaacugagacccugaaugguuaaguaacuugcucaaggucacaugguccagagcaggcagauccgcucagccugcccuacucccaccuuccaccuucugcaccauagcucauuguacuaguuggggcagggagcagggggacagagaggggugauggaaagacuuggcauuugcugagugaacucauuugacgaguuuauucguaggcauugaagucaaaauuuccaggagggagguauuuuaagguuugugauugagguuugagagagugauuagggcucaagagauuuccacguuauaugcagacagaauagagcugaaaucaugagcguaaacuagcuuuacauggggcucauggugagccaauggaagcugggcaccgaccucaguaugcagguggcagccaccuggccagcccuccuggggacagcugggcgagggcagucucuucucgccauguugagagugggccuccugagggccaguugggaguuagugggugugcaggccaguauaaaggagaggcaggaacaaguggagaucccugcuucaaggguggcaguugacaccuugggaggggaggagacagcccagcaagugguggagcacgccaaagggaggagaaaaaggcggagaccaggaagguguguggccagggagguaggcaggugguguugacaggaucaagggaggagggguggugagaaggcuggaguggcccacugggucagcaguacugaauggugguuugaaauaaugaugggacugucucuccuggauuugacaacauggggcucccugaggaccugaaggagaacagaagggggcuuaaauuaggagauuaggaucagggauauaguccagaacucaaaucccagcuacuccucuuauuaccugugaaauuuggggcaaaucacaggggcuuugugugccuccguuugcucaucugaaagaugggcaugggugauaacagugcccauauccugggguugauuugcagaguuaaugcauauaaagucacgagaacaggcucaaaugcucaaucaacaguagcuauugccaggcacaguggcucacaccuguaaucccagcacaguagcuauaaaacaacaacaacaaaaaacaaaaaacaguagcuauuaguaaugaaguuuugauaauuggccaaucugucaaucagcaggguuuguuuguuuuugguucuguuuuuuaagacagcaucuugcugugugugcccaggcucaagugcaguggugccaucacagcucgcugcagccucaaccuuccagguucaaccucccaaguagcugggaccacaggcacacaccaccacuccugacuaacuuucaaaaauauuuuuguggagauggagucuagcuguguuucucaggcuggucuugaacuccuggcucaagugauccucuugccucggccucucaaaaugcuggguuauaggcgugagccacugcacccggcccaguagcagguuuuaagcuccguggagacagcuggcguuugaggaugagguaacagcccacaccugagugugaauggcugcugcaugguuaacuuccauuucuuuccuccauaggucuuccccaggcaacaaagacaaggaggcccccugcuccagagagcuccagagggacuuggcuggugaggaggcuuucagggcccccaacacagaugcugcaagguaacucagugcaggaagcagacacuucauucccagaacacggagcccacauacacccagcugaaggacuuccauggccuccggugcaaugucaauggaugcagcuggggccaggaagguccuguucccacuguucccccaguaccugggguacugcaggucuuuaaugaacaucuguugaaagaaagaaagaaugaaugaaugaggccuggagggagguaggccccugccaugauuccucagggagccaguuagagagcaggaccaaacuccagggcaggcuauccccagcuccuggccugugcugaguuccuuccauuccccugaagcuuccacacucacugugcuuuuacugcaggacaaagcagcccugccaauggccagggcaaagcaaggccaccaagcuggcagucugggagagucagugaccaaaguaugugggcccccauagagcauguagcggagacuuucaggaugacccguggacuaagggagacauuguggcaaggggugagggguccaggacgggaaguuggagccauagcgguggaugaugaguccagaugggaugauuguccccagucgcugcacagccagcccacugaccuguccuccaagccagaccagugccaaaugugucuggugagcaguggcugcaggcugggcauuucuucagugagaaccugguagccaguuacagcuaagaacccacacacccgucuucucaguguggaucccuggagccccuagcuggaacccugagcccuggaaaugaggaaaggaaucccucuauggcuuauuaccagacccacaugucuugccccuugcucuguuggcaaucagcuccccccaccaccaacgaacuaaccuccuccugacuuuccaccuugcucccaaccaacccaucagguuuggaaaaaauacagaaauacuuccuguuagagucaacuugggcuuggcucagcucuggucagagcagcacagaguagcagccaaaggccugugcuucuggucuugaggcccacucucauggcaucuggguuagaugagaucaaaacgcaacuagagucagcaaauacuccacuucucauaacaggucaagugcacaguugagugauggcaaugugggauccggagccacgggcucccggccugaaggcuuggcugcaguagacaucggcuccgagagaggaaggugagcugcccgggggaggcagguucucucaugccccuggugacagaccagggucaagcugccaggcugcuugggcugcuauggguggggcacuggucacuuccuauggcuccugucuacugcuucucccacacucccacauuccaccacauccuguguccuugggcuuuccacuuuuuggaaucuuguucauuuuucugaucccugccacuggcccucaagcuccuccagaguaggcacuaggcccacucacagcuggaggcccagcccucacauggugcuggucuugggcuggucaaaugaacguguagggaauacaugaagggacaaauuaaugagugaaugacugaaugauggaagagucggcaccuucuuacuucuugguuaagcucugaggaccagcuaggaggcccuuugcuccugcuuucucccuucucuccuuuuccugccccaucccuaccccaggcagcucugcucugagguucagggagaggaaaagcgguagcccuggagagaccagcguguccagcugggcucuggcuucuuggaccuggagggagucaggggccacuuucucaggugauuugcagaguggcaaggucccucuugucccuaagugguuccaaaccaagccugaaucauucuuggggcaaaggcuagguaugcagauguuggcauaaauaguuuagcuccaaacuaugcuagaguccuucugguucagagcagauggcuagggaggaguggcaaagccagugucugcaaagagcuacaaccgcaagauaucaucugccuccugcauccuacugcagucuggccaaggagggaauccuguggggaaggcccugcugaugcuuuccuacuucccucagcacacccagggccccuuucccucacuaacuucaauaguuugcaauucaugccauggaaccagagcccgaauucuaaauccaggcccacaagucaacacaggaaggggacagcagguccuggccucugaaaccacugucuccgagcagguccaaggagaggccaccagagacucuguucuuuaagcugccacuaauggggaggacuccgcuagagcccuguccaugcagccugcaucuuuuugccaucugcagaggcauuggagggaucuuuuuaaaaauaagcuagaucacauuucuccccugcuaaaaccuucuaguggcucuccauuuuccuuagaaugaaguccaaacccuuucccauggcccacuggguccugcauggcagaaucuuuggccuucuauccagucggggcuccugcuacucuccccacaguggugcagcuugacuggcucugcugauggcugucgcggaagagacuucuggucuacugugauuggguggcucuggucuccuccaugucaccccgccugcuuauacacccucauaacaugaagccugugcuguccacuguuuccuuaaaaugaaaccaagccucaaaguuacuuguaaagucaucugaagaaucuucuagauuuucaugaauuuuaacccagucuuuuacaguugucuuaccuauauaguagucccuagguaucugugggggauugguuccagaaccucacucauauaccaaaauccaugcauguugaagucccugauauaaaaugguguagcauuugcauguaaccuaugcacauccuccuguacccuuuaaagcaucucuagauuauuauaauaccucauacaauguaagugguauguaaauaguuguuauacuguauuguuuagggaaugaugacagaaaaaagccuguacauggucaguacagaugcagccauccuauuuuaauuauuuuucccacaucucaucucauccucuccucuccucuccucuccuuuuucagacaggaccuugcucugucaccagggcuggagugcagugcugugaucacagcucacagcagccucaaccucuggggcucaagggauccucccacaucagccucccaaguagcugggacuacaggcguggaccaccacgccuggcuaacuuuuguauuuuugguagagacgagguuuuaccagguugcccaggcugguuuggaacuccugggcucaagcaguccaccgaccucagccucccaaagugcugggauuacaggcaugagccacuguaccuggucccaaauauuuucaaucugaaguugguugaauccacagauguggaacccacaacauagagggcugaccacacuuaguuugacuauaauuuucaacaaacuccuuuauuguuuuuccuuuuuuuuuuuuuuugagacggacucuugcucugucccccaggcuggagugcacuggugcgaucucggcucacugcaagcuccgccuccugaguucaugccauuguccugccucagccucccaaguagcugggacuacaggcgcccgccaccacgcccggcuaauuuuuuguauuuuuuaguagagacgggguuucaccguguuagccaggauggucucgaucuccugaacucgugauccacccgccucagccucccaaagugcugggauuacaggcgugagccaucgcguccugccuuguuuuuccaaaggaaagguuguuucucauggcaacaaccacucuccuuuuccauucauuuucauggauuuacuuaaucaucgaacuuagugauucuucuccauuaguggcagcucaaagaacugaguugcugccccaggggccuuuccuuggaucugcucagagacauugguuucagaggccagggucugcuguccccuucuugugcaaauacaacuggcauaaagaggucugggaccaaacaagagcaccucuuagugagugugcugguuaguggagggcacaggcuuguauaggcagugauuguucagcaugccgugagcaucagucugccugguuuacagagacacagagaaugugacuccacccugagaagguuggguaagacauuccccacuaaauccauauugagugggugaauacagguggacugggaaggugcacugcuucuauaaacagccacugggcccugugguaacaggaacacauuagcacauguuauggcccaggcauuauucaaaguacuuggcaucuaugaacucauuuacuuuucucagaauacuuacgagacagacaugauuagcaucccuauuucauugaugguaaaacugaggcccagaaaaaaaggucagguaacaugcccaaugucacacagcugggagauagcaaagccaugauuugcaacgccagagggcaaccacuaugccacagagccccaggugucaggcugccuugagauauaaauauuguuccucaagcauccauuugagcagcuucuugguccucaucaucuguggggggcaggauccacuuucucgggagaggguagacauacagacacaaaguccugaaccuggaccaggucuggccuucuuucacaggcugugugcagcugcuagcuuugccucuuuccuggaagaccaggaugggcacagugccaacucucaguccugcaagccuagaccagcagccaucagguaagguuagggccacugcccuagugcccuaucccauugccagacacagccuuuggggcccagccucagcugcagcaccccaggaucccccucgaacuucucagcuccaugccacuuucacaucaggugaucacagcaagacagggaacuccagggggagcucugaccaggggcaguggaagaagagggaugggugauaugucugcucacccagagagcccagcaccaaccuacauggacccaagcugagguggcagagaggagggcaucugaaggcagagccugggaagagauccugcuaggaggucucagagaaccucugcuguagggacuacagccagguuuagcaagcaggagucagggagaagauucccaggggcagccagcauuagagggcucaguucccaggagcacaggaccgguggcugggaugggcaaaaauggcuccuggggcacaaagguacaaugggaagaagcugugcauucccaugcuguaagcgucugcccuguuucacccaccaauccaccagugggcauggccacuuugcuguggguguguggagcauuuggcaaguccuaguaaggaacgaucuuucuuaacucccauaaacccuacagagguguaggucagguaaggauacgucaugcucagggucagguuccagccgcagcugagggcuaaggggaauggguggacguggggcagggagcuggaagaacacucgagagauagcagguaaaugagacauggcuuuacucagcagcagcucucuuacacagcuuucucaaacuagcuuucucauuagcagcuuacucucacaccgucugcccugucuuggcugcuuaguccgguggccccuacgcacagcugcguggccagcucucccuugccuucagggucagcagcuuaauucuuucucucccugggcacgggcaagccaagcuguguccuggcuccccucuguccuggcuccccucuguccaccugcaaagacagacagcucuugcucucucucuuucucuagguucccgugcacccgccaugucaagcuauguugagcugagccaagccccaagagacaugucccccauacacagcgucaacagggcaguuauaccuuuuacagacaauagugguuuagagccaaguaugaacuuacauaaacagguuauauaagaaguggaggugugcaccugugcaccagacucauugagucaugcaggccuggauaucccccucugccuauuccuugaacaaagcacauccagguaccuuacaggauacuagaacccaaaaccaggagacuuccccagggaacccaaguuggucaggggcaguguuugcucuugaacucaggugcuaaggccauguccaaagcugacaugagguugucacacacaguggcaucggugccacacuaaugccaggacugagacaccagccuuuacuggaagacacaguuccucccuuucuggugagaaggcagccuggagggggaagaccugggccccagccuucuuuggucugagaucucagcaggccuguguuuccuuccucagcuccagugccacuucagucucugcugucccugcugauaggaagagcaacagcacagcagcccaggaggaugcaaaggcagacccaaagggguaaggcaugagcagacagugcugaacuucugggguggagagaggcagcuugggcuguguguccauuggccuuuggcugggaaggugaggccagcaagguuugugagcuggccugaggcacauagcaagggcagaagccccaaccagaacccucuggcuucuggggccagggagcuuuccacuaaacuguugccuuggccaggaaauacaucauagucagaaagggucuuucagucagcaaccacucugacagcaacugccuuuugcuggaggcuggagcaugcagacaaaucagaaacaccucugcccuccaggaacucucaggcagggggugggcaaaggcugguccagauuagagcaauacaugagcgcuagagcaggggaagggggcuucauggggacuguauguagcuggauguggucagcgaugaguguccuuguuggggagugcuggaagaggaggcucagugaacuagguagggcuugauuggccucuuguacugugauauuggaguccacugugugcacagcccucuacucacagugucucauacgguucuccucacagucucucaaagguuuaugccuaauuacaacaaaacccaaaagccuggagccuaggucucugugccuccugggaaggauagugcuccgaagaaaacagccgcagcugagauagagugauggcagugaggaggguacuacuuagguggguggaaaaggcaacucaggcgaucuccucuaaagaggagaaggagccaacucuagaaagaacacgguggagagagcuauagauaaggaaccacaaaccaacuaacccugaggugggaacaugcuuagcauguuccaaaggacagaguggcuggagcuuggccagugaggagggccacagauggagcagggccuugguaagccaugguuaagagauuggaucuuauuucaaguuuuaagccaaaggggagucucaugugauuuagguguuuaaaaggugaaugcauguuugcauuuucauaccacauugcuguugcuuuuuuacuuaaaccaagaugcugggggcuggggugggcaauggauaucuaagguaugaggccuuauuguguuucuuuucucauucgaauugcacugacaauuaacaaucagagugaaaacaacagcugacaccaauacugugcugugcuaggugccuuacagccuucccagcaacuugugagauggguaaggugggaaacugaagcauagaaagauuaagugacuuagccaaggccuuacaaguggcagaacugaguuccaagggaagaggcucuaagaaaauccucaggagaaacuacgaaaaacuaguuuaugaaaucuugucuuuggagccuagucucaagacccagaaucaguaacuuacagcugguuaacaugguuaacaugcugugugaucucaccuuaauuuuccccaaacguggaaaaggauaaggcuucuuauuaugcaacuugacagaggagaaaauugagggacucacuccuguaaugaacacacuuaggaacagagcccagauccagccaacucuagagccaggcucacgcuacuuuccucugauguuuaaacgucugcaaaaucagagguguuuuuuuuuuuuuuuuuuuuuuuugagacagaguuuugcuuugucgccccagcuggggugcaguggcgcaaucucgacucacugcaaccucugccuccuggguucaaacgauucuccugccucagccuccuaaguagcugggauuacaggcacaugccaccacgcccagcuaauuuuuauauuuuuacuagggauaggguuucacuguguuggccaggcuggucucaaacuccugacaucaagccauccacccaucuuggccucccaaauugcugggauuacaggcgugagccacugugccuggccaauacaaacuuucuugauuacaguguuucacaacucuggcuguacuugagaaucaccuaggaaguacugaaauacacuguugaugaaaaaggccauacucuguaaaauauuugaagaaauucugagccaaauguuaggacuaugacccgugacacagccucaggagguccugagagcaugugcccagggugguucacuuacagcuugguuuuuuauguucuagggagacauaagacaucaaucaauacaugugagguauacauuaguuagguccagaaaggccuagguauacauuaguuagguccagaaaggccggacaccucaaagcugggaguguggugggggugggggugggggugggguuccaggucauagguggauucagagauuuucugauuggcaauugguugaaagaguuguuauucucuaaagaccuggaaucaauagaaaggagugccuggguuaagauaagggguuguggagaccagaguucuuauauaggugaagucucauaaguggccgcccuuagaagcaauagauggccaauguuucuuauucagaccuuuaaaaggugcuagacucucagaucagaaaaaguccuggaaagggaaggagauucucuacagaauguaaauuucccccaggagagacagcuuugccaggucauuucaaaauaugucaaaaaauauauuuugguguaaaauacuucaauuucuuucauuaccugcugucugucaugugaugcuauacuagagucagguuggaauuuggcauauuauugcuucaaggagucuguuuugucagucugaauaucucucucaauguuaauacuggucaguugggcaugaauuccaaagggaggagaauauauugaggcaugucugaccuuccccuuucucaucaugaccugaacuaguuuuucacguuguguccccuuggcugagagaaguguccauucauucagcuggggagcuuagaauuuuauuuuugguuuacaacacaacaaaaacuucccgaagucccagguagagauuuggauuuuauuuuucuggggugggucuccaucaugugucuuuuucaaagcuccccaguuuguucuccuuccaggcuaggucgagaaccaucguucucagguagugguucugacccaggggcaucucccaaagcuuccagccugcuacgauacaaugucuggagccauuuuugguugucaaaacugggagugggagacacuacuggcuucuuauaugcagagaucugggaugcugccccacaucccccaacacacaccauagaauuaugggguucaaaaugguaauagugcuaagguugacaaaccuugcuguagagccuugacgaucuauuugggaagacagcagggacggaaaagaaaaagggauggcacagaaccacaccccucaccuuccccgaaaucuggguagcgggcacaggacgugugcgccugcgcgaaugcgcgcucgccaccagcguacgcgacgcgugcgcgccugugcaccucggcgagcacgcgcccguagugaguacgccugcguaggccgccauuucuugaagccccgaacucggucgcagugcccgccgggaaaaugcgaccguccacaaagugaaauggccgcccgggacgagcucggccucggcggggauucucuugaggccaugcccgugccggccgccagaggucgcccgaggaucacgaaugggcccgaggagcuggcugccccuucccccgcguaaggucugaagccgcggccagaguggcuuuggggugaccgcgcguggaccgucgccggcgggaggaagcgcggucccgcgaggggccgaacggggccccugcggcuugagcuuguuucgcagggagcccuggggccauggccucugggacacuggacacgggucgucagggcugcccagggggaggggguguggacgugcagacagggaaggcagcuggacccuccaaccacgcugggcccucgggcugaccggggcuggucuguggggcagugaggaggggcuucguucccuaggaguuugaugagggagcgccauggggguggcgucauccugacaucccgcagggcaguggagccuuacuuucccuagguuacaacacaguuuuaacugucccaaacuguggggacuccgcccuauuccaucuugggccgcuccaucacacuacagggagaggcgguauaguauagugguugagagccuggacucuggugcuuuggguuccaguccaagcucugucacuuacaagcaccgugaccuugggcauguuacucaucuucucugugccucagguuccucacgugcggaauagugguaaucauaccuccuaccauauaggguuguugaaauggccaaaucgguuuguauauguaaagccuguaggacauuuaaaccugcgagcuaagugaagcagcaccagaggaauaucuccuccucucagagguguucagggacaccuggaaagcuaacuuaaccagcuuuauugguuugauuucauuugacaugacacgauaucucaucuucuuccuacuaaacuuuugucaucaaauuuuccaucuagaacaugcuguuuuccucauuauguugcaagcaugggcuucucguuuauauuuuuucugcaugaggaucaggugaaguuuaggcaccacauuuccucaccacuggcaaccguuguuggccaguggaggcaguacaaggguggaagugucagcugggugcaguggcucauacccaccuguaauccuauacuuugagaggccgaggcgggaagaccacuugaguuccggggauugagaucagcgugggcaacguagugagaccucaucucuacaaauauuaucuauaucuauauauguauauguauauguauaucauauauaugauguauaucucauauauauauguuuuugaaacaauguuucacuucugucgccccagacuggagugcaauggggugaucucggcuuacugcaaccucuaccuccugggcucaagugauucuccugccuuaaccucccaaguagcugggacuacaggcacacaccacugcaccuggcuuauuuuuguagagaggaguuuuugccauguugcgcaggcuggucucaaacuccugaccucaacugauccacccacuucugccugccaaaguacugaaauuacaggcgugaaccacuacgccgggacuacaauuuccguuuuuuaaaagaauggaaguguguagauuaugguuguguuaggaguugacaguggcuguauuaggcuacuggaucuuugguccaauuacacucagaaggaaaggcuucagagaaauuaauccaaaauccaaaaucccguuggucaccauccccuauguuaccuugccuaucucuaaccacuugacuuccaggaaguucaugaggagcucggacaggauagcugggaaguaauuccccuggauguuacauuguccagcagagcuuccugugaguguuugccuaagauuuccuuuuuaugacccacauaggucauauguccuaaaaucacaguggcccugccacaggccuaggaaagaagaagccuuguucauccauuugucccugugucacaauagagcccaaauuucucuuuguggauaauccuggcucuauccacagacuuggugagggcaaccucuacuaguguauuucuacagaggacgugggacaggacgggacucugauuaaauccauaguaaagcuaacucagggcuaccacaguagggagacaagcucuucaggccuuguauguuugucuuuggcucaagcaagcaugucacugacagagauugaaugggugugucagggcacccugcuggcaacccugggacugguguuaccugugcagaccacuuuuggaucugcaugggcugcagcagacccuaaggguggaagcagcacagagaagcacaggcccagugggaugguuccccacaguuacuguguggcgucacacucacuugccugcaguucugccuggugcagcuggagguggcaauuagcuuguugugccugcuggagaauuuuaguucccuugaccuccaccugaggcugaagaaucauguugcuuucagggcauacuuuccaaaaaguguggccucuguuggccuuguuauuccagcuugaaggcaggaagccugccuagacaaaguuaacuccuauauacaaagagucccaggguaguuuguagcguguucuugucucgggguagcccccaccagcuauugaagguaggcuggugauguugggaagguuauauucagagugagcuaggaucgaggugauggcgaaguagauuuucauucugaaaugcugggcucacucucuuaguagcccaacuugguguuugccccuggccuaguagacucuggaagcaguaccuugcaccucgguguggggcuggugaugggagggguguggaaguggaggaucagcuagcagccucuuucccacgguacccagauuggagggugcagugcaaucauggggugaggccagggaggaccccugaagagcucgaugccugagacaucugggggaagcccuguccuucuugcuggauucagggguggcaaaagccaaaaauuggagggccaggugcaauggcacaugccuguaaucccugcacuuugggaggccaaggcaggaggaucgcuugagaccagccugggcaacauggugaaaccuugucucuacagaaaaaaaaaaaaauacaaaaauuagcugggcgugguaguguagaccuguagucucugcuacucagaaggcugagacaggaggauggcuugagcccaggaggcagagguugcagugagccgagaugaugccacugcacuccagccugggcgacagagugagacccugccuccaaacaacaacaauaaaaacaucggaggcuucggcuucaucuauuacacauggaggccuguucagugagaagggagcagcgaugcugggcuccugccaaggaggagacugucugcucccuggaauuggggcugugccuggcuccuuucugccccgcuuucagggauaugagucccuccaaguccacaggaggugacagccagcuugcguccuggggcugaggcaggguuaguuucagagcacuuuuuucauaagggugcuuauucuucuucagggccuuggcugauuaugaggggaaggauguggccaccagggucggagaggccuggcaggagaggccuggagcuccaagagguggccaaggagacccagcuguacccgcucagcaaccugcagaucccagcaccccagagcggcagagcagccccagcggaucugagcaacuugucagacgagagaguuguggcagcagguaagggcugagcugcagugggcucugccucuggagcccauguuuuuguugaggucugcgacccacaugggaaccacuuccccacacccugugccaauacccgacacauugcacacccaggcuccuguucugugagugggucauggugauucccugguccuagagcagugucaucaggcuucuuguggcucaaggagcugggaggggacugugauaggaggaugugucuguccccaggugugagaagcccuggcuaauucccaaugcauggggcaggaaggaaggcugucucucagaguacaggugcucuacagguggggguccugggcagagugagggcuauuuguguggguaaaaugccauugucagagaaggacagagugugaaagagcaaaaaaacaggaggguaaaagugcaaaagugacagagugaagcagagagagagaggccagagggagagaaagggagcaugugugagcaggcaugagagagugacacaggaugugacuggccauguguuggugugugccacugugcaugagcaagaggacaaacgugccuguuacuggagcugaccauguggcauuggugugagaguuucaagucaggcucucuugaaggcaucuugccugccagcgcaaacacugcauguccuugcagcucuggacacgucaacaggccagugauuccaggggugcaaagcgaacaguuucuuacacaagacagaaauguagaaggagagagcuaagacucauauugccccgagagaggagcuaguggaauccagcagggcaucugcuguggggagcagguggagccugggguuccuuuugcagggaugaaagaaacacagucaucugccuucuuuguucuggggcuucuuguaccacagagguuccauaauuauuaauaguuagguuauuuuuagggccuagcucaacuguuagauaacaaguuuuaccuucuaagaauaucuagcccaucuuugauuccuuggcuccaggcccuggagggucccaguccaaaaacagagugaacaacuuuggacuugcugucacauuguguggcuucuagaacuagucaguguuccaugcagaagggguauaaaaagugaggcuuguggaugaaggaggaggcgagugguucuggguuuuguuuucguuuugcgggggagugucaggaaaggcuuucuuuacagggagagugauguuggagcuggguuuggaaggcugagggagauuuugccagaugugccagacgugcuugggaaggcauuccgaguggaggcucacaaaguguauagggaacauccagucagguagccaucacaaaggaggguuaauccagccuggcuuggcaggaagcaccaaguaggggcugggcaggcaccugcuccuaggcugaggagugugacccacauccugagggccuugggagccaccgaugguuuuccugcaggagagugccacagccagacucgaguccaaagaagaucccuccauugcccuguggaggaccaggccaggggaguauacgacgagacaaggcaggaggccauauuggagacuguuugcuuacaccaggggcaaggugaugaggcugcaaguauuuuugaauuauuaaagguaaaagcgggcuuggcgugguggcucacaccugucaucccagcacuuugggaggccgagguggcaguaucgcuugagcccaggaguuugagacuagccuggggaacacagcaagaccccauuucuacaaaaaauuuaaaaacauuagccaggugugguggcacaugccuguaguaccagcuacuugggaggcugaggugggaggauuguuugagccuugcacgucgaggauacagggagccauguuccugccacuguacuccagccuggguaacaaaacaagauccugucuccaaaauaaaaauaaaaaaaauaaagauaacggugagggaaaagugguagccaagguugcuccccagauuucagggcuaggcaauuggauggguggugacaggaacuagcugaggguaaggaguuugggggcaggcccgcugagagaugcacagagaugagaaggucacugggccaugccgaaugagaagugccuguaggggcuccagccagugauguccaguaggcuacugaguaaacaaauguggaguugagcaaagaucugaccuggggcuagagagcugggaguugucagcucauaggaagucacuaaagagaaugcaugagguugccuggagaaugccuuuggaaggcaguguguacaaagcauguauucucggcuuuucucugcagacuuccagggacaguuguccagccaggcccuuggcugggugggugaguccacgugguucagggaugcugagggaagcugcuucaucagcugacauuucucuccauuuucugcucuucuuuugucucaaaaagaaaaaaagaggggauauuaauuauugauccccuaaaacccuagcugaauauauaaaaugaaaagaaguaaaaauaugagagaagcaaaggcagauggaccauaauuuuggaaaauaauuccaaaaggucuuaaggaggaagaggagcuacagagagguauugagaaggaaaauuuuggauaaauggaagaaucaggaaagacuaccgucauggaaaccaagccacgcugagcuaacuuuccagugcucuguagaugcugaaauaggcccaucagauuuggcuauguagaacucaugacugccuugaggggaguagguuggggcagugggaaaggcuguaguuggauuauaauggauugaggagggagcggaggauaagcaggugcaguugaugggguacacacucugaaacuggcugugacgugauggaugugggaggggugagcagauaauuacagcuacaagauaauggggaagguuuccuauaggugaaagcaacgugugcauguuagguaaaggcugggcagagggugccuacgugaccaguccccgauaaaauccuuggacucugagucucucaugaauugcccuggucgacagcauuucacacuuguugucacaacucacugcugaggggaacugagugaauccugugugacccacugggagaggacucuggaagcuugugcccggguucccucagaaauuugccuugugugcuuuucccuuugcugauuuugcuucguaucuuuucacuauaauaaaccauagccuugagugugaugaugugauguguccugugaguucuucuugugaaucaccaagccuagggauggucuuggggaccccugacacagaugggcaggaucagaacuuuaugccauaacaaggacuuuagauuuucuuucgagggcaaagaggagccaggaagguuugaagcaggggagugauauggcgagaguauugcuuugcaaugggaucuccaguggcagugagaagagugacugaagugggcagaguggagcagggagaagaggaagugcuuacagcauccuccauguaagaaaugauggggccuggacuaggggacuagcuguggagauggagacagaacuguaaaauaaguagaagagaucccaaauuggaugacagguaagacuugggagagcagugacggagagggaagugacaauuuagaaagccacauuucuggucgagugaguggaguaugugaccccuccuggcuuaggugguggccaaaguaucucuaaccugccucuauacugccugcaacugacugagcaaaugccugguccguggagaucccaagcugacaagggcaccugaggcaagccucuggcuuucagguggaggcccuaccuaggcuggccuggcuggauugcccuggcacacugcuguuuugcugaggcagacagcagcacucugcaagugcucuucuccuguuccucuuaguggucuaaauccuguagcaugcuggggugcgacuguagacaaauccccuuuccgggcccccugggguucucuauuugcagucuuugggucuggucacuggcauggcaucucaguaggcuagguucaucaggaagggucaacuaugucauggcaccugaugggcagcauuuagagucugugggccaggggcuuaagggcugcuuacugcuaauaguucuaaguagcaagcauucccucagcccuagucugggcacacgccaggaagaaagccacuagaugugcucuccuaguggauaacuagccuggaguuccaagaagggcagagacaggcagagugagagccuucagagauguaggcaacgauaguagcagaacuucgagggagaguagauggaaaaauuaaaaaaaauccuugucauuauuuuuaaaugucugaauugaccagauuagaaucuuugagagucuagacacuagggagaucucaugggugggccaguuauuauaucauauggagggagaguacguaugacccagcacgagaggaccagaggacagucagugcuaaggguaaaaccuuaggccaugggagauugaguuuuucaucaguuggcaaguuuucacuuuaauacuccacuguuuccaucauuucagacgacuggggaugauaaggacaauguaauuugggggauaaaggaagaacucauuauauuucuuggaugacuuuacuggggaaauggauuccuuagucauuugaaagaagcgguagaauuccacauguggggaauacuuguucuaacaaaagcuuaauaacauuaguggcaaugauccuuuuauauaagggaaagcuucaagccagugagaaaaacauaaauaaacuaguaagaacauauuuauaaccaugagauuugggugcagaauaaaaucaaauuggcaguucaggaaagguccuaaacaucuguauauuaacaauauuccaucagugagcaaugugaauuucccauaauugaaaugaugauugauaaccuuguauuguucuuaucuaauauaaggcaaagcagcacuggggcuuugauaaagagcaauaucucauguacacugaggacacugaaaccccgcuaggaauucuauggaauuucuaaaauauuuauauuaaggacauuuuacccauuauagacuaauuuagggaagguucugcauuuuuuuuuugauuugacaauguuuccaaugcaauuuauacaauauuaaauaagacuaauuaguuuuugcaccuuucuuguuacaaggugaaagaacuaauccuuugagauuuuccagaaggucccuggcaaaucccaaagccaguuuuagguauaaaauauauuuaaguuuugauugugggaaggcaaauguuaagaguugucaggaguucucgaacauuugauugaauagcauuauggguuagcgagaaauacuacuugguuagcuagugaaucagaguuguaaaaauuuucaaguaaacauaugagguaacaugguuguaaagaaucuucaguuccuuuaaaauugaaaagacuuuaaaaaaauaacuaaggacauaauaaacugaacauacagauagggcauuacaguauuuugauaagacauaaaaucuuugccucuuaggcagaugacucagaagaaaaacagaccauuuauaacuuuuuauuagggacagaccaaugaucaagaauuuuuuuuuuuuuuuuuugagauggagucuugcucuguugcccaggcuggagugcagucgcgcgaucaccauguuggccaggcuggucucgaacuccugaccucaggugaacugcccaccucagccucccaaagugcugggauuacaggcgugagccacugcaccuagccuaagaaaauuuuguuauuuuaacagagaaaccaacauuuuaauuuuauacaaguauaauauuugauauuaguucuuuuuugaaaaucuuauaaauacacugaauaaaaguuuuaaccaugacaaauaaaauuccuuuucugugaacauuuucuaauuuuaaagauauuuguuuacauuuugucucacacauuuuuaaauuauuugucauuuuaauuugggacaaagcuauucucuuuuuccuuaggaaaagcauauuugcauacaaaguuguuucccuuugccauuuuugccauuauuacuuuuagcaguuuauauauauauauacacacacacuuauuuacuuauuauaauuuuaaccauuaauaacuucucuuucacagagaaaacaggagguagguaauuuugaaauaucauauaccagcauuuuguagcagacuaguaaagcuuaugaauauacaucucauaacuuuuuauaguuguuauauacuuuuuauaguaccauuuugcaauguggacaaaugaacacauuuaacagauccauauguagucacacuguaccauaaaaaaagcaaaaaguauauaaacuuaaauuuaggucuagugacuaaguauuuuaucuucuuuauaaaugauauuuaaugaauuuaguuaacuuaauucagcauaagucuaagguuuuaaguuaccaaaaagauuuuagaaacugccuuuaagcuuacauauuauaaaacauaauuacuguugaaauaaaguuugccagaauaaugacucaguuugguuaaaagcaaauuuaaauuuuuauaaucuuaaacauguaguagauauaauacuagcuuauucaacauguaaaccuguuuaaguuuaggaggaacauacccaaguagaguaaaaauauaugcuuguauucuguuguauuauauguaaugcugauaacucaaagacacauaggugucuauuaaacuaacaauauuaaacuaguuuuguuugccaaaaguuuacauaaauucugugaacuugaguuuuaaaagcauuuggguuaguuuuuauaagaauacuuuuuuguuguuuacacugaaaguauuagaaguuguuuccuuaauuuaugagagcuuuauaauaauuuauauaaguacuuauuuaucucuaagucaauuagaauagaggauaagggauuuuguaaauuaauuugguaaugccaucuggagguacugaacuauuacacauauacaacauacauguauacuaaacauacagacagacacaaauagagaucuaauggcgagcccucaaugggugcagggggccugaagcucuacuggcuauaggcaguugagagggcugagugggaaggggaaagccuggugaagaguagauagggguauguaggagguagaggcauugaaggggacagaugaaaagauucagggagcugaagggaagguccaagguggugaaaagaagggaagagggaugcgguaggaagaugagaagggggaaucuuagaugagcagguuuggggagaccccagguucccuaauaaggucacugaaguuccaaauuacccuucgugauuacuuuuuuuuuuuuuuuuugccaguuuuggaaauacuggacagaaugagugccauaggggcagggcauguagucagcaagggaggaggaggaggaugaggaggaggaagggcacccaguagauugagaguuaccugugggaagaggcagaucaaauagagaaaggagccaggcuggacagucucauuaggaaguucugcacacagucgucaucugggagccaaaguuucucuucaguccucauugaggagcugaagggcuuuccuugugcaaucucuagacaaggugucaagggaaacaaugaggccucacaaaagagccaggaauuuggaguaaaucuccacucaaaaggaaccaagaaaacuucuauccaggacgauucuggcuaaaauugaaaaggaccaggaagaguccugcucaacagagucagggguuaaauccccacucaaaaagagcuaggaagaguucugucugcgaagauucuugcucaaacagaaaagaacugggaagagcucauuuaacagaaucaaaguaacugaaucacagaaccauaaaaaguguccaauaaaagcaaauaccgucucugggcagggugcaauggcucacaccuguaaucccagcacuugagaagcugagggaggaagaucacuugagcccaaggguucgagaccagccuggguaacauagcgagacuccuauaucuauaaaaauuuuaaaaauuagccaggcaugguggugugugccuauagucccagcuaccugggaggcugaaguaguggaggauugcuugagcccaggaguugaggcugcagugaacuauuauugcaccacugcacuccagcuugggugacagagcgagacccugucucaaaaacaaaaaacaaauauggauuuagauagagacuuuuauuuuauuuuauuuuauuauuuuugagacagagccuuucucugucacccaggcuggaguguaggugccaucucagcucacugcaaccaccaccucccggguuuaagcaauucucccgccucagccuucugaguagcuggaauuacaggcgugcgccaccaugcccagcuaauuuuucaauuuuuaauagagaugggguuucgccaugcuggccaggcuggucuugaacuccugaccccaagugauucacccgccuuggccucucaaagugcugggauuacaggugugagccaccgugcccgaccaauacuuuauuuaaaaagacuauugcaauagggacaaugcugcaaccucaggacuugcaaacaucacaaaauaauacaaaaaacaucacaaaauaauaaaaaaaaaaaagccuuuuuuuuucaguagggaguaguaagcacagcuagcagcucagcuacuuucaagggccagugggcaagcaaaggggaaccuguuuggcaugauuugaccagaaauguguuucccuguggucagccgguucucaggagaagcugcuaaguggggcauguucugcauugcagcacuuacuuaaccaggagcaagcaaaauucaggcccuguggggaggacagaagccugccuaacauucugucaaggcaaaggagaggguaaaaagcagacagcugugaacacuugaucauccuucaggcaauaauccauucuggguuucuggcuuaagacucuugagaaacaaggggaaacaacugguaggagcagcaggcucaccuauauguaguuccgugagguagccuuauggacuucugccaccuuccaaaacucagcaugucccaaaccaucuuuaucaacacagcuucucaccaaaaacaaccaaauaaaacaaauuaacuaauguacuaauucuguaucucccccuguguuguucaucucaaaaaacuguuaucaccucauugacucagacucucaaccagcgagguagaagaaauguuugggggcauguuaaauguaacaccuaugagacauguaagaggugaggugcaggacgcagguacauggugauaaaagaaaaaccucagccggauuaaauuuaaaggaguuucauugagcaaugaacuauuugugaaucgggcagcccccagaaucacagcagauucacagagacuccagugcagcuacaugguggaagauuuauagauuaaaaaaaagguggagggggggaaaugacguacagaaauuggaagugagguacagaacggcuggauugguuacagguuggggguaugccuuauuugaacacaguuugaacacucaccaguguaugaaugguugaaguauggccgcugggauuggccaagaguuagcuauuguuacagguacacacuccuaaguuagguuuucaauuuugucugccucuagguuacaguuuauugacaaagacucaaauauagaacuauggaguccuucucaggccguauuuaauuugcuuuaacaauucccccuuuuuggucauuuucucaacuuugagagauugacaaaaaccuuaguuauugauaucacuauuacccuuguaaauguacuuauauggucuugaaacccacugggaaacaggaggacaguggguuuuguaaggagagaauaaggacugaguagaagguaccucuuuaugcuagaauguucuguuuacaggacaaaaacaaaaccuggucuguuuuaauaacuauuuguuuccuuaaagucuuaguuugauuauguuacauuuagcaugagcaacuccauuuuguuugguuuggucuguuggguccuagugcaugagcucaguacacaacaauggcuugccagaauuuuguuuaaaaaauuccccuuggcugggcgugguggcucaugccuguaaucccagcacuuagggaggcugaggcgggcagaucacgagcucaggagaucgagaccaucauggccaacauggugaaacccugucucuacuaaaaauacaaaaauuagccgggcgcgguggcaugcgccuguaaucccagcuacucgggaggcugaggcaagagaaucacuugaaccuggcagucagagguugcagugagccaagaucacgccacugcacuccagccuggugacagagcgagacuccaccuaaaaaaaaaaaaaaaaaauauuuccccuuauuggccagguucucacuuaggugagagugugaccaaaacuuagggccuuagcaccacuuuuaguuaccuaguuaccaucauuuuagguuuccagucucagcaugucauucauagguuaugauguccucauaaucauacauuucaaucaguuuuguuauuccaguugaagagagaccauuugacauuucagagauggcugcaugcaaacauuugaaaccuuugagagaauacagugcacuggggagacuacuaugacuaccaguaggauaauacccagaguuugaaguaugcuguuuaccugagguccccauaaaacaaacugccuaaauuaaauaaaauaaagaaugagcuagacgaagagucuacucacuucacuaagugaucuuuucauuaauccuguaugacugaauuuuuauaaucugcacuugauauacauauuagaauuuuagaaaccccauauaauuuuggaauauauauuaauauaauucacuaaaaauauacccugaagauuaaacauuauuuuuauuggccaagcgcgguggcuuacaccuguaaucccagcacucucggaggccgaggcaggcggauaaccugaggucaggaguucaagagcagccuggccaacauggugaaacccugucuccacuaaaaauagaaaaauuagccaggcaugguggcaugcaccuguaaucccagcuacucgggaggcuaagacuggagaaucgccugaacccaggagguggagguugcagugagcagagaucaugccauugcacuccagccugggcaacgagggcaaaacucagucucaaaacaaaacaaaacaguauuuuuauuuugacaaugccucccaugauuuuuauaccaaauaagccaaaugucacuguugcauuagugcauuaucgaugucaaacccaauucuuaaauaaaaccuuauagacaaauguauucaaucuuaaucaguuugaacauaagguaagaauuuuauaaaccuuuuauaacccuuuacaauuuuuguugaagagcagauuagugcucuaagaaaaccuguugugcuuuuauguccauguucaauuuauggaaaaaccuaauaauacccuuuuaaauuuaguauuaucauacauaaaauuuuuuacaagguuaauuuuuuuuuuuuuuuugagacggagucuuguucugucgccuaggcugacaguggcaugaucucggcucacugcaaccucugucuccccaguucaagcaguucuccugccucagccucuggagcagcugggacuacaggcgugugccaccaugucuggcuauuuuuuuuuuuuuguauguuaguagagaggggguuucaucauguuggccaggcuggucucgaacucccaggugcucaaaggaaaauuuaagacaguccauggaggagaaagguauagacaaggucaugcagauauuaaaccagaaaggacuuauuuccuaagccaggaaucgaacccagacugccacugugaaagggcaaaaccuuaacuacugagcccagaaggagucuagaguaguuaauuuugagcuugcaaaggcuuuuaacuagucaagauaauuuuuagaacuaacuaugauaugaacccuaaaauuccuguucccuggaagguagagacaaggagaaaguacugccacaugguuacaaggucaagcucccaaggacauaaaacaggauggcgaccuuguccaguuuuuuguugguuucagggaccugcagcaaaguuugucacugaccagcuugcugggccaucuugagcagcaagcuuaugggggcccaagcccauguuuuauccuaagguaccccucgacacagaaaaacgacuuuauagcacaaaauauaccagauugacuacagcuuaagacuagacagccucagaauuccuuuuugcauuaauuaaaauuuuacagaggagauaaacagugauuuuacaaucaguuugcacagagagagagaagccugaaaucugacugggaagagauauuuacccuuuugcuggcaugccaggcuucugggcucccuuucccugaguggcccuggugaucuggcucucugcaccauugccccgggagccaagccacaacacaaaagaauuuuuuuuuaaaaugcacuucaguguguuguuguucauuuggaauguuccacuguaaguuaucuuucguaagaugucaccauuucuguaagaauuugcugccucccgggcguaauguguaacccagaaggaacucaguuuuccagaagcaauuaauagguuccauggaauguugaugguaagaaaggaaggaaaaggugacaagagugagcguagacagcucuuucuaaggaguuuggcugcuggaaggggaagagaagcagcugggguuaggugggaggaacuaaguuuagagacgcuaaaaguguauguagcaggagucaccugaucagguugaacugcagcaggaacaaggaaguuccauuuugacuacuauuaguugcaaauuggacccuuaugucaacuuuuucaucuguaaaaaaaaagggauggccaggcacgguggcucacgccuguaaucccagcaguuugagaggccgaggcgggcggauugccugaguucaggaguucacaaccagccuggccaacaaggugaagccccgucucuacuaaaauacaaagaauuagccacgcguggcagcgggcgccuguagucccagaaucucuggaacccgggaggcggagguugcagugagucgagaucacaccacugcacuccagccugggcgacagaccgaaacuccgucucaaaaaaaaaaaaaggggggcaggggaugaaaaugcuauugcuuuccaggaauagcuaugacuacuuccaauaaagaagacaagaagguuccacaugugaaaacuacgcggucacaacgauaagugggcgggugcacgcacgcgcgcugagaucgugcgugcacaggccggggugcggccggcgugaguacgccugcgcgugccgccauuuccugcagccgcagacucugccugcggugcucgccgggaaaugagacgaucaacaaagaaaaugguuguuuugggcgagaucgaccguggagaggcuuuuucugcagcagucccgguuccugccgccagauggcgcucgaggaucacaaaugggucuaggguucucauaauggccccgccuaagaaauuuuggauucuccuggcccuuccccccuuuguggggucaacagcggauuugggaaucuggugaccaacacgugcgcacuccccuacccuugccccuaccgagcccuccaggguagcuugggggagaagcuccucccuagacugccggguauuugaugagccuggccagcgcacaggucuugagcaccauggucagggaagaaggcugaauggcuuaggucuuccuagagaggccggaggcgggaaagaacuggagaaaggagagauggcagugggaggauggggacaagaauaccaguguguuuccagccagaagacgaugucuuuuaacaccucauugaagucgucaggugacuuugcccuugucagaaaggagcagcacugcggggguccuacugaggaggagacugacugcuccuugggguggggauugugccuccuuccugucugccccacucuuggggagaugagucccuccaaguccacgagacaugacagccagccuaccugccaugggagaacaaagucuagucucagggcacucacuucauaagggucuuauucuuccucagcguguugacugauuuugaggggaaggauguggccaccaaggucggagaggccuggcaggacaggccuggagccccaagagguggccaaggagacccagcuguacccacucagcaaccugcagaucccaguaccccagaacagcagaacagccccagcggaucugagcaauucgucagacgagagagcugcaccagcagguacgagccaaacugcacugggaccuuaccugcuagagccaguguuuuuguccagggcagcaacccaggacaaacccccacacacuaggcaugccuguuuauccucugcaggugagugugguuaggagccagagggaaggagagaaaccagcaucucagggguagauauucauggguuucagcuuggagccauagcaucaaaucuguuagacuaagucuggcacagaaaggaugcacagagaaccagguugucuggcagccaguucgaaccuggaaaccugggucaggggagggauauagguugcuuuuucuguuaauggagauggaaacucucugagcaaggugugccaugguguggaugugauucacugccagaaauaacaacuguaccaguuggaugagcucuuccacugccaucagcacugggauggccauggauuuggacaguaauguagcuccacagugcugacucaggguugcucauugauugcaagaaguuggcagcaguagccugaggaaacaggggcucugaauuuucugagagagaccaagaaccaaggaacagccagguacuagggaacagacaacaccagaugcuugugcuuuucugugagcagcucaggucucccaaagugguaguuuccuggcuucuggccuuuguagaucaguguggauccacacccaauugugauguuugugguagcuguaagaacuuucccaauuuugaaauccuaggugacuuguagcauauuuuuucacauuugaaaauaauugaguuuugaaaauguuuuuacaggcaaucuaguaucagauuuuauaucauccugaaacauucugucaauugucauuuccaaaaauccauggaaaacuggaguuguugaacuggaaacaguguggucucaggaagugcuucacagccauugcaacaugggcagggccuagagggcaggagagaaugccaugauuugaugacauuuuacccauuccugccaggugaacuucaucucccucucugugacagaauuuucuggcucucacauccagcuuuggucacugggaacccaccuauuggcucuugcacuggcaggacaugugguagaggcuuccaguucgaggcaggacuggcugcauuuucaagauguccuuauuucugguauuuuguggcgaucguccuguccacuuaacugauuuugacccauugccuugcugugaucucugugcucucucugucucccaguuccaggucauucccuugaccagcuuccagucuuuccucaucuugucccugccaaugaaguauucuggcucugccuucacucuccugccaugauccauugcuuugauaggguggcuucaggaacagggugaggagagggcugugcuagcuuuaucuugccaaggaacucagcaaagaaaauuuuugcugaccucuugcauuccucagccuggcucuggucucucaaaccuaacacaugggaugcaugccagcagccagccucaguuucccucugguccuuuucugugugaggccagagguccuugcuuuaucacugccuggagcugcaguugaugauggugaaagaaggugcacgugucuuuugagagcucccuuuguuccccagagauuuuuuuuucccaaaguggccaugaguuugggaauaaccaggagccaugggccgccggcuagagaugcugcauacuaagagccuccugugagcagccauguacacagugaacacgauggcuaaggccccauccagccgcccucaaagagcacauaguccacuaaggaauaagcaugaucguaauaaccauuagcaccugcugugugcugagaaugugcaggcacuguucugcaugccuuauguggacucacucauuuaauucucacaccaacucaaggaggugcuuuuauuauggagaaacugaggcagauggagguuaaguaauuugcuggcaguuuugcagccaggaaguggccuaaccgagauuagaauccagacagagaucagagccuguacuguucaucgcuguggcauccauacugccccuccauuugugauaagcccaggaaggaaagaaaccaggugcucugauggagagggguuagagcaaggaugguuagggaaagcuuuucuaucgaggaggagacaguucggcugagaccugaaacaucuggaggagccugccuuccaaagaaccuggggagaggcauuguggacaaagaagauagggaggagggccugaacaaugagcccugugcuuggaggguacggggugaggugagcagggggcaggagcugggcccuguagggucuuguaggugagggagaggaggcuauugggagggcuccuauugcucacauugcaguccuggggggaugcccagggcauuuuuucuuuuuuuuaagaggcgguguuucacuguguuacccagguuguuuuugaauuccuggccucaagugaucuuccugccucagcuucccaaguagcuccagggaauuucuguuuuaccuugccucuucaguugcgccguccccuucaguauucugcugacauggaucacaggauaccagacaccugguaguuguucagucaguaggaggucuuccuuccuuccucuuagaaucaauccuuuucucacuuguuggcucugcauuuuaucccccguguaucuuuucagauuuuuguggggccuccucucccauccaguccaccuucuccagucucuaugguauauuucuuugucauagggugaagcaggaacagguacaggaugauuggguacacugaggugagguaggagggcaggcccucaggaagggcuucccagaggaggugauauugucugcaaaggcauaugagagccuggaaguccaggggaacugcaggcuggucuguacggcuugaguggcacgugauacaguuugagacuaugaggcgagagagcuaggcagaugcuagaccaugauuguucuucccuuuccccacucuucaacuaguuguaaucuuaggcauuggauucucuggcaaggggacaauacccaguagccugggccagauggaggcagccauaucuggaguaugaucugagccacagcauguuggagaaaagccagaaucagcccagggcagugugcacccauagugcuggccucaggccuuuggagggugagcagacuuaaguuggaaggugcaaacaaguggucaguggugcugcccaacaucgugcccugaacugcaguugacagcuacggcagcuuugguaaugaggcucauagccugggggcaggcagagugagagccgauauuggcuuggccagagaaaagcccuuuugggcugccgaggagguuggauuccaggccaagggccauaucuggcagcugaaguguggagguucagaaaaacuucgacaccggucaguuucccgccucugcugggaaugaggugcaucugacuuuccuccucaaugaugccuaauuucauuugguccucugccccuuggccuuguguucucuagagaguucccugcaggguggcagaaggagcugauccuaguaagggaccgucccauccagugaggaggugagcugggcugugucuuccccuucugcacccuccugacugucacauccccgggagccccaugauuccacucuaacugagugaaucacagaggccaaggcccuuggcugcagucaggaguacugaguggacacuggaagauuggggucuugcuacugacucacgaugugaccugggacaugucucaacucaccuagccuggguuugcuuaucuguaaagugagaaguuccauuuguuggucuuggaggaagcuucaagagcagugcucaaggguuaggcucagaaaagccuguuugacccuggaaggugucagcucccagguugacgugcccaccccucccuuuauuucuuucagggugaggagccccucgagcugcauggucacuguuacugucacugccacaucugagcagccucacauuuauauuccagcccccgcaagugaauuggacuccagcucuaccacguaagaagggcuaucuagcaaccugggagauguuccuccgccacuuccuccuuggcgguaaaggacuuggcuuuuguuccauguugcuucccauuuagugccuuccccaguuucuagcaggccauuagccaaggggccacacaggacaguguuaguccccuaauauaaacucccaucuaccgggccuagacauucccacaccuccuuuuuccuaucucuguaagaggcugcagugguacuuccuagugcacuaguggauguggcucugccauucauggguccaugccugggaagccagcuccaguccgugaaggccgggccugugagggcauuccuguguuacuguaaaggaauaccugaggcugggacauuuauaaaggaaagagguuuaauuggcucacaguuuggcaggcugcacaagcauggcaccagcagcugcuuggcuucuggcaaaggccucgggaagcuuauaaucaugguggaagccgaagugggagcaggaccaucacauggcacgagcaggaacaagagugaggaaggggagggcccggacuuugaaacaaccagaucuugugugaacuaacugaaugagaacucacuuuucacuaaggggauggugcuagcuguucaugagggauccccccaugaucccgucaccucccuccaagccccaccuccaacacugggaaucacauuucaacaugagguuugucugucucugucacaugcccacugcuucaccugcauuccuggccaccugucagggugcaggaagggaugucacugcaggaaggcugcucagugagguguguguguugggggcgggaggggggcauauccaagggggccucugcagacaucaggucagcaggcuggagugugcagcauggaaaugggggaaaauuuggggccauccugagcccagcaugaugcagaccuuguuuccaguccugcagaggccaguccaggaugaggcaaccucuaggccucuggacucuaggagugagaauggagagguuagaugugagguggagauugcacaguagcugaguaccuucugggaagugcugagugguaaagacugacaguguaggauuaaggcuuggaggauaucuugguuguggguagaggggaaagacgacgcagcccuaaaguagggguggaaagcccacaggacugaaguguagaaguauagaagccuggggagaagauggggucaccgaggucugcauggaggaggacagcacauugucauugguugcaggaagccccuuucuggggcccucaguccaaacacaacaagagacgcucauggccugggauuguagucugaguccacagcagugccagugccuuuauccugggccuucccaugagcucuuucacuuccuucaaaccaggcugggucuccccagcccugaaccacuccugugggccaggccugguucccuggaaucuucugguguaccucugauuucuucugugcuccuucuacagcaaagggauucucuucgugaaggaguacgugaaugcuagugaagugucuucugggaagccaguaucugcacgcuauagcaaguaagagcgggucccaaacccuuccaugucggccuucuccugccggcucccauauucucaucccugcauuuccaguuccuuguccaggacuuggcucagaguagcuucgggguaauugucgaguggaugagugauguaguugcccucugaugggauugaugcauuuucuacugaacugggcaccuuuggguucucccuuccggugaauucauccugcacaccauuuucacugccauucuguucugcuugucuuuguuauuuuauuuuguaaaaugcugagaacaccccucuugacagagcuggcagagcccuagggaccaacuagcucauccuauuucuuuucagaucacagagcucuucucuucugcccucauguucuuuucugucaugccaggcugccucauuugaacacacaugugacugcaguuccugauacauguguggcuuugcuuuuuaauuuuaauuaauuaguuaauuaauuuuaauuaauuuuuuuuugagauggagucuugcucuguugcccaggcuggagugcaguggcgccaucucagcucaccacaaccucugccuccuggguucaggcaauucuccugccuuagccucccuaguagcugggauuacaggcgcccaccaccaugcccagcuaguuuuuguauuuuaguagagaugaaguuucaccauguuggccaggcuggucucgaauuccugaccucaagcaauccaccugccucggccuccccuuuucauugaucaucucuucauuuucuugcuuugugaugccauguggagggguacuuccaugucaccucgguguauugcuaccuaccacacugaggugaggucccuuagaauguuucuuaugacaugucaucucacuggaggauuuuagcaacagagaggagcauccuggccuuauuucaggauugggccucuggggcuucuggacuggcuuuuauuggugcuguggaaugaugagcauggcugugggggucaaguucaagccccagcucaggccccccuguuaggaucacuucggacaagauguucaaccucucugagcuuugcuuucacaucuguaggcccuuagggugguuuuucucaacagcuuauugaguuauaauucacccuuuaaaguguacagucccgagguuuugguacauucacagaguuaugcaaacaucauuauccaauucuggaacaccuuugucuccccaaaaagaaacuccaaacccgucugcacccccuaauucuaccccauaacucaagcacagguauuauaccagaaugaucccuucuuucuucucauucccaguaucugauuucugcugagugggcuccuggugacugucacauuauaucauagguggggaggaaagcucugcuguuuucccacuggucagugggguccccuuggcauauacaaccucaggaauccuagccacccagccccgaucaucucccucauugugaaaggucuccuuugcccccccauagaagggcccuguggcaccaagucaugaaugacgacuggcaucguaguuaugucucagcuuguggccaaagguuaauuagaaaauuaacuaugauagugauuuggcucucaucucugcccuccucuccccuaucaaacucccugcagcgucagcagcauugaggacucauucgccauggagaagaagccuccauguggcagcacuccauacucugagagguauguugacuuucuuagcacggagcuugcacuucuacagaggagaaucagggaagggagaguuccugcugagucuguuugcuuuugucuucugcuuugcagccuccaauccauuugcagaaaggugaaggacacuaccguaggguggugcuucccuuguugggauaucacacuugugacaacuaaagccuuugaauugagcuaagacuagaggguagauaccagcggugacugagaagggaagugguggcaucugacaacccagaggacucgugucagcaggaggggcccuucagauuagaaccuaaucaaucacuucauuaacuugcaaaucuaaccagaaguaaaaauaaaaugacuacaaaagagaggagugggcagagaaggaagaaaaaugggcugcuggcaucaagaagccagaaagacacacaaagccaagaaugcccagugcuguggagccaccaaauugaaagcaggggcagagaacaccucguucagcaguuuugaaagcugucacuagaugauggcacagucacuagagagucuuaaugacaaagaaaucuuauguucagauucuuggaauggggagaagagagucucagagauugaguucacucaggcuucugugaagaaaauggaauaaauagccuucaguccacaguaagcaaauacggcagacccaggacuaaaccccagggcccugacuacucccagguuagggauguuucuacucugccaucuugcuucucauugaugggcagaucuuaauucauguggaugacauucagagaccaaagcuacauuggggaggaaaaggaaggaaguaagaggguuaagauaaagagaauccuaccgggccccagaggcaaacauauaggagcagacaagcauauggggccagggaaucuccuccacuauagcugaagaagcaggugguucugaguaacuacagauuacuuggugaggcacaucagcagaugaagucuuagcagagaagggcagguuggucagaaaccugagaguuaaccacuuacauaggagcaaauggaaugaggcuuccaauucuaguggagugacaaaccagauacucuagggaccccccuuuccauugcacaacuacuaaauccagaaucagucauuacugauccauugcuaggcuuggaggaaggaaggggacucucuagggacaaucucagucacuugcacacaugcauaugcacagacacacaugcacgcacacaaagaacagcugugagcuggugcugcugguggugaaagaagcaggaggagcagggcugcgcugagggcaaggauuucaagcagcacugcuguccagagugaacccugggccagcagcaggauggugggccacacccaagcugcccgugacacuucuggguccuccgacagagcuaacguggaucuagauuguuaauguccccccgccccuugggcuucugucagaagcagacccaaaucucuggaagaaaguacccugaauuuuggcuuguaggaucagaucaagcaguuacuuugaggaagugcagucugaggaagaaaagcagaggugacucucagaaacaggcauccuggaacuggaaagaugcucaacccaggagucaguaucuagaacuucagugucggaucugaguaggcucuacagacagagcaugaaggguggguccaggaguauaggcaggggcagagcucaguuggcccaggcgugaggagaagggccaucaagacggggccaggcagggcacacaaugacaugucuccuguaggagaaggcauuggucuuccugcucuagaggguagcaggccccagcggauaaucuaagcagaaggucagggggaggcaaacugucuggaauaaguaucauaucaggacaucuacaggagacaugucauugugagcuggaaaaagaugcaugacuaguuuuuggaaauaaugcagaggucuacagcaggcugagaacugaucuggcccagggcugugcugcacaccacagaaaacaguggcauccuggggauccugacagcaaaccugggccuggcugcaccaaauuggaaggucuggcugugucacaucagaggucuguacaccagccugaccaccggguuauuguucuucaucucacaggacaacuggagggaucuguacuuacugcaaccgugagauccgagacuguccaaagauuacccuagaacaucuugguaucugcugccaugaauauugcuuuaagguaaaaaagagguggaagacaccuugagcuaggcgguaacuccugaucacgugcugcuaagaacguuuuguagagugcgggagucuuacggguucagagacuguggaggaggcuugaucuccauauacaauugcacauagucgcagaggcuuugcacaacugggagcugaaugagcuuccaagucuaagacaguagaugaguguuggugguucugcaugcuuaguacuguagggaagacaaaagaggucuuuucaggaaagacuauuucuggcagagggccagcaagugcaaaagcccuggggcagaagcacuagaguguucuagcuugcgugggagaaugccaggagugacagagugggcuagaucauguaggccuuggcgggcacagaguuuggauuuuauucuaagugacauugggguccccauucuccacaguguguggcacuuuguaaccccagguuguugguuccaauccauuuagggugucaccucugggugcacugagaaaaacaacccuccccuuugccuugacagaauguuaggcaggcuucuguccuccccacagggccugaacuuugcuugcuccugguuaaguaagugcugcaaugcagaacaugccccacuuagcagcuucuccugagaaccggcugaccacagggaaacacauuucuggucaaaucaugccaaacagguuccccuuugcuugcccacuggcccuugaaaguagcugagcugcuagcugugcuuacuacucccuacugaaaaaaaaggcuuuuuuuuguauuauuuugugauguuuuuuguauuauuuugugauguuugcaaguccugagguccaggaugugccacgggcucacagcaucugcucgcccaccuuguucaggcauccccuucccacuccacucauuccucuugcuuugcuuuguguguugaccuccagcuugcuuuucuuuucagugugggauuugcaguaaaccgaugggcgaucuccuggaucagaucuucauucaccgugacaccauucacugugggaaaugcuaugagaagcucuucuaggugggugcuggcacugcaaaggacaaguggccaagagacucauuaaggaguagagaugcacccuggucucuccuggagucucagccccagacacagcuaucuuucuuggcucuuccuuauguucagggggccuuguguccucaugucccuaugccuugugauacuuugagaucuuagguggcauggacaaaggcccucaaugaggacacuuccaaaucacaccuuccguccagcaccugagccgagcccucuagcuacccugggauacucgcucggccgcuguuguuagccccauuuugcaacaaggaaauaaagauauagaaagggaggggaccuggagaaacccagguagaaucaggaccucaccccaggucuuuggauucuuguccagggcucucuguucacugucacucgcauagcuucagaucaggacugcauagccauggugcucagugaaacaagccucugggccacauuaugagaacugccugaagauguguguuugcaugcucauagccaguggaauuuaucacggugucugagcacagagcagaauauaucccuugaaggcaguagcaaccaggcuuuccacuagcuccaugcugauggucuucucuccagaagacacaccuugagcuaggugguaacuccugaugacuggagcagucacccacccugagggccucuagcugauguguuuccagucucauggcuacuucuguuuucuuuuagcgaccccccaccgccaggcugaucagaagcugaugacucguggacaaauuuggcuguccccaguuuugccccaaguugcugucuccccuucccucaccuccucccucccuguuugauuucuucaugcuuuugcccuucucaaguugaaguugcauacauccaauaucguaucuuaaugaugcuaugauaauugcuuguguguguagcuucuuguagcuuagaaagcgcuuuaugcccaugaugucauuucaggcucaaccaaagaggaucaaacaggaauuccaucuuggcuucccuaagacagauuggcuuucuaaugaguuuaagugggcagaaguguaggguucaguguguccugacucccuugaggcuuauaaugggccaaguugaagacuguugaugaucccugguggguaaauugcagacaucaaaugcuagggauuggcauaggcuaguguuuagcuugucuauuugccauaucuauuuuuuuuaaauuuccauacacuuguaaaaguaguuaguugcuuuugauugaguuauauagcaguuuuucauuuggucuuccacucaccuuucacuauauuugaguguucccuuacagguauguuggcauguguuggaaaauuuacacaauuagguuuaaauucaguaggaugugauuuuaggaugcuacugaucaaagugauaucugugucuguuggaaucuugauagcugauuaauuugcccucaauucugcucccugaacuucacacauaaaucuucccaaguggguuuuaggguguauagaucccagcaggauuaaggagguggaaaagcagcuaacauuucuugaggcucuaccacauagcaggcacugucacagaguaauggcauuaauccccauaauaauccugugaaggugauauucucaucccaucuuagacaugaggauauuggaacucagagagguggcuauugcauugcgcagaacgcuacagagcccaugcucuucccagagcagcacccacaaaagcaagcauugauuuugugcucagugugugccaagcacugugcagaggguacacaguuccugccagguuaacacccucccuucaggccucccaaaggcauaggcuugcaaagagcagaaggugugaaaucacacucuuccucugggcauccuggaucccugaauuauccccccccccaugaaguacuucaagggccaagcugccccuuucccuccucuccgcccaugaaaaugccuccaaacugagaugcuuucagcugagaacagauuugacucacagacauuaccaaagaggagcuugugaauccaggaaaagcuccagggggcuagcugaucugagcagagagcuuucagugacccauuuuccugucuagacucugccuuaagcuaguggcaacugcuggggccccagguacuugggacauggaaacucguuggauggcugggcagauguaagccuguccaugcagucagccgauccucugcucagguucagcuggacucugccaucugugggcccagcaucacucuguaaguuccuugaaaggaagaacaaccuuagaguauuucugauacaaaaugagggccucugcucuugauuuaauuauaaaaugucuacgucuuucuccaguuucugagcccuaugcacauuggcuugugggcuuguucuuccugccaaaugaucagagaggaacauuccauuuauuuguaguggauuuccucuggagggcauguacccacacuaaauaccaacugcucuuccucagcuguaguccccaacaucagacuuggcacgugguggacacuaacacacaggcacucaaugaaugagugaaggaaauaaaagucaccccguuggugagaggugcuaucccugagucucagugcaggaccaguggaugaaaggcaagguaaagaggcccaagauaggcuggcuucccccguucaagguauagucugccuuuaagggaguuuuagaaccaacaugcaagacauugaaagaaaucuugcaagagccauuauugacuuagauccaaaacagccucucucaugucuaaaaaggcacagaauuuugcagaucugaggaagagggaugcauuaccuuuuugcuucuuuucaauugcuuaguguuucuaaucauacuuaauccacacuaaugugcgcaauuauaauaaaugguaagauaucacaugugucaguguuaaaguuuucuuu

SEQ ID NO: 19019 - RNA, 2798 nt, Homo sapiens
cugaacaaaauuuacugaagagaaacaugaacugaaacugcugaagaaaagggaaucuaacacagagagaaacugcaaacagccacuacaggucacaaguccccggccccucccucaguguggccccccccaccacaucccuccuuccauagggccccaggauccaccucuugccaggauggugggcucuggcaauguguacucgcuucagggaacccccuccugagcccacccgcuggggcagggcccugcccuauagacugcacaggacagucacaggaugcuggaaaacauagcagggaacaccccaccaaguugaggaaacugagucacgaguaacagcagggguggaacgccaaagcacaaagcuuccuggggagccucaggcagcccugcuccuucccgugucugguugguccuccugcagucgaggucacagucacaaggugagcgucugccaugccuccuucccaccgucuccuggaacugcgcugggguacucuggaaaggagcugcucagauaaaaacacacacauccccaagagaacaagcagccacuggccgagaucuacaccggcaaagcagagguggaguucuugacacggaacagcagugagcagagcccgggccugaugaugacgcaaaccaaaaacaacuacccacccccaacacauccucucuucucuucuuacacuucuuccuccuccuuccccucuuccuccucccccucuuccuccuucuccucccccucuuccuccugcuccuccuuauucuccucuuccuccucccgaucauccucuucuuaauucuccuccucuuucucuuccucacuggugcaggggcuuaugaaugcugccuuccuggggcuccccucaugcaguguagaugauccuaaagacaggcuggacccuguggccuccccugcggggcuucacuucugccccacagcucuuccucagcagcccuggcuccuucuggcagaggcaggccccaggcaggcuccuccaggucccacguggccugggugccagugggcaugcucagcucaaaguccacaggguagauauuuggggguguccagaggaccaggccagagcccccagccacaccuucuucagccccugcuucgcugggguccccaucugaagcccaggcaccccaugugcuaaguguagugguuccccgcuugugucuccuguaccuguuaggggcuaugggcccggcccccacugaaccagaugcuauuuggucuugguuggugaagucccuuccagcugguggaaaguaagggggcuugaucucgaccuggcuucccugucccucugccccagucaaguucccuguuaguguaagcugccccuuccccuuguucaaaugucccugcugccugccaggggaaggagugcuucggucuucugagccuauguuucccagggcuugggauggcucauggccccagccccugccucguuucccaacuccucuccugcagccuguggccccucccugccuggagucugguuuucagccuugggauacguggccuggccauggucuucuccccuagugcuuucacugccuaacagccgccugcguuucacuaauggggguaagccucccuguauggucugggggcugcugucgcuaaaagaccuugccugcacgguggccugaggugcagagacacuggcuucugcucuugccugucuaccggaggccccccggccucucccugauggcuucuccuuauucuucaucacugccucaguguucucccacucuucuucaucucgaaugagcuucauuaacuccagaaaauugggaggacacccucgcugauccaagagcuccagcuugccccugagggcgggggucauggcgacccgagcuaagagauguuucagacgaaucaugucugugcugcgcacugacaaggggcucuugugcacggcuuucugcagcaggggcucuaagcgcagcaggaaaguggagacuuucucuccaaucuucggagaggucugcagaaaccuaaacugagaggcucuaaaguccucuuuauccccaaagaucugcuuuagggcgucaaggcacugcuccacaguuauggagucauuguuggccuggagcacccgcaugauugacagagcaggcccacguaagcucuccagcaaacgccgccucuucuccaccucagacacuugccauaugggcauuaucucagugaccugcucuagccagucuucaaaggucucuucgccugggcuaggggaagcaguucccgaaaacacuuucaguuuccuguaccacauacuuucuuucggaggcucuaaagguggggaucuaacuuggggcaugaccucugcauccaggcucucggcagggaggcugcaacaucccagggcucuggccacaucugucauacuucggcccucaucuuucaggaaguaguucagucuacugagaaacucaucaucuggguuacgggguuuuaccaccacuucccaggagccacccuuuccugguaugugacugggcagaguaguguaauugacagugucagccaguucaaugaagacugccuuggcauugucuucccuccugaacauucucccuaggacccuguaugcgcacaggggcuguaagccugccuucacaguguccugaauuuccaccucacuacacuccauggggaugccuacaaucagcagggccuuucugggguccauguccauccccuugcaccaauccucuagcagugucagugccauugcucccacuuucuauggacugaucuaaua

SEQ ID NO: 19020 - RNA, 2798 nt, Homo sapiens
uauuagaucaguccauagaaagugggagcaauggcacugacacugcuagaggauuggugcaaggggauggacauggaccccagaaaggcccugcugauuguaggcauccccauggaguguagugagguggaaauucaggacacugugaaggcaggcuuacagccccugugcgcauacaggguccuagggagaauguucaggagggaagacaaugccaaggcagucuucauugaacuggcugacacugucaauuacacuacucugcccagucacauaccaggaaaggguggcuccugggaaguggugguaaaaccccguaacccagaugaugaguuucucaguagacugaacuacuuccugaaagaugagggccgaaguaugacagauguggccagagcccugggauguugcagccucccugccgagagccuggaugcagaggucaugccccaaguuagauccccaccuuuagagccuccgaaagaaaguaugugguacaggaaacugaaaguguuuucgggaacugcuuccccuagcccaggcgaagagaccuuugaagacuggcuagagcaggucacugagauaaugcccauauggcaagugucugagguggagaagaggcggcguuugcuggagagcuuacgugggccugcucugucaaucaugcgggugcuccaggccaacaaugacuccauaacuguggagcagugccuugacgcccuaaagcagaucuuuggggauaaagaggacuuuagagccucucaguuuagguuucugcagaccucuccgaagauuggagagaaagucuccacuuuccugcugcgcuuagagccccugcugcagaaagccgugcacaagagccccuugucagugcgcagcacagacaugauucgucugaaacaucucuuagcucgggucgccaugacccccgcccucaggggcaagcuggagcucuuggaucagcgaggguguccucccaauuuucuggaguuaaugaagcucauucgagaugaagaagagugggagaacacugaggcagugaugaagaauaaggagaagccaucagggagaggccggggggccuccgguagacaggcaagagcagaagccagugucucugcaccucaggccaccgugcaggcaaggucuuuuagcgacagcagcccccagaccauacagggaggcuuacccccauuagugaaacgcaggcggcuguuaggcagugaaagcacuaggggagaagaccauggccaggccacguaucccaaggcugaaaaccagacuccaggcagggaggggccacaggcugcaggagaggaguugggaaacgaggcaggggcuggggccaugagccaucccaagcccugggaaacauaggcucagaagaccgaagcacuccuuccccuggcaggcagcagggacauuugaacaaggggaaggggcagcuuacacuaacagggaacuugacuggggcagagggacagggaagccaggucgagaucaagcccccuuacuuuccaccagcuggaagggacuucaccaaccaagaccaaauagcaucugguucagugggggccgggcccauagccccuaacagguacaggagacacaagcggggaaccacuacacuuagcacauggggugccugggcuucagauggggaccccagcgaagcaggggcugaagaagguguggcugggggcucuggccugguccucuggacacccccaaauaucuacccuguggacuuugagcugagcaugcccacuggcacccaggccacgugggaccuggaggagccugccuggggccugccucugccagaaggagccagggcugcugaggaagagcuguggggcagaagugaagccccgcaggggaggccacaggguccagccugucuuuaggaucaucuacacugcaugaggggagccccaggaaggcagcauucauaagccccugcaccagugaggaagagaaagaggaggagaauuaagaagaggaugaucgggaggaggaagaggagaauaaggaggagcaggaggaagagggggaggagaaggaggaagagggggaggaggaagaggggaaggaggaggaagaaguguaagaagagaagagaggauguguuggggguggguaguuguuuuugguuugcgucaucaucaggcccgggcucugcucacugcuguuccgugucaagaacuccaccucugcuuugccgguguagaucucggccaguggcugcuuguucucuuggggauguguguguuuuuaucugagcagcuccuuuccagaguaccccagcgcaguuccaggagacggugggaaggaggcauggcagacgcucaccuugugacugugaccucgacugcaggaggaccaaccagacacgggaaggagcagggcugccugaggcuccccaggaagcuuugugcuuuggcguuccaccccugcuguuacucgugacucaguuuccucaacuuggugggguguucccugcuauguuuuccagcauccugugacuguccugugcagucuauagggcagggcccugccccagcgggugggcucaggaggggguucccugaagcgaguacacauugccagagcccaccauccuggcaagagguggauccuggggcccuauggaaggagggaugugguggggggggccacacugagggaggggccggggacuugugaccuguaguggcuguuugcaguuucucucuguguuagauucccuuuucuucagcaguuucaguucauguuucucuucaguaaauuuuguucag

SEQ ID NO: 19021 - RNA, 3446 nt, Homo sapiens
uccccccaaauuaguauccgcagagauucgaggacaugccguugaccuuguuacaggacuggugucggggggaacaccugaacacccggaggugcaugcucauccuggggauccccgaggacuguggcgaggaugaguuugaggagacacuccaggaggcuugcaggcaccugggcagauacagggugauuggcaggauguuuaggagggaggagaacgcccaggcgauucuacuggagcuggcacaagauaucgacuaugcuuugcucccaagggaaauaccaggaaagggggggcccugggaagugauuguaaaaccccguaacucagauggggaauuucucaacagacugaaccgcuucuuagaggaggagaggcggaccgugucagauaugaaccgaguccucgggucggacaccaauuguucggcuccaagagugacuauaucaccagaguucuggaccugggcccagacucugggggcagcagugcagccucugcuagaacaaauguuguaccgagaacuaagaguguuuucugggaacaccauauccaucccaggugcacuggccuuugaugccuggcuugagcacaccacugagaugcuacagauguggcaggugcccgagggggaaaagaggcggaggcugauggaaugcuuacggggcccugcucuccagguggucagugggcuccgggccagcaaugcuuccauaacuguggaggagugccuggcugccuugcagcagguguucggaccuguggagagccauaaaauugcccaggugaaguuguguaaagccuaucaggaggcaggagagaaaguaucuagcuuuguguuacguuuggaaccccugcuccaaagagcuguagaaaacaaugugguaucacguagaaacgugaaucagacucgccugaaacgagucuuaaguggggccacccuuccugacaaacuccgagauaagcuuaagcugaugaaacagcgaaggaagccuccugguuuccuggcccuggugaagcuccugcgugaggaggaggaaugggaggccacuuuagguccagauagggagagucuggaggggcuggaaguagccccaaggccaccugccaggaucacugggguuggggcaguaccucucccugccucuggcaacaguuuugaugugaggccuucccagggcuaccggcgccggaggggcagaggccaacaccgaaggggugguguggcaagggcuggcucucgaggcucaagaaaacggaaacgccacacauucugcuauagcuguggggaagacggccacaucaggguacagugcaucaaccccuccaaccugcucuugguaaagcagaagaaacaggcugcaguugagucgggaaacgggaacugggcuugggacaagagccaucccaaguccaaggccaaguaggcucgggagaacagggcaacauuuccuaccacaggccaaggagacaaaagagauauuggaaggaggggaaagagaagcccagacaaacagcagaugaguugaguggggcagagggacagggcagccagaccaaggccaagccuucucacccuuggccagcuggaagggacuucagcaaccaagaccaccuggcaacaggcucagugggggucagguccagguccccgaagaggugcuggagaggaaagcagggagccacugcauccagcacauggggugccugggccucagauggggaccccaaagaagcagaagcugaagaagguacggcuggggguucuguccugcucauccaaccaccccuaaauacccacccuguggacuuugagcugaacaugcccacuggcccccaggccacaugggaccuggaggagccuaccuggggccugccccugccagcaggugccagggcuggugaggaagagcuggggggcagagguaaagcccugcaggggaggccacaggguccaucccgucuucaggaucaucuacacugcacuaggggagccccaggaaggcagcacccuggaggcccugugccagugaggacaggagacccuaaggccccgggagcccagugccagccagagguugugcaggcaaggagaccaaagauugaugagaagacccccagcagggguacuggguacccggcaggccagugcccucacaguugacuuggaccaggguggcugugaagggaagucuuuguugcaaaggaggaggaggaaaagggaggacuugguaggguuuuguuucuucugcuuguuucuguacagggccaccagacuccuggagagaucaagcaaggagaaccuggggcugccauggccaaagcaacucaacagaugccaaugccaauuccaaggccagccacaacccugccaccuuggggaauccagccuggaggcauccccuaagcagccagccauggccuggguggaggcaccugaagacgucugucccaaacucccccagcccugagcugggagaugacagggggaaagaggcccucucaagggugccagaugccugggucucccaagaggggucccccaacucaccguucccgggacaggcugcccccuguuccaggaagcucauccucaccuguguaggccccuguagugacccacgcguccagcagacgcccacccaccgcuagccguuguuccugugcaaaguagugugcuaugcacccacccagguggccgccucugggcccaaggcacaugcugugagcuuccugugagcccaggcucugcucacugcugucccgcgucaugagcaccaccucugcuuucccuguguagaucuaggccaguggcugcuuguucuuguggagcuguguguguucuucucugagcagcuccuccccggagucccccagcacagucccaggagaugacaggaaggaagcaccagggcaaggcggacgcucacccugugaccacgauggugaccgugacugugggaggaagaacuggacccaggacggagcggggcugcccugccugaggcucccgaggagcuuugugcuuugguguuccaccccuguuguuacucaugacucaguuuccuugaccugguaggguguucccugcuguguuuuccaguguccugugacuguccugugcgggccauagggcagggcccugucccagcagaugggcuugggagggggcucccuaaagccaguggacacugccagagucuaccuuccuggcaagaggcagaccccggggcccucaggaaggagggaguuggcagcgggggcugcagcaggaguaggagcagaugaggcgucuugccaggaaccucaggaggagggggcccgggaccugugugggaccuguguccugugguggccguuugcaguuucucucuguguugugauucccuucucuucaacguuuucaguacguguuucucuucaauaaacuucauucaguguuccag

SEQ ID NO: 19022 - RNA, 9218 nt, Homo sapiens
caggcugaccugugaggaaaucuccccagcgucaccuggggccugggucagggagaguccccuaggggcaggcuggcaugggccagggaagggagaucgagggguccaggugguccccagugcccgggagcaucacuggguucugugcaugugcuggaggcugggggagaguccgcgugugucccucuugcucggccacccaucuggaugggacccuuggucaccgggggucugcugggcguccaggcaggugagagggcagaugccagcaccugacugucgaggacggguacacagagguucauucccaugcagauggcuggggagguccugugucacccuacagcucucccgaccaacacggggucacuuggggacccggggcaggggcaaucucugucccaagggcacggcaagaauucagcagaggaccuggaguucaggugugcggagcaggugugagcucugcaggcagccccagggaagggcuggaugggacauaacgggacagguggggacgcuggccucuucucccuuguccuuugcuccuucagcaguagacacggagcaugccagccccacucuucuucaaccuggggaccuccccguuggcucucauuuaacacaccuggguuccuuagugugucuuugcacucacaagguucaggagucgucucuagccucccaggacggccagccauggugcguauggacgggaagugcgucagggaggcugacaaggcccugcuguaaacucaguuuaugguagcccaggaaacggggcauggacguaaaacuggaaugaagggucaaggaaacaggugcccgcccaaggggacggucugucuuaucuccuugcaccgggucguggggagcacaugggcagcccguggcacccucguuacuuuggugcccaccuugcauaugcuaagaagcccuagguuucuaaagcaguuucaagggcuuuagguuucccaugggaagcuccugccccacggcagaguuacagaugcccuuagagcugcucuucuggaugugugcaguccgugacguccaaggagucugauccgcagugcaugguuaucuaugacuucaguccuggagggcuugcaaaaaugucucuguaaaauggucagggcucaagggacuccauguauauaggucugcuuuaaagcuuuaauuggcaaacagccauacaaacccacaaauaguacauuuccaugugaaaaaauguccacaauagcauccuuccucuaaaaacguuugccuuuucaaauuuucagugcagcacggaauucaggaaugcacagccaucccgaaaguagucauuuugcagaaacagaugaggaagacaugugguaauguguuuaauguaauugugccuccuaguaaaguaaguucagaaaaaucaacuuugacucguggcacauuuuguguuuaaaacacugggcaucaggcaugcccuacaacacaagcgugguaucuuauucacaccuagugaaaaaaaaaaaaguaauuucuuccaggaaugaauuucaaaauaugugggaaagcuuuguaggugucugggagauacuuguaauucaagaacauuguugucagccauauaucuuuuauagcaagaaaugcuaaugagggggcugcauuaguguuauuuaaugcuuuguucuccuauccaggaugccacauaaggauugagugugauucagcuccaucgauuuccuuccuuacccuuuuaagcuguugagugaaguggaugguacacacagugguuaggcagaguaaugcuuuuacuuuauucacuguggaauaugagaaaauaauuuacaaauaauauauauuccacauugugucagauaguaagugauauaucuguuuuucauauccauugcuguuuucuuauucuaguuauuuuauaagacuuucccauuucuuucuuggggugggcagugcaaacugaggccucuaaaauagccucuuauuguuauguuuacauuaauaaccucuguaguggagaacucagacaacuuugcuggcaugugagagacgugugaucacaaccaaaaacaucuaaguuuuaaauggauaccucagcuaucaagcaucuaaguuuuaaauggauaccucagcuaucaguuaaauuaacuauguaaaaggacaaacucuuaaccgugucauucucaaguuuuaucuccucuauuuggaucauauaugugagcagauacauguugaaagcuuuguuguauuuuguggugaaaaugugcuugaugugcgagcugucuuauuaauugguuguuauagacgguaaacugcauuuauaaaauauuuuuauaguaauacagcucccuccugaacacuggaaaauaaccacugacgguagguccauaacauagaaucaaucauaugguuagcaaggaauuguuugaaauacuuaaaaaauguacaguguuacagauuguaaauuuuacaauuuugcaaacuuacaaucugcagcaauuuggggagaaaugauauaugaaaaccugcaugaaaguauccaggaaguguucuugaauaaauauuaauuuccuuaaacuaucuguggucauuuuucuuagucaaauugauuuaaaagcuucccgggcuaaauuuuaaaaauacuauucuuaguuuaucauuuauuuauuuuuauuccuuugaaaauggaauaauuguaguugguuaauauaauguguucuaaccauggucggucuaaacauauccuugaguuagaguacauuuuauuaauuuauuaagaauuauuuuucagaaaaguuuucucauaaaaaauuauaggcucuccuugagacccuuuuuacaaguuuuagaaaacagacagcuuuucucuuuaacuccuuauuacaucuucgaaacaauguuuuccauauugagguaucugucacuguaaguuuucacagacgaaaaugaggcaaauaaucuuuuguuuugaaaugaugccaauuuguucaugcuaggugucuuuuuaauacugcugaaccaacauuaccuuuauggacgugaauaugugggagcaaaauaauuuuaaacaaaauuuuaaugaguguuuuccauauagggcacuuuaaaaauguuccuaaagcaucgauaaaacauuucaaaaugaauaucaaugcuuccacgaaaaucauucagcaggaaauugaacuugcuuggcauacccgggaagaacaaugguaagauuguugguuauguuggagccagaugcuuuguuucauuucuuagcauucguggauacaaacuacuuuggaaaaaugcuaugaucguccaugugcuggaaguccaaugaaaaaauauauuuagcuggauuuuucucuaaagaaauaauuccuuaauuaagaauuaauuaauacuuaauuuaaauaaucuaagugcuaugaugccacaucauaaugaaaugagauguguauccucgaguucacuaaacaugaccuguuuucucuuucaaauuacagucgauuuugcuuaucaugaaaauuuguauucauuccaugaaugugcuugcugaauuaaaguuaaaagucuuaaacauuuagucuuguaauaguuauuuguauucaauuacacagacaaagauuaauguuauauuguaaauaauuuguaagcuucacugaacuggguucaguauauuuuuuuuuguacagaauucuuauugucagaaagugaggaaaaugaaauauuccuguuuggaaaucauagaugauaaaggaguguaauauccaaauuaagucuauuugugauaucucaacuuauauacuacucaaaaagagaaaauaaaaacuaaaacacuugcagagaaaaaugcauuuuuuuucuggaaaauuuauaauacaauaaaucuuccuuaauuuauauuagcuaaggcauguuaagauagcuuccgucuuacauuuacuagccuucuuuuuucacccaugccuugacuguaccauggucacacauuucuuauccaaaagcaaagggauuguucauauaaagaaauuaugaguguugguugaucagcucaguuuuggaaauguuaaaguugaggugcauaugaagcaccugagggcggaugucaaguggggauaagcaauauacccuggauauaugagccucauguucaggagagugguaggagcugaggacaccagagcgggaauuaauaucacacagauugcguuuaaucaaggagacuaggagagaucaccuagggaaugacuguaaacaaaaaagggaagucuaaagacugauuccgcguuccuucaauacuuugagcuaccgcagaauuggggcaucaguaaugaagccgaagaaugagugaacaaauaaguaaaagaaaaccagcugaaacacaguaaagaagaccuuuuagaaggagagaggaccaccucaucacaugcugcugauaggcugaaggagggggacuugguauauggaggcccuuugauauccuuaguaagagugguuugguggaauggugggugcaaaggacugauuggaaaagacaagagacaacugggaagaaagaacugggguaguaaccugaggcaaaaaggaguagcuagagguuuuugugguuuucuuagugauuacagaaggaccggcauguuguaugcugauaggaacaauauagagggaaaccuuggaaauguuggaaagaggaggggaaagugcugaacgauguucuugagaagcagugggcucuaguggacaggggagcaaguugacuucaggaaggaguaguaguucaugcauuuaaacaggagagaaggucgagugcguaagcacugauggacaaaggugggugaagaugugaugcucggacgcugaaugugcccuguggguugcuucugucucuguagugagauaaaagaucaucagugacaaguagagauggggcaggagggcagagaagaaggacuauacuuuuuuuccugagacugggccagugaguggacuaggggaauauaauugucaagcagcauugggagugcaaauuagauuagugucaucauaaacacgacuuugagaucuguuggcaugguuguguuagggcagcuggagaguuggauuuuucuggguuggcauuuggcugagcacugugacagagggagaagcuggcagggcacauacacaaggauggaguuauggugagugaccauggaacuuaaucugggaacgaagaaagggaguguugggcacuccaguguuggacagugaaaggugcucuauucaaugggcuucaguuccugauagacuccugagcuguagugcuuagagugaccuacagugugagggcauuaguuguugcauguuggauacauggggaaauagcauaguguaguggucaaaagcccggacucaacccccacuguuuagaaucuaagucugguucgaccauugcugccugggaaaccaugagcaaauucuuucugugucccagcuugcuccauuaauauugugggcauaaugugaguaccuaccucacagaguuguuuugaguguuaaaugaauuuuucuauaauaagguauuuaaaaugguucagaacaggaucugacauaugguuccuauaguacaacuuugcuuuuauuaauguuauguagauauuguagauucucaggaaugucaaaaucuaggauguggcuaugugaguguuuaauuugcaggaaaugucaagaucauuggugguggaacagaaagaccaguuuuauuggaaggauuacgugugugggcuuugaaagcaucaaggacuaaaacauauuuguagaauauuauuaaaaaggaacauuuccauaaaaaaugcaugauaggauuauuauauaguuuuuguauauuauuguuggacacaaauuucauaaacuuggucauaguauuuguuaauaagaaaaaauauuuucaaaugauaauuucaaaauuguuagcuuuaacaaagaauuguuuuuuugauaaauuuuaaauuuuacucgaauuguuaucgaguuuucuuuguauauuuguagagcauauuucucaacagcaacaaaagacuuuuucaagaaucugaaauuguugagggccagagaacaaaagcauuuaaugcauuaugugaggaauucuuacaggucagugguauuugguuacacaacauauucucguaagacuuuacauguauauugaaaauuuaaaaaacuguuuuccuuuccaaaauaguguuaaaaauacuuugauuauaaaauucuuaagcauuuuccauguuaaugucauuguuuuaaaguaagaacuaaauguauuuuuacuuuuagaauucauuaauuguuuuugguguaauccaaaacaggaaacgguaacuuggcaauuucacccagaaauauacauaccguguuggcuauucacacuuuauuuacaugacuaaacaccaugacucuuuugcucgacaguuuuuacuggugcagcaauagaugaaagcaagaaguuucuacaucauuucuagaugugguuuaauagucuuucuagugccaguguuucucaaagagaaggcacccaauuguaacaaauggguauuuuuuauuucaaauuuauuuccugauuauuucaugacauauuugcuugcacuauuauugaagugacuacaaauugauuucucugccaaguuacuaucacaagacagggcccagaugcguucagaaugaaaaagccaggaaagaauuaacaguuugugacugagaauugucucccgucacauuuguacuuuugcaaguuguccucagugauauugaccucuuaaccaugcagguauauaucuauuuagguuucuauggaaugguguacauuccuauucauuuuauaaauuuggaguguuuuuaaaacaaucuuguucaaauucuuguuaaaaauucacucuucuaaacugaggggauuguuucaggaaaacgaguuucaggauagucauucuuuacauuguuuacuaugauacauauacuacauguguguauacauauauguaauauguacacucaguuguuauucaaguguuucuaaguagaggauguguuguuuaauggucucugagaaccauguaccaauuguuacacauguuugggaaauaagaucuucucaauguuagugcuaaaugucaccacuuauggugggaacuucaugaugauuuagucuucugcauuuccuuuuccuucccauccagcuaucuaucacuaggcccugccauuuuuaccaccucaacguuauuuuaaguuuuuuguuuagauucucacugcugcuguccuagcucaggaccucauccuuccucacuuacgcuauuaaaauuucaucugaguucucucuuccucuuuccauccuucauagaucugcaaucuuaucuuccuaagacaucgcccuucccucuucccaaccugucacgagcuuuccauucuaaauucauggauauucagagacaccucugccuugacaugaccuccuuuuaaaacuucauuugcuuuuguccuugcgauaguuugcugagaaugaugguuuccagcuucaaaaaaccaaacacugcauguucucacucauaggugggaauugaacaaugagaacacauggacacaggaaggggaacaucacacaccggggccuguugugggguggggggaggggggagggauagcauuaggagauauaccuaauguuaaaugaagaguuaaugggugcagcacaccaacauggcacauguauacauacguaacaaaccugcagguugugcacauguacccuaaaaacuuaaaguauauuaaaaaaaaaaccacuucauuugcuacauucuuuccuuccugucaucccuccagguugauagccuucugugaaauaauucaccauuauuuccaggcuuuauuuaagcccuuccaccauaaaaauuuuaucuccuuuugcuaaccuaucgaaaucuaauucuuuugccaacuaaguaggcauugaucuccauuguccacuguacagugccagcaaguugcccuuccaugucuauuguaacauuuuuguaugacuucaguuuacauguuuccugaagucacuggaauauggaaaagaucauguguucaucuucuaaugccaccauagcacaugacauccuaacuuuucuguagcaggcauuauuucacuguuuguugaaugaagaauaaagauuuaaaauucaaauuguauuuuucguaacucgagaucauacuacugagcauuuuauucccucuaucuauggaaaccauguuacaugcaauaucagggauaauaaauggucgaauaccugguguuugggaagcuuaugaaugaaauuagcgcauggauuuacauggaacuuccauucuuuuugcuauaucuucaccugaacauuucaauaucccauuguuuggagcaaauugugauauugucgugccuccuacuguaaucauaauugacuaaauucacacauuucuauguuucuuaagugaguauuuuggucuucggguagcucuuagagugcuuuuuaaaucuggaauagauaauaaccaucauuggaauuuuaaaguguuuugcuuuugaaauguaguuauacacaguuauaaggugaugaagagugguugguuauaacugaacuugguuuuuuguuguagcacguggaggaccuggaggagaaucauacaguuugucuuacuggugaacaaagugaacuuagaaaagaaauggggccgggcgugguggcucacgccuguaaucucagugggcagaucaccugaggucaggaguucaagaccagccuggccaacauggcgaaacccugucucuacuaaaaauacaaaaaaaauuagcgggacgugguggcgggcaccuguaaucccagcuacuagggaggcugaggcaggagaauuguuugaaccugggaggcagauguugcagugagcugagauugcgccauugcacuccagccugggcgacaagagcgaaacucugucucaaaaaaacaaaauggaaaaaaaaaagaaauagcaguguuguaaacagaauuuaugaaggaaauugguaaaauugaagauugauuuaagcaguaaaauauuuuguucgcugaauuuuucuaauauuuaccuaaauauucaauaaaugauuaauaucacuuuucauguaacagcaucugcaagaggugucugguguucuccuaucgcaguuauucugaugacacuucaaagaacaaagcuaaacc

SEQ ID NO: 19023 - RNA, 14830 nt, Homo sapiens
cagccuuuagccucccgcccgccgccucugucucccucucuccacaaacugcccaggagugaguagcugcuuucgguccgccggacacaccggacagauagacgugcggacggcccaccaccccagcccgccaacuagucagccugcgccuggcgccuccccucuccagguagggcuggcuucaagcugccuccucagcaacccagagaugccccuggcucugcugccuccgcugucccaagcccugguccugcuguccccagugccgcgaggguguccacagauuuccccggugcucucuguaggcugcugauccacgccccuucaucgccacccugcggcccccuuggucccugucaggcuucugccucgucucgccgcccuccaggcaccuuucccucaccccuuccucucccucucccuucugaccuugcucugcuucauccaccucuugucucucugccucccgcucgggguccgucuucuuggcuaccacccuagagcguggcugggugacugguaccccagcuuugccaauggcccuguuucaucauugcaagucccaggcgcaugcuccacucccucagccucgcucugcccaggcgccuccuugcuccagggcuuggcgccuggcccggguugggucggaucggggaggaccgcccagcgcccaccgagcucagcacccaggagcaguccuccgcugcacugccugaggccaguccuuggcaugggcugaaagacuuaguuucccaggcacaccccaggcacccugcccagauguuccucgcucgcucacccccagguuaaugcucugccucuacauccucugugagaagucuggguccugggagcccuggcugcaagggcccugacugggggugccuggguggcucagcccugucuguuuccaggacccccuuggacugggacucagaauggguguggaggggaaggagagaaaaucaggcaacugugccaugcuccccagggcggaccuggcuuggggucccagaggggccugccaagggacccaggagagggagcgagagagugcccuggaaggcccacggaggggagcgcccccucacugcuccaugggcggggcugggugccugagcgccugcugagcagagcagggggcccagggaucugcagggcacaggguacaucagucuccaguggucugucuuggugggcaggccucucuccugcuguccuggcugccagacugcucaggucccauccucaggggguccuguuucugggcccucgccccucccuggccugccagcucucugcccuauagcaacuaauuggaacugagacaagcuggagaugcucagccccccugcccccgugccagaaaggcucccggggaccagcgcccaggggugcgggugagcaccuccuggugacacccagccgccggugccagccgcaccccaggagagcugguguaugagcauggaugucuuggugcggagcaugcccauguauggccacugugggccagcauggugagccuuugagggcaagcccguguggguauauugaaaggaagaugcagggcugccuccaagccaccagggcugggcggugggagcagguugcgagccagggagcagagagggcucccauggcaagcuggccagcuguggguggcagcccuggccucccuggcccaccuucaagccccaaggacccguacggcagugggcauuaacccuaccaacgcauagauggggagucugggaaaggaagggggguguuuccaaggcaagaaugaguuuccugucuuuagcaacauuccagagucacucaaacaaagcuauagcgugucccuuccagugacagcgccaaguccccagaggagggguuuguaaugaguucacacuugacaguuagcacucagagccuucagcaagggcuucugaguccuugccaccccguauagaggugggaugaggaccuccccaccugccgucuccugugcuucccgggcccaccccccaccccccaccccccagcaucuccagccugcccgggagucacauguccucggcccacagaauccccagcacacgccccacccacaggccuagccccagcccuggggucccuggcaccccaccugccagggccccuccccugccuugcucaccccccaacaccccugcuugucggaaaugucuucccaugcccaccacgacccccucccacucaucugugggccggagagcuuggucccugccgcacguugccccccuagcauccaggcccaccaccgagcccccgacaggccugggagccccacugguggguggggacccaccagcugggggucuugcucacaccgaggggcuggggguggcgguggcuuucccagggcacccugccuugggcugcaggccgcugggugggcaccggcucccucggaaggcagcgcaacccgggauccugccggcccuggcccccacccugccgaccgggccuggggcgaucagugccccagcuccuguccucuucugcucagaugcuggguugggagaucaggggccacagcucggccacucagagcccuuuccgcaagucuuagagggaccagcuguggggugugugcagaggggcugcgcuguggggagggcgcauggcucaguccuccuggccugaggcccgccuagccuaaguggccuccaggacccauggccaggcccuucugcagccuuccagaaagaaccagcuucccaggguucccuggggaaggccuggggccaccuccucuggagggguggggccugugcuucauuccuccuuccccagguccccuuccaggccagaagauccccuccaccacuugaaucccacagccagaagccccuucugggacucuagacuccugggaaccaucccagcugcccccuucgcuguuucgcuguuugccuucuuccccugccccgucauggcucuaggucagagcagccucugggguggcuauggaggggccaccagccuuggcucuuccgaggacugcagaacccucccacucccagcuucccaccugcgcagcucugaucccagccagcccaaggggcagggucaggucccggcucccuggcaggccuggugaaggugcugcccauucccaugaggcucaucucugaggcuuaggggccuggggcucuagccagccuucuugcauggaacucuccugguccacugcaucuuaagccugagcuccacuuaaacacuggccugagauaagcuggaggaccaggggcccaacggacucugugggccucuugaacuugccucugcuggccaucccaguccuguuuggucccugagguguucagaugggccaaggggagcauggcgggcagacuccuggguggccagaagauuagaaggcagcccugucccuggaggcaggggaagucugggaagccagugugacuucuauccucuggaagucugagucccugcuuggccuugacugccaucccaugguucuuggaggcugcccucaugcaaagagacacacacccaugggagcccagcagucccaggagccugaagcuaagcaggcugugggccacccuggcuggcugaaggaggcuaaucccagcccagccugagcccccggcagagagcggguugcggcagggaggggcugcaggaaaccuuccccuccccuccuggccuuggugggccuguaccagggagggagggaggcagggccccaggcucuggggggcaggccgggaacaccuucccuggggcccugaagugcucgccuggggagacgauggcuuuuccaggagacucccugcagacagaggcagaggugagaggcugggcgggggcugcccugcuggcuguguuggggcugaggaggggcuucuggaucugugggccauagggagcuacugaugguccucagaagggccaugcuuccaggggagcccccugcacagccccgagagugugaagcgugucagcuuuggggccuguggcacugugugcauugggagaggguggguccagacaugggggcaaggacacagacggacagacagacagugugugcagccccagcucugcuguuuccucaccguguggccuugggcaagaguuuggggccaacuuccugagccucaguuuaccccuucaucaaguucuaagagcauugcuuccuucuuauagucaacgggggacggcaggaugcuaaguaaagaaaucacaugaguccccugcucugccucugagaggugacagcauccucccuuuuccuuggagacucuagcaggaggccccggaucucuucggagagugggagggggcagcaguaguccgugugcagaggaccaggagcgcacagugggaagggcugagucccgcacuccgccgacuguggggacaggcuggaccuugacaugggcgccacaggcugcaaagggcuggcacagagaggugggagguggcugggcgcaucaagggagaacuccacccuugucgccacccugccagaaaaccucuggaaaggauuugagcagcagaugagccgggguuucccagccccuccacacguggcugcaaggggagcagacgcccaagcguggcugccugaagggcaugcuccggcaacggcaggggcuuggaauguggcacaagguccaccccuccccacuccagcccccagccccucaggcagccacucccacagaugaacgcacacgccgggcuuuggcaaggccagggaggguacacauccccucucugguugaugcccaaguacaggcuggagccaucggcggggagggacugguggacuggggccugggagaguggcagggggcaggccgggugucagcgggggcacaagcaccaggcugcugguugaaacugggcccaaaaggcuuuggaggccagaggggaggggaggaaggacacagucccggggaccccgcagggcugcguggaagguggcacaugugucagaguucaggucggguugcucaggggggcagacgcccagggcugaggcugcggagacagcauccggcgucugccacuuggcagcugugagccacaccaucugcaggcgagcucccagggcccgccagaccucaagcccugcucccgccgcccuuggccuggccugaaugccuggcacggacccuccauguucucagaggcugccaacgcaucuuguuuggcugugaccucgagcaauccagugcagaggacugcgcuagcuuucagaggggcagacaaggagggcccuauuggggugguggcggaggcuccaggaagcccagccuccucccucacucacaccugcggucgccaaaccuggggcuuaugccauugccgccccuguccuuugcucuaaagagaugguauccagggagcucagggcacacuuugguggggcuugaaacccucccugaagucccugaagacacacccagagaggccaaugaagggaaacugaggcccagaggccucaguuguggugguggagaguugaggacuggagggacuugcugugggucucacaggaucugacuaugggguauuccugcuuccugggcugggguccccgccugccuuaucuauguguggauauauguguauguauguguauauguauacauauguauaugugaauguguguaugcauguguguauagaugugugcauguauguguguacauauguguaugcguguauacagguguauaugugcagguauguauguauguaugugugcauguaugcauguguguguguguguacguguguauaaauguguaugugugcgugugugugcaugugugugcauguguguaugugugcaugugugcauguguguauacaugcaugcaugugcgcauguggauguacaugugcauguauguguauagaugugugcaugagugugugugcaucuguguauauauguguguauauguguaucauauguguaugugaauguguauacauggguaugcaugugugagugucuaggugugugcauguauauguguguacauguguguauaggugugugcacguauauguguggaugugugcauguauguggaugcauguggauguguguacauauguguuuuguauaggugugugcaugugugugugcacguguguacauauguguuuuguauaggugugugcgugugcacguguguguaugugagcguguaugugugcaucuguguguguguuuguguguguauguguguacgugugugugugugcauguucuggcaggagggaggggcuuggugugaggugguggggagaaggcaggggccaggcuuugggaggacagcugagccuauacugccaggaccucccaaacugccacccccagucuugggcauucaggcucucacaggcccagagacauggcuggagcccuguggcugaggagcacagcugagagcucaggcggggccuggaggcgccaaagcugaguuccaagucaggcugagugacuugggagaaaucagagccucucucucggccuuagcuuuuguguccauaaaauggggauacucaucaggccagcuccaggggauccuauccuuccccccaggcuccccuggcucccucugacuucaugggccccuugcugccuccugugggcucagacacggagccugccccuuccucgggagaggucucaguuuugugccaguucuuugaggggaaaugagggaugugccgggaagccugcccggcccccgccccuccagccugcccacugcuugggcacagccaugagccauggaaaaccagccaaaccuuguccuucugccucugucacggggcccggguguaugggccuuccagcccucagccucccuccccgcucugagggaaccucuuccccuugccccuuucucagucucuuggagaccccccagacauccuacuguaucaggcagccugccuccagagcccucguugccccacagcuggucccgggaacccgccugagaccccgauggccagucuugccgugacuggccugcccugugccugugcccccugcccugguggagggcccgauucccuaacaggagggccugcagggaagucccagcuccuggggagaccccuugccccggggcaggagucccuguagaguccuccuccaggccaaugcguggguccuggggggcuccaagcuggccauggucagaugguccucuguccccucggccuuccccagccccuccccacagccucccguaggcccagccggaccaccccaacccuaccuguccagguggacugcccacccuggagcuugccagggcucuggcggggugucccagcccugacucacucucccugggagguagcggcuuuggcaggggcaucggcaaggaggggcagggcagucuccucccucccccacuccaucuugcucuccugcuuccacccugcccuuccuguucucucccacugcuccuccuccuccuccuccuucugcccccggguguccacuggcacugggagaggguccuacagcggcagcaggcaucggaggcccugcccugcccuggaggaagggaaacaccauccagguaggugaguguugagccuucucccuacuugggggccaagacccuccgggcgguuccccuagguucugcugggccggccugaggcuggcaggcccugggcugcaacugugggaucucaaggcucaaaagaaugagggaggcucggugcugccccagcaggggccuccuggugaccccaggggucagcaugaaguccagcuccacaugagggggaagcugagcuaagccuugggcuccgacucccacuuugcaguguggcccagggccugugggcucaggagggcuccggggcuggcugcggaaaggccacuccacaggccuggcagccgcuauagccacagccucaccacaggccccucuguccacaggugugggagggcgcauggguggcuucuaggggggaugccaaugcaggggggacgcgugccagcagaugcucccuggagcacccgaggagcugcaugggggcgacaggacaggccuccaucccaacccucuccugggcuugugcucagacccaaccuggcccugaaguggccucaggcccccggcccgcugguagcaaggacuccaaagcggcagccccgggcagccagcccagcccccagggcaacuggggaagcaucgggcagggcggggcugcucauagggugcuggccugggggcagagcccccaccuccccacggccuccuuagaccccugcaaccagcagcugggcuuagggggcucaccucgcucugcuggagccccagacagccccuccccagcuaguacuggcccuaagugagggucuccugggcgugcgacugcuucaggucugccagaggccccugcugcccagcugggcuccccaucuccagaugcaccgagggccaccccaggcuggguggcaagcagggcaggcauguuuauucccacuuaacagauggggaaggugaggcugggaugagaccugggccuuugcuggagagucaggguggaugaaguggugagagaggcagggcuccagccucuuccuguagggcacauucccggcugccucuggacgggagaccgugucugaugaggagggaggaggcaagcagaggugggugcugggggcaggcucgggcagggcugcuucgccuccacucccacucgccgccucggccuggggggccucaggcaagccugacccugcccugccacccuggcggcagccugcuccccuggggggccucucugggcugccgaggcugugggcagggaggaagggugcgagcagaucugggagcuccagggcuguuugggccaaggcggugugggcggggggcuggggcgggugguccagaggaggaagccaaggcccaggggcaguguugggggcgccacggccuccaccucgggggccuccacucagugcugccucagccaacuuuacccacggccuccaaggauacccccucuuucuccgcccugccucccuaccuuggccuuagagggucucugagaaacgugggcaggguggagggaggaagcaacucagagucgccgcacucaacuaacuucauccacgcugcccugagcccagaacucaaaggaaggaucggcccggguaggaggccacagugauguccccaaaagugaauucuucaaagcccuugagggccaauggcuaggauuccuccuccaccuccuccacgcagccucauggacgcccccgcccuaaagcaggcuucuggcagacucagaggcgugggggccugcagacuugcugaugaggagacauuucaucgccugauuaagccaaguccuguccgggauggggagggggguaguggaagcagugaagggaguggaguggagggggcacccuccuugccagcagcauccacucccuuccugccuggagcccucugcccacacuccgcccucuccgccucccgcuccagggucuggccgucccuggugagggaugggaacgcagugccaccacacacgcggaacaccagccccuggcauggagaagacaggugggugcuggugcugaugauccccucgccucuucccccagguccauccgccauguggccccuguggcgccucgugucucugcuggcccugagccaggcccugcccuuugagcagagaggcuucugggacuucacccuggacgaugggccauucaugaugaacgaugaggaagcuucgggcgcugacaccucgggcguccuggacccggacucugucacacccaccuacagcgccauguguccuuucggcugccacugccaccugcgggugguucagugcuccgaccuggguuugucccugagugauggggagcggggcaugcagggaggcucaggugcagccugagagccccuucugaaggggacacaugcugguccugugggacgguggcgagcaugauguaaguguaggagggguccagccgucuggcugugagcugugcaguuugugcccacuugugguggcauccccgugugcccgucagugucccuguguguguguccccgguccucccuaccaguggggcuagucggcuggauggcuccaaguucaugcuggugauggugguggggccccuaggucucgaguucaugcuggugguggggguggggccccuaggucucaaguucaugcuggugauggggguggggccccuaggucugaagucugugcccaaagagaucuccccugacaccacgcugcuggaccugcagaacaacgacaucuccgagcuccgcaaggaugacuucaagggucuccagcaccucuacguaaggagcugggaggaaccagcaggccuacagcagagggcagggguccgggugggugcaugugcguggacgugugggguaugagagggguucggggacucguggggcuucagggugaagccuggagccagccgugaugggagcucccggguuugcggcucacucauguggguuugagcaaccacagcugcaggaccggaucgcucaguucggcucccuucguggcugaaaacguuucaucacguccacuccucccagcaacagaggagaacggauuucauuguagccagugugcgugugaggaaacugaggcuuggagcggcaaggcagugguggcacugcuggggcucaggaccgggccugggugcugccuccugcccugcacucugcucacaagcauggacugaaccuccucgaggcccagugggcuggggaggcacaggaaggcaggagagaggggcgggugggguggggagucugugccuucaccuccuccgcccacccugcuucaggcccucguccuggugaacaacaagaucuccaagauccaugagaaggccuucagcccacugcggaagcugcagaagcucuacaucuccaagaaccaccugguggagaucccgcccaaccuacccagcucccugguggagcuccgcauccacgacaaccgcauccgcaaggugcccaagggaguguucagcgggcuccggaacaugaacugcaucggugagcugagggccucccagaacauuccagagccuugucucgaggcauggggaagggagaccaagggauaccuuuagaggcucaguucaagaaagaguauggugagaacggucaaaagaaaauccauggauuucuuggcaaauccuccaugcaggcgaucaccacggcuaaagagaagacugggccagaggggccggguggcuuccgggagccccaucuucaucucuggcacuccucccuuuccucuugcugccccuggagcuagcaguccuggggcuagcaguccugaacagcuaggaguuugcaauuagcccgguaaauuagcagaacugcuuucaggagacgggagcagccggcagguagcagggcccaccacacuggcccggaagugacaggacccagggcugugcagggaccaccaggcucccgggcuaaugaggucucuccccuagagaugggcgggaacccacuggagaacaguggcuuugaaccuggagccuucgauggccugaagcucaacuaccugcgcaucucagaggccaagcugacuggcauccccaaagguaggaagcccacucuuccugcacgccugccugccucacccccaacagcacagauggccagggugggggcucuggaugggcccgaucuacucagggaaaggcucaacaguccccucccgccaccuggggcagagcuagggccccugcccucagcaccugcauucuccccugugcccucuucuccuggcagaccucccugagacccugaaugaacuccaccuagaccacaacaaaauccaggccaucgaacuggaggaccugcuucgcuacuccaagcuguacaggugaggccagcagggcaccgcccaagggugaugccagagucccucagugcuguguggccccucgcgcccagccccccauccuuaccuccagccuuugaguccgugucauucucccgcucacaggcugggccuaggccacaaccagaucaggaugaucgagaacgggagccugagcuuccugcccacccuccgggagcuccacuuggacaacaacaaguuggccagggugcccucagggcucccagaccucaagcuccuccaggugagagcugggcaugcacagccagguucccuaaggcugggcugggggaggcguguguguccccgggcagucccucaguccccuggcccuccuucccgaccggcucugggcaucugcaagggagcgguccugaugcucccagcuggugcugaggaggcagggagcaggggcuccaugguggauaccgagcaaggcagccugguagcucuuggacccgagggucuccaggugggucggacaccagaaagauguggcagaguccagggagucgagaaacugugggcgugggagugcacagaucugugccaagacagugaccgcccagggcaggaaguaggcugacgagggggagcagggucuugccugggauucuaucgggagcuuccaucccuggccuggcccgcaaccaggugggugaucuuggucuugcccagcccugcuccauccacaaguguuuggagcacccccauccgcaccagcugcgagccagcaccgcgcaggccaugcccaugcugggccgagugcgcccucuaguggccauugucauguucaccagcacugggcucccagcccaacccagcaggcgccucgccugcccaccuccgcuccucccagagacagcaagacgguggcuccagagaguuggaggggcugcuagagggcgagcuccucugcugacuggaagaaagaggagggcaucccaagggcucuuucuccucucaugccccauggagugugagggugcucccccgaggcucaggccaccuuuccuccaccucacaccaccaaacacaccucuaccccagccccgcccccacauguccucaaccugacccaccugagacccucauccuugucccuggucacauccagugccuuaauccuggcugacacccacacaaauaacacgcccaugccuugguuugcuccucccaacaacggggagccucugguguggcccuugaaguagggugcagaggcaacagcaaaaugccuccuggaggcagcgggcuuggcguggagggagggaggccugccgugacccggccucucugccuucagguggucuaucugcacuccaacaacaucaccaaagugggugucaacgacuucugucccaugggcuucggggugaagcgggccuacuacaacggcaucagccucuucaacaaccccgugcccuacugggaggugcagccggccacuuuccgcugcgucacugaccgccuggccauccaguuuggcaacuacaaaaaguagaggcagcugcagccaccgcggggccucagugggggucucuggggaacacagccagacauccugauggggaggcagagccaggaagcuaagccagggcccagcugcguccaacccagccccccaccucgggucccugaccccagcucgaugccccaucaccgccucucccuggcucccaagggugcaggugggcgcaaggcccggcccccaucacauguucccuuggccucagagcugccccugcucucccaccacagccacccagaggcaccccaugaagcuuuuuucucguucacucccaaacccaaguguccaaggcuccaguccuaggagaacagucccugggucagcagccaggaggcgguccauaagaauggggacagugggcucugccagggcugccgcaccuguccagacacacauguucuguuccuccuccucaugcauuuccagccuuucaacccuccccgacucugcggcuccccucagcccccuugcaaguucauggccugucccucccagaccccugcuccacuggcccuucgaccaguccucccuucuguucucucuuuccccguccuuccucucucucucucucucucucucucucucuuucugugugugugugugugugugugugugugugugugugugugugugucuugugcuuccucagaccuuucucgcuucugagcuugguggccuguucccuccaucucuccgaaccuggcuucgccugucccuuucacuccacacccucuggccuucugccuugagcugggacugcuuucugucuguccggccugcacccagccccugcccacaaaaccccagggacagcagucuccccagccugcccugcucaggccuugcccccaaaccuguacugucccggaggagguugggagguggaggcccagcaucccgcgcagaugacaccaucaaccgccagagucccagacaccgguuuuccuagaagccccucacccccacuggcccacugguggcuaggucuccccuuauccuucugguccagcgcaaggaggggcugcuucugaggucgguggcugucuuuccauuaaagaaacaccgugcaacguggcuccgugcgcugcuccuguggcggccuggccucuccgugccccuccuggcccuugggcuccuugcccucagaagaggggccccgucacccucagaagaggggccccgucacccucaggucugggcuagcccggacuagggagguuuccccucccuucuagacacuuccauggccccagcuguccugagacgcggcuccagaauccaaccaggccugaauggcaccug

SEQ ID NO: 19024 - RNA, 14830 nt, Homo sapiens
caggugccauucaggccugguuggauucuggagccgcgucucaggacagcuggggccauggaagugucuagaagggaggggaaaccucccuaguccgggcuagcccagaccugagggugacggggccccucuucugagggugacggggccccucuucugagggcaaggagcccaagggccaggaggggcacggagaggccaggccgccacaggagcagcgcacggagccacguugcacgguguuucuuuaauggaaagacagccaccgaccucagaagcagccccuccuugcgcuggaccagaaggauaaggggagaccuagccaccagugggccagugggggugaggggcuucuaggaaaaccggugucugggacucuggcgguugauggugucaucugcgcgggaugcugggccuccaccucccaaccuccuccgggacaguacagguuugggggcaaggccugagcagggcaggcuggggagacugcugucccugggguuuugugggcaggggcugggugcaggccggacagacagaaagcagucccagcucaaggcagaaggccagaggguguggagugaaagggacaggcgaagccagguucggagagauggagggaacaggccaccaagcucagaagcgagaaaggucugaggaagcacaagacacacacacacacacacacacacacacacacacacacacacacagaaagagagagagagagagagagagagagagaggaaggacggggaaagagagaacagaagggaggacuggucgaagggccaguggagcaggggucugggagggacaggccaugaacuugcaagggggcugaggggagccgcagagucggggaggguugaaaggcuggaaaugcaugaggaggaggaacagaacaugugugucuggacaggugcggcagcccuggcagagcccacuguccccauucuuauggaccgccuccuggcugcugacccagggacuguucuccuaggacuggagccuuggacacuuggguuugggagugaacgagaaaaaagcuucauggggugccucuggguggcuguggugggagagcaggggcagcucugaggccaagggaacaugugaugggggccgggccuugcgcccaccugcacccuugggagccagggagaggcggugauggggcaucgagcuggggucagggacccgagguggggggcuggguuggacgcagcugggcccuggcuuagcuuccuggcucugccuccccaucaggaugucuggcuguguuccccagagacccccacugaggccccgcgguggcugcagcugccucuacuuuuuguaguugccaaacuggauggccaggcggucagugacgcagcggaaaguggccggcugcaccucccaguagggcacgggguuguugaagaggcugaugccguuguaguaggcccgcuucaccccgaagcccaugggacagaagucguugacacccacuuuggugauguuguuggagugcagauagaccaccugaaggcagagaggccgggucacggcaggccucccucccuccacgccaagcccgcugccuccaggaggcauuuugcuguugccucugcacccuacuucaagggccacaccagaggcuccccguuguugggaggagcaaaccaaggcaugggcguguuauuugugugggugucagccaggauuaaggcacuggaugugaccagggacaaggaugagggucucaggugggucagguugaggacaugugggggcggggcugggguagagguguguuugguggugugagguggaggaaagguggccugagccucgggggagcacccucacacuccauggggcaugagaggagaaagagcccuugggaugcccuccucuuucuuccagucagcagaggagcucgcccucuagcagccccuccaacucucuggagccaccgucuugcugucucugggaggagcggaggugggcaggcgaggcgccugcuggguugggcugggagcccagugcuggugaacaugacaauggccacuagagggcgcacucggcccagcaugggcauggccugcgcggugcuggcucgcagcuggugcggaugggggugcuccaaacacuuguggauggagcagggcugggcaagaccaagaucacccaccugguugcgggccaggccagggauggaagcucccgauagaaucccaggcaagacccugcucccccucgucagccuacuuccugcccugggcggucacugucuuggcacagaucugugcacucccacgcccacaguuucucgacucccuggacucugccacaucuuucugguguccgacccaccuggagacccucggguccaagagcuaccaggcugccuugcucgguauccaccauggagccccugcucccugccuccucagcaccagcugggagcaucaggaccgcucccuugcagaugcccagagccggucgggaaggagggccaggggacugagggacugcccggggacacacacgccucccccagcccagccuuagggaaccuggcugugcaugcccagcucucaccuggaggagcuugaggucugggagcccugagggcacccuggccaacuuguuguuguccaaguggagcucccggagggugggcaggaagcucaggcucccguucucgaucauccugaucugguuguggccuaggcccagccugugagcgggagaaugacacggacucaaaggcuggagguaaggauggggggcugggcgcgaggggccacacagcacugagggacucuggcaucacccuugggcggugcccugcuggccucaccuguacagcuuggaguagcgaagcagguccuccaguucgauggccuggauuuuguuguggucuagguggaguucauucagggucucagggaggucugccaggagaagagggcacaggggagaaugcaggugcugagggcaggggcccuagcucugccccagguggcgggaggggacuguugagccuuucccugaguagaucgggcccauccagagcccccacccuggccaucugugcuguugggggugaggcaggcaggcgugcaggaagagugggcuuccuaccuuuggggaugccagucagcuuggccucugagaugcgcagguaguugagcuucaggccaucgaaggcuccagguucaaagccacuguucuccaguggguucccgcccaucucuaggggagagaccucauuagcccgggagccugguggucccugcacagcccuggguccugucacuuccgggccaguguggugggcccugcuaccugccggcugcucccgucuccugaaagcaguucugcuaauuuaccgggcuaauugcaaacuccuagcuguucaggacugcuagccccaggacugcuagcuccaggggcagcaagaggaaagggaggagugccagagaugaagauggggcucccggaagccacccggccccucuggcccagucuucucuuuagccguggugaucgccugcauggaggauuugccaagaaauccauggauuuucuuuugaccguucucaccauacucuuucuugaacugagccucuaaagguaucccuuggucucccuuccccaugccucgagacaaggcucuggaauguucugggaggcccucagcucaccgaugcaguucauguuccggagcccgcugaacacucccuugggcaccuugcggaugcgguugucguggaugcggagcuccaccagggagcuggguagguugggcgggaucuccaccaggugguucuuggagauguagagcuucugcagcuuccgcagugggcugaaggccuucucauggaucuuggagaucuuguuguucaccaggacgagggccugaagcagggugggcggaggaggugaaggcacagacuccccaccccacccgccccucucuccugccuuccugugccuccccagcccacugggccucgaggagguucaguccaugcuugugagcagagugcagggcaggaggcagcacccaggcccgguccugagccccagcagugccaccacugccuugccgcuccaagccucaguuuccucacacgcacacuggcuacaaugaaauccguucuccucuguugcugggaggaguggacgugaugaaacguuuucagccacgaagggagccgaacugagcgauccgguccugcagcugugguugcucaaacccacaugagugagccgcaaacccgggagcucccaucacggcuggcuccaggcuucacccugaagccccacgaguccccgaaccccucucauaccccacacguccacgcacaugcacccacccggaccccugcccucugcuguaggccugcugguuccucccagcuccuuacguagaggugcuggagacccuugaagucauccuugcggagcucggagaugucguuguucugcagguccagcagcguggugucaggggagaucucuuugggcacagacuucagaccuaggggccccacccccaucaccagcaugaacuugagaccuaggggccccacccccaccaccagcaugaacucgagaccuaggggccccaccaccaucaccagcaugaacuuggagccauccagccgacuagccccacugguagggaggaccggggacacacacacagggacacugacgggcacacggggaugccaccacaagugggcacaaacugcacagcucacagccagacggcuggaccccuccuacacuuacaucaugcucgccaccgucccacaggaccagcauguguccccuucagaaggggcucucaggcugcaccugagccucccugcaugccccgcuccccaucacucagggacaaacccaggucggagcacugaaccacccgcagguggcaguggcagccgaaaggacacauggcgcuguaggugggugugacagaguccggguccaggacgcccgaggugucagcgcccgaagcuuccucaucguucaucaugaauggcccaucguccagggugaagucccagaagccucucugcucaaagggcagggccuggcucagggccagcagagacacgaggcgccacaggggccacauggcggauggaccugggggaagaggcgaggggaucaucagcaccagcacccaccugucuucuccaugccaggggcugguguuccgcgugugugguggcacugcguucccaucccucaccagggacggccagacccuggagcgggaggcggagagggcggagugugggcagagggcuccaggcaggaagggaguggaugcugcuggcaaggagggugcccccuccacuccacucccuucacugcuuccacuaccccccuccccaucccggacaggacuuggcuuaaucaggcgaugaaaugucuccucaucagcaagucugcaggcccccacgccucugagucugccagaagccugcuuuagggcgggggcguccaugaggcugcguggaggagguggaggaggaauccuagccauuggcccucaagggcuuugaagaauucacuuuuggggacaucacuguggccuccuacccgggccgauccuuccuuugaguucugggcucagggcagcguggaugaaguuaguugagugcggcgacucugaguugcuuccucccuccacccugcccacguuucucagagacccucuaaggccaagguagggaggcagggcggagaaagaggggguauccuuggaggccguggguaaaguuggcugaggcagcacugaguggaggcccccgagguggaggccguggcgcccccaacacugccccugggccuuggcuuccuccucuggaccacccgccccagccccccgcccacaccgccuuggcccaaacagcccuggagcucccagaucugcucgcacccuuccucccugcccacagccucggcagcccagagaggccccccaggggagcaggcugccgccaggguggcagggcagggucaggcuugccugaggccccccaggccgaggcggcgagugggaguggaggcgaagcagcccugcccgagccugcccccagcacccaccucugcuugccuccucccuccucaucagacacggucucccguccagaggcagccgggaaugugcccuacaggaagaggcuggagcccugccucucucaccacuucauccacccugacucuccagcaaaggcccaggucucaucccagccucaccuuccccaucuguuaagugggaauaaacaugccugcccugcuugccacccagccugggguggcccucggugcaucuggagauggggagcccagcugggcagcaggggccucuggcagaccugaagcagucgcacgcccaggagacccucacuuagggccaguacuagcuggggaggggcugucuggggcuccagcagagcgaggugagcccccuaagcccagcugcugguugcaggggucuaaggaggccguggggaggugggggcucugcccccaggccagcacccuaugagcagccccgcccugcccgaugcuuccccaguugcccugggggcugggcuggcugcccggggcugccgcuuuggaguccuugcuaccagcgggccgggggccugaggccacuucagggccagguugggucugagcacaagcccaggagaggguugggauggaggccuguccugucgcccccaugcagcuccucgggugcuccagggagcaucugcuggcacgcguccccccugcauuggcauccccccuagaagccacccaugcgcccucccacaccuguggacagaggggccuguggugaggcuguggcuauagcggcugccaggccuguggaguggccuuuccgcagccagccccggagcccuccugagcccacaggcccugggccacacugcaaagugggagucggagcccaaggcuuagcucagcuucccccucauguggagcuggacuucaugcugaccccuggggucaccaggaggccccugcuggggcagcaccgagccucccucauucuuuugagccuugagaucccacaguugcagcccagggccugccagccucaggccggcccagcagaaccuaggggaaccgcccggagggucuuggcccccaaguagggagaaggcucaacacucaccuaccuggaugguguuucccuuccuccagggcagggcagggccuccgaugccugcugccgcuguaggacccucucccagugccaguggacacccgggggcagaaggaggaggaggaggaggagcagugggagagaacaggaagggcaggguggaagcaggagagcaagauggagugggggagggaggagacugcccugccccuccuugccgaugccccugccaaagccgcuaccucccagggagagugagucagggcugggacaccccgccagagcccuggcaagcuccagggugggcaguccaccuggacagguaggguuggggugguccggcugggccuacgggaggcuguggggaggggcuggggaaggccgaggggacagaggaccaucugaccauggccagcuuggagccccccaggacccacgcauuggccuggaggaggacucuacagggacuccugccccggggcaaggggucuccccaggagcugggacuucccugcaggcccuccuguuagggaaucgggcccuccaccagggcagggggcacaggcacagggcaggccagucacggcaagacuggccaucggggucucaggcggguucccgggaccagcuguggggcaacgagggcucuggaggcaggcugccugauacaguaggaugucuggggggucuccaagagacugagaaaggggcaaggggaagagguucccucagagcggggagggaggcugagggcuggaaggcccauacacccgggccccgugacagaggcagaaggacaagguuuggcugguuuuccauggcucauggcugugcccaagcagugggcaggcuggaggggcgggggccgggcaggcuucccggcacaucccucauuuccccucaaagaacuggcacaaaacugagaccucucccgaggaaggggcaggcuccgugucugagcccacaggaggcagcaaggggcccaugaagucagagggagccaggggagccuggggggaaggauaggauccccuggagcuggccugaugaguauccccauuuuauggacacaaaagcuaaggccgagagagaggcucugauuucucccaagucacucagccugacuuggaacucagcuuuggcgccuccaggccccgccugagcucucagcugugcuccucagccacagggcuccagccaugucucugggccugugagagccugaaugcccaagacuggggguggcaguuugggagguccuggcaguauaggcucagcuguccucccaaagccuggccccugccuucuccccaccaccucacaccaagccccucccuccugccagaacaugcacacacacacacguacacacauacacacacaaacacacacacagaugcacacauacacgcucacauacacacacgugcacacgcacacaccuauacaaaacacauauguacacacgugcacacacacaugcacacaccuauacaaaacacauauguacacacauccacaugcauccacauacaugcacacauccacacauauacgugcacacaccuauacacacauguacacacauauacaugcacacaccuagacacucacacaugcauacccauguauacacauucacauacacauaugauacacauauacacacauauauacacagaugcacacacacucaugcacacaucuauacacauacaugcacauguacauccacaugcgcacaugcaugcauguauacacacaugcacacaugcacacauacacacaugcacacacaugcacacacacgcacacauacacauuuauacacacguacacacacacacacaugcauacaugcacacauacauacauacauaccugcacauauacaccuguauacacgcauacacauauguacacacauacaugcacacaucuauacacacaugcauacacacauucacauauacauauguauacauauacacauacauacacauauauccacacauagauaaggcaggcggggaccccagcccaggaagcaggaauaccccauagucagauccugugagacccacagcaagucccuccaguccucaacucuccaccaccacaacugaggccucugggccucaguuucccuucauuggccucucugggugugucuucagggacuucagggaggguuucaagccccaccaaagugugcccugagcucccuggauaccaucucuuuagagcaaaggacaggggcggcaauggcauaagccccagguuuggcgaccgcaggugugagugagggaggaggcugggcuuccuggagccuccgccaccaccccaauagggcccuccuugucugccccucugaaagcuagcgcaguccucugcacuggauugcucgaggucacagccaaacaagaugcguuggcagccucugagaacauggaggguccgugccaggcauucaggccaggccaagggcggcgggagcagggcuugaggucuggcgggcccugggagcucgccugcagaugguguggcucacagcugccaaguggcagacgccggaugcugucuccgcagccucagcccugggcgucugccccccugagcaacccgaccugaacucugacacaugugccaccuuccacgcagcccugcgggguccccgggacuguguccuuccuccccuccccucuggccuccaaagccuuuugggcccaguuucaaccagcagccuggugcuugugcccccgcugacacccggccugcccccugccacucucccaggccccaguccaccagucccuccccgccgauggcuccagccuguacuugggcaucaaccagagaggggauguguacccucccuggccuugccaaagcccggcgugugcguucaucugugggaguggcugccugaggggcugggggcuggaguggggagggguggaccuugugccacauuccaagccccugccguugccggagcaugcccuucaggcagccacgcuugggcgucugcuccccuugcagccacguguggaggggcugggaaaccccggcucaucugcugcucaaauccuuuccagagguuuucuggcaggguggcgacaaggguggaguucucccuugaugcgcccagccaccucccaccucucugugccagcccuuugcagccuguggcgcccaugucaagguccagccuguccccacagucggcggagugcgggacucagcccuucccacugugcgcuccugguccucugcacacggacuacugcugcccccucccacucuccgaagagauccggggccuccugcuagagucuccaaggaaaagggaggaugcugucaccucucagaggcagagcaggggacucaugugauuucuuuacuuagcauccugccgucccccguugacuauaagaaggaagcaaugcucuuagaacuugaugaagggguaaacugaggcucaggaaguuggccccaaacucuugcccaaggccacacggugaggaaacagcagagcuggggcugcacacacugucugucuguccgucuguguccuugcccccaugucuggacccacccucucccaaugcacacagugccacaggccccaaagcugacacgcuucacacucucggggcugugcagggggcuccccuggaagcauggcccuucugaggaccaucaguagcucccuauggcccacagauccagaagccccuccucagccccaacacagccagcagggcagcccccgcccagccucucaccucugccucugucugcagggagucuccuggaaaagccaucgucuccccaggcgagcacuucagggccccagggaagguguucccggccugccccccagagccuggggcccugccucccucccucccugguacaggcccaccaaggccaggaggggaggggaagguuuccugcagccccucccugccgcaacccgcucucugccgggggcucaggcugggcugggauuagccuccuucagccagccaggguggcccacagccugcuuagcuucaggcuccugggacugcugggcucccaugggugugugucucuuugcaugagggcagccuccaagaaccaugggauggcagucaaggccaagcagggacucagacuuccagaggauagaagucacacuggcuucccagacuuccccugccuccagggacagggcugccuucuaaucuucuggccacccaggagucugcccgccaugcuccccuuggcccaucugaacaccucagggaccaaacaggacugggauggccagcagaggcaaguucaagaggcccacagaguccguugggccccugguccuccagcuuaucucaggccaguguuuaaguggagcucaggcuuaagaugcaguggaccaggagaguuccaugcaagaaggcuggcuagagccccaggccccuaagccucagagaugagccucaugggaaugggcagcaccuucaccaggccugccagggagccgggaccugacccugccccuugggcuggcugggaucagagcugcgcaggugggaagcugggagugggaggguucugcaguccucggaagagccaaggcugguggccccuccauagccaccccagaggcugcucugaccuagagccaugacggggcaggggaagaaggcaaacagcgaaacagcgaagggggcagcugggaugguucccaggagucuagagucccagaaggggcuucuggcugugggauucaagugguggaggggaucuucuggccuggaaggggaccuggggaaggaggaaugaagcacaggccccaccccuccagaggagguggccccaggccuuccccagggaacccugggaagcugguucuuucuggaaggcugcagaagggccuggccauggguccuggaggccacuuaggcuaggcgggccucaggccaggaggacugagccaugcgcccuccccacagcgcagccccucugcacacaccccacagcuggucccucuaagacuugcggaaagggcucugaguggccgagcuguggccccugaucucccaacccagcaucugagcagaagaggacaggagcuggggcacugaucgccccaggcccggucggcagggugggggccagggccggcaggaucccggguugcgcugccuuccgagggagccggugcccacccagcggccugcagcccaaggcagggugcccugggaaagccaccgccacccccagccccucggugugagcaagacccccagcugguggguccccacccaccaguggggcucccaggccugucgggggcucgguggugggccuggaugcuaggggggcaacgugcggcagggaccaagcucuccggcccacagaugagugggagggggucguggugggcaugggaagacauuuccgacaagcagggguguuggggggugagcaaggcaggggaggggcccuggcagguggggugccagggaccccagggcuggggcuaggccuguggguggggcgugugcuggggauucugugggccgaggacaugugacucccgggcaggcuggagaugcuggggggugggggguggggggugggcccgggaagcacaggagacggcagguggggagguccucaucccaccucuauacgggguggcaaggacucagaagcccuugcugaaggcucugagugcuaacugucaagugugaacucauuacaaaccccuccucuggggacuuggcgcugucacuggaagggacacgcuauagcuuuguuugagugacucuggaauguugcuaaagacaggaaacucauucuugccuuggaaacaccccccuuccuuucccagacuccccaucuaugcguugguaggguuaaugcccacugccguacggguccuuggggcuugaaggugggccagggaggccagggcugccacccacagcuggccagcuugccaugggagcccucucugcucccuggcucgcaaccugcucccaccgcccagcccugguggcuuggaggcagcccugcaucuuccuuucaauauacccacacgggcuugcccucaaaggcucaccaugcuggcccacaguggccauacaugggcaugcuccgcaccaagacauccaugcucauacaccagcucuccuggggugcggcuggcaccggcggcugggugucaccaggaggugcucacccgcaccccugggcgcugguccccgggagccuuucuggcacgggggcaggggggcugagcaucuccagcuugucucaguuccaauuaguugcuauagggcagagagcuggcaggccagggaggggcgagggcccagaaacaggacccccugaggaugggaccugagcagucuggcagccaggacagcaggagagaggccugcccaccaagacagaccacuggagacugauguacccugugcccugcagaucccugggcccccugcucugcucagcaggcgcucaggcacccagccccgcccauggagcagugagggggcgcuccccuccgugggccuuccagggcacucucucgcucccucuccugggucccuuggcaggccccucugggaccccaagccagguccgcccuggggagcauggcacaguugccugauuuucucuccuuccccuccacacccauucugagucccaguccaaggggguccuggaaacagacagggcugagccacccaggcacccccagucagggcccuugcagccagggcucccaggacccagacuucucacagaggauguagaggcagagcauuaaccugggggugagcgagcgaggaacaucugggcagggugccuggggugugccugggaaacuaagucuuucagcccaugccaaggacuggccucaggcagugcagcggaggacugcuccugggugcugagcucggugggcgcugggcgguccuccccgauccgacccaacccgggccaggcgccaagcccuggagcaaggaggcgccugggcagagcgaggcugagggaguggagcaugcgccugggacuugcaaugaugaaacagggccauuggcaaagcugggguaccagucacccagccacgcucuagggugguagccaagaagacggaccccgagcgggaggcagagagacaagagguggaugaagcagagcaaggucagaagggagagggagaggaaggggugagggaaaggugccuggagggcggcgagacgaggcagaagccugacagggaccaagggggccgcaggguggcgaugaaggggcguggaucagcagccuacagagagcaccggggaaaucuguggacacccucgcggcacuggggacagcaggaccagggcuugggacagcggaggcagcagagccaggggcaucucuggguugcugaggaggcagcuugaagccagcccuaccuggagaggggaggcgccaggcgcaggcugacuaguuggcgggcugggguggugggccguccgcacgucuaucuguccgguguguccggcggaccgaaagcagcuacucacuccugggcaguuuguggagagagggagacagaggcggcgggcgggaggcuaaaggcug

SEQ ID NO: 19025 - RNA, 4166 nt, Homo sapiens
ucuacucaguaucuuaaauaaacuguuuauucagaaggaacaauuaaagaaagcaacuaugauauggauuacaaaaacaaacaagcauagauccucuccaggcuccagggugagacggccccacgcugcaaagacugccagcccugggcugggugcaucagugggcuagcaugugugugugagcgccgacacgugcgcacacacaagcacacacacgcacacccgccacccacagggguguggacagaaaugaaugacugugugugucugcagcuuggccccuuccccaccccccaaaguagcagcggcugugugggccccgcagcagcaaaagugaggccuucuucuuccccucccccuccgcagcucucgcucugagaccccaucuccuccggcgguaguuuggccacccucacucacaaagagccccagugaucccgucaagacaucugggggaagaggaaaaaaaaaaaacaaaacagcccaccagauguguggccgggaaccugcccaguagcuccuaggccauggaugugggcggccacugcacucuggguccccauccccugggaggccccagccccgagaggcccaagcccuugguggagaaacagggaggugacaacaccagugauggcaaacgccucucccccaagcagccacugggauccagugcaacgagguggcacacacccuuccugaagggggaagcgcagggaggcgcagggccuagccgagcuggcugagcacccagggccgggacaugggccuggacaaccaccuggagagggaacccccacccccaucccgcaaagaaaaaguaacagucgcagaagaggcaggcuccgagcguggucccgccauaggcacguugauuaggacggcagcccgcgugagguauugcgcucuccccccagcacccugcucaggccgagcccuccugcccuccccucccuugccacacgagugggcagggacacccguggguggggguggggcaggggccggccugccggccacggggcccuaggugggggccagcucgaaggcgccaucacugguggggguggugaagaaggagggcggguuggaggccgcagaugccugccccccacugcccugcuccugcgaguggcgcuccuccagccgcaagcugcgcucaaaguccagcaacugccccaugaaguugaaguugggggagauguuagacuucuuccucuugaccaggucauaggcaucguugagagagagguggagcuucugcaugagguaggccacagugacggugacagaacggcugacccccgccaagcaguggacgagcaccccgcaguucugggacaaggccucaucuagauggggcaggaaagggcccgggagacccggagggcaggcgugugugaggccgaggccuuccgaagggcccucaaaggccccgcccugcccccugggccagauggccacgaccugcagguuucucuaguggccucugggggccgcccuagcucugccuguccccuagaacugucaccuaggcuuuuggcucugggaauggcagcggggcuugggaggaguacucacaagggggaggccagagcaggccuuggggaggacaggagggaagggugggugggguggacucaccaaugaacucaauggccuccggaaagaaccgcgacagguucuggcuccaguggucggagauggggaucugcuuguagugaaagucaccauucuucucgaagaaguuugggagguugggggugacauugaggauguagcggaugcccaguuuggccaggcucuccaaauuggcggaaucccgggcacugcccagauagagguugggcaggaucuggacagggaaggaugcccgcagccccacugguggggguguggcacccuccgaauccaggccacagcucauggagucgcggucagccucggauuccgcaucagagcagucggagcccaggcacaggcugcccaaccccaccacgggcacuggaccgggcaccggcgccaugcuggagccggcacggccagcaaggcuggucucacacaggugagggcacucggccuggaaucugcugaagccuccuguuggggagagggcauggggccugcugaccuggccuucugggcagccaagugccucugucuggggcuggggagaugacccuggacaacuuggaggguuugcaaauguucccaaagggaacacaaaacccagcagcuugguguguccugguacccacguggggcccuagccacccucagucagcucgggcugcaagaagcugggcucacgcugagccaccggaaaggaucuuacaccccuagggucaagcugaggcaggugugagggcucaacagagccgagaugcacugccagccuuagggaggacugcggccaucagcuaaagaaaaggaggaacucagaugucagcucucugccugggcaucuccugacucucagggaugaagugggaccccaagaugugggggaacuugggggagaauauggcucaagaagccagcaucucuauuuacagauacuauuuccccgggcuggacaccugaacacuuuauaugcuguucgggaggcuaaggcaggaggaucgcuugagcccaggaggcuucagugagccgugauugcaccagugcugucugaccccugccucccuugcucauuccugagcagguuggggagguggggauacccuugccgagacccuggggagcccgcacuuuguaauucguucuugagcauccugagaacuagcucaggucaggcuaauucuccccauuuuccaggcucagagacugggcugccgagggugaagaacuuccccacggucacacucaggcuucccuccucucaaagcagccuggcaggucaucaggggaggggggccucaacucgcuuuagaaaaaaagaaguggggcuggccuaaggucaaaugaaucccgaacccccuggaaggagggccccgcggcaccuacccuggagguaguaggccagguagccuuccucucgcagcuucugcagcagggugcccagcaccgacucggccucccacuccucggccucggccucggccuccccgcgccggcgccggcccccgcccuggucguacaggagcacgggggcaggcgggggcggcugcagcggcggcccaggcaggagcgcgcgcaccgacaggcugccccuccgcaggcggcgcagcaggagcgccggcagggccacgcucagcgccccaccgaugcgcgccgacucguacagcucgcggcugcggcaguccaggagcaggagccgcggccgcgggggcgacagcucccgacgcagccacaggcacgagcggcccagacccuccaugggcgaucggcucccuacacgcuggaccacgggcgcugcgaagagagagaaggcgcggugugagcuaccggagggccgagggggcucagacuugaagccggccccgcguccugaaggcgggagcccagggucccccaccaugaggacucccaacaaggcgccccaagaaaccccccaggcagcagcucggcccggggaaggguccucgagaagagggcugagcggcuaaccgccccuucgaggcucaucuugggguacccugaggucgcagccgccucccuccauacccccuuucugcuccugucucggucuucucgcgaacgcuccccaaguucgagcuuccgacucuggcugggggugugcgugcgaggagugccguucgaggccuagaucucccccagggccaggugggccaggggaacagaggaggcgccgaggugcugggccucagcgaguccucucagagguggucuggcccccggucccccaucucccccuaccccuaggagagaacaaaaggaaagagaccuggagcgagauccggcgguggacgaccgcgcguggacguucuggccacggccacugccacggcggaacgcgaggcgccgucccgcggcagagaguccccaggccuggccgccaggagagggcggggcggcggugcaggcucgcacguggaagccgagccccgcgcagcccgcgcagcccgcgcaccggccgcuuccuggcagccggacccagcuuccaccuuggaaacugccuucggacguggaguuacaacuccgag

SEQ ID NO: 19026 - RNA, 8700 nt, Homo sapiens
agucgguuuuuaagcggcggccggccggggacggggaagagagggauagucggagcgagguggcgagucgcugagcccgccgcggccccgagagcggcugcagccgccgccgccgggaaggagagggcgaggcgcgcccgagccgccgccgccgccgccaccgccgccgccgccaccaccgccaccggagucgcgggccagccgggcagccuccgcgggccccggccggggcggggggcgcgggccacaggccccugcuccggccgccgcuugcagaccgcgggcgccgaugucgcccgcgccccgcuaggcugagccucgggucgggcgaggagccgccgcagccgccgccgcccgagccgcgggcaggagccucgggagccgccgccgccgccgccgccgcccggccgggccccgccgccgcccgcgcgcccccgggcccccgacacacaugagauucuucaggcucacuuucaagugcuucguggacugcuucugacugcgccgcccgcgccccgcaccccgccgcccgcccgccgccccgucccccggcccggccgccccccggcccccggccggcccgcgcccucggggcccuccccggugccgccggugccccccgccugaccgccgccccccgugaggcgccgcgaccccggcccggccgugcggcccgccgaggccauggcgaagaagagcgccgagaacggcaucuauagcguguccggcgacgagaagaagggcccccucaucgcgcccgggcccgacggggccccggccaagggcgacggccccgugggccuggggacacccggcggccgccuggccgugccgccgcgcgagaccuggacgcgccagauggacuucaucaugucgugcgugggcuucgccgugggcuugggcaacguguggcgcuuccccuaccugugcuacaagaacggcggaggugaguucccccgcccgccgcggccuccucccccagcaggccgccggcccccgcccgacccccggagccgccgcggaggggugaaguccgggcaacggguggcccccgggcacgcgggggucggggccgccccucguccgccgcugccgcucgguggccgggccgggcgccuccaccccccucgcagucaugugccuggcaugguggggggagggggccggcgaugcccgcgaggcugccccccagacucccgggcugggaggagcgauuggccgccgaggugggaaagcaggccugcgccuuggggucuccgcgagguaaggagcccuggcugcccccacgggucgggcacacaagcggcacauugugugggccccccacgugugcacacacacgaacacacacacacacaaugggccacucugucccucccccugcccuccccuccccucgcggcccucccgccccuccccucuggcccgggccuggaacacugggugcccgagccaggcuugggaagccugcggccuggcccgccuggcgccgccacuggacacacugcaugcacgucccaugcccgcccgcccgcccgcccgcccgggcccagcuuagcaacagcgaugggcacgcguguguccugugacuacaaaacagcacugggguugcuggaagccgaagugacccggugaugggugggaaacagagguccagagcaaaggccuuugcccaaggucaggagaaggaugcugggaccuggagucaggcaaguugcagccaagcucagccucugaguaguggagcgagcccagccagggcaaggguaggaggcccagagaggagaaggggguaguggcacccagcucucccugcccuucugccacccccaccccagccugcuggccucaggagauaggccugugucacgcccugccuaucuccugcagagccugacucccuggccuugcuaaggccggccuggccccucuuccgcaccuguaucccucuguccuugcacaucgccaucccaccagcaggggacugugacccacccacccucugccuuagaccucacacuugcaggcaagcguccaagggcaggacagucgcgcucccugccuuuggaugagccccccaggccugaucacccagccuuggcacacaugcacacaugcacgugcccucacugugcugccugaaacagggaauugcagcacuagggacagcccgcgugucugagcguguguguccuccauggccaucgccccaagugaccguggggguggaagcccugggggccuagggccccucugccacccagggaauagggcuccaauggcucaggggcuacuguagccccucuucaacacacucaacccacccccucaagacuccaccuggggccugagucaguggccaccccuacacugacucacccagucggaaguugugauggggccuuuggagucugggcuggcccgcugggccugggcagccuggcugggggccacccugaguccacgcugugccuccacccccagguguguuccuuauucccuacguccugaucgcccugguuggaggaauccccauuuucuucuuagagaucucgcugggccaguucaugaaggccggcagcaucaaugucuggaacaucuguccccuguucaaaggugagcagcccuuggccagccucagggacugcccccuucucccagcuggcucccacuugagaaaucuuuuccugucgugagcaccaggccuggggccacgugauggcgucccagucucgaggggggagccuggaggagauguucaggccgcacagcgaacuuggggaagcggggacuagagggggcauaggcagcuccacaaggcaaggacaggccaggcauagccgggcuggggacgggaccugcccagcagcacccuuggcucucuagguagguccuacuguuacuauccccaaggacgcuggggcacagacagguggagcgacguacugagguugcccacugcaggggcgacugucuccaacacuaccucaggcgacuagaaaccccccccccccaccaccaccaucaacaccagcugcugaggacuggaggcuacuggguggccaggcagaggcuuggaccuccuggaaccgccaugguggcagugggacccacagaaggggccagguguaugaggcuggagacuccacagcacuuggucagauggggacaggaggagaggggcucgcucugccuugggucuagggggcggcuggaggagaggagacaggcuggggagucagcgcaguguuggggcucacacaagggggagcccaggggagucaggagcaccacaaacaaggcuccaggaggacagauggugggagcacggccagccuggguggggacauaaagggguggcagggggagguggccagggaagaaucuacauggcaaggacuucccggccccaggccugggcuacgccuccauggugaucgucuucuacugcaacaccuacuacaucauggugcuggccuggggcuucuauuaccuggucaaguccuuuaccaccacgcugcccugggccacauguggccacaccuggaacacucccgacugcguggagaucuuccgccaugaagacugugccaaugccagccuggccaaccucaccugugaccagcuugcugaccgccgguccccugucaucgaguucugggagugaguccggcaccucugggccaagcccaucccaucccccaggucucccucauguugcccggcuccaggggaguggcccugagggggcaccaggguguugccuggcaguccauccuggacccugccugcccuugccuguccucggagaguccuggggccagccucgcuccuggguucggcagccgaucacuguccuggucacuccccccugaugggggagcuggggcugcaugugaggugggaugggaguggccucccaauggccaggggaucgugggcuccaggcccagcccaauuggacaagagggacccgcugaacccugggcugugggagagaagggagccacaacuccuggggguggacccuguggcuccauccucugcuggcacaggccucaugggaccucccucccuccccuaggaacaaagucuugaggcugucugggggacuggaggugccaggggcccucaacugggaggugacccuuugucugcuggccugcugggugcuggucuacuucugugucuggaagggggucaaauccacgggaaagguaccacuagaggcaugcagcggggaggguggcucagcccugggagccggaugucugugccaggcacaccuguggcaacgggaggugaccagacagagucuagcccuaaggaagggggagguacugaaagccaagcaaugcuccccacccugcaaauccagggcccagcagccuuugcuccuggggauagaggcccuggcaggcacugucccuucccugugcccaucacccccacuggugcccuccugccagucucugacucuugugacagucugguggaccuggucuggccaucuguuaccuaucuugccuuggggacccagagcagagucuggccacaucccuugggggcuccuggucaggcuggggagucaccugaacaaagaagacagugucuagagcugugggacauggccagcucccugggggacaagguccccagagcagcaugugggaagagggggcagacaguguggcagcugcaucucgccugccucugccuggcccaguuccacucuccaccugcucaacccccaccucucuccagaagaggagggggacccgacccggauccaauaucccgcucccugccugggccucccacaccugcacugcccacacacucauacagcucucacuccccacgugcuccacgccuccuguccccacugaggagagcucccagaggcucgccugcuccccaccgacacgcgucccugcagacaaacgaggcgcccagggagcuuccccacugcacuuggccagggcugccggggcgcagccuugccccuagcuuccucuggcgggagccauggcucggaggacaauggggaccucugaacauaccugcccgcaagggggaccggaggcgcugggagugggggugugagggagguggugccacagccuccgcugagcagccuggccccccagaucguguacuucacugcuacauuccccuacgugguccuggucgugcugcuggugcguggagugcugcugccuggcgcccuggauggcaucauuuacuaucucaagccugacuggucaaagcugggguccccucaggugagguggagguggagaggcugcagcagggcgcugcgggggagcccugcaggccccucaugccugcgcucuccggcccuucucuagguguggauagaugcggggacccagauuuucuuuucuuacgccauuggccugggggcccucacagcccugggcagcuacaaccgcuucaacaacaacugcuacaaguaagcaccgccgcccugccacccgugcccuguccugcccugccccgcccugcccagcagccuaacccauccacucuggccccuccaccccucagggacgccaucauccuggcucucaucaacagugggaccagcuucuuugcuggcuucguggucuucuccauccugggcuucauggcugcagagcagggcgugcacaucuccaagguggcagagucagguagggcccuacccccagccccgccuccagagcagcgagugcuacccagaugcaugauguacaggaacaugcaauagaaaugcugaaaagugacgaggauucaaacggaacuugucagauugugggccugugggggcagguccugggauuugucaauguugacagagaaaggaccucccagccccugccgcacgacccaggguugacagcgccucugaggcaggcgugggcaugggcgcgaguguugcaggcagggcucagggugcgcacagggcaggacaucggcuacaaggucuagagccugcaccuuucccacagggccgggccuggccuucaucgccuacccgcgggcugucacgcugaugccaguggccccacucugggcugcccuguucuucuucaugcuguugcugcuuggucucgacagccagguuugcauggggcucugggacagggagccaggaggggggcggagggagggcugcaggcaaggaaagggguggagggcggugcggggcucggccugagcugcccuggccacaguuuguagguguggagggcuucaucaccggccuccucgaccuccucccggccuccuacuacuuccguuuccaaagggagaucucuguggcccucuguugugcccucugcuuugucaucgaucucuccauggugacugaugugagugggguggggggucugccugugaccucugguggccgucugccauccucccugacugggcucugucccccagggcgggauguacgucuuccagcuguuugacuacuacucggccagcggcaccacccugcucuggcaggccuuuugggagugcguggugguggccuggguguacgguaggucauggcugagggcugggcugggggaugguggcggggaaggcaggucuccagcuuggcccucccgccucaccucgccgcaggagcugaccgcuucauggacgacauugccuguaugaucggguaccgaccuugccccuggaugaaauggugcugguccuucuucaccccgcuggucugcaugguaagggcugggggagguggggcagggcggggggcgaggcagggcgggguaggggccccauuaaccgcagcauucugguccguagggcaucuucaucuucaacguuguguacuacgagccgcuggucuacaacaacaccuacguguacccgugguggggugaggccaugggcugggccuucgcccuguccuccaugcugugcgugccgcugcaccuccugggcugccuccucagggccaagggcaccauggcugagguaaggcucccgcccggcccgcccuccccuccccugcugugaacauucaacccagccugcuuccuagccagggaguggccccgacuaggguggcaggcagugggaaccggagagaggcagaggaagucaccguggggacgagcaggugacccugggggcuucagcauguccuccucuccugcagcgcuggcagcaccugacccagcccaucuggggccuccaccacuuggaguaccgagcucaggacgcagaugucaggggccugaccacccugaccccaguguccgagagcagcaaggucgucgugguggagagugucaugugacaacucagcucacaucaccagcucaccucugguagccauagcagccccugcuucagccccaccgcaccccuccagggggccugccuuucccugacacuuuuggggucugccugggggaggaggggagaaagcaccaugagugcucacuaaaacaacuuuuuccauuuuuaauaaaacgccaaaaauaucacaacccaccaaaaauagaugccucucccccuccagcccuagccgagcugguccuaggccccgccuagugccccacccccacccacagugcugcacuccuccugccccugccacgcccacccccugcccaccucuccaggcucugcucugcagcacacccgugggugaccccucaccccagaagcagcaguggcagcuugggaaaugugaggaagggaaggagggagagacgggagggaggagagagaggagaagggaggcaggggaggggcagcagaaccaaggcaaauauuucagcugggcuauaccccucuccccaucccuguuauagaagcuuagagagccagccagcaauggaaccuucugguuccugcgccaaucgccaccaguaucaauugugugagcuugggugcgagugcacgcgugcgugaguacggagaguauauauagaucucuaucucuuagcaaaggugaaugccagauguaaauggcgccucugggcaaaggaggcuuguauuuugcacauuuuauaaaaacuugagagaaugagauuucugcuuguauauuucuaaaaagaggaaggagcccaaaccauccucuccuuaccacucccaucccugugagcccuaccuuaccccucugccccuagccaaggagugugaauuuauagaucuaacuuucauaggcaaaacaaaagcuucgagcuguugcgugugugagucuguuguguggaugugcgugugugguccccagccccagacuggauuggaaaagugcauggugggggccucggggcuguccccacgcugucccuuugccacaagucuguggggcaagaggcugcaauauuccguccugggugucugggcugcuaaccuggccugcucaggcuucccacccugugcggggcacacccccaggaagggacccuggacacggcucccacguccaggcuuaagguggaugcacuucccgcaccuccagucuucuguguagcagcuuuaacccacguuugucugucacguccagucccgagacggcugagugaccccaagaaaggcuuccccgacacccagacagaggcugcagggcuggggcugggugaggguggcgggccugcggggacauucuacugugcuaaaaagccacugcagacauagcaauaaaaacaugucauuuuccaaagc

SEQ ID NO: 19027 - RNA, 8700 nt, Homo sapiens
gcuuuggaaaaugacauguuuuuauugcuaugucugcaguggcuuuuuagcacaguagaauguccccgcaggcccgccacccucacccagccccagcccugcagccucugucugggugucggggaagccuuucuuggggucacucagccgucucgggacuggacgugacagacaaacguggguuaaagcugcuacacagaagacuggaggugcgggaagugcauccaccuuaagccuggacgugggagccguguccagggucccuuccugggggugugccccgcacagggugggaagccugagcaggccagguuagcagcccagacacccaggacggaauauugcagccucuugccccacagacuuguggcaaagggacagcguggggacagccccgaggcccccaccaugcacuuuuccaauccagucuggggcuggggaccacacacgcacauccacacaacagacucacacacgcaacagcucgaagcuuuuguuuugccuaugaaaguuagaucuauaaauucacacuccuuggcuaggggcagagggguaagguagggcucacagggaugggagugguaaggagaggaugguuugggcuccuuccucuuuuuagaaauauacaagcagaaaucucauucucucaaguuuuuauaaaaugugcaaaauacaagccuccuuugcccagaggcgccauuuacaucuggcauucaccuuugcuaagagauagagaucuauauauacucuccguacucacgcacgcgugcacucgcacccaagcucacacaauugauacugguggcgauuggcgcaggaaccagaagguuccauugcuggcuggcucucuaagcuucuauaacagggauggggagagggguauagcccagcugaaauauuugccuugguucugcugccccuccccugccucccuucuccucucucuccucccucccgucucucccuccuucccuuccucacauuucccaagcugccacugcugcuucuggggugaggggucacccacgggugugcugcagagcagagccuggagaggugggcagggggugggcguggcaggggcaggaggagugcagcacuguggguggggguggggcacuaggcggggccuaggaccagcucggcuagggcuggagggggagaggcaucuauuuuugguggguugugauauuuuuggcguuuuauuaaaaauggaaaaaguuguuuuagugagcacucauggugcuuucuccccuccucccccaggcagaccccaaaagugucagggaaaggcaggcccccuggaggggugcgguggggcugaagcaggggcugcuauggcuaccagaggugagcuggugaugugagcugaguugucacaugacacucuccaccacgacgaccuugcugcucucggacacuggggucaggguggucaggccccugacaucugcguccugagcucgguacuccaagugguggaggccccagaugggcugggucaggugcugccagcgcugcaggagaggaggacaugcugaagcccccagggucaccugcucguccccacggugacuuccucugccucucuccgguucccacugccugccacccuagucggggccacucccuggcuaggaagcaggcuggguugaauguucacagcaggggaggggagggcgggccgggcgggagccuuaccucagccauggugcccuuggcccugaggaggcagcccaggaggugcagcggcacgcacagcauggaggacagggcgaaggcccagcccauggccucaccccaccacggguacacguagguguuguuguagaccagcggcucguaguacacaacguugaagaugaagaugcccuacggaccagaaugcugcgguuaauggggccccuaccccgcccugccucgccccccgcccugccccaccucccccagcccuuaccaugcagaccagcggggugaagaaggaccagcaccauuucauccaggggcaaggucgguacccgaucauacaggcaaugucguccaugaagcggucagcuccugcggcgaggugaggcgggagggccaagcuggagaccugccuuccccgccaccaucccccagcccagcccucagccaugaccuaccguacacccaggccaccaccacgcacucccaaaaggccugccagagcaggguggugccgcuggccgaguaguagucaaacagcuggaagacguacaucccgcccugggggacagagcccagucagggaggauggcagacggccaccagaggucacaggcagaccccccaccccacucacaucagucaccauggagagaucgaugacaaagcagagggcacaacagagggccacagagaucucccuuuggaaacggaaguaguaggaggccgggaggaggucgaggaggccggugaugaagcccuccacaccuacaaacuguggccagggcagcucaggccgagccccgcaccgcccuccaccccuuuccuugccugcagcccucccuccgccccccuccuggcucccugucccagagccccaugcaaaccuggcugucgagaccaagcagcaacagcaugaagaagaacagggcagcccagaguggggccacuggcaucagcgugacagcccgcggguaggcgaugaaggccaggcccggcccugugggaaaggugcaggcucuagaccuuguagccgauguccugcccugugcgcacccugagcccugccugcaacacucgcgcccaugcccacgccugccucagaggcgcugucaacccugggucgugcggcaggggcugggagguccuuucucugucaacauugacaaaucccaggaccugcccccacaggcccacaaucugacaaguuccguuugaauccucgucacuuuucagcauuucuauugcauguuccuguacaucaugcaucuggguagcacucgcugcucuggaggcggggcuggggguagggcccuaccugacucugccaccuuggagaugugcacgcccugcucugcagccaugaagcccaggauggagaagaccacgaagccagcaaagaagcuggucccacuguugaugagagccaggaugauggcgucccugagggguggaggggccagaguggauggguuaggcugcugggcagggcggggcagggcaggacagggcacggguggcagggcggcggugcuuacuuguagcaguuguuguugaagcgguuguagcugcccagggcugugagggcccccaggccaauggcguaagaaaagaaaaucuggguccccgcaucuauccacaccuagagaagggccggagagcgcaggcaugaggggccugcagggcucccccgcagcgcccugcugcagccucuccaccuccaccucaccugaggggaccccagcuuugaccagucaggcuugagauaguaaaugaugccauccagggcgccaggcagcagcacuccacgcaccagcagcacgaccaggaccacguaggggaauguagcagugaaguacacgaucuggggggccaggcugcucagcggaggcuguggcaccaccucccucacacccccacucccagcgccuccggucccccuugcgggcagguauguucagagguccccauuguccuccgagccauggcucccgccagaggaagcuaggggcaaggcugcgccccggcagcccuggccaagugcaguggggaagcucccugggcgccucguuugucugcagggacgcgugucgguggggagcaggcgagccucugggagcucuccucaguggggacaggaggcguggagcacguggggagugagagcuguaugagugugugggcagugcaggugugggaggcccaggcagggagcgggauauuggauccgggucgggucccccuccucuucuggagagagguggggguugagcagguggagaguggaacugggccaggcagaggcaggcgagaugcagcugccacacugucugcccccucuucccacaugcugcucuggggaccuugucccccagggagcuggccaugucccacagcucuagacacugucuucuuuguucaggugacuccccagccugaccaggagcccccaagggauguggccagacucugcucuggguccccaaggcaagauagguaacagauggccagaccagguccaccagacugucacaagagucagagacuggcaggagggcaccagugggggugaugggcacagggaagggacagugccugccagggccucuauccccaggagcaaaggcugcugggcccuggauuugcaggguggggagcauugcuuggcuuucaguaccucccccuuccuuagggcuagacucugucuggucaccucccguugccacaggugugccuggcacagacauccggcucccagggcugagccacccuccccgcugcaugccucuagugguaccuuucccguggauuugacccccuuccagacacagaaguagaccagcacccagcaggccagcagacaaagggucaccucccaguugagggccccuggcaccuccagucccccagacagccucaagacuuuguuccuaggggagggagggaggucccaugaggccugugccagcagaggauggagccacaggguccacccccaggaguuguggcucccuucucucccacagcccaggguucagcgggucccucuuguccaauugggcugggccuggagcccacgauccccuggccauugggaggccacucccaucccaccucacaugcagccccagcucccccaucaggggggagugaccaggacagugaucggcugccgaacccaggagcgaggcuggccccaggacucuccgaggacaggcaagggcaggcaggguccaggauggacugccaggcaacacccuggugcccccucagggccacuccccuggagccgggcaacaugagggagaccugggggaugggaugggcuuggcccagaggugccggacucacucccagaacucgaugacaggggaccggcggucagcaagcuggucacaggugagguuggccaggcuggcauuggcacagucuucauggcggaagaucuccacgcagucgggaguguuccagguguggccacauguggcccagggcagcguggugguaaaggacuugaccagguaauagaagccccaggccagcaccaugauguaguagguguugcaguagaagacgaucaccauggaggcguagcccaggccuggggccgggaaguccuugccauguagauucuucccuggccaccucccccugccaccccuuuauguccccacccaggcuggccgugcucccaccaucuguccuccuggagccuuguuuguggugcuccugacuccccugggcucccccuugugugagccccaacacugcgcugacuccccagccugucuccucuccuccagccgcccccuagacccaaggcagagcgagccccucuccuccuguccccaucugaccaagugcuguggagucuccagccucauacaccuggccccuucugugggucccacugccaccauggcgguuccaggagguccaagccucugccuggccacccaguagccuccaguccucagcagcugguguugauggugguggugggggggggggguuucuagucgccugagguaguguuggagacagucgccccugcagugggcaaccucaguacgucgcuccaccugucugugccccagcguccuuggggauaguaacaguaggaccuaccuagagagccaagggugcugcugggcaggucccguccccagcccggcuaugccuggccuguccuugccuuguggagcugccuaugcccccucuaguccccgcuuccccaaguucgcugugcggccugaacaucuccuccaggcuccccccucgagacugggacgccaucacguggccccaggccuggugcucacgacaggaaaagauuucucaagugggagccagcugggagaagggggcagucccugaggcuggccaagggcugcucaccuuugaacaggggacagauguuccagacauugaugcugccggccuucaugaacuggcccagcgagaucucuaagaagaaaauggggauuccuccaaccagggcgaucaggacguagggaauaaggaacacaccuggggguggaggcacagcguggacucaggguggcccccagccaggcugcccaggcccagcgggccagcccagacuccaaaggccccaucacaacuuccgacugggugagucaguguagggguggccacugacucaggccccagguggagucuugaggggguggguugaguguguugaagaggggcuacaguagccccugagccauuggagcccuauucccuggguggcagaggggcccuaggcccccagggcuuccacccccacggucacuuggggcgauggccauggaggacacacacgcucagacacgcgggcugucccuagugcugcaauucccuguuucaggcagcacagugagggcacgugcaugugugcaugugugccaaggcugggugaucaggccuggggggcucauccaaaggcagggagcgcgacuguccugcccuuggacgcuugccugcaagugugaggucuaaggcagagggugggugggucacaguccccugcuggugggauggcgaugugcaaggacagagggauacaggugcggaagaggggccaggccggccuuagcaaggccagggagucaggcucugcaggagauaggcagggcgugacacaggccuaucuccugaggccagcaggcugggguggggguggcagaagggcagggagagcugggugccacuacccccuucuccucucugggccuccuacccuugcccuggcugggcucgcuccacuacucagaggcugagcuuggcugcaacuugccugacuccaggucccagcauccuucuccugaccuugggcaaaggccuuugcucuggaccucuguuucccacccaucaccgggucacuucggcuuccagcaaccccagugcuguuuuguagucacaggacacacgcgugcccaucgcuguugcuaagcugggcccgggcgggcgggcgggcgggcgggcaugggacgugcaugcaguguguccaguggcggcgccaggcgggccaggccgcaggcuucccaagccuggcucgggcacccaguguuccaggcccgggccagaggggaggggcgggagggccgcgaggggaggggagggcagggggagggacagaguggcccauuguguguguguguguucgugugugugcacacguggggggcccacacaaugugccgcuugugugcccgacccgugggggcagccagggcuccuuaccucgcggagaccccaaggcgcaggccugcuuucccaccucggcggccaaucgcuccucccagcccgggagucuggggggcagccucgcgggcaucgccggcccccuccccccaccaugccaggcacaugacugcgagggggguggaggcgcccggcccggccaccgagcggcagcggcggacgaggggcggccccgacccccgcgugcccgggggccacccguugcccggacuucaccccuccgcggcggcuccgggggucgggcgggggccggcggccugcugggggaggaggccgcggcgggcgggggaacucaccuccgccguucuuguagcacagguaggggaagcgccacacguugcccaagcccacggcgaagcccacgcacgacaugaugaaguccaucuggcgcguccaggucucgcgcggcggcacggccaggcggccgccggguguccccaggcccacggggccgucgcccuuggccggggccccgucgggcccgggcgcgaugagggggcccuucuucucgucgccggacacgcuauagaugccguucucggcgcucuucuucgccauggccucggcgggccgcacggccgggccggggucgcggcgccucacggggggcggcggucaggcggggggcaccggcggcaccggggagggccccgagggcgcgggccggccgggggccggggggcggccgggccgggggacggggcggcgggcgggcggcggggugcggggcgcgggcggcgcagucagaagcaguccacgaagcacuugaaagugagccugaagaaucucaugugugucgggggcccgggggcgcgcgggcggcggcggggcccggccgggcggcggcggcggcggcggcggcucccgaggcuccugcccgcggcucgggcggcggcggcugcggcggcuccucgcccgacccgaggcucagccuagcggggcgcgggcgacaucggcgcccgcggucugcaagcggcggccggagcaggggccuguggcccgcgccccccgccccggccggggcccgcggaggcugcccggcuggcccgcgacuccgguggcggugguggcggcggcggcgguggcggcggcggcggcggcucgggcgcgccucgcccucuccuucccggcggcggcggcugcagccgcucucggggccgcggcgggcucagcgacucgccaccucgcuccgacuaucccucucuuccccguccccggccggccgccgcuuaaaaaccgacu

SEQ ID NO: 19028 - RNA, 4733 nt, Homo sapiens
guucaguccacacuuuauuaagaaaggaauacacacacuuucuccgagagcccucacgggggucucaggcagaacacgcucugagagccgggccuggcuccagcgucucucugcccugugguuguggagaacuggcgcccagcaggguggugggagcugucccgcuuuucccuuaaggcacggagagcuggagguggagccacagccgggccuagggguugagccaggggugcuggaggcagucagcggcacuggcccgcuuuucggggauguacuccaucaugggcagcagaaaggcgcugaacuguguggccugcucuaggggccacucguacuuuuccaugaguaccucguacaggccccagugcuugagauuguggaugugccgcagcucuccugcgggcaggccagcgggcgucaggcucugucccugucucuggaccugccuucugcuuaggcccuggcuccugggacccaguguucccucuguugcagaauccaagguccccgucccacccucccugcagccacauggccugaggcugcccgggcccucaccucuccgguugaagaacucccgggaauagcggccugagagggcgaaggcuggggggaugucccccagaagcuccacuaugugagcgauguggucugugggcagaaagaggagguugggggcaggcaggccgggaggccgggaggcugagcccagagcccucaccccuuacccucaucacgacuguagucuucuccagaaugcggcucgaacagguagucaccaguggccagcucgaaggccuggaagggggaggaggugaggcugcuggcuggugggcugcuggcccugggcacagggcagcccgggcgggcguaccaugcaggcugugcuccagaugucugccggggggccguauucggcgccgaucagcaccucgacggcccgguacugccgagucuggaugucuuccgugaagugcuugugcuggaagcaaggggagcccuggggacgggcuggggccaaggcuguccugcccccacggacuccugccccaccccgauccgccuacccgaggagcucagugggguuugcugugagccucgggguccccagguccuccaagagggacaggcccagugaugugaggcugaggcugaucccuuccuaguggccccugcccuuggccauggccccagugcuguugacugggcaggaccagugcccacccagccgacgguucacgugcacugcagacugggguagggcuccccaagagcggcccugugccuccacccuuggagcagggccccccacucugcucucccacacuugcucauaccacccagcaggcguugcccaggucugcgaucuugaucuugaucuuaucugcauuuuggggcuccaggggguucaccaggagguucgaggcaccgaauggugcuggggaaggcagagcagggagacugaagugguccgacuacugccagcccugccugcccaccacuugccacccaacuuacugcuaggcgacaggaggcccccggucucucgcugauuggacgagccggagaggauggagcaggaggcaggagagaagagggagccggagaagccugaggucugugagcccgcgcugaggcuacggccgcccccuggggcgggggaggaagaggcuggggagggaccugcucuggcgcccccggggugacagccugaagaggauguggagccgcugcccccgucuagucucaagccagagucuggggagacgggguggaggcagcugcugagcagaugucuugcagccuuugcugcgcuccacggcccaucacccucuguggccccucacccucagccuggguggcagccuccauggccuccagccucugcaggucccgcagccgcuccuccagcagccgcuucugcuguuuccguuugcgccucaucuucuuccucuuguuuuuggacagcuuaccggucugcugucagagccagggucaccccaggguuccugucgcccgccccagucagcaugaaguggagguuucccugcacagccgccagggaagaggccucuccgggccccagggcucccauggacaccagaauguggcgccagcgccccuuggcaccagcuacucacuacucucccugccuccccgccuguggccccacuccccacagcuccauuaggagugggaagaccuggccggcccgccucagggugcucucuguccccucucagcccaagcuaaggcaggcggaaguggccauucggggaagacagcauccuuucaccaagagcaguuuggggcacuugaccccccccgggaauuaccgucagcccagccacccagccuuucgggauuaccaccgugggagugcgugaaggugggggguggagccacuguggcuccagagauggccuccaguuggcucagaugggagaggaggcaugggagagaggggccccccaacuuaccaagaccuccuggggggcagugcugacugggagugcagguggggagcgguggggggggacagggaggaacagagacucaggcagggguucaggcccagaggccccgacccagccccaugugggcccuugguaccuauggagcgggaggggggcggcgccccugccuguugccacuccguggccucggcagccaggcgccugauguaagcgucccccacacacagcaagauguucucgggcuugauguccguguggaugaucuugcacuugguguggagguaguccaggccgugcagcaccugcagagagucgcaccugaccuccuccaacucccgcccaggccaggcugggcagcccaguggguggcacucaccugccucacgaugcucuucacgcagggcacgggcaggcccugguaguuggacuugaugauccauuugaggagcugguggcccagcaccuccagcaccaugcacacaucugggcugggagugaagggcggccaguggacaccagcugcggcacaggccccacccacccucagcuaggggagcagcaaggcuugggccguguggagguggggaggcagggccuccccugggcaguccuggucaccauuaugcuggugucaucaucgauagugucccugucagucucaacagguaugccaguugggauggugcauuuuguggucauccuagagguggcgcuggaggagcaggcacagaggccucucgggccagcccacucccaugcuaguuaugccauagggccucuuggcagucccccaaagggaaggcagugccacagagacagcaccugccguuuggggauaauagcaacguccauggacaaucaacgcuagcuuguuacugccuccacguaaacacaguuaccugggggcggggucgugccagaggcucccguuacugggagggaugcaagcccauugugcgggucugcagacaggcucuagcagcgagggcccccccauuugccggcccuuggcugccacacugcuuugcucuuccugcaaaggauacggacuccauugacuccugagauccugaagucaucaaugagcuggacaauggucucucuuuuggggucacuggggucgcugucccggaccuggagcaaaagccaaggggccacagaugguuccacccugcccugaagcccacagcucccuucaguguacccuucuccugcuccagcugggcccugcuggaagaaaggccgccaaccccuccugucccucgccuguuccuccagauccucccccuugggcacagccagcuggaggcugccccucagggagccccgcccugccccacagagccccggcaggccuugcacccgcauugccaggccccaggcagcuccaggggagcugggagugggguagggaggugccucacacauuucaggagcuugaucucauccacagcugucuccguguaaugccccgcacucuucaccacuuugagggccacaaagcgcuugcgccugcaauaccgagacccuuguaggcuguggcccuggcaggacccacggcggggaucaggguggccccaagcaagcccagggacaggaucccagccagugcugggccccggaggcgaaggaggcacucacuggaugucccagcagagccagacgguggagaaguggccccagcccaguuugcgcaccacgugguaccgcccauugaacacgucgccgaucuucacagggugguagccgccugcccaggggagauguagauugggguggaggggguucucacuccccugggcccccgaacaccucggccccauugaccaucuggcccaugugggcccaggacugcccugggucccugcaguggccgugaggccgcauguccccaaggccaagucucacccuugcaguagucuuuggggucuuccuguuccucgucgucggagcccagaaggcccugcagcaucugaggcaccgguguggccagggcuaguucggagcccgaggacucgggcccgcaggaggccugugagcugcggguggggugaguggcagugggcaugagagacgccaggggcuccgggugccccagccgagcccuaccugcugcuacugccgccgcugccgccgcuguccccaccaccgcccgugcuggcgcucaucccggccacgcagcccgcagcuccggugccccgggcggcugcuccuguggggcccggccgcggccugcgaauuuauagccuuggccgg

SEQ ID NO: 19029 - RNA, 4100 nt, Homo sapiens
cauguugagggggggaccgcgaccagcugggccccuggcucagggaggggccacgucagugcugccagagacgucacaaugccggcccagccguucggugcgcgauuggcugccgcugccacuuacgcgucgcucuuccucguuugccccucguguucaugggagcucguuuucuuuuccucuaggcagagaagaggcgauggcggcgauggcaucucucggcgcccuggcgcugcuccugcuguccagccucucccgcugcucagguagcggcccagccggggcuucuuucuugcgagccucugacccacggcaggugguguugggggcaggagggaugcggggguccggccuuucaggguccgucgcugcgggccgggccuucccccgagaggcaggcggccuugggacggggggaccaaagcaccucgcgcacguuuaccggcagccaggcuuuuccuugucugcccauacgaagaggaguccccgagccuccauggugcgcccggcccccaagcugcagcacggaacgugacacaugucccggcucccgcucccugcggggucggaccggagcgaagcucuguagcgcugagcgaucgcggccaaaaacggggcuggaggagccacauaagcuaggaagggaccucagugaggagagggagcaagagcggggcgaguuagauggggagccaaaggugcgcagggccuugagugccaggccgaagacuggcuuuuccggagggcccugccuuacccuuaccagaguuuucggcagagccgaccaggggucccgucgauuugcauucgugaggggcugaggucugaacuccagaguguguuuaggagguggcugcagcagccagccccgggcccgggggccaggacuggacaggggcggcuuucuccacauucccuuuucugccguccuucaggccaguagccuugcugccugcaacguuuuggcagccuaacuggccucccuuuccgcacacuccucaucugccccucaggaauucccugaacuauagucagggacguauccagaggacaagccuggccauaaaacccuucgggggcuccccugcgccacaggaagcaggcccaacuuaggcaggacacagaagggcuggcgggaucuagccccugagaacugccuccacgcuguuccuagggaucugccuccugugguccagacccagagccuucucugacguccucugcugaagccaucguucugccagggcaccacauuuggacagcggguggcugagaacauucccacuuuggggagccuuuguuucacacccucugauguaggcggcagccuuccuuuccuuugggccucugguuauggagaaggcuaaggcaagguccuuucucucacagcuaacaaguugugcuucuggaaccagagucucucccguuuacuucuucaggaaacgcuggggccagucuucaccuucugucaacuggccgggggcagagacccuuucucucaucuugaaagccccagugcauugccugccugcagcccccacccccgaugucucugcugaggaugccuucaguaacucguccaggccguuuguggcucugaauugaggcuggcguggcccccgggccuccgugucauagguccaaguguuggcauguauuguccagugaauccagcccccaccuguccccaguucgcucuuccugcacaccuccagaaagccggccuugccccuccccagccuuccuucacagccaucccgccuacguugccauugcauuugugaccgagcacuuggaucugucucgcauaucccaccuggaaggggcaggaagagcgcauggguccccagcugauccgugcuaugaggcagggccgggccauccugcccucagaccgggauacucgagcuggccuuacccaggcaucucucccucuuccccgcagccgaggccugccuggagccccagaucaccccuuccuacuacaccacuucugacgcugucauuuccacugagaccgucuucauuguggagaucucccugacaugcaagaacaggguccaggugagacagugggguuucagacaggagggcggguggggggugcuccucacugcuaguugaugggggaccugugucgauagagggagaaucaagauuccaacucuuggggugccggagagaucagggcacggugaugccagauccuagccaguguugacaggucaccuuccucaccugcuuugugugcugugccuacacgagguaacccugggcucaccacccgcuguuuccugaaugaguaucuggaccgggagaaagggccaggagucagcccaccccgguugccauuggccaguuugucuguguggguguuuuguuuuuguuuuuguuuuuuguuuguuuuuuugagauagggucucacucuguugccucagcuggagugcauuggcacgaucuuggcucacugcagccuccaccucccggguucaagcgauucuccucucagucuccuaaguagcugggaugacaggugcucgccaccaugcccagcuaaguucccauaaguccaaagaaggaaauggggccuuuuuuggguauggcccucuuaggguaaagcaccccuugggcagcccacugggcaccccugaccccagcaccucccuuguagacucaggaaaucacucagcccuuuugaucaucccgccccugcucacagucaacaggguuccuaugcguccaguuaggcccggccauggggaucuggccuugugcccccguagggaagaccaaugcagagggccagucacgggauuggugaguguuacuugguaccuccugccagggacacugcagcccccaacugggccuagccugcccaccugcaggccgugugagcagcgcacagggcuccucugcccacacccagagggggcagaaggugacccugccuuuguucccucacccagaacauggcucucuaugcugacgucgguggaaaacaauucccugucacucgaggccaggauguggggcguuaucaggugaggggccaaugguucccuugcuagggggcucccugcucccgggugugaccugaagccccagggguggccggucaaccagggccaggggccgugggcucuggcugccggagugcugcagugucggcacugguggucaggguggccccuccguguccacucugcccacacucugcucaacacccaacccagguguccuggagccuggaccacaagagcgcccacgcaggcaccuaugagguuagauucuucgacgaggaguccuacagccuccucaggaaggugaggacuccuguagcccacugugcuccccugucccuggggagcaggaugggcuggguugggaggugcuggcagcaaguccugagcuggguggccuuucugugauccugucccuuccucagugucucuugcccauuucucuccuuuccuuuucuggggcuugggccgguguuccuaccugucuuuccccuccccuccccacccccacacgccaggcaccccugaccccagcaccucccuugcaccucccuugcaggcucagaggaauaacgaggacauuuccaucaucccgccucuguuuacagucagcguggaccaucgggugaguggccuggucccuccuccuuuuugggguuguugggcugagugaagguuauccucuccacagccccagcucugcugcugggccgugauuggccagcaugucuugguuccccuggcggaaggugaccagggcuggcuggucugcucaccuguacuccccugagcuggcuugugaucuccuuuuuuucagggcacuuggaacgggcccuggguguccacugaggugcuggcugcggcgaucggccuugugaucuacuacuuggccuucagugcgaagagccacauccaggccugagggcggcaccccagcccugcccuugcuuccuucaauaaacaucacaggaccugggacugcacaggaccuggggcugcuggcuugcguuauugugccuucccccgacugggagagcugggggcccagcguccucuugucugccuggccagcagagg

SEQ ID NO: 19030 - RNA, 4100 nt, Homo sapiens
ccucugcuggccaggcagacaagaggacgcugggcccccagcucucccagucgggggaaggcacaauaacgcaagccagcagccccagguccugugcagucccagguccugugauguuuauugaaggaagcaagggcagggcuggggugccgcccucaggccuggauguggcucuucgcacugaaggccaaguaguagaucacaaggccgaucgccgcagccagcaccucaguggacacccagggcccguuccaagugcccugaaaaaaaggagaucacaagccagcucaggggaguacaggugagcagaccagccagcccuggucaccuuccgccaggggaaccaagacaugcuggccaaucacggcccagcagcagagcuggggcuguggagaggauaaccuucacucagcccaacaaccccaaaaaggaggagggaccaggccacucacccgaugguccacgcugacuguaaacagaggcgggaugauggaaauguccucguuauuccucugagccugcaagggaggugcaagggaggugcuggggucaggggugccuggcguguggggguggggaggggaggggaaagacagguaggaacaccggcccaagccccagaaaaggaaaggagagaaaugggcaagagacacugaggaagggacaggaucacagaaaggccacccagcucaggacuugcugccagcaccucccaacccagcccauccugcuccccagggacaggggagcacagugggcuacaggaguccucaccuuccugaggaggcuguaggacuccucgucgaagaaucuaaccucauaggugccugcgugggcgcucuugugguccaggcuccaggacaccuggguuggguguugagcagagugugggcagaguggacacggaggggccacccugaccaccagugccgacacugcagcacuccggcagccagagcccacggccccuggcccugguugaccggccaccccuggggcuucaggucacacccgggagcagggagcccccuagcaagggaaccauuggccccucaccugauaacgccccacauccuggccucgagugacagggaauuguuuuccaccgacgucagcauagagagccauguucugggugagggaacaaaggcagggucaccuucugcccccucugggugugggcagaggagcccugugcgcugcucacacggccugcaggugggcaggcuaggcccaguugggggcugcagugucccuggcaggagguaccaaguaacacucaccaaucccgugacuggcccucugcauuggucuucccuacgggggcacaaggccagauccccauggccgggccuaacuggacgcauaggaacccuguugacugugagcaggggcgggaugaucaaaagggcugagugauuuccugagucuacaagggaggugcuggggucaggggugcccagugggcugcccaaggggugcuuuacccuaagagggccauacccaaaaaaggccccauuuccuucuuuggacuuaugggaacuuagcugggcaugguggcgagcaccugucaucccagcuacuuaggagacugagaggagaaucgcuugaacccgggagguggaggcugcagugagccaagaucgugccaaugcacuccagcugaggcaacagagugagacccuaucucaaaaaaacaaacaaaaaacaaaaacaaaaacaaaacacccacacagacaaacuggccaauggcaaccggggugggcugacuccuggcccuuucucccgguccagauacucauucaggaaacagcggguggugagcccaggguuaccucguguaggcacagcacacaaagcaggugaggaaggugaccugucaacacuggcuaggaucuggcaucaccgugcccugaucucuccggcaccccaagaguuggaaucuugauucucccucuaucgacacaggucccccaucaacuagcagugaggagcaccccccacccgcccuccugucugaaaccccacugucucaccuggacccuguucuugcaugucagggagaucuccacaaugaagacggucucaguggaaaugacagcgucagaagugguguaguaggaaggggugaucuggggcuccaggcaggccucggcugcggggaagagggagagaugccuggguaaggccagcucgaguaucccggucugagggcaggauggcccggcccugccucauagcacggaucagcuggggacccaugcgcucuuccugccccuuccaggugggauaugcgagacagauccaagugcucggucacaaaugcaauggcaacguaggcgggauggcugugaaggaaggcuggggaggggcaaggccggcuuucuggaggugugcaggaagagcgaacuggggacaggugggggcuggauucacuggacaauacaugccaacacuuggaccuaugacacggaggcccgggggccacgccagccucaauucagagccacaaacggccuggacgaguuacugaaggcauccucagcagagacaucgggggugggggcugcaggcaggcaaugcacuggggcuuucaagaugagagaaagggucucugcccccggccaguugacagaaggugaagacuggccccagcguuuccugaagaaguaaacgggagagacucugguuccagaagcacaacuuguuagcugugagagaaaggaccuugccuuagccuucuccauaaccagaggcccaaaggaaaggaaggcugccgccuacaucagagggugugaaacaaaggcuccccaaagugggaauguucucagccacccgcuguccaaauguggugcccuggcagaacgauggcuucagcagaggacgucagagaaggcucugggucuggaccacaggaggcagaucccuaggaacagcguggaggcaguucucaggggcuagaucccgccagcccuucuguguccugccuaaguugggccugcuuccuguggcgcaggggagcccccgaaggguuuuauggccaggcuuguccucuggauacgucccugacuauaguucagggaauuccugaggggcagaugaggagugugcggaaagggaggccaguuaggcugccaaaacguugcaggcagcaaggcuacuggccugaaggacggcagaaaagggaauguggagaaagccgccccuguccaguccuggcccccgggcccggggcuggcugcugcagccaccuccuaaacacacucuggaguucagaccucagccccucacgaaugcaaaucgacgggaccccuggucggcucugccgaaaacucugguaaggguaaggcagggcccuccggaaaagccagucuucggccuggcacucaaggcccugcgcaccuuuggcuccccaucuaacucgccccgcucuugcucccucuccucacugaggucccuuccuagcuuauguggcuccuccagccccguuuuuggccgcgaucgcucagcgcuacagagcuucgcuccgguccgaccccgcagggagcgggagccgggacaugugucacguuccgugcugcagcuugggggccgggcgcaccauggaggcucggggacuccucuucguaugggcagacaaggaaaagccuggcugccgguaaacgugcgcgaggugcuuugguccccccgucccaaggccgccugccucucgggggaaggcccggcccgcagcgacggacccugaaaggccggacccccgcaucccuccugcccccaacaccaccugccgugggucagaggcucgcaagaaagaagccccggcugggccgcuaccugagcagcgggagaggcuggacagcaggagcagcgccagggcgccgagagaugccaucgccgccaucgccucuucucugccuagaggaaaagaaaacgagcucccaugaacacgaggggcaaacgaggaagagcgacgcguaaguggcagcggcagccaaucgcgcaccgaacggcugggccggcauugugacgucucuggcagcacugacguggccccucccugagccaggggcccagcuggucgcggucccccccucaacaug

SEQ ID NO: 19031 - RNA, 3756 nt, Homo sapiens
auggggcuugguuucuagagcccucaccaucuaagcaccuuccucaguucacucagaagagaagccccugcuccagaugguguggggcgcagaacgggcucugugacuucuugguggacacccugcaggaccccuccguuccugcagucuugcucucucugagucacuggggaaacaggugccccccagaggcuccccguucccacaccucagaguggaagccaccagaacagcugcuucccauuccucccaccuuucccuccccuucccucccauccauccccagcccucccucccacucuuccuccccaacucccuucccagccaucaguggagaggggaguuccacuucugccaggcugccugaaggagcugccagcccccagggcagguccacaaaacaaaacaacuauuggcaagcacagaaagggagaaaaaccacaaaaaucaggggugccuuugucuacaaauaacugcagugcgcagcggcggggagaggccgcgcucagcagcgaagccggacacucucuugugcuccuuucagcucagcuucccugucugcaaguacacgggucggguggagagagcacugggugugugugugcgugcacgugcaagcacacgcaagagcaugggggauggggaaugcacacgcacagcugaaggggugcccaucacaggugugcccccagugcuggccacuggcauggucacuuuacuugggcagaaggaagaaaagcgucccuucuccucaggggcuucucucugcuaacaaagcccugugcgcacacccagacgaggagaugugugcgugcgcacagcgagcacgcgcgcgcgcacacacacacacacacaaucucuauaggagagugagggccggggccccaggggguucccugggccugggccguguacccgcccgggcagcucacacgguggugacugagagaagaggguuguagacccgcuugccaucggcggagcgcgcgccgugggccagcaucuccuggauggugauccaguuguccaggaucuucuuguuccgcuucuucaugguuuugcgguggcucagggcaaugauguugagcucgggcuugcugucgccauucugcugcucccgcaggcacuccagccggcucugcaucaugaacucgcgccgcuuccgcugcucacgggcccggaucaggugcugcuuccgcuccuccuugcuccaguagcggcccaucuucaucucgcucaccgcgucgucgucggucgucauaccgcugcgcuccucccggaucuucagggcacgggcuuucagcagccgaucucgcacgggccgcuuggccacguagcggguuccgucgcugcgcaccuucacuuuccacuccaugcgcggugcuucaguggccgcggccgccaccccgcccacccgagggccaccggccaagcucagggggccguggcccagcuccuccaggccucgcgucggggccagcugcacgcagcugugguagugcucgcccuccuggcccuggccgcgguggcgccgcgagagguaagggcugcuuucagggcccacacgcuccagggucaaccccgucuugggguugcggcggccgcgcuccuccgcgugcugccuccggccggccucaggaucccgggagagggaccggaacuuggcggggcuccccgguggaggagcugccuuggcggggguggcaacagcggggccgggagggguccgguucaaguuggaguugccggccauggcccgccgcagggggcucucgggcaggggcuccacaagcagcggggugcugcggcagcucuccccaguguuguaggcgcuggugcuguccuuguccgacuucucgggcagcucggagaugucggacagcucgugcuucuugggcucgcuggccgccaggucguagaggcucuccuccuccagcagccaggccuucaugcagcgcucacgcagcugcugcaucuucugcgcccgcaguauguugcggcacuugaauuccaggugccuuagcuccuccuccagcauggccaucucguggcccaggcucucguugcgguugacguccagggcgcuguugccuccggaggcccggggaaagaggaggcccagcugguugccguucuccagguggcacuugaucuccaggagcucacgguagcgcucauacuccucauccgugaggcccgggacgucgcccccucccagccccgcccccucggccagcagagaguccaugcugaaauggaagucccggcucugcagggcguccccuugcaggccaaacuugcgcaggcuucccgggguguugguggagcucggggguucgucccccagcaggucgugcucagagcucucuucguuccgggugcucucgucaguccggcccaccccgcuguccagcuccuggcuguugcucaggccugggccggcaucgggagcccccuucuccucuucguuuccgggcuagagcagaaagguaaguaccgcucaguuaggucccacggacagggaugucacgggaugucacaggaggaucggaaggggcuucaggccugguucauuucccugccaagcauugggagacccugcacagccucagcgccuuccacccaguucucuccuccucgcccuccccaccagcgcccuuuuccuuccucaccugcugggcagggggugauuucaguuuacgagcacgcagcucccccucauucucagagccaaagucauccaggaagucaucccggucgcuguccuuccaccuuuucgccagcuguggagacaggcccugguguccccacagcuucaaggaccuccccauauacccuucuugucugcucuggaccccgcacuuggcuuguuucggugaagcucagcaaccugggggcagcgucccagcccccucagccuucagaggccaggaggggaaacgggcccugagagaccccugcccacccgcccuccaucaacuccaggucguuggcacaucugugcccuagucacggccagcagcuuccaagacagaaagccugaugucguggccccgggucgcccugccaggcauacacaccugacucucaggucgggccaccagcagggagauguugguguucucuuccuggcucaggauggccaccgccucuucccgguucuggacgucuacaccguuaaucugaggcaggcaggauacaaucaacaagcaugcuagggcuggcccuggggcggacccugggcgggugcagggagcccaagcacucugggcucggcugggcuaggcuggggcuugagcucugggaggauguaacuaaguggaagguaccagggagagggcggccugacucuugcaagagcaaaugugugcucaggagagcauggaguggggcagagggagaggggccaggagguuucagagcagcaggggcccuggaugccagcagaucccauaggcacacgggagccacuggggugagugggcaggagagagaugagacucagcccggguuuaggacacggcaggcugcugggccucaggguuagcucuuagugggagagagcuagggacuggcuaaagagagguggcugggccgacgggcacagcggggccuugggccaggccugcagccugcaagugcucaccuggaugaugcggucucccucacggauccggccgucuuuggcugcaaugcuguugggauuuaccugcaggacacacgcaucuuggggacuuggugccuaacaugcccuuu

SEQ ID NO: 19032 - RNA, 24263 nt, Homo sapiens
cacaagauggcggcucccagggaggaggcaugagcgcccugccguuaccgcuucuucugccguacaguugccgcuucggggccuaacucuagcucuuugaagcggcuccugugggaaggagucauaaggcgggaagugaggaucggacaccgccuugaguuuggugugcaguggaagaacugaccuaggaggaagagaauaggggggaacggggagcuagucucaagauggcggcucccacggcggcaggcgcagccugagcagcagaggcggacuaaggggagaggcgcgagacuucacaagccguacggcgcgagcccccaaacggcccucgagagcucgagcugguuccaccggccuccggcccgccuccauucguuaggugugucgaggcuguuucgggagcggcggcugcacuaaggcgcugggcggggaagcgggacggucucaagauggcggcucccacaauuguggucugagcgccggcggggcugcgacgaccgcggcgcuuguggcuccuuuccacccgccccggaagccggccagugcuggggacuugggggugugggaaccgggccggggcuccgccauuuccggcgggggagggcuacgacugaggaagggaggagagagaggcggcucaagauggcggcucccagggccucccgcccgagcuuguaagcgggagcgcccggacaaguagucggggcgacgggacucagcggccuccagcuucuugagccuaggcgcucgacaguuucgggcggcucuugcggagacggggugagcgagaagaaagggaagagccaaagggaaggagggcaguuaagauggcggccuccauggagucgucuaccgcugugugagaaaccgcuucuccgugagagcugccuuagacgaaagggggugugugaaaggaauugaggggcucccuucccgcuuguugacuucuccccaccgcacccuuucccggaacuauggcuucggccgugucgcccgccaacuugccagcggugcuucugcagccccgcuggaagcgaguggugggcuggucggguccggugccacggccccgccacggccaccgcgccguggccaucaaggagcucaucgugguguuuggcggcggcaacgagggaauaguggacgaacugcacguguacaacacgggugagugcaaagcccgcugggucuucggcucuuucccucccuccaucuccucccucucccuccucuuuccucccucccuccaucugcucccucccucuccucccucccuccaucuccucccucacccucuacccuucccucucucucuccccuccucccuuacccguccuucuccccucuccccgucccccucccccuucuccccuccucccccucccuccccacugaucggcuugccccuccccuuugcugugccgggcuucagugcuuuucucugaucuucuccccguucccuugucucucccguguuugaggauugguuuucguuaguuaaaagaaagccccuaguccgacuggugagggagaggggcugucgccagcgguggugacuucagacccacaccguuacccagcgggcuggggcuggggcuggggcgggcggauguguccccuuggcgcaggcagagcuccccucccucccucccucccuucuccugcgccugcucagcucucccucaucucgagugcccauucuggagaaaugaccauuucuagauuacagauucguucucugucucucgaaaaagggagggaagggaagcgcucuuaggacgcagaguuuaacauccgccgacccggguaaugccggagccuuggggaccccuaggacgggccggcggcagggccgccucucccuuuccacguuuacuucugcagcauuucuuuccaagucgccccuucuccuaaucuggugccuucugguuuacaagcugaauuccaguuaccccucagcggccugcguagucgugugucuccccgcuucugcggauccaggggguuaccccacccgcucuucugccucccugcaaaacccaaagcccguuaguugggaaggggaggaaccucucucuucagguauggcugaugcaccacggccuucgugggggccguuuguuguugccucugccuaguagccuugcuuagucucuagggcagaaagccugcugcuguccacgacagcuuuguggcauccuuuuucuugguggcuacuuggcccguuuugugccccuagcacaagggucaguucccaaguugccuacugacugcccguuggcccacaggacccuggccuugcccagaaggcagggucagggugaguucggucccaggcaagagcuggaagagucugggugagggaaaagcccccugcaggcggcugggggagggccuugggaugcccuaguccugaguggcaggcacggcucccagcacuaaccccuugcuccgcggccguucucuccugggggcucuagcgauccccuggccucggugguggcccugcagacaaacccucgcugagugggcuuuguguccugagcggugagaggcugcuguucuuuggcugagcuccagugccucgaugcucugggggugggaagcuggagcugccuggagggagaaaguugguuuagggaguugggaaggcuggagcugggcucuugggugccgcuuccuuccccaccccccaaggcagaaagugcugguuucuccacaucucggagauuaucgccaccuaccacguugacuuugaaaggcugguggguugucugugaccguuuuucguuccaggucucucagcaccuguugccuccagggagcagggccuuucucagcagcccccgggcgggggcgcuuggugguugguggugccccgcgccagcccaggcagcugcaguagcaggaauuagcucaguaagcuaaggcuucuccagugguggggcuguuuauagaggcaccgucaccaugagcagcaccuucuccacucuguggaccgacuuucuucucauaaggccuggagcaggcucccuggcagggaaaugcaauuuuagaaaguagggcaggggccuaauuacagucggcuccagaguccaccaccacugcugccuuggcuuccuggggccucugcauauucauuaguuuauuaaaaugaauugaccacuuuggcaugaauucauuaccagucugcaaagacagguugugcauuagagggguagccugccuuccaaagggcugcuuaaaaugaagcucugggauccuccaggguagcaguuuggaaacugucaucggcaauuccucagacgagagagcagcuggcagaccugaagcccucuuccucaccgggguuucugcccccucccgccagcccggccucgucaccuuugucuugucuucuuuuguuguguuugggaugagaucagggcauauucucacgccugugccccuugcaguucugcgggaucaguccucaaaaagccuuguaccuuuggagagagcugaucuggaagggguucccguugcuaggauaagaaagcuucagggggugugugcuuugagagcucuuaggguagcuacugugcuuguccuuagggaauuuuaguuccauguggcaagccaaaggauucagagugcugccagguguggggggugggggagcgagagcuuuggcuacgguggcucuguaauguccauagguucuuggagcuggagggagccuuggaaaauaccuaguggaacuacuuccuuguuucugcagaugaggaaauugggguccaagaggggaagugacagguccagggucgcccucccagcugguggcggaguugggcgggagugcaaaccuucauagaggccguucugccaccugucuuuggggcccaucaccuuugaaaugccuccauucucuccucugucccuguaucuaauuguucauugcguugggcaggcaucaaauguguccccuuccacaccaagcccuccucuccucuuacuagacucuugcagucacuuccugauuggcccugcuaguuucauuugucgggaaauccuguucacccuucaaggcccggcugaaacgucaccucuucugagaagcccuuuccacuccuguccuccccucuccagcagucgcacugcucugugcucccaagggcccggcuuggucagagcucuucuaggguguuugucucaucgugggaggggggcaugcagccuuccuaccccauugggaguaugagcacaagaucgguguccucugugccucccagcacgucguaugccacacaggaaaugcucuaaugugacagguagaacagagaggaaggcagcucguugaacuugaccggccaccucacugcaugggcaccagucucuagguggugaugggacaguggcaaccagggauggagcuugcagagcaugaagugguugggggagcugaugaaacacagagaggccggggcacagccuugcucaggagaggggagcuggaguggucuucaucuagugcaggguccuuuccccaccuuccccucccagcugagagccagcauuuccaggaugaggggcccaaggauuggguuacaugacaccccccagaugauucaggggugacugagagcagcugucacauugaaaagcugggagaagggaggagagcuugcucgugugcuuucagggggcggaaccaggacucgugggugagaugaggagccgcagguuugucgucacaccaggagcugugcucccugacagaccucucuugacggggguggggagggccccugcccugccuggaguguucuagaaugagaucagcaccucuuggguccuguagaaggaucuggugagcgggauccccaaagauaucacagggcgcuucuggccuggcccaccggcucacugaucagcgugugauaggaaagcugcccacugaccccacgugccauuuagcuuugucccaaacucugacccgcagccccauagcugugggcuuugaccacgagggugcucaggggagugaggguggcugccuggacaugggacccuagggaaggcacagaucgguugcuucaagucagugauggggcuguugucucugucucuguuuuacgcugugaccucaggugucgcuugcccuccugggcucugccccuuuaccuaccgagagcaguuggcccaggcagccuuaggucucguuaugcguuuacccugguagcuugcauggagcucccuccagggauuggucaggacggcucuccagugcgcaaggcuguuggccuuggcagcucuugcuuuucuggggugguuuuugcacugggaaugagaaagaggcagagggccaggauccgagcuugcacaugcgggcggcacagguguugucccucugcuuuagggaaauggcaggggagcucuagugcucggcauguccgaggcccagugacucagcugaauggcugcagaggcugucagccugcucgaagccuacccgcagagugggugcuggagagcggggugggggugcucucgccucaggaggagcgguggugguacaguugugcugugugggguuuucuguuuuuuuuguuuguuuguuuguuuugagguuaggucuugcucuguugcccaggccgggaugcaguggugcggucucagcucacugcagccucaaacucugagggucaggcaguccucccgccucagccuccugaguagcuaggaccacaaguguaugccaccacacugagccaguguuuuaaaauuauuuguagagacggggucucccugugcuacccaggcugggaguugugcuuuggauaagggcuagccuugcacacgguuccgcauugagcccugggggugacagugugagacugggugggaccagagugcaguggggcaugcauucccaaccauggucagccgccuggcccugggugcacaccugaauauggaaaaaaaacacuguuuuuccucuucuauggucucacaacacuuuuggccaccaaacugaauagucuguauuauaucacaauaucacagcaucccuguguggaagccuucccaccccacaggaauccccccaugcccugucacguccugggggacccaucuugcgucuugagucauguggaggggccucaguuccuucugccgucugcuugcugagaucucacccaggccagcucagaggcacagagucgggguugcaccuggcccccaguuugggguuucuggaaagaguguggugaauccucugagggaccccucauaggaggagguuuucggggaagcccuggccugccaggugugaggggagucaaguuugaggacaugagggaggggccuggucccagcugaaggcugcugugccauccuguggaagcaaagcagugccuaaggucugauuucccucuuucuugguggucgccucacccucaugagcuuuugagaagcuucugucacagcucugcugagacugcugccucuggcuugcaagaauguucuggaguaccauagguguggcagcaggggcagggagggaugcugguggaccaucaccuaggagaccagaggaaguccgggaggucagagcagaggccgggucucauccccauggcucuucguagccugcagcggucacuguuuuggccacuugaaagugcugcucugggcucuggcuguccugacccugugaugaagggacaaaaaugugggcuccagggaggaggagcacaggcccaccaagaggguauuuuggggagaaauucaugucugaucacugagugcuagggaaggaaggcaguggcuagauucccaguagcugaugagggaucuugcacaguaacuucccgcucauuaagaugaccuuggcgagaagcaggguggucacaggcucuuuugcacuggccugaagucgagggguuuggaagauggcccagguagcgcagcuggaguugcuagagcgcccgcagggauggugcuggcucagccccucucaccaagcuugacggcuggcacauuuggggaaugagaggaaugggggcucccggguguucugacuucugccuccuucuguuccccagcaaccaaccagugguucaucccagccgugaggggggacauucccccugggugugcagccuauggcuucgugugugacgggacucgccuccugguguuuggugggaugguggaguaugggaaauacagcaaugaccucuacgaacuccagguaaagcagccccagguucucacucugccuccuuggccccaugugaccugacgguaguggcuucaggguugaggcaagcgggagguggaagggacgcuugagagucugccaaggcugcucugaacuuggcccaccucagaagaaggcagcaaggaccaacacccaggaccuucuugcuccagcaaggcaccucgcucacccccggccauuuccuccuccaccacaaguugccccgggucccuagugguggccuucucaucccacgguucagucuccaggucuugauuuugcaggcgagccggugggaguggaagagacucaaagcaaagacgcccaaaaacgggcccccuccguguccucgacucgggcacagcuucucccuugugggcaacaaaugcuaccuguuugggggucuggccaaugauagcgaggacccaaagaacaacauuccaaggugaggcuugguccuuuucucuggaaccccccgggugggugugcucucacaugcacagggcuccaugguguccuaaagaaugugcgcagcagagccccguggccgggucccuuucucgugcuggguuguaaaugagagagcggcaccggaugcccucucaggagcuuucgggcuccaaaaucgcuacugacccugagcaggccucgugggaggagggccaagcuggagguggaagccacuuugccuugggcuggcccagcucucggagucggcuuagagcugcucgcguuccuucucagccuccgcugccuacaaguuuccugauggguauuuuccaaggcccguggccaaggacucucugucuggagguagucccaagccagcgcccccucuugcucugcggagcccucauauaauacccagcuuugugugcauggcgggggccugcugcugggucuggacucggggcugcugugcagccucacccacccuguguccccuguuccaguuggacucauccuagggagcuucuggcagccccuuccucaagagcuaggguagaagaacuucagagcucccacagcccuagccccuuuguguucuggggaggcugccacucacugauagccauccagcgaagccucuggcgugaggagucgagacuugccguaacugaucuuuccucgucagguaccugaaugacuuauauauccuggaauuacggccaggcucuggagugguagccugggacauucccaucacuuacgggguccuaccaccaccccgggagucacauacugccguggucuacaccgaaaaagacaauaagaaguccaagcuggugaucuacggcgggaugaguggcugcaggcugggggaccuguggacccuagauauuggugagcagggugguagcaccccagcagccaugggacaaagcgggucugccucuuggcuggccccguggguggcgcuguuguauggugagguggggcucuuagggagcuggagcauaccacuucgugcuuuccucuugucauggugggccaggguggggaacccuggaucgucccuagguuuggggcuguuaucucugcccugugcuggcugagugggcugaauuggucugcgggcuuauaagagaauaagucauuaaggcuuucuagaauggaauucucuggauccggguagcauuagucccucuugacucgucaguggucagacuguguggagugcugcauccuggucugacugcugugguaccauuggaugccgguaaaccgugaggccuucggggacugcuugggccggucaccagguggugguaucaggaguggcugggaaagauuacuaacuguggaucuccggaggccucuucagcugggagagaggagauggcgauguuguccuauagaucagagucggcacuccaaagaagcaguuucccgugagagaauuuuccaacaguuugccaaaaugucuguagccuaaggugguuauggcggugaacguauuucauggagaguucggggugugcccaccacuccucccccagcacagagugcaguccuggcucagggcaggugcucaggauguaccugaaggagcgcuauugcuagccuggucgaaaccgccuggguaacacaggaaucuagcuaccaugacaacagucagagggccugccguaggcuauagggaagccagggauggaauucucucacugagacagauccuaccuuccugagcuagcuugaauccagggaacgaccugugugcagucuaccuuguguaacccuuuccccuccgucucucugcagacacccugacguggaauaagcccagucucagcgggguggcgccucuuccucgcagucuccacucggcaaccaccaucggaaauaaguaaguggcugcucaccugcgucucucuucucuagacuggcguggccccucccccgaagggcucucacucaguuuuguccugucagacccuaaggccugaggaugccucuuucuggcugggcuggcauuuggcagcccuguuuuuccauuacgacccugggggaccaaggaaagacagauucaggggggagagggccacacacaagcugagucugagacccuccccgggccugugaggcuccgcccuaucagguacagaguguucuagguccucugugcaagcaccugggugucuuuguggauguccagguccuaaagggaaccuagaaacuguggacaugaaggugagcuuuagaugagcugaacggcacuuuuaugugguagaggugacacaguucuccugagggcugagccaccaggcaggagagggccacgucaggaggcuucacgcauccuuggggacucuccuggggagagccagaggacugagcucuagaacugggguagcagagguggccucuagcuuggcaccaacucuacaauccuuucccacucuucccuccucacucccagaauguacguguuugguggcugggugccucucgucauggaugacgucaaaguggccacacacgagaaggaguggaaguguaccaacacgcuggcuugucucaaccuggguauggccuccucgggcuccgaguggccugugggaggcugcaggaggcuggcccuucucagccuaagagcuguguggggugugcggggagcaagcugggcccccggcucccuuuggaauccacuggaaggauccagugggcagagcucucugaagcaauguuccgccucugaguuuuuugaaugagcucuccauccaaauggcccaacauccaaaagugcaaaagccucuacggugcagggccuccuucccuccucccgguucuccgguucugcuucucagaggcagccaugugggugguuuccuguccacccugcaggggcucuucauaucugagcauuagccauaggucccuuuaaaaacaaacaguggcagccuggcgcacgcagugccacaccuggccuuucucauccgccguaucuuggagaucacuccacgucccugccccgcagcagccuccuucgaguugcgguugugcugcuguaacuuguacaggcgccgcuccgugaguauccuugcaccaucuccacccgugugcaaguguauccuaggggugaaaaccuagaaguaggguugcuguccgaugcggcugaacugcccugcacagaggcugugcccacguaggcgccuccaguggugcccucacggaauggucaggccacucuuugccaagccugauggguggccgaagcucccccuccggcucaccuugagccccagcugcugcgggccugaaaauaaaaaugccaggcgccgaugguugaaguuuagauuucuuuugcgugagaguguguguuuuuucuuaagaucuuucuaucacguuuucccuaaaccacuuucccauugccgucucuuucugugaguuguaguguucuuuaacgggcaaggagguaaaccucugacuguguuucucaugguuuucuuaguuggccguuggugguuuguaauuuuauuuuuuguguugcuuuuugccacaaaggguuucuuuguuuuguuguuuuuaauguaauaauccaauaacuucuugauuuuaauucccauccuugacaacaaaagaaccaagggcaaccagggguggcggguuuccuccauccuccuugcugaccucccuugucugcccucccccagauaccauggccugggagaccauccugauggauacacuggaggacaacaucccccgugcucgggcuggccacugcgcagucgccaucaacacccgccuguacauuuggagugggcgugacggcuaccgcaaggccuggaacaaccaggucugcugcaaggaccucugguaccuagagacagguaggcccggcccagccgacuccccuccucccauagccucccgccccuucucaccaacugcguucucccacagaaaagccaccacccccagcccgaguacaacugguacgcgccaacaccaacucccuggaggugagcuggggggcaguggcaacagccgacagcuaccuucuccagcuccagaaauaugacauuccugccacggcugcuacugccaccuccccuacacccaauccggucccaucugugccugccaacccucccaagagcccugccccagcagcagccgcaccugcugugcagccgcugacccaaguaggcaucacgcuccugccccaggcugcccccgcacccccgaccaccaccaccauccaggucuugccaacggugccuggcagcuccauuucugugcccaccgcagccaggacucaaggugagccaggggaccagggacguuugaaaguagggggcuagccuccggggagaggcagcggccaaguaggggcugcgagacggcagccuagacagcaggccagcagccgggagcuuugggcuugucuccaaggguuguagggggaugcuaaagccuggccccaccuguggaaauggucacucucagggcacagagaagagccagacucccacacaagcaggccaacagaaguggcucagggcugccugcaaaggggcuggggacaucgugcagaaggugauggcugacggcuggccccuucucucaucaggugucccugcuguucucaaagugaccgguccucaggcuacaacaggaacuccauuggucaccaugcgaccugccagccaggcugggaaagccccugucaccgugaccucccuucccgccggagugcggaugguugugccaacacagagugcccagggaacggugaggaguggucacuggggcgggugggauuuccuguugauccaguggauuaaguugcaaguguacugagggguucacaucccucucgggcucugguaccacgcaccccacaccuuucccuccugggacgugcagauggggaaacgcuccugcgaggucauggugggaauuaauagguuaaugccuagaaggccuaaccugcugccugauccuaagagcauuugccacguggacuuucuuguccugcagccugagaggaggaucuagccagcugggcuugccacaggcccaugagaaucaacgggaccugacucuggucuuuagaaaggauccagagcucccagcugccucuugccacggggguugccgugcaugguggguggugggagcccucugugucuggggccaggagagcggggucuggcaguagagaaagcugagccaugcuggcgggaugaggcucccaagagcagggcagccccugggcagguuccggugagguccaccaagcagggagguggguggcaccugugaccuggccucacaugcccgugccugcugcaggugauuggcaguagcccacagaugagugggauggccgcacuggccgcugcggccgcugccacccagaagauccccccuuccucggcacccacggugcugagugucccagcggguaccaccaucgugaagaccauggcugugacaccuggcacuaccacccucccagccacugugaagguggccuccucgccagucauggugagcgucuuccggggcuugucacuguggucaaacaagcauagucauucccuccgggcuuuagaguuagccguuggaccgugggcugcagaauaagcugucuccauuaggggcgucauggccucaggugagagcugcaggcucagccuccucccuugccuguuaaaggaagggggaaccaagcuguucuugggcuugggagcaggaggaggaggaaggugaguguugaggcaggagcuaugggcccaccguggacaucuugggugguuuccccaucgcuuucuuugccuggccugucacucgucucugccuccuccaggugagcaacccugccacucgcaugcugaagacugcagccgcccagguggggacaucgguuuccuccgccaccaacacgucuacccgcccuaucaucacagugcacaagucaggcacugugacaguggcccagcaagcccagguggugaccacaguugugggcggggucaccaagaccaucacccuggugaagagccccaucucugucccaggaggcagugcucuggugagugaugggugcugccaggcuacggccacugccaguggugaauggccgcccugggccagcuccaggagagucucagccaggccaugcccuuguuugguuuccagaucacuccuugcuccaucccuuccuuuuuagauuuccaaucugggcaaagugaugucggugguccagaccaaaccaguucagacuucagcagucacaggccaggcguccacggguccugugacucagaucauccaggugagcucucagucuuugcacauacgcaagagugggggccugggugccaggccacaggaagaacucaugucccugcccauggaagaucccaugagcacacauggcucagcaaguucugcugcucacuccccucgcccacagccuccagaacauucccugagccgccaaggcugccggcggagaguagccagaccacacuucccuuccuggcagugaugccggcucaugcaccugcuucccccuuucagaccaaagggccccugccagcgggaacaauccugaagcuggugaccucagcagauggcaagcccaccaccaucaucacuaccacgcaggccaguggggcggggaccaagcccaccauccugggcaucagcagcgucucccccaguaccaccaagcccggcacgaccaccaucaucaaaaccauccccaugucggccaucaucacccaggcgggcgccacggguaggggccucccccgacauaugagugucugcaaguccucacuggaggggaaauggaguccggguuauaaggcgugcuguguuucuguuuaguuuacccuuuucuaucuucuccuugcugccuuuugugucuaaggguagugaggagaugggcagggcuauggcugugacuuguggauguucauuauagucuaggggcagcaggggcagcccucacagagccugucuccccugggccccacucucccauccaggugugaccagcaguccuggcaucaagucccccaucaccaucaucaccaccaaggugaugacuucaggaacuggagcaccugcgaaaaucaucacugcuguccccaaaauugccacuggccacgggcagcagggagugacccaggugaggcacucccagccgucucucagcccaguguccuagugcaguccaccccagcacgccacgcagguccucccgacaggccugggaggggcagcaucgguggcaucuaccagccugguggugacguugguggcacuuuccucugguguuccagguggugcuuaagggggccccgggacagccaggcaccauccuccgcacugugcccaugggggguguucgccuggucacacccgucaccgucuccgccgucaagccagccgucaccacguugguugugaaaggcaccacagguguguacccauaggccagguccccugccaccccuagauuauaacgaagcagggcuggccuucaauccccauggcacagcuggguggcacagcagcuccucucucccgagccuucuaugcaagcagcuccagagugccccagccugugcaggaggagcugcugggaaggagacagcagcagccuuggcccaacucuugccuccuuuccuucaggugucacgacccuaggcacagugacaggcaccgucuccaccagccuugccggggcggggggccacagcacuagugcuucccuggccacgcccaucaccaccuugggcaccauugccacccucucaagccaggugaucaaccccacugccaucacugugucggccgcacagaccacgcugacagcggcaggcgggcucacaaccccaaccaucaccaugcagguagggcagggccugaggccacgugugggcgagggaccccacacaaguggaagcacgugaggcucacgccguccguccacaggccuuuccuuccugguguugcgcugcugccgggugcagccauggcaggccuuuccucaccuggggcauuuucccuggugucacauggucccugugucauaguccgugguuuggcugucaugguuuggccaugccugguguuugaacaccggguucuuccucucgcaguguucuacaggacgccgcagcucgucugcaugugugugcaguguucuguucauacauauuaaggaaaacggugaaacguuuguuguuggccuuugagcauugagggggauuuccauucucugacaaaggacuugacuucagccagccuccugccuuccccuugcccuguccucacagccucuuccucaucccaguugccuuugaggcaaaguggugccucuucccuggccucugagcaagucagugucuugggggcaggggugagugggucuuacgucugccagggccguugagaaguggucaguggucccagccuguguggugacagugcaggacagugggagggacaggcagacagccagcugcagcacuaacucuccuccucgugugucuccccagcccgugucccagcccacccagguaacucugaucacggcaccuagugggguggaggcccagccugugcaugaccucccuguguccauucuggccuccccgacuacagaacagcccaccgccacaguuaccaucgccgacucaggccagggugaugugcagccuggcacugucaccuuggugugcuccaacccacccugugagacccacgagacuggcaccaccaacacggccaccacuacuguuguggcuaaccuugggggacacccccagcccacccaagugcaguucgucugugacagacaggaggcagcugcuucucuugugaccucgacugugggccagcagaaugguagcgugguccgagucuguucgaacccgcccugcgagacccacgagacgggcaccaccaacaccgccaccaccgccaccuccaacauggccgggcagcauggcugcucaaacccacccugcgagacccacgagacgggcaccaccaacacugccacuacagccaugucgagcgucggcgccaaccaccagcgagaugcccgucgggccugugcagcuggcaccccugccgugauccggaucaguguggccacuggggcgcuggaggcagcccagggcucuaagucccagugccaaacccgccagaccagcgcgaccagcaccaccaugacugugauggccaccggggccccgugcucggccggcccacuccuugggccgagcauggcacgggagcccgggggccgcagcccugcuuuugugcaguuggccccucugagcagcaaagucaggcugagcagcccaagcauuaaggaccuuccugcggggcgccacagccaugcggucagcaccgcugccaugacccguuccagcgugggugcuggggagccccgcauggcaccugugugcgagagccuccaggguggcucgcccagcaccacagugacugugacagcccuggaggcacugcugugccccucggccaccgugacccaagucugcuccaacccaccaugugagacccacgagacaggcaccaccaacaccgccacuaccucgaaugcaggcagcgcccagagggugugcuccaacccgccaugcgagacccacgagacgggcaccacccacacggccaccaccgcuacuucaaacgggggcacgggccagcccgagggugggcagcagcccccugcuggucgccccugugagacacaccagaccacuuccacuggcaccaccaugucggucagcgugggugcccugcuucccgacgccacuucuucccacaggaccguggagucuggccuagagguggcggcggcacccagcgucaccccccaggcuggcaccgcgcugcuggcuccuuucccaacacagagggugugcuccaacccccccugugagacccacgagacgggcaccacucacacggccaccacugucacuuccaacaugaguucaaaccaagguaagugaagguggccagccuggcuuucauggucucccagccccccaggcugaaaggccaagacaacgauggcggggguccguccagaguccaccagucaggcuccuuggcacccaauuuaccaguggggagagcuggggcguccuggcuguaccugaagcagacagaggucuccaggagccuguccugccuuaucuggcccuccccuuggugguagaggaagccugugguggucaagccaaguacaggccgggggggcuccugcugagcagccgccugccugucgcccccacagaccccccaccugcugccagcgaucagggagagguggagagcacccagggcgacagcgugaacaucaccagcuccagugccaucacgacaaccguguccuccacacugacgcgggcugugaccaccgugacgcaguccacaccggucccgggccccucugugccgguaagagcccagggggccguguucuuccccgccuucccggccuacgcccgugcaguuccacacucagacgccagaugucgcucuuguaccaggcauggggccgcuccuggucccuuuuccggaccauaaaagggcagccucggugccugcugcggcaggaggcaggagccucaccgucccccgcaucucuggggcgcuuuuauuucugggacugguucucaucgcgugucacuucaccgcagccuguauaagacauggcgggggucugagugcccauuuguccaggccagggugacugaggacggguuaaaccugaccgggggucucaagggccuuucuccucaugcuggucagagaaccacuguccccucccuauuuaacaugggcuggagcuggcccaucaagaaugaaaacuuaggcccacaaggaaaggugagggcuggcuugcuucucagcccugcugccuggcucuggccccucuccuccccucugacaggggcuucucucccuuucuagaagaucucaucaaugacugagacugccccaagggcucugacuacugaaguccccaucccggccaaaauaacagugaccauagccaacacagaaacuucugacaugcccuucucugcuguugacauccugcagcccccagaggaacuccaggugucgccagguccucgccagcagcugccgccacggcagcuucugcagucggcuuccacagcccugaugggggaguccgccgagguccugucagccucccagaccccugagcucccggccgccguggaucugagcagcacaggggagccaucuucgggccaggagucugccggcucugcggugguggccacuguggugguccagccacccccacccacacaguccgaaguagaccaguuaucacuuccccaagagcuaauggccgaggcccaagcuggcaccaccacccucaugguaacggggcucacccccgaggagcuggcagugacggcugcugcagaagcagcugcccaggccgcagccacggaggaagcccaggcccuggccauccaggcggugcuccaggccgcgcagcaggccgucaugggugagugccggugcaacccuggggaagccgggccgcucgggggagcaauaggccgcggagacagccugggaagaggagcccauuucccucgaggguggcaugagccagaugugauggggaggacgagcacaggggaccccaggcaggccaaguaguagagacugccguguagaacaggcuggcugggguuagcgccugggaaacaggcagggccccucggccagggcuuagccuacaguggagcacgguaggagguggacggggucucuaggacaggcuuugggggccuccgcccgggcugcccgcuucuggccagccuuccuaguaaguaguguuucucucgacccuggagcaggcaccggcgagcccauggacaccuccgaggcagcagcaaccgugacucaggcggagcuggggcaccugucggccgagggucaggagggccaggccaccaccauacccauugugcugacacagcaggagcuggcugcccuggugcagcagcagcagcugcaggaggcccaggcccagcagcagcaucaccaccuccccacugaggcccuggccccugccgacagucucaacgacccagccauugagagcaauugccucaaugagcuggccggcacgguccccagcacuguggcgcugcugcccucaacggccacugagaguaagcgacugagggcgaauuggugcugggguggugggggcacccagggaggugagggcaggacgggaggcucggucucacuugggagccagguuucccgagucuuucccgcugacaccuucuuucuuccuaggccuggcuccauccaacacauuuguggccccccagccgguugugguggccagcccagccaagcugcaggcugcagcuacccugaccgaaguggccaauggcaucgagucccuggguguggugagucggguguguuggggcuccugaguccguggccuggggggcagcacugccucuaggugcugagggccugaucucgucgcaccgauucugucuugcagaagccagaccugccgcccccacccagcaaagcccccaugaagaaggaaaaccagugguuugaugugggagucauuaagggcaccaauguaauggugacacacuauuuccugccaccagaugaugcugucccaucagacguaaguguccccaggugcugauguccucaggugggugggucuuggcuccaccacccugagcggggcuuacaggaaacuccuccaucuuugggccaagcugaguagccaggaagccugaggaaggugggcagagaccauccccccugaagcaguagaaaaggagagcuuugguuccuucccgccaguaccgggccacagucagccucgccacgucccuccuugccgugaggggccagccaccgcugaccucuuuucccucuggcccauaguuaccauggaccugcaguguuccugggguggcccagagcugccuucuccacaguggcguucaugccacuccucuuuuccuaggaugauuugggcaccgucccugacuauaaccagcugaagaagcaggagcugcagccaggcacagccuauaaguuucguguugccggaaucaaugccuguggccgggggcccuucagcgaaaucucagccuuuaagacgugccugccugguuucccaggggccccuugugccauuaaaaucagcaaagugagucuugcugugggguggccgucugucccugguugguuucugccugccucagcacaugagguggccgggggggggcauaggagagcuagguuuugagucccaguuugucuuaguccuuccacuugggggaagaucucuuugaagcuccuugaacuaccacauggaauaucucuacuguguuagaaaauggcuuaugggaaccaugauuagucaguucuggaagccucuagccuguucuguugaccuucugacccccuggcuucuagaguccggauggugcucaccucaccugggagccacccucugugaccuccggcaagauuaucgaguacuccguguaccuggccauccagagcucacaggcugggggcgagcucaagagcuccaccccggcccagcuggccuucaugcggguguacugcgggcccagccccuccugccuggugcaguccuccagccuuuccaacgcccacaucgacuacaccaccaagcccgccaucaucuuccgcaucgccgcccgcaaugagaagggcuauggcccggccacacaagugagguggcugcagggugaguguccuucguggagcucuucaggcacagggaaggcccaggaagccgggugcagcaggaggaacugucaccaucugagauuuuuucccaugugcggcgucucccugcuuccuuuggcgcgcacacagccccccacggggguggccaucaaguagagcaggggacccagcuccgggccugggggugcaggggacgccaccccaggauguuugaggggacaagcagugagagggcuggcgggaaaguguagguuuccaggcccgaaaacagcacgucccaggucccuggagugcagcaggugagggauggaggccagccugccuccugucaggucaugcuccugcuccagcuccccuggggcucugggaccugggagggcagugagaggugggagcugagcugaguggguuucuaaccuacguccagaggggagugaguggugucguguucuggucccaaggaguggcguaaaaggugaccacccauagggcaggcgccccacccuugccagcugcgggucaugccauguggcaccaagagacucugcaggcgggcagggcgcauguguuccuugcucucguucugucacaaugcugcucacgcaucucucccguuccuuccagaaaccaguaaagacagcucuggcaccaagccagccaacaagcggcccauguccucuccagaaauguaagcaggaagccccucucgggaaccuucugagacuagggguggaaauagcuggguucagccucuugucaaaugacugggggccccuaaccggcccugcaccagcagggccuccaguggugcagggcccacacuaacuuucucuuuccuuuuucugccuuccaaggaaaucugcuccaaagaaaucuaaggccgauggucagugagaggaagcugacuagccccuggauucuucuccagaccccccugcuucaggaacacccgccagggcccaccccucccaccccgucccagcauucgcacuucacccucgcgagccgcuguucacuccucuccccuuucucuuucucucuguuuuuaaaauaaucuaaagaaagcacauuuuaccauugcuguugggaggaagcagaggcagaugggaaagcagagagaggagcgcgcuuccuuuccuccccgcugccgcccacccuggggagagacuuuugcggggagggaaggcggagcugaggacagccagcuccgcccucccaaggcugugcguuccugagggccaggucgggggcaggcauggaggggaggaaaggcgucccucuuggcccuccccagaguggcuuuccuggcacccuggccugggugucugguucuguuuucuuuucuuccccuuguguuuccagucaccuaacuucccuuccucaggcucccccggcccacccugcucagugaccccacaggaagcuuacacauuuucucagaggccuuugugcucccaccucuucuacccucccccucuucuuucccauuuuaaaaaagaaaagaaggaaaaagaaaaaaggggcaaggagccccgcggcggccugggcagcgccugugcagaccucccugcaggccgcacugccaacugcugcauuuguuguguuuuuuagguugcaauuggugaaguucacacuuucauuguaauuuuagcgugugggguuuugucccuuuuuuguuguuguuagcuguguacagaauguguaaucuuuuuucuuuucucuuuuuuuuguuuuguuuuguuuuguuuuuguuuuuuuacuuuuuucuucuuggcuaauucuuggcagggaucuuucuggaggaaaagcuggggccagccagggcaggagaggugugaaaucugccacgaggggccugcuguuugccacccagcccaacuuccuguugcuggccccugcccucugcccuuuugccuguccucaggccgcuggaacaaaggaaggacagcucauuccucaugggcgaucacuccgcaucuauagggucgagccuaggggagcuugagggagggcuggggccuccuuguccuggauuuccagcucuccccaugcccccucccugagcaccaccggcaccgccucccaaacagggcugcugguuuccgcagccacugcuccaccucccccaaaucgucauggaaaggguggagaauggaggggaaccaggcguccuuggaggcagcuugggagggugacuguguagugucacccacaagggaggcuagggcaauggagcaggccaccagcagcagcugugcagcauggaacucaggccaggcuccgaggcugggggaucugcuuggaguuuucugccccccaccccaaacuucugucgaggagcaaggcuugccagcaagucagaaggauuugaaccgagcagccaaucuuuccagcccuccccuaccgaccucugccuggagacgcagcagccuguguccuccagggccucugguuuguuguauuauaguauauuucgcuguggaaaaugucacguuuagucaccuuggagcccacucaccugguccuguuguuuuaccccaucccuucucucgcgcgccuauugauuuguuucugaggagaguacaccguucacuauuguagaguaaccccugugacucaauauuaccauagugcgaugucguuuugugcuauuuugaacaauuaaaagacuuuuuuugaaauaacc

SEQ ID NO: 19033 - RNA, 699 nt, Homo sapiens
uuagcgugugggguuuugucccuuuuuuguuguuguuagcuguguacagaauguguaaucuuuuuucuuuucucuuuuuuuuguuuuguuuuguuuuguuuuuguuuuuuuacuuuuuucuucuuggcuaauucuuggcagggaucuuucuggaggaaaagcuggggccagccagggcaggagaggugugaaaucugccacgaggggccugcuguuugccacccagcccaacuuccuguugcuggccccugcccucugcccuuuugccuguccucaggccgcuggaacaaaggaaggacagcucauuccucaugggcgaucacuccgcaucuauagggucgagccuaggggagcuugagggagggcuggggccuccuuguccuggauuuccagcucuccccaugcccccucccugagcaccaccggcaccgccucccaaacagggcugcugguuuccgcagccacugcuccaccucccccaaaucgucauggaaaggguggagaauggaggggaaccaggcguccuuggaggcagcuugggagggugacuguguagugucacccacaagggaggcuagggcaauggagcaggccaccagcagcagcugugcagcauggaacucaggccaggcuccgaggcugggggaucugcuuggaguuuucugccccccaccccaaacuucugucgaggagcaaggc

SEQ ID NO: 19034 - RNA, 1141 nt, Homo sapiens
gggguccuuuaagaggcuugggcccaggggcgaagcggugcgagggcgaguggggggaagcggugacgucacccggcuccgccuccucgcccgaccgccggcgccgcugccgccauguuuaguuguuacuucuucacacaagauggcggcucccagggaggaggcaugagcgcccugccguuaccgcuucuucugccguacaguugccgcuucggggccuaacucuagcucuuugaagcggcuccugugggaaggagucauaaggcgggaagugaggaucggacaccgccuugaguuuggugugcaguggaagaacugaccuaggaggaagagaauaggggggaacggggagcuagucucaagauggcggcucccacggcggcaggcgcagccugagcagcagaggcggacuaaggggagaggcgcgagacuucacaagccguacggcgcgagcccccaaacggcccucgagagcucgagcugguuccaccggccuccggcccgccuccauucguuaggugugucgaggcuguuucgggagcggcggcugcacuaaggcgcugggcggggaagcgggacggucucaagauggcggcucccacaauuguggucugagcgccggcggggcugcgacgaccgcggcgcuuguggcuccuuuccacccgccccggaagccggccagugcuggggacuugggggugugggaaccgggccggggcuccgccauuuccggcgggggagggcuacgacugaggaagggaggagagagaggcggcucaagauggcggcucccagggccucccgcccgagcuuguaagcgggagcgcccggacaaguagucggggcgacgggacucagcggccuccagcuucuugagccuaggcgcucgacaguuucgggcggcucuugcggagacggggugagcgagaagaaagggaagagccaaagggaaggagggcaguuaagauggcggccuccauggagucgucuaccgcugugugagaaaccgcuucuccgugagagcugccuuagacgaaagggggugugugaaaggaauugaggggcucccuucccgcuuguugacuucuccccaccgcacccuuucccggaacuauggcuucggccgugucgcccgccaacu

SEQ ID NO: 19035 - RNA, 10067 nt, Homo sapiens
aaacaaggucacagaauauacgguucauaugcaaaacucaaccgcuuuuuuuuuuuuuuuuuuuuuuuuugaggcaaggucucccucuguugcccgggcuggagugcagugguggaaucauggcucacugcagccucaacguccugggcucaaacuauccuccugggucagccuccugaguagcucaaacuacaggcaugcaccaccaugccuggcuaauuuuuguacuuuuuguagagacgggguuucgccauguugcccaggcuggucucaaacuccuggccucaagugaucugcccgccuuagcuucccaaagcgcuggaaucacaggcgugagccaccgugcccagcaucaauugcauuucuguauaauaucaugaugaacuagaaaaucaaagauaccauuuagaauagcauaaaaaacauggacuacaucaggaaaaaccugacacgggaagugcuggguguggccagcccagaguaguaacaagacccuggacgcucaagaacccugaaguguaaggcaucaggaaagcucaaggcuuucggugcaacaaaguccacaaguagagcccgagauugcaacauacguuuuuauuacucaaggacaaccuggacgucaccaaugcccagcuucacgggggcauguagugugacucacggcugaacacaaaaucacugugaagccugugcuacagcccugggcuacuuuuggacacgcaagaggacacucgguuacaugaaaccugacuugcuucugaagacaugugauacaugucuuuucccugaaaauguuucccuucccugucugccaugcucccaacuuuucugccuuccaggggcuucucacugucuggguaacuaggucuugggccuagcuagaccuuggguaguggccccucugccacaaucagugccugggccugaggcugagcuuguggccuccgaagccugaccuggcucggagcucgucuguggcgcccagggauggccuggcuugcaggccaccacauuaggccagcucgcagguccccaguaaagccugaagacacuggcccgagguuggaggugggugcugcucgacuuucuggaggaucucagaauucucgcuucuugcuaggacugaaccaugagacuuacagccauacuucacuuuucccaggguuuuucuuuuugaaacagggucuugcucugucacccaggcuggagugcagucauacaaucaugacucacugcagccucgaccucccaagcauaaaugauccuccuacuucagccuccccagcagcugggaccacaggcgugcgcuaccacgccaggcuaauaguuuaaaaaauuuuuuggcagagacagggucucaucauguugcccuggcuggucuugaccuacugggcuccagcgauccuccugccuuggccucccaaagugcugggauuacaggcgugagccaccgcacccggccacacuuuuccaaauuguaagcagguaggagggcccuaggccucgucggccccauugugcaggguggccacuguccaaagagaugggcaaagagcugcugccagaggccugggcugcagacgcccugcauggcucucaggggagccagcucccuacuccacaccccugcacagcagccccucuccuccccucacgggucugugcagccagcagccucccaacaugcgccagccuccucacuggaugaugccagccuuccuugcccccagaugcuggcauggaggcaggguuccacucugccugccuaugcccacagagccuagaacagcagggccaccuccuucucucccccgcgggcaugggcccccacccccacugccggcagagugcugaggacucgugcaccaugagaacuucugaccaugagaacuuugacuuccggauuugggggaucugcccaggugaacacaucagcucugaaauucaucacuuucuucgggccccugccuguccuguuccaggcccaagccuacagaaggaagaggaaaguccgcuuagcaaaugggggaggcuccccuacugccagaagcccuggcucaaggccugggccaugcucccuuaucuccuggggcguucgugggaauugaggguuuuuguuuguuuguucauuuguuuuugagacagggucuaacugucucccaggcuggagugcaguggcuugaucacagcucacuguagccuccaccuccugggcucaagugauccucccaucuuggccuccaaaagugcugguauuauaggcaugagccaccucgcccagcugaggguuccuaagcagugguucuucaaauaguaccugggauggaaaauuccugcuggggcuuccuauuuccugaaagcacagaguggggcaggcacccucgggcuaaaggaggugcuacugucaggaggcgagggaaggagugggccagggucuugcuaagggaggcauguggggccggcugggcuucuagaggucgccagagccaguggccugcccggcugccccacgcccucagcgcagucgggacagacacucugcucuuuggggcugacacggaugcgccugagcaccccagaggccagccugggcggcagcaccugggagggagcuggacgacagcagcugcaggcuguccagggccccauccucguacagggccagcuucuggaccaucuucugucgggcaggguugaugauaaucugcgguggcucugacgacgaugaugcagagcugccaagggccaguccugggguggagauggcacucccuuagccucaugcuguggcuccccagcccgcagccuagcacccugccucccuggccucaggccugaauuccucagagaaguccaagggcagggcccagcucucaggcuaccagacagagcccuccuuguucccagccuucaggaaugggguggggggagggcuggagagcaagcuccaccugggaaggauguggccuggggaggggaaaccaggguugcuaaggucacagugagcugaacauuuggcccugguucucuucuagaaggcugggguggggacuuacaggggcuuuggcccaaagaggccuuggucccucuccugggaacccgucuccccagcuaccuuccacggcugugggccgggauccugggccacucccccagcucgauucuccugccgugucccccugaggacagccggccucccugaggggugcuggguccagagggcagcuuggagucaagugccaggagcgcagggcagcagagaggccgccuaggcucucgucacucuccacgggcugguuggggccucucugcagcugcucugcugccugggcacuggcuccugauggcgcugccaggggcugccauggagcagccccacugugggcucugccagugcuggacacguaggaguucuccugcggggaaggggggaugcagcuggcggccuccgaaugcccgggcacccccgccaccacugccugcagcuucucuagccucucguacaccugcaaguggaaaagagggacucucagggugagauggcagcccuggccggucaccccgugggcaaaccacagggcugcuccaggccguccgugaccugccccagggcucuaaaaugacauacccugcagcugggaacgcucugccccucgccccucuguucccaucacagggagugcugagaagcgcggcugccaaaagcaaggacugagaauggccucguucuuuucuacaaaaugaaucucacugccccgcugcccucaaacggggccucuccauuuucaacugucaccagaggagaagaggugggguacuagggaggggacagaaaaaggcagaugcaguagugcagugcgcccagcagggggcgcggcagcagcucuuuccuucucucuaugugaagggggucggagcugggcuccgcaaagcaggacugcccggggccccucaguucagaggggcgcugccccaaacagaaccaaagggcaagcaagaaauguguggagacuccagagagaccuagcaggugcugagauggggucacuacagagcaaggccuggaaugcgggcuuucuaucuggccaccccgucccagugcgcagcuggcuaccugggucauaggaggccuccuuuuggcccggcggugcaggcagcagcaggccagcuggcccaggcccaggcccagcucaggugggcagggcccgggccugggguccaggugcuucuuguagaucugcauggcgaugggagcagcccaggcaucugcagccagaccugcuugcagugugcucugggugcuucucaaagccacuccagccuccucagccuccucuuccaccaggucuuucugugggauaaauacugucaguauggcuaccagguggccacaccugcagcugcaguccucagguccuugucacucaaucguauggguuuugauaaaaaaaaaaaaaaaaaaaaaagagauggggucucgcuuuguuggccuggcuggucuccaaguaggcucaagugauccucccgccucagccucccaaagugcugguguuacaggugugagacacugugccacagcucuuggucuuucuacaacuuacuuuuuuucugagacagggacucauucugucacccaggcuggagugcaguggugcaaucauggcucagugcagccucaaccucccaggcucgugauccucccaccucggccucccgagcagcugggauuacagguguguaccaccaugccuaucuugcuauguugcccaggcuggucuccaacucccaggcucaagcgauccuccugccucagauucccgaguagcuucuagagauuuauuaaacaccuacugugggccaguggugcucugggcccuagggauacaggaacaaacagaacccugggacccgguuugacagagcugacuuccuggugggggagagccccauggagcuggggucugaaggcaggaaguagccugagagggcagagccgagaaggaaagcgccccacagagaggugccccacagacaaagagguaccccagagagagaggcgccccgcagagaggcgcccccaggguggaaacaggaccggaggccaucuccaguucugaaaucagacagaccaggaggaaccaccugggugggcgguggcuuuucucgcagagcgaacggcacauacuaaggcugugaagcaggcagcagggagcgccccgagucccagggaccuggggcguuggggggucaaccacauaagggacugggccuucaccccaagagcagagaaaaggcaaaggggccuuugaaaagagcacuuuggcugcaggguggggagcaaguggggaaguccaaggacccccaaggagccuggugcgcuucuucagcaggaugcauggauggacggacggggaagggaaaggaaggagggcucaagcccggcuccuggguucucagcggggcugaauccugacggagaccccacagcacacaggaaccgccccaaacaagaggagaagcagugaagcaauuacuggcugagcacauucugugaagucuguuuugcauaugggaaaacaggcccacaggggagcaggaauuugcuggaaggccacugucaggcuggggcuaaaacccaggucucuagucuccuggccccaccacaguccacggugaggcagacugaguggaguaagaccgugaggcagcucaggcugcccugcacggugcggagagcucagcugcagccugcuggggcccaggagguuccucggggccugcuucuucucuaccaccgccuuucuccggccagaguccucugaguuccacugcagcuugggucucagugcccugggaccgcccuucccccugcccccagcccagguggggucuguacaaggcccauagugucugcaggacagacagguuuguccucggcaagguaaacgaaguuguuuggagcccugccuacuuucaaaaaugaggccacuguggcagcagaggcauccaugggcacugcgccccaguuauccccgccacuggggcugugccugcuggcugccagcagcugugugucccuccuggcccugccucaaggggcucaccagauacuugguccuggcaccgugcgucuucacagcccucugaccagccaaggucucuagcacuaccuggagagagggaagagggagagcauggcaguggccuuggcagggaagaggccucugguguggacauggauugggccugacaaggguguggacaaaggcagagccagauguuaugggacugaagcucgggcaacucggagagcccacuugaagacaaauuacaaacacacaguuaggugcagggugaggaggagggccucggagggagggggacccuggagcugcagccuccuggggucuuggcagauggccccuggcccgcagugcacucugcagcccccaccucugccugccuguggcuucuccuccucugagccagcagaggggucaguggcucaccaccccaaagcugaagguguccguguccacagccagccuucccgucuugauguacuccucgggcagguaggccagggugccccgcacugucuguguccgggccaccaugcugcucuggcuggggcuggacccggcaaagcggcugaaccgggccaggccaaagucucccagcuugggugucagccucucauccagaaggacguuggaacuuggggagagaagacaguggcgucagcccgguccuagcuccuacaccugcccggcuuagauaaggcuggacucgaggcugccagcccggugccuugcccacagaaagcgcuggcacugcccugagcgcuccagcugccugggggccucugcucaucaguagggcccauccuuggcccguucccacaccugugcgaugccgggguguugaggucccaggccaugccugauccccacauugauaggacgcggggccccccuugcugcaggcccugccccggcaguucucaagggccccuccucaccucuugaugucuccauggaugaggcuggggcuguccugauguagaaacugaauugcccgggcuguacccagaaggauguccagucgcugaggccaggagagaggugggcaggccugggucugggguggcaaagggggacaggggagguugcuggauggccguuccuugaucccaaccauccuucuaccugucaccgugcagccuggaacagccacuucacucucuaggccucaguuucccccuucuggaaaacgaggagcaaagucuccgugaccugcacuucuuaagcaauggcuggggacacguucaauagaaucugcugggcuucggcucccagggcucaucccuuugucccugguggucgggaaguccuugaaggcauucuucccgcucuccccaaacgcagcaugcaggaggaggcaagggggcccucccucagcuguaggugguccagcugguagccccagacccccucgccuccggggcuugcugaugagacccuccagcuacgcugcuugcaaaggggagaggccugggaaagagcucuauagaaaacauugggucgggccaggcgugguggcucacgccuguaaucccagcacuuugggaggcugaggcgcgcagaccaccuggggucaggaguucgagacuagccuggccaauguggcaaaaccucaucucuacuaaaaauacaaaaauuaggcaggugugguggugcaugccuguagucccagcuacucgggaggcugcggcaggaggaucgccugaacccgggagguggagguuguggugagcugagaucacaccacugcacuccagccuggaugacagagcaagacuccaccucaaaaaaaaaaaaaaaaaaaaaaaaaaaaaaauugaccccaccgugggccaaauccugagccgggugcugcuggggagcuggaagugcaggccuggccugcuggcaggacccacucacacaggcugaaagcccuaggccccgcgcccggcuccagccaggugucaggagugcuuuggguccugggaagcgugccgggccaggugagccuaccuggcaguggagacgguccuccagggagccguugggcaggaagccguacaccaggcaguagaagccguucugagcacaguagccagcaaaguccacaauguuugggugacgaaaccuguuugaaaaaggggagcacuuuccaucaggccagacugggugggcagcccuggcuggggccucagcucgcccgggccugccaggccucaggugcccaagggagccagguccuguggugugcggucugaagccccacgggaccugguguggcucccccucuggccucaccuggacagcugcuccaccucggucaggaagcucugcuucacugcaguccacuccaggucagcguucugcagcccccagggugcggugggggaaggggcagggaagacgggcagcgugaggcucucgaagcgaaggccuucgggccaccagugccaccuacccgaggcccagaaccaccaaggggccagggacccuacgccagaaugagggcugaaggaguuguguggggaagcgagggggaaaggcuggagaaguggugaggguuaucugauggccuuccagggucccugccagggugcgacacucaccuccuucagccucuucacagcauacaccguguuccucaucaccgcccgguacacgcacccaaagccacccuccccgaucuugagcuccuccgagaaguugugggugccccgggaaaucucacagaggggccagcaaaacggaaaggggcgggcucccugcaggagggacacugagcucucugggccuggcugugggaagagagccuggaucagguggggucccugucucuucccuucugcccaaggcuccaggcucuccccaccacagcugccucccagcugacccagcuuggcugacuggggcucugcgcuacaucaaaggcugaauuccuuccuccuugucucgaaucuucccuggggggcaggggacaccuaccuugguagaagaaggggcuggagauggcgguggaggccacagggaagcagggcuugggaccaggccgagcucaggcccugaaugggucugggagccuggaaaagcuucauaaagacaccagugagaggcaggcagagaccagcagcagggucuacagccguggccguggucaaggugggcucuucuuuggguccaccgagccuaacaaccgggcccucuuaccuggggagaggaagguggaggcugaggauggcaacuuccgggggcuccaggccucggccucggcgggugcagggaugcugcugggccucggggcaguggugccuggggacggaagcggggcgggagggugcccugggacgccaaggaaggaaaggaagguugaggcccgggugggggagccccguggggcccgccggccucccagccguggggugcccggagucccgcgcucacaggcugugaugaugucccgcgcacggagcagcugcaggugcgugaggaugugcacgaggucggccacacgggcguugcgguugauccagggccacaggacgcuggccgugcgcugcccggagcgcucgcacagccgcagcucggucuggucgcgcacgaucagggcggcugcggggcggggggcgucaggcgucggcgccaggagcccgcgcgccucccgccccccggcagcccgccgccacccaccgaacuggcaccagucggcgggcuccagggcguccaucacuuuguagaagcggcacaugacccagggcggcaccucguacaagaagugcugggcgccgggggcugcgggcucccccgggcccggccccccggccauggcugccgccgccgggccgggaccugccggggccucucagggccgcggcgggcgcgggccugggccggccggguccgcggacacugacucacuuccccuucgagccggccucgugcgacgcccggcggggcggaaggggcggugcccgggcccgccgccaucuugcgcgccgcggccgcgcg

SEQ ID NO: 19036 - RNA, 10067 nt, Homo sapiens
cgcgcggccgcggcgcgcaagauggcggcgggcccgggcaccgccccuuccgccccgccgggcgucgcacgaggccggcucgaaggggaagugagucaguguccgcggacccggccggcccaggcccgcgcccgccgcggcccugagaggccccggcaggucccggcccggcggcggcagccauggccggggggccgggcccgggggagcccgcagcccccggcgcccagcacuucuuguacgaggugccgcccugggucaugugccgcuucuacaaagugauggacgcccuggagcccgccgacuggugccaguucgguggguggcggcgggcugccggggggcgggaggcgcgcgggcuccuggcgccgacgccugacgccccccgccccgcagccgcccugaucgugcgcgaccagaccgagcugcggcugugcgagcgcuccgggcagcgcacggccagcguccuguggcccuggaucaaccgcaacgcccguguggccgaccucgugcacauccucacgcaccugcagcugcuccgugcgcgggacaucaucacagccugugagcgcgggacuccgggcaccccacggcugggaggccggcgggccccacggggcucccccacccgggccucaaccuuccuuuccuuccuuggcgucccagggcacccucccgccccgcuuccguccccaggcaccacugccccgaggcccagcagcaucccugcacccgccgaggccgaggccuggagcccccggaaguugccauccucagccuccaccuuccucuccccagguaagagggcccgguuguuaggcucgguggacccaaagaagagcccaccuugaccacggccacggcuguagacccugcugcuggucucugccugccucucacuggugucuuuaugaagcuuuuccaggcucccagacccauucagggccugagcucggccuggucccaagcccugcuucccuguggccuccaccgccaucuccagccccuucuucuaccaagguagguguccccugccccccagggaagauucgagacaaggaggaaggaauucagccuuugauguagcgcagagccccagucagccaagcugggucagcugggaggcagcugugguggggagagccuggagccuugggcagaagggaagagacagggaccccaccugauccaggcucucuucccacagccaggcccagagagcucagugucccuccugcagggagcccgccccuuuccguuuugcuggccccucugugagauuucccggggcacccacaacuucucggaggagcucaagaucggggaggguggcuuugggugcguguaccgggcggugaugaggaacacgguguaugcugugaagaggcugaaggaggugagugucgcacccuggcagggacccuggaaggccaucagauaacccucaccacuucuccagccuuucccccucgcuuccccacacaacuccuucagcccucauucuggcguagggucccuggccccuuggugguucugggccucggguagguggcacugguggcccgaaggccuucgcuucgagagccucacgcugcccgucuucccugccccuucccccaccgcacccugggggcugcagaacgcugaccuggaguggacugcagugaagcagagcuuccugaccgagguggagcagcuguccaggugaggccagagggggagccacaccaggucccguggggcuucagaccgcacaccacaggaccuggcucccuugggcaccugaggccuggcaggcccgggcgagcugaggccccagccagggcugcccacccagucuggccugauggaaagugcuccccuuuuucaaacagguuucgucacccaaacauuguggacuuugcuggcuacugugcucagaacggcuucuacugccugguguacggcuuccugcccaacggcucccuggaggaccgucuccacugccagguaggcucaccuggcccggcacgcuucccaggacccaaagcacuccugacaccuggcuggagccgggcgcggggccuagggcuuucagccugugugaguggguccugccagcaggccaggccugcacuuccagcuccccagcagcacccggcucaggauuuggcccacgguggggucaauuuuuuuuuuuuuuuuuuuuuuuuuuuuuuugagguggagucuugcucugucauccaggcuggagugcaguggugugaucucagcucaccacaaccuccaccucccggguucaggcgauccuccugccgcagccucccgaguagcugggacuacaggcaugcaccaccacaccugccuaauuuuuguauuuuuaguagagaugagguuuugccacauuggccaggcuagucucgaacuccugaccccagguggucugcgcgccucagccucccaaagugcugggauuacaggcgugagccaccacgccuggcccgacccaauguuuucuauagagcucuuucccaggccucuccccuuugcaagcagcguagcuggagggucucaucagcaagccccggaggcgagggggucuggggcuaccagcuggaccaccuacagcugagggagggcccccuugccuccuccugcaugcugcguuuggggagagcgggaagaaugccuucaaggacuucccgaccaccagggacaaagggaugagcccugggagccgaagcccagcagauucuauugaacguguccccagccauugcuuaagaagugcaggucacggagacuuugcuccucguuuuccagaagggggaaacugaggccuagagagugaaguggcuguuccaggcugcacggugacagguagaaggaugguugggaucaaggaacggccauccagcaaccuccccugucccccuuugccaccccagacccaggccugcccaccucucuccuggccucagcgacuggacauccuucuggguacagcccgggcaauucaguuucuacaucaggacagccccagccucauccauggagacaucaagaggugaggaggggcccuugagaacugccggggcagggccugcagcaaggggggccccgcguccuaucaauguggggaucaggcauggccugggaccucaacaccccggcaucgcacaggugugggaacgggccaaggaugggcccuacugaugagcagaggcccccaggcagcuggagcgcucagggcagugccagcgcuuucugugggcaaggcaccgggcuggcagccucgaguccagccuuaucuaagccgggcagguguaggagcuaggaccgggcugacgccacugucuucucuccccaaguuccaacguccuucuggaugagaggcugacacccaagcugggagacuuuggccuggcccgguucagccgcuuugccggguccagccccagccagagcagcaugguggcccggacacagacagugcggggcacccuggccuaccugcccgaggaguacaucaagacgggaaggcuggcuguggacacggacaccuucagcuuugggguggugagccacugaccccucugcuggcucagaggaggagaagccacaggcaggcagaggugggggcugcagagugcacugcgggccaggggccaucugccaagaccccaggaggcugcagcuccagggucccccucccuccgaggcccuccuccucacccugcaccuaacuguguguuuguaauuugucuucaagugggcucuccgaguugcccgagcuucagucccauaacaucuggcucugccuuuguccacacccuugucaggcccaauccauguccacaccagaggccucuucccugccaaggccacugccaugcucucccucuucccucucuccagguagugcuagagaccuuggcuggucagagggcugugaagacgcacggugccaggaccaaguaucuggugagccccuugaggcagggccaggagggacacacagcugcuggcagccagcaggcacagccccaguggcggggauaacuggggcgcagugcccauggaugccucugcugccacaguggccucauuuuugaaaguaggcagggcuccaaacaacuucguuuaccuugccgaggacaaaccugucuguccugcagacacuaugggccuuguacagaccccaccugggcugggggcagggggaagggcggucccagggcacugagacccaagcugcaguggaacucagaggacucuggccggagaaaggcggugguagagaagaagcaggccccgaggaaccuccugggccccagcaggcugcagcugagcucuccgcaccgugcagggcagccugagcugccucacggucuuacuccacucagucugccucaccguggacugugguggggccaggagacuagagaccuggguuuuagccccagccugacaguggccuuccagcaaauuccugcuccccugugggccuguuuucccauaugcaaaacagacuucacagaaugugcucagccaguaauugcuucacugcuucuccucuuguuuggggcgguuccugugugcuguggggucuccgucaggauucagccccgcugagaacccaggagccgggcuugagcccuccuuccuuucccuuccccguccguccauccaugcauccugcugaagaagcgcaccaggcuccuuggggguccuuggacuuccccacuugcuccccacccugcagccaaagugcucuuuucaaaggccccuuugccuuuucucugcucuuggggugaaggcccagucccuuaugugguugaccccccaacgccccaggucccugggacucggggcgcucccugcugccugcuucacagccuuaguaugugccguucgcucugcgagaaaagccaccgcccacccaggugguuccuccuggucugucugauuucagaacuggagauggccuccgguccuguuuccacccugggggcgccucucugcggggcgccucucucucugggguaccucuuugucuguggggcaccucucuguggggcgcuuuccuucucggcucugcccucucaggcuacuuccugccuucagaccccagcuccauggggcucucccccaccaggaagucagcucugucaaaccgggucccaggguucuguuuguuccuguaucccuagggcccagagcaccacuggcccacaguagguguuuaauaaaucucuagaagcuacucgggaaucugaggcaggaggaucgcuugagccugggaguuggagaccagccugggcaacauagcaagauaggcauggugguacacaccuguaaucccagcugcucgggaggccgaggugggaggaucacgagccugggagguugaggcugcacugagccaugauugcaccacugcacuccagccugggugacagaaugagucccugucucagaaaaaaaguaaguuguagaaagaccaagagcuguggcacagugucucacaccuguaacaccagcacuuugggaggcugaggcgggaggaucacuugagccuacuuggagaccagccaggccaacaaagcgagaccccaucucuuuuuuuuuuuuuuuuuuuuuuaucaaaacccauacgauugagugacaaggaccugaggacugcagcugcagguguggccaccugguagccauacugacaguauuuaucccacagaaagaccugguggaagaggaggcugaggaggcuggaguggcuuugagaagcacccagagcacacugcaagcaggucuggcugcagaugccugggcugcucccaucgccaugcagaucuacaagaagcaccuggaccccaggcccgggcccugcccaccugagcugggccugggccugggccagcuggccugcugcugccugcaccgccgggccaaaaggaggccuccuaugacccagguagccagcugcgcacugggacgggguggccagauagaaagcccgcauuccaggccuugcucuguagugaccccaucucagcaccugcuaggucucucuggagucuccacacauuucuugcuugcccuuugguucuguuuggggcagcgccccucugaacugaggggccccgggcaguccugcuuugcggagcccagcuccgacccccuucacauagagagaaggaaagagcugcugccgcgcccccugcugggcgcacugcacuacugcaucugccuuuuucuguccccucccuaguaccccaccucuucuccucuggugacaguugaaaauggagaggccccguuugagggcagcggggcagugagauucauuuuguagaaaagaacgaggccauucucaguccuugcuuuuggcagccgcgcuucucagcacucccugugaugggaacagaggggcgaggggcagagcguucccagcugcaggguaugucauuuuagagcccuggggcaggucacggacggccuggagcagcccugugguuugcccacggggugaccggccagggcugccaucucacccugagagucccucuuuuccacuugcagguguacgagaggcuagagaagcugcaggcagugguggcgggggugcccgggcauucggaggccgccagcugcauccccccuuccccgcaggagaacuccuacguguccagcacuggcagagcccacaguggggcugcuccauggcagccccuggcagcgccaucaggagccagugcccaggcagcagagcagcugcagagaggccccaaccagcccguggagagugacgagagccuaggcggccucucugcugcccugcgcuccuggcacuugacuccaagcugcccucuggacccagcaccccucagggaggccggcuguccucagggggacacggcaggagaaucgagcugggggaguggcccaggaucccggcccacagccguggaagguagcuggggagacggguucccaggagagggaccaaggccucuuugggccaaagccccuguaaguccccaccccagccuucuagaagagaaccagggccaaauguucagcucacugugaccuuagcaacccugguuuccccuccccaggccacauccuucccagguggagcuugcucuccagcccuccccccaccccauuccugaaggcugggaacaaggagggcucugucugguagccugagagcugggcccugcccuuggacuucucugaggaauucaggccugaggccagggaggcagggugcuaggcugcgggcuggggagccacagcaugaggcuaagggagugccaucuccaccccaggacuggcccuuggcagcucugcaucaucgucgucagagccaccgcagauuaucaucaacccugcccgacagaagaugguccagaagcuggcccuguacgaggauggggcccuggacagccugcagcugcugucguccagcucccucccaggugcugccgcccaggcuggccucuggggugcucaggcgcauccgugucagccccaaagagcagagugucugucccgacugcgcugagggcguggggcagccgggcaggccacuggcucuggcgaccucuagaagcccagccggccccacaugccucccuuagcaagacccuggcccacuccuucccucgccuccugacaguagcaccuccuuuagcccgagggugccugccccacucugugcuuucaggaaauaggaagccccagcaggaauuuuccaucccagguacuauuugaagaaccacugcuuaggaacccucagcugggcgagguggcucaugccuauaauaccagcacuuuuggaggccaagaugggaggaucacuugagcccaggagguggaggcuacagugagcugugaucaagccacugcacuccagccugggagacaguuagacccugucucaaaaacaaaugaacaaacaaacaaaaacccucaauucccacgaacgccccaggagauaagggagcauggcccaggccuugagccagggcuucuggcaguaggggagccucccccauuugcuaagcggacuuuccucuuccuucuguaggcuugggccuggaacaggacaggcaggggcccgaagaaagugaugaauuucagagcugauguguucaccugggcagaucccccaaauccggaagucaaaguucucauggucagaaguucucauggugcacgaguccucagcacucugccggcagugggggugggggcccaugcccgcgggggagagaaggagguggcccugcuguucuaggcucugugggcauaggcaggcagaguggaacccugccuccaugccagcaucugggggcaaggaaggcuggcaucauccagugaggaggcuggcgcauguugggaggcugcuggcugcacagacccgugaggggaggagaggggcugcugugcagggguguggaguagggagcuggcuccccugagagccaugcagggcgucugcagcccaggccucuggcagcagcucuuugcccaucucuuuggacaguggccacccugcacaauggggccgacgaggccuagggcccuccuaccugcuuacaauuuggaaaaguguggccgggugcgguggcucacgccuguaaucccagcacuuugggaggccaaggcaggaggaucgcuggagcccaguaggucaagaccagccagggcaacaugaugagacccugucucugccaaaaaauuuuuuaaacuauuagccuggcgugguagcgcacgccuguggucccagcugcuggggaggcugaaguaggaggaucauuuaugcuugggaggucgaggcugcagugagucaugauuguaugacugcacuccagccugggugacagagcaagacccuguuucaaaaagaaaaacccugggaaaagugaaguauggcuguaagucucaugguucaguccuagcaagaagcgagaauucugagauccuccagaaagucgagcagcacccaccuccaaccucgggccagugucuucaggcuuuacuggggaccugcgagcuggccuaaugugguggccugcaagccaggccaucccugggcgccacagacgagcuccgagccaggucaggcuucggaggccacaagcucagccucaggcccaggcacugauuguggcagaggggccacuacccaaggucuagcuaggcccaagaccuaguuacccagacagugagaagccccuggaaggcagaaaaguugggagcauggcagacagggaagggaaacauuuucagggaaaagacauguaucacaugucuucagaagcaagucagguuucauguaaccgaguguccucuugcguguccaaaaguagcccagggcuguagcacaggcuucacagugauuuuguguucagccgugagucacacuacaugcccccgugaagcugggcauuggugacguccagguuguccuugaguaauaaaaacguauguugcaaucucgggcucuacuuguggacuuuguugcaccgaaagccuugagcuuuccugaugccuuacacuucaggguucuugagcguccagggucuuguuacuacucugggcuggccacacccagcacuucccgugucagguuuuuccugauguaguccauguuuuuuaugcuauucuaaaugguaucuuugauuuucuaguucaucaugauauuauacagaaaugcaauugaugcugggcacgguggcucacgccugugauuccagcgcuuugggaagcuaaggcgggcagaucacuugaggccaggaguuugagaccagccugggcaacauggcgaaaccccgucucuacaaaaaguacaaaaauuagccaggcaugguggugcaugccuguaguuugagcuacucaggaggcugacccaggaggauaguuugagcccaggacguugaggcugcagugagccaugauuccaccacugcacuccagcccgggcaacagagggagaccuugccucaaaaaaaaaaaaaaaaaaaaaaaaagcgguugaguuuugcauaugaaccguauauucugugaccuuguuu

SEQ ID NO: 19037 - RNA, 910 nt, Homo sapiens
auauugaacucgaguuggaagaggcgaguccggucucaaaauggagguaaaaccgccgcccagucgcccccagcccgacuccggccgucgccgucgccgccggggggaggagggccaugauccaaaggaaccagagcaguugagaaaacuguuuauugguggucugagcuuugaaacuacagaugauaguuuacgagaacauuuugagaaauggggcacacucacagauugugugguaaugagagacccccaaacaaaacguuccaggggcuuugguuuugugacuuauucuuguguugaagagguggaugcagcaaugugugcucgaccacacaagguugaugggcguguaguggaaccaaagagagcuguuucuagagaggauucuguaaagccuggugcccaucuaacagugaagaaaauuuuuguuggugguauuaaagaagauacagaagaauauaauuugagagacuacuuugaaaaguauggcaagauugaaaccauagaaguuauggaagacaggcagaguggaaaaaagagaggauuugcuuuuguaacuuuugaugaucaugauacaguugauaaaauuguuguucagaaauaccacacuauuaaugggcauaauugugaagugaaaaagacccuuucuaaacaagagaugcagucugcuggaucacggagaggucguggagguggaucuggcaauuuuaugggucgcggagggaacuuuggaggugguggaggugguggcagcagagguaguuauggaggaggugaugguggauauaauggauuuggaggugaugguggcaacuauggcggugguccugguuauaguaguagagggggcuauggugaugguggaccaggauauggaaaccaaggugguggauaugguggagguggagga

SEQ ID NO: 19038 - RNA, 259 nt, Homo sapiens
ggucacagccuccaccaccugcuucuuguucaccuuggaugcugggcugucgacuucccucaugaugugggucaugccagcuuuguaucccaggaaggcugugagguggaccggcuuggacggaucauccuuagggaagcucuucaccuucccacgaugccugcugcugcgcuucugaggcaggaagccgagggacccaugucugggagcagaaaacuuucugugagacaucacgcagucaaaucccgccgguagagca

SEQ ID NO: 19039 - RNA, 26110 nt, Homo sapiens
agccacgcaaaggagaauggaagcaaaacuuuauuccucuuggcuggagaagagaacuagugggugguuguguacaggacccccaucccucaccccucccagaaccaaagaagacaagcagcgccaccaaauggcucccucugcccaagugaaagccgagaggucagcggcuggcuggggaggcaggugagcgcagcacggcacagggcaggggcggcugcagugacaggcgggcggccagggcggccugggccgggguugaggggaagagggcggggcugcuuggguagcggggcaggcuugggggcugccggcuggcacgggccccagacucagggcaccacaacgcgguaggggcugccugggaugugcucguccccccauuugaccaccaguguguacucccccuuguccuugagcagguaggacacgcuguagagccggcugcccacgugcuucaccaggaucuccucgcaggggguccuugggccaugaacccccaccagcagcauguuguugccugaggcaagagggguccucagucccaggucccagcccccuuccucccgcugguguccugcucuccucuccugucccuaagccaguucuggggugacaguucucucuuccuaaagagcugccagcaccuccccaacccaggccagcuuagcagauuccagcuccucccuggucuuuguuugagggguccaggagguggcagggagguggcucuagaagugaaagccacgccccaaaggcggucccugcucucccagacacuggccauccugugauuucuggccucauuuuggugggaaggugggccgggggcccggguugcccaccugcuuugcugcagucuacugugaagcugcucuucuggccuacguaggccuugcucagccccaggcccuuggccaccaccuugcuggcgucagcaggcccaggacccggggccccaugcuggggggcacagguggccuuggucagagagucuacaaacacugaugaugucucguggaggcugugguugcugacgagacgggggccugcaaggcagaguggguggggcuaagagguggcuguggugccgggcguugggcagaugccaauagcuuggccccaggcucaccugugacuuuggccuugaaggggcugcccccaaugugguaggggccgccguacuugauggagaugagguagcugccaggugccauggggguauaggugacgcgguagcccucagggcacuccuggcaauccaucuucaccuuggaggggccgucaauggucaccgacagggcaccagcucccgcauugcucguguucacgacgaacucagcuggguucccugggagcacaggaggucaggcagagccagacuggccugccucccuguccucggccacccagcacaggcuugucaccuccaggugccuccuguugucaccaagagcuuggaggcaagggccuagcagcugugugcacacgugcagccgcaccgacagacuuaccugugacaccgccuuccagaccugcuccguaagcagacaccaagccuggguccccuccaugcccaggcuccccaacucggaucuugaaggggcuuccagggaugugggugccguugaacuugacgucaaucagguaaacgccauucucccgagggaugaagcgcacagcauacuuaucugaggagcagggagucaugcugugggccuggggccccuccucaaaccagcagauggugucugugaggaacagccucaacccuggcccuccccauuuugccgguccaucagugugagcccagccacgcugggcaccugcaccccgcagcagaccuccugagggccgaagguuuagacacucaagcugcccaccgucagggugcauugggacggaaaucuuuuacaagccaaacccaggccuugcugccuccuaagaaagguuaccgugaacaccauauccccugcauguuaacaggcucagagacgggcaggaacuugcuucaggucaugcagcugggaagggcaggacuaggccgugaaaugaagcccacugggcuccuccuacccacaaggcugccccaggccugugcacaaguaccauggccguggcugaagggccgggcagcacugaggcuggacuuugagucuuucccuguggagauggcaugguacugcaggguagaaggccuuccuaauagcuguggguggcgagccacauccccagcggcuugggucaccaauugggaaaggguugccuggcuuagggggcccaggaguuggggccccgucuuggcugcuuacagaagcgguaccuuccuuuuguacucucagccugcuuccagccagcagggcagggcggccgggcagggacagggccucaccuuggucaauuucugugacauagcacuccuccagggcuccugaggggcugugcaccuuggcaucgaucgcccccuuggccccguucaggcugacugcaaaagaggcuggcugguugaccuuuagcccugacuccuggaagcacagcagacaugguuagaugggggugcuugagccagggcaagggaggacggaaaggccccaggagcaagaggcccgcgggucgcacuuacccaucuggcguccaacuugguuuaaagagggagagccacugauuugcaaggggcagcaagccacaggcgcacauccccgccccugcccccacacucugccgucgcacacacccagguggcaggaagggagggcugccccacccugugggcagcacccagccuuggcaggcugucccucuuuaaaccgcagcccuggugcucaaggggcacaggcuucuguucaaagccuuuagaccugagacacgagaaaaacuccacguggugggcaggauauuuccugccgaccccaagcgugggcugcacccggccagagcagaggccuggaacccagagcugggccaggggggucacugaacacagggccaaggccuggucucugcgguggcucuggucuguccgggcccaggagccccaggugggcgguuucucucggugccucaccugaaggcuagaaacagugaggcggcgggcgucgccagacggagaagccacaggcaccacgaaggggcugucgggaauguguuccucguugaacuugacugagacuucguagucaccugggcagggaaagaguguaagaccggcucaucagccuuugggccucccaccucccacgaacagccuggguggcccugugaccucaaagugaagagugagugccaggcagggcuaucugugccagcccuggguccaauacccacacucaggccccaccuccuccaaccccagccggguucccaguaccuggcuccuggaccacauaagccacaccacaggagccguccuugcgguccucaaaagagaucucagccuugcuggggcccucgacagcaauggccaggccuccagcaccagcuucccggguccagauacugaauucggcugugggagaacaguuuguccucacugaaggcugcuucaccagccucggcccccuccaggcauagccaagguagacaugccugccggcucuuuccuccacccccaaccccacccuggccaacgcaggagagcgagcacucggggugugagcaggccuaccuggcacuccagcuucagcucucuccaggccagggcccccagcucggaccuugugggcucccccuuccccuaggggccccacggugaacuggaaggggcucccaggcacgugcuggcccuuguacuucacgcugacugugugugugcccaucucagcgggaacaaagcggaugcaguaggugugguucuccccuuccacgaucucggccucaugggucuugcccgaugggcuggucaccugggcugucauauccuggaugcuaauuucugcaggguggggaugggcuagugagcagcagcccugggcuccaccccuccucuuggggcugcuugagccccaggaccccuccccaggcuucccacagccccuaccagggauuuucaggcugaggucacaaugacuaccaacguuggccacugaaggagcccgacgccugcgggugaugcucucuuucacccggcccucgccugucaccuucacagagaaggggcugccugcaggaagaaagcacggcccacgccccuccagucacauacugccugugggcccugguguagugaggggggcugccgaggcacugcugcacucaccaggcacgugcuggucggcaaacuugauguugaugauguaguugccuggcucuguggggcaguaggugacccugcacgucccguccuccagguccucuguguugauguccaccuugcuggggcccucaauggacaggcugagcccaccauagccuaggggauggauaccccugagccucggugcuaugcacagugcucccgccccagcuggugggcagccacugccuaccugcaucgcggguaucaaugauaaacucugcaggcucaaagguguggccuucgugaaggcccugaccagagacccgaacacgacuggcauccccaauuuccgacuggcugaucaccaccgggauggggcugcuggccacgugcuggccauuuuucuucacaugcaccaggugcucccccgucuccuugggcacgaaugaaaucccuggacacagggcauggcugucagucagggagggcauggcuccccacaggcugccuccuuucugaacccccuggacccuucagccgcuuacccacguggccauuacgcagccgcuucagcaaacagggcuccucccggcccgagggcgggaccacaguggccgucagcaggcugagauccgucucugagauguugauggggaugucggcagcagagccgaccuuuaggugggacauacgcauggagucgucaccugguggggacaggccagccaucagugugcguccagccaugggagaccaugcccacccugccacccguuucugucacugcucccagugccacccaccugugacccgagcagugaaggggcugccugggacgugcuguucauuguacuugacuagaaugcuguagucccccggcagcacaggcagguaggacacgcugcaugucccauccugguugucagugcagcugauuucugcuuuggacgggcccucaauggccagagacaggcccccuggagagagccgugggugagcaugggaacuaugcuggggacacuccaguuggccugcacugaggagcuccgauggccagggcagcagggcagggagccccauucaggaguaucuccugaguccagcccuuaccccggugagggcaucccgggcacagagcaggucaagaccagagcuauugcucacccucuccugcauccuugguguugacggugaagguggcaggcuuguucacuacuccaugggugaggccaggcccauaggcagugacauggccacaguugacguaauccacauagaacugcaaggggcuuccugaggcaggaagaagggccuuguggaauggcagccucgugugucccccagccccaucucucugugaggugguggcgguggagugggcagaggcagggcaggcccaccugggaugugcauguugucauagcggauguccaucucgugcaggccagccucgcugggugcauaccgcacggucacggugccgucuuuguugucagugauggugggcugcgccaccuugccugagggcauccgaaccuccccuguggggcaguggggcugaggucagggcagcucauuggcacagucuggccuccuuggcucccgagcuccuucccaaguccccacucaccugugaucucgcccuucuugauggugaaggggaugacaaggucaaagggccucaggcuggucacauccagcccauugacacccaccaggggccucuccggggccugcaguggagacacagggcaugggugagggacagugggaggaucuggggucccuccucacacaugguaaacuaggggcucacagaacacccagcuggcuagccccagugucccuagcuggccaggccguacccaagucugcuggccgcccugggcguagguguacuguggggccagcugcugagaccguagagggggcugcaccgagggcugguccccagccagagccugcagggcaaagcagagagcugcuggagagucuguugucacagaggggccccaggggaacaggccgggaccugccagacaccccugcugaccuaccccccaccccuccucaccgucacuuggaaggggcuguugggcacgugcucgccaccaaagcgcacacagaugacguauuugcccggcuggggggccguguagaagaugucgaaagugccguccucauucuccaccacguccacauccaccucugagccaucaggcgugcacacggugcacgucacuuugccuuugccugccgccuuaguguccacagugaucaccgucuccuccccaaucugaaugguggggccgaugccagcaccugguggggcaggguggguccccaaaggggggccagcgugugagcucggguucagguuguucccguccgccugccgcccacacaggccucucauugccaccaccaagcacagccaggccgccaggccuccugccccgcccugccccuccaagcugggauggcgagugguuucucagaaggcaggaagguuucuccugaccaccucaagugcccaugugggagaggcccgacaguagcacccaggugccugggaggaaaaggaagggcccacuccagccuaaguguugacagccacucccuugccuacucagccucguccagcaccauggcccacacugcugaacgccagcaucuggcugggcacacggcugccugcgcccuucuggccuggccccggcccccauugcuguguguggacgcggugaggcggaguccugcugcagcguggggggaugugacacuugccuccccaccccccaggccugauggugaaaccggaguuuccugacaacugagaaggcucgcggugaaaagcagcccggugcagacaggagugggagcggggaagcgggaggcagcgggguuagcacccgaguagcgcagcgcagcaggcuuggcagagcggggauagcacccagggagacagggaacaggaggcccaagcuacagccaccacugcuggguugcgagggcagagcagcugagcaggcuccagggccccagagugcccgaggaaaggggagagacagugacguuaugaucugggucuccgccguggaggcuuggggggcugugggcugugaggccuggcagugagagugcccccugcagccuggccuccugccagggaagcagccaggagcacgaaaccuacuugaaggccaagcucgaggggcccugccaccaagucccacuaucggccgagggcuccugcugcacuaggcuccaugcuggccugccgcggccaggcagcucucccaggcuccagaccuggcugccggcugcccacgcugcccugggaggcuucacucaugugcaccccaugccaucuaguuaguggcuugggccccaaccucacagguacccgacugcccccacuuucccugcccggcucccagccaaccgcaggucucagccacuccauccucaaaguaugccuccuaauuuggcucucacugaagccccguggccgucaagcuugccagagagcaacuucagcgcccccuuccccaccccgggcucccugucuccauucugcaaacaguagccagggaaacugagguuacugagucuugcucccacccucaaagcccccaaggcccugcaaucaguacuccccagccucccccgcccugcgcacacacgccugucacacacacaucggauccuacggccugcucuauaaagccaucucgcuccugccgcaaaacucuagccacccucucacccuuuccuuagccaccucgcccaagugccaggccuguagccucucaucagcaucccugggugucccuggcuggggcaggugacccuccaugccuguuggggaaugucugaauaacgucacugcugggggauaggggaagggggaaggagggagacgggccacagaaugcacuuuggggcucugaggcugggccgggccccgccaugcuggccgcccaagcagucgacacuggcgcuacugcacuaccagccagccccacccgcucaugcaccucccccggcccgggacgcagaggccccuggaagguggggaugggggucuguggaucuggccagggcuggggcucccauugaguuggggagaccccuuguucccucagcccacgcaggagcccuugugccucccugggugccaagaucccgagaccccaaaguccccaguggggugccucucaggaugcaccucaccccaaagcucucagcugcaacccgaguucucagauggggaaauaaaggcccagagaggggaagagcuggagcggucaugcucagcuccggaagccucccugggcccucgcccuccagcccacggccucaucuucugcaccccacccaacucugucccugccuagagcugcagcuggaacuguccugggaaucggccccaagaggaaaggaagcugccccucugggcaggaggggcauugggaguggccccagcaagcagcuuaccuagcccgugaccuccgauugacacugaggugagagggcagagagcaaggagaaaggucaggugagucacucaagggggcggcccccacucccacacgccgccccaagcagcgagcccuugcacacaggcacaacccaagccccgugccgagcgccgcagcggccaacagcgggcgggcucaccugugacagugcacuugcuggcguccccggugggcacggcacgcacgcgguacggggagaaggggaucucgucaccaccguacuugaugaggaugguguagcgaccugucacgucuggcacguaggccacuguauacgugccgucaugguugucuuggaugugugucuucuucggcuugccuucgggauccuguguggcagaggcaggggaggcaguuggcccaagcccgaguagccccgggccugccucaggcgcucccagagugcccagcgcugcugcuacagggacagucucugggccucaggcaucuuaacugcuauggcccaaaagggcugccugcaccuggcagaguccagaauggagacuaaaacaucccacacuucccacaugacaacaggcgcggccagccagcuuggcacccauccucagccccagggccuggccagcacuaggaggagcucaccggggugaucucaagcuucuauccuauaccugccccaugagaauauuacagguggggaaacugaggcacagaaggcuuuggugacgugcucaaaguuagcagcaagugcacgucuggggaagccugugccugucaccaccauccuaagguagucacaaccuuagcaaaccaaagacaggggcccuguccuucccugcccuccuuggugcagcuccgcagggagaucagacaccagccacccgcagcccacacuccagccgcccaggccccccugccuccccugccugugcccggagcucaccgugaucuggacagccagcaggcccuccccggcguccuuugcaucgauggugaacuccacgggcaggcuggcaggcacgccagugguguugagcccggggccacuggccuucaccuugcuggcaucaugaguaggcagcaccuugaccuugaaggggcugugagggauugguguugugagcagucagacagguucucagcauccagccugggccacuccccacaggcagcaggcccugccucuuaccuccgggguaccucuucaucuccauacaguacugagaugcuguagggcccuucucggcugggcacauaauugacggucugggugccaucagcguugucuaccacguccacuggcuccaccaggccuggccccagccccagggacagagcaucagcuagucuccugggccuccauuccuaccccaccacacuggacggccaggacccagccccaggccuagaccucgcuuuauccucauccacccgacccugggaauggccuugacccccucuggcacgaaagacacccaucugggugccagcugggacccuugccugccugccuuccugccacaucugcucagugaccagucccaucugcucuaccuccuccaagucccccaccuggcugcacugucaccugaggcucuuccaaaaacaccuacacacuugcaccaccucugcacucugguccucacuuugggccuccaguuuccuuucccggcccucaaacaggacacugcccuccugaccccuggcuccaggcaugcaaacacucaccuuugggcccuugcacuuugaccugcaauggggccacaccagccuugcuuguguccaccuggaaggacugagggagguuggcacgaaccaugccugggcucaggccgggcccagagcacuugaccuuggacgcaucugucacaucaugcacagggaccuugaaaggacugccugaggguuggggcaaagggauggcggcuguaugagacaggguggggacgagcagacagucccagcccugcccuggccgccaccuccucaccuggcacuugauggccaccauaggugacguugaggcuguaggugccagccucauaagggauguacucgaccgagcagcugccguccuuguuauccaugcaggacaucuuggccucggaggggcccucuacagccaggcccaggccgcccgugccagcuccccugguccaaacagacagccggucauuccugggguucccaggcccaccagccacacgggcuccugggggcucccuuaccuggucuccacagugaacuuguugggcuuguugguggugccacuuuggaugccuggcccguggacacgcacccgggaggggucgcagcccucggucacgggcaccuggaaggggcugcugggcacgggacugccgucauaggucacguccacggagugcaguccuggaggagugcaggccaggucaggaggagcccgggccaccccacccaccccgucugccagccugugggaguccccagcacgcacccuccucguaaggcguguacuccacuuuguacaugccaucgccacgguccugaacguaggucuccgucagguugccugagggguuggccacacgggccuugacgugcggcccuccggucugugucagagcccgggcguccacacugaacucagugguggccucacggaagacaccugcaaaggcacagagaggaggcuuggggcucggggguucuggucccugucccccgucacauaccccacggcagggcaacucacccuggcccucaauaccaggcccauagcacuggacaccggaaguguccaccgcagguuccaccugcagcuugcuggggaaguugggcacgggcuggccgccguacuugauggugacgguguaggccccggggcagaggggaauguagguaauggugugcgugccaucaccgugguccuggauguacaccucggccggaagccccgccuccgagcagaucucaauggucagcuccgcgcugcccgcgcucgagcaguccacuuggaauuggcccaccuccccagcgguggcccgcuccagcccggggccugagcacuugacuuuggaugcgucaaagcagggaaccacgugggccuugaauggggagccagggaugugggugucagcgaagaggauguugauguuguaguccccgggcucggugggcacguaggacacggaacaugugccauccccauuguccaagcacucgagcugcgccucacaggggcccuccaccgucaggcccaggccaccugugccggcgcccuuggugucgauggugaagcgggcgggggagcccgcacugccucccugcagccccggcccaaacgccuucaccugagggaagaaggggucaggagccaaggccacacuaugccccgaucccagaccuccugcuugacuuuccaccugccuccccuugcccuggcuuccugcccucaccaaacagggacacgggcgggcccaggcugccugccagaugggccauccaucagucauaaggacaaaaaggagggcagggcgcggucacucacgccuguaaucucagcccuuugggaggccaagguggguggaucaccugaggucaggaguuugagaacagccuggccaacauggugaaaucucgucucuacuaaaauuaccaaaauuagcugggcaugguggcgggcaccuguaaucccagcuacuugggaggcugaggcaggaguauugcuugaagccaggaggcggagggugccgugagccaauaucgcgccacugcacuccagccugggcgacagagugagacucuuucucaaaaaaaaaaaaaaaaaaaaaaaaaaaaaaaaagaaagaaaaaaaaaaaaaagaaauucuucaacccugaugacuuuuuguggguuucuauuucccuccuccccuuuacucucacuuaaacagggucaagguugacagucugucucaggaaaaaaaaaaaaaaaaaaggauuuagggcaggucuggagaagaugggguaccuuuggggcccucagagagcacaguggguucuacccuuagggccucccauaccccaauuaccuugcuaggcuuggugggggccacagcuuccagaggaaaggggcugccaggcacgggcacgccgucauaggucaccuccaccucauagggcccuuccucacggggcaggaagcgcaccacacuguugucagcccccaggccuggcuccaccuugcagggcaccgcugcacccgaggggcccacaaucuuggaugccacuuugccuugaccaccagcacccuuugauuugacugugaacuccuggucuuugccaacguccaccucuguggaaacgaugaaaggaaggagagagacaugacacccagcucagccaaucccuggaugugacaaaggccuuugcgacaagggccccaacuacuuacucucucccaggccagacaccuugaucuugcugagguccaggcuuggagauacugccacugagaaagggcucuuagggaugggauccccuccauaagugacauugacgccuacuggacccugggaagggugcagaagggaaggggguauuuagagacaccagaauugcuccccaacccccuccuggaccuccaugccuguccucucccagguaaggaaugagagugggcagaaagucccucggagcuguccccuaggcugcugcaugaggaggcuggggacucggugacuguaguggaggguguggcuaccugcuggacaggcguguacuugacuguguagguguugucaugguggucgaugauguccacaucucgcacugcaucccccuuggugaguccugagaacuggacguccagcuugccuuugccagcagcuuuggcauuuacugugaagugggugggcuugccaagcucgacaccugaggaacacacagggaccauguaggggcacccugccccaagcccuccuacccuugaugccccgcaaccugccaugggguaccuguccucaccagugcgacugaggccagggcccucggccuucaccuuacuggcgucaugagagggcuccaccuugacucggauggggcuggugggcguggccugcaggcagugggaggagaaggccuuagaggagggcagacgucauccgcaaugacaucuuagcggccaggagcgcagcacccaccuggucagcaaagaggaccauaaugguguagcugccagccccccggggcguguacuugaccgugaaggugucauugucauugcggaugaugucgaagucgaugucagcuucggcggggccuaccacuccaggggcacacuugaugccgaugcugacguccccugcggcggggagaggagcggaggcugagaccucgcagggacaccccagccaccugcccucccacccacagccaggccuuacccuggccagccucggcgcaguccacagugaaguaggugggcucgugggccuugagcccugucuuggcuacuccggggccguauacuuugaccuuguugggguggcugccagcucccacauucaccugcagggcacaggggcaagggcaagggcaugagcagccuggaggagacucagaagcucccucagcuacacuggcaggcacacaaaaugguccagcugccuugggaagagucuggcaguuccucaguugaccacagagggacugugugaugcuccgguucacuccgaggcaacuacccaagagaaaugaaagcaaauguccacgcaaacaccuggacucacuguuaacagcacuguucaugaucaccaaaggcaagcucauccucaauaucuguuagcaagugaacggaaaaauggaauguggucuggccacacaauggaguauuaugcggccauaaaaauaaaugaagcggccggacgugguggcucaugccuguaaucccagcacuuuggaaggccaaggugggcggaccaccuggggucaggcgguugagaccagucugaccaacauggagaaaccccgucucuacuaaaaauacaaaauuagcugggaaugguggcguaugccugcaaucccagcuacucaggaggcugaggcaggagagaauugcuugaaucuggcaggcagagguugcagugagcugagaucacgucauugcacuccagccuggcaauaagagcaaaacuccggcucaaaaaaaaaaaaccaggaugggcgcgguggcucaugccugucaucccagcacuuugggaggccgaggugggcagaucacaaggucaggagaucgacaccauccuggcuaacacagugaaaccuugucucuacuaaaaauacaaaaaauuagccggggggguggcgggcgccuguagucccagcuacccgggaggcugaggcaagacaauggugugaaccugggagaaagagccugcagugagccgagaucgcgccauugcacuccagccugggcgacagugugagacuccaucucaaauaaauaaauaaauaaacaaaauaauuauaaaggaacaaagugccaagacaugccaaacaugaacgaaaacacggaaaacuucguggugagcgaaagaagccagacacaaaaggccacauggcacacaguuccaucuauagaacauguccaggauaggcaaagccacagcagaaagcagguuaguggucaccaggagcugugggacaggggagucaggauggugugccacaaccacuugaaauggacgaaucgugugcuacgugaaugcuaucgagauggacuaaaggccgguggagguuggcucacccugaaggggcuguuggggaugcugacgccuccccaggacaccauggcugugugcuucaccggcuuccugggcacguaggagcagcuguaagugccauugccguuguccuugaccaacgccuccacagggcagccuucauuguccugucaggcagauaggagcagguggccugcuggucagugcccaggccugggugcccacaccugcccugcccccaacacccgugggugcucuaccuggacuuggacccgaaguggggccuugccaccgugcuuggcauccacugugaacucugcuggcuuguugacggccacaccugucuucuccaauccaggcccacgugccuucaccuagcgggagaccacccagcugucagggggccagguccaggcugccagagcuacaacccaggcaggguggccagggacacagagugccauccccaccagaccccaagcaggagcagcagggcgagacuuaggccaucacagccugcucuuuacccugucuggguggaaguccuggggcgcgucacggaugucagccaugaaggggcugaggcggaugucuucgcuguugcacagcacgugaacggcauacucgccagccuccugcggccaguagcgcacaucacaggagccgucgcccuugucgucacauucgaucuuagccugcgauggcccuuccaccgagaagccugacaacagccaccaguccccucagugcccuggagccucagggugggccguccuugccaucgucuguccccaggugcccaugcugcagccuccaacuuacccagcgugcccacgucguccccgauagccuccaccacaaagucugcugacuugccaacgacgccgcccuccagcccagggccccaggcccguaccuucugauugccacacucggugcccaccuucacuucgaagggacugcaaaugcgagagccacacagggaacaccgaggaucaccacaugagccagcgugggccccacuguggcggccaggcaggaagagcccauguggccccucaucaucagguggggaggcagaaggaagagaagaggcagagugugcagagcugggagagggaugccugggggccucaccugcgcccgauguucugaccaccccacgugauggugacgauauagguuccagggaccaugggguaauacucgaagccauacacgccaucccccagguccuucugcuucacgcgcuccucucccucugccaagacaaggagggccucaggccugcccagcagugaacccgggggcugccgccacccauccuggccuggcuccaggccaacuuacuggggcccuucacggugaccuucagcuccccacugccagcgcccuuuguguacaccuugaagucagcugucuccuucacccgcacacccuugggcuggaggccccggccaaccgcccggcaggcacucggguuacaggcugcaggcagaggggccagcugagcaccagcagcucggcugggcgaccccucccuugccucccacagggccgggcugucaggauuggugggucccucagagcuuggcuggagggggacaugcaagacagaacuggaagggacugugaccccaggaacuguggccugggccaggacauggcaggccuccucccaccugcuccacaccagcccagagccccccagccucccccuuccaagaagaagacagauccaaguaccguugacccugugggcagagcagagagcagcagguuucuagacagcuggagcgagcucuuccgaaggugaaagcgugaggagagagauggagaggggcgaggagaggagaggaggaagggccccagcaggggaggaaaaacagcaugugcccagacaguagaagcucaaagaguaggggccccggggcgggcugcagcgggacuggcccagggggucccccuccugugggaggcccagacugcagugccacagcagagggcagucagggccgggccuaccuuggccaacagugacaguguaggggcugcgagggaugggcacgccggcaaacgugacgugcacgguguggacgcccuccauggugggcugguagcugcagcgguaugugcugucgccccgggccuccagcugaggcucuaccgugcccuucugucccaugggguccuggaucacaaccucgaccucgcccgugccagcuccugccacgaggcaccugcucagcucccaggccccagugcggcucuccccacagaccagcugggccuuggcagccuccccucaccugccguaaagaucucaaaguagguggucuuguuggcgauguugccacugggcuccaggccgggaccuugggcugucacuuugcuggcgucacccugugacuuauccacguacaccucgaaggggcucuuggcgaugugcuggccagcaaagagcacaguaaccuguccccagaagggugggccgugaggguagggcugggggccuccagccacugccugaggucacaagccuccccccuggccaagggcucaccuuaugaguccccgucaccucggggacguaccagacggagaaggugcgguucuugucguuauuggcggucacuuuugccugcagugggaaggagccugugagccuuugcuaagagcagccccacugaaagggagcgcugcggggccucugcugccagcagcuggcccuaccuccuccugguguccggccggguccuccacguacaccagcaccucucccuggccagcacuucuggucuccacagugaacucugcccgcuucuucaccauguugccugugggcucgaugccuggcaggggaaggcgagccaaccacgggccagcuguuaaggccacagccucaccccuccacccuucagcccucccugcuggccccuaagucaggcacauuccaaacugggcaaguucauucagugugagcuguggcacagagccuggccucgggacccagcugugcucucgcugcugggacaggcccagccuguuuucuggaacauucauucucaccgcacugggcccuuguuccugugugagccuugacuggguuuuaggucccuguuacugagaccugguucaucuccauuuauaauaaagaccgcuggaugcuaccuccccgaggaccccacgcagcaggcuucugugacuggaggaaccuauuagcauucucuugucguuuucacuagucccaaaaacccacucuugucugacucuuggguggcuugaucaccuagccgccauguaacccaagaccccuggggaccgccacguuuagaugggacacugucuuauggggaagacguuggcacacgggugcaccccugguggggcucccucaccuggcccguaggcacgggcuuucuucggguucaguuugggccgcaagggagccccuggcuucagcuuggccuuggggaacugggacagguaggucaugacagagugcucguccacguugggguccacaaucuccucgggggugaucaccugucacaggcagaaaacaggagccaucgggccuccgagucucucccaacugccgauccgguccccuacagcuguagccaggccgggcggguguaccugggggaugcccagccagucauccgccugcugcauggccucucgcgcauugguaacgggcuugcuggcgucccaagagucccagucaggacacaggccuguggcgcaagggaggcugugagucugggggccgcagaacccccucaagggccacccaugggugaccccagcccagucucuccugccucugcgcccccucacccggggcacagcuguccaccagggcgcccagggcccggccgcucugccagucccggcugaaguuggugaugggcagcugcggcagcuuguucuggauccagcccaggagccucugcuugggggucugcuucuuggccuccucauccuccuccucgucccacaugggcauggagauggaguagugcaggaucaggguccagaugaggcccaggaucagcuucagguucccguccacgauggccuugcugucugugaguagaagaguggccacgcugggcacacggcugugcgggaggggccgaucccaggcuuuggggucagggucuggcagcacgggguagcaggggccaaggaggagguagacacccccucuuggccagugguaggauguggaugaggcccucucugcccagggucccaggggguguucagaggugaaggagacuuuggggugagggcagauacacacagacacacacacacgaugccagcaggguaugauuacugccagaagcccugggcccagaggaagggcagagggcagacccagccugcagaugggcagcucuggagaacagcuggacaguguccacagcugccagagcagggguccgccacacaccucaggggccuauggggaaccaggaggaggaggcugacuccagcuggcccagaauccagggcccaugaccuggaguggggcuggggcugaggaagaggaagguggguggcccugggugguugggaaauacaacuguuguuccaggguggguggggugaggcaggggaagugggggaguugggcaaacgcccuuugggugagggauugugacccccgccaccacccccacuuccucuaccaccucgaagacucaagcuuggaguugggaggccacaggccuagccaggggaggggcccagagcccaaaggaaccagcaguugggccacauggcccugacucacuggggcccaucgggagaugccgggguggcagcaggagacacugggaacccccuugccacccacugccugacccacuugccaccuaacgggccucugggccucggcaggcucgccacaggggaagugguuagggcgggucccugacaccccccaucaccauggcaacccugcugggcucugggccccacccaaggcuacuucugggucucaggcucaaggcaggauggcucaucuuuagaagcccugucagccucccccauaaucagacaaaauacuucucuggugagucaacuagggggcgggccuaugaggaggggcugggcuguccauggcagcugcuucccagcccagcaggcagcaccuggagggccaggugagccgcucagaguggccuccccaguucccagguugguccuggccccacgaggcugccuuucacucuccccaaauggcagcagggagggggacucggagaggaccaagggugcagggccagggaacaaggccagccagggcuucccaucaggcccccaccccaguccagccucagaccccucaacgacccccacacggggagcaaccaggcccaccagguccauguuaggccagccuacuccguccccaucccccucccaaaagagagagggaaggaccagggcccagggcugggagacugucuggcuggauggccccgccccaucccaccccccuuuccccagccccugggccagccaaccccucccuccccuaaucacugcugcuuuccaacauuuuuuugccuuauauggcaaagcucugggaacuaggccugcuccagccagcucacaaggaggaggggagcugggaggagggaggagacccccccuaaagagcugggguguggcccgccuccccacauccggucgcccccccuaccauccaggacugagaugacucagcuuggcuagacugaggcugggacuugugggggugggccugccccucgccucaacuggcauuccaaagaaagaacuuugguucuugggaucugcccucugaguggcugggggaacccaagucuuggucccucacuuucuuggguucagcaagggccauuccagggcugcaggguaacuggaaggccucucaauucugaagaagagaagacucaucaucccucuccucucccuguuccacaucacccccgagucacccauucuggggccugcccucucaugcagccccuaucuugagaacgaauugggcugcugcagcaggccuggucaaugccagccucuccaguccagugacacagacacugggcuggcacaaugcacgcuggagcaucuaccaaccaacuccugcgugcuacacgcagaaaagcaaggccuacauggaagcaagaguuuggcccaagaugaagagaaaaguuggcguccaaguagucuacaagccaggucucucagucaaccacgcccaacucaccccgggugcaguuuugcuaacuaugcuucuuucuggcccccagguugccuguguguguguggggggguagaucuaaacuggugguuggagccaucuccgaugggcgacccauccuccagggacacaaagagcccagagccccagacaaugggacgcacgagcuccaacccacacuucagaaccaacgggccucugaaggccagagggcccucucuaaacagcuguggggggagagcccgggccuccuccuccucggggacggggcgcagggccaggagccugcccagugcccgaccccccaggcccacucccaccgcgagcacagccgcggaggcgcggccugcggaggaugugaguucagccugggcgccggccagccggggcgcagcgggcgggggcgcguagcgguucgcacgcccggccggccagccagccagcccgcgcgccuuuguucugcaggcccgcguggagcagagcagccggaggccucgggaguugcgcugcggcccggaagggggugguuuggagggguccgcccggggagauggaaggacgcacggaguccccgcccccgcccgcccggcgcuucggggcgucccucaccgauggacaccaguuugaugcucucgcgguccaggaacucgagcgccaccgacacguucucaagcugcauuuggcggaaagugggccgcugguugugcuugcggugcaucuucuucuggcugagcaccuccaacagcgcgauaagccgcagcccgucgcucagguccgucugcagguuggcgaugcgcuugcucacgcacuucaggugcucguugcaccagcgcgugaaaguguucugcuggaucuucuuccacggcgcguccuccgccagguccuucucgguggccggcaucucggcgucccgcgugucgacgccgccgcccggagccgcgccugcugcgcucuggcccgcccgagagugggagcuacucauuuugaggcgcgagaagccgggggggcggugcugcagccucggcgaggggacggcccuuuaauuaaagucgcaggcaccuaggcgcgcgggaggcgaggcagggagcagagguugcgcugcggagagagcgagcccuuuaaaugcgggaggagggcggggccagagggcgggccuccugcggggaggggccgugggguggggcuucgagggcgcgccugccccaccccgccccgcccguuggaaugcccccacuaggcccccggguucggcugaucagacgcgaaacccgggcuccagggugggucgcugggcaguggggugggcaaggaugcucccagccccgcagccucgcguuggcgcugcaggaaacgcgcccuagagcgaggaaaggcugagcagugucuggcgcgggacugcuuggccugcagccggcgcgccuuacaagggacuuuccuuccccagggccccugcggggggugggguggcucucuucccuaagucacuugggcucugccccgucccugcacaucccuaccccccgccgucaucccccuuccccgggcccccagggccuaggguuccccggcggcauccccguccgccggcccggcagcggcgggaaggggccaacccuaagagcgaaccccuggagagcggcagccccggaccaggcacugccgagggcgcuuugugugcucaucaccugggaagcggcugcagggcaaggccugcgccuacgcgguccccgcagacccccugccacgggcccgccuucccaguccguagggcccucgcccgcgcaccugugcccgcugcuucccaccgccucccucucugcuucccuccacccgggaggauauggggcacugggccaggaggccgccggcacuccaggagcaagcagccuucgaagggguccgggcaugcccacgggcacgccagugggcgcgggcagagggcgccgugcgaugcaugcagagacgugugcccgccuaacccuucaugccaguucacccggggcacuggggggagcugaagcgggggguccucuccugucggaaaguccccucagcccagcguggccagggcagggggcaaacacgggaguggcauuccagacccagaggggccugcucagagguucccauaagacuugucaggcucugagcaccugggucugggugggcuucaggugugguggcaggugcagaggaggccugaggacagggaucaggggccugggggguuguguccccagagcugugggggcucuucacucaaaauuuucugguagauaacucuggagauggugcaguggcugcugugccgagauguagacugggaccaggggacggcuggggacgcucacugcuacuaucuucagucagaagccagccugccuauggcuuccuccccauugugcacuccccucccucucaguccucgguaccuccccucuccagaauguuuccuccucugaguguuuuuuuuuuuuuucuaggaaggcagguaucugucccuccuguucaauucuaguaauaauuaauuuaucugcuaaagaccagugagagauggaggcccuggguuggccagcacgucaugcccaaauaugguugacucuccuguagcccugggugucuacaugacacgugguggggcugugauccgcccagcacauucacuucggggcagccuguggccccacugguuuuucccacuaguagugguguuagggggugcaaauggcauuuuccaguacugaggccaaccccuguauauuguccccucuccugaccacuuugagacacaccugcaccaagugcgccugggcgucugggagcugggguggaggugggagggagggcugggaagggggaacccauacagaccccucccugcacgggccccauucaagacgggcuugaaguuguccuucuggucccccugccccacuggaaagcaaguucccaggcacggaauuccaucaauaauugacucucucuccacuaagggccauugagcuggguugucuggguucauuccuuaaucuucagagcucagggaaacugagucagagugaccaguggucaauuccagcagaaagagugucaggaggugggugccgugucuuccagcccuagcuuuucccuauuuagaggaaacaaggaaugggcguguagaggguucuugucccuagaacauaguaucaaccgccagaugucgcccgaucccaaagccaccagaucgggcaguccugggaagccaaaauccagcucuuucauauuuucccuuauuuggaguagauucuuggauguuaggcacaccccgcccaccacaccaccccuggcccucagaccccaggccagacccucccacugggagguauagcccaagcccaggagcuguucagcugggaucccuaaggagcuguuuccaggccugcguagccagggggcgcaggagggaaggaagccgcagacuggcaaggugagaagagaccugugcuggcaaguccaggugcggcaggugaggucgcccauucccaagcucccaccuugacggugcacucggagcacuuacaaaugggucugccaguggauuuuaaccuauuuugccuggccccagguggcacgggaaucuggggacauuguugguuauauccuggcuggcagugcgcauccaacucagagccaaccuggcauagggcccagggcccaaccaaggaaccuggccuggucucauccucaccauggcccccauggaguagagcagccccagaaccagcuccccugugcccaaagcagcuggugcccuguggacucgagccagcaagggacacgcugucccccucccagugggcacacuggcugagaaguguccuuccagguggccacucgcccugaguccacacaaguuccuggugucagggcccuucucucucaggcaugcagugguccguucaugggcaagugcccagacacccucucucucucggggaccccccauggccucaggcucccacauucgugggcacagacauggcucgugggucaacuagggaagcuauucucuggacacucacucccagaugccaggggagccuccaucggcucacgcaucccagcugaaccuggcccggaccugggcgcgagcuggcgccugcguuuuccggccucucugcccgccuucuccaaccccgcccccggccgacgaggagcgcggcgacccuacggcgcgaagccgggccgcggagaccucaccugcuguuccugagagcgaccggugaccgaugaccgcgggguggcgcccggaucgccuucgcgcccgcgcccgcgccaggcgccucggggauucugucggcguccgcugcgcgcgacgcgc

SEQ ID NO: 19040 - RNA, 1595 nt, Homo sapiens
ccacgcaaaggagaauggaagcaaaacuuuauuccucuuggcuggagaagagaacuagugggugguuguguacaggacccccaucccucaccccucccagaaccaaagaagacaagcagcgccaccaaauggcucccucugcccaagugaaagccgagaggucagcggcuggcuggggaggcaggugagcgcagcacggcacagggcaggggcggcugcagugacaggcgggcggccagggcggccugggccgggguugaggggaagagggcggggcugcuuggguagcggggcaggcuugggggcugccggcuggcacgggccccagacucagggcaccacaacgcgguaggggcugccugggaugugcucguccccccauuugaccaccaguguguacucccccuuguccuugagcagguaggacacgcuguagagccggcugcccacgugcuucaccaggaucuccucgcaggggguccuugggccaugaacccccaccagcagcauguuguugccugaggcaagagggguccucagucccaggucccagcccccuuccucccgcugguguccugcucuccucuccugucccuaagccaguucuggggugacaguucucucuuccuaaagagcugccagcaccuccccaacccaggccagcuuagcagauuccagcuccucccuggucuuuguuugagggguccaggagguggcagggagguggcucuagaagugaaagccacgccccaaaggcggucccugcucucccagacacuggccauccugugauuucuggccucauuuuggugggaaggugggccgggggcccggguugcccaccugcuuugcugcagucuacugugaagcugcucuucuggccuacguaggccuugcucagccccaggcccuuggccaccaccuugcuggcgucagcaggcccaggacccggggccccaugcuggggggcacagguggccuuggucagagagucuacaaacacugaugaugucucguggaggcugugguugcugacgagacgggggccugcaaggcagaguggguggggcuaagagguggcuguggugccgggcguugggcagaugccaauagcuuggccccaggcucaccugugacuuuggccuugaaggggcugcccccaaugugguaggggccgccguacuugauggagaugagguagcugccaggugccauggggguauaggugacgcgguagcccucagggcacuccuggcaauccaucuucaccuuggaggggccgucaauggucaccgacagggcaccagcucccgcauugcucguguucacgacgaacucagcuggguucccugggagcacaggaggucaggcagagccagacuggccugccucccuguccucggccacccagcacaggcuugucaccuccaggugccuccuguugucaccaagagcuuggaggcaagggccuagcagcugugugcacacgugcagccgcaccgacagacuuaccugugacaccgccuuccagaccugcuccguaagcagacaccaagccuggguccccuccaugcccaggcuccccaacucggauc

SEQ ID NO: 19041 - RNA, 1595 nt, Homo sapiens
gauccgaguuggggagccugggcauggaggggacccaggcuuggugucugcuuacggagcaggucuggaaggcggugucacagguaagucugucggugcggcugcacgugugcacacagcugcuaggcccuugccuccaagcucuuggugacaacaggaggcaccuggaggugacaagccugugcuggguggccgaggacagggaggcaggccagucuggcucugccugaccuccugugcucccagggaacccagcugaguucgucgugaacacgagcaaugcgggagcuggugcccugucggugaccauugacggccccuccaaggugaagauggauugccaggagugcccugagggcuaccgcgucaccuauacccccauggcaccuggcagcuaccucaucuccaucaaguacggcggccccuaccacauugggggcagccccuucaaggccaaagucacaggugagccuggggccaagcuauuggcaucugcccaacgcccggcaccacagccaccucuuagccccacccacucugccuugcaggcccccgucucgucagcaaccacagccuccacgagacaucaucaguguuuguagacucucugaccaaggccaccugugccccccagcauggggccccggguccugggccugcugacgccagcaaggugguggccaagggccuggggcugagcaaggccuacguaggccagaagagcagcuucacaguagacugcagcaaagcaggugggcaacccgggcccccggcccaccuucccaccaaaaugaggccagaaaucacaggauggccagugucugggagagcagggaccgccuuuggggcguggcuuucacuucuagagccaccucccugccaccuccuggaccccucaaacaaagaccagggaggagcuggaaucugcuaagcuggccuggguuggggaggugcuggcagcucuuuaggaagagagaacugucaccccagaacuggcuuagggacaggagaggagagcaggacaccagcgggaggaagggggcugggaccugggacugaggaccccucuugccucaggcaacaacaugcugcugguggggguucauggcccaaggacccccugcgaggagauccuggugaagcacgugggcagccggcucuacagcguguccuaccugcucaaggacaagggggaguacacacugguggucaaauggggggacgagcacaucccaggcagccccuaccgcguuguggugcccugagucuggggcccgugccagccggcagcccccaagccugccccgcuacccaagcagccccgcccucuuccccucaaccccggcccaggccgcccuggccgcccgccugucacugcagccgccccugcccugugccgugcugcgcucaccugccuccccagccagccgcugaccucucggcuuucacuugggcagagggagccauuugguggcgcugcuugucuucuuugguucugggaggggugagggauggggguccuguacacaaccacccacuaguucucuucuccagccaagaggaauaaaguuuugcuuccauucuccuuugcgugg

SEQ ID NO: 19042 - RNA, 2587 nt, Homo sapiens
cagacagaccgccuauauaagccaugcgcaggcggaggagcgccucuuucccuucgguguggugaguaagcgcaguugucgucucuugcggugccguugcugguucucacaccuuuuaggucuguucucgucuuccguuccgacucucucuuuuucguugcagccacugaagauccuggugucgccaugggccgccgccccgcccguuggugagucuugaauccguguacuuucacugcugggaaacgggcggggaaagaagugccuauggccgcugaaaacaauugugggguggagccucccccgugcggcggcccugucuugggaacugacccuauguuuuacaccucccggcuauuuuuuagucugcaauauuacugucuguuccuucguucccgugucgguguggaagcgacgguucccucguaucucugccuguguccugcaagcucaccgcauuuucgggcgcuagauacgcucuuggggccuuugugugcguucucugucuuauuuccgggcgacgugccgcgugcguugucggacgugaagggcaguccgggaaaaacgggugcggccgccuccuguguccuacagggggcgccagacgcauuuccacucggcuuggagguggauuuagugccacgugcccgaaagucuuaaauugggugaccugagcugugcaaugauaaugcggcgauuuuguaguacgcagugucuugaagagagaauuuuuaacuaggaaaguuuguugcaaaguguuuauaggaagcguaagacaaaguaacggaagauggugucuguuguuucuagucuuggguguugucuguguugcagcagccaacuguugcuuuguaguuuauuuccccgaauggaaacgguuuagaaguggacgugcauuccccacccuuuucccgucccucguuuggguuguuccuugaggggcaaagugccuguugggcuuucugugaaccucaccuaaccuguguuuuuucacuccccugcaguuaccgguauuguaagaacaagccguacccaaagucucgcuucugccgaggugucccugguaaguaguggaagagccccugcacugguuggcucugcggacuccgcguccgucugugacacccccugcacacuuacccaauccuuuuagaugccaagauucgcauuuuugaccuggggcggaaaaaggcaaaaguggaugaguuuccgcuuuguggccacauggugucagaugaauaugagcagcuguccucugaagguaaggcaggauucuuuguucgucaccccccaguccuuccuccgugcucccucaaccccacccacauacacugcacuggaauugggaguugaugaaacaugagccuuacaaaacucagccaacacaguuccccugagcuggagauagucguggugaauguuucucuauuaucuucucucacuuugcugcuuuucuucucccuaccuagcccuggaggcugcccgaauuugugccaauaaguacaugguaaaaaguuguggcaaagauggcuuccauauccgggugcggcuccaccccuuccacgucauccgcaucaacaagauguuguccugugcuggggcugacaggugagcuuggucugggccuuuuaaggcaguuggagucucuacauuauuaggcuugcauuauuuuaucagagcauagagguggccccagugacucagccacuauggcuacuagaaaagccaggcuggcaagugacuuucaguggucacucaggaccccuuccugcagauacaaacaaagcaugaguaagucuuagcaagcucuuccccacagguuaggggaaacacuggugaugggaguagcucuucuugcuuuuagcugaaugacaaccaucuugccagcagguagcugaagcuggcagaggagcccaguggcgccuuuucagugguucuugggaugcuccgcagccaauuaagccgacugaguuccuuuccucauggggacccagugugcgauggcugcacacagcagcuuccuugguaguguacgcagccuguugguuguauggguugcucuaagggaccuuggagacaggccuuucagguggauguucauguuucugaccuugcacuaccccaauguaggcuccaaacaggcaugcgaggugccuuuggaaagccccagggcacuguggccaggguucacauuggccaaguuaucauguccauccgcaccaagcugcagaacaaggagcaugugauugaggcccugcgcagggccaaguucaaguuuccuggccgccagaagguauguagugcugcagcccccuucucccaccuuugccccaggccuccugacucaguucuuuccauugcuccuuagauccacaucucaaagaaguggggcuucaccaaguucaaugcugaugaauuugaagacaugguggcugaaaagcggcucaucccagauggcuguggggucaaguacauccccaaucguggcccucuggacaaguggcgggcccugcacucaugagggcuuccaaugugcugccccccucuuaauacucaccaauaaauucuacuuccuguccaccuaugu

SEQ ID NO: 19043 - RNA, 12137 nt, Homo sapiens
agucuucugucccuguuguuggguucugagucccaguguggcugcacacuucugaguuagggguguuugaugcaagcgcucuggagacccaaagagagggacaguccacacaugaucuggccacagucgugaagucaagggaggacugaggaucugccccagagaggaggagacccagggagcuggcaguccaacguccuggggguccugcaguaaugcuguugggacaaaugaggugcucggacagggucugugagcaggagguggggcugaauccacucagcuucucaugggauggcuguagcuaauggauucgacgugguaauagaaggcuggacaaauuuuaaaaaaucaauaaauuaugggcugggcgugguggcucaugccuguaaucccagcacuuugggaggcugaggcggguggauacgaggucaggcguucaagaccagccuggccaacauaaugaaacccguuucuacuaaaaauacaaaaaauuagcccggcgugguggugggcgccuguaaucccagcuacucaggaggcugaggcaggagaauugcuugagccuggaaggcggagcuugcagugagccgagaucacaccacugcacucgcacuccagcccgggcgacagugcgagacuccaucucaaaaaaaaaaaucaauaaauuaugguuuaaaaauaaaaaacaggccagguaggaugacucacacuuugggaggagaggcaggcagaucaccugaggccgggaguucgagaccagcuugaccaacaugaagaaacccagccucuacuaaaaauacaaaaauuagccaggugugguggcuugcgccuguaaucccagcuacucaggaggcugagacagaagaaucgcuugaaccugggaggcagagguugcaaugagcugagaucucgucacugcacuccagccugggcaacagagcaagacucugucucaaaaauaaaaauaaauaaaaauaaaaauaaaaaacugccgggugcggcggcccaugccuguaauccuagcacuuugggaggcugagguggguggacugccugagcucaggaguucgagaccaaccugggcaacauggugaaaccccaucucuacuaaaauacaaaaaaaaaaaaaaauuagccgggcguggcgaccugcgccuguagucccagcuacucaggaggcugaggcaggagaauagcuugaacccgggaggcggagguugcagugagccgagauugugccacugcacuccagucuggcgacagagcgagacuccuaaaaaaauaauaauaaauaaauaaauauaaaauaaaaauaaaaaacuggcugcuuaaugcauagggggcuuucuuuccgggucaugaauauguuucagaacuagagguaguagcugacauugugacuguaucagaugguauaaaauacuguuucuuguauuacauaugauacacaauauguuuguauauauugcuguauauauuguauauuuugccauacaguagauuauacauugcuacauacacauaguaucauguaguacuguaacuaugucaaauuguauauguggcugggcgggguggcucacggcugucaucccaacacuuugggaggccgaggcggguggaucagagugugauggcgggcgccuguggucccagcuacucgggaggcugaggcaggagaaucgcuugagucugggagaucgaggcugcagugagccaugaucccaucacugcacuccagccugggucuggcuggacccugugucaaacaaaaaacagaaacacuagagagacaaaaggcgagcgcaggaggcugccaggaagcgggagccccacggggugacggccacuucccgccgccccggggcuggccucgcugccgucaagcggcccgugcgcgcuuugcgacagucggucgggcugggcaccggcgcagguucgcuuuccggcgguugcaccgggccggggugccagcgcccgccuucccguuuccucccguuccgcagcgcgcccacggccugugaccccggcgaccgcuccccagugacgagagagcggggccgggcgcugcuccggccugaccugcgaagggaccucgguccaguccccuguugcgccgcgcccccuguccguccgugcgcgggccagucaggggccagugucucgagcggucgaggucgcagaccuagaggcgccccacaggccggcccggggcgcugggagcgccggccgcgggccggguggggaugccucugcacgugaaguggccguuccccgcggugccgccgcucaccuggacccuggccagcagcgucgucaugggcuuggugggcaccuacagcugcuucuggaccagugagugggcccaggccgaggcaggcccgcccggguacccaugcccggccggaggugggacuuagggugggggacgccgcggccccgaccuagcgggcgagcccggagcgccugaccucuccuuccccgccagaguacaugaaccaccugaccgugcacaacagggaggugcuguacgagcucaucgagaagcgaggcccggccacgccccucaucaccguguccaaucaccaguccugcauggacgacccucaucucugggguacccgggccagugugcugggcagggggaggaaaggcgaggauucgggacgggcccagccucgucagaacaaaccccuucucgcugccuuuucauggagcccuggcacuccgguuuccgggcguucugccccagggcugagacuuggauuuguggcuccugcagcaucccugagggagcaugauuuggagagggccuugggcauggagcaggaccaaggaacggccacagggcauaucuuacagcuccuuuaacgucaggccuccagaacccucuguucucuaaaccauccagggccccacagucuugggaaaaauuuggggguuggacauaggauauccugugaggaaguucugggccagggacuggaagcccaguguccuggcuucagguuugccccuggcugggcguguaccguucagcccuauuugggagccugguugccacaccuagagguuccugcucugcugacuucacaggaaguugcuuggcucugguaaccagauggccggguggaggggugccuggggcuuccacuccugaacagagagcuuaacuguccuagaguucauggggagccaccuagccacacuggagcccuucagagcucacccuggcugcuggguggagaaaggccuauagaugucacagguggauccugggaggccaggaaggaggacuuggagccauccacuagccuagacugggcugguugcagugacaguacagggagaaguauagaagaaugggcauuguccaaguauguuggggagguaggcaguccaggugcagugauuaguaagauguggagggugggggagagggaggagccagggagaacugaaugaucuggccuaagggucugaaagaugccacuuugggcuguagggaaaugguagugcugcugucccucauucccugagauggggugaaggaagggcacucccuggggauaugggaaguuggggcaugaagccuuuccuguccucuagggauccugaaacuccgccacaucuggaaccugaaguugaugcguuggugaggaggaaugggccccucgaagugggccgggccggccccaccugccucugcccagauuugcccuccuccugcucugcccaggagguggcguccagcaguccaggcagggcaugggguggggccccgcaggcccuccccugugccucccuucugcaugcugaugcugggggcagggugguggagcggggugcagggggcaggacuaauugcaucugucccugcuuaggaccccugcagcugcagacaucugcuucaccaaggagcuacacucccacuucuucagcuugggcaagugugugccugugugccgaggugagcugcuccuccagcgagugcagggaggcacuucuggggcaggaaagcugguggccagugucucuguuuuggagggaccuauggggguaggcaucccgggagccaacaugaggcccagcuccaucacaugccagcagaggggacagaggcugugggaggagggauggguccuuggaaaguccucaacucucugcaacugcccagggauccuguggaccuggagccuuggcauuagaauucaaggaggcauuauccauaaccccuucucucagggaugucacuaagagacucauugagaacagugcguugucauugguccaugguggcaguagcauguaccugcaggccagaggguuuugcuucuaggagaacaaacaggcuuguggggugagaaccccaggggauaggggccauuuugaucccuauucuccagacagggaggaucacagagauuaagcugcuggcccaaggucaugggguaggagguggcaaagccaggauuugaauccagauugcuccuuccucugcaggagcagaauuuuuccaagcagagaaugaggggaaagguguucuagacacaggcaggcacaugccaggugcuggaaaaagaagagagaaagguaagccaggcauagcgguucacacuugucaucccagcacuuugugaggucgaggugagaggaucacucaagcccaggaguuugagaccagccugggcaacauaguaagacccugucucuuuaaaaauaaaaauauuuuaaacaaaagaaagguagaaaauaugaguuguauguagaauaugaagguucuagaauaauccuauuaagaauuuuggauucuggcugggcgcgguggcucacgccuguaaucccagcacuuugggaggcugaggccagcggaucacgaggucaggagaucgagaccauccuggcuaacacggugaaaccccgucucuacuaaaaauacaaaaaauuagcugggcaugguagugggcgccuguagucccagcuacucgggaggcugaggcaggagaauggcgugaacccggaagguggagcuugcagugagccaagaucacgccacugcacuccagccugggugacagagugagacuccgucucaaaaaaaaaaaaaaaaagugccggccaugguggcucaugccuguaaucccagcacucugggaggccgaggcgggcggaucacgaggucaggaauucgagaccagccuaaccaacauggugaaaccccgucucuacuaaaaauacaaaaauuagccgggcgugguggugugugccuguaaucucagcuacuugggagacugagacgggagcauugcuugaacccgggagguggagguuguggugagcugagauccugccauugcacuccagccugggcaauaagagcgaaacuccgucugaaaaaaaaaaaaaaaaaaaagaauuuugaauuagcuggcugcauuggugcaugccuacagucccagcuccucaggaggcugaggugggaggaucacuugagcccucgauuuucuuuuuccuugagacaaugucuguuucuguuguccaggcuggagugccguggcgugaugauggcucacugcagcuucuguuuccuggguucaagggauccugucaccucagccuccugagcagcugggacuaaggagugugcccagcuaauucuuuuuuuuuuuugguagaguuggggucuuacuacauugccagggcuggucuugaacuccuagacucaagcgauccucccgccucagccucucaagugcugggaucacaggcaugagccauugugcccaacccagcccaggaauuugaggccagccugagcaauauagugagaccccagguauagauagauagguagauagauagguagguagguagguagauagauagauacguagguggguagguagguggguagauagguagguagguacguagguagauagauagauagauacauacauacauagauagauaagauagauagauugauuagauagauuagauagccaggugggguggcucacgccuguaaucccagugcuuugggaggcugagguggguggaucaccugaggucaggaguuugagaccagccuggcuaauguggcgaaacccugucuacuaaaaauacaaaaauuagcuggaugugguggcgcacgccuguaaucucagcuacucgggaggcuggggugggagaaucgcuugaacccaggagguggagguugcagugagcugagaucaugccacugcacuccagccugggccacagagggagaccuggucucaaaaaaaaaaaaaaaaaaaaaaaaaagauuuuuguauuugacugugcucucucauccagguggugacaugcuuguaucugugguuaagagguaguaucugccgggcgcgguggcucaugccuguaaucccaguacuuugcgaggccgaggcgggugguucaccugaggucaggaguuugagaccagccugaccaacauggcgaaaccccgucucuacuaaaaauauaaaaauuagccgaggcugggcgcgguggcucacgccuguaaucccagcacuuugggaggccgaggcggguggaucacgaggucaggagaucgagaccauccuggcuaacaggaugaaaccccgucucuacuaaaaacacaaaauuagcugggcaugguggcaggugccuguagucccagcuacucgggaggcugaggcaggagaauggcacaaacccgggaggcggagcuugaggcaggagaauggcgugaacccgggaggcagagcuugcuaugagcagagaucgcgccacugcacuccagccugggugacagagcgagacuccgucucaaaaaaaaaaaaaagagagagauaccauuccaguugcaauguggcugcagcagggcuagguggacaugaggagcccaguucagggcugucacaguagcuccagcagcagaugauuguggcugggccucccaagugucacguuggagaaccggagaaggggacuucuuugggauguacucuggacuuguugauagauuaaguguagguggggugaggaagagaacucaaagaugacaccagguguuggagcugagccacggggagaagggugcaaagggaaagcagugcgggggcugggaggggagagggucaguccuguuuugcuugugcugcaucugaggagccccucaccuguggaaggagagcagucccagaggcaguggggugugcaguucuggaacuuagaagaaugaucagggggcugggugcaguggcucacgccuguaaucccagcacuuugggaggccgaggcgggcggaucaagaggucaggagauugagaccauccuggcuaacauggugaaaccccaucucuacuaaaaauauaaaaaauuagcagcgcaugguggcaggcaccuguagucccagcuauucaggaggcugaggcaggagaguggcgugaacccgggagacggagcuugcagugagcugagauugcgccacugcacuccagccugggcgacagagcgagacuccgucucaaaaaaaaaaaaaacaaaaaauuaucaggaauaaagauacugggaauucaaccacaaaaaccacaaagucacgaaugcagagugagagucuucagagagagggcagaggcccaggauggcacagagggagagagaagccaccaagauggcagggagccauggccagagagaaaagcaaaccaggcgccuguggcaccauggaagcagcaggugaugcuggagaagcguuuccaugcagugacagcugccagagccagauuauuauggccugagggcugguggugcugcaguugggggggaauggagaccgcagcgggggaauggagaccgcaggggcggcaacuccucccagagguucaguuuggaggaaaaagagacagaaggaaggguaaccaaaggauauuagaggucaaggagggguuuauuauuucuagcuggucaaaguagaaugugguaaaacccaauaaaguaacagcaaauaacaaagaggggcuuuuaauggaaagcugcagugccugccccucaccucccuagccccacuccucagaagcagcccccuggagcgguuucucuuucugcugcuuuuggaggcuacuucugucucuguaaaggaacuucugucucuguaaaggaacaagcagaggccacagugucuuggcaaaugaccguggcauuguuuaucccaaccugcucugagagauggggacucugcugauucaccccucgucccugccucuuuaguuccuucagcaaagaacuaauaauaugucauuaaggcaaaggcaguauuuggcacacuuggcuucuguguuccaaaaaauucccuuuuucuccaagcguagauuuuaauaugguauuuaaguaucaaagugauuugacacaagugacacaagugagcaguaguagcauuugcaaaagcuacaaaugaugaagucuugcuccaaaagcauauuauuauuauuuuuuaaauuccaguuucaagcucaauggauagguugcgucaguggguuuuaguagagaaggggccaguaccuaugaagacuccccuguacuauuacacaugcugcgucccaaguagggaaacuccagugggucaucacccccucccucuagcccaagugggcugcugggucagggcacuguuuggguuggguugagauuccuggaucccuaacuagcaccuuccaaagaaucggccuugcagagaacaaaguucauugccaaagguauucccaaugucugucucucgcucugugauagggcuucuuuacuccccacuuuauaagaugaggauaucugcuauaccccauuccuucaaccucuccaccucuuuccucuuuugucugccaugugauuacuuuuccaucaccaagguugaugagauccuuacuguguacuuacugucuccaagcauccccaggcuuccagccagcacgcagcagccaacauuggcuucagaaggaaggagguuugcauuuccuucucuuggguccagugccauggucucaggguuaucuccaauguggaaaguugcuagaccaggagcaguuugacuccacuguuuuucagucuagcaaguuugaguuuuucccaagcucuugauguguguucaaaugaauguucucccuuucccaagagaccucccuauaagggagggucuaguuucccggggugcccugagaagaaggggucagcaggggggaggaaugguggaggcugaggccucaggcaggugcccugugaggaguggcugugacaagcggcugagaucccagcaaaggguuguugcccagaaucuggggccuaagcgagguuggaaaucacaaaugcacuugguuucucuagcagcuggcacauaguaggaucagcccaggaguggcaccuucaaagagaaaggaacgcaugaggcuccgagagcggucggcuggcagccagggccuggcuggggagggagggcagguggugcgcugaccuggggaucuuugagagugugcaggaguauguggcugaagcggcccagcuggugagccacugaagaugggggucauagguagauggaggaauugccaggucagaaucucgguaggagaugacuugagcugaugcugccuggcacauagggguuuagaagauauuaggaaggaagccccacagcgugcccaagugccaugcaggcccuggagacggucauuggagggcgucuguggauggcgcagugggggaugggaagucccuaaucugcuggggcuuucccagcaagcagggacugagggggauaguccccaacacaugggccccagggagaagggccuguuucauugagguuuggagaguguugaggguaagcuaaccugucaccccacgcccccgagaaugguuacugauagggagaggccuuuuccuugcaggagauggcgucuaccagaaggggauggacuucauuuuggagaagcucaaccauggggacugggugcauaucuucccagaaggucagcagggcugacugggucgagcccccccaguaugagcgggaugggcucccaagccucgccucugugcucucucaccagggaaagugaacaugaguuccgaauuccugcguuucaagugggguaagggcugcuggucucuggccacagccauccucccggcccagagauggcccugugggccccuggcucccgcccccucgggcuggcuuguauggggguagaugggcguguuuguagcgccaggaaggggacaggugcugagacuaggccugccucucgcaggggcuugcccaagggagcugaauugaacuggaggaugucggggguggcaguggccagaggcuggcacagaagcuuggcucagggcccagcuuaugcuaacauuucuaccuccccccugggcaggaaucgggcgccugauugcugagugucaucucaaccccaucauccugccccuguggcaugucggugagccuggggacggggacagagagauggcaucugggguggggggccugggacucccucuggucccaggcugcccugcuccaccccacgucuggccuucuguccacugugcugcaggaaugaaugacguccuuccuaacaguccgcccuacuucccccgcuuuggacagguggguggggacugcugaccuucggcugucugccugucugcugucugcuccgugucucccacucagcacuauggaggccagcugcaggaggagcugagcaugaggcuacagcaggggacagaguggaacauagacagggacuuccuggcaccgagacauuaaaaugagagcagaggaagucaggcuggggcagaggugggcuguggggucaggacaggacaggucaucuacagcacaggacccaggaccaggaccuuguuuuagaggaagaguggccccuggggaguguguggcacagcagggccggggcuuagcuucuggcucccggguugcuugggcuggggcugugggcacuccuacugcuccucaucacucuuggcggccaccccacagaaaaucacugugcugaucgggaagcccuucagugcccugccuguacucgagcggcuccgggcggagaacaagucggcugugaguuuccuccugggucccccguagcuguccccggacccccugcugcuggcuuccagcagggugccuccacccucuccaucccgucacccucccagggcacccucccagggcaccuuggccaagcuucccgaggggugcaggccaucccugguccuuucccucagguggagaugcggaaagcccugacggacuucauucaagaggaauuccagcaucugaagacucaggcagagcagcuccacaaccaccuccagccugggagauaggccuugcuugcugccuucuggauucuuggcccgcacagagcuggggcugagggauggacugaugcuuuuagcucaaacguggcuuuuagacagauuuguucauagacccucucaagugcccucuccgagcugguaggcauuccagcuccuccgugcuuccucaguuacacaaaggaccucagcugcuucucccacuuggccaagcagggaggaagaagcuuaggcagggcucucuuuccuucuugccuucagauguucucucccaggggcuggcuucaggagggagcauagaaggcaggugagcaaccaguuggcuaggggagcagggggcccaccagagcuguggagaggggacccuaagacuccucggccuggcuccuacccaccgcccuugccgaaccaggagcugcucacuaccuccucagggauggccguuggccacgucuuccuucugccugagcuuccccccgaccacaggcccuuuccucaggcaaggucuggccucaggugggccgcaggcgggaaaagcagcccuuggccagaagucaagcccagccacguggagccuagagugagggccugaggucuggcugcuugcccccaugcuggcgccaacaacuucuccauccuuucugccucucaacaucacuugaauccuagggccuggguuuucauguuuuugaaacagaaccauaaagcauauguguuggcuuguuguaaaaugu

SEQ ID NO: 19044 - RNA, 7934 nt, Homo sapiens
gcgaggcggggcucgggcgggggcaacggucaccugaucugcggcugucgaggccgcugaggcaguggaggcugaggcuaugauggcggccauggcgacggcucgagugcggauggggccgcgaugcgcccaggcgcucuggcgcaugccguggcugccgguguuuuugucguuggcggcggcggcggcggcggcagcggcggagcagcaggucccgcuggugcuguggucgagugaccggugagcgggccggggugggaugcgcuguggcggcugaggcgcccucgcccgacuccggcgcuguccuaggcgagggguggugaggcccggagguggacuguuccuugcucgggggcucgcagcgaaucugccggcgacagagcuccaguccacaugcgcccccgucugacagcaccucuucugugcccugccagggacuugugggcuccugcggccgacacucaugaaggccacaucaccagcgacuugcagcucucuaccuacuuagaucccgcccuggagcugggucccaggaaugugcugcuguuccugcaggacaaggugcgcccgccccagcccacucucccccggucaucgggaggcagccaggcccccuccccccaugacacugacgcccauuccccaagggaagcuucagugaccuugucccaacuguagggaggugugggucgucucaugggaaggccuguaguaaacgcuucagugggcauggcgacagccucggaaauggcaccaacuugauuggaggaagcgacggaccagaggccagguaccuacugaguaccaagcacuuuggauaucugacuuaguccaauaugguggguggggauuaucgucccuguuuguuuauagaugagaagacugaggcuggagguuaagugacuuguccaagcucauacagcuaauggguggcagaguuguaauucuagcugugaugaucauaauaaugauaauuggaaaaugcucaccuguuuagugcuuuguaggcacuugcuacacugaugucauuaucuugguuucacugccaaggaaaguaagguuugucgagauacaauguuucacuacaguugauagauaccacuuugguuccagccugagucugccaauccucccucccaauuggagcucauaacccgcaugcuguuuuccuucccauccaggaucuuugccccaaaagcaggcguggagaccaugagaugacucuaagauagcaagucucugcuaggcccucccuuguugguggccuguauggcucauugcccuuguagucucccuugguugcugugugggcagauggugguggccugaagucuuuucaggaggugguaaauaauauagucaaauaggaacugaguccuaguucuaccauguaaccagccauuggaggcaugaaauaaucuuugugaaugacaguuucuacaucuguaaaaugaagacaccaccuauaucagagggcugugagugggaaaucuuuuuuuuuuuuuuuuuugagacggagucucgcucuguugcccaggcuggaaugcaguggugcaaugucagcucagcucacugcacccuccgccucccggguucaagcaguucucugccucagccucccgaguagcuaggauuacagggcgcccgccacuacacccagcuaauuuuuguauuuuuuuguauuuuuaguagagaugggguuucaccauguuggccaggcuggucuugaacuccugaccucgugauccacccaccucagccucccaaacugcugggauuacaggcgugagccaccgcgcccggccugugagggggaauucuuauaauccacauaaaacaucuagccaggaucccccagucuuagggcauucacccauucauucauuugcccaauauggaaagccuacuaugugccagguauugugaaguguuggggauauggcagugagcagaagaacccaagcccccacccucaggaagcugacauucuugugaggguggccaguaaauacuaagucgguauaggauaugaugucaguguuacggccuuuagggaaggaagcaggcuaaggggacagagugacugggaugcuauuuuagauaaggguggucaggccaggccucauugaggaggugauauaugagcagcgaucuuaauggagggagggagccguuuggggaaggacauuccuggaacagcaaauucgaggguccugggcgaggugugcucuuggccagcucaaggaagagcugguguggcuggagcacagugagugagagaaagggguaggagauguaggagaugguuugcagguggcuaggcgaugaaguaggaccuuguaggccaugagggggaaggucaguugcaguucgaaaugugugagaaagccuuggguaacguggagcagggaguggugugauuucucaauuaaagaaagcccacaggacccaccagcaguuccugggcuuuccgacugagaaccccgguggccaaacagcagcaagguccugcccacaagggaggggaggcugggcgaguguguauaccaaacagguuagggaagcugauuaaaaucuccucagggccuaacugggaagggccagaggaagcuggggaugggaguggaggguaggagcaaaaggacaaaggacaucuguagguuguggagaaaaagggauggggucggggccacugugguccuaagagcucaaaagacuucaaugcucgaugcuuccuccagcauguucugagauccucaccucuccccuuccgccaaaagcagguggggggagggucccguccagacuggacauagccgacucuccuuuucucuggcugggaggccugccacaaaugcucuuggcugccccacccccuccccgcagcuucccuguucccuccccaguuccucuugucuguagggugggcaaggcggcugacuccuacuccugaguuaccacaagucagcugccugcagaucuccccaccccaugacugccuuccaugucuucucacccugcccugagagugcuggagggaagaggugagucucccaccccacccccaccaacacacaguugcgcuccaccauacugaaccugacucucagugagacuuugcuggcccugagaaugcacggggaagguggcuguccccugccuuggcccccaucacuugccaaaccuccucagaugucuccccuauuucccuaauagcugagcauugaggauuucacagcauauggcgguguguuuggaaacaagcaggacagcgccuuuucuaaccuagaggugagaguccucucccagccaggggccaugggggacauucugugcuccuucucccagcauaagaacuguacucugaccucauaucaggguuacuugggucugagucucuucugggucaaccaucccccccaaaaacaacaacaacaacaaaagccaccucauacucuuagggagcagagacgcuggcuuugggguagaaaggccuggggccugaaugucaggggcuggggugugggccauuuucuuggugagccuuuauggguauggcuugccagaggagagcugccagagagguguggggggcugggccaggcccacuggccccuggcuaacucaccuuuugccucuccccuguccccagaaugcccuggaccuggcccccuccucacuggugcuuccugccgucgacugguaugcagucagcacucugaccacuuaccugcaggagaagcucggggccagccccuugcauguggaccuggccacccugcgggagcugaagcucaaugccagccucccugcucugcugcucauucgccugcccuacacagccagguacugcccgcauggcccagccaccagccucggggcccagagagcagcaaggcccugggcuauggcaugugguggcaccguuuggcuaaagaugccaguacuccccacccccucacagcccuuccagaaggugcccuguguggccagaagaggaggggagggccucuucugugacucaggaguuggugccuagcacugagcugggccuccagagaugaggcagaugugagcccugcggguggggagccuucucaccuagccaggcccuugucacagagcagguggccaggacuugagugugacugagaagccucggggugggaugggcuuccaggagggggcacugagguaagagugugcaggcuuggugcguggggcuaguggggaggagaagcuggggucggggaaggguagugggcagugcagguccaggccgccugaggacucuggcgcucuguuugucuuccauagcucuggucugauggcacccagggaaguccucacaggcaacggugaguagaaucagggaggaugcacguccucaucuagcccuugggugggggccacagagagagcuggccugcaguuccucggccuccucacucccaggguggcccgccugcuucucggggcagcuggcaguggagcagggaaaugcuggcucccaggaccagccagggaccaccugacagaagacccuguccagccagaccccacuuggcagaggggggcggcucucugugcuggaggcuguggagccaguuucugugcaggcagcgugaauccuagaguuauggguuuaauaagacugcagacauuuggaaaaacaauucuggggacucaucuauuugcaauaaaggacagucacuccccauggaaaggcagucgugaaccuuucauggguggauguggaguuuucuguauugauauguauuuucuuaugucacauagguagggcuuggcauuagggaaucgaugacugaagccacaguugucucugggggaggcugggaaugggggugggaugagaaguagcugcuccuaaggauccucaguggaaaguaaacacaccacuuucagauggucuagaagguuucuaaagcagacaguggggaguguuucuuuaugcagggugccuggugaccugagucucugcucuccuuguugacccucagaugaggucaucgggcagguccugagcacacucaaguccgaagaugucccauacacagcggcccucacagcgguccgcccuuccaggguaugugcccuuccagcaggggcucuggggcgugcagggagaggcaguguggugagucugcuuggagguggggaguguaugccacagguaggcugcccaggaggcccagcauaggggaagcaugaggcacagaaccccuguggugugacuauuuggaguggcugacucugggggcagggcuaggaugagcacucaaguccugccuccccauuccaggggcagcuuuccaucucguccugugaggcuuguggguggcagacuuggacacuaagucuaaaugacccuaaguuugagggacuaggaaugucaucaggguuuagggggcaucagggaaggcuuccuggaggaaaggucuccucuggcugaugggacuuugagauaguggacaggguguccuguugggaggggaaggagggcacgacaauuggguucaagugugacacucucccagggcugcugaaagaaggcugguuggguguuucugcagguggcccgugauguagccgugguggccggagggcuaggucgccagcugcuacaaaaacagccaguaucaccugugauccauccuccugugaguuacaaugacaccgcuccccggauccuguucugggcccaaaacuucucuguggcguacaaggaccagugggaggaccugacuccccucaccuuuggggugcaggaacucaaccugacuggcuccuucuggaaugacuccuuugccaggcaagggcacuaggcuggggaggacugugccaccacaggugaccuucccaucacugugggucgcagguggggcagggagccagggucaggucuguguuuugggguggggauggccauggucugguuggggucugggcagcgugaggauguaggaggugucauggcauggggugcuguuggagggggaguugcucagacuucugccuccccaugcuugcgagucuuugguugggaccuugguuguuaacaccucaagguuaccugggaaccugucaccucccccuugagcaaaaccucugggacuuugugugggcaaauaccaggccagcuaucugagccauuuauggggcaaccaugcccuucuguuugcucucgcccccaaagcccagcccaggcaccuuagugacccuaagagggaguaaaaggaggggcagugagcucaggggaaccagaggaaggacccccaugcugguggcaagggggaccuggguccuggcuuccagcucuguuccgaccuugcaaugugacuggauccucaguuuuccuaucugucaaguggggacacugcuucuucagguggcugcaaggacccaaggcagcuuagguaggagcagagcugaggaacuuguuccucuaagaugccaaaggcccucccagagccucacagugcgccucuuucucuggccccacaggcucucacugaccuaugaacgacucuuugguaccacagugacauucaagugaguccugggggugguugagguaugggugggcugguguggccccagccuccccagcucaccugacaucccugccaccuuccccagguucauucuggccaaccgccucuacccagugucugcccggcacugguuuaccauggagcgccucgaaguccacagcaauggcuccgucgccuacuucaaugcuucccaggucacagggcccagcaucuacuccuuccacugcgaguaugucagcagccugagcaagaaggguagucuccucguggcccgcacgcagcccucucccuggcagaugaugcuucaggacuuccagguauggagcgggcguggcccagcuucaggugggggagcccaggcuagugguugagagacgaagagaggcuugggcuugggcauguaguugagaguccugucccugcgcugccccugucccaguucuugcugggccucccaacgguccuuucugacccgugucugugugucugccagauccaggcuuucaacguaaugggggagcaguucuccuacgccagcgacugugccagcuucuucucccccggcaucuggauggggcugcucaccucccuguucaugcucuucaucuucaccuauggccugcacaugauccucagccucaagaccauggaucgcuuugaugaccacaagggccccacuauuucuuugacccagauugugugacccugugccaguggggggguugagggugggacgguguccguguuguugcuuucccacccugcagcgcacuggacugaagagcuucccucuuccuacugcagcaugaacugcaagcuccccucagcccaucuugcucccucuucagcccgcugaggagcuuucuugggcugcccccaucucucccaacaagguguacauauucugcguagaugcuagaccaaccagcuucccaggguucgucgcugugaggcguaagggacaugaauucuagggucuccuuucuccuuauuuauucuuguggcuacaucaucccuggcuguggauagugcuuuuguguagcaaaugcucccuccuuaagguuauagggcucccugaguuugggaguguggaaguacuacuuaacugucuguccugcuuggcugucguuaucguuuucuggugauguugugcuaacaauaagaaguacacggguuuauuucuguggccugagaaggaagggaccuccacgacaggugggcugggugcgaucgccggcuguuuggcauguucccaccgggagugccgggcaggagcauggggugcuugguuguuuccuuccuaauaaaauaaacgcgggucgccaugcguugggccucuugucgcucauuucugcgcug

SEQ ID NO: 19045 - RNA, 7934 nt, Homo sapiens
cagcgcagaaaugagcgacaagaggcccaacgcauggcgacccgcguuuauuuuauuaggaaggaaacaaccaagcaccccaugcuccugcccggcacucccggugggaacaugccaaacagccggcgaucgcacccagcccaccugucguggaggucccuuccuucucaggccacagaaauaaacccguguacuucuuauuguuagcacaacaucaccagaaaacgauaacgacagccaagcaggacagacaguuaaguaguacuuccacacucccaaacucagggagcccuauaaccuuaaggagggagcauuugcuacacaaaagcacuauccacagccagggaugauguagccacaagaauaaauaaggagaaaggagacccuagaauucaugucccuuacgccucacagcgacgaacccugggaagcugguuggucuagcaucuacgcagaauauguacaccuuguugggagagaugggggcagcccaagaaagcuccucagcgggcugaagagggagcaagaugggcugaggggagcuugcaguucaugcugcaguaggaagagggaagcucuucaguccagugcgcugcagggugggaaagcaacaacacggacaccgucccacccucaacccccccacuggcacagggucacacaaucugggucaaagaaauaguggggcccuuguggucaucaaagcgauccauggucuugaggcugaggaucaugugcaggccauaggugaagaugaagagcaugaacagggaggugagcagccccauccagaugccgggggagaagaagcuggcacagucgcuggcguaggagaacugcucccccauuacguugaaagccuggaucuggcagacacacagacacgggucagaaaggaccguugggaggcccagcaagaacugggacaggggcagcgcagggacaggacucucaacuacaugcccaagcccaagccucucuucgucucucaaccacuagccugggcucccccaccugaagcugggccacgcccgcuccauaccuggaaguccugaagcaucaucugccagggagagggcugcgugcgggccacgaggagacuacccuucuugcucaggcugcugacauacucgcaguggaaggaguagaugcugggcccugugaccugggaagcauugaaguaggcgacggagccauugcuguggacuucgaggcgcuccaugguaaaccagugccgggcagacacuggguagaggcgguuggccagaaugaaccuggggaagguggcagggaugucaggugagcuggggaggcuggggccacaccagcccacccauaccucaaccacccccaggacucacuugaaugucacugugguaccaaagagucguucauaggucagugagagccuguggggccagagaaagaggcgcacugugaggcucugggagggccuuuggcaucuuagaggaacaaguuccucagcucugcuccuaccuaagcugccuuggguccuugcagccaccugaagaagcaguguccccacuugacagauaggaaaacugaggauccagucacauugcaaggucggaacagagcuggaagccaggacccaggucccccuugccaccagcauggggguccuuccucugguuccccugagcucacugccccuccuuuuacucccucuuagggucacuaaggugccugggcugggcuuugggggcgagagcaaacagaagggcaugguugccccauaaauggcucagauagcuggccugguauuugcccacacaaagucccagagguuuugcucaagggggaggugacagguucccagguaaccuugagguguuaacaaccaaggucccaaccaaagacucgcaagcauggggaggcagaagucugagcaacucccccuccaacagcaccccaugccaugacaccuccuacauccucacgcugcccagaccccaaccagaccauggccauccccaccccaaaacacagaccugacccuggcucccugccccaccugcgacccacagugaugggaaggucaccugugguggcacaguccuccccagccuagugcccuugccuggcaaaggagucauuccagaaggagccagucagguugaguuccugcaccccaaaggugaggggagucagguccucccacugguccuuguacgccacagagaaguuuugggcccagaacaggauccggggagcggugucauuguaacucacaggaggauggaucacaggugauacuggcuguuuuuguagcagcuggcgaccuagcccuccggccaccacggcuacaucacgggccaccugcagaaacacccaaccagccuucuuucagcagcccugggagagugucacacuugaacccaauugucgugcccuccuuccccucccaacaggacacccuguccacuaucucaaagucccaucagccagaggagaccuuuccuccaggaagccuucccugaugcccccuaaacccugaugacauuccuagucccucaaacuuagggucauuuagacuuaguguccaagucugccacccacaagccucacaggacgagauggaaagcugccccuggaauggggaggcaggacuugagugcucauccuagcccugcccccagagucagccacuccaaauagucacaccacagggguucugugccucaugcuuccccuaugcugggccuccugggcagccuaccuguggcauacacuccccaccuccaagcagacucaccacacugccucucccugcacgccccagagccccugcuggaagggcacauacccuggaagggcggaccgcugugagggccgcuguguaugggacaucuucggacuugagugugcucaggaccugcccgaugaccucaucugagggucaacaaggagagcagagacucaggucaccaggcacccugcauaaagaaacacuccccacugucugcuuuagaaaccuucuagaccaucugaaagugguguguuuacuuuccacugaggauccuuaggagcagcuacuucucaucccacccccauucccagccucccccagagacaacuguggcuucagucaucgauucccuaaugccaagcccuaccuaugugacauaagaaaauacauaucaauacagaaaacuccacauccacccaugaaagguucacgacugccuuuccauggggagugacuguccuuuauugcaaauagaugaguccccagaauuguuuuuccaaaugucugcagucuuauuaaacccauaacucuaggauucacgcugccugcacagaaacuggcuccacagccuccagcacagagagccgccccccucugccaaguggggucuggcuggacagggucuucugucagguggucccuggcugguccugggagccagcauuucccugcuccacugccagcugccccgagaagcaggcgggccacccugggagugaggaggccgaggaacugcaggccagcucucucuguggcccccacccaagggcuagaugaggacgugcauccucccugauucuacucaccguugccugugaggacuucccugggugccaucagaccagagcuauggaagacaaacagagcgccagaguccucaggcggccuggaccugcacugcccacuacccuuccccgaccccagcuucuccuccccacuagccccacgcaccaagccugcacacucuuaccucagugcccccuccuggaagcccaucccaccccgaggcuucucagucacacucaaguccuggccaccugcucugugacaagggccuggcuaggugagaaggcuccccacccgcagggcucacaucugccucaucucuggaggcccagcucagugcuaggcaccaacuccugagucacagaagaggcccuccccuccucuucuggccacacagggcaccuucuggaagggcugugaggggguggggaguacuggcaucuuuagccaaacggugccaccacaugccauagcccagggccuugcugcucucugggccccgaggcugguggcugggccaugcgggcaguaccuggcuguguagggcaggcgaaugagcagcagagcagggaggcuggcauugagcuucagcucccgcaggguggccagguccacaugcaaggggcuggccccgagcuucuccugcagguaaguggucagagugcugacugcauaccagucgacggcaggaagcaccagugaggagggggccagguccagggcauucuggggacaggggagaggcaaaaggugaguuagccaggggccagugggccuggcccagccccccacaccucucuggcagcucuccucuggcaagccauacccauaaaggcucaccaagaaaauggcccacaccccagccccugacauucaggccccaggccuuucuaccccaaagccagcgucucugcucccuaagaguaugagguggcuuuuguuguuguuguuguuuuugggggggaugguugacccagaagagacucagacccaaguaacccugauaugaggucagaguacaguucuuaugcugggagaaggagcacagaaugucccccauggccccuggcugggagaggacucucaccucuagguuagaaaaggcgcuguccugcuuguuuccaaacacaccgccauaugcugugaaauccucaaugcucagcuauuagggaaauaggggagacaucugaggagguuuggcaagugaugggggccaaggcaggggacagccaccuuccccgugcauucucagggccagcaaagucucacugagagucagguucaguaugguggagcgcaacuguguguugguggggguggggugggagacucaccucuucccuccagcacucucagggcagggugagaagacauggaaggcagucaugggguggggagaucugcaggcagcugacuugugguaacucaggaguaggagucagccgccuugcccacccuacagacaagaggaacuggggagggaacagggaagcugcggggaggggguggggcagccaagagcauuuguggcaggccucccagccagagaaaaggagagucggcuauguccagucuggacgggacccuccccccaccugcuuuuggcggaaggggagaggugaggaucucagaacaugcuggaggaagcaucgagcauugaagucuuuugagcucuuaggaccacaguggccccgaccccaucccuuuuucuccacaaccuacagauguccuuuguccuuuugcuccuacccuccacucccauccccagcuuccucuggcccuucccaguuaggcccugaggagauuuuaaucagcuucccuaaccuguuugguauacacacucgcccagccuccccucccuugugggcaggaccuugcugcuguuuggccaccgggguucucagucggaaagcccaggaacugcugguggguccugugggcuuucuuuaauugagaaaucacaccacucccugcuccacguuacccaaggcuuucucacacauuucgaacugcaacugaccuucccccucauggccuacaagguccuacuucaucgccuagccaccugcaaaccaucuccuacaucuccuaccccuuucucucacucacugugcuccagccacaccagcucuuccuugagcuggccaagagcacaccucgcccaggacccucgaauuugcuguuccaggaauguccuuccccaaacggcucccucccuccauuaagaucgcugcucauauaucaccuccucaaugaggccuggccugaccacccuuaucuaaaauagcaucccagucacucuguccccuuagccugcuuccuucccuaaaggccguaacacugacaucauauccuauaccgacuuaguauuuacuggccacccucacaagaaugucagcuuccugagggugggggcuuggguucuucugcucacugccauauccccaacacuucacaauaccuggcacauaguaggcuuuccauauugggcaaaugaaugaaugggugaaugcccuaagacugggggauccuggcuagauguuuuauguggauuauaagaauucccccucacaggccgggcgcgguggcucacgccuguaaucccagcaguuugggaggcugagguggguggaucacgaggucaggaguucaagaccagccuggccaacauggugaaaccccaucucuacuaaaaauacaaaaaaauacaaaaauuagcuggguguaguggcgggcgcccuguaauccuagcuacucgggaggcugaggcagagaacugcuugaacccgggaggcggagggugcagugagcugagcugacauugcaccacugcauuccagccugggcaacagagcgagacuccgucucaaaaaaaaaaaaaaaaaagauuucccacucacagcccucugauauagguggugucuucauuuuacagauguagaaacugucauucacaaagauuauuucaugccuccaauggcugguuacaugguagaacuaggacucaguuccuauuugacuauauuauuuaccaccuccugaaaagacuucaggccaccaccaucugcccacacagcaaccaagggagacuacaagggcaaugagccauacaggccaccaacaagggagggccuagcagagacuugcuaucuuagagucaucucauggucuccacgccugcuuuuggggcaaagauccuggaugggaaggaaaacagcaugcggguuaugagcuccaauugggagggaggauuggcagacucaggcuggaaccaaagugguaucuaucaacuguagugaaacauuguaucucgacaaaccuuacuuuccuuggcagugaaaccaagauaaugacaucaguguagcaagugccuacaaagcacuaaacaggugagcauuuuccaauuaucauuauuaugaucaucacagcuagaauuacaacucugccacccauuagcuguaugagcuuggacaagucacuuaaccuccagccucagucuucucaucuauaaacaaacagggacgauaauccccacccaccauauuggacuaagucagauauccaaagugcuugguacucaguagguaccuggccucugguccgucgcuuccuccaaucaaguuggugccauuuccgaggcugucgccaugcccacugaagcguuuacuacaggccuucccaugagacgacccacaccucccuacaguugggacaaggucacugaagcuucccuuggggaaugggcgucagugucauggggggagggggccuggcugccucccgaugaccgggggagagugggcuggggcgggcgcaccuuguccugcaggaacagcagcacauuccugggacccagcuccagggcgggaucuaaguagguagagagcugcaagucgcuggugauguggccuucaugagugucggccgcaggagcccacaagucccuggcagggcacagaagaggugcugucagacgggggcgcauguggacuggagcucugucgccggcagauucgcugcgagcccccgagcaaggaacaguccaccuccgggccucaccaccccucgccuaggacagcgccggagucgggcgagggcgccucagccgccacagcgcaucccaccccggcccgcucaccggucacucgaccacagcaccagcgggaccugcugcuccgccgcugccgccgccgccgccgccgccaacgacaaaaacaccggcagccacggcaugcgccagagcgccugggcgcaucgcggccccauccgcacucgagccgucgccauggccgccaucauagccucagccuccacugccucagcggccucgacagccgcagaucaggugaccguugcccccgcccgagccccgccucgc

SEQ ID NO: 19046 - RNA, 6579 nt, Homo sapiens
ccagagauucagguuucaaccguuuuauugggagguuuuguuuucugugaaauacacuagaggguggggaaggggacacauucacuuugcaagauaaggguuucccaccacuaaaggaaaggcauggggcagggcacacugggguuuggguccguuuucccaccuccuucugcuuggcucacuuuucuuuucucucagcaaguaccacagaacacaaagacaagaaacaaaacagcaaaucaaccuccaacggggccaugcccaagccuuccccacucccccaggcugggcaagggcugggaggggcuggggcagcucacucgacagcccucaggccacacgggaaggcugcaggcucagaaagggugggucaaaguuaauaaauuagaauaaauuaggggggaggaaugcaacuuugugcugggagggccccuucucuccaacacgcgagaguuggugggggggaggugggggcaucuccaaaggccacuacaguggggguaagagcggugggggcagaagucaccuuuuccuccacgucuucccaaacagagcagaagaauuagggguggggggaagagacacacacaaggagaggaacccucuuuuccuaggauaaggaagggccaagaaagaggaugcuauccaaccccccaucucccaagccaucgcuaggguuaaggauuuggucaguggaucaaugaggugggugaugggaacguggugggggaagcagaggaugcuggagcccucgaggagaacagacacaggcuggggcagcaggggcugggggcggccacaaucacugcucagcuucuccaaagacgucguucuguuugcgcuucauguucucaaagucaaaggccgugccagccaugcguuuguagaugucuuugaugucguugcagguugucucaaagugugugguggcaucguaggagcaggaacagaacaccuggaaacagccagagcccagcgcccagggugagucagacagguauccugggcgggcagccaggagcccagggcugggacgagcugcuuaccuggcucucacaaccaucaucaaugggcucauacaagucacugauagccacaaaccugaggggcagacagaggggaggggacaggccucacaaugggccaugcccuuccuggucccuaagcccagcugcugggcucccucccucucccccuugggcucagcccagucccucacuucuggucaaugggcuccaacagcuccagagccggcuccaccuccuuuucaggguccguggucuccacaguagugcuggcaauagcuauguacuugcccugggccgccacguugugugcauaggagaucaugcacacguagaugucuggccacaggaagagcuccgucaacucaggccagaggcgcuggccauacgcagagagggguuccaguggcuggacacaagucuggcccgacugccccuccccagccccgcagagcagguagcauccaagccgccacccucccagagggaaagaguccaggccacccaaacccuagggcuccaaguugugguggcuacaauguggcucaaauuuuuuuccagagagguaaggcagggagcucccacacugauggggagaaaaagaguaaccccaaagagaacacccuagaggaagcuguaccagcgcccggccuaccugacuuccuguugaccugguucugggggaugauuauuuggcaggaguuggcgucguugguguucuugaugggguggcuaaggauacagaugaugcggauaaccuggccagccuuccgcacacgguccgggauguagcuggggucacagaucagcugcuugcagcgggccaccugagaaggcaccagaaguccucgccccugucacaucccucccuuagguagacguggggcugcgcucacagcaagggcaggcagcucuggcagacaagacguuccucggagccaucacuacugccccuccugaaugcauggcccuacccugccgcucagauaggugggccuugacgcacgggcugggugcccgcccccccgccccccagaggcacugugaucaagaacacuuucugcaccacagacauggcauguggccucugaaagagaccucucacccacagucaugacucugaagacuucuggacccccaguucccagcuccaagacccuuggggcugugcagcaggagacucgacagcacagagaaagugaccaagccccgccucaaccaugggacugcacugcaugcacgggaagggcucaccucucccucagacuucacgcccaccaccuugccguucuccaugaugaugucauccacagguuuguucagcauauauguccccccauagauggcacucaaucuguggugagagcagcuccggugaaggccccucccaggagaaacggggaccaauuccacugcacccuuccuccaccaaagugcaaagaaggcugccccaggcaggcagcagguaggagacgccgggauucaucccagcucugucacugccgugaacgcuggccccaucuccgcgggcucuuuccucucuggagcuucugcucagaauacacugccaagggccagcgggagggggcaugagggaucagugcuccgcaccaagacagccugagggaccagaauggacucucuggagauaggucagcucccagcuaagcccugacucaagguucugggacccugggcccaguccuggugcugccgggaacugagcaagucacauuuguggagacucguuuuuucaaguguggagacuucuguacuucagugcacugggguugugcccucaucacccaaggauggagugaaguaaaugaagagcacgaauuggaaaggaggaaauacuaccaagaaaaugcucaaggcggccaucuccacuccuggcccuaguccuacucagcuaugccaacugaaaaaacccauguccucaccuugcaaaacccuggggcagcucgcccaagccguagagcggguauaaauaugggcucuugccauaccgggccagggacucacuguacaacuugaugcgguugacggucucaaggcagggcugguccagguagcugggggaauagcagcaccccugauuuacccccacccagguaccaggccagucuucccaccacccugaauggccuggggaagaugaggaucaaaugcaagggggaaauggaaagggugauaggugagccuguggcugaguacaagagacaugcggggcagggggacagcaggcaggugugggaagggugggggcgggccgggcgagggggcugccaccacccagcuuccccucacucaucagugcgguagagcgccagggcauggccagugaaaucgaugacauccuggcccagaucaaacuuccgguagacgucacgcaugcugguagucugggggucaacgcccucaaaggucuuggggucauucucaucgaaguuugccacaaacaccaggaacuugcggaagcgccguuucucaaacaugcccaucagaucuaaggaacgcggcgggaggagguucugcaucaaugcagcacaaaacucuccaucccagcagggcaggcacccccacucacagcccagcuguccugugaucuuagguuaaccucuucacccuuuuuagccucaguuuccccaccuggaugaagaggggauuggccuggaugggcucuaagggccuuccuggcucagacacuuggcgaugucucggggauucaguggaggcccugccaaaggcucaaguuuuuguuuuuuuuuuuugagauggagucucccucuaucgcccaggcuggagugcaguggugugaucucggcucaccacaaccuccgccucccgggcgcaaaccauucucuugccucagccucccgaguagcugggauuacaggugcaugccaccacacccagcuaauuuuucguauuuugagaugagacgguguuucaccauguuggccaggcuggucuugaacuccugaccucgugauccacccgccuaggccucccaaagugcugggauuacaggcgugagccaccgcaccuggccaggcucaagucuuucaaaaggagccccguuccccuccacaucacaucccugcugugugaggaccucccuccuggcagccagccgugcagcaugacauggggcagagggaauacagagugaagggccucucugguccuucacgggaaaugugacuuuggacaagggggugccuuauucuggacagccacccaucccaaagacaguuggcuucccugccaccccaugauuucucuggcucagggggcccacacucacuggaagccaaggccucagucucaguggacggcacuuuguagaucuugccccccuuguagacaaagcugcccuccaccaccuugaaguccagguagcgagucaccucuguauacaguagcaucuuuaccagcugcccugugggggugcacaagggcaacaucagcacggcucucuccagaggcucuagcuggucuggccgugccuccucuggagccugaccguccucgggucuucccuaucacccccgaccugcaauaccuccuuccugucccucaccguuagccaugaggaauuugggaaucaggucaacauuccagucucggccucggcccaucgacucagggggccccuccagcaacugaaaacgcuuauacagcuguaagcagaagggagagagagagacaccucagggaccaccuccuccugcuccaggcaccuggggagcuacuuccacccugugccgcuaugugggagguuaacagggauaggcuugggccugggcagccucaccuccuccaggggugugauggaggagcucucgcccccguaguagggguuccgguccaugugcagcaccuucuucccguucacagacaugaugcccgacaggaugcauuccugggggagggugacaccauccgcugcacucccaccugccuccgcuccuaccagcagaccugauuuguuccccacccaaaccugccucaguggacagcuccuuccacccaccauccccacuggcuaguugccucgccuaaaauuggggugauggcuucauccgaccacacucuccauugcaaccuugcugggcaaaggagucccgucccccucacaaggcggagagugaaauaacggaggcuuugagggaggcagggcauccagcagacacaggauggccuuccaguaccaacacgccgagaggcaucuaccuacgcagagccgcacaaaaaggcggauaaaacacaauaaggcacagagaagacccagcuggacugcaaaggacacucgaaagggaggaaaagaaaggcuuagcacaguccuugaaauuguaggccccacccuggacugcucuuucuucaaauagcaggagccccugccgcugaggaggggcaucugggccuggaccgaggaagaagagucucugaggggaguaggccaacgggguuuucggggaaagggggaagauaaacacccucaccagucacugucacuagcccaaggacaaaggcugcagaugcuacccagccugaggucuccaugggcaaccgaggugggguugcgggaaugugcuuacugcccccacugcuguuccuucuggaacauucccuggauccccuggccccagaagacgaugaggaggcgggcugagggcccacucuggcgaggcccccugaccccagguccuucuacuucauccccaccgggauuagcgcaagaugggaagggacgcugagaggcaacgcuaggcgggcaaugggugcgggcgacggguggaugccgugaugggugggggcgaugggugggcggggucgugggcaucgggccgagugggggugcguuuuccgguccagcgggcagggguagggaagaugggagggcgccgggggucggacccggguagcccaggaggcggccaggaagggggccucuucggggagauggggucauggcaacgagcagaggcgacgucgcugggggagcagcggggugggcacggcgccggcuuuucggggagcggagcgcagaagauggcagugaccagaggaugggccggcggccgcaucaucgcgggggauggcgagggcacgacgcagggccaggggcgccggggccgcacuuacggugagaccgguccccagcacgaucacaucguauuccucguccauggucaggccucggugccagcgcccgcucggcuccuccuccuccuucaccgcagcagucgccgccgccaccgccgccgccgccaccgcacuggaccaaagauggcggcgcgucggccgucgcccgaccccuccgccgcgucaaagagucccgccucuucccgcgccccgccgcaaccggcaggggccaccgccuccccggcucgccucccgggagggcugccagggcccgggccacagcaccagcgcggcuccgcgggcgacgcugcucgccgagagucuagagaggcgcggggcggggcgggcggggcgggccggcggccggugcugcggcccaggaagaauccgugcgcgggagccg

SEQ ID NO: 19047 - RNA, 6507 nt, Homo sapiens
cgucagcugacuguucggccgccaccgccgcugccgcugccgcugucgcugucgccgccgccgccgcccgccgccgccgccgccgccgccgccgcugccauggcucaauacaagggcgccgcgagcgaggccggccgcgccaugcaccugaugaagaagcgggagaagcagcgcgagcagauggagcagaugaagcagcgcaucgcggaggugcgagccggggagccucggagcaugcgcgcugcccagguccccuggcggccccgcgccacgcuccggcccuggaagcccuggggcgguggccacggagcgcgggcggcgcgccggggcaggccccuggcucgcugacuuccagcagggcacacagaagcaagccagcgacagucucaucugugaaaugggccuggagccgggcguucuccgaggcugaggccacuagcugaugaccggccuccggcaggagggagccgagccaguguuucuguugggaggcacggcggggacgggccucucgucgccucgccugggcacccagcguccuggcucuggccccucggcccucagagccaggccucugcccccucggcccucagagccaggccucugcccugguccuauggacaccgggcagggcgguucgucucccccuggagaggcggggaggccugagccagaccuggcaaguccacuggccaggaggcuccuuccagaaccccuugcaccugugaggcaggcacgacccucccgggugccagcgguucacccacugcuuccgugaguggccugugauggugguggucagggaaggagcguggaggagcuugauccuuuuggggagacucacucaucaggacucggggcuccaggggagagcaggcuccugccuggggaacuggggaagccuggccagaggagccuugaaacaccaaguccucaugcccuggccgcacugucugagccggggugcccagcaagcagaagguguauuucucugccagccaccuucuugggagaccacuggucagcgagggcuugacaugguaccaaguggguuggggcuggggccaaagagaggccuccugggaagcuguugaugacauucuggggccuggagggaggaaaaucacucagggaggggccaggccccucaaccacucuguucuuguuugcccucuccucauaacccuuggcuugggucucggaagcuucagcuuaaaggcuggagaugaaaaaggccaaaggucaguagggucgguggcuucaggcuacugagggaccugugauccccagcaggagaccugaagagccagagcagcucagggauggaaacagccccauuuggcacucuuagcauuugaagagcccugcccagccucauggaaccuuccaucgacaagggcacaggggcagauuuggacuauaacgcagguccuugauggccagccugccauuuccacagugaggggugguucucaugguggcugucacuccccgcaggagaacaucaugaaauccaacauugacaagaaguucucugcgcacuacgacgcgguggaggcagagcucaaguccagcaccgugggugagcagggugcgggugccccucacccgggccccgggccacucuuccgcuggcccugcgacuaccuugccccuugugccuccuugcuucaaaggucucgugacccugaaugacaugaaggccaagcaggaggcucuggugaaggagcgggagaagcagcuggccaagaaggagcaguccaaggagcugcagauguggguccucucgccgcagcccucaacauggagcuagugcuuacggggucccguggcuggucgggcucuuuuugcacccugggggggacccugucuccagcuuugggacagggguagcaucuagcuugcgauuugcauuucucucucccgccuccucggguccacgcucacgucuuuucaccauggcggcuugucuucuuucugacccucuaaaugcagugggcccuuucccagcauccggugccugagcagccugcguucuccccauugccagccugugcuuggcucuccccuguggcccucugugcuugcuguuuguaacagagcccucgcccaugagcucaaagugauccaggacagcaggacccgucuggggcaauggggacccagccugggcugggcaggccccacauagggcacacagguggcucugggucaaggaaggggcugggucagggucgggaaggacaugaugugugauggggccaccugcaccucacuaggaagcuggagaagcuucgagagaaggagcguaagaaggaagccaagcggaagaucuccagccuguccuucacccuggaggaggaagaagagggaggcgaggaggaagaggaggcggccauguaugaggaggagauggaaagggaaggugagggcuggcuugagucggagccccgcccgcagccccuggggagggguccccaaugugagaggcugucagcaaagcugaugcccugucaagauggcuccaaaagcugcccucuugaggcaccgcgcacaguagaccggggagggaagaggcuggucuagaccaggcuggcugggcacauuuucugugaugauggaaauguuagagucugugccacccaauaugguagccacuugccccaggugccucguaugacuggggcacuaaauggugaauucuguuugauuuguuucagcguaaauguauacagccacagaaauuccgaggcuacuagucagacacugcaggucucagcugugagaacaaggggcugucagggaaagcucaggauggcuggggagugaggguaaagccagccuggccuccacgugugccacacaccugugcugugccuggccagggcacauagggugcugucccucuccugguggaagucacgggucaccaugcacugaagacacuacucaggguuacugcucugcucggggcccaccgggcuaacccaggggucaaggaaggaggggaggguugaguuaggcccuaaggaugaggggaguugcauucgccagagaggcaggaggggcgacgagaaaguacaugccagaagcccagcaggaaagagcuuuucaaaacguuugaagauugggagcaaguugugucacgggccccuggagggugugguggcaguucuggaaauugugucacccagggaauggcagagggagagaagcgaggcaggggauggugcuguguggcugugguaacaggcugggugccauggcuuugaggggagugcaggauuguagggaggaagaaccugccagccaccugccauuuggguuccauguuccagcagccacaguaaaacauagaaaaagaaacaagcaggauuuuaguaugacauuguauuuaacccagcguauccaaaauaucaccauugcggcaggcgcacuagcugcaaugcuggggugcugugugcagcgggagcuacugguuuguguuuguguuuuuguuuugguuguuguuguuuuugagacagugucucccuguggcccaggcuggagugcagaggggcgaucacagcuuacuucagccuugaccuccuggacucaagggacccucccaccucagccacuugaguagcugggacuacaggcgcuuuguauuuuuguauuuuuuguagagacggaaucucgccauguugcccaagcuggucucgaacuugggagcuacuggcguggacagugcaggccugggggaaagguugucacccucacugugugucacuggggcuuuuacaaaacacugcuuggugggcucuucccucccuccacagguuccguuuagggggcccagccacaagaccccaggcucuagaaucucugcccuugagcaucaggcuaaagaguuuagauuugucuuuuuuuguuguucuuuucuuuuuuuucuuucuuuuuuuuuuuuuugagaugaggucucacucuguugcccaggcuagagugcagugguuugaucacggcucacugcagccccgaccucgcaggcucaagcgauccucccaccucagccuucugaguagcugguacuacaggugcgccaccacacccggcugauuuuuuugaguuuuaguagagacgaggucuugcuauguugcccaugcuggucuccaccuccugggcucaagugauccuucugccucauccuccccaaguguuggguugacaagcgugagccucugugcccgcccuaggcuugucuucuagaucgacuguucucaagguaugcuugggggacccugggcgucggccauaucaaaaucauuuuuauaauaaugcuaugauauucggcuuccuuuuguuccagagaucaccacgaagaagagaaaacuggggaagaacccagacguugacacaagcuucuugccugaucgagaccgugagguaaaggcugccuggcccugaccccggccucgacuccagcccugguggagacccuugcuuagggagccaggcucugcgugcacccugagcagcccugggccucaccugucugccugcucccucucccaggaggaggagaaucggcuucgggaagagcugcggcaggagugggaagccaagcaggagaagaucaagagugaguguuugcggagucagacgcgaggggccugggcccaagccagcuucccuguccacagucuccuggguggugcgcugagccccaaggcugcucucaguggggcuggagaccaagaggcagcucugccuuguaggugaggagaucgagaucaccuucagcuacugggauggcucugggcaccggcggacagucaagguaggcagcgugcagccugcuuccugcucaccaugggcccagccucccucagguuccgugggaaggaacugaccuuccugacuugggaagccccagggauccugaggauaacuggcuccagggccuggcccccugucuggggagugaggcccaggccuggcugaggcucugcagcgucuggcagggcccucugggccucugccuuguugagagcccuucugcaggcuuccgccuucccuucccaacuccuggauucccggauacagaugagaaagggcaacaccaugcagcaguuccugcagaaggcgcucgagauccuucggaaagacuucagugagcugaggugugaggugugcgugugugcacggugguguguguggcaccuguggcuccagccugggugccagacacccagugugaugugggcgcugucugggcaagcaagcagcgugcugggcacucuccucccaaaagagggggucaggcuccucuucccuucccucccaccagagagcuuugcugagagcggccugccuugguuccuuagcccaaagguggagggugcugggcgccaguccugugcucacuaaaccauggagcuucccucacagccaacuggccgcugcuucccagccccagcaugggcucuccugggcuggcugucuccucccucccugggcaggggugcuguccucuugcccacgcccuccugccuuccucccucagguccgcagggguggagcagcucauguacaucaaggaggacuugaucaucccucacgugagucccuucagccccaguacccgcagugggugcagcacccugggcuuuggcucaggcuggugggggcagugugcgcaggcgggggguguggggaggggccgagauggaccaucaagacgccgcuuuccugcccuuggcucccagcaucacagcuucuacgacuucaucgucaccaaggcacgggggaagaguggugagugccgccgacccagccgcccccauagcaccuugccgccgauguugucacuggggcagcagcgggacauugggcugucacuucuccccugcaggaccacucuucaacuuugauguucaugacgaugugcgguugcucagugacgccacuguggagaaggaugagguacagcguagggggccgugugagggggaacgggugucccugggcuauggaggagaagccaagggaaggggaggucagcaggcggcccugugcccucuuccucccuuagucccaugcaggcaagguggugcugaggagcugguacgagaagaacaagcacaucuuucccgccagccgcugggaacccuacgacccugaaaagaagugggacaaguacacggugaggaggggcuggcagggaccccuccaaguuggggacggcagccagccccugcucaccccucgccuuccuugucuccucugcccaccuuguccucacacuagauccgcugagcauccaggaggcugcgcggccccggcuccucagcucccucagugugccccguggugucaccgggacuccaggcacccgcuccccugcgaccaugccaggcacgcugggaggaggacggcagcugcucguguccugccccugccacaucagugacugcuuuauucuuuuccaauaaagaagugcacgugucagagcuggagcgccugcau

SEQ ID NO: 19048 - RNA, 10189 nt, Homo sapiens
cgcacugacaacagcaucugaaggcauuucuucuguggggccaucacuuuauuaaggggucaucuagaaggugggcccccugacaaaccgcgggacugugaucgggcuccagcuacuucaccaccccgggccagccugcuccaggggucccuuccugcugagagcaggcgagaggcagucaggcucaugaagcagccaccggguuuggcucacuggaaggaaucacacuggaaacauguuuagcccgcagugcagaguggcuccagaagggagagguucuggaagacgccccaaccugccgggcugcucccagaguugcacagugaggggcaggcacccagggccguuccaggacucaagauggggauggagauggcgugaggaauggaggacagggcuagaugggcugaccggggggaacaguguuacgaaaaggaggcggguacccugggcucccgugacaaagugcggcagggcuacccccugcagcccccauagcccccaccaccuugagaccacguucuggucacugccucggagccccgauguguuggggccagggagcgcuccugcccggguguggggugugagccucagccucuguccgcccggcagcgcgcgugccucccuuggucuggccucccucggcccgguccuggcacuggccgugcuagcuggccgugcuucuccgcgggauacagccuuccaucuccagcgccucgggccagccuucguacuuguugcugugcuuacuguucuucacgugcuguggggaggggagcagaaagucaugacuuuggcccucagggacaggggacaggaguggaccaggacccaggcugucagucaacugugcuguguuggccaacgguguacucucagggcacuuggccccuccacccaucccagggaaacauggcaucagcugcacuggcccaccccucauagcuggacuggggacgguccccugcuggggcgugagcagcuggggaggcucgucgcaugcaggcagaaggggcgacaggcugccccggugggggugaugccaggcaccccccauaccugcucaaaggggcucuuguucugcacacccuuggccccgacaaacacccagcugucccggaaggccagcuccuuggcguuccugcugcccagcucacugaagagcuuucuggucucuucauucauccugcagcaugggaggaaggggugucagcuguugcugcagaagggcaaggcugaggcuggccuccccaagcaccuacuugguggcugggucgucguaggaugccacgaacaccagggugccuucgugcaguggccgaauaaacuucaacaggucguugacaucugggggggcaggugccacggaacaggggucaucaggcaccacugagcacccucccacaagcccguucuccaaacaaggaaacagaaguagggauugggccugggacaugccccgccaagggacaggcugguguaggaagcugaggcauccccgugaccucccacagccuccagaccaagcuggcgaugccccuguccuuucugaacccacggaggugacugagaagcuccaaguacagacagagagagcagugucucaggggaagcugcccaggucauuuugcugcagucaaaaugcaagacgcugcgcugcaacucaccuccggcccacaugucaaaggcccgggccucgaugagcucgccgcugaccccugugucaggagggaggggcccugcuggguaagccaggccagccucagggcacggcaggcggguagcaccggggguggggggcagcccuucuggaagcuuucaaacagucccccaauauucauccauuuguucaggcagcugcaucccaccccaagccguggugccucugucuggcauuugaggcccuccgggggcucuccaugaagcacccucaaccucccagaaccuucccuaguucuuuauugccaucaugcuuuuuuguucauugggucacuccucuguggagccuugcgcuugcacagacuccuucccaggccucccugggagaucuugaaugggaggggaagggagggcaaacacccagaggccuccuggggagggagcagggaaggagggcggcaggccacgcucagccaggggccucaccguucaccagggcgauguucagcccgcggcccacguuguccuugacgcugcucaucagccuaguugggggggggugggggggacggggagaucccacaugggcacgucugcuccacucucccuugcagacccggcccuggaucccccacucccucccugauccccagucaccccagggagcucacaucuuguccucgaggcagaucuugggcccaaugacguuggcggccccgcugaccacgcggaaggccaggugcuccucaggacacggcuggggcaggccacacuuguacuuccuggcccguggcgcugggcagggauagcagguguuauccaugggccuggcccugaggucaccugagaucugaaggggaggucaggaccagcacacaugguagaacaagugaccgcagagcaggacacaaguagggggauguggcucaggccgaggcuggggacacuuccauacucuguguccuacuggugaggccacagggacccaagacagaaggauuuucuguuacuggugggagaaaagaaaggaugcugagggcuggccugggccacugcacagccaggaacaaagcaggggugaaguaagucaggcugggggucuagcugcauggaugaggccaaccugagcaaaggcaguguggcaggggguaguguggcagggggugcagccugucucccgauuuugauggggguugguugggaggacuggagcaggauggcuucuauuauggguugaauucuguccccucaagguaugcugaaguucuaaucugugguacuucagaaugugauguuugcaaauagggccuuugcaguucagauggggucauacuggaguagguuggguccuuaaugcaacaugacugauguccuuauaagaacagaagugacaaagacacacagagggaagacagccaugguacaguggaggaagagacaggagugacacagccagaggccaagguaugccuggggccacuggaaccuggggaggucaggaaggacccuccuguagaacuuucagggugaguaacgcccugcugacacuuugauuucagacuucuggcuuucagaauggggagagaauccauuucuguuguuuaagccacccaguugaaauggcaguuccaggaaauggauacagguuuuggcaccaggaaguguggugcuuagguaacaaauaccuaaaaauguggaaauggcuuuggaacuggguagucaguagaggcuugucuuaguccauuugcugcugccauaacagaauaccacagacuggguaauuuauaaagacaacagauucauuuggcucaugguucuggaggcugggaaguccaaaagcauggcgccggcaucuggugagggucaucccguggcagaaagguggaagguggaagcaagcauaugagacgcaggaaaaaagggggcugaacuucaagguaacuaacucacccauaauaauggcauucauccauucaugagggcagagcccucaugacguaacuaccucaaaaaggcccuccucucaauaccaauacauugacaaauuucaacaugaguuuuagagaugacauuuaaaccauaucaaggcuauagaaguuugagguacauguuagaaaaggucuggauugccuuuaagagacuguugguaggaguauggauguuaaagguaauucuggugagaggaggggagagcaauagagacagccucuguggucuuagagaauacaaauaucaucaagaacagaacguugcuagaaacaugaauguuaaaggugcuuuuggguuggguguggugauucacgcaugugaucccagcaccuugggaggccaaggcaggagcaucacuugaggccaggugaucaagaccagccugggcaacauagugagaccccgucucuacaaaaaauacaaaauaagcuggguguggugguacaugccuguaaucccagcuacucaggaggcugaggcaggagaaucacuugagcuaugauugcgccacugcccuccagccugggugagagagcaagacccugucucaauacauucaaaaaauaaauaauaaaaaauaaaacauuagcugggugugguggcacaugccuguagucgcagcuacuugggagacugaggugagaggaucgcuugagcccaggaguuugagcuuacagugcacggggaugauaccacugaacuccagccugagcaacagaguaagaccucugucucuaccaaaaaaaaaaaaaaaaaaaaaaaaggugcuuuugguuaagccucagaggaaaaugagggacauguuauugaguuauugggcgcuggaggaaagcugauccuuguuauaaaggaacuuggcccaggugugguggcucacgccuauaaucccagcacuuugcggggccaaggcgggaggaucacuugaggucaggaauucgagaccagccugaccaacacggugaaaccccaucucuacuaaauaugaaaauuaguuggguaugguggcaggugccuguaaucccagcuaaucaggaggcugaggugggagaaucgcuugaacccgggaggcggagguugcagugagccaagauggcuccacugcacuccagccugggugacagagcaagacuccgucucaaaaaaaaaaaaaaacuugguugaauuguguucuaguguuuugucgaaaggagaauguguaagugcugggugcugaacuuggauauucagcugaggagauuuccaagcaguguugagagcguagccugacuucuccuugcugcuuauaguaaaaugugagagacauaaggaagaaacuguugagcacaaaggagccagaaagcgaagauguggaaaauucuuggccuaaucauauuacaaaaacugcaaaaguguccccuggacagaacagcaaggcuguucaagcguuugccccagagcugagguaugugacucguggguccacucaacccuuucagcagaaaucuacaaugaagaugggguuaucuaggaagcgucugugggaaaacucucugauuuuauagcuugggccucuauaacuugcaaaagagaccaacaaggcucuugagaaucugacaccagcagaaacacugccggccuggagugaagggggcagagaugagauaaagggaaggaaggguggccccgaagguggggcugucucguuucagagcaugggucauuccagcaggcccagaagaaagaaucucaggccacagaggauuccccucaggccuugaaaccaaaugaauuuugcccugcugggcuuuggacuugcuugggacgggugaccucuuuuuuccuuccaaguugcccuuuugcagugggaguaucuauccuaggccugccccaccgucauauucuggcaggaaguaacuuggcaggaaguaacuuguuuuguagguugacaguggcaagcagcccccguggaccaccacagcugguuuggggaggaauaaauggaaaaccgaagcccuacgggaccgggggcaggcagggaugucacaaaggggaggagcagggaggugacaggggccuuaccugcagucaccgagcucucuggaccuguggauacagagugguuucuguuaguguggagccucccggggccugcggcagggcagccuggcccuccuuacaccgcgaaguguagacacaggcagucaggcucaggggccgggggcuaagccaggccgaccuuggcaugcuuccugcucaaguguaagucauguucagaugaaaaacucccuacucuaggaacagggggaaauggaauuagaaaaacuacuuagaugaccuggccgggcauaguggcucaugccuguagcacuuugggaggcugaggcggguagauugcuugagcccaggaguuugagaccagccugggcaacauggugaaaccccaucucuacuaaaaauacaauaauaauaauaauaagaagaagaagaagaagaagaagaagaagaagaagaagaagccggguuugguggugcgcaccuguagucucagcuacucgggaggcuggggcacuagaaucgcuugaacccaggagguagagguugcagugaaccgagauugcaccacugcacuccagccugggagacaaagugagacacugucucaaacaaacaaacaaaaaaguacucaggugaccuauuaccagucaacaagguggagaguccccucuccaucucagagccugcagggagcaaccggggcaucacuccccauguucaguggaagcucccuaccccuuacucuggcccuacugacuccaguugggcauauaauucuagugaucagguauuggcuuuccuagaugaagcaacuggguguugggggaggcugcgccugaugccaggagacagacuggggacagccaaagguagccugccagggaggagauagaaaacccaagucaacucccaacccagagccucaaccacaggcccagguggccaccuugguggccuccagagaaggauaaggcggggucccacacucacuggugaagaguugcuggaugcgaggaaagccacugccaggcccacccaggaggaugcugaccacgauccaugugacacccacacugacgacuaggaccacaaugcggagagggccuggaggcaggauagacacaggguggggucaccucagauaccagcgaaccccagaaugaccccauagccuugcaugacuggaucuccccugccacuugggaagaaguggcuggaggacaaggagguggagaccuguugccuucuaccagggcugaaagggagacuugagcucccuggcagguggaaggaggaaauugaguucaaaucccaaggcugcuggguuugguuuucccuggcgggucugggagggggccuuccagaacucucugcucgagaagggcuccagcccucuuuccaagaacccccucaacuuccugccucugaaaccaccaauauauuugggcauccaccugccccugcuuuccuccuguucugagggagaagggucccuacucccuuuuaagaccagucccggccgggcgcaguggcucacgccuguaaucccagaacuuuaggaggccgaggcggguagaucaugaggucagguguucgagaccagccugacaaagauggugaaacccugccucuacagaaaauacaaaaauuagccgggcaugguggcgcgcaccuguaaucccagcuacucaggaggcugaagcaggagaaucaguugaaccuggguggcggagguugcaguuagcugagaccaugccacugcacuccagccuggcgacagagugagacucugccucaaaacaaaaacaaaaacaaaacaaaacaaaaccaaaacaacaacagucccgucaucugcugggaccuggauugcaagcuccccagccuucucugauuucuuguaauagugaucacucucucuaguucgcucuuucuccuguauuuucaacaucuccaauguuaaggaagcaaagaaaacacucuucuucaaaaccacauccccauccucuuuccccuaaccuuucuuuucccugucaacccccucaaaagucaucuauacucauuccaucaucucaccuccuacucccucccacccuacuccagucuggccuggcuuccaccaccucaccaaaucagcuuguugccaaggccacugaugaccuuuguggugucaccaccccuggugaccugucagccuugaucuuccuugaccucucagugggcugcccauguccaccugacagaagcacuaacuucucugcuggcuuuccggacagcacacucuccugacccaaucucucuggacacuccucauucuccuuaguuagaucgucuccucuacccuccccuuaaaagcuggacuuucccaggcucccaucucaggcugccuucuggucccuaccuguagugucuuuuuauuuuuuuuauuuuugagacggagucuugcucuugccccccaggcuggagugcaauggcgcgaugucggcucacugcaaccuccgccuccuggguucaagcgauucuccugccucagccucccaaguagcugggauuacaggcgcgcaccaccgugccuggcuaauuuuuuuuuuugagacagagucuugcucuguugcccagacugaagugcaguggcgugaucuuggcucacugcaagcuccgccucccgguuacacgccauucuccugccucagccucccugguagcugggacuacaggcgcccgccaccacgcccggcuaauuuuuuuguauuuuuaguaaagacgggguuucaccauguuagccaggauggucuugaucuccagaccucgugauccgcccgccucggccucccaaagugcugggauuacaggugugagccaccgcacccggccaugccuggcuaauuuuuguauuuuuaguagagacgggguuucaccaucuuggccagacuggucucgaacucuugaccucaggugauccacccgccuuggccucccaaaguguugagauuacaggcgugagccacugcgcccagcugucuuuacuuuuuugagacggagucucgcucugucgcccaggcuggaguuaugcgguggcgcaaucucggcucacugcaaccucagccucccggguagcugggauuacaggcacccgccaccacgccaggcucauuuuuuuguauuuuuuuaguagagaugaggauucaccauguuggccaggcuggucucgaacuccugacuucaagugauccucccaccucggccucccaaagugcuaggauuacaggcgugagccaccgcgcccggccuguaguguguuuuuagaugaugucaucuacuccuagcucuuuaauuaagcaccaugugucaaugacuuucuauuuucuaguuccagccguggccucucuugaaaccacucccugccagcugguuccucaguggccagcuccaccuggauauguccacaaaguuaccaccuuagcaagucugaaguccaauucccgaguuguuucuacucuccacccagccccaaccuaucccuccccaaggaucuucaucuuacuuguccaggugacaguagggcugucaucggguucaugucgaagcccacagccacuuuugucacuuccccucuaagaccacgccucuccaccuggacugcccaccuccucucucucaccacucauuuuccaaaaagcagcuggucugcuaccugcguugggagauacugacuauacuaauccucaugucauagcucggggagcugacguccucagaggugaaaggauuugguuaaggucaaggaacgaguguuugugcagaguccuccauuuccaaaaccaaacccagugguucacccgggccucuccagacacagaugucgcgacgcugggccuccagccaggugcccuuuucaacucccucccguucgcuguggaagccacccaccugccaaccucauguccacuucuccugcuggguugggaccgccggcaagugcacuguuugggggcaaagcggaaggacagguuugggugggggucaggggcaagccugugcgggaccccugcugggggcgggcgcgaucggugcuacgaccuguuuguccagccgcccggccaggcagggcuccucggaaacgcgcggggaaacccugccuggccaggaggggccucaggaacccguuggcucacgaucuugcccacaggagccuccggggcugggacgaagaugugguucuccugggcucgggccguuccuccgggccugggggcuggcgaugcgggccgggccggagauuucucuggccguggggagacgugggcucggucagggagguucccugucaggcccgccgacccgcuccgcccccggagaggacgcaaggccgcugcgcaggguggccaggcaggcccggcaauggcggcuaagggcggggccacagcccgccggccccgcccccggcagcagcugcgccgucuggcuccacgcaggccccgccuccagacccgccucuaccgcucgc

SEQ ID NO: 19049 - RNA, 10189 nt, Homo sapiens
gcgagcgguagaggcgggucuggaggcggggccugcguggagccagacggcgcagcugcugccgggggcggggccggcgggcuguggccccgcccuuagccgccauugccgggccugccuggccacccugcgcagcggccuugcguccucuccgggggcggagcgggucggcgggccugacagggaaccucccugaccgagcccacgucuccccacggccagagaaaucuccggcccggcccgcaucgccagcccccaggcccggaggaacggcccgagcccaggagaaccacaucuucgucccagccccggaggcuccugugggcaagaucgugagccaacggguuccugaggccccuccuggccaggcaggguuuccccgcgcguuuccgaggagcccugccuggccgggcggcuggacaaacaggucguagcaccgaucgcgcccgcccccagcaggggucccgcacaggcuugccccugacccccacccaaaccuguccuuccgcuuugcccccaaacagugcacuugccggcggucccaacccagcaggagaaguggacaugagguuggcagguggguggcuuccacagcgaacgggagggaguugaaaagggcaccuggcuggaggcccagcgucgcgacaucugugucuggagaggcccgggugaaccacuggguuugguuuuggaaauggaggacucugcacaaacacucguuccuugaccuuaaccaaauccuuucaccucugaggacgucagcuccccgagcuaugacaugaggauuaguauagucaguaucucccaacgcagguagcagaccagcugcuuuuuggaaaaugaguggugagagagaggaggugggcaguccagguggagaggcguggucuuagaggggaagugacaaaaguggcugugggcuucgacaugaacccgaugacagcccuacugucaccuggacaaguaagaugaagauccuuggggagggauagguuggggcuggguggagaguagaaacaacucgggaauuggacuucagacuugcuaaggugguaacuuuguggacauauccagguggagcuggccacugaggaaccagcuggcagggagugguuucaagagaggccacggcuggaacuagaaaauagaaagucauugacacauggugcuuaauuaaagagcuaggaguagaugacaucaucuaaaaacacacuacaggccgggcgcgguggcucacgccuguaauccuagcacuuugggaggccgaggugggaggaucacuugaagucaggaguucgagaccagccuggccaacauggugaauccucaucucuacuaaaaaaauacaaaaaaaugagccuggcgugguggcgggugccuguaaucccagcuacccgggaggcugagguugcagugagccgagauugcgccaccgcauaacuccagccugggcgacagagcgagacuccgucucaaaaaaguaaagacagcugggcgcaguggcucacgccuguaaucucaacacuuugggaggccaaggcggguggaucaccugaggucaagaguucgagaccagucuggccaagauggugaaaccccgucucuacuaaaaauacaaaaauuagccaggcauggccgggugcgguggcucacaccuguaaucccagcacuuugggaggccgaggcgggcggaucacgaggucuggagaucaagaccauccuggcuaacauggugaaaccccgucuuuacuaaaaauacaaaaaaauuagccgggcgugguggcgggcgccuguagucccagcuaccagggaggcugaggcaggagaauggcguguaaccgggaggcggagcuugcagugagccaagaucacgccacugcacuucagucugggcaacagagcaagacucugucucaaaaaaaaaaauuagccaggcacgguggugcgcgccuguaaucccagcuacuugggaggcugaggcaggagaaucgcuugaacccaggaggcggagguugcagugagccgacaucgcgccauugcacuccagccuggggggcaagagcaagacuccgucucaaaaauaaaaaaaauaaaaagacacuacagguagggaccagaaggcagccugagaugggagccugggaaaguccagcuuuuaaggggaggguagaggagacgaucuaacuaaggagaaugaggaguguccagagagauugggucaggagagugugcuguccggaaagccagcagagaaguuagugcuucugucagguggacaugggcagcccacugagaggucaaggaagaucaaggcugacaggucaccagggguggugacaccacaaaggucaucaguggccuuggcaacaagcugauuuggugaggugguggaagccaggccagacuggaguagggugggagggaguaggaggugagaugauggaaugaguauagaugacuuuugaggggguugacagggaaaagaaagguuaggggaaagaggauggggaugugguuuugaagaagaguguuuucuuugcuuccuuaacauuggagauguugaaaauacaggagaaagagcgaacuagagagagugaucacuauuacaagaaaucagagaaggcuggggagcuugcaauccaggucccagcagaugacgggacuguuguuguuuugguuuuguuuuguuuuguuuuuguuuuuguuuugaggcagagucucacucugucgccaggcuggagugcaguggcauggucucagcuaacugcaaccuccgccacccagguucaacugauucuccugcuucagccuccugaguagcugggauuacaggugcgcgccaccaugcccggcuaauuuuuguauuuucuguagaggcaggguuucaccaucuuugucaggcuggucucgaacaccugaccucaugaucuacccgccucggccuccuaaaguucugggauuacaggcgugagccacugcgcccggccgggacuggucuuaaaagggaguagggacccuucucccucagaacaggaggaaagcaggggcagguggaugcccaaauauauuggugguuucagaggcaggaaguugaggggguucuuggaaagagggcuggagcccuucucgagcagagaguucuggaaggcccccucccagacccgccagggaaaaccaaacccagcagccuugggauuugaacucaauuuccuccuuccaccugccagggagcucaagucucccuuucagcccugguagaaggcaacaggucuccaccuccuuguccuccagccacuucuucccaaguggcaggggagauccagucaugcaaggcuauggggucauucugggguucgcugguaucugaggugaccccacccugugucuauccugccuccaggcccucuccgcauugugguccuagucgucagugugggugucacauggaucguggucagcauccuccugggugggccuggcaguggcuuuccucgcauccagcaacucuucaccagugagugugggaccccgccuuauccuucucuggaggccaccaagguggccaccugggccugugguugaggcucuggguugggaguugacuuggguuuucuaucuccucccuggcaggcuaccuuuggcuguccccagucugucuccuggcaucaggcgcagccucccccaacacccaguugcuucaucuaggaaagccaauaccugaucacuagaauuauaugcccaacuggagucaguagggccagaguaagggguagggagcuuccacugaacauggggagugaugccccgguugcucccugcaggcucugagauggagaggggacucuccaccuuguugacugguaauaggucaccugaguacuuuuuuguuuguuuguuugagacagugucucacuuugucucccaggcuggagugcaguggugcaaucucgguucacugcaaccucuaccuccuggguucaagcgauucuagugccccagccucccgaguagcugagacuacaggugcgcaccaccaaacccggcuucuucuucuucuucuucuucuucuucuucuucuucuucuuauuauuauuauuauuguauuuuuaguagagaugggguuucaccauguugcccaggcuggucucaaacuccugggcucaagcaaucuacccgccucagccucccaaagugcuacaggcaugagccacuaugcccggccaggucaucuaaguaguuuuucuaauuccauuucccccuguuccuagaguagggaguuuuucaucugaacaugacuuacacuugagcaggaagcaugccaaggucggccuggcuuagcccccggccccugagccugacugccugugucuacacuucgcgguguaaggagggccaggcugcccugccgcaggccccgggaggcuccacacuaacagaaaccacucuguauccacagguccagagagcucggugacugcagguaaggccccugucaccucccugcuccuccccuuugugacaucccugccugcccccggucccguagggcuucgguuuuccauuuauuccuccccaaaccagcuguggugguccacgggggcugcuugccacugucaaccuacaaaacaaguuacuuccugccaaguuacuuccugccagaauaugacgguggggcaggccuaggauagauacucccacugcaaaagggcaacuuggaaggaaaaaagaggucacccgucccaagcaaguccaaagcccagcagggcaaaauucauuugguuucaaggccugaggggaauccucuguggccugagauucuuucuucugggccugcuggaaugacccaugcucugaaacgagacagccccaccuucggggccacccuuccuucccuuuaucucaucucugcccccuucacuccaggccggcaguguuucugcuggugucagauucucaagagccuuguuggucucuuuugcaaguuauagaggcccaagcuauaaaaucagagaguuuucccacagacgcuuccuagauaaccccaucuucauuguagauuucugcugaaaggguugaguggacccacgagucacauaccucagcucuggggcaaacgcuugaacagccuugcuguucuguccaggggacacuuuugcaguuuuuguaauaugauuaggccaagaauuuuccacaucuucgcuuucuggcuccuuugugcucaacaguuucuuccuuaugucucucacauuuuacuauaagcagcaaggagaagucaggcuacgcucucaacacugcuuggaaaucuccucagcugaauauccaaguucagcacccagcacuuacacauucuccuuucgacaaaacacuagaacacaauucaaccaaguuuuuuuuuuuuuuugagacggagucuugcucugucacccaggcuggagugcaguggagccaucuuggcucacugcaaccuccgccucccggguucaagcgauucucccaccucagccuccugauuagcugggauuacaggcaccugccaccauacccaacuaauuuucauauuuaguagagaugggguuucaccguguuggucaggcuggucucgaauuccugaccucaagugauccucccgccuuggccccgcaaagugcugggauuauaggcgugagccaccacaccugggccaaguuccuuuauaacaaggaucagcuuuccuccagcgcccaauaacucaauaacaugucccucauuuuccucugaggcuuaaccaaaagcaccuuuuuuuuuuuuuuuuuuuuuuuugguagagacagaggucuuacucuguugcucaggcuggaguucagugguaucauccccgugcacuguaagcucaaacuccugggcucaagcgauccucucaccucagucucccaaguagcugcgacuacaggcaugugccaccacacccagcuaauguuuuauuuuuuauuauuuauuuuuugaauguauugagacagggucuugcucucucacccaggcuggagggcaguggcgcaaucauagcucaagugauucuccugccucagccuccugaguagcugggauuacaggcauguaccaccacacccagcuuauuuuguauuuuuuguagagacggggucucacuauguugcccaggcuggucuugaucaccuggccucaagugaugcuccugccuuggccucccaaggugcugggaucacaugcgugaaucaccacacccaacccaaaagcaccuuuaacauucauguuucuagcaacguucuguucuugaugauauuuguauucucuaagaccacagaggcugucucuauugcucuccccuccucucaccagaauuaccuuuaacauccauacuccuaccaacagucucuuaaaggcaauccagaccuuuucuaacauguaccucaaacuucuauagccuugauaugguuuaaaugucaucucuaaaacucauguugaaauuugucaauguauugguauugagaggagggccuuuuugagguaguuacgucaugagggcucugcccucaugaauggaugaaugccauuauuaugggugaguuaguuaccuugaaguucagcccccuuuuuuccugcgucucauaugcuugcuuccaccuuccaccuuucugccacgggaugacccucaccagaugccggcgccaugcuuuuggacuucccagccuccagaaccaugagccaaaugaaucuguugucuuuauaaauuacccagucugugguauucuguuauggcagcagcaaauggacuaagacaagccucuacugacuacccaguuccaaagccauuuccacauuuuuagguauuuguuaccuaagcaccacacuuccuggugccaaaaccuguauccauuuccuggaacugccauuucaacuggguggcuuaaacaacagaaauggauucucuccccauucugaaagccagaagucugaaaucaaagugucagcagggcguuacucacccugaaaguucuacaggaggguccuuccugaccuccccagguuccaguggccccaggcauaccuuggccucuggcugugucacuccugucucuuccuccacuguaccauggcugucuucccucugugugucuuugucacuucuguucuuauaaggacaucagucauguugcauuaaggacccaaccuacuccaguaugaccccaucugaacugcaaaggcccuauuugcaaacaucacauucugaaguaccacagauuagaacuucagcauaccuugaggggacagaauucaacccauaauagaagccauccugcuccaguccucccaaccaacccccaucaaaaucgggagacaggcugcacccccugccacacuacccccugccacacugccuuugcucagguuggccucauccaugcagcuagacccccagccugacuuacuucaccccugcuuuguuccuggcugugcaguggcccaggccagcccucagcauccuuucuuuucucccaccaguaacagaaaauccuucugucuugggucccuguggccucaccaguaggacacagaguauggaaguguccccagccucggccugagccacaucccccuacuuguguccugcucugcggucacuuguucuaccaugugugcugguccugaccuccccuucagaucucaggugaccucagggccaggcccauggauaacaccugcuaucccugcccagcgccacgggccaggaaguacaaguguggccugccccagccguguccugaggagcaccuggccuuccgcguggucagcggggccgccaacgucauugggcccaagaucugccucgaggacaagaugugagcucccuggggugacuggggaucagggagggagugggggauccagggccgggucugcaagggagaguggagcagacgugcccaugugggaucuccccgucccccccacccccccccaacuaggcugaugagcagcgucaaggacaacgugggccgcgggcugaacaucgcccuggugaacggugaggccccuggcugagcguggccugccgcccuccuucccugcucccuccccaggaggccucuggguguuugcccucccuuccccucccauucaagaucucccagggaggccugggaaggagucugugcaagcgcaaggcuccacagaggagugacccaaugaacaaaaaagcaugauggcaauaaagaacuagggaagguucugggagguugagggugcuucauggagagcccccggagggccucaaaugccagacagaggcaccacggcuuggggugggaugcagcugccugaacaaauggaugaauauugggggacuguuugaaagcuuccagaagggcugccccccacccccggugcuacccgccugccgugcccugaggcuggccuggcuuacccagcagggccccucccuccugacacaggggucagcggcgagcucaucgaggcccgggccuuugacaugugggccggaggugaguugcagcgcagcgucuugcauuuugacugcagcaaaaugaccugggcagcuuccccugagacacugcucucucugucuguacuuggagcuucucagucaccuccguggguucagaaaggacaggggcaucgccagcuuggucuggaggcugugggaggucacggggaugccucagcuuccuacaccagccugucccuuggcggggcaugucccaggcccaaucccuacuucuguuuccuuguuuggagaacgggcuugugggagggugcucaguggugccugaugaccccuguuccguggcaccugcccccccagaugucaacgaccuguugaaguuuauucggccacugcacgaaggcacccugguguucguggcauccuacgacgacccagccaccaaguaggugcuuggggaggccagccucagccuugcccuucugcagcaacagcugacaccccuuccucccaugcugcaggaugaaugaagagaccagaaagcucuucagugagcugggcagcaggaacgccaaggagcuggccuuccgggacagcuggguguuugucggggccaagggugugcagaacaagagccccuuugagcagguauggggggugccuggcaucacccccaccggggcagccugucgccccuucugccugcaugcgacgagccuccccagcugcucacgccccagcaggggaccguccccaguccagcuaugaggggugggccagugcagcugaugccauguuucccugggauggguggaggggccaagugcccugagaguacaccguuggccaacacagcacaguugacugacagccuggguccugguccacuccuguccccugucccugagggccaaagucaugacuuucugcuccccuccccacagcacgugaagaacaguaagcacagcaacaaguacgaaggcuggcccgaggcgcuggagauggaaggcuguaucccgcggagaagcacggccagcuagcacggccagugccaggaccgggccgagggaggccagaccaagggaggcacgcgcgcugccgggcggacagaggcugaggcucacaccccacacccgggcaggagcgcucccuggccccaacacaucggggcuccgaggcagugaccagaacguggucucaagguggugggggcuaugggggcugcaggggguagcccugccgcacuuugucacgggagcccaggguacccgccuccuuuucguaacacuguuccccccggucagcccaucuagcccuguccuccauuccucacgccaucuccauccccaucuugaguccuggaacggcccugggugccugccccucacugugcaacucugggagcagcccggcagguuggggcgucuuccagaaccucucccuucuggagccacucugcacugcgggcuaaacauguuuccagugugauuccuuccagugagccaaacccgguggcugcuucaugagccugacugccucucgccugcucucagcaggaagggaccccuggagcaggcuggcccgggguggugaaguagcuggagcccgaucacagucccgcgguuugucagggggcccaccuucuagaugaccccuuaauaaagugauggccccacagaagaaaugccuucagaugcuguugucagugcg

SEQ ID NO: 19050 - RNA, 656 nt, Homo sapiens
ugauaggggagcagccggauaagaaaaucaaaaaagaaacaguaauuuaaaguuuauuccagcuauaaugcagguuauucugacuuuaagguaacaucacauggcauacuucugaguccauucccgagauauucuguuguacuuaucucugucuguuuuauagauccgugcaaucucuggcacuaggggaucaucuggguuuggaucacauagcagugaacaaauggauaaaagaacuuuagaaaguguuaaagcaggcgaccacugugaucuuagaaugucaagaaaaaugcugccauuacuguuaauauuugggugauaaauucuuguuguaaaugcaaccuuagaugguuugaagggguagucuguaggaaaacgaauuguccaaaagaauacaccgccuugauauggucugucaugaggucccauaauuguggcuugccagugaaacauaucauccccaacuggaccugcagaacauugugcuggagggucacgggccaaaucacuaaguuccuuauuaauccguuucagcgccauagugugugcuugucgucuggcuccucacucucucaguguaugcucaaagguccggccaaaacucuugauuauccuggcggcggggcaggauugucucgucucacaccagcucugcc

SEQ ID NO: 19051 - RNA, 656 nt, Homo sapiens
ggcagagcuggugugagacgagacaauccugccccgccgccaggauaaucaagaguuuuggccggaccuuugagcauacacugagagagugaggagccagacgacaagcacacacuauggcgcugaaacggauuaauaaggaacuuagugauuuggcccgugacccuccagcacaauguucugcagguccaguuggggaugauauguuucacuggcaagccacaauuaugggaccucaugacagaccauaucaaggcgguguauucuuuuggacaauucguuuuccuacagacuaccccuucaaaccaucuaagguugcauuuacaacaagaauuuaucacccaaauauuaacaguaauggcagcauuuuucuugacauucuaagaucacaguggucgccugcuuuaacacuuucuaaaguucuuuuauccauuuguucacugcuaugugauccaaacccagaugauccccuagugccagagauugcacggaucuauaaaacagacagagauaaguacaacagaauaucucgggaauggacucagaaguaugccaugugauguuaccuuaaagucagaauaaccugcauuauagcuggaauaaacuuuaaauuacuguuucuuuuuugauuuucuuauccggcugcuccccuauca

SEQ ID NO: 19052 - RNA, 14949 nt, Homo sapiens
cggucucgcccuccguacuggccgagccagcaaaucgcauugcgcagacgaccagcgggcgccucggauuccgcccccgggauggccccgccuccucccgccccgcggcaaggcacgcacagggcagugcgcggguggguggguccuagcagcgcggccugacgggaccaaggcggcgggagucugcggucguucccucggcuguggaccgggcggcacgcacgcggugcaggguaacauggcggaugcggaagguaagggcugcaggcuuccgggccgugcuaacuccgggcgacucggggaacggggguggggggaugguaucggggcccgcgcacgccucccucugguucccgccggcgugucggccucuucaccgcccggccuuaagccggccuugucucucggcccuggcuccguggcaagggcgcgagagugggagccccucgcggugacuuggcaugauggggcucggcccucucaccucccugggguccgggucgccgucgaaagacaucugccgugcugcccaccccgcgguggcgugggacguggcagugucugugcugcugccagcccggacgccgccguuacagcuccaugcgacuaggggagcaaggguaguggaaacgggccgagaagaaaaggagcggagggaccccggagcagggauagagcuccgaguugcaagaaaguucuagaggccacaagcccgcggggacagucgaguggucgcuuauggaacuuuccggcccccugcgugagcgcuucugugggauguuuaagcucugccauagccacguggugaaccggaagggaagccgacacgugcaguagccuacagucaguuacccagccaugggacccauacauuuggccuuacacaccuuguuuucucgcuuaccuacggauauacguucuaagaaaugggucguuaggcgauuucaucauugugugaacaucagagggcucuuacacaaaccuagguggcauaggcuacuacacaccuaggcuguauaugguguagcguauggcuccuaggcuucaaaccuggacagcaugguauugugcggaaugcuguaggcaguugggacacagcgucgagaguuuguguacuuaaacaugucuaagcagaaaaaggacaguaaaaauauagcacagggccgggcgcgguggcucaggccugugaucccagcccaggcuggcggaucaccugcggucaggaguucaagaccagccuggccaacauggugaaaccccgucucuacuaaaaauacaaaaaauuuaggugggcguggugguauacgccuguaaucccagcuacucgggaggcugaggcaggagaauugcuugaaccuggagaaggagguugcagugagccgaguuucugccacugcacuccagccuggggaaagagugugaccgucucaaaaaaaaaaaauuauauauauauauaaauauguguguguauauauguauauuauauauguauguauuauauguauguauauuauauauauauaguacacaagguuauaaguggugcacccguagaggagggcacuuaccaugaauggagcuugcugagcuggaaguugcccugguugagucggugacugaaugugaaggccucagacauuacacuacuggagacuuuauaaucuguacaccuaggcuacacuaaauuuauaaaaauauauuuuucuucagaauaaaucaaccuuagcuuacuguaacuuuauaaacuuuuuacuucgacuguuguaauaauacuuagcuuaaaacaaacacauuauuuagcuguacguaaauauuuucucugcuuaucuccuuauuuauaaguuuucuauuuuaaaauuuuuuaauuuuuuucuuaaaaaauuuuuuuuuguuaacuaagacacaaacacagcacacacaguagccuugaccuacacagggucaggaucaucaagacaucacuaggagauaggaauuuuucagcucuguuauaaucuuaugggggccaccaucacauacgcagucuguacuugcaaaacauuauguggcaugugacuguaauuguagaccuaaaauccauuuccuaccugcccuaauuucggucuuuauuuuaaacccuuguuucauuuauucuuggggaaaauucccaaauccuguguuuguuuuuuuaguaauuauuuugccaaagaaacauaagaagaaaaaggagcggaagucauugccagaagaagauguagccgugaguaguaauguguuugacuucacuuugacuaaaaagaaaguuuacuuaaauaacaaacuaaaggaaagaaguguuuuuaaagguuuccaaggaaugggccagcauugguagucauuguguagauucgaaaaagcacugaaaugacacagccccagacaguccaaguguccuucaggcauagcuuacuaaauggugcuggccuuaccaacugcugucucugaauuugucuuccuuaugccacccacagacccgccaucccccuuucucuuuaaauguuuggacccaucuuagugacauuucacuuccccucuguacuccugguucauuucuucucucucuuucccuuggaggucccagugaaaaggcauaggaagccuuguuuucuguuuaaaaggcauacauuuccauggcaguaauggaauuguucaaaaucgggugggaaguuuaauagguuauauuucuguccugucgaaggaaauacaacacgcugaagaauuucuuaucaaaccugaauccaaaguugcuaaguuggacacgucucaguggccccuuuugcuaaagguaugugguuaaaaucgugcaucagaugaaugccugcuuuuacguuauuuccaaguguuaaacaauugauugagaaugcuuacugcuggcauccuugacuuugggaagugcccacugauacaguuuaaagcaggauuccuuaagguaucugaaaugagaaccaaguuuuuaaaaaauuggcagugcacucaacacuguuguagaacacauguccccacaauguuaaauugcugaguuugucaacaguucucaguuuuuguacuuaguccaucuugcagaccuaugccaguuugugggccacauagugguacugacucuuuuuuuacaugugcucacgacaugguauuuuguuuuguguugugucguugcuuuguagaauuuugauaagcugaauguaaggacaacacacuauacaccucuugcaugugguucaaauccucugaagagagagauuggggacuauaucagguaaguguugggaggaggcacugugcaaacuuacuuucuuuugaaaaugcuuucacaucagcuauucaggaaggcaguggcaugccagaauagcuuugucuugaauauauaaccuguacccgcagugaauuauuuuucuuuuuaacuuuucagauuuguuguuucacuggagcauuaagagugggugauacauuaauuuuuuuuuuuuccauuccaggacagguuucauuaaucuugacaagcccucuaaccccucuucccaugaggugguagccuggauucgacggauacuucggguggagaagacagggcacagugguacgcuggaucccaaggugacugguuguuuaaucgugugcauagaacgagccacucgcuuggugaagucacaacagagugcagguaugugggagagggagggaaggacuggcuagagugaaaagcuuucuguauuucccuucuauguuuugucugcuggaaacuauuucuucauuaagaaaaaaaaaaauccuaaagcaaggauauuguuuugguuucuguguacguucuguccccugccagaucuuggugguccgcgcuuuuuggaauuccacauacuaagcauguauucaucaagcugacuggauccauuuguccggguucagcucucagcuugucacuccaggcuucucacucugugcuaccgcuucugccuaaaguauccuucguucauuuuuaucugagaaaagccugcuuaucuugcaaggcuuuuuccacgcagcuucuacacugaguacucccaacugucccuguuaguacauugaauucccagugagaaagugucuucauucuuucccacaucaucaccaugaaaucucucuuaaugcaaauuuuauagaaacacaaggucaaacugccgcuuuuccugcugugcaaaaugggagugacugagcauauaagaaauauggaaaacagaaaacucaguggccacaccugacuacucuuuugucauuuuucaggcaaagaguauguggggauuguccggcugcacaaugcuauugaaggggggacccagcuuucuaggguaagucugcaauuguagggaggacacccuuuguugacuuggaucucugagccccuaaacaucuggagauggguuagcuguccugacugacuccuuuuguccccuuuucagucggcugcugcagccagccuggaccagugacugcacauguacauucugaugagguguuuguuuucauuuguguuuguucuuaggcccuagaaacucugacaggugccuuauuccagcgacccccacuuauugcugcaguaaagaggcagcuccgagugaggaccaucuacgagagcaaaaugauugaauacgauccugaaagaagauuaggugagucauuaggccugugaguggguaugaacacauucuucaggauucuguucucuuauuaaaaguagaugcccuugaaguugaagacuuucuaaaaccugcccuacagcugggauauugucugugggcgauaguuuuuguuaucuuuuguugaaaaagugaacagugccuaguaaagugagauggcuuuuacaccuuuuaugaugacugcuucugcuggaguugaaauguuuucauucugcauuuguguaguucggugcuuuguucaaagguaaguguuuucaccaaaguauguuuugcauguguuuuuuauuuguugcaauuuugacugcuuagaaguuucuguugucagaaguaaauuuaagacaaugccaauuuuccucccauccaugaaacauaccaugcugaauauaccugcaacuuaaguguuaaaaauucugcuaauaucagaauuacagaucuuuuuuuuuuuuuuuuuuuuuuuuugagacggagucucgcucugucgcccaggcuggagugcgguggcaugaucucggcucacugcaaacucugucucccggguucacaccauuuuccugccucagccucccaaguagcugggacuauaggcgcccgccaucaugcccggcuaauuuuuuguacauuuaguagagacgggguuucaccauguuagccaggauggucuugaucuccugacgucgugauccacccgccucugccucccaaagugcuggaauuacaggcgugagccaccgugccuggccagaauuacagaucuuuacagcaaaugcuuauauuuuaagaagugugucugucaccucuagucuugguggcucagaugaaggauaacugcauuucucaaccagugauguauuuacaguaggugcugcuuuucuuuuguguguguguaucuuaggaaucuuuugggugaguugugaggcuggcaccuacauucggacauuaugugugcaccuugguuuguuauugggaguugguggucagaugcaggagcuucggaggguucguucuggagucaugagugaaaagguauguguuacggggcuagaaguuuuagagcugguucuuaccaucugccagccuuugauggcacuccacuugcuucaugucgugggaaagaugcuuuccaaaguguugaguucaguccagggcagcuucccuguucuguuaauuaaacuuugggacauuaaaaugggcuaagggagaugauuggguagaaaguauuauucuauucauuugccucccagccuacaaaaaugccugcuuggggucuaauacuucaacgguuaaagaugccuggaagagggcgcgguggcucacgccuguaaucccagcacuuugggaggccgaggcggguggaucaugaggucaggagaucgagaccauccuggcuaacaaggugaaaccccgucucuacuaaaaauacaaaaaaaauuagccgggcgcgguggcgggcgccuguagucccagcuacucgggaggcugaggcaggagaauggcgugaacccgggaagcggagcuugcagugagccgagauugcgccacugcaguccgcagucccaccugggcgacagagcgagacuccgucucaaaaaaaaaaaaaaaaaaaaaaaaaagaugccuggaagagccaggacugaagaggcugaagacauaaugagcuuggacuaguaaacaagugacauucaguuuuaggaaguuuggggucugaugggcugagauacaaauaaacugaauuauuuucauacauggcugcuuuucaggaccacauggugacaaugcaugaugugcuugaugcucaguggcuguaugauaaccacaaggaugagaguuaccugcggcgaguuguuuacccuuuggaaaagcuguugacaucucauaaacggcugguuaugaaagacagugcaguaaguuccggguuaggaguuuauauuuggaaagaacguacuccaaagaugaggcuugcucuuuuuauuguuuuccuuggguuuuauuuuauuuuuuucaaguccaaaccaaguauauuaauuuaaaguaaaaguuuaaugguaggcauacuuaaaaauaaggcacauuaggccaggcacaguggcugaugccuauaauccuagcacuuuggcaggcugaggcaagaggaucacuugaguccaggaaggaguuugagaccagcuugagcccaggagaucaaggcugugagcuguguuuuuaugaugaucagagaguuggccuuuuauaaauuaaaacauugucuuuuucucuaacuugagggauaaaaauuucuggauauuuaaaauguuuguaguugguaauuauuuauauucaaaucuuguauagauguucacauuuuuuguauguguauaggcuguaauaaauacugaaagauggcaccauaauaguugaaaaaacucagucacaaaacaguggacaacauaaaugugauguccucuccuuaucaaaccauuggcuucugggugaauguaaagggaggggagaaugugaucaaaagaggucuaggugaguggagaugguaugaggcagaugggugcauuggguaccauugaaccucuggagagguagccuuaacuuguacccacugaccuauaaauucugcaccaagacuuuugugugauugguucaacagggcucaguaaucuuguuuucaaguucuuuaagagccuguuauugccuggaucuccaguaaaucuguucuuucuccucauaaggaggagagaggaguaauuaaggaaugccaaggcuauuuuuauguuucaaaugaaaauauggaccacgugcgguggcucacacccauaaucccagcacuuugggaggccgggccaggcaaauugcuugagcucaggaguuugagaccagccugggcaauauggugaaacccugucucuauuaaaaauacaaaaauuagcugggcgugguggcacgugccuguaaucccagcuccuugggaggcugagaaucacuugaacuugggagauggagguugcagugagccgagaaugugccacugcacuccacccuggacaacagagggagguucugccugaaaauuaaaaaaaaaaaaaaaaaaaaaagaaaauacuugugagucucuagaaccugaaaaccugaaagucuucuuuacuacuuuugagucguguguaaugugcggagagugguaccuauagcacagugagguggcucuucugaguaccacucaugccccuugcagcuagugggcuauaagugucaucccuguuuccuggugucaggccccacucccuuguuguccuccuuuacucuggugugggagugggguggagggcagcagcugggccccuuacacuuggugccaucucugcagguaaaugccaucugcuauggggccaagauuaugcuuccagguguucuucgauaugaggacggcauugaggucaaucaggagauugugguuaucaccaccaaaggagaagcaaucugcauggguaagaggggauguuuauuuuuuaaauucuaaauguuugugguuacauacuagguguauauauuuaugggguucaugagauguuuugauacaggcaugcaauacauaauaaucacaucauggagaauggggcauccaucuuaagcauuuauccuuuguguuacaaacaauccuauuuuacuguuaguuauuuaucaccuuaguuauuuuaaaauauacacuuaaguuauuauugauuauagucaccccguugugcuauuaaauagucucacucuucuuguucauucuuuugguuuuuugguggugguguuuuuuuuuuuuuuuuuuuuuugagacagucuugcucuuuucacccagacugcagugcagagacgugaccucggcucacugcaacuucugcuucccagguucaagcgauucucgugccucagccuuccgaguagcuaggauuacaggugcacaccaugacaccuggcuaauuuuuuguauuuuuaguagagacaggguuuugucauguuggucaggcuggucucgaacuucugaccucaggugaucugcccucccaaagugcugggauuacaggugugagccaccaugccgggccugauuuuuuuuuuuuuuguacccauuaaccaucccuaccucccugccagccccccacuacccucccagucucugguaaccauucuuuuacucuucucuguccaugaguucaauuguuucgauucuuagcucccacaaauaagugagaacaugcaauguuugucuuucugugacuggccgauuacacuuaauauaacgaucuucaguuccauccauguuguuggaaaugacaggaucucauucuuuuuuaaggcugaauaguaauccaucguguauauguaccacauuuucuuuauccauuuaucugucgaugggcacuucgguugcuuccaaaucuuggcuacugugaucucuuugauaacacugauuuccuuuauuugggguauauacccagcagugggauugcuggauccuaugguagcucaauuuaguuuuucgaggaaccuccaaacuguucuucauagugguuauacuaauuuacauucccaucaacaguguacaaagguucccuuuucuccacauccuugccagcacuugucauugccugucuuuuggauauaaaccauuuuaacuggagugaaaugauauuucauuguaguuuugauuugcauuucucucgugaucagcauugagcacuuuuucauaugccuguuugccauuuauuugucuucuuuugagaagugucuguucaaaucuuuugccuguuuuuugaucagauuauuagauuuuuuuuccuauagugcugaguuccuuauauauucugguuauuaaucccuugucagauggguaguuugcggauauuuucucccauucuuaugcauauggauaucuaguuuucccagcaccauuuauugaagagacugguuuuuacccaguguauguucuuggcaccuuugucaaaaaugaguuaaauguaggugugugcauuuguuucuggguuccuuauucuguuccauugguuuaugugccuguuuuuaugccaguaccauacuguuuugguuacuguagcucuauacuauaauuugaagucagguaaugugauuccuccagguuuguucuuuuugcuuaggauagcuuuggcuauuuugagucuuuugugguuccauguaaaguaccaguguuuuuuaacuugugaaagcuuagcuacuguuggauugucucuuaagacuuuaaaugcucugcgcacccucuuagugaaugaaccuuagagcuauucauuuaaugggucuaauuuguaccagaaguaagcaugucaucaggauuccuuagcucugugagcaggcaaggcagccacggcuuauggacagcagcagaaaaggaauccuuaaaacuucaaagguucuguggccccaaagggagugugcaugccguucuuauagacgucuugagcugcaagccuguuauguguaucguuaggugcuuugguuagguguuuuuuaacuucagaaguuuaacgucauuucaaaggccuccuucucauaauggaguauuuccuccauaugcacauccugagcaaagguaaccccaauuaaaguaguagcucagaguuuuaaaaguuuuaaaguggcauacaacaguagaauuggggcucaucaauuaucaauucuuucacccuucaaauaauucuuuucuuuauucaaugccuguagcuauugcauuaaugaccacagcggucaucucuaccugcgaccaugguauaguagccaagaucaagagagugaucauggagagagacacuuacccucggaagugggguuuagguccaaagguaagugguacuggguugcgugcccugccagguucuuuuuuuuuuuuuuuuuuuuuuaaauuuauuuuuuuauugauaauucuuggguguuucucacagagggggauuuggcagggucaugggacaauaguggagggaaggucagcagauaaacaagugaacaaaggucucugguuuuccuaggcagaggacccugcggccuuccgcagugucugugucccugauuacuugagauuagggaguggugaugacucuuaaggagcaugcugccuucaagcaucuguuuaacaaagcacaucuugcaccgcccuuaauccauuuaacccugaguggacacagcacauguuucagagagcacaggguuggggguaaggucacagaucaacaggaucccaaggcagaagaguuuuucuuagugcagaacaaaaugaaaagucucccaugucuacuucucuccacacagacacggcaaccauccgauuucucaaucuuuuccccaccuuucccgccuuucuauuccacaaaaccgccauugccauccuggcccguucucaaugagcuguugggcacaccucccagacgggguggcggccgggcagaggggcuccucacuucccaguaggggcggccgggcagaggcgccccucaccucccggacggggcggcuggccgggcgggggggcugacccccccccaccucccucccggauggggcggcuccugccagguucuuuuguuuggcauuguugaauacuugggcagcucuugguguguuucaccaccacagccuuguauugugcugggcucuggguugucgaugaguggaaacaggcccugucuugggccuuagagauuucagucuaaugaggggaaacaguugggcauuacucacguaaucacacaguggaauggcgaauuucaugcacguuaguggcuaccaaggagugcagagaggugucugucaccuggaguguccacaguggucaaggagucuggucaagggauugucuguuaagccacaccggugugaagaguggguuagguguuggugaagugaagaggggaggggagaguucagggcauugggagcaagcagcaugugcaaaggcaaaaaaguagaguggcugcgguggggacguuaugucugcagaggcucucacuaauaagcuuugugaucuucaacaaguccuguguguguuggaguuagugggcaaauucugaaugcucuggagaggaguuugaggcccugcugagaauacaccagggaggaaccuuguucuauucuuuguagucaccaugcccgcuuccagcauugacaccauucuaauguugacaccuugauguuccaccaggcaagucagaagaagcugaugaucaagcagggccuucuggacaagcaugggaagcccacagacagcacaccugccaccuggaagcaggaguauguugacuacaggugagggcaggauguuucagagccgggguggguagagacggcacacuugcugccuugaugcaggaguaugucaacaacaggugaggaugggaagguagagcccacuugccaucuggacgcaggaguacauggacaacaggugaggaacaggugagcauggagguuguagagcccaggggagggggagucacuugguuuggggcaaacuugcuaaaugcaggaccacaggaaccagcucuucagcucccgugagauuuuggcugcccaggccaguuaggggugugggccugcacggcagacaguuaucccuuucuagucuggcucgugggacucuagagggagucagucugcaacaguaaguggugaguucuucuguccagcgucaguauuuugaugguggcuuuagacuugccagauaacacuacauaacaucaguacugcccuggaaagccauucagugaauuugaccuauugcuaccucuuuuucagugagucugccaaaaaagaggugguugcugaagugguaaaagccccgcagguaguugccgaagcagcaaaaacugcgaaggugaguggcaugcuguccucaguuuggaaugugcuuagggagauaauccuaagaggcacuggcauucgucuuacuuugugacuguccgcaguccagccauauacgcuagcaucagaggugcagcgcauacacagguaaugcugccucauacccuggggugcuuguuugggcucugcaggcuccucugauuuguauucucuguccuaucugcugggaggaggaaugugggcucaggaaucagaugggccucgacuccuaccucagcuauggcagcaacacagugauggaaugggugguggugugugugucaauucuggcccccgcccugggucaaaugguaggacagauguguugaaaucagaggccauggcuguuggacauucgaggccauacaaaauucagcagagagcagaauugcaucuuaaccuggcaccacccaguguugaaagagucagucaagcauggguuggcaacuccaccccauggagcugcuggcauuagagcacagaaugacaggucugcacucagaaaccgggggcgguacugaguauccugcacaggcugugugggaggagcuucugacuugucagaugugaauuccugcuuugccugcuuucugugagagguccuugcagucaugagagaaacagcuccuccgggccuuuccaccccaagccccgugcugcugcugugcuccuucucuugugccugccucaaggcuucuuggauuugggggaugagacugucuucaaauccucaguaaacuaaggcccuguccggguuuguagucagaaaacguccuguuagauucaguugggaucuuucuuggugccuugcuaccuuuugacucacugaaccuuucuuguccauuauugcccaagaucuaacacuuaaccaauugcuuucaucucagcggaagcgagagagugagagugaaagugacgagacuccuccagcagcuccucaguugaucaagaaggaaaagaagaagaguaagaaggacaagaaggccaaagcuggucuggagagcggggccgagccuggagaugggguguguggaaacacguucagguuccuugggcuggcuuagucccugcguggggaaagaauuacccaggugguaccagcuuuguuacucuucuuggaggagcuguggccugggggugggaugccaccgagugccuuuagugcuuccccauguuccuggagugcuuuugcccucccuguggaauggacagauagaggcacccgaccucuaccacuuauacuuagagcucuauugaugguggguggagaggauguguaggauggugaucugaauguuuccacuuccaaaaguagaccacuagggugucacugaaagguuuacagaacuuugugucacaugcagcauuuaacccaaaauauccuuacagguccugaaaaaggcuugcuugacuguggaccuuuaccagauuuccuucugggagagucauagcuuuguuaguggaugguaucugugagcuuucauucucuuucuuucuaggacagugauaccaccaagaagaagaagaagaagaagaaagcaaaagagguagaauugguuucugaguagugaaggccacuugaagcuggaggagaaacuaaagccuuauugagaaaacauguuauagauccuuuuguugcugagagaguggaacauagguccuagacagggugaagaguucuggcacauuuuagcugcuacuuugagaccucggugauguuaccugguguggucaucccaucuuguccuguuuuaaggauauggguggugaaagaugaaagaggcagaguuuaucccaaugacuucucuguuugaguugggaagccucaccuucagacccaguaacuguccgcagcugucugcuagugguugucuuaacaucguaguccuaguuugcauuuuuuaaauccccucuguuuaaaagguuuguaaaacaaaaacaaaaaacuaagucugcucagugaaaugcuguagaacccuaaauaagugguagaagagugucacugaauuuugucucugaauucaguauaacugaguuuuguccaugcuggugucuggguuauaggccugaugggccugguaguuuuccaucuuguucuggccuagaggucaguccuuugcacuuccucaaagcuuguguacagugcucaccuaaauccaucugacuacuuguuccugugcccucuuguuuuaggccucguuuacuuuuaaaaaaugaaauuguucauugcugggagaagaauguuguaauuuuuacuuauuaaagucaacuuguuaaguuuuuuauguauuccuguuggguuuucuuguugaucucaugcuagcagagcaaaaauuguaaaauauuuugauuaaaaaucuagggaccuuuauguccu

SEQ ID NO: 19053 - RNA, 2836 nt, Homo sapiens
gcuuggggagaugcucgcucuguuggucucacucucucacaugcuuccccuggcucccuucguuccccccacccaacuuggccugcaugcgggagugugugcgagggagugggaggacgucgggggguggggggaggcauuccgguccccaagagaccugcggagggaggcggaggcugugagggacuccaggaagccauggacguugagagucuccaggaggcgcugaaagauuuugagaagaggggaaaaaggaaguuuguccuguccuggaucaguuucuuugucauauagccaagacuggagaaacagauucaguggucccaauuuaaaggcuauuuuauuuucaaacuggagaaagugauggaugauuucagaacuucagcuccugagccaagagguccucccaacccuaaugucgaauauauucccuuugaugaaaugaaggaaagaauacugagaauugucacuggauuuaacaguaucccuuuuacuauucagcgacuaugugaauuguuaacagauccaaggagaaacuauacaggaacagacaaauuucucagaggaguagaaaaggaugugaugguuguuagcuguguuuauccuucuucagagaaaaacaauuccaauaguuuaaaucgaaugaaugguguuauguuuccuggaaauucaccaagcuauccugagaggucuaauguaaaugggccugggacacccagaccacguaaucgaccaaagguuucuuugucagcccccaugacaacaaaugggucgccugacagcacagacagcaaagagguaaauuugcagcaaaaugaagagaaaaaucacagugacucuucgacaucugaaucagaaguuugcucagugagcccuuugaaaaauaaacauccagaugaagaugcuguggaagcugaggggcaugagguaaaaagacucauguuugacaaaaaaggcgaagucagagaaacagccauucaagcgacuugcagcgaaauuucuucgguuaugguagaagaaacagaagcaucaccuucaucucaggauaaagacaaagaaagccguuguacccggcagcgcguacagaagaggaugaagaggaagaagaagguauugagagaccaucuguaaaagggaggaguaagaagauccucaaauucuuguauucauugcuuucgugaaagaauuguacauaauagaacuccuuguaaugccgacauugggcuuuucucccaccuguauguaguuguugcugaauuucagggaaugugauuugaauuauagaacaucagaauucaugaaacuuaacuguggagguauucugaaaauaaaauuuaaguacaacaacauuugcuuauuuuuagagucuuuuaugacaucaagagaaaugaucccggaaagaaaaaaucaagaaaaauaaucugaugaugccucaacugugaaugaagagacuuuugaggaaaauaaucaaauggaggaaucugaugugucucaagcugagaaagauuuacuacauuccgaagguaaugaaaacgaaggcccugaaaguagugguucuucugacugccgugaaacagaagaauuaguaggaucuaauuccaguaaaacuggagagauucuuucagaaucauccauggaaaaugaugacgaagccacagaagucaccgaugaaccaauggaacaagacuauuuagaaacauuuagaugcaguauuuuacauacaguucugguuuuaacgccguauaaaacuuuuauguaaaaaaguccacguuuaguuuuacaagaaaagcagguuguaaaacaauaaaguacuuuauggauaauuccuggaagaguuguacacguaagaacugugaauaucagcuccucuggguccuguuuaccuuaccgcugaucuuucuuucuuucuuucuuuuggucugggcaaaucagugguuuguguauagauuuuuuuuuuuuaauuuaggauuaaaguuuuuaaacuggaagguaaucauaauuuugaaaaguuuuuugagauuaucacauuuaguuuauacauaugaaagaagguuuuugucuugucucuuucugauagcucuagcaguuuucacauuuuggucauaguuucaacauuuuaacaugugaauaacaggguuucaugcugguuuccagauuuuauuguccggcuacguacaauggaacuuuaaguuauauauacauauguguauauauauauauauauauaauauauauauuauuuuaaggggggaaauguuauauuuuucuguuuccauaagagaugaauacaguggauacuuuuucuauugguagugauugaguucaccucuuucagaagacauuuucuuucucuucugaguaacugaaauaaaaucuggccuuugugaaacccuagaaaucuuaagucuguugaaauaccagguuaaacacauuccaagagaucuguucaaacucaaauucuuuuguauacuucugaggugccugagaaacagacuucauuauuuaugagaaaauauucuuuauuuuuggaaauuguguucaaauguuagcuuacuauuuuguagaaugaauguuuaugaagcugauaugaggccaucucagaaccaagcagguuccuugaacuuuugcuugcuuuucugaacauugcgaauauuacacgucuuuccaaauuauucuagaguaugcaagugucaaugguaugaaacaccauuguacuggaagaauuaauauauuacuuuaauauguaccugagcuaaaugacugaagcuuuaggggugcauagaaaccaccauaauuuguaugacauuuugaagugaauuaaauauuuuugaacaug

SEQ ID NO: 19054 - RNA, 1040 nt, Homo sapiens
ccuccuacuuccugucacagucacucaagacaaaaucacgggagucaccuuucacacuucucucuuccucacuaccaauaauaaaucaaucgccagauucacaucaaauuucccucauaaaucucucugcccauuacuguucucguucuggggcuccaaaaccugcacucagaaccuuuuuagguuccucucauuccaucuguccuucccacuaucucuaguaugaauuuacuaggucacucauuuuuauuccucugguuacaauauuucaacgguuccuuguuacuuacaagauauacauauaggcacucuugugaagugcccccagcuugucucaccucaugccacugaccucuucuugccuuuccccagugcauuccagguuccagauaaccccagucaguuauuguacacacuccccaauugugccacacccuuugcauuucuacacuuuguuccuccuaacuggaaugacuuucccauauuuacaggaugugcucuuuuuuuacccuuuuacccuaaauaucucaguccaagcaucagagcuuuccugaacauuuucugauccucagaguguuucuugugugcuugcuuaacacauacugcuuaguuuuaccuugccaaaccgugagcucuucagauguaggagcugcacuuucucuucuuuuccagugugcagcauguggcaguuguuuaugguuggcugagggaaggcaggccuguuggggccuagugcaguggucaucaucaucugacggguaguguggaaacuucauccagcuaugagaugacgagggccuaggacggguggcuuguggaaaggaaaagauauuaaacgugugagaaaaaaacaggauccagugacuuagauggguacaggagccaaaagugaggaaauccucuaagaugaguccuacaagcuuaguuaaaugccauuuguuauugcuaguacugcaaaagguaggaaaggaaggugugcagacaagugagggagcuaggguggacagucucuguuacauugacauucuacuggagucuaa

SEQ ID NO: 19055 - RNA, 1040 nt, Homo sapiens
uuagacuccaguagaaugucaauguaacagagacuguccacccuagcucccucacuugucugcacaccuuccuuuccuaccuuuugcaguacuagcaauaacaaauggcauuuaacuaagcuuguaggacucaucuuagaggauuuccucacuuuuggcuccuguacccaucuaagucacuggauccuguuuuuuucucacacguuuaauaucuuuuccuuuccacaagccacccguccuaggcccucgucaucucauagcuggaugaaguuuccacacuacccgucagaugaugaugaccacugcacuaggccccaacaggccugccuucccucagccaaccauaaacaacugccacaugcugcacacuggaaaagaagagaaagugcagcuccuacaucugaagagcucacgguuuggcaagguaaaacuaagcaguauguguuaagcaagcacacaagaaacacucugaggaucagaaaauguucaggaaagcucugaugcuuggacugagauauuuaggguaaaaggguaaaaaaagagcacauccuguaaauaugggaaagucauuccaguuaggaggaacaaaguguagaaaugcaaaggguguggcacaauuggggaguguguacaauaacugacugggguuaucuggaaccuggaaugcacuggggaaaggcaagaagaggucaguggcaugaggugagacaagcugggggcacuucacaagagugccuauauguauaucuuguaaguaacaaggaaccguugaaauauuguaaccagaggaauaaaaaugagugaccuaguaaauucauacuagagauagugggaaggacagauggaaugagaggaaccuaaaaagguucugagugcagguuuuggagccccagaacgagaacaguaaugggcagagagauuuaugagggaaauuugaugugaaucuggcgauugauuuauuauugguagugaggaagagagaagugugaaaggugacucccgugauuuugucuugagugacugugacaggaaguaggagg

SEQ ID NO: 19056 - RNA, 6294 nt, Homo sapiens
ugaugagucagagugcguggugcugaugcugcugccauuucaucaccuuugcgagcgcagcauccaucccuccgcucucccggcgccugggccuacccagcuucgggcucccaggccagcgaugcgcucgcggcugagcuagauccugccgagccgcgcucucugaggcgucggcggggcgcccccucccgccguccccgguccgggccaaggagaccugcagagccgcggccauggaggccaucuggcuguaccaguuccggcucauugucaucggggauuccacagugggcaaguccugccugauccgccgcuucaccgagggucgcuuugcccagguuucugaccccaccguggggguggauuuuuucucccgcuugguggagaucgagccaggaaaacgcaucaagcuccagaucugggauaccgcgggucaagagagguucaggugggagcgcaguccgggcccgcaagcagugggagggucuucgggguuugcaccgccucuggggagagaggacuuccugguucuaggugcgguccaggagggcaacaccaagggucuugaggauucugccgaagcccaccuucggcuaacccggaguuuagugcaaggaaagaagcgcccuggcagggaaggccggucaauaacacauauugcuugcaccacaacuccaccaaccugcccuuugguggcuaauaaacuagcuggaauugaucucuguaucuguaauucaucaaucucagucccuauguuacauacuuucaaaaacguucccaggucauccuaacauaacugacagagauuuaaauacauaaauacauguguauuauguuuuauuuccacaucugugugugugcacauauauaugcuaacauauguucuaacaugaaauagauacgauugauuccuucuugcaaccagcacacauucagugaucaucuacuaugugccagacucugggcuuguuccugggaaaacagugugaggagacucacacaaggggaugccauguaaucuaaacagacaaagccccuucauucuuggaacuucugugcuaacauaguugagggaaauagauaaucagcaauuacgaaagugugucuugcucauauuuguaugcccacucccuacuguaacacuuggcacaaaaugaacaugcuuaauuucaaucaaugaauucauugaauaaucaaugaauauguuuacuuucacucagaacccuuugcuuuucuauuguagcauguauuauuuguaauuauauguaugaacacagaggaggaaagguuaacuggagaagaugagaccggaugaguaugacugccuaagcaaagacaggaaacgcccagggauaggaaacagcaugaauaaagacagaagugagagggagcagaguguacacagaaaacuuugcagagaacaauuugaacuaaaguagagcagcaggaaccagaucaagaaaacucaauagcccaaguuuaugaucauuuacucauuuaucuauugaaaacuaacuaagcauagaagauacugguuggguaauugaagagggguaaggagaagaaauaauuacaaacuuaaguuaccuccagcuccccacuuccacaaacaccacuguggaaaauauccuuguacagguucacuuugaacuugcgauugcauuucuccuaagcaaagaaagguaucuuuuauguguuuguuggaauuucuuucuauaugaacagccuguucauauccacugcuuauuuauuuauugggcaauauggacuuguaagaguacuuuauagauuaagaauauuaacccuuuccugucauguauguuguaagauauauuccuaguuuaucaucugucuuuucacauuauuuaagauuuuuuaauguagggaagaauuuaagguuuauguagccuuauguccaugcuuagaaggccuuugucacuuucuuugcuaaguacucacaaacaauuaauguaauaauauauuccagaguuuugacagugaucuacagcuugcuuguugauuucuugaaucaaccuucucacaaaucaaaaccuuuguuuguucaugucuaaauuuucugguaaaucuaccauucuccaugaaucuucaaaccuaagagacgagaaaugcuuucaguccccagggcugauuugccugauuuuggagacuuaaagucauuuguaaguuuuacuuuuaccaucaucuagcuuggacuguaggucccuggacaaugcuuguucugcuaacauugagccauuuucucuaagcuauugaguccuucguugucuaucuucuuuaucugaggagacagaaaaccuaaaaauagacauagguaaaaaaaaucacaguagucuaaagcaagugacugcagagacaaauagguccauacccuguaauaagcuuuaauacacuguaagcaaagugccauaauguauauuuauaaugagguuccucaagucaagaaguuaaaacaugugaaguuucuucugauggcuccugaguugaguuggccucucugaaaugugucaggaaacagggcugagaggcacuuugccugaacccuucgccaucucucuuuuucccauucccacaggccuugaaaauaaaaaauaaaauuguguuucuccucacagaagagauugaggaucccuguuagcuaauaauaauaauaauaauaauaauaaacaauaauaauaauggaaagagaaaaaaacaugguaaugauaaauggaaaaaauggaguagcaagauaccuacuuuaaauauuuuguuaacuaucauaaauucauuucuauguuuuaaaaauccuguuucaacugcuagcauuuguaaugaacucuccacgucacagaacacuuuaauauccauuguuucauuuugccucaugguaacacugugacuuggguauccuauuuugcagaaaaggaagucucugucaguuauucagauuuggggggugggagaguuaguuguaguuuuaccugaaggcaagaaauagaacucaguuaugucccagggucacucuccagugcugaauccauggaaaaugccuaaaaguucaugaacauucguuucuagaagaugcccaucucaaaguuuggcccaauuggaaacucacauauuaguaguaguauggaaugccauuuguauuccuuuguuuuuuuaaaaaaaaagaaaaucauuuuuauuaaaggacugugucacuaaccaggaacacuugaauauacugaguucauugacaugcagaaguuugggcacagccuuuacucuuuacuucuuucuuguguuuuagauccaucacucgcgccuacuacaggaacucaguagguggucuucucuuauuugacauuaccaaccgcagguccuuccagaauguccaugagugguuagaagagaccaaaguacacguucagcccuaccaaauuguauuuguucuggugggucacaagugugaccuggauacacagaggcaagugacucgccacgaggccgagaaacuggcugcugcauacggcaugaaguacauugaaacgucagcccgagaugccauuaauguggagaaagccuucacagaccugacaagagacauauaugagcugguuaaaaggggggagauuacaauccaggagggcugggaaggggugaagaguggauuuguaccaaaugugguucacucuucagaagagguugucaaaucagagaggagauguuugugcuagucaguucuuuuauuuccaaaacaugcucuccuacuugaacugaaaaguaagagaaauaaauagaaucuuuguguaacugaugagaacucaaccuccauuuggauaccaagugagccucccucucagggggacucugacagacucgugugcggguggaugggggugccugagugcugugaccaagggacugaauugcugacaugggccaggccaggcacuguuuuguggcccaugcuaggcaguggcugcuccaugagcccuuuguggaccacauguuaaaggccugggguuuaggaagcuaagucccaggaaaacauaccuacagacaggacaacuguuccuugguauuugagcucacuuauaggccaugaacauaaagaaauacauaaaggggaaaaaaguuucacaauggggacaauuagcauaacuaaacaaagauuaugagcucuacuuauuccgugagaauacccugcaccaaagguguuugcuggguuugguuaaaagguaccaauuagcuuuuaacagcuuucuguaaaaugaggaacacagaccaaaaggucugguguucaaguaaaaaugaugugacuauggaaaggaaggcaaucgacacaguuauuagcacauuucagaaaaugaacacccuugugauagaauuaccagcuguaugaaacaaauugucccaugcaaauuacccuauaacuaggaaagagacacuauaacccaaaugccauacccccuuuuuccuuugaccaugccugggguuucaaugccuuggcaccugcaaucuggaaguaaacagucugcuugcuucuucaggcacgugacagugacaacacagugacugccucugaaaagagcccugaggcaaacacucucuccugcugaacaggaggcacuguaacccuuacaaacagcuuacaguuacuugggcuacuuauuugaucaucauaacaggccuacgagguuuuugccccauuuuacagaauaguaaacuaagagccaugaaaaucacuuggccagggucaaggacucgugacuccuagcucuuuucacugcaucauacugcugucagaugaauaaaugauuaugaauuuguuuacuugggaagagauaugacuauaaauaaauguucucuacauguuaggauauguuuuccuuauugauuacaacucagcuauaauccugagggaacaugggaaggaaucaaagguaaagcccauucaggcauuauugacaagagggcuuuaaacaagugaauaauugcacaacuaaaaagacauuagaacugugugggcuauaaguguucuuaucacugagacacaguggauuuuuauugaaaggaaccacguacagcaaugcggagugggauagggauaaaauacccaccccaaaaugaccuuggccaccugucugccauauacguacacugaguuccugucuacccaagagagucagcccuuaauucucaggugaacaaacagcuaacugcaucagcaaauuggaauggcuggcuugaaguuuccauuauuuucuugaagagaggugaugcuuuaaauuacuuuuuggauuguagccaguucagcuaggcaaaagccauacuuuucacaauuaaaaaaaaaaacuauucugacuagagucagguuucucauauccaucgugauaggaaggccuaagaauggcaaaucgcuuugagauauaauauugaacuucaguaugaaugugaccgaaucugaaacuuugggaauuugcuuuagccagaauaaagaaaccaaaucaugaaaauuauggaagacuauucugccaccugugccccaaguuggaugagcaaaccacuuuggaucaguucacagcauuaacuacaagugaacugaucaucuucucuauauucauuucacaagagcuggcuuaggugggguaauuaaauugccaccuucgugguuguaaaagacaaacaaaacauggcaaauuucauuaacacaaaauuucaucaacugcuauacugaauuauguuuagaagauucugaaagcaagauuauccaguggguaaaugagagucgacuggauucugucaguucaaaaaaggaaagaaacaaaacuucccuacaauuuucuucacuaaaauuuauuauauguacaguauucccacuccuggcauuuucuggcagguuuaaaaauauucagcauaaauccagcagagguggcugagcuuaauugcuuaaauaaguucuagaaaauuuaaaaaucauuuuaguagaauucaguaccauugucacugcaauaaguggguuuuagaaaauaagugugaaaagaaucagguguuaauauaauacuaaggauaaagcuuuagaagcuauuuuacuacauagguaaagaaaagauaaacuaacuuguaacaaagaccacaacugcauguuggauuagauugucucauauuucagaauaaaauguacuguauacuuuuccucacuuuguugugcacuguaaugaaaugugaaaaaugcuuuauuuagcuguaugugaaugaaaauaugcuuguauuuaguaaaaugauugauuaugugacugugagauucca

SEQ ID NO: 19057 - RNA, 640 nt, Homo sapiens
cauggucugguucugcaacagugccgacugccaauuuucagucuucgcccuuaccaccauaggauggauccucuccucuacguccacgggccucguggaguggcgaauaugguacaugaaagacaccucgcucuaccccccuggaaucgccugcgugggaauauuuagagucugcauuuaccggcgucgcaccaacagcaccacaaccaaauuuuguuaccgauacagcuaccaggacaccuuucucccuuuugaaauuuccauggcucaacgcuuccuacugacugccagcauuuucggauucuucgggagagccuuuaacauguuugcacuuagaaacauguccaugagaauguuugaggaggacaccuacaauucauucguuguuucaggaauucucaacauugcugcuggugucuuuaacuuaauugcugugcuccagaacuacgaugccgucauaaacucacaggggaucaccuuccugccaucucuccaaaugcccuucaagccagaugugcaggaaguuggcacugccauucaaguggcagggauaggugucuugccgaugcuguuaacugggauguuuucucuguuuuacaaaugucccccguacggccaagugcauccugguauuucagaa

SEQ ID NO: 19058 - RNA, 54622 nt, Homo sapiens
aucaggggcgggggaggagaaggaugugccaccagugguucgcgagguuccguuucucagcucaggagggagccuggcugccuggacccgggcuagggacccagagcuggggcuccacaggccugaccagggccagggaagaagacggaggaggaggaagagaaggcggggcuggcggcuggggcuuguaauuuacaugagaaccgugcuggucacuagcgcugucugugucugucuguccugcgggacuucugcucuggggagggaggcugggauucagcgucguugucauuuccuguguggcuucuuuuccagcugagaaacuuuuuuuucuuuuuuacuuuuuaaaaagaaucacagccaaaauaagacauuaacugcaaaauccaaaauggcugcgcuuacccuauguauaaaaaugcguccaguccggucggggcacggccuaugcuuucccggggaucuuggcccgcuugcgugcaauagcauccuccacggccuucagcuguuucagcagcuccucccgccgagacagcgugcuggccuucccugauuuggugcuggcggcgccgggauccgaggcuuugccgggcacgcucgugaccuugcuggagcucuuggacuggggugacagcuggcgcuuccuacaaggggguggggaagaccuugagcccccagaagccacgucugcagguggaaggggugaccuccccguaggggcgcuuccacuguguccucagcggccaccaggacaggcaaggggcucccuggauggccaggcucccacugccacaagcaggccugguccuagccacuggcucccgggcuuuguggagcagacugggaggguccugggcuggccccgcacaaccuccuguuauucuucccaccucugugcccagggaucuuuugcccaagggcaugcggagcagagggcacccuccagccucaaccagggcaggagcgugugugugugugugggggggggugggggguggggcugcaauucgcuguccaugccccucaccccgucagaccagcaggagcuguagugacgccuccagccuggcccagugcuagcccugcugcugcuggccucccuggggaagcgacuggggcuggcccccucggugugcccagggcacaugcugggugggacucaccugucagccggggcugcaggggcuuuggaguucuggccucucugccgcucuggcuucggggagcccagucucccaccugacuuccggucccgagaaccugggugauagguacagagugagaccacccuccugauguacagggaauggcuguguggguggccucaccgaugccagggacucacuucuaaagccugaggcugcuuaguucaccaccuucauuuuuauaaagaaauaaaaaggggagagccaaguaggagaagagagaugugggcaccaaggcaucuggaaaugaggcugaggccaaaccugggccccagguuccagcaagcagccaauaucucacgcagagagacaaaacuccuuccuagcuuugaagaaauuuaucacaugggucuucaaauacggaacaacaagaaagacauggcaguaaagaaauacaagcaaagccgagagacuaggaguguuucacucuggcaauguuaggagggaggcgcggcaaccgaggggggggccacugcccagcgcaggcccaaggcuggugcgagaacaaagguccgcaggaccccagaggcccugguuccaaccccaggcaagggcagcaaggcuguuccagaccagccacacagggcacaggcccugggcuuagggacaaaggugagcagcuuccucuuccuguguccgacaaacccagagaacugcuugggaaggggucuggaagcccccugccuguucucugugucugggagugucugugcggguggccaggcccccuuguccucuaucugguuugagcuccacccaucaaagccagccaggacaaucucccugucuuuccaucugggccccagcucuugggguguggucagcauggcuggggguccccgaggcccuuucaggucugugugguucaacaguaauauagacacuaucugccucgucacucaguccgcaggagccugggaggaucuccagaaggcacgaggcauguggguccagccgucuuccgucagccagacugaagagauuugcaaaaauggaaaaaccaaugccauuccugcucauuuguuuuggaaaauauauuuugcaaaaauggcacauguguaaaaaaaaauacaguugcucuuguugcccaagcugcagugcaauggugcaaucucagcucacugcaaccucugccucccagguucaagcgauucuccugccucagccucccaaguagcugggauuacagacgcacgccacuacgcccaacuaauuuuuuguauuuuuaguagaaacaggguuucaccauguuagccaggcuggucucaaacuccugaccucagaugaucugcccaccuuggccucccaaagugcugggauuacaggcaugagcuaccgcgcccggccuaauuuuuguauuuuuaguagagacaggguuuuaccagguuggccaggccggucuggaacuccugaccucaagugaucugccggccucagccucccaaagugcugggauuauaggcgugagccaccacgcccgguccuguuauuuuuaaacaaauauuuaaaaccuuuucuucguuuuaguuuucaacacccuaaauaccgacaggcaucaucugcaagucagauguucucuggacccuccuccuacuuguuaagagcaauggggucucagacccagcugcuccgcauccccaggcucccgucccucugcccugcccccuaggggcugggaggcucaccucggucuggggauguguugggccgcuuggcuggaggagggcucugccuguccuugucugaugguucauagcgcuuccugcuuccuuuaucagccgccugggacaagagagaggccagugaggacagcagggccaggagccagaagccguguccucgccccagaggacauggguuccuugccagcaaccugcucugcucccaaaggucccaccacacacccaugagaccccguagcccugagugaggccuccaggacccggaccaagggcacccccacugugcacuuggggcccuucacguuccaggggaagcacccugcaggccuuccugcuccccacgggggccacucuaggaggaccugggacccaugaagccaggccucuugcccuuccagcagaggacagggauguguccugcugaggacagaggacagggacggaggcuuccuguauuguguugagacugcauggcagggaauggcggccacaggcacgaagagaacgcccucucuguucagagagaggccagcagcacccaaaccuccccagaugcucacacuucccagcccaggccggaaagauggagucucgcuuuguuacccaggcugugcugacaccugcaaggccccacucgcccucacucaggcuccgucccccaggaggaagcugucucaggaagcagauggacccaggccuagacgcuggggcagccaccaggagggcccuugcccucaccuuauucaacagugucaacuugaucuccuugugggccacaaaugugcccugcuggggcugcccggggggugccugcuggggugucgagggcugcugggaggacuuccccccugcuggagguuuugcagauuugggugguuguguggacgaaucccuuuuccgcuuuuccucuuuaacaccgucuucuuucuuagauuuuccuaccaaugauaaauccgcagucauggggguacuggugauuuucccauggccacaccaacagccaggcaaagucugugcugaugccgcccuccucccccgggagcugcuccccaaagguaccagggcuccugaguaccuuucuccuuccuggucugggcuggggccggggaccgagagcuggcugaggacacggggcuagccaggucugcguacauguccuccgaguccacgcugugugcagagcugcugcucgacguagcacuggacacugaggagacgcugcucacgcucagggaccuggacacacaagcacaucucaccacaccccagccagacuggagggaggggccagcagggggugcuccaugguccacuuuuacgcaguguccauuuauggaucauguacccacggaaugugugauuuuggggggacacugggcaguuucaggguuacaaaguaagggacguccccauggcuaggccagggccccauuucacuaaucaaugucagguugcagccaggcacggcugcucacgccuguaaucccagcacucugggagacugagaugggcagaucucgucacgagcaauggggucugagacccagcugaacugaugucaggaguucgggaccagcuuggccaacaugguaaaaccccaucucuacuaaaaauacaaaaauuagccgggcguggucgcaggcgccuguaaucccagcuacuggggaggcugaggcaaaaaaaucgcuugaacccgggagguggagguugcagugagccgagaccaugccaucgcacuccagccugggcgacaagagugaaacuccgucucaaaacaaacaaaaaacaaaacgaaugucagguugcuuuuugggaagggaaacaggacugagcugacucaacagcggcaaggauggaauuuaagcagagucccuggcuuagacaaaagggagauagccucagcccacagggaaauuaaaaacacaaggagcaauuccgcagucucagggaaugccugaggaacacacggcagacagacuggaaacagcaggucuguagcuucacuggcgugcacucaacacggacacaaagcacacaggacuggcaccugagucugcccugcccauaugcugcucgagaaaacaccaaccacgucuuccagguacauuggguaccggagcaaggaacgggggaauguaagagaaccauuuuuuuuuuucaaaagucaggucuuuaaaacauuucagacuuauuaagaaacauuuaggccaggcgcgguggcucaugccuauaaucccacgaguuugggagaccacggugggaggaucacuugagcccaggaguuugagaccagccugggcaacacagcaagaccaugucucuccagaaacaaaacaaacaaaagaaacaaagaacugugacaaauauauaaacgaccugcugccuggaaaugaaagaguucuaugcaaggaaucuaaggacugauuuaauacuuucuuuuaaaacaacuaaauagcaaaaauccuuuuuuuuuguuuugagacaggaucucuguuguccaggcuggaaugcaaugucgugaucacagcucauucaaccuugaccucccaaguagcugggaucauaggcacacaccacuauacccagcuaauuaaaaaaaauuucugggcugggugcaguggcucacaccuguaaucccagcacuuugggaagccgaggcggauggaucaccugaggucaggaguucaagaucagaaacgugguaaaacccagucucuacuaaaaauacaaaauuaggcugcgugcggcggcucacgcauguaaucccagcacuuugggaggccaagguggguggaaugccugagcucaggaguuugagaccaaccugggcaacauggugaaaccccaucucuacuaaaauacagaaaauuagcugggcguggcagugugcgccuguagucucagcuacucagggggcugagguugaauccgggaggcggagguagcgagaucgcgccauugcacuccagccugggcaacaagaaugaaacugucucaaaaaaaaaaaaaaaaaaaaaaaucuuuuucuguggagauggggucuauguugcucaggcuggucaaguccugggcucaagcaauccuccugccuuggccucccacggugcugggaucacaggugugagccgccgcaccuggcccacaaagcuuuuccauguauucucuucucagauguuuuuaucggcuuccccacccccucaggccgguucccucgacaggugugauaggucacgcaggcccagccucugcccugcugggcuggaagcugccggcuccuccccaggugcaggugcucucucagggugcugggcaucaagucagcagggcagaggcaccuccuccugaccugagugcccccgaguuugugaaucuuuuuuugguggggggagggggucuuccuaucacgaguccuggcccauuuucuccugugucaaagcuucaaccgcagccuuccacagccccagggugacucagauccagaagggccccagcccaccugugggagacagcccaacccacacuggcugcuucugggacuuccuggccccgacggggagggagaaacagaggcacagggugauggggaugaccuggaucgggagcuggaaccacuauagcugcuaccacugccacugccgcugccgcuuagcguccgccuguaauacaagcaacagcggggcucagggggcguggccuccacagccccucgcggccuccccuccccaccagcagcccugugaggugagccuccagacuggccuugcuaccaccuuggaacagggccugggccugucuuccuuuaggcucaguguuuugucaagauaaaaaguacagucucucgggggcagcaccuuccagugcagacggggccauggcgggaaggccugugcuccgugccacgcugucccuuccccuucacgcuccagaaacacaggcucagggaggggacagggcagguucccggguaagggcucacugggugcugcucggcuagggggcgcuucccaccaccuggcucuggacccuggcacucuggauuuccagcagugccagcaucacaguggcaccaagaacacggaaagccugagggccccggacgccggagugcucaccuccugggggggguccuggcuggccgcuccuuccuccuggcuucccgagggucuccuggcuuggugggcucggggacaggagcagugguuuugguggccugugguggggcuggaggcggggccggcuucuucacugacuucucucugugagacagggaggcucgagcagggcagggcugguggacggggccccgcuggccuacauccccuuucaauggacccacagcucggggaacgacacugcaugccugugacgcucggugagcacgcucgugccuggacacggcuccccacccaucggugucagagugcuugggaacggcuucaaagcccccagcagcccuuccaggcuccccucuaacaggcaagagcuacaggcaccgccaggcaguggggagagcaggcuaauaggaagaccccuuaagaacacccggcugcugccguguccccagggcugugcucuguccccaggguucccgagggagugcugcuguguaaggguggcccgugagaacaggagcugugcccagugccucccagcccagucacccccuggggccagcccccugaggcauccucaccucuuuggucccaaacacaaaugagagauagagacggagggaggaggcugcagccuguggaggccuggccggccaggacuugcccacaggcugggcacucacccugcuuucccgggcggcggggccggcucucccuugguucugauggaaggucuauguggggaagguguuggggacggggacggggacgaagagaaggaccgggaccuaggggagugaacaaaggugucggaaggggccuggggguguuucuucaccagcccaagcccacugaggacccacccagacccauggagaaggccacgaauuuccauuuaugugccucaguuuuaacuucaguucuggacuguucugucaucugcuaaaaacacaggcccagaguagaccagagagcguggaaggugucagcauccacuggcggguccuccgggaggcgagugucacguucaugugugugcaggacaggaggagacaggcuccuuggcaguggggcagcagcacagcucccauagaaacacccacaggacagggcugggucuggccccuuccucggccugucugcggaggacuggagugccucaacucgaggaucucaggcuguggcccucagugacagcacgcaucuacacaaggacgagggcccgcaaggcugguguuuggugggggacacaggacacgacccccuggccauccuaguucagcugccagcagggaccuucaauaccccaaggggcuacuggcgccacaacuaaagccacauccgcaggugcccuugcucacugcaccugcugagggcccuucaugggcccuggggacauaccuggaccggcuuccugagaacgagcugugucuggaagagcggcuggaguaggagcuguaggaugaagaccgggaucgcgaccgggaggagccggagccagaguaggacgaugaccgcgaagacgaccuggggcgggcgggacggagcguggcgagaagugagaagggcccucccugccccacacgcccugacgcacacaugcacagcuacacacccacagacgcacagcuacacacaagcgcacagcugcgcacgcgcgcacagcugcagacgcgcgcacagacgcauacagccucccccagacacucuucagugccaucccuccuuggugcagaacggcauuuagaaaucaagaccugggcguggggugugccugcuguuaccggguggcgcugccugagugggcagacccagcucacguggguccgugugugugucuaucuguucaucugcauccacuuucagugaagccuggccucccacccacaccuccuguuccugccgagcaugauggggucuaccccggcccccugcuuuccaucaucccucacucgggagccgggcuccugugugcugagaccaggaccguagguggaggggcaacaguuucagguccagucuggaggaacagauggacucacugggccccaggucugugcguccucccgcauccaggugccccucccuccaguguggccugugacucccugggagcagucaggcucagucgccggggucugugccccauuuggggucacugcgucaguccuacuuggcauugaugcucuuugcugaagguauaaacgccggguuagucccacugacuggucugcagguaacgacgccacagcaaacaguggggcugggguguuccccaccugacccagugagguacauggugucagcugacggcuccaaggugcugacaccccagccgucccacgagcccuccuuaccuggaggaauuagaggcagaggcugacgaggcugauguuuuccgacgccuucgagcccggcucggggagaccgacaccccgaguuucuucuugggagacuuggaucggcgccaaggguccuuccacucaucugcucucuucaccugcggccccgugguggcagccuccuucuuugguggcucagcuuggcggcugaaauuacagaggcauuagcaacucucaggccaccuuccgcuucacagcaaugccaggugugacagcagcgggagagacuauggaucucauaccuggcuuauuuaaggaucaccugagaaacaaaggguccuaaggggaaaaaaggccacucacaaaacccaucaccccauggacuugggugauguccauggcccuuggcucagugucuguuacucaggggaacacccagauuucuccugaaccagaauggcaguuacuuucugugagugucauuacuuacuuaauuuccaucuuuccaacuacgcugucagcucuaggagggacagggauggugucugccgugucuaauacuaucucuagugcugauauacuaguagguucauaauaaauauuuaugaaauaagcccagguaugguggcacacgccugcaaucccagcacuuugcgaggacgaggcggguggauuacuugaggucgggaguuccagaucagccuggccaauauggugaaaccugucucuauuaaaaauacaaaaauuaggcugggcgcgauggcucaugccuguaaucccagcacuuugggaggcugaggugggcggaucaugaggucaggaguucgagaccagccuggccaacauggugaaacuccaugucuacuaagaauacaaaaauuaggccggcugcgguggcucaccuguaaucccagcacuuugggaggccgaggcgggcgaaucacgaggucaagagaucgagaccauccuggcuaacauggugaaaccccaucucuacuaaaaauauauaaaauuagccaggcgugguggcaggcgccuguagucccagcuacuuggggggcugaggcagaagaauggcgugaacccgggagguggagcuugcagugagccgagaucgcgccauugcacuccagccugggcgacagagcgagacucugucucaaaaaaaaaaaaauaaaaacaaaaacaaaaauuaguuggaugugguggcgggcgccuguaaucccagcuacuugggaagcugaggcaggagaauugcuugaaacugggaggcggagguuguagugagcugagacugcgccacugcccuccaaucugggcgacagagcaagacuucgucucaaaacaaaacaaaacaaaaaacaaaaaaauuagcugggugugguaacacgugccuguaaucccagcuacuggggagccugagggcaggagaaugguuugaacccaggaggcagagauugcagugagcugagacugcgccacugcacuccaaacugggcaacagagugagacuccauuauaaaaaacaaacaaaaaaacccaaacacaaaugauauuaaacugaccccuuauauauaaaucuuuaucugacuuuuuaaaggguaaacuccugagcaauggaauuaaugggucaaaggagauacacauuuuacagguucuugguggguuaucagauauuuuuuccucauucagccagcagugugcggugccgaaccugggcucggugucaccacuaagaaccacaaccaccacccagacacaaacuaacccaaaauccuggcaauuguauaagcagaacguggcuuuuuuuuuuuuuuucuuuuuuagagacagggucuugcucuguuacccaugugggcuggagugugguggcauaaucacugcagccuugagcuuccaggcugaagggauccucccaccucagccucuugaguagccaggacugcaggugugcaccaccacacccaggucauuaaacauugauuugaggucucccuauguugcccaggcuggucucgaauuucuggccucaagugauccucccacccuggccucccagagugcugggguuauaagcuugagccgccaugccuggccugcaaacacauuuuaaaaagcuguuuuaguuccuguguuacugugagugggauucucugcccuacgucuugcucaccucuggcucugcugugguagcaucugcuuacgucacacgacaacacaugaaaccaccaaaaccaucaauguuuauguuuucagagcuuguuuaaccaaccggcuggcaaacaugccugcuaucugcugagaaugcaggaugggggcagcuccccacuuaacacuguccuaaggacacggacacgcgacaucacagcuucagcuccuguacgucagcccaaaaccccaagagcuauugccacaucugggugucuccuggaaaaguaauccaggaaggaaguaaacaccugucugaugauccucccugucacaggcuacuagagagcuacuuucaccuuuauacuuccuguauaacucucauccuaacaccccaagaggaaagggagcaccaauaagucacagggacagcgcggcccuuccaacacagggagagggaacgggcagaagucaaggcguggucaggaccaccucuucuucgggugaagcuguaacagcauguggaguccuagcugcggugagggggaaggaaaaacagcgucugcuugcccccugccacggcauggaaauaaaaccagcugagguccagagaggcgggcagugcaggccuccacaaucucagggcagcuggugcuugccccccagaaagagcugcucauucccucuggagacaaugauaccgaauuucaaaaugaagauggccagaggcaggcccagcaggggucagugaggucucuccuucucugggccagggcuguggacgggccugcaccaucucgucacugcacagcgcgcccuccgcugccgccggccgcaccaccuuccuucugaagcagcugcuuccaggcccauggagcaaggagguccuauccagcaaguccauguuaccacgugugggacguggugguacugauuuuaaccaggaugcagauaaccauuuuuuuccuuuuuucuuuuuuuugagacagagccucgcucuguugcccaggcuggaguacgguggugcgaucuuggcucacugcaagcucugccucaugccauucuccugccucagccucccauuggacauuaucuccacugcacuuugauagcgagucuccgggcaccaagucugcggcagaaagcaaggcugagcacuggcuuucuacagcccagggaaccgaggcaugugcccuucucucagcaaagaaugucaccccaggggacauccugauuagacuuggaaaaaccaggcagauacaaaauaaacaaaaccaaaacacacaacaugggugccccaggacagcccaccgagugcggcucagcuccuucacaaguaggggccugcgcagagggagccagugugggcugagaacgcucgcaagggauggcccagucaggaaggcccaccuccaagcugggccaggacagaucuggaauuugcaugaacacuuccaaccgcaggggagaacccuccagaugaccucugacugaggaaguagccuuucccgcagcacaaggcccgcgcuaucaucuggcccccauuccccguugaaggccacaggagacucucuaaggggcaaaggucagcuccaccaccaaugcaaacaugccagaggcagacaaaaccaagggcccgaggcuggcacacucauagcucaugccucaccgaugccagcagccacacgaggcgccacagaugccaggcugcuacaggccacguguccagaaacuccaaccccagcagcugucaaguuuggggucaaaggugaaaaaggauaaaaacgcaugaagguucuuucuucaaucaaaagagcuaagcaucuacaucaacaagggaaaagggagaugggagccuaugggccuccccgggcugagccugcucagaggcagcucugggagcaccuccacagcaaagcuucucuccuggcuuguucugugagugccuguggagcauuuagcuacgggccacaugcucuccccaccucccuuaaaacguaacagaaaaagcccaaagcagaccuggagugcccgccccaugucuuuacacuuugcaaaaaaaaaaaaaaguggaguccaauggacgaccugaguggccgucaccuucucugugacuugugcagaaggccaggcggccucacucacaccugcaagagccagucucagcgcagagcagauacaaacaccagcaacugcgccuucugugcguucaacugcacaugaaaaucccuaacuccacuagucccuuacccagaaggcuggucuaaaauaggguuucuuaaccuuucuaggggagucacaaaucccucugaagaagacuguguagccuggcccacucccagcagagaucuugagacuccuggggugccucaaacuggcagaugagagggcucagcccaaaaaacugagcaugaagcgguggcccaggaagcaggcgcccacuggaugggccgccaaaggggugcggacucugcgguguccggaacuuaccagggaagagugagaaugaagagcccggggugaguaggugcuggggggcgagugcuuccagucucagggguccaccccacaaccccaccgcaggagccugccaagcucaagcccugaaggggcacccaaagcugcaaagguaaaccuggaaguugaauagcuuggagacagcaggcagcccagacagcuccugcgggaagguccccaaucaguguuuacauuucuaaugacaaugacuagccaaagagcaucguaaugacgugccucggcggugagcacacccaucggccuagcuauaaagauuagguuucacauaagggaccgcccccuuagcucuacagaugcauuugauagaauugauugaaagguucugcucuaaucauuuuaaaacagcccagguggaggaguggguaagccucaaaaggcaaacuaggacggagagagcggcacaacuccgucuccagccgcagguccaggggggagcuggucaagaagcccugccagagauaccgauggggaugagaucccgacggggacaagcuagccaguaacucccagagccaaacagcuuaggcaguaagagagaaccucaggaaagagggguauuagcuuagagauaaggaaaagaaauggcucccccauggacagagggcuggccaucagauagcucagggcaguguuuccuauuggggcucagcauuauccuucccgggggaggcccucaacucuacccaggacacccauggcacccaaacaguggccgacucucgcuccucccgcugcacgacugugcccccucucgugaagcuugggguggugaagugccugcuauaacgagccugggccgcgcuucagaccaaacaaaagugacugcgcuucacuaggguguagcccccaugcaaggccuagcccuggugcagccgugcuggacacugcagagccccucauucguguucugcuugguagcugaaggcagaaucuucccaaauggaucucccuggguaaaacugugucauuuucuuccaguuuaggugagaaaaguucuuucuauccaccuaaugauuacaaacucccaaccugccaaagacccacccauucaauacguguauuacugcaaagggaauucagcugcuccugaaaaggcagccaggccaguucuggcugauaagggagaaggaagcaggagcacuggcuggaaauucugcgcuggggaaacccuuguccuccaggcagguagcgggccuggcagggcucccgcaaaggugagugaagccaagaccggggacuccccagcacccggaagccggcugaaugaauccaggcaagcgacgcagagaacgucagcccugcugcuggcagcuccgagaaggggcugagggcagccccaggagcacaagcaagugcuucaggaaggaaagaaagggacgugagccucgcagaagggaaaugaaccaggucagaaacaggugggaagagcggcucggcccaguuuggugagagcagcuguguuugauuuuaagaaaaacucauuuaguacagaguuuccugaacccuagcugugagcccagaucaggccagacaacgucugagcaccucccagucccuuccugaauguaagacuccucugugaagcugagggcucaggggcuggcgauggcaaccugcugccugguggccaugcuggcagaguuacccucuccaagccuccugggauccgucacccgcuuuccucuggggaggcugagcacacaggagacgggcacagcagucgggaaucugcccucccauuccgcgggucacuaaagugcgggccacagcagaggaacacagcaaccuuaggcauggcggcccucuaacgcguacuccagaaguacauucuuguacacagaaaacaucccugaguuggaauuacagacuccugacugggaagagcccccggcugcuuagaaacaggcagaauacaugacuaggggcuggggaagggggucuguggccaggcacgugugcccauaagccaccaaaguggacaugcugacggacucauaaacccagagccacacagcacagugaccuuccacguggauaucacugccuuucuaugucucugcuucuaaaaccaaugaucuggguggcgugaaaaccccuauuuugugaaucuggaaagcagacucagcugguucuguuuguagaaaucaaugugcaauuuuagcaacccuguaacaaucaauuaugacaugcagguaaaaaugcaggcugauaccaaauccaaaacucacggacagcacccccaaauguggguaagcaccaaccugugcgggacucugggacaggcacagaggcugcaacggggagcagggcagacgguggugccccaggaccaucugcugcaagggcuccagaugggcacugagggccaugaggaacaagaaagcaggcuggcaagcaggaggggauggggagacuucccugugcagaggaaucugagcaaaacccuggaggagguagaggcagcccguccgggcagagggaacggaggaggugggggcagccugucaaaggcagagggaacggaggaggugggggcagccugucaaaggcagagggaauggaggaggugggggcagcccguccaggcagagggaacggagcaggugggggcagcccguccaggcagagggaacggagcaggugggggcagcccguccaggcagagggaacggagcaggugggggcagccugucaaacgcagagggaauggaggaggugggggcagcccaucugggcagagggaacaggagguggggcagcccguccaggcagacggaauggaggaaaugggggcagcccaucugggcagagggagcggcugggggugugugcacggggugcugggcugcaccuuugcaguggggucucaggggagaaggcagccuuaggcugagugcacacugaaaauacugugugugcuguaggggaagggcuucuauccaaaagggcuugaaaggcugaagaaggcggcacaaugucaaggucaaugacgguuuccccguuuggaugaccauguaaacuucaaaauaacuuagagauuacuguaacauaaaaggauuaaaaacaucugaaauaugucacuuauucugaauguucuuuaagaagauuacuuugccuaguguuaggaaaguaugacaaauacagcacauuuagggaaguccauucacugugagcuggagaaugaaaacagucaaaacuggcacuugccaccggcuaagcagcagcuacagccaugagugacccugaaacaaaggccugcgaaguccugccugagagcugacuuucagaaaagcguagaugacuuguguuccacuguacacaagagcgggugucguccagccacacggacaagaugaggaggacaaggggcuuguuuuugucccgugguggaaagcaaauccuuccagagccacagucgcagguccugauggcugccaggucucugaggggagcaugagaacuguggccccuccaaguguggccacuguguggcuccagccacgaagcugcccaugccugcaggucuagcggaguccaguguuacuggaagguguaggcccaaauguggauuuuuaugagagccaagucaaacaacaucccugaguuggaaguacagacuccugacugggaaguccugcaggccauggcccuggaaggaucucgggcuguuucccaauaaggaacugccuugaucccuccuugcauuucacccccacggggacggugacacaaaccaacccugagacggagcaacguucaugcucucaucgacacccccccuuuuuuugagacagggucucucucugucacccagccuggaucaaagaccuauguguaagagcuaaaacuaugaaacucuuagaagagaacacggcaguaaaucuuuaugacccuguauuagucaaugguaucuuacaugacaccaaaaccauaagcaacaaaauagaaaacauuaauuggaacugcacaucaugaaccugauaagggacuuguaucuggaauacauaaaggacucuuaccacucaauaauaaaaaacaaaaaaugagcaaaggaucugaauaggcguuucuccaaagaagauauacaaaugguugauaagcacagaagaagaugcucucauuaucauccaucaucagagaaauacaaaucgcaacggcagggagacgucacacccaccaagacggcugucaucaacaagacggaccgcagcaagugcagacaaggaugcagagagauggcgcccuccuaugcggcuagcgggaauguaaaaggugcagcugcucugcacaacaguuugaggguuucucaaacagcuaaacauagagugaccaugugaucuagcaauuccacacugagguauaugcucaagaaaaauggaaaccuauguccacacaaaaacuugcacacaaauucacaaccacaacagccaaaagcuggaaacaacccaacguccaucaacagacgaacagagaaaugcaaugcggugcauccauggaggaauaaagcacugacccacgcuacaacguggacaaauguuaaaaacgcucggaguagaagaggccaguuacaaaacgcuguguauugcacacuuccguuucuacaaaacguucugaaugggcagauaccuagagacacaaagcugcuaagagacugggaaguguggggaaaauggagagugacugcugauggguacaauguuucuucuuuuuauuuugagacagaaucuugcucuauuacccaggcuagagugcaguggugcaaucucagcucacugcaaccucaaccuucugggcuuaagugauccucccguauuagccucccgaguagcugggaccacaguggugcacuaccacgcccugcuaauauuuuguauuuuuuuguagagacgggauuuugccauguugcccaggcugaucucaauuccugagcucaagcaaucuguccaucccggccgcccaaagugcugagauuacaagagugagccaccgugcccagccuagauuuuuuuaaaacaauuuuuaauuuuuuuuuuuuuuuagauacagggucucacuuugucauccaggcuggagugcagccgugcgauuguagcucauggcagccuccaacaccugggcgauccuguaauccuccugccuuggccucccgaguagcugggaccacaggcucaugccaccucccccagcuaauuuuuaauuuuuuuuuuuuuuuuuuaaauagagauggagucuugcuuugcuacccaggcuggucucaaacuccuggcuucaagcaauccaccugccucagccucccaaagugcagggugcaagugugagccaccgcaagguuucacuuuagggggcaaaagugcucucauguugauugcgaugauggcugcacaacucugugaauauucuagaaaccacugauuguacacuuuaaauggguauguugcagcguccauuaauuauauuucaauaaaguuguaaaaaacacccaccaaaaacaucauccaguacucuaauguccacugacgcccauccauucugcucuaacagucaaguauauuugagagaaaaaaagggcuguccugagccccagcgccugccugucucaugggucuugacugugcccccagcaguuggcagcaaggaucauucugcacccaaggcacccacuccgcaaaggaaaaacagcagcccgcccggcccuccccugcaugcuggcugcuagagugccucacccuggccagcaacacggaugccccacagcaccugagcccagucccaagcucugggggccaggcaugcuuuggaauucagaacucuccugagaacaguaacauggugcccagggugugaguuacacaccgugcgugguauacaagggcagcgccuauuaaaacacaccgauguuugcacguggacuguaagcauuuucacaucagugagauccucuagaaugagaacagccucccaggagcucagggcagaugucacggccuugggaguuuuacagaaaggcccugcguuggagagcucuggguuuggaacuaugggcucgggcugugggccugcacugguccccugggcuccagagcugugggccacagaggggaagcgcaggccagggggacuagguacagagcugcaugccggaccucccccacaccccugggcuucaggaagcagggucuaccuuggcggcugcggggagcggggcuugggcuuccccuucuccuucucccgcuccuucucccggucgcggucacggugcugccgguccuucucgucccgcuuggcucgcucacgcucccacuccuccuuccuccgcugccgcuccuugucgcgcucgcgcucccgcucucgcucgcgcucccucugccggcgcucccgcucucggucccgcucccgcucccgcucgcgcucgcgcugucuguucucucucucucgcucccgcucccuuuccuuuguuaaaaagccaaacacauggggacaccgugcguuauuugggugacagaggcacugaaagccuuggcuccaacaccacgcgaucugucugugucacagaaucacaccuguaccccacaaaccuacacacaaaacgccaagugcucccgacuaugauugaacucucugcgguggaguacagaggagauggcaagagagaggcaggaucagggagcacccucaaguggggaucucaucucauucccagcucucuccuuaaaacacaauguuaaaaaccgggucagaugccaaauuagagcaaacacaaacuaggagugaaaucaucccaaccaccaauucuagacuaacucagggcagcaauucugcagucacagcccggugucguuggcacagauggccuuccgccguguggccugggcaaguccauuuguccauccagagacgggaguuccaggcuugucccagguaggugcagccacagcagagcacaugcccugccucuggagcagagcaggcacccaaaagacugcuccucuucuucuaguacaauccucggaugcccuuuccaacuuuuccucugcucuuacucauucauuugcucuaauauucaagguuaaaacugaauaaaguccaaucacaacgcaccugauggguuucaggcuugaggccucuguuggggagaugcagggugcaccccgagccucccugcugccccucccucggacacagcagagaggaacgcaguggaaagggaucccuggggcuuucucccaccuuccaggguacccugcccagggguaagcagcaggacccugcagcccaccugcaaugaggaagcugcuuuauggagagacggggcacaagagcaucgagcagggggacuuuucuggcacgauggggcccucuucccucugcaagcucacccugaugggcuccugaggagacagccgcaccugguccucaaagcucaugacugucccugcagucacagaacagaacuacacagcagcuucuaacugacccuucccuggggcaacuucgucaaaucacccuaacagcuaagaugaggaacucacagucugaagcacauaacucaucaauaugcuaaacucugaggcucagaccagggagauuuccagggcggaaaucucaguauagaccagucuuccaugagagcagugaggugcagcaggcccggaacagacuuaacaagcuggcugaaguggaccagaacaggcgccacauccuaaacgggaucacugagggguggggaagagugacacgcccgagcagggagacgcaggcaccccuggacacaggcaucaguaaguauacuggcaaaucucauuuucaaaaccaggccgagcugggcacagugacuuaugccuguaaucccagcacuuugggaggcugagauaggcagaucaccugagaucggaaguuugagaccagccugaccaacacggcaaaacccugucucuacuaaaaauacaaaaaauuagccaggugugauggugggcaccuguaaucccagcuacucaggaggcugaggcaggagaauugcuugaaucugggaggcagagguugcagugaggugagaucacgccacugaacuccagccugggugacagaguuaaacuccgucuccaaaacaaacaacccaggccgggcgcaguggcucaugucuuuaaucccagcacucugggaggcuaaagcaggcggauugcuugagcucaggaguucaaaaccagccuggacaacaugguaaaaccccgucucuacaaaaaaaauacaaaaaaauuagcugggcaugguggugcaugcguguggucccagcuacucgggaggcugaggauggagaaucauuugaacccaggagguagagguugcagugagccgagauugcaccgcugcacuccagccugggugacagagugggacccuaucucaaaaaacaaacaaacaaacaccacacaaaaaaacaaaaccauagcaagaaccaguuuucaggcaagucuuuguucaaaugaccauuaauguaaucgcugccucugaauucguucuccguaacaaucaauuugguuuucaaauugguacauugugcuggcucuauaagcucauauaaagcccuguauuuuuuacuguaaauaaaaagggauaacuugaaugaacagaucaugaaguucauauguggauauugaagucauacuuacucgguaauuaugauacggcucuguuucuguauacugcacccugaaauucucauacuguccgccacgccaaaaccgcucaauuucauagucauaauaagggucugcguaaggcucgagucugaaaagggccaaugaaaaagaacucucaucacuuaggagcacuggcguaaaaagaccacacgaaacauuagggacagaaaguaacagaccgugacgcagugggguuuacuccaggagcgcaagguuggcucaagguuaggaaaucuguucacaaacuacaucuaagagcaggccagaagucaaaggguucuauucacagaugauaaaaaugucuaacaaaaauucaauagccuuuuugauaaaaaauacucaagaaaauaggaagugagggccaggugugguggcucaugccuguaaucccagcaccgugggaggccgaggcagguggaucaccugaggucaggaguuugagagcagccugaccaacauggagaaaccccuucucuacuaaaaauacaaaauuaguugggcgugguggcacaugccuguaaucccagcuacucaggaggcugaggcaggagaaucacuugaacccaggagguggagguugccaugagccgagacugugccauugcacuccggccugggcaacaagagugaaacuccgucuugaaaauuaaauaagaaaaaaaaaaaaggaaagaaaauaggaagugauacuuuagcaugauaaaaauauacugacacacuuuggaacaaaagucagcaccuuacucacuggggaauaggaggagcucccccaggagucuccgcaaccaccugucccuguguggaggcacccccugacuggacaaggggagcccacuagaggcacaagaacacgaaaacaaggagcaaaacgagcucagauuugcaaaaugauaugauacuauacaugaaaaacccagagacuugauaaagccaauucaaacaaacaaugaagaaacuuggaaaggcagaggauaaaaaaauuaacauagaaaucagugucuucacagacacagauuauaaccaguuaggaggcagaguggagaaaaccgcauuuacaauagcaagaaagaagaaaaaaguacuuaggaauaaaauaucaacacauuucaccagaaaugugcagagcugauuccugagagacacaaagugugugugaauaaguggggagacgccugagagacaugaagcgugcgugaauaaauggggagacgccugacaugaagcaugugaauggggagaugccugagagacaugaagugugugugaauaaauggggagaugccugagagacaugaagugugugugaauaaauggggagacgccugagagacaugaagcgugugugaauaaauggggagacacgugacaugaagccugugaauaaauggggagacgccugagagacaugaagcgugugaauaaauggggagacgccugauacaaagugugcaugaauaaauggggguuuugaaaccugacacaaagcgugcaugaauaauggggagacgccucuugcacugggagagcgcagcucggaaucgcccacaagucaguccuuccuacacugacugauaaauuuaacacaaucccagcaaaaacaccaaugagcuucuuuaaggagccagacaagcugacacccaaguucacaugaaaaaucgcaccccaagaacagccaagaaaacccuggaaaugaaaagacacgccagacacgcccucugagacauuaaacauccuaaaaagccuguauaauuaagccagugccaucgcagcacaugaaaaccggcggccagaaggaggaggcaggagguccagaggcagacccaggcacgcccagagagguggcaucucagggacagaggggauucuucauugaacagggaggggacgacuguccagcugcugggaaggucaggcucucuuccccacugcgcacaggguuggggggggccugcucuaaacuccuggcggggcccacaacucugcaucuccuuuccuguggagcagaggaaacaaaguguacacuagcaauaggaggucccuggacgccccuccaggguaugucucagccacaagccaacccucugcuucggguagacugggugggaaccugaggcaucauggcuugagguggcuccagcgauggguggcuacgaacacccucgaggccuccucaacucuccacauggccuagaacuggcucucccaaaggacacagcuucaguccguucccaucagucggacaccguucaaucuaaugugcacacuacucaaaucacacugaauuauaacacucaggaaacauuuguagagaccuguggcaauaugacaucaggcuacauaaaaacgaagaggaagccuggacagcacgcgagacaccgucucuacaaaaaacacaucagcagccaggucugguggugcauggcuguggcccccaacuacucggugggcugaggcugauugcguaagcccaauaggguagaaaagccuuucccaaaaugugugaggcguguguucucugacaagaggacugugccggcaaauuuguuuuugggaaacuguacuuaagcaaaaugaaaaggccucuuuccugcaggcuuucuggaagucguggaugagcggauaggaaugaggcacacagcauuuccucagcguggcugccucggaaccaucugcuccgcagcaugcguucuagagaacgugucaacacaacacgccaccaggaacugcaaccaugccaacaacggacuccucagcaccauccugaaaaauucugaaacacucuugaaaugaauuuggaagguauuuaauucaauuuaaaaauaaaugcuacugggcaguaucaugguaugcacaaacucuuccccaacuguuuuagggaacccaaaauguuaaugggccuuuugagaaaaggguucuguggugaagcaagguugggcaaagcuggcucgcagcaacugggaggcucgcaccucguucugcagucaccacuuaaccagccaacaccaacaguguccugugcacacacguggaaucugcacuccagaggccccgcguccccagaggucugggcagcgucagacucagcacuggcacguggaguggaccuacuccucgcuggagaggagaacccgagguccuggcuaaggggaaccauuggacaugcccaucaggggcaggugguuucugcccacagccuugcccagggagaggcauggcaggugaaaagucgagcaauuagagaacguguaagacagaaguuuggagcuucgagaucacuuuguuuaaccauuucauuucagugacaaggaaacuggaucucaaaaaguacuaggaaaaaguucuaaaaugucuaacacuacucacuuuuaaucuaaggguuaugcaauauuacacaaugaaaugcaacuugcauuugcacaauucagguugaaaucgugcugaccucaacccagguggagggaggcugugcucugcaaagggugggagucagaugcucacgugucccugcuugcugcagagacccaaggugaaaaggagggucccaggcagcucacaaagggagcagcgacgcagcccccugcugccucuugcccucaccccaacccagcauggucgaccuggugcccaccugccuguugcccacguuccuguugcaacgcuggccacugaaagugcaggcaggggaggagguccccaaaggcaugcagaggccacaggcaaugccugggcacccauacauccaucugcccugagucugugggacugugggcuuacccauguggagcaggcccugucuuacucuccagguagcccaacccucccucccugcucacucagggggcuuccccacagggcaccagcaaaucccagguaaaagccacuugugcucucucaguuaagcaucugggacaaaggaggugcuggaccagcaucugguagaccuguuaccugaggaaagggagugugcuuuuugaaaauuacuguucuguuuccucuguaucccagccugacauccuacuccaaagaacagcagccugcaccuccgccucuaauacaccggcacugcacuacucucugugcugggggcguauggggaguuggcaggggcccaguccauggcccuggccauggccugacagccugacucugauuuaaucagaaacucuguucacgguggggcuacuacugaugaccgcauuucucacaggugacguccugugcgcacuagaggcccuugugucuuuugggucacaugucccuauuagacuuguagaauauucugggcacagcauccccaggagcccuaugcagagaugacauuucuuuuuuuuucuuugagauggagucuugcucugucgcccaggcuggagugcaguggcgccaucucggcucacuguaagcuccgccuccuggguucacgccauucuccugccucagccucccgaguagcugggacuacagguguccgccaccacgccuggcuaauuuuuuguauuuuuaguagagaugggguuucaccauguuagccagaacggucucaaucuccugacccugugaucugccugccucagccucccagagugcugggauuacaggcgugagccacugugcccggccgucauuucauuucuuaaugucuuacauaugugagaacuuuuuuuuuuuuuuuuggagaaagagucucacucagucacccaggcuggagugcaguggcacgaucucacuugcugcaaccuccaccucucgggcucaagagauucucccaccucagacucuugaguagcugggacuacaggugcgugccaccaugcccaacuaauuuuuguauauuuuguagagaugggguuuugccauguuguccagacuggucuucaacucccgagcucaacugaucugccaaccuugaccucccaaaacacuaggauuauagacauuacuagcuacuguauccagccaauaugugagguuuuauaagucagaugguaccugaacaaagugcuugaggugguagaaacggaauauuuaaagcugcgaaucagagugcgucugucuagcaaaguauuauuauuauuauuauuuuaagaaauggggcugggcacgguggcucacgccuguaaucccagcacuuugggaggccaaggccgguggaucacaaggucaggagaucgagaccaaccuggcuaacauggugaaaccccaucucuacuaaaaauacaaaaaaaaaaaaaaaaauuagccgggcaugguggcaggcaccuguagucccagcuacuugguaagcugaggcagaagaauggcgugaacccaggaggcagagcuugcagugagcccagauugcgccacugcacuccacgcugggcgacagagccagacuccgucucaaaaaaaaaaaaaaaaagagacggagucucgcucuguugcccaggcuggagugcaggggcaugaucuuggcucacuggcaaccuccgccucccagguucgagcaauucuccugccucagccucccaaguagcugggauuacaggugcaugcugccacgcccugcuaauuucuucuguauuuuaguagagaugggguuucaccguguugcccagccuggucucaaacucuugagcucaggcaauccguccgcuuuggccucccaaagugcugggauuacaggcgugagccaccgugcccggccacaaaguauuauguuuacuaagugauccugcuaggucaguuuuuaauuccaaaagagauauaaagaaaaaacaggccaggugcgguggcucacgccugucaucccagcacuuugggaggccgaggcaggcagaucacgaggucaagagauugaggccauuccuggcuaacauggugaaacccugucucuacuaaaaaauacaaaaaauuggcugagcgugguggcgggcgccuguagucccagcuacucgggaggcugaggcaggagaauggcgugaacccaggaggcggagcuuacagugagccaagauggcaccacuacacuccagccugggugacagagcgagacuccgucucaaaaaaaaaaaaaagaaggaacaacaauuuucuuguccuuuauguccucaagacuucucgaaaaguccucauauuccacugguucuacaaugaagugccuagagcuccauccuguaguaagcaaagccugccugcaugaaggugcuucuaugugacaauuauuugcaaaacucaacaucagguggcuaacgucuauauucccagcaacuuaggaggcucaggcgcgaggauugcuugaguccaggaguuggagaccagccugagcaacauagcaagaccucaucucaaaaaaccaacagaaaacucucgacauuaggaaauaaaauaacaugguaucuucagagaauuugugucccuggaauuacuuacaaucaaugguucucaaacuuuaauaugcaucagaauuaccuggagggcuuguuaaaaacaaaccacuggccugggcucucccuggaguuucagacucagucuuccuggggucgagcuaagaaucugaccucucacaugcugcugggggcagauguggcugagguuaaggcaccacaccaggaggucacagcuaucaauccagguugcacucuccucaccugugaggcagggacauggcccugaccucggccugcugugacccaaaacaggucaggagcacuggaugcgaagccugucaugcagcaggauugcaacacauaagugcugcuggcuuggccucuucugugccauuaaggcccuggagccugaccgccaacugggcugccagccacccuccugcacacccuacaagcugcgaccugcuuugccagcuguuccaggugaggcccugccugcagcgggcacagguaggaccgagaaggcugggugacaagaggacccacuccugccaacagcacgcaccaggacaucugcacuugcagugcagcuccuuccuucccuccgggucucagcagcccagcuguacuggcucccucuacucacuguuuuccucuguagcaaccuaccugguggacccacccuucccuuagaugcucuuugugacaaucauaggggggucuccacccuccuggcagaacccugacaguucuuuccacugugucuaucagaaacagccagggcaccucgccacugugacacaugcacccugacccuguucccagagguccugacucaccaggucucgggggaggcauggcacaaaaggccucagguuaacuguaacauacacagaggcuacucuauaaaaacaaacaaaauacaaacauacagaaauaccuggcuuucagacaccagugaaaaccuuucagcccugacugccgagacuuuaacauuuggggguccugcaguguagauaccggcuccugggagagaagcuagggagccaggagccagcuucugucaccuggugccaggaugggagacaccuguuucuguaaccaacacugauagguaaaacacacacagagggcacuccaaaaaaccucagagaccugccgaaccacuuccaagcaggcaguuuuccggucccugcuccagccagggaaacuggaaauagagugucaaggaucacgcccagguucuaaaauccauccuuccccacacauauuuauagagaccucugugcacacgagcucuggggaaggaaagacgauauccacaucuaacaaaaaaacacaaaggccuccagggcuucaggagacaccccuggugauccugcagaguucugacucaaaugcuccuuucugugaucugacauuccacacaaaacuuaauuagaaaauguacauguuaaccaagucuuuaaauaccuaucccuuuaaccucuaagcucucaccugcuggggcaggugugggccacuggggcuuccucccccaacuuccgcaggcggaaagcccaggguagccugcucgcggcaagaaggccuugagaagggccuugcagggccaagucgacaggaccaaauccuggagugcaagcccugcacgccuuccuuuuuugagcaccguuuauugucacuccagauagaaaucauagugauuaugauucccuaauagcaaccagaaauguacagggcugcuaaagccucagcaugauggagugccaauucagaucugcccgaauuauaauccaguucccugcccugaaccucaccgugccauccacaggcagaggaaaacagcacuuuauaugccaugcaaucccccaagaucugacuuccacccuucgacccaggcacuucuucuguuaagacaggauuuuuaaagaccaggcauaaaggggcugggugcagugguucacgccuguagucccagcacucugggaggcaggcguggguggaucacuugaggucaggaguucgagaccauccuggccaacauggugaaauccaucucuacuaaaaacacaaaacugaguugggugugguagcagacaccuguaguuccagcuacucaggaggcugaagcaggagaaucacuucaacccagggaggcggagguugcagugagccaagauugcgcaacugcacuccagcuugggcgacagagcaagacucugccucgggaaaaaaaaccaaaaaacaaaaaccagccaucaaugcccuggaggagaagcagugaaggcagaacagcccugacagcgaagaggccgcagcuguuguguuccuggcuuguggcaaccuccacacguuuccuggcuccuggguaaugugggcaggggugaggagccagaaacacagacuuguggggcucuagaggccucaaggacagcagcgaaaacucucagagcucaggaaccacaacggugugagugcugccagucaaggcccauggcacagagcccuaacgcuuccuuccuagaagcaaaaaacugagaugagcucugagaaccgugccugaaugcucucaggaacgucacugagacuccagugaguggggcugggucucagccgagcgcacccuggggcccugcacauggcugcucucuccggagcguggccgcaugcaggaaggaaacggaggggcaggcagggccauuccuuacacugugucucugacaucucucgggauccgagaauuccaaucucgaaaaacuucauuuucuuugucaaauucccguucgucuucgccaauggucaccguaaaccuuuucucuucaaaaucaggcuccuguucuuuucgaauaguugcuuuuuuuaaaaccuaccauuguaagaagaaagaagucaacauggaacagaauaccgggcgucgcuguuaggaaacacaaagggagccgucccacccgaccgcagcagcccugcaggagcaggagcugcacgcugcaagugcucaaggggugaggggcggacacagcacaguuguccuucuggggagggcagucugugcccgucucugcacaaacagcugcccccggccuccgugugcccacaugagguguucaucacuuccuucaacuacccuuggaacuagauccaggguucagucacucagugacaagcagcagguggaguggcuggagucucagagggaaggaagugacaugccgagggagugagaaggaacaucuuguccgucauuucccagcagggaggcugaccaggaaaaugaggaaguggggcugggugccagcagagugguccccagagcugaagcucacacacuggggccaacgugggccuagagggaggaagugugcagugauaggaccagaaagcuccaaguuuucuccaggaagagcagacacugagucucaggaguguggggugcagauccugggggugcggcucgggcagccucgccaggcuuucugugaguggcuggagacugcacccugugcuccugggcagugccagcugggguguggcccagugcugauccagccccaugaagacaguggguaugcccuggacugaacucccuggccuacugggcugcugccugagacaguuagauauaacucuccauccuuccgggccugguggcgcaugccuguaaucccagcuacuugggaggccgagcaggagaaucacaugaaccugggaggcggaggcugcagugagucgaguuugggccauugcacuccagccugggcaacaagagugaaacucugucuccaaaaaaauaaauaaauaaaaaauaaagaaagacaccacagaaacagacgccuaacuucagagauuucuggggcucucucuggaccgaggaaaucccaguuuugucaagaaccacuccuguaauagcaucuuucuugucgggauuucugcugaauuguguuuaccuccuuugcaugccggaguccucguucccaggcacucucuguugggggcucuggaggggguggaggcaaaauuucaucaacuaccggcccacccuauugaaaaacgagaagggagaaggugagaaaguaaaacuuucaaguguacagagaaaccagacaguaaaaacaucaacuacaacacaagccggccguguguggccgcucuccuuccaccaagccucacuccguccucggaaagccgaggccugcuuccacucgggacgacagaagcagccgaaagggggcacugagccugugcuaaggcacagugacuugucuuaagcuugagauucagacacagcucaguuggcugaugugcuaacaaugaaagaagaggcaucacgcacccaaggguuggcgggcaucagcgggugagguccgagaggcggggcaccauuaggcgggaaggggucggcuuuggugauuagggaguaguuccccuugucguucacuccaggguguauaaaccuacaauucauuccccagguacaguucccuauggaaacaaaagugagaucagaaaggguccacaagagccuaauugcacaagggcagcugcugggguggggggugggagggggcagaggccauguuuacccaggccugauggcgagccacacaguagugggaacugaacggggaggugggcgggaugagccuggagaggcugagccagacagcugcaccugcccaggcacggcaguuccccagaggcugccaggcaccucggucagagugaccacaaagucacuuuguggagaguucacgcguaucaacugucugaguauuaauuuuccccuuaaaccagaaaagccccagagcuuugcuuccagcccuggcccaggcucaucuagguacaacuggauguuaauuguauuugugccgaaacagacaucaaugagaagcauuaacaaugaucagaagccugcaggugugcucaggguccccuuggccaccucuguacgucugcauuucucucacagagaaaacucucacagggcauuucaagauauuucuggaacugaaacgggcuuuuacacuuugcucauaaauaacaaucacaaaccuucaucuucaacagaauauccggguuaguaaaggagaccucgacuuucaaguguagaauauaagacaucuaagugucuaacucaauuacugagugaaucacuuuuuuaaaauguacuuuuuugggaauagauaauguguacacauuguuuaaaaccaaauauggcauauaguaucuaagcgguuuaaaaauuuuuuucaauggguuaacaugcaguuagauuuuaaaucauuuaaaauuuuaaccuuaaacaucaggaacacuuaagccugcauuaaaaccaacucaauacaacauaauaacaauaucgauccaaauuaaacacgaaagaaaacuuaaaacugcuucucuggaaaugcaaaaaugacaaguaauuuuuaaaauuucuaaaagcauuucagagaucacacauaagucaaacgaaguugggaggccaggcgugguggcucacgacgucaagagaucaagaccauccuggcuaacauggugaaaccccgucucuacuaaaaaauacaaaaaauuagccggacgugguggcaggugccuguagucccagcuacuugggaggcugaagcaggagaauggcgugaacccaggagguggagcuugcagugagccgagaucgugccacugcacuccagccugggcaacagagcgagucucucucaaaaacaacaacaaaaaacaaaagagguugggaaauguuauucuauaggggguucaaaaauccagagccucagagagauuuaaagaaaaacugacuaugcagucauccaucugagacucaacacacuacagagcucuucaugguuugccucugaaaauacucaugcaguauucaaaaucacguguguaacuaaacaaguaacaaaagcucauuguaaaaaauguccaaguacagaaaagugcugacaauagaaaccacagcuuuucuguacuccuuuuccuuuuuuuuucagauggagucucacucugacugagugagacagucccaggcuggagugcaaugaugcaaucucggcucacugcaaccuccaccuccugggugucagugauucuccugccucagccuccugaguagcugggauuacaggcggguaccaccaugccaggcuaauuuuuguauuuuuaguagagacgggacuucaccaacuuggucaggcuggucucgaacuccugaccuugugaucugccagccucggccucccaaagugcugggauuacaggcgugaaccaccacacucggccucuguacuucuuuuucaucuaaaauauguaucugggugguggcuaaauguuaucguucuuuucuguauuuaugaaaauuuuuaggacaucaccuacgaaccuacuaucaaaaaagauccuuucucacugauauuggcauggggagaaaagaggaacaaggcagaagagaacaaaccagugagcgccaaagagcaagcugagaaggcgagcguggggcugccacuagagaccagacacuagugggugacaguguucagcucucgggagccaccugcccgggggugcugagcgcuguccugccccuggccagaguaaaggggaagauggcucuggaaagcagcacaguuggucugcacgucuagcugggacacacuuccagcagacgucaggcagaaagaacaccauugucccaucuaucuuuuuaaaaugugaacuuuuaucuguguaggaacacacccaacugucgggaaugugggaaggggcuuuagauuuuauuuucuugccuucugccagcccauauuacuuucuuuccuuuuuuuaauuuuuuuuuuuuugagauggagucucgcucuguugcccaggcuggagugcaguggagcgaccuaggcucauugcaaccucugccucacaguucaagcaacucuccugccucagccucccgaguagcugggauuacaggugugcaccaccaagcccggcuaauuuuuguauuuuuaguagugacaggguuucgccauguuagccaggcuggucucaaacuccugaagucaggugauccgcccaccucggccucccaaagagcugggauuacaggugucagcuaccguccccagccuuacuuucauaauuuaaaaagcaauuuguuaaaaaaaaaaaaaaaaaaaagaaagaaagaaauuauccagaaaauagaagcaacaauaaagaucuucugguuuacaaaugggacuucaaacccaaaauuuauguggauugugauucuaacaguauaaagauaguucugcggauacuguguacacagacauggccucaggccagaagaggacaaggagggacagaggccgcuggagcggggcggaggcggccccuccacugcugaaaugucuaaguacuauuucuggcuucaagacaggaugauggucuuuuucuuaacuggaaugucggcacagcagcaacugguuuuucuuuuguuuuguuuuuguuuuuuugagauggaguuuuguucuuguugcccaggcuggagugcaauggcacaaucucagcucacugcaaccuccgccucccagguucaagugauucuccugccucagccucccgaguagcuggaauuacaggcaugcaccaccacgccuggcuaauuuuguauuuuuaguagaaacgagguuucuccauguuggucaggcuagucuugagcuugcgaccucaggugauccgcccgccucggccucccaaagugcugggauuacaggcaugaaccaccacgcccagccaacuguuuuauucucuuauuaaucuuuacgcuuguguaaacacuguauuauuuuauauauaugaaauauuucauaaucaaaugaaauacuuguaaauaaaaaauacccacccacucuaaaagguacacugugaaguugaccaccuaucccaugccuccagggccauucccagaggcaguuaucaauauacuggggcuccauccaucaaucauugcccccuuuuaccugagcauauauauuaugcucugugcugaaccuugcuuuuuuucacuaaacaauguaacuacagaaagggaaccugcaugcucaguagcaaccaacccaaacuggaucagggaaacagacaggaaacagauaggaaacauggaaaauccggaaacuaaacacagagguggcaggaacugaggcucagcucaugcuccagcacagcccacacaugaaguaucuuuaaaugucucuucugauuuugaauacaguaaauaucaauucccuguguuuacuugguuuauaugugucauuucuauugauacguacgauauuagaaauuaagagacacuuaaagauaucucauuauuuaacaauaacaagauauccaauauauaguaacaaauauuuaugaaacuguuuuuaaaauauuuggugagaggaauagcauucuuugccuuuuugcgaaucucuugaaugcugacccuggaaaaccccuggccucccaucugcaugcgaucgaccaugaagggccgcuguggcucaagcaggagaggacauuacagccccaggaagagaugcagcuagagagggaggggcaucuaaaagccuuuucagugugcucagagcuucucccugacaccgcacucagcaagggaaggcuccuuacagcgagcugcaauugaacccuaucaccacacuuuuccaacuugguucuucugaaauccauuggucuaucuugaacuuugaaugggucuuuuacccaggcaugauucugugacauccugcaauggucaccugagaaaguccugacacacugagaagcuggugagcacacaaaaguccaauuuucaacugaaagcuccaauuuuaauacugcuaacacuguccguuguucuccuugaagccacaggcucacuuuguuccugccaggacccggaucugcauucccuggcaugucugccagucuuucucaucaaugugugcuccacggagagcgcacagggucagccgcagcuccagccuugcacgugcugccccuugaggccgcuggacuugggugccggcaggggcucuacccacgcugccacuccaccacgcugaguacugagacacacacagaagcucugcuuucuggcuuuccacaguuucaguuaccugcgucugaaaauacuaaaucgaaaauuccaaaaauaauuccuaaguuuuaaaugauguucugugcugagcagcgugaugaaaucuugugccgaccuccucugccccaccugggacacgaaucaucccuuuguccagcagaugcaagcuguccacgacgcuaacugcccacuagucacuuagcagcccucuuggccaacaaccguuggggguacggcggugcugugcucacuguggcucagugacccaggaucacugggggcaggugaccuuccuucugacgcauuggcaggaggucaaggggggcccaaugcuaaguggcagggccuccgugucaucaugcgagcauauuucaucccacgucaucagauggcugaguggcugagugcaguaaagugagcucuuuugagagaucacauucacauuuuuauuacaauugcucuauuuuaugauuggcuauuguuguuaaucucuuacugugcguaacuuauaaauuaaacuuuaucauagggauaugcuuauauaaucauggaacuguacacuuaaaaugggucaauuucauggcacauaaauauuacuuuaauaaaguuuuuuaaaaagaacuuacgaauaauaaaaauaaauaauacaucuguacacaaguguaagauuuaauuaaauuacaguucuuacuacuacagcacagacaugaaguaaaguggcauucgaaaugccagugcauggugaaugccuggcucagccuuacuguuauuauaaauauaguuucgauuugggaggccaaggcggucggaucauuugaggucaggaguucgagaccagccugaccaacugaaacacaaaauuuagccacuacuaaaauacaaaaauuagccaggcaugguggcaugcgccuguaaucucagcuacucgggaggcugaggcaggagaaucguuugaacccgggagguggagguugcaagugagcugagaucacgccauugcacuccagccugggcaacagagggagacuguaucucacaaaaguaaaauaaaaugaaagaaaaagaaaaauaaauaaauauaguuuugaccucaggguccccugaaagggucucaaggacucccagggguucacagaugacacucagaccugcugcuuuaaacacaguuuugcaaggauucaaaacugagcaaaagacauuucuccaagaagauacacaaaugaccuauuaagcacaugaaaaaagacaccccaccacccaucuucaggaaaggcagaucaaaacccaguaagauauuaccuccuacccacugaaauggcuacuaucaaaaaaaaacagagaacagaguaauggugaggacguggagaaacuggaagcccccacaccacuggugggaaaguaaaauggcacagccacuguggaagacagcuuggcggcuccucaaaacaugaaacauacaaccaccaggucaucagcaacuccacugccagcggcuccgcaaaagaugaaacacacaaccaccaggucaucagcaacuccgcugccagcgguuccucaaaagaugaaacauacaaccaccaggucaucagaaacuccgcugccagcgguuccucaaaagaugaaacacacaaccaccaggucaucagcaacuccacugccagcgguuccucaaaagaugaaacacacaaccaccacgucaucagaaacuccgcugccagcaguuccacaaaagaugaaacacacaaccaccaggucaucagcaacuccacugccaggcacaugcgaaagagcugaaagcagggucugaagagauuuuuacgcccacguucacagcagcucuauucacaauugccuagagguggaaaccacccaaguguccacccacagaugagggaaacacccaaugcagcugcuccacacuaacaaauauuggucaaucuuuuuuuuuuuuuuuggagacggagucucguucuguugcccaggcuggagugcaguggugugaucuuggcucacugcaaccuccaccuacuggguucaagcgauucuccugcuuuggccucccaaauagcuggaauuagaggugugcucuaccacccccagcuaauuuuguauuuuuaguagagacaggguuucaccauguugagcagucuggucucgaacuccuaaccuugagugauccacccaccucggccucccaaagugcuaugauuacaggcaucagccaccgcaccuauuauucagucuuaaaaagacagaaggccaggugcagugacucacgccuguaaucccagcacuuugggaggccgaggagggcagaucacgaggucaggagaucgggaccauccuggcuaacacagugaaacuccgucucuaccaaaaacuacaaaaauuaccugggcgugguggcgggcgccuguaguuccaacuacucaggaggcugaggcaggagaauggcgugaacccaggaggcagagcuugcagugagccgagauggugccacugcacuccagccugggugacagagcaagacuccaucucaaaaaaaaaaaaaaaaaguauuccaccacaauuuuaaaaaauuagggggagcacagccaaggagaucagacccaaaaaauggacugggaugcuuguucacugagggauaaaucagaagcccaaaguaggggccgggugugguggcucacaccuguaaucccagcacucugggaggcugaggugagcggaucaccugaggucagggguucgagaccagccuggccaacaugaugaaaccccaugucugcuaaaaauacaaaaaugaguugggggugguggcagaugccuguaaucgcagcuacucgggagucugagacagaagaauagcuugaacccagguggagguuccaacgagccgagaucucaccauugcacuccagcccgggugacagagcgagacacugucucaaaaaaaaaaaaaaaagaaauaaagaaacccaaagugggacacaguuuaaagaagaugcuacuuacuccucuguggacagaacuuuguguccugaugauccaacacaggcccacgagagauaaaaacaucccaugaagaaguacagcuccaguuguaguguaugugcuguggagccgggcaggcguacacaaagcacugaucucuaaaaugugagcaagguguguucccagugcauuuugcugucauuuggucacaaaucucaauguguccacuaagcgauuaaaugauuaaucucuauaucacaacgugucggagauaaagcuaagagaggccugagcaguggcucaugccugucauccccauacucugggaggcugagguggaaggauugcuugagccuaguauuugagaccagccugagcaauauagugagaucccaucucuacaaguaauuuaaaaaagaaagaugagcucuugcaauguugcccaggcuggucucuaacuccugggcucaagugauccuccccauucagcuucccaaagugcuaggauuccagguaugagcuaccaugcccagccaccgacuuuuuucuaagaaaagaauuuucuaauugugacacaauucacauaacauaaaauacucccauuuaauguguacaauucacugguuugcaguauauucacaaaguuguguaagcaucaccacuagcuaguucuagaacauuccaucaccccaaagaggaaauccuguacucacuagcuaucacucuccacccccaguccaggcaacgaggaaucaaucuacuuuccgucucuguggaucuguggccuucugugcucccuucugucacucagcacgucuuuaaggcucguccacauuguggcaugagucacaaucuacuuucugucucuguggaucuguggccuuccgugcucccuucugucacucagcacgucuucaaggcucguccacguugcggcgugagucacaaucugcuuucugucucuguggaccuguggccuucugugcucccuucugucacucagcacgucuucaaaguuuguccacauuguggcaugagccagugcuucauucccuuuauggccaaguagcauuccacugcauggacaggccacacuuguuuauccauuccucacuuuuuggguaccuggguuguuucucuuugguuacuggaaauuaugcugcugugaacauuaaugcacaagcuuucacauaaaugcacacguccguuucucuuggcugcauaccugcaguggaacugcugggucauacaguggguacccgggagcuucugaggaacuguuuccuaaagcagcugcaccguuuuacccucucacgagcagugaaugagggcuccaacaucuccauauccuugccaacacaacaaacuucauuuuguuuuuaaaauaacuuguuguuauuggagagaucauaaacugaagaauuucaauuucauauaaacugcagguaggcagaaacauuuaaguccaaauuucucauaacaaagcagcagcagaagacaugaucuagaaaacgguaagaaucagccacuuccucuguaccguaucaccucacucuacagaauaaaaacacuucugaaaugaguuauugauaacaccugauuaagccgcaaaaaugcugccuuaucuagcuucugacuuuuuuuuuuucaagagacugagucucacugucgcccaggcuggaguacaguggcacgaucauggcacaacugcagccucaacuucccaggcucaagugaucugccccugucagcccccaccccccacguagcugggacuacacaugcgugccaccaaacccugcuaaguuuucauuuuuuguagagacaaggucucacuauguugcccaggcuggucucaaacuccuuucuugacuguagaaacccuuccacauggucucacuugcugaaacccaaacucaguacuuagucuaacuuugggggcaccaccuuccaauucugaccaacccacgugaugugcaaggagacaggauccugucuguguucauccaggcaucucccaaugaagggaaugaagaguuccaguaaccaucucucugucuguuuugugcuucuguuguuaaauucuggaauuagcucagcagugagcccugggcuccugguccagagucucccugcccugguggaugcugcagccuccugcaguuggaaccaucaggccaacgccgacuggccggucaagcuucccagucacacugccacccagagaccagagcacugcacugugaugggugcugauucaaaaugacugcaaauguguacacguacauguguacagauuguucuccaucacuuucauacagaaauuugagacacugauguuguuaauucccacacuauuauggaaaagaggucuucugcuuaaauuccaauuucuuuaaauacugacacugugaauaccaaagcuuuuccaaaacguaccgcacauuucucugcauucuuaggugugucugugacaaucuacggcucuaagucugcugcccucacaggcucuccccaguaggggccccucacaugcacgugugacuugggcacgucaacuguuuuugcuuggcaaaaccaagcaagcacacacccacaggagcgagccuaacccgggguucccaugagccccacaucaucaggucaucucuugcacaggggcguucccggcugcucuaagagcacagccugccucugaaugaugggacuccgccacaccccaaggguguguccugccuguccccgaugcucgacuggcucacgugccucuaaggaggagguuccgaacagcucucugccccucaaagacccccuuuccuucuggcuucacagcuguguucuggauccaggagaaggaagucuggccucuggaguagggggacuuuaagguacugaagagagugaauauagcguauuuuguaccuuuaaccuggccucugaaugguauggaauuggauauugguggaagaagaguggauaauggugucacaacaucuggaaaagaaguacaggaagcucuugugagcuuuagauggcacacacaggcuggcagugacagucaucuaugggcuuacagcaaaauuaagagaaaagagaaaaacaccuuccuaccuuuccaaggggaacgcugaauuacaagaaauaugccaaaacuacugcugcacaucaaagauacccuuacaaguuggaaauucucauuuccauuuccgaaucccccaagacauuaagcagcgaaacaaaaagcccuaacaucaucaggcuagaguucugccacauuuuaaaaugggucagcccagacuuuucugacacuuucuuacacuguccccugcugcagcuccugaacucacaccauuccuucuacaggagagagcccugcugccuucagcggccaucucuggccauuucgaaauccauuccacacgaacaaacgcuucggacacaucuugcaggaaaagcggccaucucuacagagguggggaaaaugcuaauucuggugucuagaacauucggccuuaugaaaaggaccacuuugaaaaaugacugaugccaucugcauuauaguuaugggucugcugcgaucggaagggccugggaccaccagugugagaaugagaaugaccaggcugcucccaccaaggcagucauuaaagugauaaaagcaccaauaaaagggccuauuguuuaccaucaauauugccaccaccaccaccaccaccaccaccaccaccuagccaguaaugcccagagaacugccuugagcagagcagggccuggcaaggugagccagcaccacagccccagaagguggggccccagcuggcugcgagaaggccucacacgcagacaauuaccuuucaugaagaaccggcaggugggacgaggccucaccuuccugucacugggguccuucacuucaccuucuuccaggucaucauccugaaacagagaacaccgucuuagcgugggggaggcaucuaucaaucagcacugcuuucuccaaaccagaaggggcaggaagcugcguguggaaccuggauauugucacaggaauugaauucacgucaauuuuccaaaucuuaggucccagaucuacauagcagggaugaucagagcgugcccggcagcucuaagcaucccgccacagcaccagggagaagcacugugcagcacacagggcaauuuacagagugggcuuucgugacauuucucuuaacuaucaacucugggcaggaaauaguaacacuucgggguuuuaaaacuuuuaacauuuaaauaaaauauggagaacaaaauauuuuaugucccuuaaacacaaacauccucuaauuuacaauucuuggggaggggaggaguugggugccucagggcagugaugccagcaguugggaguggcccgccuugaggcucauccucaaccagcuccucacccugacugucaagucuuagaacaacccaggagcucuaagcugggccucacccacagggacucgggugcacagccaaaccugacccuugcuuggugcucuccccaagccacccacugucccagggccuguucccacggacgugcagcugagaccccuccuuacaccaccccagcccacgugggcaccagcugcccaccugacaucccugacacaggaccauccaagauggaaguacucgucagccugaucccggccucuuccagccagcccuagcguaaccaaucucaccggucccauguggccccucuugaucccccuccccaucuccugcaaucugcaccacugcccaucacacccagccugguaaaaccacuuucuaacugaccucucucauucccuccucaacuccuccagucucgcuucacagugugaagcgcccuuuuccaguuccaggccugaccgcguucuucccucuccucuuccugauuauucaacuuacuuucagauggaagcuugaguccccuuccuugggguggccuucccugagcucccccuacgacagguccuugcagccccaagcccugcagguguugcagccacaccugagcacccuuguguugacgacaccaccaccugccuggcugaacccugugccccaccagggcaggcccacgucugccagggcaggcccaucgccaaguugcugggcccaggcagcaucuggcucacaguaaacaguccguaauuaucuguugaaugaaaaaaugcugaaaccaaacccuggauuuacgacaaccuaaacuuucacagcuuaaauauuugcaucauuuuuugccucaaagauaucugguuauuaaaaaguauuuuauaaggaaaagaacagauuccugagaguuauaucccuuaaguaauccagcagaaucacuuuuuaaagaaaugaucaaacauaacaaauuaaaaaaagaaaugaucagagaaggcauguuuaauuuaugccaagugacaggaugucucucuucucuggucuuuuaguuugugucuucuuuuuacuacuauucuuacaguaaugagcaccacacuaaaaucucaacgugguauucuauguaagcucaaaucuaaguggagaacacauucuuuguucccaugagaaaaacaaaacucauuuggaaaguucgaauccauuccaaucuuccugccuuacuuggaagugagcguguaggagaugagguggugagaaggguuuuucccgcaucaggaugaauaggaaacaaacuagaucagauguagcauuguuucugcaaagauguaaccaccaacauucacagaagcaaaaaaggagaacaauguaaccaccuuaagauuggagggaggacccuguagcuacuaaaggugaucgguaaacagaccagaguugcauacugaaggugcgagacaucauuucaacccaaagaacacagacuagcaccuacacacugaccccagucacccagccucuacacccgcaaggaccaggggcuguacauauuggugugcugggcuuauggccccuuucaguuaaaaaaucaaacaaacaaaaauaauccaccaaucacucagcaauauaauauugugaauuuucaacuaaccaccauuuagcacaauggucuuuuaaauaauggaugauuaccaugcuuuuuuuuuuuuuuuggagacagaguccugcucugucgcccaggcuggagugcaguggcacgaucucgguucacugcaaccucugccucccggguucaagcaauucucuugccucagccuccugaguagcugggauuacaggugcccgacaucacgccuggcuaauuuuguuauuuuuaguagagacgggguuuugccauguuggccaggcuggucuugaacuccugaccucaggugaucugcccgccuuggccucccaaagugcuaggauuacaggugugagccaccacgcccagccuccgugcccaauuuuuauucuuacuuuauauguguaaauaacaaaauauuuaaccucccaaaauaaauaaacaaaucacuaaauaauggauaauuaaaacaaguucuuaaauuuuagaauaucaugcaaagacaacucaagacagggacccagagcugaagucaucugagauugucacacuaagugucugccacgcaggaacuccgggucuccugguuucccucacgccgauggccuucugcucaugugacccgagccacagagaguaggaagcagaggacaaggaggggccugaguggaccagcuagcuacaaauuggccuaaaaacggauggugcccguggggcucucaacacacaccaccugggacaggccaaguugacguggacacugagggugagugugaggagacacacaggccucagugcacccaucugaagccgggucuccacgcuggcacacuccugcuggugcuuucucaccacaggggaaauacacacguggauaaaggacaccaggcugagggcaucaucuacuccaauuuuaagagccuuuauaaaauucacaugcagugggggaaaaggcccagguucaaauccuggguccaggcugucaugacugugaguguggacaggucaccugaucugcaaaagucaccugaucugcaaagcucgccuuccccuuugcaccacggggcaagugccccagagcagggugaugugggcugaaggaaaaugcugcaccgugcuuaaaacaugagcagcaagugcucagcaagcgcgccugaguccuccauuucaaaggaaacgccucacugguaacgugcuaaacaggacuaacucagagcaaugacacaggggauuuucgcuuucuucuuugugcagccuuuucuuuuccuuucuuaaauagaaagaacacugugaacauguauuacuuacacaacaagaaaaaaguuauuucacacuggagcuucuguacaaaggcagaugcagauaaggaaagggggccacugcguggagcugcugugccagaggaagccgagcagccgggccccgggcccaaccuggcacggccacucaggccaaccacaaccuccugaauccugggcaucuugucugcaggaugugggugaaaauacgggucuaucauuccuuaacugaaaccuguggggccaggugucuugagaauucagaaauauucuggcuucagaaaggugacaacacagggucuaaaacgguagccugcgagguacacagcaauccugugcagaggucucggggacccucccacaagaggggaggcaggaggcuaugagcagccucacgccagcuugggccaggucugccaccaggugaggaaaagguuucaguucucagagcuucugaggccucagagcuguaaggacgguggccugcgcuuuuucauguggcuauguggaacacuaaccacgcuaaggggcacagaaggucucugagccuacuacugaugcuacggggcccuuuuuccaagugugguacaggccgcugcuuccugggcuuuggcaauagaaugggcgcacuuggcaccuuaucagugacacggaagagaaccccacuugaaguggaaacccacagccaugaggcucgcugaagaaucuucugcagaagagcucauggauccagacauaaaaggcggguggaucacgaggucaggaggucaagaccagccuggccaagauggugaaacccauuucuacuaaaaauacaaaaaucagcuggccgugguggcggaugccuguaaucccagcuaaucgggaggcuaaggcaggagaaucgcuugaacccgggaggcagagguugcagugagccaagaucgcaccacugcacucuggccugggcaacagagcaagacuccaucucaaaaaaaaaaaaaaaaaaaaaaagaaaagaaaaaggaaagguggauuuaaacaggagaaaauauuaaagaccaugugcaaagaaaauguuccaaaagguggacugagagcuaccaauuaugacaggagucauguggcccacccacucaggacagggcccacugcgcugcuggcugacuaggaggccacccuacaaauguaggagguccucaauaagaggagaauggaacaaaaugggaacccuauccuuuccaagggccagugugcuccaggugacggaaggccugcuaaucaaaugucaagucagauauaaacacggaacauggagugagcaaaagagcgggcagacagacccaggccaggccucucaacuguaacggcaaaucagagccucgccaggcuggaaggagcuugucaucucccagcaggaaaggugguucuggggagagacuagacgugcaggagaaaggagaggcugccacauggcaugagugggucagggugggcuccacgcacucuuuggacggcaggagcauaaaaacaaggccugcugcacccagcucucuuccaugccgcuuccugaacagguaagagaccggugacugaaggucagcuggugucagggacgcccucacccacaccacaaaugagccaggugcugcaaacugcuggucccagcccuguacggaaacuuuccaccccaccacgcaggccagcggcacuuccagaagauacuugcaucaggggguguucuggcagcauaccaaacacagauucaaggccuuaggcacaagcuaugugguuuaaacaauuucaagggcuuauuguacaaauugaugucccgaucaaggaaaguguaccccauaaucaguucaccugucccagugacccaaaaucuaaaagggacaugugcccugagagaagagaaagcgcuucugaaaaagaaugauaaaucaggccagggacaguggcuuggcacuuugggaggcccagguaggaggaucacuugaggccaagaguucaagaccagccugggcaacauagugagaccccaucuguuuuuuaaauuaaaagcaacaaaaauuaaaaaucaaaacuaagaaaaagagaaaagaaugccaaaucaaacggcucucuagacuuugccauucaauccuuccagguauccaguagaccagggugccaagggguaggccacgaggcugcaggcaugcagggaaagccucuaggcgaaucagucccucuccugacugggccgguaagacccugcugggaccuggaaugcuaugaggccucagaaacauccauuugcgaagguacaggccaaagagaguaauucuuccacagagaaacaucuggguaguagacgugacaccagggcucuacuugaaagcaacgagaaaaaugucuucuagaacggacacuuugcaccacacgcagaggcugcuuuccagggacugaaaggaaaggggaccgggcgaaaggccuggugggaagcugacugcucacggacccggcgcaccccagggcucccaguccaucagagaaacccagcuagagacagggagcagggcgcggggcaggaaugcagcagggccucugagaaagaggcaggcacaggaggugggcuugguggagauacggcagagaugcaagaguggacgacaggcuuggaacugggccugagaggaggaaaaagcuggaagcagccggagcggcagcucuucaugcacaggauggcguggcgcguaccucugcuggguccuucccacaaggguggagggcugaugcugcucacgugaacucccuuccaucugugacuggcucuugagcguggaccuuccacucacugccacuucacauuacaaagguucucaccuucaaugugccccgggcaaguaggauuccucuacugacuggcugcccacuaugugccaggccccagggagauaggggaaccagccagguagcccccagucuuaggaaacauguucuugggaauaggggaagcagcaggcagagacauauacauauacacacacacacacacacacacacacacacacacacacacacacacacacacagaugaaccugugucacgacagagaggcagaggcaacagagaaacagccuacgcaaaugcugagguugacacauaaaggauggaggagccugaaacgcugcugggcgugggaacaagaggagaccacgggggcuccuggggcaagcaacccaggggccugaagucaaaugugcucuuguagaggcugaacccaccauucacagcacugcccaccuugguuaaaggccugcugcccccacagcaggagcgggcucugcuccgcccugcccagucacacucagcauguggcacagcaagguccaccugugcugguguccaggagcacagaccuaugggggauguggggcgcuggaggcagucugugcgguggaagaaaccugccuccccguuugccaagggagcugugcugggguuuccacagcagcacuccguuuucaacuguggguccccucacaagacggugccaggcagggcaggcaaggucuagguaggcaaaaauggcaaaugggguuuuucuuccaugugcugugucuaggggaaaccagcauguccaggcccuuggcagccagggccauucuccagagcagcuggacccaucuaccgcaccgcccgcgcccauggugcggcacugagaacucacaguaugcuccacagacauggccuuucaggaccacuauggggacccuugauccgucugaugaaucucccccaagacuugagggucugcagccaguccucuuaagaggaacuagagcacgccagagcccugggugcaggaccugcugcacucccagugguggugcagacagggcuguuacccccaggacacaaaaacucagucucaugggcauccucaacccaaccagcucccccagcugaugaaccugaaucucaccgucucuccuuucccucugccagcccugggguaggucuccucuugcaaaaagcacuagcugaggagaccacuuccuacacuucgcugcggaaagaugaaacaucuaaaauucucagcuugcaggugcacacacgucccguaaagucacaugagcaauacuucaaacccuauaaauuacugagcagugccacagagagcagcgauggccggaaagucauauccaaacgugcauugagagcacgcacgccagcaugcuacuggagaagcauggcacccgccgggcguggugccucacgccugugaucccagcacugugggaggcugagacggccggaucaccugaggucaggaguuugaaacaagccuggccaacagggcgacaccucaucucuacgaaaaauacaaaaauuagccagugguggcgggcgccuguaaucccagcuacucaggaggcugaggcaggauaauugccugaaccuggggguagaggcuguagugagcugagauggcgccacugcacuccagccuggguuacaggguagacucucucucucaaaaaaaaggagcauggcauucaaggcaaaccggcgguuacacaucuaacuggcagccuuuaccugccucaacccagagcaugacaucagagagauacucucggcagacacucuucaccgcaaugacuccccauaagcacaauccccuuccccaggaucuuucaaaaaaaaaacaacaaaaacccaguucaguucaacugcucugucccuugcucaccuccuuugaguucaauagcuccggcaaguaucacucaggaggacuuugggguguuucucccgaaacacucauaguuuuuccaacggcaucaacugcuaagaaaaccccaccuacccauaccuaggaucauagauaguacuaccuuccccucaaccugaaggccacauuaauuuaauguacaaaaaagugugcuggcuuugucagaaguugaggugcccaccacagucuuuucagggauauguccaaagaggccuggcccagcuggugcccucuccagaggucaggcucuaggaccagcauaaaaaugccuaaaacauccaaaaccagauggaaaauuuccucauucuuuucaguccaaaaaccugacaagaguggaaacccacgugguuucugguugaguguuaacuugaguaucacuugaagacggcaaagacaaggacagacauuaacccuucauuccuagaaccuaaaaacacugggcgcuggaccuuucacuacaacccaaacaaucccaccagcuggccggccgagggccacggaaacccugcuggcagcuucuggagcugccucugcucauucucgauuucuggcucuuucucuccaaucacuaugggacugaacccaaaacaagccucucauucuccugcaccaucccuaguaacaaaucacuaagucagucccacacagagucccuccuuuccagcaccagucuaugucaggcugcugggcaggaugccccgcgacgcucugcuccaucauacucacgucuauuuccccaucaucgauuucuccaucaucguccucuuucuuuuucuccuuggcagccuccagggauuccuuuucucccacacucugaacaccagccuuccccuccucccugggagugccuucgccuuucuccucaucauccucagcccccgcuuucucagccucguccuccuggacggcgggagcuggcuccucaggaaccuccucaucguagucuagcucaugcucauccagcucccuggugacugaggaggccucaucccuaaggucgcuuguccggucuuccuccccuucgucccccuccuccucgcagggggagcuggucgggccccggcucagcucauucaccucugaguccuggucuugggauuuaggcucacuugcccgguccuccucgucggagugauuaucuuccuccuccuggcucggcccccuggcugcacuuuccucauccuccagaucagaagcccucacccccgccccguccaaauccugaucggacccgcugucccucagaaugucaucguccgagagucccuguggcugcucuucauccucuggagagugaggaucccguucagggcucucggccacauccauc

SEQ ID NO: 19059 - RNA, 1303 nt, Homo sapiens
ucucuuuuuuuuuuuuuuggcugagcacaggguacuuuauugaugguauaugacaagguggggcucccuaggccccuccccucuucaaggggucuacauggaaacugugaggaggggagauucaguguggugggggacugaguguggcagggacuccccagcagugagggucucucucuuccucuugugcucuuacuggggcuggugguccaggggucuuacuccuuggaggccaugugggccaugagguccaccauccuguugcuguagccaaauucauugucauaccaggaaaugagcuugaaaaagugguuguugagggcaaugacagccccagcauugaagguggaagaguggguguugcuguugaagucggaggagaccaccuggugcucaguguagcccaggaugcccuugagggggcccuccgaugccugcuucaccaccuucuuggugucaucauauuuggcagguuuuuccagacggcaggucagguccaccacugacacggcaguggggacacagaaggccaugccagugagcuucccguucagcucagggaugaccuugcccauagccuucgcagugccaguagaggcagggaugauguucuggagagccccguggccaucacgccacaguuucccggaggggccauccacagucuucuggguggcagugauggcguggacuauggucaugaguccuuccacgauaccaaaguugucauggaugaccuuggccaggggugcuaagcaguugguggugcagaaggcacugccgacaaucuugagguuguugucauacuucucaugguucacacccaugacaaacauuggggcaucagcagagggggcagagaugaugacccuuuuggcuccccccugcaaaugaggcccagccuucuacaugguggugaagacgccaguggacuccaugacguacucagcgccagcaucgccccacuugauuuuggagggaucucgcuccuggaagauggugaugggauuuccauugaugacaagcuucccauucucagccuugacggugccauggaauuugcuauggguggagucauauuggaacauguaaaccauguaguucaggucaaugaaggggucauugauggcaacaauauccacuuuaccagaguuaaaagcagcccuggugaccaggcgcccaguacgaccaaaucuguugacuccgaccuucaccuuccccauggugucucagggaugugguuuggcugacgaugcaaaagaagaugcggcugacuguagaacaggaggagcagagagccgag

SEQ ID NO: 19060 - RNA, 2563 nt, Homo sapiens
uucaguuuuaauuuauuuuuaucacucuuucuucaugauccagauauuuuaaaaugcaaagaaaaucaacuuucaggccagguguaguggcucacaccuguaaucccagcacuuugggaggccaagacgggcgggucacuugaggucagcaguucaagaccagccuggccaacauggagaaaccucgucucuaccaaaaauacaaaaauuagccagacauagguggcggaugccuguaaucucagcuacuugagaggcugaggcaggagagcugcuugaacccaggaggcggaggcuguaauuuuaaagaacuauugcagagguuugaagaaaauagauuuauuaguuaacuuaugaagagauuaaagagcuugaaacaagcauuaaaaagaaauuugugccuuuauuagaauguuguuaggcuuuaaauaugccaauuuugguaaucaaauuauuguuguuguuguuguuuuauaagaaaugacacuacagaacugcaauacugguccaacacucuugucuuuacuguuuuuuuaaaagcaagaaacagaaugugaguaaucagaaagcagcagcaggcaucaguuaauccaagauaucagcucuuagcuucaaaagcacuugcaaagaaaaccuuuuggggagaaggaguggagggguauggaagcacuccauaauaaccggaaucccauuaguguguaugccaagucucauggggcuauuuuuuaaauuuauccuuuacuuguucaugacuuuucucucaaacacaauuuuucuuugacuuuuuaauccucaaaguacaaaaaguaugaaauauaaacaagcucuugcauugcacacuuagaaguauacaauuaaauaauuauagagcuaucuacacacugauaaauccaucaaaucuuggauaauucauuaacauacaaaauaccagggcacagaaggaacuaaaacccacuucuuuuguuacacauacgauucaaauauucaaucuaaaaaaaauacaaucacuuucuuucucuucuacauuugcauguugauacacuuauuaaaauauuucuguauaaucacguuuggucuuacuauuucaagucagguuuaaaaccucaaaaccagccauccagacaaaacauaaugaaaaagauuaucucuucuccaccucccuaaccccaauaacuaugaagucauuuuuaugacaugacuccaaacaccggauugugacggcaaaugcuagguccaauuucuucauaaugauuuuuaguguggcauacuugguagaacuccggcguggaagccagcauugauccuccaaaccaaacugcauauggcugcauaugguguguaacgacuuguacaucaauagauuuuggcuucaaucuacugccacucaauuccuuacuuaauuucagccaggcaucuacauacaguucuuuucaaaucucuuugcaagugauauccaaagucacugaacaugguugaaccuacagagaggaccauauucuuauagagaggccgucugacaucaauaggacaauucugaauuacuucaccuacaauuucugagauagguuauguaaagucuggauuggcaaacucuagaugaaaaaaagauuucaaaucccaaaagucucucagaaacaacaccaauggaaaauucuuucuuugagauagcauugauucugguauacugcuuaauccauuuugacccaucugugucauacuuguuaaauuccuuuacuaaaucugggcagacauaacuauagugcuccuuuauugucuuagcaguuuccagggauuguuuuugagggauuccuacuucuuggucucucagcaguugcggaauaaaauauguuauauuucguccugggauuggaauguguuuaauacaguuggcaaucaaauacccuucagccauagcaaugacaugagugacaccaucuccacugucuauuacuguaccuguaaauguccguccuccuacuugucuggagguccaagaugcagcuaaggcaagaacagccugcacagcaauguacaagccuggaacacugaaggacucaaacauuacuucagcaguauauucccuguuuucuggaguauuaagucgagguucagacaaaauaaaauaacggucuucaguuucugcccuuaaauauuuaagaugacuugcucuauaaaacuuuuugucagguccaacuucaacuauaccauggcggauuggccacuuuguugcauauguagguuuuuucuacugcuucaucaccaaugaagaagucuuggucaucaauacuuuucaucacccuccuuugagauugaucacccacuuuuggugacuccuuaguagcaauacaggaaaggaugaucaacugugguucuauauuucuggcauauccuaguuuuguauaccccaugcuacaguccaccacacaggccugcagcccucccaccauuucccugcuugccugcuucugcugccgccacugucugcuccaugcugcuaggggacagagauugguggugggagacaggggcuaucugacugaccauacacagcugggccgcccuc

SEQ ID NO: 19061 - RNA, 859 nt, Homo sapiens
agagcaauuugcagaauucguauuucaagagcuuguaaucucgugcucccucuggugucuauuugcuguacugcagguccacuaaggcagcggcacaccacccagcucuuuucaagucucagcagccccuaggcauuuagaguaguccagguccugugugcguucuaagacaggcaagacagaaaucagccuuuccggcagccuccugaaaagcuacaguguugugcacaugcuccagucuucuccuucuuucuaaggaaaaugcuucugagcuguaucacccugucagcuguaccaguguuccucuggagaagcaacauaucaccaguuucuuuucgguucucaacaaccuccaagcaucuagaauaugcugggucgcuucauugcucuaagaccgaugaaacagccaccagucccuuugacagaccccugaaaagucauaacauaagaagauagugucaaguuuucucuuuccuuccucaaggagaaucuggagcuaggaguuucuuuuugaccaugugguacuauaaugaagggaggggcuaugaugacagggugccacauguuuuguuucauguucuucuggguugcagaaaucucuuaacuaguuucuggauuucuuacacagaaaauugguuucauguacuguuguugaauuagugucuccaugggagaaaugagggucugggccuuccuauuccaccauauugcuuacaaaacucuauuuccuauuaauuuuuuacuuguauaauguauacaagucuuacucauuacaauuaauuuuguuuuacuggggaugggaauacauggguaauaucacuaaugagccuguaaaagguauaaguaaaauuuuaaaaau

SEQ ID NO: 19062 - RNA, 1890 nt, Homo sapiens
ucccagggagaaaacuaaucgcuaugcagcaauauaaaaagggagcguucucuugcgauuugcagaggauuagaguuugguuucauauauaaucuggagcccauugauccacacacacaaaugauuucccuuuaaucugaggaucagacucuuuuucuagaggaaccuuggcauuugcgugcugaauuguugaacuuggcuugcauugcuggaauacuggcaggguguggaugguaaaauauauuuuaaaguuucugcuaccguggggcagggguuuggaggggugggcaucaauauaagcaucagaaauccauucuaguuccccauuucuuguucccugggauauuuaccauuuuauucugucuggcuaaagccagggcaaagaugauugccucgguggcuguuccagcuguuaguuguccuccguuuuauuugcuuuucaagguuuaacuccuacccacccucaacuuuggucaaagcaauuucuuuucagggucguguccaaucggagaucaaacaaugaugacugaaaccaauuccacgguguucaagggucagagaccuuucauauaaccguguugcuucauuugcuccacucgcuucuccaacagcaaauguauccuccaaagaggggcuugaguaaaaggcaauaaaaaagcuaggcaaaaaaagaaagguugauuggggguguggggggggggggggugggugacaaggagagaugacagggauaaagcagaagaccaagaagaguuuauugcccaaggaaaaauguagauuucacuuaaagacgccacuuaaaaguucaccacuuaaaucggauggauuuuuuucaugauguaaaaacaguuuauaauuaauauuaugccucccucgagcaacuaaaccccuucaauuuaaagcuucaaacuuaacuucaaauuugacuaauauaagcaaaguguucugcccuuuuuauugccgugcugggauugggagugacaaacuuugcuugaagaugagcacagacaccuggagaaaugcgagagaacacccuagaaaugacuccacacccaaucccgaagggcaaaaaaaaaaaaaaaaaaaaaaaagcccaaacaaacaaaaauccccacccccugaaaucuuugacuucugggcuuuaguuguuuguucuuucuuuccugauuucugcaggucuuggggcauggaaugagcacgguagaaaaugcagcgagggaaaugucaguuggaauccucggaagaaaucaggcagaaaguugaccuuuuggcacuugcagugcaauggaagguagcgccgcgugcgccccuuccuucuacgaguaagagcgacgauuuaggaacagccagccuugcucacguccacacuggcagccuggaaaggagugaaaagcucccccggccccaauccccgcgugaggaacgcguuauccccucuggggacggggagaaaucagcuuuuucucuccgagcccgucccaaagccgagggaagagguucccccacuagcccggcgccuggggagaaaccccgggggcgcaccugcagccgcgccgcgggaacccgcgggagagguuccuagacgcccagccgcccggcgccccggguccagccgccgcgccuguccaaguuuugaccgccucagcuugcccccugcucgcgccacaagugcacggauugcggccaucagacggggccggggccgcgauccacuuacccuuugagcuguucccucauggcugcaagggcuccgcggucgaguguggguacgaguggaggagugagcuucccagagccgccgggcuccccgaaaguggagcgccgccgccgccgccgcccaagcucacagcugaaagcacugcggaggagccggcgcgggcgggccgggga

SEQ ID NO: 19063 - RNA, 61823 nt, Homo sapiens
ggcggcucacaccggaucccggcccugcacggcgcguacccuggggguucgggcggggaagcggcgccggcccggaccccccgcgggaguaggcgacgggcgugagggcgaggcggcggcggcggcggccagagagcagcagccgccuggugaguguccgcggggaggcccggcaccugcccgagcagggacgucgggggcgcccccgggaucgucccagugacccugugccugagacggugggcgugugcgcaacugcggcgucccggggacucaccccggcccgggacugcggcugacagcgggaacugcggggcugccggagguuugcgcagggccuggcgcguccgcgcccgccccagacgccccgagaggccgaggggagagggaguggcugggguggggugucgacuugauuggccuuggucccccaaacggaggggacgaugcccuuccucgccggacccuaggcauugcggagagugagccucuguggaccggcuuuaagcccccaggaagguguuugaggaugaggacuagcagcaccagcgugggggccguugaggguguugagagaugugaagguuaguagcaguauaguaagaauuguuggagaggagguuuccagaugacuguugguagguguugaguaaggagaaaacacugcuuuccuuuaaagaucgcacaagcaguccucugagguccaacaacagauuagaguuauucccaguuggaguucuguaguuuacuaccgugugccagcucauaaagugcguaaaagcaggauuugaagggugagggacaggugaggcauaaaguaagcugcauaaaaagauccaaaguuuguuaauguguuaaaguguaaauccuucuguuucuacugaaauguaacuuauuuaaauuauuuaagaaaacuugccaccuuugguccagaccgggcuugucaguucgauguguuucuucagugacguuugucaaucaggcagucauuuuggcauacaguauauuuacuucugguuucuaaaagaacaagaaugaaugagaaaagggaacaguuuggcaaacugagcuuucuuugcgcacuuuuucauuuugaaaggauaagagaauuuacuuuuuucuuugcuuuaguaaugauuugcaguaguauacaagaacacguggaagaagaaaggguuuuuugagaugagaguuuaauuuugcacaguguuaaauuauaaagggccucaucacccaugguaaguuuugugaugguguguuuuaugaacaccggaagaauacaggcacauacauauacaugcuuuuuagucagugugugauaugaaucuuuacaaccguagggacagcccccgcccccacuugcuuacaacuggcuuaaucaagggaaagacuucagugaagguaaauauuaaauaugugauuuucaucuucacaucugaaagaacauaaucugcauucagucacccugaauuuucauccauauguuuauuugauggagucuuccccucaguuauagauaccacauuguguacaguuuguuggagcaaacagagcuaacgucgauuauauucaggcacuggagauccucacagcuacccuaugcuaaagauaauguuaugccgauugcacagaacaauacuaaccuccaauauucuuuggcgacuucgcugaggagauuauauagcugguaaauugcagagcuagaacucaaacucauguaggucugauucuagaguguguguucuuucaccauacucugcguaaguuuuugugcugacugauacaaauuuuaugaaaauggaaauuuguguuacaaagaaaccuuucaguucuguugguaaucuugaaagcuuucaguguccuuggcuccagauaaucucaagguuuuuuuuucuuuucagaugcguccauuuucuagccagagguaacauuugagcuagaagucugcugaucuguaaagagauuccugauagcugguagugaccuaucugaaauucagauauuuucaguuacuuugccucuugugucagcaugcccaagauacuucaaagaacaaauauuuuguuuauucuaguccugaauaguauuucaaauuacauuauuacauggcaacuaucuauagggguuugaauuugcuuuaucagcuuggagguacacauacacaucccugccuucuccagcaaguggaguacuugacagcugacccuguuuuucuucucuuuaauaauuugauacaaagguuuuggacccuauucaugauuugcagaaaagacggcagcucuucugggauccaccauaaucugcuauggggcaagggaaugaaagaccuuaacagguucccaggcaguaucugagguguugaugaaacagcaggaacaucuugccaguggucacuuuuaucucccacuggucuuugcuguugcauuucuuaugugcugcagagccugcucaagagaagggcuccacaucugaauagaguugaaguggaacagccacagaaaucagaaaaaaagagaaaaagauacuaaaugucugguagucauccuccaccaagucacuuagucagguuuagcugccuaguuaauuaucucuggcugaaaguucuagaaaaguuuugaaauuugggguuugcugcuucaucuuuuaagaaguacauuguuugggggccuucaguuaaguaguccugucuucauggaaacagaaaaaggagucuuguguuccucaguacacaucaguauguguguguauuauguagcuuuagagacuguuuuaaguaaucccuuggcaucuugaugggcaaucuguggucugaauaaguuuuuaaauauaguuauacucccaagaaagcguuaaauaaaauauacuuccuuacuugugaaaguaauuacucaugguauuugggcuauuuauuagggcaaaaaaaaaaaucaacaaaugauaauguaacugaaugcuuaccaaguaaauaaagccuuucugaaaugauuuauauugccaccguauaaagauaaaacaccaggaaauugccucauaucuacuuauaaguuuauuuucauaccuucuauaugguaaaccucaaauuauuaccauggccacaaauauuuauuucucuaaaagugaaauggacuugaugaaauauuuggaacuaucaaacugaauuaauccuaaauaagaacauuuauuauaguuuaauucauggacaguucuauuuguccaacucuaacauccuacuucccucccugcuucaaauuucucuacuuuccauccucuccuucugaugcuguuccuaccauuuaccuggcacccuuaguuuuccauugacacugaagucuuugauaggguggaugcuaacaaggaaggcaccaaaacuccuccaagucccuucuccaccaucccgugcucuaggaggucaagagggaugcggauaagaucucuuaccccacccuguucuuucuugaaaaggaggaugagaauagccaagagugagggaggcacugucaagacccuccaaugguuucuccucuucuucccucuccuuaaacaccaaggaggaaaguugguaaaagcccacgugcugcaggaacaggcacuguacacucauccucuucagcaggccgccaucuucgcacuguuuccucacuccuuucagcugccaucccccgcuccauccuucuuucccaguuggucuugccuuccucaucccuggaucuccucccaccccagcucugccuuuuugcccuccuucauaguggaagccgaggucugugguccuagggaagcucagacuuccaguuaugggagggaagauuuccuuuuucuaccuccagggcuaaaugggucaggaguaguugcuguuauccuaaguuggaaugcuaaauugauuuuccuguagaaacauugcccacacagguucuguguuuuguuauacuucuguaaccuuuuggacauuuaggcuuuugugagcgggcuuggaaaccuagcauauugaucauugucuccuggaaaggcaaagucugaguuucaaauagaugauuuuaaaaaucagcuugugcuccagaaauuguugaggguugccugcuuuuuguuaauuauucacugaaaugguagguauuaauaguacaccuuuagcuguccagaauuagauuuauguggaucagauggcucuugugggagauaaacugauaggcuuuuuagauugucaaugaagaauuucuaaauuuaggcacauguuuugaaauaaaauuuaaguuaguccaucucagccuaauauugucauuaaagcggacagaucuugcaguuuuguugaaagagcauaguuuugguuuuucauaaaaggaauaucuuguucccaccaugaauuacugaugauuugaaacuuuucaaagguauuggaccucuugcaguuauuuuacccucauuuauuuaguguaaacaugggacaguguguuuguuuuacuucaagauuuuaaaauaaaguguuagcguguugagguuacauacuguuaccacuguuugugauguucagacaauuaagugagggauaugaagguaauaaaaacaaagcuaaguacauuuuaaauuuguuuuccauaaauguguucagucuuauauugguugaaggaaauacuccuaauaaaaggcaagaugguuuuuuuuuuuuuuugguuuccaaaccacucuuucguuugaaaaaugacuuucaguaagcacgcuguguucauuuuaagaguuuaccaaguuauuuaauuacacagcgagugcagagguuaaaaauaugaucucgggguaaaaugcccagauguucagaucugacacuaacuagcucuguguucgugggcaaauuacuuaaucucugaccuguucccucauuuuugaagggauaaugugguaccuaccucauacaaggauuaaaugagccagaggauguaucauauuuaaaacaugccuagcaauggugaauacucaaaaagaguuaguucuuauuauuacguugucgucaucauuacuacuauuauuguuauuacuuuagcuacuuucgaagaugauacgccuucuguucuggggugugggcaugaaagauauauuuguuuaccugguagcaauuuuuuaaugcagaguuuauuugagagguucagggagagagcaguauguuaacugcuggauauauccacaauuggccauagugcaggaaauucauagaauauuaagcuuauuuuuuucaguaacaccauuccuuuuguuagguauaaagaacuaugccuuuuugauguuugagcaaaacuagauuauuugaguaauugcaacgucuuuauuaaaauacaguuaucuugguaucuaaaggcuagagucugugcagggggagccucaauuucuaaaugauccauugguaagacuuuuuuuuaagcagcaccauuuucccacagaaaaaugucacauaauaguguucagauucccaagccagcccaacauaucugaauuugaauacugauaguauuauaaaaacuaacuuuuauguguaacagugucucagcaggaacaugcacugaguacaucaaguacugaaagauuaugaacacaaucuugcagauauggcaguagggcuaucuuccuuugcaguccuagcaaggaccgucaagccuugggaagagaacucucuccucugguagaggccgaggguaaguaguggagacuggucucuagaaggcaguagcuuuuuucuggcuuggcuccuuaaaaggcuguauaguauagugguuaagcgcauggacuguccacucagagugcuuaucuucaaaucucuguucuauuacuuacagaacuucccaucuguaaaauguagguaaaaguagugccucccuuaugggguucuugagaggauuaauguguuaauacguguguagugcuuaaaauagcaucugacccaugagugagugcauaagaaguguuauguauuuuuuaauuauucagcuugacuggucuaggaucucuagaauacuuuugucugcuuggcuguccacugcccacaucuuuugcacuaaauaggauucuucucuuuccuuucuacugaggaaugguuucagacucuucauuccugccugaaguauuuuuuaagggguuuagggggguuuauuuuauuuuuuaauguuggagaaauagcauucuucugugaacccacuccauuuccccauuuaggccuuguguugauggagaucaucauuugaagaaagauauugacuaugggcauuuaauugagucagaauugaggugcaaauuucucaacuuuuaguaguuuuugcuaagucauuucuuuuuaaauaagcuuuuuauuuuggaauaauuuuagacuuacaaugaaguugcaaagauuguacagaauuccuauauacucuucauccaaguauauauaacccugguaccuuugucuaaacgaagacauuaacauugguacauuauuguuagugagacuguagauuuuacucgauuuuaccagaaucucacuaauguccuuuugcuguuccaggauaccauguugcacugaguuguuaagucauuuuuaauuauuuguuuuuauaucauggagcccuccaguucuuuagugaauagauuucugugguuguaaagccauuuucuguuuuaguuuuaaguuuucugcacauacucgaaggcuagguguuuccucuagggauggcaaguccagggauuuaucuuggcacugaacuuuauagguugaaauaaaaggagagaguccuauuacuguggaaagaacacuauggugauggaguguaggcuaaagcauuuuuauaauuuaaaacuguguuuucaugggacuaaaugaguuauuuuaugcacuauucacuuuugauggauuugauuucaaaaugacaagucauucuuccuauuaaaaaaguguuaagcauacuucuuggauauagaagcuaauugaaaugaauuggagaauuuaauuuuuuaguacucaucauaguuaugauugauuuaauaaauuaaguuaguauaauuucaguaauuuagaacauuuguuuauaugcgcuuuuagaaaauccuugguuucgauuuguggcaacaauccagucuuuuuguuuuuuucagggauaccauauguaacaggugccauuguuacucuaacuuuucacacaugccuucaguuugaugucaaagucaucauuuaguguaaacagcaaguuaucuguuaggcugcacaucaugaacuuuacuuuuagaaagucuuaucuuuuaugccacagaaauagcauuuggcuauuagucauggauggcaaagaaauuaauuuugaguuguuuggauaaaaauguuucaguugacuguaguguguauugagagacacugccaguaaacaaacucucuugguagguggaaauccccuagaaguuacagaaaauugggaggaggugaacuuaauuaaauaacuugaauuguuuagacauauucagagcuucuuaugaccuugaagaaaucacccaacuucaaaagaccucgguuucuucauuuguaaaauuagggaguuugacuagauguguaaaucuaguuguuaguuaacuucuaagauguaaaaacccucuuguuuaacaaaaaccuacaagaucaaguugcuuaucugaaaucuuuaugaaucaacacuagucacuaagucuagauauaagucaguuuaucaauuggguucaaauaguuucaaaccaauauuacuguaaguuugagagucacuaguugguuugacaccucuuguauauuuuugguaauuaguauauugcuuuuuaaaauuuuguuaucugauuuuugugcuuuacccugaagcaaugaccuucaaacuuuuuucucauauucccuaaacaauuuugaaaaauguacuccuuuacacuuaaaaaaaaaacaaaaaaccucuuacugaaguuuaauaugcagaaaguacacagaaaguacgguagugaacaacucagugaauuuucaccaacugagcacacuuguguacuagcacccagaucaagaaauucuuacuaccuuaccccccuccacccccaucccugcauauuguccuaacuucuaacaccacagauuaauuuugccuacuuuuguacuuuaucuaaauggacucuuuugucucugacuucuuuuaugcaacaucgugaauuugagauguauuuauaucguauguaguuguagacuguucauucucauuacuguauacuauuccacuguaugaauagaucauuauauauuauuguugagggauauguacguagaucucaguuuguggagaaugucuuugugaccuuggaguaggcaaagauuucuucagcaggacuuuucaggaguaauuauuuuacaguuuagauuggauaaggaaugggagaacugguuuauugaaauaugagcaguuaaauuuuuuuaaauguuaauauguaguuaaaacuugauauucucuaaaucucggggagaauguuaauauuuuuaacuaaaucuuccagguaacagguuugugcuuucaugacuauuuugggaggaauuucuucaaaaaugugucauguacuucuuugucuuuuugacuugccgauuuguaggaguuuuuuacuauaugcuggaaaugagcccuugcugguuguaaauaucuucucccacuguguggcaugcuuuuucuauuucaugguauucucauaagauuaccuccaagguauucucucaucuucuagaagcuuuguuguuuuggcuuucacauauagaucuagcauauaccugaaauugauuuuuguauuuugugugagguaggggauaauaccgucuuuuccuauauggauagcuaauuuucccagcacaccauuucccugcuauugucaggaaucaaguguccauauaucugugguucuguuucugugcuuucuguucuguuccuuuggucuguuugucucuacuuguacugaugccacauugucuuguuuauuauaguuuuaucauaaaacuugauaucuaguagaacaaguucuuccacauuguccuucgaaagcaucuucgcuauucuuggcccuuugcacauuucuuugauuuuaauaucaucuugucauuuuccacacacacccacaaaaccuguugcuacucugauuggaacugcauggcaucuagagagcaauuugggaagaauugacaucuuuaucauuuucuaauucaugaacaugauacacuacgccauuuauuuaggucuuuaauuucuuucaguaaugguugugauuuucuccggaagauuguucacaacuuuugagaguuuuauuuguagauauuugauauuuuuugauauuguaaauguuuauagccauuauuuuguuuguuuauaucuuuauauugaccuuguaucuaauaauuuugcucaacuuuuagucauauaucuuuagaguauguauuugaucuuuuacuauguauucagucuucuuaucugcaaauaaagucuuguuucuuccuuucgaaauguuauacuuuuguuucuuaucuuacuguacuggcuaguauuucgauuauaaugcagaauagaaguaguaauaguggcgcuauugucuuuuuuccuuucuugaaaggaaaacuuugaacauuucuccauuaaauaugauguuuacuuuaauuuuuuucuagcuaucaucagauuaaggaaguuucauucuguccuuaguuuauuaggagcuuacaucaugaauagauacuggauuuuaucaaauguuuuuccuauuguuaauauaaccauaggauauuccucaagucaaauuauauugauugauuuccuaaugcuaaauaaacugcauuccagaaauaaaccuagcauggucaacaucacauuuuccucuaauuuuacuuuggaauuuuagaucuuuguucgugagugggauuggccugaaauuuuguuuuucuuguacuguccuugucaggcuuuaguagccuuguaaaaugagcuaaggaagauaccugcuuuuugauucucuggaagaguuuagguuaaguuugguuuuauuuuuucuuuaaaugcaugauagauuuuagcagugaagccauuuaggccuagaauuuucuuugugggaaagcuuuuaauuacagaugcaguuuuaaaaauacuaauaguauucuucaaguguuucuauuuuguuaauaucugcuuuuauauucaguauauuuuauauaccuuuuuaggaauuauuuugcucuuuuucuuucuaacuucuugagauggguagguagguguuuauacccuuguuuccuuccugacauacauauuuaaagcuauacauuucauuuucaaguauugcuuuaccugcaucccaucauuuuugagauguaauauuuucauuauuucacaauauuuuaaaauucccacuguaauuucuuuuuugauccauggguuuuuuaaaaguauauuucuuaauuuccaguaauaugagaauuuucuaacuguguauuuuuuguauuuuguuucuggcuuuaacacauuuuccuuagagaacuuugagugauuucaaucuuuuaaaaugcccugagacuuacuuuauggcuuagcauguggucaguuuuugcaaauauguaagcacuugaaaagcauauauucugcaguuacuggacacagcauucuauauauguccauugaucaaguuugguaauuguaucguaucucugucccuaccaacuuuuuuggucugcuuauucuuuuaacuacugagagagauaucuuucuuucuuucuuuuuuuuuuuuuuuuuugagauggagucuugcccuguugcccaggcuggagugugcaguggugcgaucucagcucauugcaaccccugccucccagauucaagcaauucuccugccucagccucccauguaacuggggcuacaggcacgugccaccacaccuggcuaauuuuuguaauuuuuguauuuuuaguagagacgggguuucaccauguugaccagacuggucucgaacuccugaccucaagugauucaccugccucggccucccaaagugcugggauuacaggcaugagccaccacacccagccaagaggugucuuaauauuugccccugagauacuaaugcaugucucauucuccuagaaguuuugucaaccuuugcuuuauauauaauuugaguccauguuaucaacugcauacaaauuuaguucguuauauuguucuggugaauuaagcauuuuaugacuaugaagggacucuuuuuaacucuagugauccuuuuucuuugauucuauuuugucugaaauuaauacagcaauaccaucuuuaauagagcaauaccaucuuuauuuuagcuaauguuugcaugauauguguuuauccuuuuacuuuuaaccuuucuguauucuuauguuuuagauggggcucuugaaagcaacauauaguuguagauuuuuuuuaacccaaucugauaaucauucuuuuuugaaacauuugauucauuuauacuuaauauaauuauugacauuuugggguuaaguacagcauugcauuuuuauucuacuagcucuguauuucuuuuuccccuugucuuuuucuuuuauuugacuauuuuuauaucauuuuuccuuuauuacuucagacaucacuuauucauuuuuauucuuuuugugauuacccuagcauuuauagcauguauucuucacuuaucaaagucuaguguuaauugauacuucuaccuuccuccuaguugaagcaagaauauuaaagcaccuuaguuccauuuaccuaccuugugacauacauauuguuguccuguaauuuaauuuucuguauguauuuuaaaccuuacaagacauuauuuuauacagucaauauuccuuuagauuucacgugcuuauuugaacuucaugggucuucauuccuuucucuaucugugaccuuccaucuugaggcaguuuucuuuugcuucauucuuagugaggguuugcuggagaugaacucuguuuuuauuugucugagccuguauuuuaauuuuuuucuugaaggauauuuucuccucaguggaauacuagguuggcaguuguuuucuucaugcuucuuggagauacacagucuuuuagcugccauuuuuguuguugaaaauuaagcuaucaaucuaacuguugcuucuuugaaaguaaucuccccaccucugccccugcugccccuccaucaggaugcuuuaaaacuuuccuuugucugguaggaauucauugagauuguuacacaugugguuugacagguuucaucauuuuuggaacauuuauucaaauauugccucugccccauucugucucuuuuccuucugggauucugauuaacucuuggauauuagaccuuucucacuguaucuuccauguuucuuacccucucuucauucugagcguuuuauuuucccccgaccuaucuuuugguucacugucucaacggugucuauuggcuguuagaccuguuuauugaauucuuaguuucgguuuuugcauuucucaguaauaaaauuauucuuugcuucuuuuaaaaaucugcuguguagcccggacaacauggcaaaaccccaucucuacaaaaaaaaaauacagaaauuagcugggcaugcuggugcaugccuauagucucagcuacucaggagacugaggugggaagaucaccugagccccagaggucaaggcugcagugagccgugaucacgccaccgcauuccagccugggugacagagcgagacccggucucaaaaacacccaaauucugcugugucacauuuuaugauuucuaggucauugcugagauuuuuaaguuuggcuuucaucuccuugaacauagcaagcauaauuuaaaauccaugucugauaauuccaauacuuggaguccuucugagucucuucuggucaucuuauuauguuuccucgugugccugauugucuuuaauugcaugcugggcauuguauuugaaaaauuauuugaaaaaucauuugaaaccaaggaugauaguuuuucagaaaggaguguauguguguguguguacaucugcuuaagggaauccagaaaauccagaguugcuuaaucaaaucucagcuuuagagaccuuccugggccaaccagaugacucaaggccacaucacauucagugugugaacugauucauugcgauucacccuuauuucuaaguugcagcccuucagggucccaacccgaaagugggugaagaggauuuucccuuuuguccuucuguuuuggcucuuugacacuuuuaagaaaggcauuucuuauauuuugaccaacccuauuccuugccuucagauagggaggugcuuuguucgcucuuuaugggcaggauuuucuuagaaguggcaaagacugucauuuucucuaagacuucagacucagcccuaguucuguuuaagcuuuguuuuauauagcuguacucacuuguauaauuauauacauuuuuaauugaaagguuacauuguaugugcguaaauauaaguaaauuguuuccugaacacucagcaauauuuuaagucucuucaaccuuggucaauugcuagaccuugacaauggacagguuuauuuaaauuucagcuacgucuggaaugacucaaaagaugaaaucccucuuaauugcuauugaaauuaggaugcauaauaucaacuaaaauuuuuuccucucauggaagagaauacuuuccuaguuacacuuuugcaaucacaucuucugucuuagcauacuuauauguagguauaauauauaucugcccuugugaaauaggaaaaaaaaaaaaggcaguucugcugagauuccuagauuucugccauaugagaacccucaaacaaccuaaucaaugaacauugugcuuuacaaacuuuuuuccuucuauguaaauuaauaacccacagcagccuugugagguaaguauaugauaggugugauauuaagcaaaggauuaggaaacugggccuaagagguuaaguaacucgucugucgucccacaccuggugaauggcauauguucuuugucuguuaauauuacagcauuguguuucagcuauaauggccagguaacucuugccugcauaugcucacugacuucccaguuuuaucauauuaugcuuucuucuuucuguaagucauauaauauccugaccccaugacucauguccugaagauugagacaauugggagauuacuccuucauaucucauccucaccgccucccaccccauuucuagaacaugguaccaccagcucuggaauuugccaaccucucugcccuguuagaaagcuugcugugucacuaguccuuucucaucccuacacauacagucccuuucucucuuuuuagacaugucucaauuuuuccaguucuaaaagagaugcgucuuugcuuuccaguucauuuaccgucuuucuuggcacucagggcuuccuuuguugcuucuccagucacucuugaugaaauccuagccagucuuguuugccuuauccuucugaaucuuaagaagggcaaaaagcuuaucugccuuguacuucuuuuccagcaauagagucaaugcuccuauacuucuagugauucugcuucugaaccgcccucauaucucauuuucaaaucauuguuuucagcauccagcaacauccuugcuacucacuuguaaugauagccuugaacaauuauuuuacguuaggccugugaaugucaaauacccuuguuuauuuguagguacuugacauuugaacguuuuauuugaacauuucuaaauguacacaaaugaaagguccaaugaaccucugaugcuacaguuacauacguuuuaccauacuaguuucaucuccuuacuccucuuuuuuccaagaauuaaggcauagccaagacauaauuucacuccccaauaauuuaacaucucuaaaacaacacauuuucuuacauagcuacaauguuauuaucuuauacagcacauacaauacaguucuuaauagcacauauaauacaguugacccaugaacaaagccgaaguuaggagugcugacugccugcagagucaaaaauccaccugaacuuuuguuguuguuguuguuauuguuguuuugagacagggucucacucugucccccaggcuagagugcaguggcaugaucaugguucacugcagccucaauccccugggcucaagugauccuuccaccucagcuuccugaguagcugggaccaugagcaugcaccaccacaccuacuuuuuuauauuguuuuguggagauagggucuccucauguugcccaggccagucuugaacuccugggaucaagggauccucccgccuugccuucccaaaguacuaggauuacaggcgugagcuacugugcccagccaaugugccacuuuugacucccccagaacuuaacuaguaauagccuacuguugaacagaagccuuaucaguaauauaaacaauuaacacauauuuuguauguuacauauauuacuguauucuuacaauaaaguaagcuagagaaaagaaaauguuaaaaucauagaaaaauauauuuacuacucauuaaguggaaguagaucaucauaaaggucuucaucguugucaucuucauguugaagaggcugaggagguggaggaagaggugggguuggucuugcugucucaggcauggcagaggcagaaaaaggggaggagguggaaggagaggcaggcacacuugauguaacuuuuuuuuuuuuuuuuuuugagacggagucucguucugucgcccaggcgggagugcuguggcgcgaucuccgcucacugcaagcuccgccucccggguucacgccauucuccugccucagccucccgaguagcugggacuacaggcgcccgccacugcgcccggcuaauuuuuuguauuuuuaguagagacgggguuucaccguggucucgaucuccugaccucgugauccgcccgccucggccucccaaagugcugggauuacaggcgugagccaccgcgcccggccguaacuuuuuauuuuauugaaaaaaauccacauauaaguagacccacauaauucaaaccugugcuguucaagggucaccuguacuuaguccauccuuaaauuucccuaauugucuaaaaaaaauucguuuuuugauaguugguuuguuugcaacaggaucuacucauuguauuugguuauaccccuuaagucucuuaauucucuuauaauguauaacaauccucucugcuuuuuuucauccucagacuaugccauucuggugagauauuguuuaacuuguuucuuuauccucuuacuucauauggaccggaaauuagaucuauaugcuuaauuagguucauaauauauuuucuuggaggggugggcaagagugcuuguggucacuucauauuacaucacaucuggaggcacauaucaucuggucauuucaccuuaaguguugugaagauucaucagaggguucaaguggugacagcuugaucccuuugugaagcccaaccuuuuacuuaaugcuguuagcauccauugauuacuggugcaugaauuaguuauguaauuaaagguugcaaaauugugauuguucaauuuggucacuucugcuauuauuagcugaaauauuuauauauggacaaacugcuuucucauucacaagagcuauuugguuaaccugaaauauguagucauuuauugaauuguuaaauguauaacucuauuauuuuacuaaggcuuaugauaaagugauucuugaagaaguuaaagcuauuccugaauguuagauuaguaauuuuuguggguugggucauggggaaggucuuccaauccugagcgaacaguucuaauccuauugagaaaagguaggguggcagggaaaaacaaacaaaaaaacagaagaaaagauuguauacucucuucauuauugugggcuugcagugcggguguggugcuuacuugggguaugggaauuuuaaaaaguuccucuacuuuaccagagacuacaucagacucaccacggaguccuuuaaauuuuaaagaccuauggcccuaaaagggccucagcacaguuuugcaaucaaguucauuaaauuuuaaugacuaguacaucuugggaagcugcagggacuccugaugguuuuccagggaugcagcuaaagcuccucuugcuagcuuucuccgaagcuaaaaucucaggaaagcuucauuuguccccucugcuguuguaaagcucuaccuuaggcacucgaggugaugagagaggagcaggcuggcucaggcagucaggaaaacuuucucuuaguaucaauuaaacauaaguuucauucacugaaauuucauguaguaaaauggcugccugcuuuuucaugaccuuuuauucauacacuauaucacuugcucauacuguuguauuuaaagcuuucacaguuugaaucuuaccucauuagccuuuuauuuuucaggacacugucuucagccuuuucuucaaguuuuugaccguggauuguguugugucaaacuggaugaauuaucuuaguugaauuuucaccaguugaaaaauuggagguaaggaguauauuucuuuuuugaaaaugaaucuauauuacuguuaacauguuuacacccuccccuccauuuauauucuguguccuuugugcacuuaagagcaaggaugacaaaauaaaagauguccaagugauuucauguguuuagauuuaggcccuaagagcagcagcugcuacugcuacuacuaguacuaguacuacuacuacugcuagugggaguuacaaguucuuuggacaauucauuugcuauuagaaaccucaccagaaaauagaaggguaauuuagcaguuuauuuugaauaaaaggggcuaauccuacucaggugccagauccccagcacuggagcugguggagauugaaagaucugcccccaagaaauaacuagaugugugugggauauacgaaucuuccaacuuccuaguuuuuguaauuuuucuuauucucaaauccauguuaaauaacugaauuaagcagaugguaaauacaguauuaugaacaaauaaggguauaauuuuguuagugguauuguaaccauaauucuugcuuugaaccauugguagaucuguaucaggaaagacuacauaacaauaucagccgugauuucuacauaguuuaucuuucuaccuuaugaaaauguucccacuuuuuauaacaucuguuuccuaguauccagcauggguaugugcugugaauuaaauacuuaggcaagauguugugacacccguuuaauaaucuuggcuuuuaacaaguuuuaaaaucccuccagccuucaguuaucuucuugugugaaauguuuguauuuggguugaguucaggguuucgcagauuuggcacuauuggcaucuugggcuggauaauuuucuguugucaggggcuguccugugcaguguaggauguuuagcagcaucucuggacucugccugucagaugucaguggcaccuuuccucaguaugacaaccaaaaauaucuucagacguugccaaaugucccuugcagggaaaagucaccccugguugggaacuacuggguuagaugauguggaguuucuuccagcuuuauaauucuauuguuuuuauuuuaaacaaaaaaccuauuuuuuguaauccagcuuaaaugucaucucuucccugaagcuuuccucagcucuccuucucuuuguucuaccuucauuguuucuuuuucugacuacuuauuauagaacucaaccccacucuauuauaacugccaguguuucucucacuacgaggacaugggucuucuguaucgccaagcuuagauuuuauuaaaugagugggcaauggguuagaaauuguuuaguuaaugauuauaaauagcauuucuguuaaucuuucaaacucuuccacuaggaaauucccauaguugugaucuuggauuucaggguuaaugagacugauuauucauuuuuuaaaaaaaucuuuuaaauauauuagaaggcaggagccuccuauagguacgugaggaugcuacaugaacacaucuaggcugcacuugagagaaaucacacagaaauucauaacgugaagaguuaagucauuucaacugucauauccagaggguuucuccaguacuuccauuuugcuucuuaaucagcaagcuuccaucuauuuagaagaagguaacaaggaaaguaguaauauuuuuccuuguauaacuuaaaauauaucaccauauuugaagucacuauuucucaaacccacaguaagaaauacauuuuaaucgugaucuaguacauacgcacauaccugaaacaaguuuuuugaaugaguauuugccauuacugugugugaaacacuucgauauuuucuguuauuucuuuuucuuuuccccuuauagucaucacguaguacauuuguuauacaauacauuaauaaaucaaaacccaccauuugaaaaacacuguucuaaguaaucucuuuaaguaauaaaaugugcagaugaucugcuucuggcauaugucaccaauagguuguucuaucuuucuuuuaaaauaacgucauuuaggaauugaugcaaccaagaccuuaaaacaccuugaccagagcaaauuagauuuccaguuauuuucaaggccuauguuuugucauuuauauggaauauuuaguguguacaaggcacuguagccaaaagagcauguuugauucuuguucucaagauuuauagugaaaaauccuagaggagaauaaaaaguuaauauacuaagugcugaaagugauaaucaacacacagugacuuuuauaggcauuuaugaaagggagaaaacuuuguaggcauuuaggaggggguuaacauaaaugugggauggcaaaaaacaaacaaaaggcugggcgcaguggcucacaccuguaaucccagcacuuugggaggccaaggugggcagaucuccugaggucaggaguuuaagaccagccuggccaaaauggugaaaccccaucucuacaaaaauacaaaaauuagccaggcaugauggagggugccuguaaucccagccacucaggaggcugaggcaggagaaucgcuugaacccaggaggcggagguugcaguaagcugagaucgugccauugcacuccagccugggugacagagcaaaacuccaucucaaaaaaaaaaaaaaugugggguggauuucgcauuguuguaucagaaaguagaaaaaaguauuacacaugguagaaacagcauuuaugucagugcacagugcuucuugcucauacuugaaguuaguuuuuuuuuuuuuggauaaucaaaguaacugagaaauuaaaaaauaagaaaguuugguaaacugcaaaauuaaauguaugauauaaacacaggguauguuauuuuagcucuacugugguuguaaaaugaaguugacucaggagaucaauuagaaacuuguauguaugauagcucugauaaaagccaauauaugcccuaaaaugauaauauuaacauugaauuacuagguuuacugagaaugcggauaaucucuaaauggggagagagagugcucaucugucaaaauaagugaauaagguuacaauucucucucucucugucucucccccccacgcgcucucucucucucucucucucucucucucucuauauauauauauauauauaagcuauauauauauauauauauauauauaagcuauauauauauauauauaagcuauauauauauauauaagcuauauauauauauaagcuauauauauaagcuauauauauauauaagcuauauauauaagcuauauauauauauaagcuauauauauauaagcuauauauauauauauaagcuauauauauauaagcuauauauauauauauaagcuauauauauaaaagcuuauauauauauauauauaagcuauauauauauauagcuuuucacuaaacagaacuaaacagaaaacaggguuuauaauagagguagcauuuuucaaaaaguuauacacacuuugugcuaugcaauuaaaaaucauauaggccaggugugguggcucacaccuguaaucccaacacuuugggaggcccagguggguggaucacuugagcccaggaguuugagaccagcuugggcaauauggugaaaccccgucucuaugaaaaauaaaaaaauuagccagguaugguggugcacaccuauagucccagcuacuugggcagcugagaugggaggaucacuugagccugggagguugaggcugcagugagccgugaguuugccacuauacucuagccugucucaaaaaaaaaaaaaaaaauuauaugcaugcuucauaggccugggcuuaauccucucuuuucuaaauagaauggaggcucaggaugcuaagucagaaccagguguugacuuaagaaaauaagcaguggacuuguuuuucuuuuugaacuucugcucucuucugugggauaauguagaauuuaguugcuguagaagauauuucugaccuaaaagaaaagaagauucaguuuguaaggauacuugggaaagagccaaccugcccugaaaguguggucuagcauccugucugcuguuacuuugaggcaccagaagucuacuaguuuuuuguuauuuuccauauugaguugggaaguuagcaaaaagauaaccaucuuuucguuuucucagauuucuagacuacugaaaagaaguugcuuucagagcuggagaugugaauaaaauuucugugccaggguugauaaaccaucuugagguauuuuuuuuucuaauuuuaaauaacucuauuuuuuaaaacaguuuuaguuuuacagaaaaauugagaagaugguacagggaguccccauauacccugcacucaguuuccccuauuauuaacagcuuacauuagcaugguacguuuguuacaauuagugaaccaauauugaaacaugauuauuaacugaagucuauauucagauuuccuuaacuuuuacugaacauguuuuuuuuccucuuucaggauuccauccaggaaaccccaucacaguugguuguuaugucuccuuagacuccucuuggcugugacaguuucucagacuuuuguucuugaggaguacugaucagguauuuuguagacuaucacucaauugggaugugucagaugguuuucucauggguagaaugggguuauggguuuuaaggaggaagaccacaaagguaaagugccauucucacauucucaucacaucauacaaacaguccauacuaucaacgugacuuaucacuguugauguugaccuugaucaccuggcugagaacguguuugucagguuucuucacuguaaucuuuuuuuuuuuuuuuuuuuuuaaacaccccuuuccuguauugugcucuuuggaaagcagucaccaugugcauuccacacuuaagaggugggagguuaugcuccaccuccuugaggugaauuaucuauguaaauuguuugggauuuucugcaugggaggcuccccccaccccucauuuaucauucauucauuuauucagucauuucuuuaucucaguaugggcucauggcuauuuauuuuauacguuggaucauaauauaauacuacuuuauuuauuuugguguucaaauuuuuccagcuuugaccauugggagcuccuucaguuggcuccugugucauuucgacaugcccucaucaucaugggauuuugauuuuuuaguacuuccuuacuuucugguacuacaagaugcuccaggcucauccuauauauucccugccccaguuuuagaaucauccauuucuccacagggccuugguucccuuuauuaaagagagaaugcaauuagaaaucaagaacugggugcugggugugcucauugcuacugggguauuguugccucuauguccucucagcugaaauuuccguguauauagucuauauauuuaugcauauuuauaaauauuuuuauguauaauuuuaauguggcagcuaacauauucuuugugggggguguuaaguuuaaauuaaauaugaaucuaucguuucuggaggccauauuuaaauugaaaauguuuuuguggauuauuuuaauauuauuucagucucauaguauaucucuugagacuuacagaauaugagauagaugcagugaauaugugacuauuucaaaauggucucuacuguaauaaaaauccuauaggaugacuguuucauaaauuauuuagaaggcuuauuuaggggaaauaauaacuaucguauuccucucccccuuguuauuugguagcaccuuuacauauaugcaugaaaaauccugaaaauggaacucuuaucucugccaguaaaagaccauuuguuaugccucaauaucagccacuuuuuguuacuguuuaacuugaagaauucacacuguaguacaaaaacucuucuguuuuaaaagcaagguuugcuuuaaacuguuguuaagaguuaugacaucaucagagucuuaccagguagccaguaguacagaagaauaaugguuaagagcauaaccuuaaauuuguauccuagcuuugcuacugguugacuguguaaccacaggcaauuuauuugcccucucugaacuucaaguuuccuuauuuguaaaacguggaugauaauauuaccucucucauggaaguauuuuagggauuaaaugagguaaagcacuuagcacaguacuugauacucagauacggcucaguaaauaugaucuaaaaucaaaaccuccaaagcagcaaaaaaauagaugaaaguuugaaagcuuuauacucauauacauacuguguuuuguucaacaauuauuacuggaccagaccaaccagaaaaauuaaugauucuuuuauuuugcaauccuaaaaguucucucaagacaaggcuaacuuuucuucaaaccugggaaaugcucacucaccucauuaccuuaauaugcuagcaguggcugucagcccaagaaaguauugccucucuagaggccacuugggggugcuacugagauuuuaugggcggggccagaaugcuaaauaccuuucauugccugggauagucuugcaugacgaggaauucuugugcuccaaaauuauugcaucaauaguaugccguugagacacacuagaguacacugauacuuaccauuguaucuuuaaaccuuucugcagaacacauuucaggugucacaaacccagcagguaucuagaugagugaagcaaggccaggcugcaguguuuggaaucagcuacggaguauaggaacuaggcaaacuguccuuccuaaaaggggaguggugccuuaguuucagccaguuguugccugcaguugcuagaucacgugauuuuucagagaaaagcuagauauguacauuuuuaugugaugucucccaguuuuaaauguagcucaacuuuaaaaaaaaaacacacacacacacacacugugauggccaaaccaggcagaucugugggcugaauucauuccacagaccauugguuugcaaccucugauauaacuguuucaggaagugaccuaaaauucugacagagguaaaacacucugggccauaauggcaccacccuguuuauuugcugagcucaggaaaaacuguggaaacaaagcacuagaugucgacaucauuuucuagaguguggggaauuguggcauuagagcagagcucugggggagcuuccucucugauugggaggagcaauucuguugggagacauccuagcaauugauuuuucaggaacagaaaccacugugccuuguguuaccagcagucuugaauuagggagguggcugcaccacugaaggaagccucugauuccacugcuaagcauagcaucugggccccauagucugucuugccuuuaagaaaagaauccucacaaagcugacaugcaauaaaggcuuaaaacucugcagaaucucuugguucauguggccccugaacugugugaugaucauaggguuuaugucuuuaguguuucuucuuucuugaucuaggguuaccgccuacacagcuccacaauccacagcuguggccaucuggacuuuaguggggguguuucaagggugucccaggaguuuggucaugccugagccuagccuguacagcuuagauacugcuugaguccucugucuggcuuuaaagugacaaaucaucauucagcacuuauuguauaaaaaauagcccauuauaauguuaagaaacaaacucaauguguauuuugcuuaguaguuguugccuacauugauauauuuggacaagaauagauuauaugcuuugaucugcaugguagccacaucuauaauaugacacuauaugacaguguuuucauuuuguuucuauuggauuaaauacaaaaguacagcauaauacuuuacuguaaaacuuuguguuuuuaaaggaaacugacuauauuaggccauucuuaugucacuguaaagaaacaccugaggcaggguaauuuauaaagaaaagagguuuaauuggcucaggauucuacaggcugcauaagcauggcaccaauaucugcccagcuucuggugagagccucaggaagcuuacaaucauggcagauggugaagcaagagcaggcauguaauauggcaaaagcgggagcaaggcgggugagggagagguccuagaguuuuaaacaaucagaucuugagugaauggaacaaggacucaccuaggauggugcuuaaccauuuacaagggcucugccccuaucauccagucaccucccaucaggccccaacuccaacauugggaaucacauuucaacaugagauuuggaggggacaaacauccaaacuguaucauugacuuaauuuauuggcuggaauauuuucuguuuguaaacagaaagccucccagugaacaaaauggaaguugcuuuuuuaaaguauuuuaacaugauauaguuaucaaaaaauuaaguuugagaguguuauauauuacugugaaauacuaaaugauuauucaugucaguuagcgcugaugugagugaauguuuguacagggcagagugcuaaccacuauuaagauuacauacauaaucccuuaagaaggauauguguuuaccaguuuagauuccuauuuguugugaaaagucagucuacuauuaaucaucuuuucagaugguagccauuuuuguaagcuguuggcuuccauuugaaagaugcuuuaacauguuucuucaaaggaaaguauuuauaaccauuuuuuaaaaaggcauuuucuucuuguguguuuaaacagcuaacuuauuuguacaagaauuauuuuuuccuucccucucagucuuccaccucaccacacaccuuuagcucccuaugugaaugauaaacuuaaugaggguuugcuccuuagccagucaaagaaaggcacucaucauuagaaaugucucugauaccuacuagugacacaguggaaagaacacagacuuuggagcaggcaggcguggauuugagucaugauucugccauauguucauucuuugaguucauuuucuuauuuguaaaauggagauaaucauaacuaccuuugagggcauauuauuagcuaccaguaaaugguagcuaauuauagugauaaaaauaaugguaaccuuggauucaguagcaucugagguuucugaaggcucugacaaagcuaggugagagcuggccgcucucaagaucucugaaguauauggagccuaugcuuuugacaccugaagccugucuguccguguuuugauucuucuugccuuuucuucuagcucauaaaaaagacaaugguauugcccuuguauuuuaaaggcuuguaauuaagguuggaaaaugaauaaaaccguuuuugggagccauugggaaagcuggaguuaggccuuuggcugcuucagaagcucuuuauugaagguuugauuaaauagccaugaaguguucugaaugugguuuagcaccuaaaauacugggaucacuuccuguuaggaaaacuguuauuucuguaaauacaagccgauuugauuaguuaaggucaucccuaccauuaaauucagugaauuccuuuuuucuccccauuucuccuaauaaauauuuauugaacagcuagccugugcuaggccaugugccuacucgauuguauacccucaaaggagauguugaauuaaggaaucuaagaguuguagguagucgccuauuauuuaaaugaagauccuaaagccuuagagcugcacuguccaguaaaguagccacuaacuacagguggcuacugagcacuggaaaugggaccagugugaauuaagaugugcuguaaguauaaaauauacacuggauuucaaagauaucauuugaaaaauauauauaaaauaacugauuuuauguagauuacauuuaaaacaauacuuuugacauggguuaaauguuacaauuaauuucaccuauuucuuuuuaaguuggccacuagaacauuuaaaauuauacauaugacucacauauuuuuuacuggacaaugcugccuuagagcuucagugacuugguaggauuauacaucuagcuaggacuccuuuggccaguggaaauuauaaauugcuuuacugugaaaauggaagauagauaauucaaaccccauucagaaaaaaguuaaauuaacacuaaggacuuugaaauaauuuacauuuuaaauuaaauccuggauuguuaaucugguagcaucucuuaguauuucagauuuggaguuuucaaaagggacaaacuggaaaaauauacccauugauuuagaagcguaaaccaauuuuuuucccuauguguucacaaauugcccuauauaggugacuccacuccccugacauuugcuggguggggggauggcaggagauggggggacaagagucaucuaaaaggcuugucuauauauuuuucuuugaauaugaauaguguuuuauccaaaucuaucuuauuagguagacugguuuaguauagugaaauugauucaucauuuaacagauacuugaguaguugggcucuguaaauacaguggugaacaaggcacagaucuugaguagagcuacaggcuuuuguuugguuagcugguuuuuguugucauuuuuacuuuuuauuuggaaauaauuuuaaacugacuaaaaauaggagaaagaacaccgcauacccuuuaccuaaauuuaccuauuaacauuuuccuauuugcuuuauaguugucugugcacacaugcaugugugcauguacacauguuuguauguacacauguacauauauuuuuuucugaacuguuugagaguaaguugcaugcccuuuaccacugaaugcuucauugucuaauaccgaaaaauaggaauauucucuuauguaaccacagcacaguuaucaauucagaaaacaggaaauucaauacauuuaacauugauagaauacuucuaaucuaccaucaacauuucacuuuggucaguggauccacucauuuauuuuauuaacaguuuucccuuuuaguauaggaucaggaucagguaaaagauuuaguugucauggcucucucuuuuuuaaccugggacauuuuucaaaccuuugucuuaaaaugacauuuccuuuccccuucgcuuuuuaauagaaaagcccaaaaugagaaauguucuauuuccucaugauuaguuucagguuaugcauuucugacuguaauacuauaaaaugauguguuuuucucauggugucacaucuggaggccugugcaguccaucuggcccucauuggugauguucaucauuuugaucacccagucaagauguuguucaauuuguccacuguauaauuaaauuuuuccccuuugcaacuaauaagcuuuggguacacacuuuuaaaacuguguguauuuccuacucuucauccagauuuuccccuagauuuagcauccauugaugauacuugcuugaaguagucuauacuaugauggcugcaaaaugauuuuucuuccagcuccagcacuccugcauguuuaccaauuggauuuuacuguaagcagggacuucccuucuccccuauuuuuguagguauguauuuagcuaucuucauugauacggacacacggcucccucuuuucuacagguuuauaacucauuacugucuuuuauuauuuugguauucaaauuguugcaaauguggccagugagugcaccucuucaaguugacuuccagguccuuauauguucccaucacuucuugaguacuuccucacugucuuuaauaaugagcuauauuccagguggggcuucagguuuuuguuuuuuguuuuuuuuuuuuaaauaggugagaccuuuaggugcauagaugguuucaguauagcguguuuaguguuucugugaggguaagcacagccugcuuuggcagcauuguggaggggagaggcaaggcagcaggacuaagaaggagugucaguggaagccuccuuagaggagaugccaccacuacugagauguauaggaucaauaggaauaaaguaaaauauguaacuagacuuaaccauacuuuuuuuuuuuuuuuaaauagaaaaugacuguggugcuagaagaucauuacuuuuggaaagccgguuaacauccauuuccuaagagaaacuuggccaccauuugcucuggcauggcgcaaagcagcccacagcuugauauucagguucuccaugaucuucgacaacguuucccugaaauuccagagggcguggugucucagugcauguuacagguaaguuaccuaccagugauagugauauuaaguucuaguuuuuccuauuagagcuggugaugugugauguaauuagaacccagguauguuuucuuguguguguguguguguguguguguguguguggagcaggauuucccucaaccuuggcacuguugacagucuagccuggauaauucucuguugugggagucggccuugugcauuguagaauuacuaaacguucuaggcauccgaggccucuacccaguaaauaacaauagcauccccgcaguugugacaacugaaaaugucuuuagacauugccagaugucucaugggaggcaaaaucucccaccauugagaaccacagauuggagaagaaaauaaaagcauguagcaacaagaaaaacagauucuccuuauguuucacuuuuugaaguuuuuggguuguacuaucagucccuaaguccuuagaguugaauuuugaaucuuaaauguaucauuuuaacuucuuagacuacacacuuuugagucuuuuuuuaaaagucuuuagauaauccacucccuguuuuucuaaugcuaaauccuuaccgauaucuaauuuuaaauguaagcccauuuucacucaccuuaccuuuguuuugcugugugucuuacauugaauuaaaucucaucucgaagacagaaugugucuuucccacucaggggacaacaaacagagaaguuggccuaccacuuucccuguaccccaucucccugucccacuguccccuuguuauguuuuauauaauccuucacaggaucuuaguguuuuggguuauggcacuuaccuauuugcuuaacuuugggcagcaguacuucuaccaugcucacuggucuuccucacacacagucaguacucauguucaaacucuaccuuauggcagugugagcagcucaggacauaaccuaaaccuauauacaggugugguuaauuaaaaauagagacucagagaacaaugaugguaacagaggugcuuccuuuguuugcaagcccuuuacuagucuagagcuuugggcuuaugguuuuuguguuacagcuugccuuugcuuuuucucacacacauuccuagccugaaucucagcucuuuacuuuggccccauuuugguuucugguagagcaaagacacuucccaccggagugaaaccaaauaaggaugaagcuuuuaguuuaaaccacuuccuagcaaucaccuuccucaccuaucuuagggcccaaccuagcccugaccuuguuuuauuucacuuagcccuuuauuaccugcauuuuucauuaccauuuaacuaaacugaagaaauagaacuucaaauucagcucagugaacauuuguugauaauuacacuguccuaagucuuucacuuuuuucuuccuuugggauuaauaaaauauauugguauggagauuuaccaccuacuggcucuggaaaacugcuuuauucacauuaaaauguacgaagcucagcaguuugcauuuaaugugcaagccuuagagccucacucugggguguaucauccucaauuuaggaucacuuuuuaggaauaugaugcuuuuuugccucauuccuuucaaaaguguucauuauaugucuuaaaaauucuuaccucugaaaugauuuugauuucuuccucauguuuacuguuugauacauuuuuuauccuuauuuuucuuuaaagacauuuaacagucaaaugugacauuagaaucuauucugguaguuuucuuuguacaguacuucuguaaaaauaauacuuuaauaucuugguuuugugguuuuuuaaauuuuucuucauaggaaaauuuacucaacuugucacuauagauaugcugacaauuccaacuuuauaucauuuugaauuuggguccuuuuugugacaauacuaaguaggcuaacucaguguagagaacauggaauuucaggguuauuaauaaaaauaucagauguuaaaguauccaugacuaccuuauguuucaaacgaaacucucuaguuuuuguuuuccccuaauccauaggucuauaaaaaaaaaaagaauacuuuauuucaccuuccauauuuuuuuccuucagaugucugucagugacacauucuaguuggcaaucaguuugaauccuuuggcuccaaauuuguuuuuaauaucuucccuuccuugcucaauacgauuuucaagcaagguaaaaauaauucaaaucuuugaguuguaaugguuuucuucaauuaauacaucuuuccgucacucaaaguauuuuuugaaguauuugaauuuuaaauuuucuauauugauuauaauugccauuugucacuaucaucuggguagaauguuaauguuuuacacgcaugaucucauuuuuuaaaguauuugaauuuuaguaucaaaaacuuuauauaaagaaaagguuaaaaugaucuauagaguuuuaauacagccaauucauuaaauuucuaagaauucauuuuguaaagauuugcuggacuuuuuuuuaaacuuccuaaagcuccaguuuaauaauguccuuuuggccagacauccuuucccuugaaauuaucauguggaaagagcacugggacucaggagaauaagaaucuagaauuggcuuuucuguuaacuaguuaagugccuauugucaagccauguaacuucccaggcaucuuuuuccucaucuguaaaugugcguugaauuggagcagaugaacucuaauaggaguucucccaacucuaaaauuacaacauuauggguccuguuuuagguuuaacuucauuugguucucagcagaaaugaauuauuuccuuucauuuuuauauaaaauguacuuuuccuaaaauaaauauauaguaauaucuaugcauguacauaucuguguguauauuuaugaacuacagagaaggucacaauaauugggaaacuuuuauggauuacuucaaaaguaguggauaauaugugcuuuacacuaguaaaauaguuuggaauucuguauuuccuuagagaacugcuuuaugauaaauuaacauuuuacaaagagggaaccuuuuauuagucugauuacugucaguuggaacuucaaaagugucaguuugcuauuaccuccuuugugaguguagaauuaaacaauucaaaucuuucagugauuuugaaaguauaccaagacaccuuucagcggguaaaaacuuuugagacugugagaguaugaaugaauuuaauuaaggcagucgacaccagguuuuuaauuaaauuacccuaacucgggcaaagucauggagccguaguucaaguuauggacuuuuuuuauacugauucguuuugcuuaaaucuuacguaaugguucagacaguugaaguuauucaaggauaaauuuagguaaaagaaaaaugagggcugcuuuagaauuuuuauuguuuuaacucuugaggaauuuuauuguaauucuuuuucuccuuuugugguuuuagugccuuuuaaaaacuaaagcaugguuauuuuuauguuuuuuaucaauuuaaauauuaauaauggauauuacuuauacuuauauugcagcaauuguggugaauccgagauaagcccaacauuuuaauuuguugagaugcaacaaguauaaaaugaguccuggauuuggagucagaaaacuugggguugagucacaguguucauuaguagguacuuuacauuucuguagcaguagcaguagugguaguacuaguaaugugagcuaaauguuuguaaaauaauaugaaucguuugggucuccuuuucaggauagaugaccaugaaguuuuuugugguuaaaauacugcucucuauuuauucugugacaguaguauuugcauaacucucuggcaaagccugacuuccacuauuagaauuuguuaauguugccaauguuacuuuuaccauuuuucuccccuagaauaacaacaaucuugaagccuguugccgagcccuuucccaggagaguagcaaauacuuauauauggaauaccauaguccagaugacaauaggaugaauagaaaucgccuuuuacauauuaaccuggguauccauucuccuaguagcuaucacccaggagauggagcccaacuuaaugguggucgaacacugguacauagcucaagugauggacauauugauccucagcaugcagcagguaaacagcugauauguuuaguucaagaaccacacucagcuccagcuguuguugcugcuacucccaacuacaauccauuuuuuaugaacgaacagaacagaagugcagcuacuccuccuucacaaccaccucaacagccaucuuccaugcaaacaggaaugaauccgucugcuaugcaagggccuucaccaccaccgccaccuccuucauacaugcacauaccucgguauaguacaaauccaauuacuguuacaguaucccagaaccucccuucuggacagacuguaccaagagcuuuacaaauucuuccacaaauuccaagcaaucucuaugggucuccugguucuauuuauauuagacagacaucucagaguucaucaggaagacaaacuccucagaguacgccguggcaguccucaccacagggcccagugccucacuauagccagcguccuuuaccuguuuauccacaccaacagaacuaucagccuucucaguauucucccaaacagcagcagaucccucagucugcuuaccauucaccaccuccuucucaauguccuucacccuucagcucuccacagcaucaagugcaaccuucccaguugggccacaucuuuaugccaccuaguccuucaacuacuccaccccauccauaucaacaaggaccuccuagcuaucagaaacagggaagccauucaguagccuaucuuccauacacagcaucuaguuuauccaaagguuccaugaagaagauagaaauuacaguugaaccuucucaaagaccugggacagcaauuaauaggaguccuucacccaucaguaaucaaccaucuccauggaaucaacacucacuguacacagccaccacgccaccuucaaguucuccuucaagagggauaucuagucaaccaaaaccuccauuuaguguuaauccuguguauauuacauauacacagccaacuggaccuucuuguacuccaucaccaucuccucgagugauaccaaacccaacuacaguuuuuaaaauuaccguaggccgagcaacgacugaaaaucuuuuaaauuuaguggaccaagaagagcgcucugcagcaccagaaccuauucagcccauuucagugauaccaggcucugggggagaaaagggaagccauaaauaucagagaaguucuaguucuggaucagaugacuaugccuacacacaagguaaauuuuaacccuuuuaugaaauuuaauuucuguggugaggcagcagucucccauucaaauauauuagcuguuuaguuuuaauuaaauguuuaguauuaaauguugggcaguagcauugcuauuaagaauaaaguuaguggccgggugcgguggcucacgccuguaaucccagcacuuugggaggcugaggcagguggaucaccugaggucaggaguuugagaccagccuggccaacauggagaaaccccaccucugcuaaaaauacaaaacuuagcugggugugguggcgcaugccugcaaucccagcuacucgggaggcuaaggcaggagaauagcuugaauccaggaggcagagguugcagugagcugagaucacgccacugcacuccagccugggcaacagagggagacuguguccaaaacaaacaaacaaaaagaauaaaguuagugcuucagagucauguauagacuuuguuuuaaaacaugaaaauguaggccuaauaaggcuuaguuuagaaagaauauucauagagcgaaaaauacaagugacauggaaauugucaaaaguacaaacuacagaguaggaaaaaagagauucauggagaauggacuaaaguucaucaaacgaaagaauuugaaucuuuucuaaagaggauggcccagagggcauaaugauauuuacauauaaauaauauauaagaaguggaauuauuggauuagcuaaaaaguaauaauauauaaaaguggaauuacuggauuagcuaauaguagauuauuggauuagcuaauaguagaccuaaauuagauacagaguuuuuaaaaagucuauucagauuguuucaagauaaccggagaauuuaguuuucuuucaguauauaagaagggaaguaauuauucaguaugccugguagucagccuguucaaaacacacauaaguauaaagagaaucuuaggacaauagaacaagagggauguucaggugaugucacuuugguugcauucagagggcuaaauugaagcagauguggaggcagcauagcauuagaaagacaugagaguaaaugccaacccccaaguugaaugagucuuuuauacauuagcagugcauaucgaaauuuuccagucgcuuguucaauguuguucucugcaaugacauuaucuauaaugcuguagccuugcuguuacaucaacgagcaaggauggagagguuagcaaagcaacugaaacuugagaaagaggagcuagagcgguugaagucugaaguuaaugguauggagcaugaccugaugcagagacggcucagaagagucagcugcaccacugcgaucccuacgguaagugaucuguuaggauguguuaauaggagggucgggauauuggcugucaggucauuuauuuuucuuuaggcuuuauuccuggcagaguuccgguuuuuuguuguuguuguuauuguugcuuuuuuuaaaaacaacagaugaaggacuuuugccuuuaguaguucucaucaaaauaauucauguaugcagauuccauaggcucaucaguauuuucaaacacugacgauuauaaucaagguauagcaucucauuuauuuguaaauugcugucaaaauagaaaugaaaagugcacccugaccaaaaauuugaugaauuuauucuuuguguauucauuuauucuucuaagcauaugauauauauauuuuuuaaacauuuaaaauuaauuauuuuuguaaguacauuaauucagaugaguuagaucaauaugaauuuuggagaaguguuaacuguagaauauuuuaaggcagagcaguuuuguuaaguauaaauaauuguagaaacugagauaacaguauugauugauagcagucuuaaagggaacugcucuaaugaaaagauucagauaauauaguuuuaacauguugguuaauauauaugaguucuaacgaucccaaacaacugagaauuuugaagcauguuuaaaaucuugugacuucacaagcgaugauccaaccuaucauuucaccuuucaacauuuagcaguuuugugcguauaguuuaugcaaugugguacuaugcuagaugcuuaguacauaccuaccagugggaaaaauagauacaucaacagauaauuauaauacagugugguaagugcuguauauguucacggguaaugagagaauuuauacaucaacucguuucugugcagauucauugcacuucucugcucuuacauuaauccuccugcuggaaugcccuucuaaaaagcucugcacguguaaaucuugucuguucuguucuucaaggcucaacuuaaccucuacuuuuuccaugaagccuuuccucauuuuccuacccucucuaagcuaagggcaaucucugaguuuacagguuuagagaagugggcauaugucaggccucuugcagucagcaugucugcagccacucccucauagagaaguuucuacuugagguucuuggcuucaaaggggaucugugaauucucugaaauuauaugcagaguuucauaaguguguuuaauaugggaagugggucuauagcuuucaucagauuuucauaagauuauuacauuggaggaaaaaaggagugaggaaccauugccuuaaacaauaggcagagagaaaaggggaaggcauuuuagaagagaaaagaacaauaagguaaugaaggcuugaagucaagauggagagugacuuuuaggagacaguaacuacaguucccuggcauaagcaugagauuucugaagaguuaacagagguuaacuggggcuuugaccuugaaugcuaggucaaggugcuugaacuuuauucuccugguaacagggaacaagugggaguuuuugagagagagagucuugagaaauuggcauauucacuaauuuagugacuuuuuuguaauaucguguauagucaauauuagaagugaggaggaagauuuuaacuacuuaaagcacuggaaaauaacaaaguuaucuuuaauggaaaggugauguuaauauaaaucaaauuucugccucauuuucuccauuugaaaucuuaauugaauccucugauugcggaagauauugaaggacauaacccauaugggaauccacccguaguaguuggguacuuuggaaaccuuuagguaccuguagagcauaaacaaauuuucuuagcauaguaauuuucuuuaaucauauacauuuuauuuagcaacuacuugcugugugauaaucccugcuaaauaaaauauugguuuuuuuuuguuuuucauuggaaguggagaacugucuaauguagcauagguuaguacuaaaaaaaaaaaaaagaaaaaagccccagauuuuauaucagagcucuuauugauguaucuuuuuucuuucuuucuuuuuuuuuuuuugagauggagagucucacccugucacccaggcuggagugcaauggcgugaucucggcucacggcaaccuccgccucccagguucaagcgagucuccugccucagccucccgaguagcugcgauuacaggagugugccaccacgccuggcuaauuuuuuguaucuuuaguagagacgggguuucaccauguuggccaggcuagucucgaacuccugaccuugugaucugcccgccucggccucccaaagugcugggauuccaggcaugagccaccgcaccuggcccccgaucuaucuucuugagaaaggaaaaagagaaguuggugaaacugcugcccugggcuguaauuuaguuuuaacuuuuauuauaauuucaaagauacauaaaauaguauaaugaacccccauguagccaucccccagauugagaaauugguaguucaugugggugcuaacaucugagagauaagacauuuaaguguuucccauguguuuccauugccaagccuaguguaaaauggaggacaauuguaguacacagcagagggacaguacguggugguugagaccgugaguaggcucucaagucaggugccaguuugaauccuacuucuauuugucacucauguauccuuggauaaguaacuuucucuaugcuuguuuucuuaucuauaaaaugugugguauaguacucaucuuacgggauuuuucuuaggauuauaugagguaauauaugugaagcaguuuacacaaugcccaacaaauaguaaguguucuuauaaaauauguguugguugcaaaauacuagacaacuuugcuugagguuuagacacauaaaucugaagcauuuuauacuuugacuuccuuugaacuugaacauauauaagauuauacuuauguaggaaauuaaucaagaaauaaaucauuuagucagauuucccauuuugcucaucaaggcucauuugaggaaccaugauauaguggaaagagagcccacauaggcuugggagucagaauugcucaggcgcucacuggcuauaucugauuucucugcaucugauuuucccuagcuguaaaagagaauuauagcaaguacauuauaauaauugucaagauaaagagacaguguauguaauaagccuggcaugaaguaugugaacaguagauggcuagccuuaucauugucccacuuguguauaggaauacccaguggagaauugacauuuuugcuacuaaagcacacauugcuaccuucaaguuuucaaacaaacugcuuaucaggcaguauauacaaaauugauuagaaaguugcuugccuaaugauacugcagugcacauuugugaccagcuaugugggggagggagguuguagaaacuuagaauaacagugaaauaaucuuuuucuaaggagagcagaagugcaagauauaagaugcaugauggugucauuucccuuaaucuguuauuugcaaagcauuauauuaaaugcugacaaagaugucaucucuuagaucuguaugugaaaugagauagguauaucugugagucuauauguauuugugugagagagaaaauauaaggcaguaaaucagaaguguugaccagcuaaaugguaacaauauaaguacuuucagaguuuugagauagaaauguuagcuuuuuaccuauagaguuuauagauggaacaguuucaaggaggagggggaaauuuaaguuuuaccuugaaggauaagauuuuaauaugcagaaagcugccaauuacccccucccucaaguuauucccccccauucuuccuguucuaauuacauuuuuggacuaucccacagcuuugagucccagaggcauaacugagucccagccaccaaagaacaucaguggucuuugacgcuggucuaugccagcuuuggaaaaaaagcuuaccauuuuuuauuuugaaauguuggcuacaaacauccuguuuucuuacagacaacuuugaauuauacauacccaauuuugaaauuccuccugcacgaaaacuacuuuugacaaauggcaguaauuucucagaaacugcuuuuuuuccccccucaguuuaaucagaagccauaugaaaaaggacauaggaaucuuacugauaaacccuuaguaagaucgagugguucuacuaucuuuggaaaugagccuguugaugagaguauguuuguuguuucugagacagagucucacucuguugcucaggcuggagugcaguggugcaaucugggcucacugcaaccuccaccuccccaguucaagcaauucucgugccucagccucucgaguagcugggacuacaggcacgcaccaccacgcccagcuaauuuuuguauuuuaaauagagacgguuuugccauguuggccaggcugaucucaaacuccugaccucaagugauccaccugccuuggccccccaaagugccgggauuacaggagugagccacugcacccggccugaugaaaguauguuuucguuacgagcaacugugugguggcugcuucacuguuuugggccacuguggcugaaacaucucucuugcccccaacucccuaaaaccuauggaauagauaauccuuuucaggugcuugacuuucccgacagguucuuccauguguuccuaggaagauagcaucacuguuuggagcccuuacauuaucuuuaauuuaaauguucaaguauauauuuuaaacuauuugaauauugcuugauaggcaaggcgcaaagcauuuuacacauuaaugucacauaguuuuagcccauaggaauuagaaaaggcaguccauaauaaauauuucuaaacgacuuuuuuuguuccucuagcauucuguggaauuguagcuauucugccuuuuaucacuuauuuuaaacuuugauaccugcuuauuuaaugggcauucucaguuacucugauaauagcuccuaacaccauaugaauuaagauauccuuucugcucauuuuucuuucacuggcauauuaacauauuuagcguuuagcaaaguacauguuuuuaacagaauaggauuuuguucugucuuccuauaguagcagauauuuaauuuuucacuuuauauguuauaguuaaaaucacccuaguauuuaauaccugggccgugcugaaagcuucaguauuucagccucuagauucuaaacuuugacuuuuuuacuauacauauauauguauauuuauauauauacauauauauaaaaauaaagaaauuaaggaugacaugggaaguaaaggcuuccaaaaagcuuuacugaauagaagauuaggacucucuucacauuucagugccucauaugugccccugaaaggccuaaggagugggcuggccugaagagguagaggcagaagaaaacaaaguuggggaacaaauggaauucauuuguuucugaaguuuucaugugcuagaguaacugccuccuucaaucuagaaaaaauaugacaaaaauauuuauauaugaauuuauauaggagucuuuuauauaaauccuggcucuaccaauuacuagcuuuauaacuuuaagaaaauuauauaaccucucugugccucaguuuccucaucuauaaacugggcacaauauuaguaccuaccuuaaaggauuguuaagaagaaggaaugagagaauucugguaaacaccguacuguuguaauuuuuaccaggcuggacaagacuaagaucauggacaugacucguuuaacagguugauucuuacaguuucccuuaccaugaaaacauagacacaaaauauucucagugcucuaugauuaaaacgguaguaucuuguaugguagaacacaguccacuacugcagcucgccacuuuauaugcagauuuuguuuauauguggccauuuugauguccccauuuuacccgacuauuccuuuaaaaacauauacauaggacuucuuaaacaugcccucuuauggacuaaggccguauucuugguaauacccaaucauuacaauuaacaugaaacgcaguucuuaaauguugggcuugauaaugacuuucccacaauugcuauuuuggguccuuucuuacuagccugaggaaaugacaagauugagaagcaugaacagacaacuccagauaaauguugacuguacacugaaagaaguugaccuccuucaaucuagagguauagacuugauuauuugguaaaccauaaguaauagugugguauuuuaagcugcuuaaauagcaauaacuuugguuuuguagauuuaagagacaguuuuuauccguaagauuacaauccugggaaagagaucccccugucccauggucauggaucagauuuggggaugaaaaaauaguuuuacuucggcaguuucaucaaguucuuaucauuuagacuguucuauguuguuacuuugcauuuauccucuuuuugucauuuacugugaauauuuuauaaauugauggguuuuaauucuaaaacuuaguagaguucauauuaugugauagacaucuaaaauaucuguaaaaagggaucccaaaucagaguaucagauuucucaguuuuaaaauaaacucuauauauguuauuuuucauguuauguuaugugaaaacauucaacuauaaucauaguuuuaguuuuuuggauuuuuuuacagaaguauacuacagcagaagcucucuuaaacuuucauuuacccaacucaccagauuagagauggucuucauuuucuguggaaaauauacugacugauguccacagcugcugcauacuuuugacuaguaggcugcauucugguaggcccaugaauauugcucccaucgguugaauugucugcuuaccaagaguugauucuguccccaaaccuguuuaugccaguuauuguauuucugcaauuuaauguuucauaaacugacaugaaggagaaagccgcucuuucuaugaaagccaaaggcaaaucacucaaaaaauagggauugugaauuagauaugggugaaaacaacugaaaaaagucuaaaaggauucuguacucaaauugcauuauaaguguucuuaauaucuuucuugcuccauucuaaagcaaucaaaauuauagaugaggguucagcaaacuagggccuguugccuguuucugugaauaaaaguuuuaguggagcgauagccaugcccauuuguuuacauauugccuaugguugccuuugugcuucaacagcacaguugacuacuugcaacagagacucuaucacagguccacaaagucuaaaauauuaucuggcccuugacagaaaagguuugccaaccucugcuguaggucaucaugggugugguuuauguaagaaauacaauauggaaccccagccaacagacacguaaaaauuaggucuuuaucuaacuaacuuuaaaauauagcuauauacaaguguuuuguuacguuaaaguugacguguaauuuuucuuaauucuguguauuaaucagcuuuccugccccccaucccccacacuuaacuuuucuugauuauggcagcuaagacuuucuacaguguuuuaagaguauauaauaaaauaucucacugccauuuuuaggcaagauuaaacaaacaguaggcugggcacaauggcucaugccuguauucccagcaguuugggaggccaaggugagaggaucacuugagccuaagaguuagagaccagccugggcaacauagggagaccccaucccuacaaauaauuuuuuaaaaauuagcuaggugugguggugugugccugugaucccagcuacgugggaggcuaaggcaggaggaucaccugagcccaggaggucaaggcugcagugagccgugaucacaccgcugcacucuagccuaggcaacagaaggagacucggucuaaaaaacaaagagcgagagauuaaagauuaguggcaggugaacccaaaagacacggcauuaucugaacaacagacagaagcaaauuugaaugugagaauugagcaaucuagucagguacccuuaaagucauuuucagaagccuagucacucuauagcccacuaacuugaagcaaucaaagaauuacuaugcaugauguagggguuacauaaacuauugcuacuauauuuuagaagauugcaucaauuucuuuuacuuguguggucuuuggagcaaaacaaacaguaaaacauuugguuaggauacuuauaguaagccuuuugugaucuagaaauuagaacaugagcuguaacaaguaauugaagaaauacauaugcagcuucuuaaagcauaaaaagauucaauuaauacaucaaauagcacuguggcuuuuaugagcuaucacagcaauuauuuucagaaaauuaucuuaaaacagcauauucaaguggauaaaacauuugugaaagggccugcaagggaaaccacuauuaagguuuuauaagcaaagagcuguguuuuuugucugcauuggacaaugagcucuuugggauacuuaggcauuucuaaaucucuuuucauaacgaaucuaaauguauccauuuuauacuaaauucuacucuuccacacugcagaaaacuuuuuauacugaguuuccaaucuaaacuuuuaagcuagggaaggaaucuaaaccuuuuucgguggugacggggggaggcaggggaauaagcauuuagaauagaugcaaaucagugcaugacuugaugaaaaccagcuuuuuugugauuuuugguaaggaaaacuuguugggaaaaaaaaaaguagaucuggaaaugaagagauuuaauauauuuaaacuaucaguauuaguaccauacagcaucuucuauaaauaaguauggcuacaguuaacuguaaucguuuagaacaagcagagcacagugauagguucacagaagugaaggcaggacccaaaaccaaccuuggaggagacacagcaggagauguggcugaaauacagacacuagaccagggaaugaacauuugaagacagacaggugaaaauuuuguggcaagacaaaauucucagguauuguucuaucuauucugaaauuggcaccuuuuaucauugauaaaucuguaggaaacauuuaacacuuaguguaagauucuccuuuucuugaaaauaagaauacauaaacugcugauguuauuucacauuuauugagguugcuuaguagucucaaaauauaacuugauuaauccuuguaaauguuuauauuuggcuuuuucuguaguucaauuuauaaugaauuuuuaagguaaauuaugauaaauaugaaaguaagcuuucauuauuuaaguguucuuucucacaguuuguucauuaaaaaucaaaacaagcagaaagagaaaacaguucaaccauccuuucauuucucuucuucauuuaucuccccaaaugccccacaugccuaauccugccuaaggagacuagccuuacaauuagaaaaauauuccuuuaaguguaauacauuguagacauacaucuguguagugguuuucuugggucuuuucucacagcgaugaaaacacaauuucauugggaggacagaauuauguaaugaauuuugaaauccuggaaaacauuuuucccuucuuauguguuuuauuuacauauuuucuuuaaaaaaaaaucaaauaacaggaaaaaagaguucuuaaaugccugaugaauuuacuuucuuuauaggaaacuuugauccaaaagccaugaauaauuuuuaugacaacauagaaccuggcccaguuguaccacccaagccaucuaaaaaaggugaguaugaaaaaugucacaaauacgauagaaauaaaugucaaaauaauuugggauuucacauuuaucugaagaaauuuccacuagagguuaaguuguucagcauaaaguuaccauauuuuuauuauuuuuauuuuuuugagacagggucucauucugcugccccagcuagagugcaguggugugaucauggcucauugcagccucgaccuucugggcuccagcgaucuuucugccucagccucccaaguagcugguguguggcaugguaggcacacaccaccaugcccagcuaauuuuuuuuuauuuuuuguagagaugggaucucaccauguugcucacuggucucaacaaauuuaccauauugguguuauaauguggcaauaaugaaauguccccaaacuuuaguuuuuaaaaaguacugaaauuaguaacucuuagaauuacugucagagguaauuugauggacuauauaauuuuuuacaaacagaagcugaaacacuauauuacauaguuaacauuauaaauuuacuuagcauuguaaaaacuauaacccuaaaagauaauucucauaaaauaaugaggauuuuaaaggucuaaugugagaauagaaaguuagauuugcaauagacuuaagauuauuuuucagacaacaaaagaauacuuguguacucaaaaggggagcauagcaauugguagcgacuagguauuuucccaucaagaacaaaagaaauccuauauaaccaagguuugaaggaaucauuuuuggauaguuguuacauaaaaaugauuuaaaauuaaagauaucaaacauguucuuauuuuuauguagcaaauguuuaauuggcauuucuguaucuuaaaaaauuaauuuuaauugaauuuacacgugcagucauuuaagccagacggauggaucacaugaggccaggaguucgagacuagccuggccaacauggcaaaaccccgucucuacuaaaaauacaaaaauuagccaggccugauggcgcgcgccuguaaucccagcuacucagguggcuaaggcaugagaaucacuugaacccaggagguggagguugcagugagccgagaucgcgccacuguacuccagccuaggcgacagagacccugucauuuauucauucauucauaaauaaguagucauugaauguagauuaacuuucugccucauucuuaauauuuuaauccuuuuugccuuaagcaacucaagguagauugaucaugaagacacauagaacaguggagaaugccuuauuuuugaaaaaaauuaccagagaguauaacauuuaacaucucaucagacuuaauuaaaagaauguauaaauucuaucuaaauaauacuaccugaccuaauuacuuaaauuuugguugaauaguuuucuacguauauuaagcucauuacagaguguuuuuuuuuuuauuuauaaguugcaacauaguaucuguucuucuuuuuauuguuuaauauuaccaucgauguuucaucugaucuacauuuaaaaacagccuauugauuucuuuuuuuuuuuugagauggagacucucucugucacccaggcuggaaugcaguggcacuaucucagcucacugcaaccuccaccucccagguucaagugauucuccugucucagccucccaaguagcugggauuacccaccaccaugcccggcuaauuuuuguauuuuuaguagagacggcguuucaccaugguggcgaggcuggucuugaacucuugaccucaagugacucagccucccaaagugcugggauuacaggcaugagcuaccgcaccuggccaaaaaauagucuauugauuucuaaaaauggcacaaagaaucaucuuaguggaugacugccgagugccagauuuggcacuuuggcagcaucauaugcaguuucuugccgaaagucacugagguguauaguuagcauugaucaauuuagucuuuuggguucauaaaaucagucuuuaaacucgauuuugccugaaugucuacuaaagaaguaucgccagacaaacuuuaguucauugauucaaagagcugucuuagagcaauugcccugucuaagggagugcauuggaaaguuuuuacccuggaaacaggaccaaguugauuagaaaugguggaaaacacgugcaucaugagccaucccucagcauaaacucccuauaggugugguguauuagucuguuuucacgcugcugauaaagacauacccaagacugggcgggccucacaaucaucacagaaggcaaggaggagcaggucacaucuuaaagagagcuugugcaggaaaacucucccuuauaauaaccaucagaucucgugagacuuacuaucacaagaccugcccccaugauucaauuaccucccaccaggccccucccacaauaugugggaauucaagaugagauuugggugggaacacagacaaaccauaucaugcggucugagggacccaccauaaauaacaaagacacugccguuacucaggaaauuucaagguuuugagccagggacaaagccagaccucuguuugggcaaggcaaaauucuuucccaugcgauaguuaaagcagugcuuagaaggaaauuuauagcuuuaaaugcucauguaagacaggaauaucuaaaauucuaccuuaagaaacaagacaagaacaaaguaaaaacaaaguagaagaaaggaaagucaaugagauagaaaacagaaaaaguuaacaaagcaaguuugaucuuugaaaagauaaacaaaaucaauaaacuucaagguagacugaucuguaaaaaaagagaacacaaauuaccacaaucaaaagugaaagauggguuaucuauuacaaugauaaugauaauaagggaaagugauggacaucuuuaugcaguaagcuugacaccuuagauaaaguggacagauuuccugaacaauauaaucuacccaaacugaaaacaagacaaaacaguaaauauuaguaaguguguguuuuuuuaauauauauuauauauauauauauauauauauauauauaauauauauauguauaaagaaacugaauccacuaucaaaauuuucccccacaaagaaaacuccagauccagauagauucacugguggguaaauuccaccaaauauuuaagaaaguaaaaauaccaaucuuaaacucuuugagaaaauacaggagggaacgcuucccguauuucuuuuuuguuuuuucauuucauuuccuuuucauguuacugagaggaaguugcggagauuuuccauauaccuccugccccauuaucagcauccuacaccagagugguacguuuguaacaauugaugaacuuauauugagaccucauaaucacucagaguccauaguuuacauuaggguucacuguugguguuguaccccaucuuuuuuuauggcgcuagcagaacucugauucuaaaaccugguaaagacauuauguaucugccccucacaaaaagaaaacaaaauuucagaucaauaaacuucaugaacauagaaacaaaaaauccauaauucuguuuucuaucucauugacuuauagucacuauauaaaaaaagauaauacauuaugaccaaguugaguuuagcuuaggaauauaaucuugguauaggcauuaaaaaaccaaccaguguaauuuaccauauuaaacaaagggaggaaaagcaugugaucguuucaccagauacaggaaaaacauuugacaaaauucaacagccauuccugacagacaaaaacuuuaaacaaauuaagaauagaaaagaacucuuucagucucauaaagggcaucuuucaaaaaccuuuagcugccauuauuacugaauaaugcaauucugaacuuaccaacauugggaacaaggcaaggaugucuauucucaccaccuuuauucaacguuguaccuggaguuccuagcccaugcaguaagagagaaaaaaaaaaagcauaaauauuggaaaagaagaaauaaaacuauauauacuacagaugacauaauuauuuuuaaaauccuaaggauacuggaaaacaacuaacuauuagaacuaauaagugaauuuaacaaggccucaggaugcaaagucaauauauaaacauguuuuuacaauaucaguaaacacuuggaaaauaaaauucaagagaauuucauuuacaauaccaucaaaaaccauguaacacuuaggaauaaauuuauccagagauguauacauugaaaacuauaaaacauugucaaaagauauuuaagaagaccuaaguaaauggagugauauaccauguucauuaacugacugaaucaauauuuuugagauaccuguucuuacaagguugauauauagauacaguguaauaccaauuauaaccccauuaggugguagugcauuuuuaauuaacaaacugauuauaaaauucauauggaaauacagaaaguccuagaacauccaaaacaaucuugaaaaagagcauccagaagucuuagacuggcucagugcaauggcucacaccuguaaaccuagcauuuugggagaccaaggcaggaggaucacuugagcucaggaguucgagacuagccugggcaacauagaccucaucuacaaaaaaaaauuuaaaaauuagccagacaugguguaauuaaaaguguaugaaaaguguguuaguguagagcuaauuuaaaaauagcucauugcagccucaccuauagucccagcuauucugguggcugaggcgguaggauugcuggagcccaggagguugaggcugcagugagccgugauugcagcacuauacuccagccugggugacaggcugucuccaaaaaggaaaaaaaagucuuagacuaaccaacuucaggacuuacuauaaagcuacaauaaccacagugugauauugguauaggaauaaacaaauagaucacuggaacagaauagggagcccagguuuauaccccccagucacacugucauuugauauuugacaaaagcaccaaagcaaccaauagacaaaggaacauuuuuuucaacaggcagagcuggaagaacuggauauccauguggaagaaacacacagucugaucucuaccuaccucacaucauacacaaaaauuugagauagcucauacaccuaaguauaaaaguuaaacuauaaagcuuccagaacagaauaucuuugcaauuuagguauaaaaguuuuuggacaggucacaggaagcaauaaaaagaaaaacaauugauaaauuagucuucauuaaaguuuuacacuucugcucaucaagugacacuauuaagaaaaugaaaaggcaaaccacagaccaggagaaaauauuuguaaaauauguaucugaugaaggaugguauccagaguauauaaagaauuucuacaacacaguaauaaaaagacaacucaauaaaaaaggguaaaacacuugaacagacacuugacaaaggaauauauauaugaaagaccaugaaaaaagaaauaucaaggaauuuuccugggguaaucagauggaucugcugccaggauccuguauagucagauugugguuuucuagcaauggugauguucguguuaauaugucauucugaggccagccuuguggcucaugcuuauaaucucagcacuuugggaggccugggagggagggaggaucacuugaggucuggaguuugagaccagccuguccaacagggugaaacuccgugucuacuaaagauaccaaaauuagcugggcaugguggcguggaccuguaauccuagcuacuugggaggcugcggcagaagaaucacuugaaccugggagguggagguugcagugagccgagaucgcaccacugcacuccaacgugggugacagagcaagaugcugucuccaaaaaaaaaaaaaaaaaaaaaaaagaugucauuuugccuucugucuuugggaccaacaccauguauucgaggugggagguuccuguuugguauccuccuuggcugggcauugaauaaggcuugcauuaauauuccaugauguggucccauuaauaucaagcuucaucuagcgcucuacaaguaccuuuacacuaaaaagacuuuguuuguuuguuuuuguuuugagacagggucccgcucugucgcccaggcuggagugcaguggcaugaucauagcucauugcagccucgaccucccaggcucaagccauccuccugccucagccaccugaguagcugggacuacagacgcacaccaccacgcccggcuaauuuguguauuuuuuguggagacaggguuucgccauguugcccgggcuggucucaaacuccugggcugaagcgauccugcugccuuggccucccaaagugcugcgauuacaggcauaagucacuguuccuggucugaaagacucuuuucuaugacucauuuaacucaaacacaauuugcaaaaacugauagucccuuagaguuaguuauaaugggauuucgguuaaaauuucuuaaauauguauugaaugcucaaugcguagcucaauuauguagauagaugcuugcuguuacacagggaaaacaugacuccuaccccaagcaguuuaauauucuacauauguacacuucuaauaaaaaagagacuaggaagccaucucagucaucuucacuauaaaugaauuucuauuuuagaaauuuaguaguuguaauucuauaauaauauauauuauuggugaaaguauaaaugguucuauuauaugccaaauugucuuuaacccguuuuuuaucuucuucuguuaaaacuuagaaacaguagaacuugauuaaauucuauaauuuuuugguaagccuuucaucacaaauuuauaaaagcuauucaguuuucuccauaaaaucaaguuuguuuuccauuaagcacuugcagauucucauauuguauuugaaacuaaaucggcguuuucuaaaaguacauauaguuuagcacagauuggccugcuauugcaggccacucaaauacaaaaagaaaaaagauaaaccaguaaaacacaaauuacugguagaauagguuuauugguucgaauaaauaaaugucuuggaguuauuacagauauauaccagaaauccaaguguaauuaauauaguuuaucugaauucuaagugugauaauuaaagaaugugagggagacagaaggaaagagagagaaagagacagagaaacaaaccuuuuuuggauuggacuuuguaguuaagcaauacaguguguacgugcucuucagcgggcuuagaaugucucccaacccuuauuaguaacucauaacagugguagauuggacuuuguaguuaaacaauacaguguguaugugugcucuucagugggcuuagacagcuuccccaaccuucaucaguaagcaagcaagcacacugaccuuggugucccacgaucugagcacugguccuggucaucuuggccaccugaccuuguucaaacucaaucugagcaccauagagggacaauccagccaaauacuccaaagguuguaagaguuagugagauaagguaugugacucgacagaaguacuuugcaaaucuaagaaacagaacuuuaccuuauucuuuggagccuuaaggagacauucacucugcuuuuguuuacucagacaauggaguauuuaaguaccugagcaccaugcuuuggauucuggagcagugauuuccaaagaugaguuguacugugggcucagaauucauuagaaaaugcaagaucuuucuuugguuccuaagggcaaauaauauaaaggcugccauuuuucauuuuuaauccaaaggguugcuuacuaauaaacuauaaauuuauagaaacaauuuucuagcaagauauuaggaugccuacaguucuugucuguguugcaaagugucugcugggcuucugcacacauagguaauuggaauucaggaaaugauuugggagcacgugguugucaguauauacuauuauaucgaguugguucugauuuuucaaguacugcuauuuuuaaaaaauccaccagacacaguggcuccugccuguaauaccaacacuuugggaggcugaggugggaggaucacuugaggccaggaguuugagaccagccugggcaacauagcgagagacccugucucuacaaaaaauaaaauuuaaaaaauuagcugggcgugguaguggcaugcaccuguagucuuggauacuugggaggcugaggcaggaggaucacuugagcccaggagaucaaggcugcagugagccauuauugugccacuguacuccagccuggacagcagaacaagacccugucucaaaaaaaacaaaaacaaaacaaaaaaaauccugucauuuucaucacauuucaucauuguaauagccuuacuguauggauagugcccauaauuuuaaaauaauuuuuaaauaauuauugcuuaaucagauaauugcuaaaguaaaauuucccaaauuuugcuuucacaucgacauuuauuugcuaucacugaguuuguaccccuaauccauuaaaaaguagaaaacagugaaauagggcauuuguucuaaguaaugggagaagauguaacuggagaagauggaaaaaaguuguaagaaccacugcucuguauagguuguaaaagcaguauuaaauauggugccugcccuugcuaaagguaacaugaaguaauagguaggguaaaugcacucagcuguguggguugcuugaaagaucuugugagccuguucacucuugcaguugaaagacuggaucacuucuuucuggcguuguuuauuuuuaugcagacuccucagaccccugcacaauugagagaaaagcccgaagaauuagcgugaccuccaaaguacaggcagacauccaugacacccaggcagcagcugcagaugguuuguacuuguguguccagaguuugugcagaauguccaaagacacauguuaauccauguagaauuauaaguaaaaccauaccuuuauuuuuugcuuuaaaaacauuaccgaguuucuaaggcugugcuguccaguagaaauauaaugcaagccacauauacaauuuaaaauuuucuaguagcaaagaugaaauuaauuuuuuuuuuuuuuuuuuuuuuugagacggagucucgcucuuuaggccaggcuggagugcaguggcgcuaucccggcucacugcaagcuccgccuccuggguucacaccauucuccugccucagccuccuguguagcugggacuacaggugccugccaccacgcccggcuaauuuuuuguguuuuuaguagagacgggguuucacuguguuagccaggaugguaucgaucuccugaccucgugauccacccgccucagccucccaaagugcugggauuacaggcgugagccaccgugccuggccaaauuuuaauauauuuuuauauaauucaguauauacaaaauauuauuucaauaugaaaucaauauaaaauuaucagugagauguuuuacauccuuuuuauacuaagucuuugaaaugugguguauauuuuacacuuauagcaacauugaguuuuuagagcaugucuauuaaaaaccagcaacaguaagauacgaauuuuuuuuuaaguguuacguuuuugggcauauuguucuuuuaaaagguaaagacaaaagagguccuuuucugaaaauggcauaguaggccgggugcgguggcucacaccuguaaucccagcacuuugggaggccgaggcaggcggaucacgaggucaggagaucgaaccauccuggcuaacacggugaaacccugucucuacuaaaaacacaaaaaauuagccgggugcgguggcaggcgccuguagucccagcuacacaggaggcugaggcaggagaauggcgugaacccaggaggcggagcuugcagugagccgagaucacgccacugcacuccagccugggcaacagagcaagacuccgucucaaaaaaaaaaaaaaagaaagaaagaaaauggcauaguaaacauuuuuccuccaaccgaaggcuuuauuccuccauaugagacaaaaaagaaaacuguauuaaaucuacauguuuuggagucaugagccaaaagacacaaggugggugauaauggcaguuaaaaagcaauaguugaagcaagagaaacaagcccaucuccuauuuauagucauaggaagcagcugaaaaacccaguaauuuucuguuauauccuaaggcuaagaucaccuuccuguuugaggcugagcauuaucauaccuugggguaagguucagggucuaaaauucaguucuccuuaucucuuggggaauguuauaacauuugucauauaaggcaaauugauaaacuagaagucagcuuguuaauuuccaguggaagauaugccuagcccaaaauaguaacugacaaagcuucccuagaucuguuucuuuuguuaccuauuuaaaaagguguugcuuaccucagaucuuaaucucauuuccaguuaccccagauuccagggugaauuccaucuggagaucuuuagucuccuauuuauugaccucagucucaauagagaccuaaaagacagaaauuacagguuaacucuagaugcaaagagcuuuuuugagcacaaagccagagggaaugaggaccuaagaggaauguaaguuuggauaucuuuuucaaauccuggggaccaacauaagguugccagguaugggcauuuuuaaaaacugauauaugaaggauuuuuaaugccaaaaauguaggaaagaauaugagaauaaaagucuuuuauacugaaugaauuuagcuuuaugaaaaaugaacuguagaaucuuccucuuuucacuauucugaggaaaacuuugguaugaacugccacugcuauuuaugaaccauuaauauaaaacauaugcauauuguagagcuuaaguugucauggaagaaggcacacauuuagucagauguuuaauauaguguggauaguauuauacuauagagaggaaaagucaaggugggcugaagucagggaaaacuuacagaggcgacagaauuuaacaugcuauaaaacauuucucuuuuucuucauuuggcuggaauaaagcauaacucuccgcuauuuacagguaaugaccuaggaaggcaaucuauucuggacauauauccaucuucuuauagcagaaaaaaaguaauuagaacaaaguaaaagaucaacuuucuguucaacuaugcauuuccaguagauauauuuacuaauuggcuuacauauuaaaguaggcaauuaccucccuugauuuuugugguauuuuucuuuucaguuuggauuauacuuggaaaaagguuaaucuauuuaccuucccccucccccuuaauccuaaccucccucagagcaucgaacuggcuccacacaaaguccucggacacaaccucgagaugaagacuacgaaggggcuccauggaauugugauagcugcaccuuucuuaaccacccagcacuaaaucgcugugagcagugcgagaugccacgguacaccugaauucagaaaagucugcgccagguugaaagugaaacuuugagcacuaccagaagaaaaggaaaccucgggacucuauucauccacccagccuuuucauuuucgauugcacagcggggaggaggaauggcuuuguggucgucguugugcucacgaaaggaaaaauggggaggucuuuuuuuucuccuuucuuaacucacuacagagugagagauagaaagggauacuugaaacugggaaaggauucacucugugaaagaauguacacacagaagucaagagcucuucugugguggaaucccaauuguuaaaguuacugcugaguggcccuuauuuuuuaaaguaguacuuugaaucauaguaugaaaugcuacaguuuaugcaaacugugaauucccagagcagacuuaccuggucaccgcucucuggaaaaccaaggcuccccgugcuucuucccauugcuuccuacuaaagaggacaacaggaaaaagcaccuagaauauuuggggggggggggcaaauuaauuaaggguauuuguaauugcugcuuuuuucagggguaauuuccaacacacauacaugcacacaaacaaaauguuuuaaaaugugauuuguagcagucaggaacuaggcauaucaugccuuuguuuaaaaguacaaucagaggugguaagaugccuuuggcuuguacagugugauucaucgagcucuaucaacacugguaacuaagaccuacuuaugccacauaagagaugcauuuuuuuaaguuacugcauguuuuuauuaaggccauugguuuucaaaauaacaaguccuuacaaaguaugauuuuauaaaugauauucucguaaaacugcgcuuugccaguagcacagugaauguaugccaaaugcaaguccauuccaaaauccauuuggaaaucuugagcucagcugugguucuuaaacuuuugcaguccauagggccuuuuuuuuuuccuuccaauuuugugauaaauucaugauguuuacagcacagauaaaacuuugugccauaauccuaauuuagcugaaaucaauauuaacuguucaauaaaaacuuacuugcauauguuaacaaaccagugugaggggaauuacaguuggccaacgacaaaguugcacacugcauuauuuaggaaaggagggauugucaaaaauuauuaagagaaaggugaauauagaggacuuugaaacaacuuuuaaaauuuaacauaacuguaucuagaggucaauugagucucuacaggcaguucagaucauuuuaaagcacuccuuauuuaugaaauagaacuucagggugcggauaagagauauaaagucaugugacucacuagggugcaucgcuggaaacuuaauagcacauuucauuaaggucucugccauuguuggaguuccuucuuagcucagaauuggaguuuuggaaucuuccccucauuuuggugaguauaaacagcaauaaaguuaguagguucucccauccuaaaggauuuuaccugaggauaucgucuuaggaauauccauagacgcucccaucagguuucucccccaaccccccuacaccgcccccccacuucuaauuuagcaguaaucucuggcagaccuggaaaaacaagcugcucuuaauagcauaaugaaaccaaaggcguaauaacucaucauaguuuuccaucagaaucauuucacacucugccuacagcuuugaaaacauuuuuucauaugugaaaaacuccccaaaauauauccacuagucucccaaaggaagcaugguaauuaacacugauaaaaacaucucucacacaacaacuguggcaaaacugugaaaauaacggugagaaagcagaugggcuuaaaagcaugguccccaaaacaacguucuucaaagguuuuuguaacacuggucucugucuccaauaacagucuagccguccuacuguucuguaauaugccuuugccuuuguaugguuucauaucucuuuagugauggucaaccccacuugguuuuaaguuacaauuuaggggaaauauauauauauauacugcuugguguccuagcuaaaagguuuaccaguauucauagugauaugcugaaguggaggcaauuaacuuggcaguugucaguugagaaugaaaguagcaugucugaaaacagucugaugcuuuauaaaaccauguagaugacuuuaaaacuauugcaugaaaauacaucaagguuaauaagcuguuauacaguagaugcaugguuucaauccuuuggugauauuaucuagucaaucauuguuuucaccugccaggaaaagagagaaaacagucuauuggauagguguaaagggugggguaugcgguaucagauugauuuuaaggaaguuuuguacauguuaauuuuuaauugugcacaaguuucauaugccaacauaggcuguauucaguuuuaaaauaggcaaaaugacuugacacugauaaaucugguauguuuaacugugucccauauguagacugcuuuuugccuaugaccaguuugaacaagaauucacccaacuuucaagaugccuuuucaaaaggaucuuguagucaguugguauguacagacaauuggcauggaagugguaggauauaaaucggaugacgccuggcugcugaggugccagcuggaucagcuggugcacuucuuguuucuuguaagagguuucuuuaaaaugacuaguuugauguaucugguaacauauaggccugacuauacauuuuacauuauuucgcuauuuuguaaacugggauuuuagaaagcacguuugccauuuuguuaaaguacauugccccuuaaauuuuggaguaguuuuuaaaaguuuaaaaugguaauagaggagccagaaacuuuuuaagcauuguaaaauguuuugaauugauauugacuuuguuuggaagagaguagaggcagggggcuuuaaagaaacaaagaaaugcauuguaaaaauguaguuuuagagcaaauuaauaaugaugguggggaaaguguugcuaauuuguuuauuucccuggaagaaaugggaagugugauaagcaguuuaauuuuuaaggagcuggucucaauuuuaguacuuuuuaauuaugcaaauaaaucaauguuuccuuaaauuuugucauugcuuugucacaguugucuaggguucauauccaaccuucuguggcaauucaauuuuauauagucuuuuaagagguaauuguaauguauuucugacaguauaaacaaaaagaauauaaggcauagaagaauuguccucuaaaaauaucaaugauguauccuggaaugugaagaugucccuuuauaguuaaaaauugaauuauuuuaauauuguaccauuguuagaccuugaaugaguccauguuaccgugugugucuguauaucuaucuguagagaaagaaaaaugacaacugaaauguuacuuuuaaaaaucagaauaaauugggcacugucuguguugcaccacuacuguaucuuuucgaaagaauuaacaguauuugccuauuguaaagguuaauucugaugacguuuucacauucaccagacuuuuuuuccuguauuauuugcauccccaaauauuuaauacaaguagauucugcauggcuugggcauucagagauuaauagaaugaugacucaauuuuaauucuaaagccaugaaaaguuacuuugagacugaacaauucugaauuauuuaugauacccaauguccauguuucuuucccuacuguaaaagaauugaucaguuucuucauuaaagcagcaaaaacuuauuaaaucuuguaaauaccaugucucuuuuagauuucuguguaugcugugaaugaaaucauuuugagaugaaauuguacaaaggcauuuuaaaaggcucugcaugcaucguaccuccaaacaguacauauucggaaagucaaagauuccugcaaaauaaauaaacuaaaagcaaacacuaca

SEQ ID NO: 19064 - RNA, 1056 nt, Homo sapiens
cuaagaccucauugggggugagaacagcagguaaacuuggcuuugggagauugauuggcuauggcaguagugcaaggccuggcuacaacucuggcucagacuccggcuuucucuucaucuuucaaagcuucuucguaauggguugggaaggcacagggggugguaccauuuaccuuggccaaaaacuccaggacuuucaucuugcugguuucagcauaggcucucggaccccacaggaauugaaagcgugggggaucacugcugggcaccugcuuguacuccagauauuuuuccugcaccagaucuuuggugaugagcuuccaggguuccccaaagacugagugcuccucuccaucauagacucccaacauauucaggaauucccagaucucuuccucaguagcugaguugccauuuaagaagaucacacccaggagaggcaucagaagcuuucuccugggaaagucccaggaacugagcagggauuccucaucagugaggucuaccuugucgaugaagguguaaguguggccguugggguugacuuuauucagcucaaggccaaagacaacacugaggcccucagaggcuuucuugaggaucucagggaagugcucccugaaccuuuugccaacaauuuucagcauuucucccuuuguaacggacuuuuuuauuuuauacuuguacaacaggaacugcaccaacgacccugacuuccugguuagaggaucuucgcuugggcucuuaguggauguugaggccugggaggaacuugcauuuuucucaccuugguggcucuuggcaccuuuuuuagauuuuguggaugaaacacccgcagccgcagcagcggcagugguuggggcucucugaggcuccuggggaaugccagcagcaggagagcuugaagcagcacccccagaaacagaagaggaacagcagggggccucuucuuccucugcuucagugaccugaggaacauugagaccccgggucucaucucgggccuugcggcguuucucacgggcacggagcuuacucuucugaccacgaggcaug

SEQ ID NO: 19065 - RNA, 1060 nt, Homo sapiens
ugagggucucucucuuccucuugugcucuuacuggggcuggugguccaggggucuuacuccuuggaggccaugugggccaugagguccaccauccuguugcuguagccaaauucauugucauaccaggaaaugagcuugaaaaagugguuguugagggcaaugacagccccagcauugaagguggaagaguggguguugcuguugaagucggaggagaccaccuggugcucaguguagcccaggaugcccuugagggggcccuccgaugccugcuucaccaccuucuuggugucaucauauuuggcagguuuuuccagacggcaggucagguccaccacugacacggcaguggggacacagaaggccaugccagugagcuucccguucagcucagggaugaccuugcccauagccuucgcagugccaguagaggcagggaugauguucuggagagccccguggccaucacgccacaguuucccggaggggccauccacagucuucuggguggcagugauggcguggacuauggucaugaguccuuccacgauaccaaaguugucauggaugaccuuggccaggggugcuaagcaguugguggugcagaaggcacugccgacaaucuugagguuguugucauacuucucaugguucacacccaugacaaacauuggggcaucagcagagggggcagagaugaugacccuuuuggcuccccccugcaaaugaggcccagccuucuacaugguggugaagacgccaguggacuccaugacguacucagcgccagcaucgccccacuugauuuuggagggaucucgcuccuggaagauggugaugggauuuccauugaugacaagcuucccauucucagccuugacggugccauggaauuugcuauggguggagucauauuggaacauguaaaccauguaguucaggucaaugaaggggucauugauggcaacaauauccacuuuaccagaguuaaaagcagcccuggugaccaggcgcccaguacgaccaaaucuguugacuccgaccuucaccuuccccaug

SEQ ID NO: 19066 - RNA, 370 nt, Homo sapiens
caaucauggaucauguaauacaguuuguugagccaaguuggcaguuuguaaaggacucaguucagcugguuaaagaugcuccgaaccugauagaaaaaaauuucagaagauugccauggcaacagcaauaagauuugcuauaaugggauucauuggauuuucugugcaauugguucauauuccuauuaauaacauaauugcugguagcugaauauguuuuggaggaguguuuuccaucuuagggaugggugaacaagugaggguuugagaagcucauggagugaaaauuugcugaauauuuugugguuucuuccuuuuuauuucuuccaagauguuuucuauuucuaaauuaaaauaacaugaaaagaaa

SEQ ID NO: 19067 - RNA, 370 nt, Homo sapiens
uuucuuuucauguuauuuuaauuuagaaauagaaaacaucuuggaagaaauaaaaaggaagaaaccacaaaauauucagcaaauuuucacuccaugagcuucucaaacccucacuuguucacccaucccuaagauggaaaacacuccuccaaaacauauucagcuaccagcaauuauguuauuaauaggaauaugaaccaauugcacagaaaauccaaugaaucccauuauagcaaaucuuauugcuguugccauggcaaucuucugaaauuuuuuucuaucagguucggagcaucuuuaaccagcugaacugaguccuuuacaaacugccaacuuggcucaacaaacuguauuacaugauccaugauug

SEQ ID NO: 19068 - RNA, 372 nt, Homo sapiens
ucccucgaaggggucuuuucgccuuccugguggucuuuaggcccuacagggagaucacagucaggccagagggcguugguuuugggaaagaaggugggaaaugcauaggaauaggcuucaugagaagggugugaguugaggaggggguuugagugaggcaaggaaaggauaggagucuugggguggcggaaucaguggggcaaagagaagggguuuggucgggaucaucucaccuuaacgccgcuucuggaccuucguugacggggugucuuccccuucuuccucccuuugguacuugagguugauggggucuguucguccacaucuucauuaggcuucuguggcucacuggucaccuuugccauacugaau

SEQ ID NO: 19069 - RNA, 303073 nt, Homo sapiens
gccaguuuugggcugguuggcgcggaaucgggagauucgggaccauggcaccugugcacggcgacgacugugagauaggggcgaguggugagggacaauuccgcgcgcggggcuccggguugggacaguggcaugauugccggugguggggguucugagggaggcgcacacccggguuuguuugggcgcagaccuuggucguccccggcgggggcccuucuggcgucggaccgggcuuccuuuaggcgcgguuugcucuuggaggaccagagccuggagggauuuuuguuugggaggcugucucaccucugccacugagagucuccacagucgauugcguuucuauuucuuuuggugaguugcacccacgugcuggguauaacuuuauugagacuggccccguggggccgaaaguauuucacugcgaucucccuaaguauccacuugaaggcuugaacagaacagaucugugucccuuuuuguaggaacuuccaggaaaauuuuauacauuguaacuaagcaggaaagaaagcucuaagugcugucaucggggaauaacgcguuuuguauuuuuagguaauggguuucuacuuuaugcauuaacaauuuuucuuucagauucuuuggaaaguucuucaagugcugcguagaaauccuguucacaaucuagucauuccuggugaaguuucaaaaaaauggcaucaauuuagggcauuucggauccccuguauaucacuccguuugucaggggugucuuuuauuuccaaaaauagaauacaaaaaugcaaauagauuugucugauuuuuuaaguguucaacuaaagcgugacuucaguuaacuucuaacuuaaaaucagaugcuucacuuuguuagcucaagcgucaccucuccugucauucagauacaucaccauuaaugagaacucgcuuccuaaucagcuuccuuugcauucaccuaguugugagucacagauuucaauuuguucuagccguucguuuuuuaagacuauuuuggagagucgaccugccuggauuacagauaggauguuggguguaaguaugugaacgaacagucuuugcaggccucuaucagugauuugccacuaagcccuuucuucauccuaaaaacuacgucaucuaugaacaucaggaaaucacuuuggaggauacugugcaaucuugagacuccucuuaggucaugguguucauuaaguaguugcuggggacuugugacuggaauuuuuccuuuagagcagacugaaggauuguuaccugaaagacugcuguaagcuagugucugucugcuuuuggggaggauagagauacuccagaugguaauuuugaaacaaauauuuaaaccuuuguagcuggauuuuuuucaugcuuauucuuuuuuugcuaaguuaccuacgugaagcauuggagacauacuccaaaaaacaaaauguaggcuuuuuuuuuucuucaguauuagcaggcagggcaccuugauaauggcagugaaaaguugaaaggucuguaacuagcuguuacuauauaugaaaaaagaucagggaauuuuuauuuauuuauuuauuuuugagacaaagcuucccucuuguugcccagacuggagugcagugacgugaucucagcuggcugcaaccucugccuccuggguucaagcaguucugccucagccucccgaguugcugggauuacaggugcccaccaccacaccggcuaauuuuuuguauuuucaguagagacaggguuucaccauguuggccaggcuggucuugaacuccugaugucaggugauccaccugucucuuccucccaaagugaugagauuacaggcaugagccacugcgcccggccagggaaaguuuaaugaucaaaaaagcagguacagugguucauucauugguucauucagcaaauauuuauuauauaccuacuagguauaagccuucugccaggcucuggcauuaugaugguggguaggcuggacaugguuugucuucaugaaguacagaugguaaacaucuaaucauaugcagaaaacggcuuugcuuuguuuuugccuucuaaagcuagaccuugguacucuuagguauggugugugugggguauguggauguguguuugacuucacacgcggaagcguuacaugagccgcuccuauauugcuaagugcaaaguaagauaggcaucuucauguaauccuuaacagauuuugaagcagacaugauuauccccauuucacagauguggacccugaggcucugcaucagucagagccccuaucuguaagcugcaggaaccaacucuaccagauugguuagaauuuguuagaagaauauuguguucacagaaacuccaggaggacuaguaagccagucugggagcuguuuagccaggaacagugagugaaauugugccacaaaaaugggccagugaggaggucauugccaaccacgagcaaguacuugaugcuauagcucauaccuuaggacauugcugacauuguugccgguuuuguaauccuucugcagcuguugcuacuuguagaaucuuuuaaaacccaugcccccuuccuugugacacuagcuucugauuuaaugucugagcagguguuccuaaucgguagcgccuauuuuauaugcccaugcucuaggcugcaagggugucugggaaagagcaucaaccuuuucagcuucuguaauggggcauaggcucugcgucucaucaagacuuauaagggaugggggccggauuucacaaacaguuucagaugcuaggcugcuuuaaauaacaagacaccugucugcugcuuaacugguuaaccgguguucucaugucacccaguaaauggcagagcuggaaugugcugcuucucccuaaccugguucuccuacucacucuacacucccuugucgaauuuaccuugcacacugaguucucucaguuucugaauacacuaugcauuuucaucccuuuguaauuuggcucaugccucuucuuuugcuugugccacuuuuuacuuuguucucugugaaauuugacuccuuuuucuaggccuguauuggaaaccucuccugugaagccuuccuugauuuuccaggcaaaauuaacagcucucuccucuguacauuuccucaguacugaguucuuaccuuuucuauggcaccauguuuauauugugaugguaauuucagguacuuugcuuuacuugacugggggccucuuuuggacaggcagcucugucuuauuugugauuguacccuaaacccuguguaguggaacauuguugccuguguagugggacguugccuguguaguggaacauuguugccuguguaguggaacauuguugccuauggaguaagugcauuugaagaccuacagaugucaggcaucaagggagucuugaggggaaucgcuuuucacuuucaggggucauguucaguaaucuucaaagccuuuucauguaggccuguucacgauuuuugaaaucauuugagugacauccaaguuuuuguggcugucaucauuaaguaccuuuauuccuuaauuuuuacuuaaugucuuucugaaaauggauuuaaaagucaaaugugaaagucaaacaauagagugugauauuauaaagagagauuccauuucuagaaagcuagaaaaaaauaagaucucuaauuaugccuuaccuuuaggcuauaguuuccagcaguuuauugccagcauuugguacauguucuuuaaauuguaucuucuauuucagucaaacacuuagucaagcagcuuaauguuguuaugaacauucuagugggguuggaguuuuaggcugccucuuauccauacuucuuuucuuugccugcuccuuuuuauaaauuaauuagcaccaaacacaguaaaauacuagauuucacagacauagauggcaaucaugcugagccuaaacucguaguugacaggcagcacuguuaugcuugacuuaguuuuucaucaguggguaugugaaagucuuuaauucuguggaugaauuuuuuuuuuuuuuuuugagauagagucucgcucugucacccaggcuggagugcaguggugcaaucucggcucacugcaaccuccaucuccuggguuuaagggauucuccugccucagccuccuaagcaguugggauuacaggugccugccaucacacccagcuaauuuuuguauuuuuaguagaguugggguuucaccauguuggucaggcuggucucaaacuccugaccucaggugauccacccaccucagccucccaaagugcugggauuacaggcgugagccacugcauccgcuugaauuuuuuucaguguguguguggaacggucaguuuaugaugaucggagcaugaauaauucaaaaguugaaugaauaaacgcugaaguccucugauauuucaguaauuuuugacaaaccauuuaagucccuguaguuguuuuaguaauguccugugucauaaccaacugaggccuugaaauaagugauauaccaauaauccccucagagccaucuuuguuaaauuucuccagcccucaaucuguuccuucuuugaauuuccgggugcuuuggcugaaucucuuuuaaggcauuuauuaucucuaaauauuguuuagagccaguugcuacuugucucccauguuagauaguaaguucugugaguacagagaccaugucuuuuuuaucuuuuuuuguuguuguuguuuuuuguuuuuguuuuuuguuuuuugagauggaguuucucucuuuuugcccaggcuggagugcaauggugcgaucucagcucgcugcagccuccgccucccggguucaaguguuucuccugccucagccucccaaguagcugggguuacaggcaugcaccaucaugccuggcuaauuuuguauuuuuaguagagaugggguuucaccauguuggccaggcuggucucgaacuccugaccucgggugaucugccugccucagccucccaaagugcugggauuacaggugugagccaccacgcccagccugucuuugugucucauagugccuaguacuuugcaaagaguagaugcuccuugaagccuuuuagauauugauugacagauugcaaaaugaauagugcuuuuauaacccacuggauuacuucuggcuggucauuucuaauggaaaggugauaaauuagcuaacagcugaucucccuuguuuagugucuccgcaggauaucaguugaauugggaauuuuccucuuuuuagagaaaaaaauaacagugacuuuaauuguuuuaacaggaucuuggaggaacuuucuggcgagucauguauauuuggauauguauguuuggccaugagcuuugugaauuauuuacauuauaaacauuaucuacuuguauauuacuaaaauuguauguuauuguuggcuagaaacuuuuccuuuguguuugagggaagauggcugacaauuuuguaacaucuguuguaaauuuuuuuucuuuuuucagcucugucagauucagggaguuuuguaucuucucgagcccggcgagaaaaaaaaucaaagaaggggcgccaagaagcccuagaaagacugaaaaaggcuaaagcuggugagaaguauaaauaugaaguaaguaaccauuuuucuucuuuauucuuccugugcaucaucuaauucauagccugcagguagucuuaugucaccuuugccccagauuagaaauacucauauauuuuaaacuuuuuguaaugggaauuuauuaguauuggacaagcauggguaugagguagauuuacagaucauggagaauguucgacccuuaaaguuccuauaagguauuuuaaagaugauuuuaaaauuccaaaaugaaaguacauagucauaucuauauuuuuccuuauugagcaugcuguaucuaugguaagucccauggguuuguuggggucauuuagagaugcuuuuacuuacucuuaagguauugagcagucuaagugcuacuucuuggagagaacuguucuuccuaaucucauuugcaaggguaguggcaguggagacuuggaccuuaacuucugccguguucugcuuguaagauugaaugugaugcucuuuugguuuuccucuacccacuguuuauggccugcaggucaaaaacagaguggccaccaucugcauaaauauugucuagcaucaccuucagggcuuccugaguaucuuaauugccuuauggccagaaagugauuaaccaauacuagaaaauaacaaccauaacugauagacuuuuugaacuaacauauuauucuaaguguguuuaccaauguguuuauucauuuaaucuuuucaauaaccaaaugaaauuagauacuaugauuaauaacauuuugcaggugagauauccgaggcacagaaaguuuagugagguuacaauggcagauucuuuuuugaacccagacagucuggcuucagaauauuucuguuuaaccaguuaaccaaauaaaagaauauuugccauuugucaccauuuguucaaguuaagugaggcaaccagaucauaaaagguugcuaaaaggauuucaguaaaacaggaauaaagcauuuuuuuuguuuuugagauggagucucucucuguugcccaggccggagugcaauggcacgaucuugguucacugcagcuuccaccucccagguucaagcgauucuccugcuucagcuucccgaguagcugggauuacaggcgcccaccaccacgccuggcuaauuuuuguauuuuuaguagagacgggcuuucaccauguuggucaggcuggucuugaacucuugacuucaaaugguccacccgccucggccucccaaagugcugggauuacaggcgugaaccaccacacugagcccaggacuaaaacauuuuuaauguagguacuuguauaaaggaguuccauggggcauuucagauguuggcacaauguggcugauuucccuuuaacacugugauguuaauuguauggcucuaagaguucaugcugagcaguaguaauguuguuuuuaaagauugagucgaaaugacuuuuuacucaaaaugauuuuuaaaaauaguuuucugguaucuccuugauaauauagugaaucacuuaaguaagagacaaagucugucuucaaccaacaaaaauaauaacgccaguuccccucccacccccaaaaaagaaaguuggucaguauaguaauauuaauuggacuauuuugcaucucuuuuguuaaaagcuuaauuugguaaggcagguuguuucuguuacuagaugguuaaagaccaaaucaguauuugccagugauuccuguagaguaggcuaaaaaggaggugaaaacucaaaucccguaauuauuauaagccuuauagguguggcagaaauccagucagcucuggccacuggauuccaaaagcucuguccaaguuuuuuccuaggguauuaacucuucagauggaguuguuucucccguacuccauuugagaaagguagaacucuuuuuuuuuuuuuuuuuugagguggaguuuugcucuuguugcucaggcuggagugcgauggcaugaucuuggcucacugcaaccucagcuucccagguucaagcgauuguccugcuucagccucccaaguagcugggauuacaggugucugccaccacgccuggcuaauuuuuauaauuuuaguagagacgggguuucaccaugucggucaggcuggccuggaacuccugacuucaggugauccaccugccuuggccucccaaagugcugggauuacaggcgugagccaccacacccggcugagguagaacucuugagagaaugggagaauuuuuuuuuuuuuuaaucucgcucucucucccaggcuggagugcagugguguguucuuggcucacugcaaccuccaccucccagguucaagcgauucuccugcuucagccuccugaguagcugggauuacaggcgccccccaccaugcccagcuaauuuuuguauuuuuaguagagaugggguuucaccacguuggccaggcuggucuugaacuccucaccucaaguaaucugcucaccuuggccucccaaagugcugggauuacaggcgugagccacugcaccuggccgagaaucagguacuuuuuuuuuuuuugagauggagacucggucucuuacccaggcuggagugcagugcaugaucucggcucacugcaucacugcaaccuccaccucccggguucaagugauucuccugccucagccuccugaguagcugggacugcaggcauaugccaccacgccuggcuaauuuuuguauuuuuaguagagaugggguuucacuauguuggccaggcuggccucaaacuccugaccucaggugauccacccaccugggccucccaaagugcugggauuacaggcgugagccacugugcccagcauuuguuaauuuuuaauaaguaucuaugagauuuugcaaaccagcccaccagagucucaucuggaaagucacuggccuuuccccaugggcagcugcagcagugguguguaucuuucauuuguugcuuuagcugugcagagguugucugcuuuacucauaccaguagcucauaguguucugacccucuugcagucaggcagccaauaugauuggaggaccugccacucucuggacuugccuuucaaauagcucagcguuuaaguccuugugugguuucaagaccugaggaugguggaguuucagugguaauacaaacagggucacucaaaaacuauuucugguuugccuguagaauaugcaauauguuuguuuugcuaauuuuuggaaggggauggaugagggagauuuuccuucugaauuguauuugguugauugaacaggcaugaaaauuaucgucuauuugcagagcguacaucagcuaguggagagggaaguggcaugccuuacagguuugcuaaguguaggagaaaccagucuagaaauuacaagugaauaauuccccaaagcagcuaaugaagaauuggcuauaauucaguuuguuuuuuaugaaauagaugaguaauugaugguaugacaaguguauuaugcuaauggaaucauuuaauaucuuauguuaacacccaccuaaaaggaauacuaaguuaauugaugucuauuuaaggaaaacccuguagugguguugaaugucagaacucaugauuugguugcagcuacuccuucagucugccauuccaguuucaauuugacaauuuuuucaucagaauuauuuaacacuuugacuccucuauuugaagcuuuuuuccugaaacuuguauaaugguaggucgaggacuucacagguguuuaugaagaaguugaugaagaacaguauucgaagcugguucaggcacgccaggaugaugacuggauuguggaugaugguagguggggcggaggugggggcggggauguugcuuccuaggcacuguguuaguugcuucuuguagauucucacucaugugguggaguugcugcuuugccugggcaaauguaaggcacuguuaggaucuuaccuuugguuuggauuuuccuuuaauuauuugaggaugaggaagcagaauagcaggacauuuauuuggggauauuuuggagaaucuaggcacauaccucaggauguaguauaaauccuccagguaauggcuguguaagaauugggaggagccccuugucuguggggccaaugcacagcgcuuggaauuaaggaaugcagguucgggauccaucauuccuacuuuccaauucuaugaccuuggacaagucacuuaaucucucugcgccuuagagucuucaucuguaauauggggaugagaaaacuaccuucucccagaguugugagguguauaugagguucuagguaugaaaauuaacuuggucaguagaaagcaccauacaaaggcugguccuaauguccugugccccuucugaaagcucauugguucucacuuguagggucugacuucauggccaugugaaugcugaccacagggagcauguagauugugccugugacuauuuauguuucuacuuguguaguuggauucagcuauauugccaguuuucccuuguagacugggauaucucucugggcuugugguaaucuugauucuuuuacuuuuuauucuucugguagaguaaaacugcuauaaagcauccuauuguggcagacuuugauccuuugggccaaaucguuuccugaggucaccugacuagguauaauauauaucauuugguuuugacuccacaccugcuguguggaugcugugcauugucugacaccugugugaacagaauucugcugcacuuaaaaauagcacaggccaggaaaacaucugagcagguauaaaagguuuuuuuggucauggcuaaaauauuauuggccacuuuuagaaauuugaucccaguauuaaauuuugucccugcagaugguauuggcuauguggaagauggccgagagauuuuugaugaugaccuugaagaugaugcccuugaugcugaugagaaagguaccuaccuuuuguuuuccaggguguuguuuugagauuuaaagaauucucuaaaauuagagaugacuugauacucugauaguuuaccuuugagagaaggaccuaacuaccauuguuuuuagauacggaauauguucuaagaugaagagaaguaugguuuuguggaaaauuaaacauaaaaagcagaaacaacaucaggaaaugaaguuucaugucucuguuauucaaguaguguggucuuuacuuauuuugaaguuuucaaucccguggucauuuaaaacuugcugauuuugagggcugcaacaguaauugaucuuuuuuaauuccuacugaaguuauauacuuagaauuuuagcucuuugcuaauuguauagcacaauaacaagguuuagaacuagaguaaucagcuugcuuugucuaauugaaauuuaaaauaauauggugaaugugucagauugucuuagcuguacaaucauuggcaauuuuuuuuugaguaaacaauccugauuuaguuccuguaaaaugggaauggaaaauucucuucaguauuuuuuuuuguuuaguuuguuaauuaguuuucuacuacugagugguagauuggggucagcaaacuauggcccucucacaaccaguuuuugacaaaaaguuuuauugagauacaguucacauaccauacaauucacauauuuaaaguauacaauucaguggcuuuuaauauagucacagaguugugcagccaucaccacaaucaauuuuagaacauuuuuguuaccccaaauggaaaucuugccuguuuuuguguggcucucgagcuaagaauaguuuuuauguuuuuaagcgguauuuuaaaaauaaaaaaugcaaagaauauguaacaaaagaauaugugaccaaaagccuaacaucugugcugucuugcccuuuacugucuggauccucauuugcagaauaauauuuugcaccauuaguuuucucucuccuuccaaccacauacacagagacuuuuugcucagugaacuuuuagaacuucagcagugaccuccuaagaauaaggauaccugacuacuuaaccacaauaacauuaucaugauauuaucuaauauauugucuguauuaaaaguuucccaauuagcccaauaguaucuuuuaaagcuauuuuaaaugcagacuccauuuuuguuuucaugucucuuuagucuuuuuuaguguagaacagcaacaccucccccccuccccugccccuggccucuuuuugucuuucaugacauugauuuuuaaagggaccaggcuguuuguuuuguugaaugucccacaaucugaguuuugcccaacuacuuuguugugcuuagauuuggguuaaauauuuuggcaacaauaaauaaauaguuauaaauaaaugcuuugucaagaccuacaauauaaagucuguccuucccauaucaggggcauaugacgucacuuguaccauuauuguugauacuaaguuugaucuuuugguuaagaugauauuugucagauuucuuccuuguaaagcuacuuuccucccuuuuguaauuaaugcaaaauagggggugauaauuugagaccauguguauaucccauuuccccaugaauuguuacccagugcuuuuagcaucuauuguugauccuuucucuucuuuuaaaaauuaaugcuucagacucauguauuucuaaaagauuuacuguucuaauucaguagccauuauuaucauuuuuccuuuuuauguucaaauuaucucagauuuggcuggugagagccccuuuaagccaccuccuauguucuuuugacauggcuccaucagucuuugaggauuuccuugcuuucugggccaagaggauaagauguuccagguuuagcuugcauucuuccugcccuggaccuggaaccaaccauuucucccaagaauccugguuccuuuuaguggggaaugguauccagauaugggagauggauguacucauugcuauugggguguaacggcuucuaggcccuuucagugaacagaacaaggaaauuauauaugucaugaguucauacagauauauuugauugguugaaauccaacaucacuggguucuuuaucuucccaauucuauauuuguaucugccuucacccucaaugaaaacccuugucuucuaaaauacacacaaaauaaugucagaaucacuaaaucaauaucuguacuaacaaccuuucuaaguaaaauuuaugauuucucuacaguuuuauuuguucuuguuauauauccuaagggucuauagucagaguauuguguucagaagcuauauaaaguaauuuuuuguguguuuuguauugauuuacuauguagguucauuuuuuguuuguauucaaauuucaguuuuaaaaccuuuuaauuuuacuucugaauauuguaaaacauaugauuuaaaaaugaaaaucaguaacuuuuuuauuaguuucugguuuauuacaaaaaaauaagcauauguauuuuuuucugugugauguuauuuauuuauucauugauuuauuaguuaaauuagaauaugugaaccaucuuccugguucugccaaccuguauaauguggaaauuuucuacacugguaccauuugguagcaauguggccaauuguguauuucuaguuugugugaguccaugaagaagagaaugagcucaugugccacuuucaucucccugaacugaggaggccuauguuagaguuacgguucuauuguuaauuggcggugucaucuugaacuaaucccauuaccuaucuggacuugaguuuuugucagcuguaaauuaggaaguuggaauggacagugagcuucucaaagaaaggacucauguccugguaaucucagugcuaaucacaguaguggacucaaaguaaauauguaguuuuguugaauaaaggagccaucucuguguuuccauagucaucauauuaucucuuccgaguaauaaguuacugaagagaaugauuugaucuggaagagagcuagucuuagaaauuuuuauuucgugcuuugccaccaccauucacccacaaguccccacuguuuuaguguccauuacuaggagcccaguaaggucacaagauccuaggaaggaaaauggacuucugcaauguacuuuaaaggcuuauaagaaauuacuaaguuuugcuuagaaguaaaaagucaacuaugguguggcucuaauuccugggauguuguuuucaaacagagaaaaauggccgggugcgguggcucacgccuguaaucccagcacuuugggaggccgaggugggcagaucaccugaagccaggaguucaagaccagccuggccaauauggugaaaccccaucucuacuaaaaauagaaaaauuagucgggcgugguggugggcaucuguaaacccagcuacuugggaggcugagaaucucuugaucucuuaaacccgggaggcagagguugcagugagccaagaucgugccacugcacuccagccugggugacaggaauaaacaaaacaaaaccauagagaaaaauaucaaccaagucccagugaagaaaaauuagcaggaaaaugcaauaaaacaaaacagaaacacuaaacuguggaagaauuccaccucaaauauuuacuuguauucaaauuuuuauccuucugucuaaauccugccaaccuacaguggugagauuaaagcccucucaugaagccuuccuugcuauucaaaccucuguugaccuccucuguucauacacuaucaagaccugaauuuuauauacuaaacauuuugacuauuaauuacauucuguuuucagagugcuccagaugauacagaucuccugucucacauuuuucacaaauguccuacaauccuuuucacaaucuuaggcucaugaaaauacuuuuuuuuuuuuuuuuuuuaauuuauuuuuuuauugauaauucuuggguguuucucacagagggggauuuggcagggucaugggacaauaguggagggaaggucagcagauaaacaagugaacaaaggucucugguuuuccuaggcagaggacccugcggccuuccgcaguguuugugucccugauuacuugagauuagggauuggugaugacucuuaacgagcaugcugccuucaagcaucuguuuaacaaagcacaucuugcaccgcccuuaauccauuuaacccugaguggacacagcacauguuucagagagcacaggguuggggguaaggucacagaucaacaggaucccaaggcagaggaauuuuucuuagugcagaacaaaaugaaaagucucccaugucuucuacuuucuacacagacacggcaaccauccgauuucucaaucuuuuccccaccuuucccgccuuucuauuccacaaagcugccauugucauccuggcccguucucaaugagcuguugggcacaccucccagacggggugguggccgggcagaggggcuccucacuucccaguaggggcggccgggcagaggcgccccucaccucccggacggggcggcuggccgggcaggggggcugaccccccccaccucccucccagacggggcggcuggccgggcggggggcugacacccccaccucccucccggacggggcggcuggccgggcagaggggcuccucacuucccaguaggggcggccgggcagaggcgccccucaccucccggacggggcggcuggccgggcaggggggcugacccccccaccucccucccggacagggcggcuggccgggcggggggcugacccccccaccucccucccggacggcacggcuggccaggcggggggcugacccccccaccucccucccggauggggcggcuggcugggcggggggcugacccccccaccucccucccggacagcacggcuggccaggcggggggcugacccccccaccucccucccggacggcacggcuggccaggcggggggcugacccccccaccucccucccggauggggcggcuggccuggcgggggcugaccccccccaccucccucccggacgggguggcugccgggcggagacgcuccucacuucccagaugggguggcugcugggcggagaggcuccucacuucucagacggggcagcugccgggcggaggggcuccucacuucucagacggggugguugccaggcagagggucuccucacuucucagacggggcggccgggcagagacgcuccucaccucccagacggggucucggccgggcagaggcgcuccucacaucccagauggggcggcggggcagaggcgcuccccacaucucagacgaugggcggccgggcagagacgcuccucacuuccuagaugugauggcggcugggaagaggcgcuccucacuuccuagaugggauggcggccgggcggagaugcuccucacuuuccagacugggcagccaggcagaggggcuccucacaucccagacgaugggcggccaggcagagacacuccucacuucccagacgggguggcggccgggcagaggcugcaaucucggcacuuugggaggccaaggcaggcggcugcuccuugcccucgggccccguggggcccguccgcuccuccagccgcugccucccgggcggcgcucgccggcgccuuuuuuuuuuuuuuuacugugguaaaauauguauaacauaaaauuuaccacgagugacauuuaguauauucacaauguuugcaaccaucaccaucaucuuguuccagaacauuuucaucauccaaaauggaagcccuguacccauuagcagucacuccccaaucucucuucccccagagccugacaaccaucagucagcuuucuaucuuuauggauuuguguauucuggacauuuuacauuucauauaaaugaaucaugcaguauuuuaucuuuuguguuuggcuuugacuuagcagaagauuuucaaguaucauguuuucaaguagcauguaucaguacuucauuccuuuuuacugcugaauaauauucuguguggauguacuacguuuuguuuauucauuaguugauggacauuuggauuguuucuaccuuuuggcuauuguauguagugcuacuaugaacauuuguguacaaguuuuuguuugaaugccugcuuucaauuuuuuaggguacuaaccuaggagugaaauuguguauauguugugguuuuuuuuuuuuuuuuuuuugagacagagucucgcucugucacccaggcuggaguacaguggugccaucuuggcucacugcaaccucucccucccggguucaagugauucuccugccucagccucccaaguagcugggauuacaggcacgcgccaccauacccggcuaauuuuuguauuuuaguagagaccggguuucaccauguuggucaggcugguuucgaacuccugaccucgugaucugcccaccuuggucucccaaagugcugggauuacaggugugagccaccgcgcuggcauguauauguauuuuuauuuccuuuucuuucuuuuuucugagacagauucuugcucugucguccaggauggagugcaguggugcgauuugggcucacugcaaccuccgccuccugggcucaagcuauccucccaccucagugucccgaguagccaggacuacaggcacauccugccacgcucggcuaauuuuuuguguuuuuaguagagacagaguuucgccauguugcccaggcuggucucaaacuccugggcucaagcaguccgcccguuuugcccugggaaaguguugggauuacaggcaugagccacggugcccggccccuuuucuuucuuaaacaaaagauaauguuauagagguuuuguacuuugcuuuuuucuuguagcaagauguuuugaaaauuaccccauauuagaacauagagagcuuguuuuuaauuauuuauuucuauguagcugcauaguauuccaugauagggauugcacaauguuuauucaaaugguuuccuuggaaggacauuuagauuauuuugaguaauuugcuauuauaaugccacauccaauaacucugugcauauggcguuuuccucagagaaaauucccagaagugggauugcuggcucaaagaguagcuacgcauaaauuuuuuuuuuuuugagauggaguuuugcucguugccuaagcuggaguacaauggcgcgaucucggcucauugcaaccucugccuccugaguucaagugauucuuccgccucagccuccugaguagcugggauuacaggugccugccaccacacccagcuaauuuuuguauuuuuaguagagacgggguuucaccauguuggccaggcuggucucgagcuccuguccugagaugauccacccgccuuggccucccaaagugcugggauuacaggcgugagccaccacgcccagcccacuacacauaaaauuuuauuagcuauugccuauucuuuauaggagcugucccauuuuacacucucaugaacaauguaugaaugucuguuucucuacagccuuacuaacaguguuuucaagcuuuugaauuuuugccacucugauaugugagaaguggcauuucagugugguuuucauuugcauuuuuuuuuguuuguuuguuuuugagacugagucucacuuugucacccaggcaggagugcaguggugcggucucaggucauugcaacuuccgccuccugguuucaagcgauucuccugccucagccucccaaguagcugggacuacaggugugugccaccaugcccggcuaauuauuguauuuuuaguagagaugggguuucacuauguuggccaggcuggucucgaacuccugaccucguauuccgcccgccucguggccucccaaaguguugggauuacagaugugagccaccaugcccagccucauaugcauuucuuuuacauaugaaauugaucaucuuuucauaaaacguaacuauuuauauauguuuguguuuacugccugcuuuccuuuugggcuuuuuaucuuuuaaguuuuuaaaaguucuuugucagggaaauugguccuuuaucugugauacauauugcacaaauuuuuucuucauuuuucuuuuaacuugguuuucuuuuuucuugguuuuucuuuuuacaccaauucugguguaauugaauuuaucauuuuuuuucuugcaaguggauucugagucauagaaagauuuucacuggacccaaauugcaaaggaauugcuuuuuaaaagguuuuuguaaaguuucauuuuuaaaaauuuugauuugugauccauuugguguuuauacugguuuacuucuuuacaaauggcuagccaacacuacuuaauaaaguccaucuuuuccuuagugauaugggaugccaccuucauuauauauuaaauuuccauaaguaauugggucuuauucuggacuuuauguucuguuucauuuggucuauuuguaugccacuaccacauucuuauuuuuuuuauuuuuuuauuuugagacagagucuugcucuguugcccaggcuggagcgcuggagugcaauggcaugaucucggcucacugcaaccucugccuccuggguucaagcgauucuccugccccagccucccgaguagcugggauuacaggcaugcaccaccaugccuggcuaauuuuuguauuuuuaguagagacaggguuucagcauguuggucaggcuggucucgaacuccugaccucgugaucugccugccucggccucccaaagugcugggauuacaggcgugagccaccgcgccuggccuaccacauucuuucaauuauucauuguuggcuuuuuuuugagaucaggacuauucugggaugaaucagaaagcgagaguaaaauugacgguauuagaaaaguuuguaggugauuuacacauagccguaagagaaaacauauggcaaaaguuuuguuuguuuuuuuucuuuuucaagacagagucuugcucuguugccaggcuggagugcaguggcgcgaucccagcucacugcaaucucgccuccgggguucaagcgauuucccugccucagccucucgaguagcugggauuacaggcauguggcaaccacgccuggcuaauuuuuuguauuuuaguagagaugggguuucaccauguuggccaggaugguaucgauuuccugaucucgugauccgcccgccucggucuuuuaaaguguugggauuacaggcgugagccaccgcacccggccagcaaaaguuguucuuuaaugagcagaugucucugugcuguuuaguguugauaugacauacuguguaucugguugcuguuucucauaaaauggaaauuaggaugccaccauaucauaauugguaaucccauuucuucacaguuaaauuuuccuaucagauucaguauacagcuaaagagaugaucucaugaaggcuacuaggcuaauuucuugguucaagauuagcuuuaucuuuuuauuucuguggggaaaacaaacccaaauucucacuuuuuuaaaaagcuuuuuauucacauuaacaauagcaguuaagcagucacacuuaugcugauauuuaacugguauuucauuaguuucuauaaaaacauuuggcccauguuuucuugaauuaaacucauuuaaaauauuuuuuccuacauaccuuguauagaaucucauaguuuuguuuuguuuuguuuuuugagauggagucuugcucugucgcccaggcuggagugcaguggcgugaucuuggcucacugcaagcuccaccuucuggguucacaccauucuccugccucagccucuggaguagcugggacugcaggcgcccaccaccaugcccggcuaauuuuuuguauuuuaguagggacaggguuucacuguguuagccaggauggucucgaucuccugaucucgugauccucccgccuuggccucccaaagugcugggaauacaggcaugauguauuuuuaauucuuaacauuuuucuucccaauagagaucaagugacuaggcuuuuaguuuuccauuuugauuuuugcugaugcauguuucuaaauaauucauauuccaauaggaaaagaugguaaagcacgcaauaaagacaagaggaauguaaagaagcucgcagugacaaaaccgaacaacauuaagucaauguucauugcuugugcuggaaagaaaacugcagaugugaguuucaugguuuccuuauuuuuuguauuuuccuuugugaggugaauuuaauauuugauuauacagauaacaggugcucuguauauauuugaguaacauuuuuccaauuucacucacuaaguuggauguagauuucuaagugaauuaaggcaccucagugguuggaacuugcgaaauggaaaagagaauugaacagaaaagcugaauugagaguguguuuaauuuuagugaguagcaggaagaucauggauuaagggcgaaaguagaggaugggagcuauagauguaggaaugcuauauacacaggugguuguuaaaaucugugaauguagaugagcacucagagagugaggaaugaagaggcaaggacuaacuggcuagguccuuccuuucauauacauguguguaguuuuggugagacauuuuaagugcaaggcuuucucauguuaccuuucuuuaucauuuccagaaagcuguagacuuguccaaggauggucugcuaggugacauucuacaggaucuuaacacugagguaaaugaaucuccaggaguuguaaaauaugcagaggacauagacugaagaaacacucuaguaauuauacaaaacagacuauugccagaauuuuuucuuuuuuuuugaaacaguagcuugcacuguugcccaggcuggugugcaguggugcgaucuuggcucguugcaaccucugauucccagguuccucuucccugauuccugccucagccucccgaguagcuaggauuacaggcaccugccaccacgcccggcuaauauuuuguauuuuuacuagagacuagguuucacuauguuggccaggcuggucucgaacuccuuaccucgugauccgccugucuuggccucccaaagugcugggauuacaggcgugagccacugugcccggccuguugacagaauuuuuuaaaauguaagaacgccaacaaaaaaccccccaccaaaaaacaaagaaacccccuucagauugguuuuaucccaccauuuuaggugaguauuuccagcuguuagagcugugugauuauguagauagggauguguggguguguguuugaaguaguaagaauauacccaggagucaguucugugagugcucacugcuuguguucaguugcugugguguauguucccuaaauagauugaagccugucaaucugcacaaucagguauaagagccuugucuugaauucugagugggaaugaaggaagagugagugaacuaucccugauagaacucaaacaggauuagcugcauugugaauuugagauuuggccauuucccauaaagacuacgcucucauuuagaaguguacuucuuuuaaagugaccauugauuaaaaugacuuaacaacaacaccauguaguuuuaucuugacaauuuuuaaauguaauauucucaaagggucagugaaaguauguuaaauuuuaagaagaaaaaauuugggaggggguagauuuaauaucuauuuuaguuuucuugugauuucuauaguauuguugcuauaguaaccacaguacaugacaucgaugggaggggggagggggaaagggaaagaaaagaaagcuuugcuuauugggcuucaaugagugaagaaguauacuuuuucugucugugguaaaccaagcauggcagugaauaugucuuaccuuuccuuuuagacaccucaaauaacuccaccaccuguaaugauacugaagaagaaaagauccauuggagcuucaccgaauccuuucucugugcacaccgccacgguaaaguguguagagauaccuucaaucuugauuuauaguauugcuuuaaacuuauuuuguugcuuuucuguaugagggaaauaccuuuacauuuguuuuugauuuuuguuuuaaauuaggacucccauucaauuuauaguuucauguauuucaaaaauagcaugugccugccuuuuucauaguaaauuugcaguaacuaguguguguuuauuauagguauuacaacugugguaaaugcaauaauuuuccucccagaagcaaguauuuuuuuguaaaccuagguaacaguaaaauaauugaagcuguuacauuaauaauacauaaaaucuuuuuauaaaagggaacugucauuaucuuuggucaggguaggacaguugcauauuuuuaguauguaggucuaacugacuaaauauuuaaaaacguuuacaggcaguuccuucaggaaaaauugcuuccccugucuccagaaaggagccuccauuaacuccuguuccucuuaaacgugcugaauuugcugguaagugugaugucaggcagaauugcaagaguguugagugguuucugucaaaaauggaggcccuaugauggaggagguagaggagauuuugaagguguugugauggcaaguuuaaaugugaagauuugaauucauaaaaauuucaguaaaaguuaaaaacacccaauuuggagauuaaagagaaaugcaaacauaguauagaaaagggacaggcugcuauuuuaguguuggauaagccuuugugcgccuuugugugccuuugugugccuuugugucaucgcaauaacacaugacaagaaugugugaugaugccuacaggcgaugauguacaggucgagaguacagaagaagagcaggagucaggggcaauggaguuugaagauggugacuuugaugagcccauggaaguugaagagguggaccuggagccuauggcugccaaggcuugggacaaagagagugagccagcagaggaagugaaacaagaggcggauucugggaaagggaccguguccuacuuguaagagcauuuuaugacuuuucuggcaaauaggaccacaauuuuucuguuggauuuugaaagguuuuugaaaaugugauuucugcagaggaaguuuucucccggaugucucuuguugggacauugaucaagaaggugauagcaguuucucagugcaagaaguucaaguggauuccagucaccucccauugguaaaaggggcagaugaggaacaaguauuccacuuuuauugguuggaugcuuaugaggaucaguacaaccaaccagguaaucauauauaagguaacuauaugccuuuaacucagaguaggacuuuucccuuaaauauuuuauuuuuuguuucuuuuuguguguuuugucuuuuuauuuaaucaguuuauuucuguuuuuuuuuucuuuauccuuaaauacuugagucacuguaauuagcucaggucaggcccugcccucacuuaacauguauuguaagagagcgacacucauucauuguaaagugaaugcgccacccugauggagaagagcuauggugcgaauaauccuuaaagaugcuuauuccaaaaaucaguuacauaugguuuuggaauguguguuuguaguucacuauugaugugucugaaguuacaggaaugcacuuuaauuuaaagggaaucagucauuaauuugucuguuucuucagcaaauuugaaugccuauugugugcuaggcacugagaugggaugaauaagcuggacaaauucgugcacuauaauggagcuuauguucuaggaggguggcagugggugggggcacauuagcaguaaaugagauaaauugauaaaugauguaaagaaaauuaguugggcgauggccaggggaggccugucugaggaaaugaccacugggcugagauuugagguauuugcagagcuggugaaagggcauuucagcuuaacgagccaaguacuagcaaaggccuagagagaggaaggaggaggccugugugguuguagcauaguaaucaagugacaagauugguauaaaaugaagcuggagauaaagacaaaggccagauaauguaggacuuugaaagccucguuaaggaguuugaaucuucuaagagcaaugggguggcauuggaggguuuuaaguacagggggugguggucacguaauuggguuuacauuuuaacaggaacagugguuuguguagagaauaagcacuguggugcaugugugcgugugcacacacacguggagggaugggcugguguaggguaauggggaaguguggaagcccuggagaucagucaauccagggcagggcugcuaguuacuuggacccugguggcuggagaggagagaaguaaaggcauuugacaugucuuuugacacaaacuuguuaauggauuggaugggggaggugacagaaaggaggaaucaaggaugauuucuaggucaucuuaaugagcuaauacugugaauucuugacucacaaaaagcccggaggcuguucgguauucuuuugugccucuuugagcccgucuucauugugggacugugcauugcaagaucugucagauuaauguuaaauacaguaugcacucuuaaacagaguugucuuuauuuagauccuuuuuggaucugugguacaugcaaauaguguauuuuucaaagcgguuuccuggaggcuguaucuagugaaaagagagggaguaccuagaugucagcaaagcaagcgugugaguaaauugaaggccacauuuaccuuaaagauaaccaggcauugacuuuaauuggaaaaauguuaaugaucucuggcaggggugggggcggucagaagcauuaauaugcuucagcuuaucaaauauauauaaacucuugagccacuugaguagcacacugccauguguuaguuucuuaggaaaagauauaaucaauuuuagaaaugauaucuuaauuuacuuuagcuaggacaaaaugauuugauuauacccccucaccucuuugacuauuuuguuacucugcuggaagucuggcaaguaugauuacaugaggcuaagcagaugauuucccauccauugcugaaacccagggcugccccauuguacaaccucagggaauaccauuuucacgugacuuuccuggagcacagcagugugacuggugcucccuggagcugggcagcacacuggccuggcuaucccaguauuacuccccguacuuugcugcaucugcucaaugcugcauuucauucccuaucuugguuaauggucccaucaaaaccagaaaccugggagccauccuugauucccuccuuuuccucacuuuccuuuccaagucugguuaguuuucucugccgaaaguggacaacuuaccuucucuuuuuccucauaucuaccacccugaucccuucuugcccacugaaacaauugcaccagccuccuaauugaucucuuagcuaucgucuuccacaucacugcuagagggacugaucagaagggcaauucugaccaugucagucgucauuaaaaaaaaaaaauccucaguggcuacugccuacaacauaaaguccaaacugcuuagcaaggcuucugaugccugcugucuaugaauuuuguucccuagaaauaauucucuguauguacuuuucugcucuuuauaccuguguuccuuuacuccuuguuuuuugucugauuggaaugugcucaucugacucauucuuuaaaauucagcccagauguuaucuccugggaguguaccuaaaccuccagacgggucuaggagcccuuucuccuugugacuacaucauagccuuucccacuguagcguuuguccuauuauuuugaaaugaacugagucuguguuuuucuuugccacaaagccuguaagcuccuggagggcugggaucuuuuauuuccagcauccagcagcaaugccuugcacauaguacguguuuaauaaauaguuguugaaauaaacugcacagugacugacaguccuguagaugcaggugaaaaauuucagagacuaguguugcauuugcuacuauuccugaguuugcaucuuaaugccuuguagcuuugugggguaugagaaugcguaacacaaaagcaaaugguuccccacucccccacaaccccacaaaguaaauacauccauaaggcuucauauugccagcgucaguugccaaggauuagaaccuuaagaagcaacaaccuucuuucuuucuuauuugaaaaugaguugguuauuucuacauuucguuuacuggcugauacucuuaguaaacagagcauuguuuugcaggguaaggaucuagagcugcauuguccacugugguagccaccagccacuuguagcucuuuacauuuaaauuaauuaaaaugcaauacaaauuaaaauuuauuuucuuggucacuagccacauuucagguguucaauagcaacuguggcuaguagcuaccauauuggauggcucagaaacaacaauuccaucaucacagaaauuuauuucaacuagugcuggucuguagugacaaguguuggaagauugaagcauugaagcacaguuauauuugcaaagcaaccaguuuaugauauaugaugguguugaauuccugguacugaccauagucauggauaggcuuuuucaaccaauauuggaaaauauuuugcaauugaaagagauacuaauuuguuauugaucugucauccaaaugcuaaggcagaaugaaauuucuggugcuggagaaggccucagagaucaucuagucuaguuaugcacuuaagaaacugaggcucugaaagauauaauagcucuuuagugguagaagcuugggcuucucacccucaguccacucugcuguucugguuccgugguacuucucaaguuguguucucuccuauggcacaucuucucuguuauugaugccaacggguuaaauaagauagcuuaaaaaaacuccuuuaaucucagaguguugaacacuuucauugugauagcagguaaugaucacugagcuuuggugaaaucaaugcugcuaauaaaaaugaaguacuccaaaagacccuguuauuguuucucacuuucuaacagauucuaaguaagucaguuguugcugaaugcuccauaauuaugaaaagaaucuuacucuuugcauaugggaagauauccugucuucauuaugacuuuuucaagguugaauaauccugacugcaccugguuucagcuaguaacuuuggggggaaugugaucuuuguuuaccaugaucuuuguugugucaaaugaggcauaaacagugucaaauguguugcaugaagugugauauuaguuugacaguaaaaugagcuuauuugaaucuuugaauccaauauuagggucuuuauuuuucuuugcauagcauuuuguuuuuccaucuuuaacuguugugaggaugacuuuuaauuuucugaguuacugugauuuuuuuucuuucuuaaucuucccauaguccuuccuucccucucccuccccauccacccuccguuacccccucaagcugaaagucucacaacucuuguaagaauuuuaaucaucugcagaaaugaaaauucuuagaucgucuuauuucuaccaggaugugugaaaaaaggagucacugaugaguagucuuucaaacugggguaauugaccuugugaacaguagccuuugcauguaccagaauuuucuuagugucucagauaaguggcuguguugaguggcuuuguugauuacugcugucuaauuauucauggagcccaggauuuugcacagugaccaucuccuggguugacuaacaaauguuugcagucuguucuucguggccaauuuucauaaacaaugauuugaugucuaaaaaggugugguuuuacuuuaugguauucauuacuuaaauuacugaaauagaauagaaaggaacauuauaaacacuuaccuaguuagauguccuaaguagcugugagguagaaaaggugaaauagaagauaauaguagucccuauugugagguauuuauuauuauauggaauaagaaauaagaaguaaauuauguuuuuuguaaacacaguuuuacauauagaaaaacacugaugcacuaguuauccugauacaugaauauugguuuuuauagguaaauacaagcgcuaaaaaauuagaauuauauucucagaucuguaaucucacaagaggcuuaauuaugagauuuguuggaaaauacuuuccuuauguuuguuucucuuuuuuuuuucuugagacaggguuuugcuguguugaccaggcuggucucaaacuccugagcucaagcgaucugcccaccucggccuuccgaagugcugggaucacaggcaugagccacugugcucggccuguuuuguuucucuuaaucuguauaauccugguuguggggaaaguguuuaugcaaguuagagaaucauucuguccccuguccucccaguggucauacacuguaucauuguguuaguguaguauggcaucaguacugaguaaagaacuggucuuggggagugggaaauggauauauuugcugucaaaaugaguuaucaugaagguauaaauguguggacacauucagugagccucuauauuguuccuuuaauuaggugaaauugaaauguuucuuuucucgugauuuucacuuauucuuucaggugugguauuucuguuugggaaaguuuggauugaaucagccgagacccaugugagcuguugugucauggugaaaaauaucgagcgaacgcuuuacuuccuuccccgugaaaugguaaacauuagugauuagcuuuuaguucucagucguuguaucugccacacauucuguguuuugcagccagcucucucucuuucaauagggcuacaaauucucuacaauccugaugcuucuuucuugcugcuugccuggugaccacugauugucagcaauucuauuagagguugggaaaaguagaaaaaauaaaguagaacucaguuuuucaacuaguuagaguauaaaaguuucugagauuuaguauauaaugcuuucuuucucucacuccucauuuccauaauaaucaggguuggaacuauaagucucuaaaaugugacauggcauuuggcccaguuuucaugguuuugcugcauaggcagcagugauauucccuccauugccauuuauuaacaaguucaauucuauuugcuucuuuuuuuuucuuuauugagacggagccuagcccuguugcccaggcuggagugcaauggcacaaucucggcucacugcaaccuccgccuucuggguucaaacaguuuuccugccucagccucccgaguagcugggauuacaggcgccugccaccacacugagcuaauuuuuguauuuuuaguagauacaggguuucaccauguugaucaggcuggucucaaacuccugaccuugugaucugcccgccuuggccucccaaagugcugggauuacaggcaugagccacugcgcucagucugcuucuccuuuuuuauugggacuuaacauccccauuucccucucagccccucccuauaucaguugaacuguggagucucuuggucaggauuuacaacacuuauucuuccauuuuguagacuugaucaucuuuaucgcugauuuguuuuuuaugaugccauugggaggaauugggcauuugguuuaguacauuuuuugggucuguuuguaucuuugaacuuaucuguaagacugcuauuaaauguuuaaaugggugaggaugaaaauugauauagacuuggauuuuuggugguugagaagaucauuuauguacagauacuuuuuuuuccccucuguccccuucucugggauaacagaaaauugaucuaaauacggggaaagaaacaggaacuccaauuucaaugaaggauguuuaugaggaauuugaugagaaaauagcaacaaaauauaaaauuaugaaguucaagucuaagguuuguauuuggcgaugauuuuuuuccagcucuguuuguuguuuauuuucugauuuagcaaauaguuauugcauauuuucuuuguguaaaaugccuucugugcagcuauaauuuauugaauggaaauuucauagguaugaauguaaaaacaguauauuagauuugcaaaaauauuuuuucuuucucuuuaaacugcuuauaaaauaauguuuauuaauuugaauagaaagacaauccauagcaaauuaauugccucuggugcuugcaacaugucuugugcucucauucccaagugcagaagaaacugcucugaucucguuuauauuaguuguugccaagauguuuugguuagaaaguuaaguaagguuuuauuuuuaaaagucagggacuaugauacagucugauagaaugaaaaucucugguucaugugcuaguuaugauacauugucuugauuuuagugagauauugaugucuuuggccauaaucgugggggcuauagccugcucaaaauacuggcuauuaauaaugaucgcaggaaggauugaguugcugaagauaaggcuaacaguauuaacuauuugaguuuugaauugccgcugaugagucaagucuuuauaauucuagaagcaauugugauauacuggugaagagcuuaggugcugaggccggacugcuugugguuuaaguccuagcccuauuacuuacuagcauguaacuuggacaagugcugaaugacuacuuuuuuuuuuuuuuuuuuuuugagauggagucuugcucuguuguccagguuggagugcaguggugcgaucuuggcucacugcaaccuccaccuccuggguuuaagcaauucuccugccucagccuccugaguagcugggauuacaggcacccgccacaaugcccagcuaauuuuuuuuguauuuuuaguagagcuggaguuucaccauguuggccaggcuggucuugaacuccagaccucaagugauccgcccgccucggccucccaaagugcugggauaacaggcgugagccaccgugcccagccgaaugacuucuuuaugccuguuucuucaucugagaaauagggcccuauuucaagaguugccggaaggguuaaauccauuaauucauauuagaugaugagagcaguccuugccagauagccaacacucaguaaauauaagcuauaauuauaaugcuaauuauuaaucuagcaagauggaguugcuuaauaucaaauaguagcaaaucauuuaaugcauuaacauuguaaaaaauuuuaaauuuuuauugccccucuugcaugcaaauauuucugaguucuguaguguccaagaugaguccuuuuagcauuuugacacugguuguuuuaguuccaauugaaagaggaaaggguaccuuuuuggcuucauuuaccuuuguguuccauaaggauucuugaugauuaaauacaagagcauguauuguaauacugguuaguuugugaaguuuuugucuuaaggauuuuuuaaaauaucuacuuacccagccaguggaaaagaacuaugcuuuugagauaccugauguuccagaaaaaucugaguacuuggaaguuaaauacucgguaagucaaacaaagaaaauuacuggguuuugcuugagaaugacauuuuucuguuuuugaacuuucaacugacuuucaguuacgaguauuggcagggcuucucaagcccacaguucauugagguggauuuauaguaaugaauaauugaaauggauaaaauuaauuuaaguauauagacuacagguuacacugccuuucucugcuuuugaguaugcaucuuuaaauaaauaaguugaaacagcacgacuguuugucaaguggaaugaaugccacaugauggaguuggacaucauuagucugcugaagugucccuuaugagcaguggaaaggugagagaggagugucaguagcauugcuauagugcugcucuugcuccugugacaggcaaggucauugcuauaggauguuaauuaacuggaccuuaaccucuuuuuaccucuguucuaguguuuuguucccacaacguuggaaaaggaaaacuuuuaagaacuauuucugacaguggugaugaaaaguauuuucaaugaguuccacucuguugcuuucauucuucuaauggagugguacuuacuuggcuauucuuuaucaguaaagcauguacagcucuggacagaaauuuucuuuugggggagcuucuuggccuauuuuucuucuaaugggugucaucaagaugcauuauuuugucauugugaauugguuuuguuuccuacugugaauuguuuuggauuucauuuguggcaaauuacauuucauauauaucaaagggguuuucuucugugcuucauagagaggcuuuuguuuauuucaaauauagacuuuggaaaaugcaaaguaauaguuuuaaacaaaaagauucuuuuuuuuuuuccuuuuucaggcugaaaugccacagcuuccucaagauuugaaaggagaaacuuuuucucauguauuugggaccaacacaucuagccuggaacuguucuugaugaacagaaagaucaaaggaccuuguuggcuugaaguaaaaaguccacguaaggaaaaauacaugcucagaaugcugaauagauugcugauagaugugguuuuuaaaagggaaguuaggaaauugaucuauuuauuuuaaugugucuacuuccuuuucuguuuguuucuucaguuuucguugagugaguauagggaguacauuuggaaucaccuuaucucgguaaugccuggcgguuuagucugagggaggccuuaguuuggggugcaucccucauuaugcuguuauucauauguacuucugaccuggcugauguggcccagcuguugugcauagugaacugcugaccuuugaaggagaggagaaucacuauucaauauggauagugcauguuuuuccuguuaccugauguuuuucaguaauugcuucuaugauagucugcuuugucuuaaaaauguuucaugauuccuccaaggcaguguuucaguuuuuuuaaaaccuauuuuggguccuggaugcuuuggagaaucugaugaaagcuauagaccucuuucccaggaaaaugaacauauguacacacacgugaggauuugcauacaacccaauaauguggcuuauuuuuaguuagauguuacaauaugucauucuuauuagaaggcaggguugaagaauaugccaguuaaugacagaugucuuaauuauaguaguuuuucuuuuucaguaaauagcuauugaucuguuguaucuauucucuuucagagcucuugaaucagccagucaguugguguaaaguugaggcaauggcuuugaaaccagaccuggugaauguaauuaaggaugucaguccaccaccgcuugucgugauggcuuucagcaugaagacaaugcagaaugcaaagaaccaucaaaaugagguuuaaaaaauaggacagauuuuguacccaugccuuagauguguuacuugccugaacuugcacagcuuugcuuuaagagaaaguuguucuuuuuggaggggaaagaauacuaauucacuacuaaacucuuauagagaaugaauugaauuugucuaguguuggaguuuuuucuuaaagacuuaaauugcugaacuuauuuuuauuuuugucuauuaaauuuuuuacuuaggagagcuucaaauggacacagacagaauaauaaaaugaacuccccauaccaaucacucauauucagcaguuagcaagauuuuguuacacuuguuuauuucccuccuuuuuuucuucuugaaguauuuuaaagcuagucucagacauugugucauuuucccugugaaccuugguaugcuucucucaaaaugugguauuucuuauauaauaccauuagcacaccuaauaacauuaacagugacuccuugguauaaucuaaaauacccaguccauacuuacaugacucugucucucaagaugccuuuuaaaacucaguuuguuugaaucaggauucacacaagauucgcagaugguauuuaaucuaugugccucuugaaucucuuuuaaacaggaagaacucacuccuacucuccaguuuuuuuaaugacauugaauaauuaaagaaucauuguugguugucuuguagaauaucccguuuucucuauuuauuugcuuuguuguggugucauuggacuuuuccucuauaccagggguuggcaggcaaucaauugucugugagccaaauccagccugcuaccuauuugugcaagucaaauuucacuggaagacagcauguuuacagcugcuuuugcacuaugacagcagaauugaguaguaacggugaccauauuuaggccugcaaagccuaaaauauuuacugucuggcucuugaaagaaaaagugugcugacccugccuuauccuucauauuuccgcauacuauaagugagcucuaaaggaucaaauuagauucagguucaacuuuuuuagccaaaaugcuuuauaggugaugcaguguacuucauauugcaucauaucagaagacacaaugucugguuaagcugcuauuaguugacaaaggcugggaucaguggaaaaaaauaaccugcuauuagugagucugugucugauuagcaguugaaugaaugauaacuauuguaauucuccaucaguuuuucaucuaagguuuuuuaacuuugacacuacagguauuuugggccggauaaugcuuuugugggguacuguccugggcauuguaggauguuuaacagcaucccuggucuuuacuuucuagaugccaguagcauccguccccucuaguugugacaaccaaaaaaugccuacaaacacaucaucagauguccccgggucaggggauguguauguguguauaaaauuacccccaguugagaaccacugagcuaauggcuucauuuauuagucauuuuugccggaauuaguuaauuucauuagaagucguaaaauggugauuuuuuaaaaauucuguccaugguuuuuaaauuuuucuauaaaauuaaauuuuuuucuuuagccaguauuauuugguuaugccauaaugguuuacacaggaaagacaggauaaaugcuuacuuccuucucuuuaauugccaguuguccuaguaggaaguugggaccuauauuacaugcagucgugacugaugcuuuauuuauuuauuuauuuuuguuguuauguuuuaacuuccuaaguccuuuugacauugauagggaucuuuuuuaacagcauuuugucaguguuuucaguauuuucugauuuuuuuuuuuaguauguguuuugaucuuuuuuucuuucuuuuuuuugagacagagucuuacucuguugcccaggcuagagugcagugacauagucucagcuuacuguggccucugccucccagguuccagugauucuccugccucagccucccgaguaacugggauuacaggugcgggccacuacacaugguuaauuuuuagcagaggcgggguuucaccauguugcccaggcuggucuugaaccccugaccucaagugaucugcccaccccagccucccaaagugcuggaauuacaggcgugagccacugcacccggcgugaucuuuuaauaauaguuaauacuguagauggccauaguucauaguuaaguguuugggagaaguuuaauuaguaguuaaaauuuuaagaaaguauccaccucuaguguccagaaugagguuuccacauuccauuuucuuuucuuuuuuuuucuuuuuuugagauggagucuugcucuguugccuaggcuggaguggaguacagugaugcgaucuccgcucacugcaaccucugucucccggguucaagugauucuccugccucagccuccugaguaacuggaauuacaggugugcgucaccacaugcccagcuaauuuuuauauuuuuaguagagacggaguuuccccauguuggccaggcuagucccaaacuccugaccuuaagugauccgcccaccuuggccucccaaagugcugggauuacaggcgugagcuaccaugcccaaccccauuuucuaauaaaaggaaauugggcgcucuggaguaauggcagauucagggaaggaaauguccaggauaagucuggaacaucuuauuauaccagaaagcaacgacaguauuaaaaucuacugaagauaugucaaaaggacucaggaaucaacuugaagagucuucuacugaacaaagaugggacaaugugaggguaagaauaaguugaacagauugcaacacaucagauccaugaguucauaaugauauugucugcaaugacaccacaucgaucacuucugaaggaagcuggggaaccaacucauuauuuugaaaacugauaaagggauugaaugaagguuuuugacuuuucugaacacaugcuauaccucaggcaaccaaauaauugaugaggggaaguuucucuucauagacgguuuccagcuaauaaaugaaagauaaauggaauaguaccacuuuguaauugccggugaaauaauggaucuaggaagugaucaccaguggguacuuauaucucuaagguagagaugagcagacauuaugugccugugccuuuggauagaaguaaucagcgccucuaaaguauucuugccccagaauugaaccugauuuugaucaagcuuuuagaccuaacuaugaauuuauagacaguauggagacagaaaaacaaguuaagugacacuguugggacacaaguaguagaauccauacuauggggcacucucuaggacaaacagccuaguuucuuuagcaaguaaauuauaggggaaugacagaugggauaggguuguaccuguaguuuuacauaucagccauuacaaaguaugguccuugugugguaaauaaaauugagauaauuggaaaauaugaaaauuuaaauucugccuggauaauuaaugauuuuaagaaauuacuauucauguaauuguauuaggugagauaauuguauugugauuauauuuuucaaacuucuuaucuuucagagugguggugguugucagcugggugagauuuugccucuaaggggacauuuaacaaugucuggagacauuuuugguugucacaacucagggggucugggaaugguaauacuggcaacuaguagggagaugcuggggaugcugcuaacaucauacagagcacaggacagcccccacaacaaagaauuauuuggcccaagguguuaauagcuccaugauugagaaacccaguuuuagagauugaugcugaaaucuucccagauaaaaugauggguuuggguuuugcuucaaaauaaucuagagagaggaaggaaguagguaggguuauagaugaguugauaauugaaacuggaugauggcuauacaggaguuaauuuuauuuugucuauuuuuaauguguuuacauauuuuuauaauaaaaaguuuaaaguauuuauuauuuuucgagacagagucucacucugucacccaugcuggagcgcaguggugcgaucucaguucacuacaaccucugccucuuggguucaagugauucuccugccucagucucccgaguagcugggauuacaggugcacgccaccaugcccagcuaaguacuguauuuuuaguagagacgggguuuuaccauguuggccaggcucgucucgaacuccugaccucaagugguccacccgccucagccucucagagugcuggaauuacaggcaugagccaccacgccuggccaaacuuuucauauguguuuaaauguguaucuuuaaauauucuuggugauuuuggugagaaugcagaauguauaguagcggucugguaaguggguuuuuuccuccuuucuuugcagauuauugcuauggcagcuuugguccaucacaguuuugcauuggauaaagcagccccaaagccucccuuucagucacacuucugugguauguauuuuuuuuuaagcuggcuuacuaacagcuugauuugaauuuccuuauuuuuucuccagcuauuggaucaguaacuuguuuuucaaaaauuguuuucaagaauagugcauauuguuaaagaggguuuuguuuuuuuuuguuuuuuuuuuuuuugccauggaaacuaaguuuuauuggguugguugccuccuauucagcugguucauuuuuuuuuuucuaggagaagucuggagucuauuugacaucuuuuuuuuguuucaaugguugcucuacugagguugaguaguuuuuuccugggucaaaauuagacuuuauuuucugaugucauucuaauagccuaucauagaagcuugaucaaaguuuucugugugaugaggcaagaugccaaggaauaaauauuuaccuauuugggaggaguuauaguaauaagaauuggaguuggguugugcuaugcauaaaauucaauggaugaaacaauuccaccaaguucugcauauguguuuuaugagucagucuccaaggaggauucugauauauuccauguugagagcuuggccaguuaccuaagcauuuugcuguuuuuuaaaaaagggaauaauaccauugaccuauuauauuuccugggaucuuuuucagcccagaagcagagauuaacuuggcgagccucucgucugguuuucuuggguguuaggaaaguaggacuaaaacaugcagagaagggaguaugagauaugauuguugugaaguuuucccccuuaaguggguggaacacauggaacaaaauggugaugagaauagccuggaaaauauguagaagagagcaaucaugaguucauuucaacacgcauuuauucacuuccucuauguacgucacuaugugaacagcuguuguguaugguaaggaacuuacaguguguaauaggggaagcuuuggucaauuuuaccuuuucagaaggcugaacugaguuucuccgcuguauguugcuugcggcauuggugguggugggauuuccuuugaggaagacugcuaaaaucuuccauucuggcuucaguggauagauagcaaauguuucaucaaagcaguuuuaacaacugcagggacuuaggguucugugcuugaccauucuuuugaggucaucaacaugaccaguggaaguauuugaugacccuccuaauucuuuaggguuggggggaauauauuuaagacaguuucguuuggaaacauguacuauaugauuaccugaaauuagacuaagauggguguuggaaucuuuauuuuuuuuccuuuuuacaguugugucuaaaccaaaggacuguauuuuuccauaugcuuucaaagaagucauugagaaaaagguaaagugcucauuauaugaagcaucuguuuguuuggagcgagaaagaaaaggggggugguauggacuaguagaaaaaagguguuuuauauuuuauuagauucauuccugccagauuggacuaugacaucgacccauuaaaauguauuagacauacaccuagaagcauuauuuaacaauguuuaaauguuuuacuaccugaaaauaaugggauucuguacuguauuggugguuggauaggcucaaaccccccuccaauagcuuaauuagaagcuucucuaaaaugcaugaucauaugauuccuguuuugggaagguguuggguagagucccuccccagcuugagggaagcuaaaugaaguugggaauacuguggacguuaaagagccauguauugacaaaguugacaugggguuggccaaaauggaucagugaucucuaaauuccagcgugcuccaugaagaaguuuucauggguccuuaauaaaauggggaggagugggaaguaguauaauguagugaauuuuucacaaagguaaauguauucaauuaaaagaauuuucuuuuauggauuguauguuguuucuuuuacgaagugaugauauugauacguuuuuagguuuguuuuguuuuuuaaugucuucaucugacaaaaguaagcaaccuugucagguucuacuuauuuuauuuaauuggcuugagaaguccaguaguugggagguacuguuagauuaggcuauuauuugugaagugccgugaauuaccuaaccagguaaaaugaccuaggaaaauuccauuagagucaaaccgacuuuuuuuuugagacggagucccgcuuuguugcccaggcuggagugcauuggcgugauauuggcucacugcagccuccacucccuaguucaagggauucucgugccucagccuccugaguaucugggauuacaggcucguggcaccacgcccagcuaauuuuuguauuuuuaguagagacaggguuucaccauauugaccaggauggucucaagcuccugaccucaagugauucacccgccucagccucccaaagugcugggauuacaggugugagccacugcgcccagccacuuauaauucuuaaauauguuuguuuuuagucuaguuucuuauuuaucaguucucaucuuaccauuugggauuauuuuauacaauccuugggauuucuuugcccaguaaauacauaaacagugaagucuaccagggauuauauaggaaaguaauguuuuugauagguacucugauucauaugcucuaaauguguccagaugcacaagcaugucccuguggagggacauuucuauauuuuauguugcucagcacuuaaaauauuuugcuuuauucacaugcuuauuacuagaaugagcuccucagagacuuugaaauuauuacuaugaaaccuacaaucaggaauuucauugcuacauuuaguuuugaaauggaugguuucuuuuaacccuaagaaaucuuaccauaguugaacaagaagccaagauacaguacuugcggacaguaaagagucgucagugacugguguguuuuuaucuaacagaaugugaagguugagguugcugcaacagaaagaacacugcuagguuuuuuccuugcaaaaguucacaaaauugauccugauaucauuguggugaguagauguuugaucauguuguggggaagcucuucauuucuuaguucuuuucagugugacuuuauuggugcuuuugagcagcaaauaaucuuuucagaguaaaaugauccuguggacuggugggaauugcugcuaauaggagaaaaaaauagcaagcccacugcaagauaguuuuuuuuuuucucuaguauaaaagcaaccuaugacuuaguguugaaguuaaggauugucuggcuauuuaugcuuagagaccagcacauaaauaaguaaacauguacaaauggaguuaucgccaaaauauugacuuaguaguuguauaguggucacaggaguuuauuaauucccuugguuuggugcaaaucacaaaacuaaguauuuuaauuuuaugaguucaguggaucucuaugacauauuccuuugaaaacucagggcucggaauugauuuuucucuugacgauccaguauauccccacuagauagcuugagcuaauaauucauugagcuauuuuuugccccaauuccugagagucauaaggcaacauuuuguuuuauauauccucuggccuuucuaguuuguagaauauggaauuccuucauuugucuuuuuucuagguuaauggaucaaucauauuguuuuuguuuuuucagaggaauguaggcuauaaaugccuauauuuuggaugugauauggguaauuuggguacauuaaagucuugcaaaaguguuugccguauucuucccuacauucauuuuuacucuuggauaccuuaucuggcaacuguauagcuagcauccugaguuccuguggauaggaagcgauaucucugcacccacuucccuuaugauauuucaagaccuaucuuuaaaguuccaaaaagauucuguccacaguguuggacugugacauucugucucagcaccaggcccucagucagccuccaauaacaacaguuucuuggaccccaaggagaugccaugaagccugggaaaccuggccuggcuucagguguuagagccaagucuaugcgugagaaaucuagauguaagauggaauucugacaugaauaugggucccugauucuagguauuauaauuuguaagugagacuuccucaaggccuuugggucuucuaauuuaauaagcaaaacugcuauaaauaucuagugguaaaauacauauaaaauuaacuauguugaccauuuuauaguauacaguucagugguauuaacuacacucauaauguuauacaaccaucaccacgauccaucucuguaacucuuuucauuuuguaaaacugaaacgcuguacucauuaacuucccauuccccggccccuggcaaccaccauucugcuuuuuguuucuaugauuuugacuacucuaaguagugguauauauuuuuaauuaaguuuaauaacaaguauauuuauugaugugaauuauuuuaaacuucaucuaauuuuugauaaacauaggaaagugaaucauguucacguguuggaaauuacggaaaugaaaaaucuaguugcauuuuugagauaauuucuacucuauauaguuuuguuucuuuguuuuuaacaaguuucuuauuugaacuauuuagugguauuauauauuuaucuuguugcauaucaauuaugagucuaaaucaguaguguuugaacucaauuuuuaaaaagaagcuaaaugcaguuccugaguuuucgaagaagucuuacauaaacugucauacaacaccaggcagguucuguguuuuuaaggaagcaaaauggaauuauuugaauuuagcuuuuaccgaucauaugaaaaguaugggacauuaaauuugcauuuuccuccgagaccguaaggcaugagcugcaaauuaaaagauaucauaugagccuugcaucaauuaggaugaaauaaaguuuauuccagcaaucugcuuagcagccuuguuaaugucaaggcuaaugagugcugcugaugaauaaauuccugaagaagaaaggacccccaaucggagguaagugcaugaugucuucaauuagagacuagaaaaagaaagggcaaagaaauucugugcguaugaagauaaauccucuaauuugcauuuguuauaacauuaucagcugccuucuuuuucugacuagggucauaauauuuauggguuugaacuggaaguacuacugcagagaauuaaugugugcaaagcuccucacugguccaagauaggucgacugaagcgauccaacaugccaaagcuugggguaauaauaauuuucaaaaucuuauuuaucuauuuauuuuaauuugggauagcuaccaaggaacacacuauacuuuuuaaaacaggaauugguuaucuuguuaugggaacuucaguacauuuuaacuuuggcacuaaacaucuuuuccuuugaauucagcauuuuauuuguaaaagccucugguaguuuuggccgggcgcgguggcucaagccuguaaucccagcacuuugggaggccgaggcggguggaucaugaggucaggagaucgggaccauccuggcuaacaaggugaaaccccgucucuacuaaaaauacaaaaaauuagccgggcgcgguggcgggcgccuguagucccagcuacuggggaggcugaggcaggagaauggcgugaacccgggaagcggagcuugcagugagccgagauugcgccacugcaguccgcaguccggccugggcgacagagcgagacuccgucucaaaaaaaaaaaaaaaaaaaaaaaaaaagccucugguaguuuuuaaaaucauugguuagaaucuagggauagugaacaaagacagcccauacauguuaccuucacuuugucauuccugaagugauagcccuuagggcaagguugcaugguucagaaaucguugagugcuaucauuuaggaagaaaaugggaagaaugaauggaagggaguugauguugguuguauaagaacgcaauauugcuugcugauaucuuguaauaaaaaaaaaaggaaaaaagaaggcaauaaacuaagugcuuucuguguuaguuaccucucaugacaacuccaguuuuauuuuauagacagucucauagggguaacguaacuuguucuggaucauguaaguaguaaggggaagaacugagauuugaacccaggccugggugacucuuaaagccaauguguacuuuucauucugccugcuugcuucauguauggagguuuuggcaguuuuuguaugaagcaccuucuuccuaaaccugauacugcucagugcuugaaaucuuauuuuacuuaaagcuuauaaauaaaauggacauguugccucaucagauaaguuaggaaucuguaccuuuuucguaauguucucuagaggauucugccacuacagaucaaaguuggggccacugcucuugcuucuuuucuuauucauaucuuuaaggugguagaguuguuauuagcacuucaucugaacacuugcuuagcuuuuuacccccuucaagauuuucuuuauguggcaucuucucagugagguauaccccauuacccuauuuaagauggcaguccccccguauuccuuguaccccucacccugcuguuuucccauuuuccauccacuuguuaccuccuaaaacuauauaauuucuuguuuaugaugucuguuuuuuauuauacauuucaaaugaggccaggaauccuuucuguuuugaucacugcuguauccugagugccuagaauaaugucagauacauaguaaauguucaaaaauauuugauugauguauggaagaaugagaguuuuaucauaauuuugggccagcuucaaaauagguuagaaagaaauguucucagugucugcucuuucaugaaguuugcuuuuuguucccaucuuguagggccggaguggauuuggugaaagaaaugcuaccuguggucgaaugaucugugauguggaaauuucagcaaaggaauugauucguuguaaaagcuaccaucugucugaacuuguucagcagauucuaaaaacugaaaggguuguaaucccaauggaaaauauacaaaauauguacagguaugauccuagauucuucagaauucaucugucuugaaauuaacaacagcaggacacuacuaguacuauccuuagucuggagggacaugagccagugguguuguagaggggaaauugucucuacuacuuucauaauuugaacuaguuuaccucuugaauuauuguaauugaucaguuuaucuccgucucccucaccuguguuaacacuaucuugauguuuccuaacaguaguuuggauuuagauuucuacucuuaauucauuuauucaggaauuaggguagauauuuuagaaauauaaaaacugagcaaucauuaaguuagagguauugcuugcuuauuucuuccuccuacuccucuggccaucucucauucauuccugcuaguucuuccugaguucuuucuuggacuucucuuuucugacuuuguucuuucucuaggugaucucauugagucuuaggaauuuaaauaccaugggauggcuaugcuucccaccuguguaucuucagguuagaccucccuaaauuccacacucaguguaucuguuuuaccuauuuuacuugauaucuaaugugaacucccagcuuguucaaaauugagcucugaucuucuauccuagguucuuccuauagucuuuccuuacuaaauuaauagguguauuuuuuccauuaucacuggaaacuuccagagucuuacuuagccccacaugucugaggcaucuuuaauuccucucucugauaucccacaguagaugcaucaggguauccuaucaguucuaucuucuaaauagaucuaagucugaccacuucuuuucaacugcauuggacccauccuauccaagcugcuauccucuuuccccuggauuacuggguuuauaugccuauccccuuacuuuugcccuuacccccuuguggucgauucucaauccagaaucagaguuauccugcuaaaaucaagucagaugugauacucugcucagaaccuuccagugacucucuguuucauucagaguaaaaacuaaaguccuuauuuuuacuuacaagguccuuuacaaugugucucuaugucguuaacucuguccuuaucucguacugcucuuuccaucauucucucugaucuagccauauuggccucuuuccuaguccuggaacugucagauuugcacgcagcucaggacuuuugaaugugcuauccugucugccuggaaugcucuuuccauaaggcuugcucccucaccucuucaagaucuucauucucaguaaaaucuuccacuguuuccuaacaaaaauuucagucucugcuucugauacuuaauauucccguugcuuaacuuuuaacauuauauaacauacuauauacuuaauuucuuuguuuuuuuuuauacucugucucccccgugaggacauaagcuccaggaggauaggaaguuuuguuuguuuuggucacagccaaugccuggcauauaguaagcaugcaauacauacucacuggauggaaugaaugaaaggauuuagguaguuuucaggcuuguaguuauuauauuacuucaguuuuuccuuaugggauuuugugugugugugugugugugugugugugugugcgcgcguguguguguguguguguuuuggagaaaagcauugggaucagugguaugaaugaauuccuaguuacauacugaccuuauuuuaaauuguuucugaagccaaggugcuguugcucugaauuuacuuacacccagaauuccuuauaauauuuugugaaguucugauuauaggcauuguuucuuuuaauuacuugauucuguuucauucuuacuuuucuguacagugaaucuucucaacuguuauaccuguuggaacacaccuggaaagaugccaaguucauuuugcagaucaugugugagcuaaauguucuuccauuagcauugcagaucacuaacaucgcugggaacauuaugguaaauuuaacuuagaaagggggaaaaagcauuuccuguuggauucaguguuugcuugggguaguuguuauaugauaaugagucuaaaugcaugcuuauaaaaugaguaacuuggauucugaaagcuggauuucuuuuguaaaaggaagaacugguugggagaaggggaggaaugccaggugcagcguguugaaauuugggugaacauacggaucaucucucuaacaucuggaugugucuuuuuaguggaaugguccauuugggaguaaauaaauagccaaguugucaauauuuuaagcucucuuugucuccuuuagcuauaaugcuuaaagaaaacguuaggaauaauuuaguaccuuuuuuuuuuuuaaaaaaaaagcagaccguuauuaggaauaguuuugaaggaggugcugugacuaaacuuacugacucaaaguugcuuuuguuaguugugguuuugagcucaaauuuaaaaaauaaauuccauuuaauaguccaggacgcugauggguggacgauccgagcguaacgaguucuuguugcuucaugcauuuuacgaaaacaacuauauugugccugacaagcagauuuucagaaagccucagcaaaaacugguggguccaaaacuguguaguauuuuguuuucucuuaaccccccccccccuuuuaauaccuagauagccuuuuuuuucugugauaacaucugcuuucaaaauagcuaaucccuuguguacuaaagaaaccgugucaaguuuauucccuuguuuuuguguggucauuuccuuuuccacuuuguaaaaggaaaaugcacuuugugcagacaaaauuauuugugaaaugugaaauucuuugagggaagcauuagaccucucugaugggugaccauacauggaauguguucuggcaccucagcccuauccaaagauaaaugccaguuaaacuuuuuauuuucuuaaaccuaugagccuuuauuuuuguguugcauuuuucuguacuaguaugaccaaggucacccacagucagguuucugaaguagccuccaucacuuuggaacuaaaacuuaguuuagcuacuguuuuauuagcacugauauuaauuaauucagaaaugggaauugaauguuagaauuugauucagguucucauauuugcuuguuuuuuaauguacauuaucaaaauugguauagggcauauucauuuagaggacuuuaacuucugcugagguauugaauguuggccaguaauaaacuacuuaggaauggauuuucaguauauggauguacuuguuuuaugguguccauauuaauaauagggauaaugauaauaccugcaugaaguauuuuauguuuuuacaucacgaauguuagaguagugauuuuaagagggcuguuuuauaaucucaaauuuuauauaacaugaaaagugguauuuuucaauauucauugauuuaaaaauaugaaauucuguaaauucaaaaacacauaaaaauagaauuuucauauuuguuaacucaggauauaguauuuguuuaagaaauuacuaugcuugggauucauuuggauucgugaacauauuacaauaacugucuuucccaacagauaggaccacuaacugaaauguuuguuagaacuaaguccugcaauuggaaaagagagaaucaucaaaauuuuaaauuaguuaauuaguugcuggcuggugaaguuaucuuuccauuugauauuagggagaugaagaugaagaaauugauggagauaccaauaaauacaagaaaggacguaagaaagcagcuuaugcuggaggcuugguuuuggaccccaaaguugguaaggcugggcagugaauugguuuucucccaguauuaaggaauuucuuaauguggaucuaggcuugagaaacuagaagacugaauuauaucuuauagaucagcgaauaggucucaugacuuuuaucuuucguucacgugaaaaucuugguugccagucaccugacauagacuuaaugugaauuuuguuaugcuguguuccaauaaaauauuauuuauagacauugaaauuuaaauuucauauaguuuucauaugucaugaaauauuguuuuugauuuuuuuccagccauuuaaaaauguaaaaaccauacuuaagcucaugggugguacaaaaauaaguagguuggauuuggucuguagccguaguuugucuaauacauagauagcuguccaguacauagauagcuguuuguccugaccaguucaguugacagcaaaguugaaggacgugcagacaauaaccaccaaauuuaacuuuaauaggagaauaucuuuuucccuauugucaugaauggcaaagauguuuugugguacacagagcuagaaauaauuuuuuuuucuuuuuuucuuuuuuuuuuuuggagacagaguuuuacucuguugcccgggcuggagugcaguggugcgaucucuacucacugcaaccuucaccucuuggguucaagcgauucuccugccuuagccuccugaguagcuaggacuacaggugugugccagcauacccagcuaauuuuuuuguauauauaaaaaaacauuucaacccuucccaaguguacaguucagcaguaguguuaagaauauucacauugcugugaaggaauuaaugugaauuuuaucuaauaaguuaguucugaguaggaaacauuuuugacaaaagugauuuuguuauuaguuauaaugaaauggagcaguaguacuugguguuauguaggucuggguuugaauucagugugaucuugggcugccuguuuaaccucuguaagccucaguuucuucuguaaaauagaguuaagaguaauaucuaccacacagggauuuaaggauaaauuaguauagugcuggacacagaauaaacuauccuauauguuugcaauuauuauugucuuaauaguggacauuuauuuuuauucaguuucuucucaaggugaagauaacucuuuguaaauguccuacagaaauauaguagcuuucuguucuuccuuugcaaguaaaaagggugggucguuccacuacugacauuuauauauaugugucucuuguuugauuuuagcucaguuuuuguacagguaaaugugccguccauuuuauuuuuugaagcuguuguaaaagaauaaauuacucuaccaggcgcgguggcucacgccuguaauuucagcacuuugggaggcugaggcaggcagaucacgaggucaggagaucgagaccguccuggccaacauggugaagccccaucucuacuaaaauauaaaaaauuagccgagcacgguguugcgcgccuguagucccagcuauucgggaggcugaggcaaggggacucacuugaacccgggaggcagagguugcggugagcugagauugcgccauggcacuccauccuggagacagagugagacucugacucaaaaaaaaaaauaaaaauaaaaauaaaccacucacuugguuuuauuugggguggggggugggagaguagguaggaggauucuucaaagaauucuugcuuugaaggagaguugaacauuuuuuuuuuuuuaauggaugugacacgucucagauagcugauugggaagguauuugcucauaauaauggugugcuuuggggacagcuggggaaaggacugguuguagcugguucuaaagagagacaggaucuuuuucucccucuucuuuugugaucuggcuuuucacuaauccgcaucauuuuaugaaaugguaguugauucuuuuuuucccuuuuugucuguuucacagcucuggguaguguauauggauaguauauaguuucuaauauacuuacagugcuuuuaauaaugauguuuugacaauucugcuuuucuuuagacuuuuuaugacguggcuuuuuaauuucagguuuuuaugauaaguucauuuugcuucuggacuucaacagucuauauccuuccaucauucaggaauuuaacauuuguuuuacaacaguacaaagaguugcuucagaggcacagaaaguuacagagguuuguauuuaaccugggacucuugaaauugaguuuaaaaaaauugcuuaaagaaggaagaucugugucuuuuuaaaauaguuuuauugugguauuauucauauaccauauacuucaccuguuugaaguguguaguucaguggcuuuuaguguauucccagaguuugcaaccaucaucacaaugaguuuuaggauauuuucauuauuccccaaagaaaccuuuuagcugucaccucccucaauccccaucccuuccaccucuaggcaacuacuaaucuuuuugcuuuuauagauuuguguauucuggacgucucauauaaauagaaucauacauuauauggccuuucgguaucuggcuuauuucacuuauaauguuuucaagguucauccauuuuguagaauguacuaguacuuuauucguuuguguugcugaauaauauuccauuuuauaugcgugugugguguauguguagguguauacacauacaccacauuuuguucuuuuuuguaauuuuuuuuaauacauggcagaagaugucuguuugcccucuagcuccugaauuuauaugucaguucucaccgcaagcuuaggaccuguuuuucaaucccaauuucauauucccagaagagagaaucugauagguuugccuagguuggugagcacuccagguccccguuaccugugaccacaagaguagguucacagggcacggaucuggcugcuaaggguggaccuuucugugggacuaguggauacuuuuacagagaagauacuggguagacauccccaaaagguaugacugcauucaauuaauauuugagcucuguucugcuacugugccagcauggugauaauuaauauuauuuagccucugcccaccaccauuuugcuuauuggagcuuuccagcuuggauucuggauauauaauagaaucauuuuagaguuggaagggaccucagaggucaucuaagaaauacuauacauguagcaauuuauagaucugaaucauuuucauacaugguaccucagaacaguuagugucacacagguaguaguuguagagcuaggaguggauuguaaacuuccugacuccacaucuuucaguuuacuuuuuaucugacuuucauaguugcuguaaauaaauuagaauguguaccaggaucucuuuaauagauuuacuaucaucaucuguuauauuggaaaacaguaggucccuauuacuauuguaacaguguucacuugaagauauugaucucuauaaaaucagaugcuuuguaaaggcuagguuaucaaauggcauugacuugauguacuuuaaaccaagagguuuauuuuuaauucugaaccuuugaaagggcaaaugugccuggcuuuuuucuuuguagcuguuaauagaauuuacggaggcuagggaaaaauggucuaaugcuuccccugcuuuuucuuccuguaaauuuuaauauaagaagacugcugguugcuuuucugaaauguugcuauucuucugccgauugcauagcaauuuauagguaaaagguacuacauaaauguuaagggauauguauguauuaguuuuuagaaaugucauggccuauuuaaaugugcuccaagcuccuuuuuuuuuuuucuuuuuuuuuuggagauggaauuucgcucuuuuugcccaggcuggagugcaauguugugaucuuggcucacugcaacuucugccuccuggguucaagcaauucuccugccucagccucccgaguagcugggauuacaggcaugcgccaccaugccuagcuaauuuuguauuuuuaguagagaugggguuucuccauguuggucaggcuggucuugaacucccgaccucaggugauccacccgccucggccucccaaagugcugagauuauaggugugagccaccgcuccuggcugcuccgaacucuuaaauuugcugauuuauuagcuuuuaauuauuagucuacagcauuuacaauaacugcuaugauucuccauaguuuuaaaauucuauagcauuuuguuugguaguaaaaugauuuaaaauaguaguuuagcugcuaguuauuuuguuuuuuuaauccuggaggucugucuuaguguuuguauuuuaaaaacaauuuccccaaacauguuguucuccaguuuuguugaagagagauagcauguguaaaaauguaucccuuuuuuuuuuuuuuuuuuuuaagacagaguuucgcuguguagcccaggcuagagugcaguggcgagaucuccgcuuacuguaagcuccgccucccggguucacgccauucuccugccucagccucccaaguagcugggacuacaggcgcccgccaccgcgccuggcuaauuuuuuauauuuuugguagagacgggguuucaccauguuagccaggauggucucaaucuccugaccucgugaucugcccaccuuggcuucccaaagugcugggauuacaggugugagccaccgugcccggccaaauguaucccuuuaaaugaaaucuaaauuugugucuaacuacaggggugggagauauugggaaugacagccuaauauaauugggagagaagagggcaaucaugaccuguucuacaacccucucagcucuuucuuauacuacucaugcauuauugaccuuguauaagauaauagcuuuucaagaugugaucaugggggaaagcuccuauaaaauauuacuguagaaauuuauuucgcaaaaguuugauuugugugaaauuuguuguguguuuaucaggauggagaacaagaacagaucccugaguugccagauccaagcuuagaaaugggcauuuugcccagagagauccggaaacugguagaacggagaaaacaagucaaacagcuaaugaaacagcaagacuuaaauccagaccuuauucuucagguauaucuuuucacuaagaaacauuugagugacagucucagcuuuuacaguuugauuauuuaugaguaaacaggaugcugggcaauugcagguacuuauuuuaaguuuguggauaggugaccauuuaaaaauacuagagugccucagaauggaagccaccuuuguuuacaaagauuguaucugagcaagauacuucuggcuccugggagcuuuggagucuguguuuacuugcugcuucuaggagguuagggaaucauggauccaggagaauggguugaguauauuaauucuuuuuuauucagggauauugaggguuucccuuuuuauuggagaucuagaaagacaucuaauguaaugcuuaaccaucuguaaauguuguuguuugucuuuuguucuguguggccugcaguaugacauucgacagaaggcuuugaagcucacagcgaacaguauguaugguugccugggauuuuccuauagcagauuuuacgccaaaccacuggcugccuuggugacauacaaaggaagggagguaaauggcguaauaacauucacaucucuagauaugagaguauuuuuaacuauacauguuauagugugggagagucaaguuuauuaccuaguuguacagcaucaaauacaguaccccucucuuuggaugacagguuugagacaaauaggcauuuaaauaagguuucauuaauucguguguguguguauuuauuauugaacaucuacugcaugccaggcauuguucuagguucucaggauagagugucaagcaagaccuaaacgaucccuguuaugaggcuuacauucuacccagaaugggagggguuugggguuggggacgacauggguugggaaugugggguggugagagggugguuugggaaaacagacuuuaaauaaguaaauaaacauguauaagaaauaacagaaaauaugauagaaguaaaugcucuguagauaauuaaaacaggauggugggcuagagaauguuuggauggcugguuuagauuggucagggaaggcuucuuugaggaggugacaugaaugagaaugacuuaagagaguuuuuuuuugcugauggauuagcuuggagugugagugaaagguagaaaucaggaggauaacuaguagagccuuuuacuaagauggaggaaacugggaaagaaggauuaagaauucugucauggauguguugccuuuggcaugaguaauagaauuccagacauaauaaggaggccauuggauguauagauccagaauuccaggaauacaucaagacaggaguuauggauugagaguuauuggcuuuaauaagaugggccagauaccaaauagaauuuagguacaucacuuuauggacacuguaagcuucaacuguuuuaguacuaugugcauggguuuuucuuaauuuguaaaagaauaguuacgcugaauauuaaauuccauuuaacucccugucuguggguuuaagacuauuuagccuuaaaggagguagguaguggucaugggaaaaaugcuuauauuggggggucuguacucugaaugcucuagagcagugguuggcaaaugauggccaucggggcaaaugcagccugccaucuauuuuuguaaauaauguucuauuggaacagagcuaaacucauuuauuuauguaucaucuguggcugcuuuuguauuacgagagcagagcugaguagaaaagauggaggcucacauggcccgcaaagccugauauauuuacucucuggucuuuuuuagaaaaaaaguuugcugaccucugcuuuagaguuuagaucaacucuguccaguagaacuuuaugaugaugaaaacguucuccaucugcacuauccagugcuguagucucuagccacaaguggccagugagcacuugguaucuggcuggugccaacuagcugaggaacuggauuuuuagauugcuuuaauuauaauuaaaaugaauuuaaacuuaaauagacaaauguagcuaguggcuacuguguuggacagugcagaucuagcugguauaugaaauaaacgucaggauguucagaaucacucuucuguuggcagccguaucucaaagauuugucuuagggcacagugaggaagggcaaaacauguauugaacgccagugaugugauagaagcuuuccuaugcauuauuucacugaaauuacacaagaauccuuugaaauagauaauaacguuuucauuuuuuagaugaggaaguuaaaacucaaggagauaaaguauaacaagugguuauuuugaauguaaauccuuuuaguacaguaggguugucucuuccaucucaagaugucauuuaugacucugguucugcuuuauauucgaccucuuauuacaggaagaucaugauuuuugguacccaucucaagacacaggucucuuuuuacaugagaaagauauagguguuuuaggggcuaguugaagugagggaagggaaggaugcuuucaguuucuuaagcuaaguuuacuuuaaaauuauuuaaauuuuauuucuuuacaaguauccaguggcuucugauggaauaccaucuuauuuuuguauuagaaaaugcacucacuaugccccaacugggugauaauacauggguugacuauugagauuggaucaagguuacucuuaaguuucucacgagaggcaauaguugacaauuuacucccuuggagagugccucuugcugcugggaaaucccuguuguuacauuuuccacauuggcucagaaauccacaagcuuaaaagggcacuguugauaaugauaagccccaaauuuguccaaugaucucccccacucuccuaauccauuggauuuuaagggcaaugguuuucuuuagcuggauuuuuaauagcgaguuuaaacacaauuuuaauuuuucuguuauauaaaauauaacaauaacaaaucuuuaauaaaugaacuauaaaaaacccuguucucuccacuaaaaaacaaaggauuucagacgaaucuagaacuacuuguuugugauuuaaauucuugguaucugcuuuccucuuuucucuuuacccuuugcuguuucccucaaauaaggauaaauaaaacucuggaaaguaggccuuuaaaguaauaugaggcuacugagaaauaauaauuacgcaguuucucccaggaaaucuuauucuagaagaagauccaaagucacuuacaaauauuauuuccuaauauaaaaaugauuuuuaaaguauuggugauaauuguuagcacugguggauggaaguagucuaugugauaucuuucuuuggguuagcgucucuuaauuauuaaagagguaggaggagugaagugaaaaugagagccagugugcugagauuuuggaauaccuuuguaacuuauuaaacuaguauuuuuugugacaagauacgagugggcagaauaauauaguaaccugcagaucuuacaaauucuuugcuuuuaaaguccuugugggauaaauuagauuaaguuucaaguggaaauuaaugagaaggaaaccugguagcaugccauugcaaaagauuauaaaauuuugcauuuggauguggauuaauacacagccuagggaggccuugaagcccccuuuuccuuuuuauuuuuaagucuauuuuguguuugcucaguuuuccuggaaucgugcacguuuggcucuagcgaccuaauaauuucuguaaucaaauguauuauggcugcuagaauacucagaguaauuacuaauuguacuuuuuaaaacagguuuauaauaaaagugcuaguaguugugucaaaugggcaucaauauugucuuuucacaggugugaucuuucacgcuuaaacucuuccaugauuuugaauugcuuugugguagaggaaugagcuaauggguaaggaauuguaugagggaucucacaguguguacguuauuuaaaaguaaugaagucaguguuucagaguacucuguggaucuauagaaauaccaucuguauuuguguuuguucucaauguguguguagagaggcauaaaaaagaaauugggcaagccuauggcacugaguggacauauauuuuuaaaccaugaagaaaagggguaucaguugucaaaugucugaugugguaauugaagugauuguucacuagauggcgauagacacccugagaucauuaaucaauuaaggauuuuauucugugaacaauagugaaggcaauuuaaugaguuaaaucuguccacauuuuagacuuuuauuaauuuuggaacuauuaaagaaaagcuaaaacuggcccaaaggauuguaauacucuaguguuuaaaauaauuaugauuuuuuaaucauuaguuauauugauaggaacaguaauuuaucauagcaaguuaauucuucuaucgaguagcuaaauucugauuucuggccauggagacacgauacaugacucccucagucacaguaucagaagcuaaucuaaagggaauuggaaaugauuuugauauaugauuuugccuuuuugaauuuguuuuuuuauugcgaaauuuuuuauuuuauuuuauuuuauuuauuuauuuuugagauggaaucucucucuguugcccaggcuggagugcaguggugccaucucggcucacugcaagcuccgccucccggguucacgccauucuacucucccucagccucccgaguagcugggacuacacuacaggcgcccaccaccaugcccagcuaauuuuuuguauuuuuaguagagacgggguuucacuguguuagccaggauggucucgaucuccugaccuccggauccaccugccucggccucccaaagugcugggauuacaggcaugagccaccacgccaggccuauuuuauuuuauuuuauuuuauuuuauuuuauuuuauuuuauuuuauuuuaagaaacagggucucacuuucuugcccaggcuggagagcaguggugugaucauaguucacugcagcauugaauuccuggacucagacaaucuucuccccucagccucccuaguagcuaggacuacaggcauaugccaccauccuuggcaaauuuauuuuuauuuuuuguagagauggagucuugguguauugcccaggcuggucuccaacuccuagccucgagggauccucucaccuuggccucccaaagcuguaggauuauagauaggagccacugugccuggcuuuauuggggaauuuaaaacugacuauguacuuauaaguauacucauugcauaacuuuaguuuaacgggaauauuugucuugauggaauaauuaguacuuacugacauugguauuauuuuauuucucuacucucuuauuucuguguccuugagaaagccauuuuuggucuggauuuuuuauugcauuuuaaaauguaugcucugauguuuagguauagaguccaugcauuuucauuuuccuaccugauaggcugaaauaagcuuugccagccugcuugccaguuggucguagacugccuggcuuuuaguuguguuggagcuggaauuugugcacauuaaaaguguauccaaaucauuaaugcaaacauuacaaucuuggcaagccuuucugggauuuucuuggugaugugguagcaccuaucaggaucccuugggaaauggcacuaggacagagggcucuagccuuuguugauguuggugaugaaagagaaugagugacuaugaagaauuuuacaauuaaauauuaagagaagucuuucaucuuuaccuguaaauaaccaaaaauuucacuuuugcaaucuuuuucuuucuuucuuucuuuuuuuuuuuguggggggcaggggggcagaguuucacucuuguugccuaggcuggagugcaauggcgugaucucggcucaccacaaccuccaccucccggguucaagcgauucuccugccucagccucccaaguagcugggauuacaggcacgugccaccacacucggcuaauuuuguauuuuuaauagagacgggguuucuccguggucaggcuggucuugaacuccugaccucaggugauccgcccacuucggccucccaaagugcugggacuacaggcaugagccaccgcaccccgcugugaucucuuaauagccuaguuuuucuuuaaaaaaguaaaagcaauaaaauauuauagagacaacuaaagaccauuuccuccccauccucucucauuucuuuuucuuuuucggagguaacuugcccagaguugguuuugucauucuugcccauggguuguucuuuuuugcuucugcaacguguauauacaugugguguguuaaaaguuuuuaccauguaugugucaugcuauacauauucuuuugcaguuuggaaaagcaggagaaaaacucuacucuguaugccacauuuuaaguauauucaucuugauacauuuuuagauuugauucauucauguuaacuauuguauaauauuucgaugaauauagcacaguguauuuuuuaauucugccaucauccauaucuuuagguuuccaaguuuucauuugucuuaauuauuugcuguuacaaacaguacugaaguagacaauaccaccuuugugagaguuucucugguauauuucuaggaguggaauuuguacaacauccacagcaguauaugaggcuuuauugauaagagcagccauuuaauuuaucacagcaagcucauuuuuaaaaaucaaguagcuaaauucauaugucuggcuggagccacaauacguaacucccucagucacagugucagaggcuaaucuuaagagaauuggaaaggauuuugauauacaauuuugcuucuuugaauuuuuguuuaguucucuguugaggcauuuuaaacuuacuauauauauacuuagacuuguugcauaauccuugauauuccacauccuugcagcacuuauuaucugaguuuuuauuuuuuggucagucucauggguaugaaaggguaucucauugugauuuuaauuuacauuuuaaaauuauuaguuaaguugggcaucuuuucauguguuuauuaacucuuccauuuucuugucugaauagaacauagauguucuauuuuguuggauuguaugucucuuaguauucuuagguauucaaaagccaauccuuguuuugucauuugugcugcagagaucucuuucagucuguggcuuguccuuuuacuuuauuuguagucuuucauuaugcagaaguuucuaauuuuaaugccagauauuuaauuuuuuccuccuuacacuauguggguuuuuuucccacaagaaagcuuucccuccucuagugacguagacauucuccccuguuuucuucuaaaaguugcaagguuuggauuuucuuauuuaggucuuuaauccuucuagaaauuauuuuuaggaaugauacaaguuaggaaucuaauuguacuuguuugcuuccuuguagaguuauugaacguuccuguauuguuccuguauuccagggguuggcagacuuugacccaugggcuaacucaacucaaaacugccuuuuuuuguaaauuaaguuugauugggacacagcccuacccauuuguuuauggcugcauuugugcuacaacagcagaguugaguaguugccagagauacugagugaacuccaaagccuaaaauauguccuaucuggcucuuuacagaaaaagcuugcaaacccauggucuaaaagauagucaugaaagaguagcucauauuuccaacaguagcagauauagucagugaaaauagaggaaauuacacuaaagguuguaagaaggaaggaaaacaaucuuuuggacauguaaaaaauacaaaguuugggccgggcgcgguggcucacaccuguaauccuagcgcuuugggaggcugaggcggguggaucaccugaggucaggaguucaagaucagccuggccaacauggugaaaccccgucucugcuaaaaauacaaaaaauuagccgggcgugguggcaggugccuguaauccuagcuacucaggaggcugaggcaggagaacugcuugaacccgggaggcagagguugcacugagccgagaccgcaucacugcacaccagucugggcaacagagugagacuccaucucaaaaaaaaaaaaaauugaaauuuuacugauucuuagauugucauaugagaacuucccucaacccaaguagaguaaaggggaggucugugaauccucugaaguuguauguaauauuuugugugucugugcauauguguacuuuuuuggaggagaggaugcauagcauuuaagagacucaaaggggaccaugaugugaaaaaugauaaagaacgcugguucuuauguuucauuucuggccucuuauguaacuugaggggaaacuuuagccuuaaaaauguauacuuuugucaccuaaaacauggcagugcgaagaauuuucuugccaaaccagacccauuuaaacugugugggugguaggagggaugaguucuaauucugucuccagaauuuuuauagccaccauuaagacuacuuuuaacuucagcugaccuacuaacauuuugauuuuuuuuaauaugagaauuucuuuuaaggcuaauaugaagguuuaauguauuuuggcagacauauuuuauguuaaaaaaaagcaauauccuuuguuagugaucaugaauuaccuaucacuuucaaaguugcuuacauuauaaaauuugaagccagauaauuuuuaaauuucguuucuauugucauauuucagggauguuuggauucuaaauucccggcaguucuucagaacugauaacacauacuauucagcuuuauuaauucacauucuacucauuuagaauuugugguaauucagauggaaugaguugaaauucuucuuaguacacauuaauaguuauuucagagccuagguucuuuucauauaccauuaaaaauacagguugagugucccuaaucuaaaaaucugaaaugcuccaaaaucugaaacuuuuuuuuuuuuuuuuuuuuugagacagagucuugcucuguugcccaggcuggagugcaguggugcgaucucggcucacugcaggcuccaccuccuggguucacgccauucuccugccucagccucccgaguagcugggacuacaggcgcccgccaccaugcccggcuaauguuuuguauuguuaguagagacgggguuucacuguguuagccgggauggucucgagcuccugaccuugugaucugccugccucagccucccaaagugcugggauuacaggcaugagccaccgcgcccagcccaaacucugaaacuuuaagugccgccaugauacucaaaggaaaugcucauggagcauuuuguauuucagauuuuugaauuagggaugcucauccaguauaauguaaauauuccaaaauuccaaauucaaacacucugguuccaagcauuucggauacucagccuguacuguagaaacaacuaucuacauuuaaguaaguggcauuuuaucugcagaucguuuauauugaugaacuuguacuaaggaaccaucuguuugcuuguccauuugucuacauucuuucaaaaauugaugaaaguaauguugguacuuucaaauaaaggugaaaaaaggaagcuguaauuuggaaacaccccauggaagcccaguccagauuauaacuuagacuuucaguaauuugagagaaaugcgaugauaaaaauucaaguauauagaauaauuuaugcuuauauaugcuugcauuauaauaaacaauauauacuuauaugaaaaauauaugguaagcauauaauauauauguuauauauaaucuauuauaacaguguugcauuuauagagauuaaauaaguggguuacacuuaggcuugauuuuaauuacucuauaugcuugaaaauacugaguauuucuuucaaaauggcuaagauguuagacuugagacaaauucagaauaaccuuauucuucuuucuuaauaguuggaaacuagcauaucucuaagaugcauggauauuggccucugugugccuuuuagguuuuuggacauugaaagguacagguuuaggaggacacaagccaguugauguaagagacagcugggaagagaaagacuaggucaaaucuugccuggggucugugaguguaagagaagaaagcuacaucaaggaggccauuuagccaucuuuuguuuauccccuuugcauuugcugaaguuuuuuguuuuuuguuuuuuuguuuuuuuguuuuugagacggagucucgcacugucucgcuggagugcagcaucgugaucuuggcucacugcaagcuccgccucccggguucacaccauucuucugccucagccucccgaguagcugggacuacaggcacccgccaccgugcccggcuaauuuuuuuguauuuuuaguagagaugaaguuucacuauguuagccaggauggucucgaucuccuuggccucccaaagugcugggauuacaggcaugagccacugugccuggccugcauuugcugaaguuuuugaguggucaccacaucuuaguuuuaccugugcuuuaaggaauccaggugugggcacccgcaccccucuccuacacauacauuauacuacuaagugucaaagguaauaagauaugguccugggguugugaguuggccuuuccagucuugcugaaucuucagucaauacuaaucuuuaaaauuccagggcuucuuucaucaaggaagauggaauuuccuuauucucaauccaaauuugugccuuuuuccacccauauauuggauuucuuauuacuagauuuuucacaugggucugcauaaacuaguaucaauacuuaaaaauuuuguauuaacacaaaacaaaagucugcagccucaaauuauuucuguauucuccaaccucuacuucaguuugucagggagugcauuucagauguuuuuuuguucuaccuagccccuaagcccugugcucuacauaguggauguuuguuugccuuaccucugggaucacacucacuugguaguuucuguaguuauagauggguagauagggaagugguauauuuuuuaaagaaggucuugauauuuaagccuauuuugaauuuauaagaauggccaggauacucaaacaagaaaaaggauaauucguacauuuguagugggaaccuaggaacuuuuaucugaaaagauagggacagaguauuuuugccuuguaauuuugccuuuuuaauuacugaaaccauugggaauguggcuaaggaugagaagauaaaugcuauuaagacugaccuugugucagcaccacugaucucugcugagauagauuaaguuucauuacuuugacuagaaucacauaaauugaguccuggaaaucuuuuucuuccccaccccucaccagaaugagugacuuuguuaacccaaauucauuccauuuuucuccauaugugaaaauuuuaaauaaaccuauuuugguaucuauuucuuuuucacaagccauguguuauuugacagguguuuugaagcccuugcuuuggcagugaaccaagaugacagagcaguaaugauuuggaaagugccauucccuccuuguuaagcgauaaaaagaaaagugugaaguuauuaaccacuauucaccaguggcauagaaaucgguauaagguuuaauugucugguucuacaguuggucuagguaggcaauuuccuggauagugcuucucuuaaggaaagggaagaauaaucauauaacuucacuuuuuucucccauauaauuuuuuuuucuucuuuucacaaauugcagauagauggauuggagagaaaggaucacuagaaaaccaaaauauugaccucacaggcuuucccuuuccucaucugcccagguauacauuuaugggugacauggcagcacucagcaacauugcaaauuucccaccccccaaaugaaucacaugcucaaguguuugaaucugaugguguacaggauguuaccacacugucuccuuauguuagccaugcugagucuauuuauugcuaauuggaaaaaccuacuuuuggcagccucggcugccugguggcuuuagcauacccgucacaacaguauggucagacccauuaaagacacaucccugucaaauuuagaaaacaaaacaagcucauugggcuuguuauggcucaggaccagcugacugagggaagacuaauagaauuaguaccuucuguuuguguguuaucauugcagugggcagcaugagccugugucaauuugccagaucauaaauacuguguuaaauuacaaugaacugagauugguaaguugugggaguuuuggaaggcggggagaagaauaguuuuauguaugugugaagaagccguuugauuuucagccagggauuccugagcccuguggucaugguuuuagagaucuuagacuuacuuugaaauuuaguaccagagucagguugugcagcuguccuuguuuccuuuuuauuguuaauuuugugguugaauuggcuuguaucccuuuuaaacuugaauguaugagucucaacauuaaaauuuuuucuuugaaaauucuguuuuaaaaagcaauaugaaauagaauguagcugaaaagugaauuuuuacucacauuuuuaaaagagcaacaaagcaugagugauuuccagaaaugguuucugugucaucuuuggaauucuucuaauuacuaauucuucuuuauaggcuuggguuugauuuuguauuaccuguuuuuauuggcuuuguuguuuuacauuugacaaaagauuugcuguuuugaggcuagugaugagauugauuuauuuauuuuuuuauuuauuuugccuuaggacuaagaguugagcggagaugggaguggaacaaagauauuagguuucuuuuaugauuuggagugucagacauuuggcuauauuuguuucauggguuuuucaucgcugcugacuuaaccacagacgacauuuucagcccugugcaggaggguggugugccuucugcaggcagggaggaggaggguuggggugugguggcuuagagaaaggaaucagcucaugggcuauuaauaauguaaauuguucuugaggccacauguaacauuucugagcccugaccaacaggguagggugcguguucuauuuacauuggacugcauggcacgaugugauggauagcugauaaucacaggaaaaauccggguauuucuucuuuaaugauguccugauagggcagaaaaaaauaauuugucuucagaagauuggcuuagaguggcugaauauauuuaauucaauuacugguucuugccucauagccaggaauucuucaagugauauuugcugaguguguacauggagggaaauggagacaaaugacauugcuugugacccacugccuugagaggaaagccuucgguaaugauuccaguaaaacuagagcuagagcuugggaagcuaaacuugugauuacuuacuaguaaacaagagaaaggaccuguuguaggugcaaaaaucuuacugaaaugccugaguaugcacuggagaaagcccuggacugcacaccaggggugcucacccacuuguuuacuuuuuguggcuuugagcaagucauccauucugccuuugguuuuucacuugucagaggggugcuagaugaugauaauuacugcucagugggcuucaguuacaaagcaccuuaacauagaguagcuaucuacuguuguuucucagaacaacccaggggaagcauucgugcaaggcuccgaguaccuagcaagugucaggcaugccacguggugcugcuguuagggagacagugguaaacuuaagcauucaaggaccuugucuucauggaguguucaguccauuaggugagagcuguuaaucaaauggucaaugaauaauuaugucauucugaaagaaaauaagugcuaagaaaaggcacaugaauuucugagucuugauagcaaaggcccuugaccuggacugaaaagucaaaauuuuccugauccuuugguacuugagcugagaucuagaaagugugggcuggaguuaacuagguaaagaguuggaagaauaagcauucuagagugagggcuagcauguguagagguccuguggugguuggaagcauuauguggccagggcacugagaaggcugagguagcugaaguauagaaaggaaggggagagugauaggaggcaaggcuggagggguaaucaaggucacaccauaugggcuuugcaggccacguugaccaagaggcagauguuaauaguuuuuuggguuuuuuuuuuugaggcagagucucgcucugucgcccaggcuggaguacaguggcaugaucuuggcucacuacaaucucugccucccggguucaagugacuuuccugccucagccucccaaguagcugggacuacaggugugcgccaccacucuuggcuaauuuuuguauuuuuaguagaguugggguuucaccauguuggccaggcuggucuagaacuccuaaccucaaaugauccacccaccucagccucccgaagugcugggauuacaggcaugagccaccacgcccggccagauguuaauagguuuuauauguugggggagauuggcucacauuuccauuuugagaagaucacuuugccucagugaguuggaggggccagaguggaugaggggaaacugauuagcaggcuauuauuagaauagaauuccaggcaagugauggugguagcuugacuagugugauggcagucaguggagggaggaggacccagauaugagagagauuuaagagaaaaaguaucaguaaaacugggugguauauuggauguggggcuuaggauggggaagguaucaaggucaacucuuggcugacuuguguaggaagauggaguaccuuucacugagaugaagagcacuggaagaugaccagguuuggggcaggaggagggaaagaugaacaguuugaucguagacauguuaauuuugagguugcagaauauaaacuggggagucauugguuuauagucauuguuaaaugaagccauggacauggaugagauuacuuugggagagaggagagaguggaaagagaaguggguguaggacucagucuuaaggaaccccagcauuuaaugacuugguagaggaggacaggcuuuaaaaaguagaccgugaaagagcagccagagaaugagaagaggugggaaaacaugguguugugaaaccagugaagagcauuucagggaaguaguaggcaacugucaggaagagacacugaugauaguuuugaaaaauuuccauugaauuuugggauauggaggugaucuuuuacuuuaguuggugcuguuugagugcaguaaugguggucagacugauuugcuauaggaagauaauguaauuauccauaguuuauagaucaagaaucugaggcacaaggaaguuacuuguaaaacagcucaccuaagugucagaacuggaauccaggcucccuguucuguauaccugcuaccuacagcuuacugcuuuacuaggugaguguguggacugaagaggcaaacacagcugugucccuguuuugcuucucccugaguugggaucuauuaacuaguuacuuaaccucauugacccucugcuuccucauuuuuaauaaugguaaaugcccggugagguuguugggaaaauuaaaugagauaauguguguuaaugccuugaaaugcguuugauacauaauaaguacucaguuaaugcuagcuaaaaaauaaacaaccuucuaccguucugucugcccucuccucagagccucuuaccuccaauuacauuuuucucuuguuuaaugcuuagcagucuucucuaaaaaggccaguuuguaugcuauuugcccaguuauuuuucaaguuuguguuuuuacuuugccauuucuccugcuuuuagugccuuuguccaccuacaccacuaauuucuguguaguguaauuucugucagucuuccucaaaacucacuuuuuaugacugauuuaaaacugauuuucuucacucugcaacuuaaugagcucagcuuauguuuacauuuguuucuucuuaggagcuugauauucaugaguuugcgaaguuuguucacucaguuuuacuaaauagauucaggggccaggcauguuuuuucauguccuucagcaacauguaguagaaugcuuuaaaguaguggguacaaaauggcaaacaguauuuuuaugcuauuuaagaaauagcucuuuccugucacuuucuucucauuacagucguaaggugcaguuauuacuaaguccugccaguguuacuuccaaaauauucggauuaauccauuucucuccauugacacugccacugcucugauuaguuuagaccaccaucaucucuggccaggaucacugcaucagccucccuguggugucucccuucuacucuugucccccccaaucuauucucaacccuauauuuuuaagguguaauugcaucauaucauucugcuuugauuccucauugacuuccuauuucaguuuaccuuggacuccaagguccuacguggaucacuucaccucuccuuuuaccucauuuuugugccuccuaccugcugcucccucaccugcaccccugcuuuaguccagccacaugggcuacccuguucuuucaguucuucacacacaugaauucugucccuccauagggaccuugugcaucugguuuccucugccuggaaugcuccuucccaggcuuggugcaggguuguauuuuucucucuucaggucucagcuuauaugucaccuucuugugugugcgugguguuuuuuuuguuuuuuuuuuuguuuuuuuuuuugagacagagucuugcucuauugcccaggcugaagugcaguggugcucuuggcucacugcaaccuccaccuccuggguucaagcauuucuugugccucagccuccugaguagcugggauuacaggcacgcaccaccacacccagcuaauuuuuguauuuuuuguagagacaggguuucgccgugguuggccgugcuggucuugaacuccugaccucagguuaucuaccugccuuggccucccaaagugcuggaauuacaggcgugagccacugcgccuggccuuaugccaccuucuugaugagaccuuuccugacuacucuuucuaaauagauccauccagcacaccgccaucucucauuuuuaaauaaaaaauuuuuucucacuaauuuuauagggugaaauauacccaugugccaauuuuccagaauuaauacauguuaagauuuugucauaauuauuucagauuuuaaguaaaagagagcauuacagauaguugagguugguaaugugugcccuuccccaguuuccuccuuuccucuccagaggcaacuguuaugaagcugauauguaucuuuccuuuuuccauguuuuuguuaccuaugaaugugcucacuuaauuuauguggaugguaucuuaucauuuuucaguuugcaacuuuuuucacucaacauuauauuuuugagugauauccauguugauguauacauaucugaucacuuauuugaacugcuguauaguauuccaucauacaaauauucuacaguguauuuuucccuuucucaagugauggucauuuagauugucgucaguguuuuacuguuaugaaaaguaagcauuccucuacuugucuauuuguacacaggugcaagaguuucucugucaugaucuuuucuagcucaacacccuguuucauucccauuuuggcacucaucauuuuguaaucacugacuuauguguuugcuuguuuauauacaucuuccuuauucagcugugagcuccauugggguaggcaguguguuuaacucacuccugcaaacacagccccuagcauagaccuugacacauaguaggugcuucguugguauuuguugaauuaagucagcuaccugcuuuccaucuguuuuguguaguucauuccuuugguuuuugagcuuugguuuucagauuucugaagaaaggugaagacugaugaggugaguugccaaauucuauggauagugauuauaggugauuagguaaaccuggcaugggaaggagcugaggaaaaaaagcuauaaauaauuuguuuugguuuaaacaaaccaaaaucucaaaauuuggagaugaugguuggcaaggaacuauguguacuaguuuugguuauugaaggagcuggguuuaucagcugugggcuccuuccacaucuguaucauugccuuauuauuauaggauuuuggagaggggugggaggauuuuguguuuauuuucuaaaauuauucuaugugaaaauuagaaaauuagaauuaugguagguguaggagauauggaucguagauuaaaaagcaugagaagaaauugggcuguugaucuuaaagcaagauuguuuaaaucaauuaguuuuuuaaaauucuccuuuuuauuagaguucacugaaucagugcauguguucuguguuuucuguuugcuuuugaagcuguucaguguuuuccuuaccaucauagacuucagauuuaacuacuugauguucaccuacugaauucacauguagagaggaaagacgaauucacgggaacaaacggauuucuuaaaauggagauugcugcuauaaucacacuuuggaccucuauucuaguacaggacaucucauuuuauccacuaguagccuguguaagccauuugcugauaaauugaaucacuguaauuauauuugaaguuagcuauuggaggaaaaaauguagcuauaguuaaauacuaugguaaugccuccuaauuuauucuuuuucauuuuggaguauacuguuucuccccuccuccacucaguuuaguguggcacauuugacugcccgccccccuuagguuggguaucaguuaugaacuuccagagagaauuaggaucuggucucacugucuccuuugcauguaaauaguaaauaauuagacaugcaguuaaauuggagacaauaauagcugagauauauuaagcauaugauccuguuagacacuguucuaagcacuuuauaugaauaguaaacauauaagcacaguccaaaaaauuuuuuucuaacuguauaaaauguaggagucauguuauuuugagguuuaugagaaauuguaaucuucaauuucuaguuaguggaggugggcguggaggagaaaauguuugcauuuauuacauguguagaaauguacugaacugagaaaaucuaaaugguuacaggcuagucauuucuuaguauccugccuauuacucauccacucccuugguaaaagcuuuacccuguuccuauaagugggagcuggguggaggaugggaagcaauccucaauugaguuagaucugacuuugcuugauuguguggcaaguuaguaugggguuuuaugucauuauuuuauuucccuuuuauaguugagagaacugaaguacagaaaguauaaguaacuugcucaagaucacagagcuagugaauaaauggagccauaauucaaaucuaggcaguccaagcauucuuaacugccacaguacauugccuguguuuuugaguauuugccugugcaacaggcauuaggagaugggagaaaauaguguuguaucuucacaguacuuggagccauuuuuguuugaaaggauguguacuguauuagugugugucauccuggguugguuagcauuugcugccacuuuauagauuuucugagagcuucaauuuuccuuuuauauuuccucagucuuuugacagcagucauaauggaauuugaauggucauaguuaauguggccuuuggaacagaauucuuaaggaagaggauugggugaugaagcaagggugguaagauggggaaugaggaggaauucuuucugucguauguauuuuguggaauaaaauagugaugccaugcaccacagcucaaacuuggcaugguucuggaagaugucuuuguguagccugucuguaccacucaccaucuguuauaauggugaaggucauagguuguuugccuuaagcagaauaaacaaauagauacagaaaauguauucaguaaucuuugcuugaugagcagaagcuagcaguuguuuaaaacaagugaaggggauaaaaacuccccuaacuuuuauuuaccaaucacaucgcaaagcaaaaauagccuauuuuuaggcugaggcuccaauuauguuaagccuugaagauaaugaaacagucugacacaaaagaguguggugacgcaaguuuguguggugaaauuccaagacacucacugacuuuuuaggauucugcacggugaauauuaagcuccuaaaguguuuguugcccggaaacagcgcuuuauucuuuuacaugcaguguaaugaagugaaccuguguuguaauuuguuucuugcaaggaaaagggagaauuaacacacauuaucuaucuuuguguccugucuuuggccucuugugugucccuuuuaugugcugaagccaccaagucaugcuauugcuaauacugcauauuaccuucuguuuuagccacucuaauuuuucuuaaugcuuuacacaguagggguuuccaguuuuucaacuaauuuuguauuguagauuucaccgaauuuggaggguuuuucuuuucugucacuuuuuccucauucuauguaagaauuacucuuagcuuuuggacccguucauaaucaugucaggugauguuuuuccuuggaacuaauuaguuucggggguuugaaauaugugcuggcacgggguuucauuggcuggauuaauggaaguuggccauuugugcucucccggucucauguugcccuuucuauuuacagguugguaaugggcuucuggguuuuuauucugcugccuguagucuucuugaaaaugaaccugaggugcugaauucucaugugaugggaaguguaaugcuuccuuccagggcagccugucuucuuaauuccugaaucuugcuauagccuaggucccaaggaaucagauuccuagagucaggagguuggucaucuuccauuuggucucagaauuuuccuuuccaaagaguagucauaagaacuaaaugugggaaggcagaaggaaagaccuaucaacaucaaggugccaaaguuacaagccucuggcauuggugguucauggcaggauuugaugaaguuggggagggaaggggacuugaaggggauaaaugaacuccucauuagauucagauugaagugcacugaugugaccuguggaagagcugaaaacauaaaauagcacucaggugauugauaaagacagccugguuggaugaaguggaagcuaggaaaucucuggcugggugccugcuauccacguacaguacuuacucuauuucauuuaaucuccugcagcccugcgggugggggcucuuauuucuuuuuacaaaugaggaaaaagucuugaagggauuaaguaaauugccaaggccucuuuauuuguaaguggcuaaaaugaauauggcuucucacauuugugccacucuucugaaauacaggaaacacagacaucaacaguauuuaucuuuguaugcuuacuaaggaaaauacugugugguacaaccacugaaaaggcuauaauagcuuuuuuguuauugcacuuuaacagagagcucuuucuuaaaauuacagauuuuuaggaccaaauucaguucagucgucuggccuacuaugugccagguacaguauugaauccuggggauaugaaggugagacagaccauggucccuggucccugauuauagucugaguugggaguagagguggagggaaaggaaagaaauugcccugugaacaaauuccaugccauaugacuaagguaaauuuaaagaaaaaaggaaagguaaacauugccuagagauuacagaaugaugcccaugcccacagaauaucucuuacugugagauccauugauucuuuggucauugccaggauuuguccagagagguacgggaugucgucuuuacagggugaagcccaagaggaaccauauuauguuacaaacuugggggcuuuucuuuucuagcuagaggucuaaacucaggaggguaaccaaguuuuuuguuuuguuuuguuuuugguacacaaagaaucuucuguuucuacauccaguaaacuuuuuguuuucuuaauuuuaaauuguccucaggcuguaccuuuccuuacccccaucucugaccaagaaggguggcagggaagggggguucuaauuccaacucagcuacuaauuuaggaggugaccgauaaccucuacaguuccaucugucauagugccuuucacauaacugguacucaauaauaaguguuugccaugggacaacagaacuugaaaucuucugugauuaauuuguauugauuuuuggggggcaggaacuggaaggggguuaguuuuuuuuaggaugaaaaguugcugccucacauuccauaacaguaacacaaauuauggauaaaucauuaaguauaaaucacaacucaagauaagugaaaaaaauuuucaaauauugaagaguucuuuuauaaauuccaucuccuagugagaugcauuacaucucagcccagaaugcugaagguucuugugauuccuagcacagugccucaucuuugguguaugaucagugaagaauaauacaauuaugaaaugacuacuaguaaucucugaggacuucugaggauaacagguguucugaaguuugccaaacuuggagaccaccuucccuuccuagaacagauuucuaggaaaagucuucaggucuuuuugaucacaauacgauaggaauuguagggaggacaugaagaaacaaaagaucagucagaauguuucacacacucucaauucucuaauaaacacaguacuaagcaguaccuagacauugcucuuugccugaaggugggauucuuuaguaccucauacaguaaaagauggugaaccuuucagugcuuuuuuucagggcaaaaacagcagggucaucgagucauaacucuuguaaucugggaugcaaguuauguaaccaugucaggauuuucuugaggguuucuguccagaagauggaagacaaggaguguugguuguuuucuaaacagugaacucuagaaauuuguagaugaaugaacuauacaauacaauucuagagaaaacugcuaagcaauuuuucagcacuuuauggcagucaccaaggaucauuauuggcucacccagaacagguacuguugguauuuuuuuucuuuuagucuuaauauuaggcuuaaauuagcacaugaaagugcuaguuuuaaaaguuaaaagcaguugaauaucaacaguuucaugugauucauccuaaugguuuuuauuauuuuuuucugguuauaaaauuaauacauguucauuguagcacacuuagaaaaauagaggaaaauaaaauuacagucuaacaaucuauuuuaugcacuuccaucuuuccaugcauauacauaugcacacguauaaaucuguucaccagaauauuuucaaaaaacuuacuguggauuauaguucauuuuuagagacuaucuggcuguuuaaauugaaccuaucauaaacauuucucuguaauuaguaauuuauaaacuaaauuuuuaugauuucaggagauagaugucacguaauuuauuuaucaauaccccuauuuuaggacuuuucguauuguuuucaguguuuuacaauuauaaauaaauagugcugcaauaaacaucuucuacaugaauccugguccacaucugauuauuuccuuaaaaugaguuaucaaaagagguauuuucagguuaaaagaugugaauucugaaaacauauuucuaaauuucuuaccauaaaggauauacuaauuucuuuuuuuuaaucuuuuauuguuacuuuuuuauuuaacuuuaauuuuaaguucaugaguacaugugcagguuuguuauacagguaaacuugugucauggggguuuguuguauacauuauuuugucauccagggauuaagccuaauacuuaucaguuauuuuuccugauccucuccguccuccaagccuccacccuccgagaggccccaguguguguuguuccccuccgucuguucauguguucucaucauuuagcuaccacuuauaagugagaacacacgguauuugguuuucuguuacucuguuaguuugcuagggauaauggccuccagcuccauccauguuccugcaauggacaugaucucauucuuuuuuauggcuguaaauuaguucaaccguuguggaagagaguguggugcuuccucaaagaccuaaaaacaacuacuauuugacccagcagucccauuacuggauauauaccaaaaggaauauaaauugugauauuauaaagacaugcaugugucuguucauugcagcacuauucacaauagcaaagacauagaaucaaccuaaaugcccaucagugguagacuggauaaagaaaauggggguacguacaugauagauauacucauuucugcuuuuacuagcaaugugugaaagaaccucccugauaaaacaucgccacaguuagcuguuacuucuaagaccaagagaaaaaacaggauugaccaauuuuguuuuuccaccuuugauaaguuuacuaaacaaagauauauaauuugguuuuaucgaaggaccugacgaaguuuuucaugauaucuuuguuguccaaucaaacaaugugaacugaaugcagauagaaucagggaucucuuguuugcagaacaacuauacucuggaaagguuuuauuaguggguuauugucaacugggagggacaccuuguguggugaggcuuagugacccuguccugaacaauguuauuuacagugauuuugaugaaaacagaacaugagcuuaacagguuuccagguaugccacaaagugagaaggauggcuauaaguucuucuguaccauacugugggcucccugagcaagggagcuggagugcugagagcauuccuucuggagucaaacugcuaccuauuagcuguguggcuuugggcagaguuaccuaaccuuucugugucuuaguuuccucaucuauaauaaaacaggaaucaacagaauauuuaccucaugacguuuguugggaagauuaaauaaguuauuaaaugugaagcacugagaguaguuucugguccuuaguaagugaucaauaaagaugagcugcuauuguuaaucuuucucucagaugguagauaacacuucuuaaaugaaugccugagucagugucauaaaugcuuuguaugcuggugggauggguccauauugcaaaugaaaugugauguguaaguuuugcauuuauguuuuauaauauuagaaccgucauguaaagauagggcugagaguuauacuguguagcuccagaagguagagauacgguuuauugauaggaauuagugauaagauacuuucuaccaauuagcucuacucaauaguggaguugcccuuucagguaguggaagaauucagguacaagcuuccagaccauuacaaguacauaauugaaaagagagggcuucuuuggcuagaggugagacuagaugaccucuaaagucccuuccaacucuaggcugauucugugauuuugaguggcauauguaggauuaucacauaucaugcaauaaggccccacgaguacaucuuuggaaggguugaugcugcuaauccuugcccacucugcccucucugcuucaguuucuuucaccuguugugugucagccugacaguggcccauuccucagcuugauucaguuuuacagcccagcuuagugucccaggcugcucccuccucagcagcaaugccuagaggaugaguauaugaaccaagggcacauuuuucauaagcauacaagaaaauagaagauuguugccugcaaaguguaucucagaauuguauuuuaaaaaaacaagcaacaguuuugaccaugccagauguacucuugucgcuuuauucggggccaaggguggacuuuaccuuuuuugcucagcagcucugggcacuggguuucucugcuugucugguuucuugccuaaguucagcaucaauauucuaauccccugggaaggagcaguugagcccacacuguuguauauacuaugugggcuuguauaccuuuggcugagauuauuuuucugucaugaacucugauuccuugccuuaugcuauuuaaagguagcuucaaaauaaaguuagaaagcugaauugggagcccaaccaauugcuuuuucuuuucaggguucuuugcugaauaauuucugacacaucaauuguguaauuguuuugugcugcucuccccauuuauaauauuuggagcauuggcuuuuugccacacuugucaaggguuuaugggaguuagugacacguaguauacaagguucuuugagauucuuucaugaaacuugguauuaucuugaaagcaaaagguuuaacuguucauuuguuagaugacuagugggauuuuaaacagauauaaucacaccaugucuuuuuuuuaaaugugauguuacguacauaugaacuuuuacugcucaaauuuuaaauuauguguuuuuuuuucuuuuuuguguuuauaaaauccauuauuagcaaauaccucaggaaaacuuuagagugaaaguccugaaaaaauuuuccacuccauguuuuuuaauguugugguuuguccuuaguuuugccaucugguaaugaaugguugaagugauaaacuccuggcaccaccgcauuuugcuguugauacuagugugugucuauagcuugugguacagaagcacuaagugagguccaugcuguacagugagaagccgaaagaguugcugcucugugugccagguggguuaauauguuuuagagaaagcaucuguggaauuuuacaguggauguucuuuuguagccguauuaauuuuacuccuuuugaguaguaucauuuuaccagccagaaucuagagcacgcacaugcauuaucagagugauuugaaacagugguguacacacgagcacuguggggaugguucugaugcuuucaaggccuagagucucacugcauauauucugagccagaguguuaauccuacugccuuaagaagccuuugcuucuccuuuuagucuuuagaguuuaugaaaccaacagcuuuguagucuucaauaggaggauuguacauagagcucuaaagauucuuggaacauagaaaccauaaagaggaacgugucuguguuuacucuuguguuguguuauaugcacaguguagaacuuuuuaaaauugaaacaacagagguagaugauauuuuaaaagauuacuaaacauuagauuuuuagacucaucucauuuaggcugaaaggaaccuucuaguccagcccccucauuuuacagaugaaaaaauauaaguccauaaggucccacugagccugaaucaggguugauguaaaaccuagaggucuuccuucccaagccagaucugguuggaucucaccgcucuuguaacugcuauagaacaccacuguagcauuuagaaaguacugaaucauuauguaagaaaaugacucucucaguaaaacaguguaguuguugaguccauaguccaagcagguuuuaucguuuguauuaaguaacuucagcuguuccauagucuucagaaagucugagcugacuauauuuauuuuauccaccuuuuacccaguuaacagaaugcuuacucucuuauugccacuuaaaagucaucuggaagacucaugcugauaauguaaugcauggugaaggaaggggguaaaguaggaaaacauaauuauugcaugcacggucuuuuuaaaggcucuuuucuccucuuuuucccaguuuaguuggguagaucugauuuauauagcauuuuccccccuuuuccuaaauuggauaagagcuggaagacuauucaggaaaagcuauaagcuauagcaaagcgugugaaaagacaguaguuugugccuuucucaaccuuguuauagaucuguggauaguuuggaguuuacaaaacuguacuuaaauauuuucuuuaauauagguuagggacagauuucuauuugcuauugaugacugucaaaacaacuucccuagaaugauugucacagagcauggggccucauuuucugauggagaaacugcuuugguuuauucucacuguuuuuacaugauuauuucuuauuuucucaagugcuuaugacauuuaaaaaaucugugguugagaauuguggcagccaguauuaugagaaagagaaacuaggugccuguaaacuauuuaaauacaaacaaaugauagcaaaacuuaaccaggaagaacaugaguuugaaauuguugaugaacgugaucuaggccuaagacaagcugaaacuguauuucucauucauucuuucuuaaccagaauugcuuuaccuucaaacucaagcaaaucuuuuguuuaauccuugagaauugauacuucagaggauuucuuuauuucaguuauugauggacauuauucuuaggauucaguacugggucaagauguguguuuuuucagcaauguuugacugaaucccaagcuuucucaaggcauauuuaaaaaccaguacugguaauaggcagacuuacauacaguuuuaucaguuuaucucugcuuuuuugagggagagggaguuucagcuaaguuggguuugugcucgugaaauacaauacaaaaagauuugaccaaauaacuuucuaaucauccuugcuguauguauauuuugguaaaauccugcucacagggaaaaugucuuguuaauuuuugguuacacuaaagacauucugagcaacuaacuuugguguguagggcuaaaauuacuugaaaugcugagauuguauuguuuugggaagaacuuaaguagcauucuauuuguguuaaauguucuuguuaaggcaauggaaaagauauuaguugaauauauuuuuucaaauuaacuuuuuugucuuuguguuuuuauuuuaaaaagcuuauuguauugucuuguauuaaaaaaacacauaauggaaaauuuaccaucuuaaccauuuuuaagugugcaggugcacacaacacaggugcacuacgcaauucacugccaguuacaguagaguaagaaguagauauuugccuuuggggaucuugggaagaagacugcuaucuaucucuaauccucauggaauccuuaagugguaggugccaagggcuaaggugaggggggagagguggagggaguuguuuaauggguacagaguugagcuccuuucucuauaaagcauuuaagcuuuuuuguugccauuaauugcuucuaugggcuaaagaaacugaaagugugggcagguaaucacuuggcuacuaauauaaagaggaagugaaacaaaggacuggcuuaaugguucaggguggaaaguauacacaguuaaaaguaauguuauauggucuuguaaauaguugugcauauauccgaugucaauaagaauuaguaauaccaaguuaaaagaaaagcauuauuuuaauauuuguauaccuuuuggaaaugaaagaugggauuauuuaaagagcaaaaaacuaaagauguucuaguugguaagugacuuuauuugaugugauuuguuauucggauuuaccugugauuagaguggucauauauucuuaauaguuucuuccuuuuugugagacaagguaagagcagcuuggcaucuaaguuuuggauaauguguugcuacuugauuuuuuuuuuccccaagauggagucuugcucuggagugcaguggcacgaucucggcucacugcacccuccaccucccagguucaagcgauucuucugccucagccuccugaguagcugggacuacaggcgcccgccaccacaccuggcuaauuuuuguauuuuuaguagagacgggguuucaccauguuggccaggcuggucuugaacuccucaccucaagugaucugcccgccuuggucucccaaagugaugggauuacaggcgugagcugcuugcuuuugagaggcauccuaaacauguuggauggccuacccuuauuuucugaacuaaaauauguuaaaauuaauuugguuuugagaacuuuugaaaaaucaucugacuuuaaucuagcuaauaugaguuuuuuucccuaugcucugggcacuauccuaaguauuuuacauacauuacuuaauccucauagaaacccugugauauuauuuuuccuuuuuuacagaagaggaaagcagcuauagagagguuaaauugcucacuuaaggucauagauguaacgauggaauuaggauuugaacccaggugguuggcuguggguugacauuuaucauuuuaacugcuuugugauguuacuccauacugagcauguaaauguucuuggcacucagcacauuguaggauuuaaacaaauaacauuuauaucuguugagcuucuuagaaugacuggagaugaaguagucugcuauaaaaauaagauaggaagccauuguacuggacacuacugauuuagcuaauugauuucaauccaggaacugauuagacauuucuuucuuucuuucuuucuuuuuuuuuuugagauggagucucacucuuaucacccaggcuggagugcaguggcgccaucucggcucacugcaaccucugccucccggguucaagcaauucuccugccucagcuuccugaguauuuaggauuacaggugcccaccaucacacccagcuaauuuuuauauuuuuaguagagacgggguuucaccaccuuggccaggcuggucucgagcuccugaccuugugauccaccugccucagccuccuaaagugcugggauuacaggcgugggccaccgcgcccggccuagacauugauuucuaaccuugagguccaugugugaguuccaagagaaacuaaagaaugaccucagacaaucauuuagcaaaugauauuguuuuguucauguaguauggcuuuuguccucugcuuuuauacuuguacaauaauagaauuuaagaacugguccugacuuggucuagguagucaaauucaaccucugcauuuuaccauuugaggaaacagguaaaagaaccuucuuaaggucacuaaaaaaggaagugccagagccaggauuuaaugcauaauagcucacacugaccuaguuuuaccaugagccaggcaguguucuagaggcuuuauauauguuaacucauuaacuccucagaacaagccuaugaaacagauacugcuauauacccacguuacagcugagaaaacugagguuauguaacauacacaaagucacacaacuaguaaugaguagagccaggaugcaaauccagucauuuuggcuccaguuugucuccaaacccuccucaugguuguaacauauauaauugccaucuuuuuuuaagagcaaaaaugguugaauaucagccauuucuuauaguucaaucugacauagcuugagcucuuucuauggcauuucaguaccuuaccacaaugcguauuugugguuauuauuauaucccacuugaucuugguauaugauccuuuuaaugugcuguugaauuugguuuguuaguauuuuauugaggauuuuuauaucuauguucaucaggaguucggccuguaguuuucuuuuucuuuucauaucuuugauuagcuuugguaucaggguaaugcuggccuuguaaaaugagguuggaaggguuccuuccucuucacuuuuuuggaagaauuugaaaaagauugcuguucuuuaaaugucugguagaauucaccagugaagccaacgcauguugguccaguauccuguugaauagaaguggugagaucaaaaauacuuaucuuguuucugguauuagggggaaagcauuuagccuuucggcauuaaguauguugucagcugaagauuuuucuuguauguccuuuuucaaauugaggaaauaccuuuuuguucuacuuucuugaggguuuuuuaaaaccaguaaugaguguuggauuuuuucaaaugccuuuucuaugucuauugaagugaucaugagauuuuuuuuguuuuguucuguuuuauuuuuuaguuuguuaauauggugauuuauaaugauugcuuuucagguguuaagucaaccuugcauuucugggcuaaaccccacuuggucaugucuaugaauacuuuauuuuuggauuuuuauuuacuaaaacguuuagaauuuuuacauguauguuuaugaggaauauuggucugaaauuuucuuuucuuguaauaucuuugucagucuuggucagacuaggguaaugcugcccucacaauguguugagaaauauuccuuccucuuccauuuucugggagaguuuguguagaacugguauuauuucaucuuuaaauguuuggaguaauucaccacagaaacuaucugggccuggacuuuuauuuguuuaaaaauuuuuaacuacaaauucaauuuguuugacagacagucaaguugucuguuucuucuugagugagcuuuaguauaauaguuugugucuuucaagaaauuugucagauuuauuggcacgaaguuuuuaaauaacauucccuuuuuauccuuuuaauaucuagaauugguaauggugucaucucuuauugcugauguugguaauuugugucuuuucuuuuuuuccagcgaugguagucacccugaacucugucuucuggcucuucaagccagaagaaaugggcaucuugccuggugccuuuccuuuuuaccaauuguagacaucccuccauuuuuggcaaguuuuucguugugcuccagugccuucagguaguggcuuuuuacauuguccagagguuaucaacgguaagaggcuauuuuugcccagugcugaagauggcaucucuggguuuugguuuuguaacauucuagcaaagccagacaugcuuugcugcagugaaaguguggaacuggauaauugagcagcacuguuuauucauuguugccuuuauuggaucucauauggaauaaccccacuggauauuagaguaaauuacagaguuaggaaaaggugaaaaagagaaaugucggguuagcucuuuucaaaauauuuucagugggagaaauuguugucacuuuaaaaagugagcuuuuuaaaaaacgaacauuuugaguacugaauauguuaagcuucugaaugauuuugagugcuuuugcuugucauggggaaguuuuucaagagaagaugaccuuuuaggccuaaaaacaaagcauuucuaauugcuuaauguguauuguaucaaguaaauuaucauuaggucauauuaaugcuaugauacuuaaauauuuuauuuguaguggaauccauuuucugaucauuuuauacugagcauuuaugccaauuuuaguauauauuguaauucaaauuaaaaaaugcuagaagucaucuuaggucucuggaucucagccugguauuuacugaguagcugucaggagccaugcacuguucuaggcacaggagguucaguggugaaugaggagcuuauauucuuagaagcucagaaaucuaacccuguuagcacacuguagauggucagacucacauguacuugcccuaaugccaauuuguucaucugaaaugagaaguacagcuguuaauuagacuggugaggucgaacugagagauuagugcauuuucucuuuauagacaacccacaugggaagccaaauuacaaucacaagguugcuuggugagaauggaaucaaaacaaagggacuuggauagauaauccaugauuaggacacaccugccacagagacuauuuggguuuucccuaaguagugcugagcaguaaagcuugccagugucugggucuucagacuuauuuuuaugcugaccauuuuccuuuguucacaccaucuuuuucaaaccaagcugcaauacaguucacuaaaugacaagcacauuccaggccugcuuccuaagauuaaacuuagaucaccuuuggaaacauguagaggcuuccaaauucugagcuuagguacacaccuguagagagucucuuguuugauuucaacagagugcuaccuuagccauugugcaagugcguuuuuacccucagaggguaucauuuuuuucccccuuacauccauggugugggggaaguguuugagucccuuauagugguccccauguacugccaauaauaccguuuuauucuguucaagugguaauggaagauuugacuucuguuuuuuuauaugauuuacugaugccaaacccuuauuaaaucaguccccacuucuaccauguuuccacaggagaggcuaaucugucuuaauaagguaaaaugaauuuauuugaaaauguaguaaauguaauaaauagcuaaacuuaaaccuagaaaguccuggaacccaagcauacauguuugauuuuuguuguuguuguuuaaugaggggauauacuggaauucucuuuaaaagauccagggaacaugccuuuagggaugaaucacaugccuugaggucuaauagagacccaaacauuggaauugugagccauuuucacauacuagauucuuauauuguuccuucaguuauugucuguacaccaguggcccacaauccagguuaaaguacuacucaguuugcuguuaaaaaaaguaaacgaaguuaagacccagugauagccaugguugucauauuuucaguacaaauaaagugguaucacuguccauauauccaccaaaaccuauggucagccagcaaagccuuggcagguaccuguuugcagguuccuuggaggcaacaaccauaacaacaauagcaauagugaaagcacauagugauauauguguguagugcuuuguaguuuuuucacagagcccugucaccugaauuaucuaaauuucacaagugcaauauauaauguguagguaugcugguaaccauuucugcuuucuagucaaccauaaccuuaccuacacucuuuuguacuauaaauuuuuggccugagaaauaggaaaaucuauuuuccccauucagacugccaaaauaccuucuuuuauggacaaauuuaauuauuucgugaaauuuuaggcuaugcuucuaaggauucuuaacaccaaguuuaaagucuuuucuugauuuauuuuuuuuaagcuaauaaaaauaccaggccauucucaaccauuuuuuagucuccacaccauucuuaaaauauaucccaauuaauaacaguuuuccuuacauuacuugugcagauaucaguguucugauuuugcaccguccaguaugguagccacuagccacagguggcuauuuaaauaaauuauuuaaaguuaaauaaaaauucaguuucuaagucacacuagccacauuucaagugcucaauagccauuauguggcuagugacuacagugaguacagauauagaacauuuccaucauugcaggaaguacuauuggaaagcguuguucuagaaaucuaauuccugcuuaguuuugggggggaagauagucaaacaguucuaccauuuaucauuuuaucugcaagauuuauauuucuuuuuuuuuuuuuuuuuuuuugagauggagucucacugugucaccuaagcuggcacagucucagcucacugcagccuccgccuccaggguucaagugauucuccugccucagcuuccugaguagcugggauuacaggugcaagccaccaugcccggcuaauuuuuguauuuuuaguagaaacgggauuucaccauguuggccacucuggucucgaacuccuaaccucgugauucgcccaccuuagccucccaaaguguugggauuacaggcgugagccacugugccuggccaagauuuauauuucuaaauagaucuacugagccugccuagaugauguaaaauacuauuuuacauauacuuuuuaaaaauauacauaaaacuuggaggcugaggcgggccgaucaccugaggucagaaguucaagaccagccuggccaacauggugaaacuucgucucuacuaaaauacaaaaaaugagccaggugugguggcgugcaccuguagucccagccacucaggaggcugaggcagaagaaucacuugaauccaggaggcagaggcugcagugagccaagauugcaccaccacacucuagccugggcaacagaacaaaacucugucucaaaaaaauaaauaaaaauaaaacauuauauaaaccuuuuauuuucuuagcgccuccuaaguuauaggucucacagguaagcagcaaugggaauugaaguagacacuaauguaauaauaaaaacgucccagcuucuuuacccuucaguggauauuugcugaagugcaacagaaaagauaggugcagguacacuguucugcacuaaacagaaaacacguagccaucauauaaggagaagcgaccgacugacaguaaucuuaagaugauucacauaauuaagauuucaugaugcaaaaauucaggucagucauacucucagauaaaauauuaguuaggggauuuagcuugaaaaggcacuuggcaguuggagaaucucucaaauguauagcugauauuaaaaauguguuaucacuuguuagguucuuaaguguuacaaauuaauucaguacgauaauaaauuugcuuuuucucuuucugcuuauauauucacauuguacagaaugaaaggaaaaauccagacuaacauccaaagacuguauuuuugccaugagugauucagggaacuugagguuuuaaggauguaguauccuauaauauauucaguuuaacugggacaaaacauccagagaaaccccuuugauccuugccuguguaagaauggucucaugaguggcugaauauaauggagaggcauauuuauugggggugaccaguacuauuccauggugaaggacagaauuggagcuuuguaggacagagguauaucuggauacauacuaaauucuagauaggugaagaaaauugugugaauuucgaaaaagugauugccuuuuacaaaaaacaagagcaaaguaccacaaauacuggcaguuguuacauuagugugauucuguaugauugaauguauguuuaaucccuuuuucacuuuuaaaagucauuacuuucuugcaaaguuaaacaauguuaaagggcaacuguuuuuuuaaaaaauauauuuaauugacaaagauuauauaugaaagguguacaaugugaugauuugauaugcauauacauugugcaaugauuaccacaaccaaauuaacacguccaucacuaugcaugcuguaccauacauacccagaacuuguucaucuuauaacugaaaguucauccccuuuggccaacgucuucucauuucuuccacuccccagacccugauaaccacucuucuacucucugcuucuuugaguucaauguuuuuagauuccacauauaaguuacaucauacagcauuuguuuuucuguggcugguuuauuucacuuagcauaauguccuccagguucauccauguuguugcaaauggcaggauuuccuuuuuuauggccaaauaauauauuccauuuuguauguguguauacaucccacauuuuguucaaccguuuaucccucagcggacacuuagguuguuuccauaucuuggccauugugaauaaugcugcagugaacaugggcguacagaaaaaccucuucaagauaacugauuucauuuccuuuggauguaauuuuuuggggaaccuccauacuguuuuccauaauggcuaucccaguuuacauugccaccaauaguguacaaggguucuuuuucuucacauccuuguuaacauuuguuguauauagcuagccuaacagaugugaggugauaugucauugugguugugauuugcgugucgcugaugauuagugauguugaguaccuuuucauauaccuauuggccguuucugugucuucuuuggaaaaauaucuauucagguccuuugcccauuuauuuuuauuuuuuauuuuuauuuuauuuuauuuuuagggacagggucucauucuguuuccuaggcuggaguccaguggcacaaucauagcucacugcagccucaaacuccuggacucaagugauccucccacuucagcuucccaaguagcuaggacugugggugugcaucaucaucaucaggcuuggcuaauuuuuuuuuuuuuuuuuuuuuuuuuuugagacggccucaccucuggcccaggcuggaguauaguggcacagucagggcucacugcagucucaaccucccaggcucaggagauccucccaccucagccaccccaguagcugggacuacaggcauaggcgugcaccaccaugccccucuaauuuuuuuuaaagaugggguuuugccauguugcucaggcuggucuugaacuccagagcucaagugauccacucaccauagccgcccuaauuucuuuuuuaaaagcagggucuugcuguguugcccaggcuggucuugaacuccuggccucaagugauccucccacauuagccuccugaguggcugggauuacaggccauuuuuuaaucugguuguuuguuuuugugcuauugaguugugugaguuucuuauauguuucagauauuaaccccuuaucagauaauaugguuugcaaauauuuucucucauuuuguagguugucuuuuuguuuuguuaauugcuuucuuuuuaguuuguugcagucuuacuuauuuauuuuugcuguuguugccugugcuuuuggugucauaucuaaaaaaauuauugccaagaccaaugucagggagcuuuuuuucccuauauuuucuucuaggaguuuaugguuuccagucuuacauuuaaguuuuagauccauuuugaguuaauuuuuguauauaguaugagacaaggauuuaauuuuauucuuucguauguggauaucuaguuuucccaguaccauuuauugaggagacuuuucuuucccuguugugaguucuugacccucuugucaaagaucgguugaccauguaugcaaggguuuauuucuggguucucuauucuguuccauuggucuuuguaucuguuuuuaugccaguaccauauuguuuugauuaccauaguuuuguaauacaguuugaaaucagggagugugaugccuccagcuuuguucuuucuuaagauuacuuuggcuauuuggggucuuuuguugugguuccauacaaguuuuaggauuguuuuuucuauuucugugaaaaaugccauuggaauuuugauaggaaugacauugaauccauagauugcuuuggggauuauggauacuuuaacaauauuaauucucauuguaaagaugauaauucauuuuaugaggccagcauuaaccugauauuaaagccagauaaggaugcuacaagaaaauaaaauuguaggccaguaucccugaugaacacagaugcaaaaauccccaauaaaauacuacuagcaaacugaauuuaacagggcauuacaagaaucauacaucauaaucaaaugggauuuaucccugguauauaagaauguuucaacauaugcaaacuaguaaaugugauacaccacauuaacagaaugaaagauaaaaaucauaugauaaucucaauagaugcagaaaaagcauuugacaaaauucaauauccuuucaugauaaaaaccccucaacaaauuagauauggaaggaaaguaccucaacacaauaaaggccauguaugacaagcccacagcuaacaucauacacaacagugaaaagcagaaagcuuuucaucuaagauugggaacaagauaaggaugcccacuuuuacuacuucuuuuuuuuuuuuuuaaucuuucaagcuuuuauuuaaaugccaugauccaggauggauuuuagaucuuguugaaagcagccacauccauggacugcacguaguccucaaaagcagugaucugcuccuccagcauaucuguuccgacuuuaucaucuucaacuacacacuguauuugaaguuucuuaauuccguaucccacuggaacuaguuuagaugagccccagacuaagccgucugcuugaaugcuucugacgcgcuccucuaauuucgccauaucugucucaucaucccaagguuucacaucuaguaagauggaagacuuggcaacaagugcagguuuuuuggcuuucuuugauucauauugugcaagacguucuucccuuagccucuuugcuucuucacuuuccuccucaucaucagauccaaagaggucaaugucaucaucaucuuuacuaucuguagcuccacuuccuguagugucuuccacaucggcaggaccauacuugcccaaagcuuucuucacuccuggcaggcuggccuuuuccuuuucguaagacuugaugugauuauaccaacguagggcaugacacaagucggcaggcagugggcuggacacggcuucaaauacugccacaucugcuugugauggcacauaccccucgauguagcucuuguccgccagguaaucguugagcaccuggaggccggcggggcuuuucaggucucugaaacccauggugucggcuguauccgagagcuggggagcagcagaaagagcccacuuuuacuacuucuguucuacauaguaguggaaguccuaggcagagcaauuaggcaagagaaaaaaguaaaaggcaugcaaaucagaaaggaagaaguuaaacuguuugcagaugacaucaucuuauauauagaaaacccuaacccuaaggauuccaccaaagaacuguuagaacuaauaagugaauucuguaaauucggaggauacaaaaucaacauacaaaaaucaguuguuucuaugcacuaacaauaaacuauccgaaaaaagauauuaagagaaaaaucucauuggcaauagcauaaaaaagaauaaaauacuuaggaguaaauuaagccaaggagguagaaggccuauacauuauaaacuauaaaacauugaugaaagaaagugaagacacaaauaacauggaaagggccuguguucauggauuuuuuuuuuuaaggccuuuccguuaggucgggugauauguguaauguucacagagaaagcaaguaguccccuuuuuucuauaugcauuuuagaucuucuuugcugaaguaacagcuuguuauaagcaugaguauggaaaagagauuuuuauucguauuuaaagaacaucaguaauaaaaacauuucccuagcuaugacaaagaacagccuuuguuuaaggguuagguaugucuaaagaagugacucuuguuaagaacuaaggaauaaaauauaauucaucuuaucuuguguagggaaaacugucccaacuugaaagccgcugagugccuaauuuacauuuaaagcugaaguaaugaagccuuuauuuuuuugccagaaacucccauuucucucccaaauacauucucuaucaggaaaaaaagcucauuauuuugcaugguaaugugucuuugcugaugcagaaaagcaacauaauucaggaugaaggguuaauuuaaacuuucuuauguacucuuuugcagauaauuagaauuauuucucagaaucuaaagguggguuugcagaguacaccaaaaagaauagcuuuauccuggugaauugcaaaggaaagguacaguccuuuacucuucaggagaaagagguuccugaaaacugugguuggauguagaaauuaacucugagaacuuuagacgucauagaaacuauaguugcaggagguuuaaaguuuagagugugucuauggaaauucuuaagaacaaacaguauuuacauucauuuaagucuucucaauguaauacaaaugacccuuuauacucuuuuauuuaguaauaagggauccauuuucuuuuucauuuacuaucccuuaagggaaaauuggcuuuguugcagauaagcaugcuuugagacauuuccccuccuccacuauggcuaauuuucuuugacacuguucguugccuuucugauuuuuaaauggagaaauuguugacguccaucucccuggagcuccccacucacauccugcucccuccugcugacuuagaugucgucaguuuggcuucauucuaaaaaucuuuauuucuguuccaacauuagcuuuuaccuuccuuuccuauucucaacugcagcuucaucuuucucuaauuauccccaacaggauugaaucauaguuuugugcaauuuacauauacugaaacugaaugaaauuuuugaaguugccccaaaaauacacagaaguaaaauugagaauaugcaaguucaguuuaauaagauuagauaugagaaauuagugucauauccugcaaguguauaugaauaugugcacucauuuuacguguauauacagcccccacucauuuauuuauguauauguauauauauauauauauauauauauauauaaaacauuuaaccuaagaagaacuugcaauuguuaagcugcucaagaacuuucagagguucuaacacaguugcacauuucagcaaaagcaggcaauaugcuuacugucaaucgguggcauaaucguuuauugagcagugcuuuggauuugugaacaaauggacuuauuauacagccuuuuggagccuaaaugguuccaaagacaaaaaucuucucugcuacuccagcauaaggguuucagaucauaaguagcagucaacuauaaauuccggaagccagaccugugucaucuauccucauuccuugaaacuuggggguauccuagaugagguaggagaugucacugacccugcccaacugguagucaucagacuuuggaggaagcacaaacagguuggaacuuuuguucugugaguacgcuaaacuguuaaagccuugauuguuuuuguuguuguuguuuguuuggagauggagucuugcccugucguccaggcuggagugcaauggcacgaucuuggcucacugcaaccuccaccucccgguucaagcgauucuccugccucagccucccgaguagcugggauuacagguguaggccaccacacccagcuaauuuuuguauuuuuaguagagauggaguuucaucauguuggccaggauggucuugaacuccuaaccucaugauccaccugccucggccucccaaagugcugggauuacaggcgugagccaccacgcccggccuauuguauuguuuuuuaaaauuuaucccuggaauugguuuguguuuuuauuuuuuaggaaugauuauauacauugaccuugugccacaugcuucagauuuuauaagaaguaagcugggauguuccaaguuccguguugcauagaguucuuauccaugaaaaaauguccaaaaagaugauuuagcaaauuuaggauuauuucauccuaauuugguauucucuauagugggaguuuuagaguguuucuugugauaaucauuauaguuaagauuuauugaauguuuacucaaaaaaguugaauuuuucuacugguuuugggacuacuugggugagauaugugaaauagauucaaauauugaaauauugagguacucuuauaacagaaaauaucaaagcuacugccauaguuuauuagaaaucaggagaaagacuuuuuuuuauuguuggccugaaugagcugaaguucagaguaagacuguggucauuauucauuaccucuuuuuuuucaaacacuaaaacucuuggguuucuguggacaaggcugcuuuuuaauggcauguucuccaaacagcuguuaagcaccccccuccccaauaccacagaccacaucuguucccacuguugauuagcuagaggguggagaaaagagaggcuguagcauguguaauuaccaguaauuaauucuuguugagccuccucauuuccuucuauucuaacuacaccuacucuucuuccugccucuguuguaaauucuguuucauguuagcuacuuguggaaaauaaucuugaugguuauacagcuguuuuccuaaaauuuuauauucaccuaacagugaggcuuuuauuuuucuucugguggcagaaucauuuaauaaggcaugccaaauaagaaaauaccaaaguaaccaagcauaucucuuggggcuagcuuuccugcuuauguucuuuuacuguugauacuauuuccaacugucaagaaauuauuuuucagauauauccucuguuaaaggaacuauugcaaggcaugauuuagugugaggaaaacaaacguaagacacgguccugguccucaguguuaaugugcaguguauggaaauauaacuauguaaauuaacauauauuaauaauauaguaauuuccaaaauugucaagaucauaagguggagguagucuucuacuauuuuucauucucuuugggauaaaguugggcugacggaaauucaacuuugagcguuauuaauaugucauggucaaagagagauaucaaaggcuugcucuuuaaagaaaauucacagcauaucuucuuauuuacaagucuuaaaagccuagauuuucuguaaucccagcacuuugggaggccgagguggguggaucaccugagaucaggaguucaagaccagccuggccaauauggugaaaccccaucucuacgaaaaauacaaaaauuagccgggugugguggcaggugccuauaaucccagcuacuugggaggcugaggcaggagaauggcuugaacccaggagguggagguugcauugagccaagaucgcgccauugcacuccagccugaaugagaagagauagacucccucucaaaaaaaaaaaaaaaaaaaaaaaaaaaaaggccuagauuuucaaaagguguugcuuugugugagucuacuuucaggaggaugagguuucaagaagacauuucaaaacugcuuuuuuuguuuguuuguuuuaaaauuuauuuggucuaucagucaagauccuggcaggaaagagaugacauugguauuaauaggauuugauaaagagauuguucacaaaaaugugggcaauuauagugaaaucacaggagaauugugugaacucuggugcuagucauaggaggguuguuauaugaagagagucucuuuuuuuuguuuuguuuuuuugagacagaaucucgcucuguugcccaggcuagagugcaguggcaccaucucugcucacugcaaccucugccucccagguucaagcaaaucuccugccucagccucccaaguagcuggaauuacaggugccuaccaccaugcccggcuaauuuuuguauuuuuaguagagaugggguuucaccauguuggccaggcugguguugaacuccugaccucaggugauccgcccgcgccagucucccaaauugcugggauuacaggugugagccaccgugcccguccgaagagagccucuugauuguggguggauggaccccgccauccccucggaagagaccuguugcccuuccuaaugcccuuuuguuucuuuuucuuuuucuuuugagacugagucucucucucucucuauugcccaggcggcuggagugcaguggcaugaucuuggcucacugcaaccuccaccucccggguucaaaugauucuccugccccagccucccgaguagcugggacuauaggugugugccaccacaccuggcuaauuuuuguauuuuuuuaguagagaugguguuucaccauguuggccagguuggucucaaauuccugaccucaagugauucgcccaccuuggcgucccaaagugcugggauuacaggcgugaaccaucacacccggccuucccuguuuaauucuucuuagcaucuccacuaaacacaaaccaagaaaggugauuuuucucuuuguuagaacuucuuaggaaaacuucacuauucucuuauuccaucuguuuugggguugaggagagcuguuauauaagaaguuauuguuaggguuucuuguauuccuguuguaauauucucaagcugacauauuugugauagaucaacaaagcaguagguauuuuguaccgcuaccuaagcaauaaaagcaaguauguaaugcuguaguaccagaguugugguuuuuccccugcacaauauauuaacuaagcagaaaauuuaaaagaacaaagacaauaaaaguaauguuuguuagugguaguuugagauauuucaggagagaugagaugugaagaaaagcaauggccauauuuagaaagcugccucaaacccaagaguaucuauugaaguaaacuugaugacagacuuuuuuccucuucaugaaucauuguauuccuauaaaagcgaaaauuccucuucaucuaaacaaauggcuucaacaucuguuuucuuaguuucucaaaagggugucuucggcuugcauuuuuuuuuuuaaaaguguuuaucuguuuaaaaugaaauaucgucaaaagcaguuuguacaucaaaauccaaguuggucuucagcuuguaagaauuaguugagaauuaucuggugguguugauagugguauaggggaaaaaagaaauuacauuuuguauucugcauagguaaguucuucuuccuaaccauauucuuuaaauuuuuuugacuuacauuuaauuuuacaugcucuuagcuuuggaggaccgauugacuaggaaacuugaucguugagagcgcauuccaacguuuuaaugcucuggguucugaaaguauuuuaaaaauuagcagcuggagaauuauucuguuagucccauugacuaggaacugaucuguaguugguuugauucuucucuugcucccauaaucaguuuccuucuaccaugucacuaagagaaacacacuuauaacugguucguaaaugacuuaugugcuuuucugaagcacuuuuucaauucccagucuccugugaauuuguauacccucaaugguguugguuuuaucuuuuuuaaucuuuaaucucuucuugggugacaggccaccaugcccuugagcccauccugccauuuaaaaauaaagaaugagaagcagcugaaaugcuggcucuuuugcagcugacaggaaucagaucuauugcuuagauucuuuaucuggguacagacaugccaguggugugugacuuguucuagccaugccauuugcagucacaagguuuaagaggaugggaguagaggaaguugucuccaagagaaagaaagauuuuuuuuuuuuuuuuuuggauguaaaggucaaggagaaaggcuguagaucagcacauggguucccacugcaggucacaggacuccuggcuucuuaccacccaguggaauuucugggccaugauagagguguuugucuuuccgaaaagguugcauaggcuccucccacccccauccaccccacagcugucuguugugucugaacaguggcuugcucugagguuaaagguccaugaaaacugugagacauuugauguuauaaaaucuaauuagugacaaaagcaauuaauauaaucacuuaugacuuaguuucucuggaaggguauacuuaucuuuauugaauaaguauaaaugguaacugcuagcaaauggcaccaaacuuaacauaaaauagaacuacccccaccucucuccuccucuccagugcagaagagaggcagugaaaagggugguuaugguuauguagguguagagggcucuaggaggcucuugugacuugauugguguucagucucccuguugagcccaucaacauggccucaaggaggggagcuauugcaaagguuuugccugcuguuuguuaagccacagcuuguaguuuugguugcacaugacaaagcaaggugcucuccuuuuuugaccuuguucagaggcuuaauacaauuauuuguauuaagcacuagccaccuguuaggaucauucucauuaaaggucacuguguggugccugacugucugacuauggcagccugcaucagauuugcuaguggccccugguuugugugacaccugccaauaguaacagaaagaauggagaucugauagcucaaagggaacagaagguacuagaggaggaaugaggaaucaggagaaccauggagcaccugccacucuagcaccauuaccaugguuuuuggugcuaacuugccuagucucccuuuucucuggcuaccccuucagugagcugugccaggcauuucgaagaguucuguuauugucugcaugcugauauugcuuugguuuauugauauuaauauauugcaucccuguuaagcguugaauuucuuguaccugaaauuccuuacauccccucugcugaaugucuuagcuucugucugcuucucugugaucuccauugagguguuccacaggcauauccuauucaguuccaaaacugcccuugcaguucugguugccagccuguuucccuucccugauucccggucucagugaaugaugacacuguuuacccaguuguuaagccaggaacauggguaucauucuugacuccuaucucuuccuaaugccucaaauccagcccagugccaagucuuguagauugcacuugcuaaaugucugugauucucugucuccagugucacugcaauuaugcuguucaggccucauuacaucucccuggacacugccccccucaaguauucuccagauguuuuauagccagagagaacucuuuaaacugccaaucugcuuaugccacuccccaguuuaaaguccuuaaugugacuuacaaggcccuucacauuugggccucucucccacccucucuccauuuccccugaacauucuagccucaaccauacauuuuauuuucuuugccuuuguaaaaaaaaaaaauuuguuuuuuuaaaacuuaauuuuuuuuuuacucaccauucagcauuucccuguguucuuugcaucuucacaaacacuguucuuccauccuccuuuuccuguuauucccuauacucaccuuccccuuauacauuaucuguuuuuauggacuuuucucuaacuccugccccaggagccccuguuauguacauguguguguauguaguauguguguauuuuccaauugccuauuugguucucugcucuacuggggguuaugcccuauaagagggaagggaucaugucugaaucauucacaguuguguucccuaugaccuacgucuagcacaugagaagaguuuaguaaauacuguugguguuugaaugaaugaguuccuucuugagguucuaaaugacaagagaauauagugcuuccuauaauucauaucaaauucuugagccuuggccaaauuagagaguggaaaugcacaggcugggugcagugacuuacaccuguaaucccagcacuuuggggggcugaggugggaggauugcuugaguccaggaguuugagaccaggguaggcaacauagugagacccugucuuuaaaaaaaaaaaaaaaauuagccaggcuugguggggugcgccuauagucccagcuacuugggagggugaugugggaggauugcuuuagcccaggaggucaaggcugcagugacccaagauugccccagugcacuccauucugggugacacagcgagacccuguuuccaaaaaaaagcacaaaguucaaaagugaaggagauugcuuucuuuuaaagcagugaguagccaaaccucauauauccuuuauauugcuucuucauauucuguaucuccauccuaaauuacuuuucucaacuugaucuuuguuugauuuaaaauuucucuggauucuucccagcaaaaguauagaguauaaugggacaggagaaaaugugauugauaaaugggaauaugucauuugauugauucuuaaauauauaguugacccuuaagcaacaugaguuugaacugugugaguccaccuauacauaaauguucuuccaccucugccaccccagagucagcaagaccagccccuccuccuccucagcccuacucaacaugaagaugaugaggaugaagacccuuaugaugaucuacuuccacuuaaugaauaguaaagauauuuuaucuuccuuauaauuuucuuaguaacauuuuuuucuauaguuuauuuuaagaaaccauuuuuuucuaguuuauugcccaccuucauauuguaagaagaacaauuuuucucuaguuuguuguuuauauguauauaauacauauaaacauacgaaauaauguguuaaccguuuauauuauuggcaagguuucuggucaacgguagacuauuaguaguuaaguucuaagggagucaaaaguuauacauggauuuuugaaugcaaggggauuggugccccuaaccuccgcaucguucaagggucaacuguauuuauucuagagucaugccugaacaugugucuacaacacauguuucucuggacaguugaacacguuuacauuucccuaaaacuaggcagucuuucucagaagauuuuuuuuaagugggaccccucuguauuuuaaucauagcuagcucauagaaucuguuuguugaacuuacaguagaauggaagugggcaagggaugccacuuuguaaaaaaauaaagaguugcuuuaagaggccgucuagaaaguguggucaugauagaacauaauuuaguauuuagcucugguacugagcaagggaauuacccucugagguauugggccuaaaacauucucccucgucucacuucauuugaagaagagaguaauuauggacacugcaauggcuauuuugucacacacugauccuaagaaggagcuuucuagagaucagaaugcuucugucaaaauggugacagcaccaccuuggucacuguccaacuucggguucuccagacuaccagcugugugcucuuccaggauugagcuucagaccagguguuuaguaaugacaagggacagcuuguuaaaucugccauuugugggagcugggagcucaaaguuuucuggucagauuuucccaugaccuuaguuauaaagaaaacguuacagauucuagaaaaugccaauguccuuuuuagcguauuacacugauugcagugcuucagaauugcccaacuucauuaucugagcauagccagccugacgccuucuucucaaauagacaauuaugaucaauuaagcacuuuuaggccuuauagaauacuuaauuuuauuagccaauuauuugugcuuugaaagaguuaaugguagcuacccaagccauuauuagaaauuagaaugucccaaaauagaaaggcuauuuccuuuguguguggcacugcaguggaaaaugccaagcauaguuuuuacugaguuaaagggugagggaaggcggggugggggagaaaguuacauguaaaucauuuagccauuaaccuaauggguggguuuauaaauccuauuacuauaagcccuuuucauuuccacugaggccuggugcaugcuugaucccacuaauguaaaauucauuccgucuaagugauuacugaaguaagacacuuugagucaauuuuaaucagguugugugaaacuugcuugagugcugauauucacuaaagcauggacauaguuuggccgugucuuaauuagccccccuggaugaguuauaugaggagucagucaggaagccaaaucucugagccuuuucacauauacauguuucugugagcaaaauaaacuguagguaggggcugaaaacacccaccucaaaagcaaggggcaaggaccuuugggugaguguguuucuagucuuaaugaaaauugugaauguuaagaaaucugaaaguucuauucuuacggugaauuggagcauccucaaugguacuuauauuuaaacaaaucagaauuucaaguuugauuaaauauguggaucuucuuucuagaaaaaugcacguaagcacacauucaaaucuuugcugacaguuucaggggauuuucagauuucuugaccuuagguuaauaccuacugcuccaguuuuaauuuuaguaucuuagguuuuuguuuuuuuuuuaacuggggauguaauauuuaggauuguauaggcucauauugagcucuugugucagugaguagauuugguucaagugugcuuuaaggccagcucuacaagcuguccacuguccugugucagauauaacccgaagaauggcagcaauacuuguaaauucaagugaaacauauaggacaugaacuucuaaacuggagguuggaguggaagaggaauggagaauaagaauguugugaaaggaagguuucuuuaaaggugaaaacugaguucuuaaaagucagcaugugaaguggguuuuuaagaauccacaggaugaauaaauagucaugcuggggacaagaaauuauaagacacguuauaagacagggaagaaauucacuuuuccuuucacacauucaaaggcauaguuuguaguauuuuaaguuuugggaucaaaauaauagcccugucaaacuguagggcaauaauggagagauacucauaaaucguauuaaauuugucuuuuugggaggagaagccuuucagaaauuguuguuuauucaguguuuuauauucuucauacaugagcuaccagaaggucuagguuguaaauuaaggauuuaaaacaaaaucaguuuaucuggaaacuauaguuguaugggagagguacacuuauagucaaguuuauaauuaaugggccuuugucauuggaauagaaauucuuuucucuugagugaauauuuguuuauauaacaugcauuguguuugaaggugggaucaaaacugauucacucuucauuucuugcauggaaaaagccagcauuuaaauguguacugugugugggcuuaauugcugcuuuuuguaaccaacuuuaggguccuguuguuguggagaugcacuuacugaucgauaaugguuugcucuucuuaagcuggaccacuaggaguuuuccuccuuuuacuagagccuaaaaaauaaauauuuauugaauuauuacuuugugccaggcauuucguuagguuuaaugcccaugauaugaucucugccuauaauuugcuuauggucucuuaaucuuaccuuuuguaagagagugguguguugugguaugcacagaguacuuugggggauacauaggacuaggauauucauuaauaucauucgguuggggagucucgagaaggcuuuucugacaguauuaaguuccuugugaaauaaguagauguuagguaauaauaaccccuaacauuuauugagcucuuaugucccagagaccauacaaaacaaaguacauacaucguuaaauuuaaugcucacaguagcccuauuaggaagcuucaguugcuaucuccauuuuacaguugaggaauuggaagguuagagagguuauauuguuugccugaggucaucgcacagcuuauuagcagugcuauuaggcuuugaacccagguagccuauauuaggguuuuccagagaaacagagccacuaggagaggugggugggugugugugugugugugugugugugugugugugugugugugugugugacauuuauuguggaggcugucaagucugaaaucuguagggcaggccggcagcccagggaauaguugauguuucagcuacaguucgaaagcagucugcagcagaauucguucucccuugagagaccucagucuuuuccuuuuagggccaucaacugauuugauggggcccgcucacacugugguggauauacugcuguacucaaagucaacugauuuaaauguuaaucucauuuuaaaaaaauaccuuuacagugacaucuagacugguguuugaccaaauaucuggguaccgugacuuagccaaguugacacauaaaauuaaccaucacacagccuaacuucucaacucacauuuuuaaccacuuggggaaagagcauguaaaaacacagaagcaagaagaaaagcauagccuguuuaaugaaccuaaaauauuuugagagggcugguuugaaggugcauguaggaaguguuagaagaugagauaggccucaacuagaugagucucaaggacaggcucagggguuugaauuuuauuucaagaaguacauuuuauuauagaaagaacacuggcaaagugugaagauuggcuugggagguagugaugcuagagacaaguaggccaagagagugaugggugucugaaggaaggacaugggaaugcagaaaaggugccacauuggaaagaugcaguauaguuaguguagcauaugugggcucauuggauuagaaaggaaaccauuuggggccaggcgugguggcucaugccuguaaucccagcacuuugggaagccgaggaagguggcucaccugaggucgggaguuccaggccaaccuggccaacauggugaaaccccgucucuauuaaaaauacaaaaauuagcugggcgugguggcgccugccuguaauaccagcuacucgggaggcugaggcaggagaauugcuugaaccuggaagguagaguuugcagugagccgagaucgugccacugcacucccagccugggcgacagagcaagacuccaucucaaaaaaaaauaacaauaauaaaauaaaagauagaaaggaaaccaguccuugguucugguugaagguuucuggaggggccaguuaucauguuuggagcugguuaaggguuuggaggagaugggugggauuuagaaugaaugcuuaugggaccaacaguugaaugugugccuggauagagaaaacgcugucaucaguguguaucacugauucucaaccggugcaguuuugcucuuccuaggaagugcuugacaauaucuggacacaauuuugguugucacagcuggagagaaggagagcacacggcauauguguguacucauacuacugaugaaaucuaguggguaggggcuagggaugcugcuaaacauccugcaauagacacaggauagcuccuuauaauaaauaauuauucagccuaaaauguuaauaguacugaaguugagaaaucuugauauauauguagauguguauauauacccccgaaguguggaaaagagaucucaacagguguuggauguuauuauguauuuuaaauguacccacucacauuaagugcauaaagauguauccagacaacuugugagaacuuacguguuucuaguuauuuuacaaccacauagcccucaaaagcaaccuagaauauggaaauauauccucacaacgcuaauuauccuuguuagguacacuaguacuuccuuuuccuaauacugaagaaguaaaugugauugaaauacaaaccaaccaaauauaaugaagagacauuucuacaugucaaaguuggauucuagauuuuuagaccugugaggaaucucaaccucuucauuuuauaaaugaggauauugagaccuagaaaaggaaaccaacuuggucccaaaucacuuagcugguaauuggcagauuaaacaagugcucugauuucagacccuagacuuaaaaaaaaaaaaaaaaaaaaaaaaaaaaaaagcacgaauauuuguauaacauuuuaucuuugcaaagcacuuuuuaagccugugguucuuuuuauucuuaccuagcucagggaacaaggugguaauaucaccccaauauuagagaaaauaaaacuaagguuuaaaggcaguaaguagcccaguaucacagaaguguuaaguagugaagacagaaaguaccaugcuuauuaaauccauagcccauauuucuugaacauuuuuagaggaagacacaaaucuaagaauaacagagaauaggaaaaagacaaucuaauagaauaaggaggaaauaaauguucaucaagugagagaacugaguagcacugaguccugcuuggcaguugcugaaauuuggaauguggaaugcuuagguaaugguuggauuaucaaauaucauaauauuuauauuaauauuucaccugccuuucucuuuccuagccuucaaaaccauuuauauuuuacuaccccuguuaugcuaauguauuguuuaauuuccaguuuauuucuaauuuuauaucaucgguaauggaagaauccuaaagccauugagauuucaguugucauucucuuuuugcauuauuuguuuagaauuucaccuuacucaacauuuucuuaacuuguaggauuuucuuuguguuuaauaucugcaucauacaccaaaguggguuucuuguuaauaaguaauacuauaguagacauguuuucggaauaggaccuugaaacuuuuuuuuuaagcuguggaaagcugguguuuucucucuauuguuuaguauuaauaaauacucuuuuagucuguaauagcaucuaaaaacauuucauaaccuuuggaugcauugugauacaacaguauucuauuuuaacaagauacaaagacucagguguuauccugaacuuauuaggagaaccuacaaauacacaucuuaguaguaguuggucuuagguuguugcuguuguuaaccuuggcacacacaaaaaacaucuuucugcuuaguaaaccauaucguggguauauucaugaacacauuauuuucuuuagaaaacaauuuuugauacacaucuaaauuuccuuucuaguucccacuacccuuuuccagcuuucagaagcucagacugggguuaaaauuccuuuucguauuauuuuaauuauugcucuccccaccuccaccccuuuccuguuucccccuccucuuuuccccuaacggcacuguucugcaaagccugcaaugauugauaugauggcagugcugucauucuuuuuaaccaaaaaaaagucauuuuuguucuaguuauuuuaauagagucccauuaaagauguauugcugacugaaauaucggcgugaagggcucucacugagcugagcccaggaauuaagaagucaggaaaucggcugcugcauugcaagagagccuugugugacaccgagucuccugauuggggagaucauuacugcuauuaugacucgacuugcguaggaauuuuaaauuccaucugaaugucaguaauaacccucuuagcaaauuauccugaauaaaaucacgaaggcauuuuauauaauagguguugaauuacuggauagauuugcuaauuaaauacucuuuguucugcugcaguugacauuacaggguaagaucuugaacaauuauucucaacagcuguacuuuguuaagggaaaaauuaaccacaaaguuuauuuuuuuauacuugaaguuggcagauuuuugaaaugugcuugaaaaaauuccaucauccaauugguaaugaguagauaaauaugcagguguugcugugaaaucagauaacugcagacugccuuauuaaugaauuuagcaagccuuuauagcccuguuuucuagccguuagcacuuacaaaaugauuuucugucagaaugggcagcuuuaauauuacacuugucacuucaaagugaacuuaugaauggucaucuuguaaucauuguaccuugugucuaguagaccuuucuggguacuuguggcuauuuuuaaaauguguuucuucaauggggaaaauaccuguaauguauaaguguuugauuguugacuucuagaacauuuaugugguaugagguuuuuuuuuuuuuuuuuuuuuuuuuuuuuuuuuuuuuuuuuuuuuuuuuuuuuuuugagaagguagugagacauaaugaaaagaaagugaaacauaaaguccagcuucuggaucaagcuuuugggcaaaaucucagagccuaauuuuccucauuugucaguugggauuuauaauacuguguaccccuuaggauuauucacuuagcauucuauaaauauuuauuaacagcucccauguaccaggcccucugguagauaguaagaauuugguagcucccugaguagauaacaucugagcccuccccagugagcaguuugaauugagggcuggacuugagggcagcuuuggaguguuucugcucauuagcacuuggauaagcauuggacuagagaggucacugugauacccaccaucuagaacugcuuagugaagaaacaugagagguuaggggucagacugguuguggguugucuuguauagaaugggcugaagaguugacaaacuguggugaggaccuugaaccugagauggaacauuaucaucagcugcuagugaggcccacugaaaagauggugagguccacagaaaucgguacaaccucuauagagagcuauuggguuauauuuauuuuaaaaauuugaaacauaacaaccuuugacccagcacacccacuuguaguaauuuaucuuguuacuggcagauuuguaaauuacguauguauagggauuguuuguugaaguaugguuguaacaguaaagaguagaaacaaccuauauguucauuaauagaacacuaguuaaauagauuauguucuauuuauacagugggguacuauguagucauuagaaaagaauaaggcagcucuuuaugugugaauuugaaauaaccucuaggauaagugcuaggugaaaaaagcaguugcggcauacucuauaguuuaccauuucugcaaaaaaagacauccaccaaaagauuucugccaccaaagagaaaauuguuuugguagcaguccucagguuaugcauggcaaugguugugaguugguggcaggauggaguagggguggaugauggaucugaaaggugaagguugccaguucacauugaagguacacucagggaugacauaguagauuugguucauguugugaaacaagaguagaagaaauugguuauugaauauguggaguuguaguaaaagguugacaaacugcuccucagguauuuuauugagguaacaguuacguuaugguguuguccauugugaugaagaaagcuaagccuagcuaacuguaagaggcagaggguaaagaggacucuugauaaguaauucuguccucacugugauuaauuugccuuggguuggucucauuauugcccuuucccuaaaggaauugucaaauauucucccacaaugcauuucccuauaauuuaaauguuaaaaaaugaagaugaaguuggggagagugacuguuuuuuauguuagcugaauuuuagugucuaguggaaaaguaauugggauuacuacaggaccuaucagucaccuggcaaacaguuuuuugaguuccuauuacagugaagucugcacuuaggcacaaacauguggucugaccuccaggagcuuguagucuaguuugggguggguaggugggagcuaauaacguaaagcaucauucaaguacuaguaaaauaauucaaacacagaugagaggagagagacagguaugggcugggccagucagcucaugcaggaaggauuugagccgaggguuguaaaauucaaugauaggaaaaggacuggggaaggaauuccggguaggagacacacugcaugagugaaggcaugaaaagaugagucuguacacaguuaacuguuggaagacugggagauuuauucuguccagcaagaggaucuauguaaaagaauaacaggccauacaaguggaacagugguuuaggugcaguugcagaauuuguucuugaccuuguaggcaucggagaggcauugaaaacauucaggagauugguaaugauauucagggugaguugaugagaccuaaagccaguagagacgcgaguugguucauccucagugacaaccucauugcuauggagucaggcgcuuuccaccuugcagccggcccugcucagcauguuagcuugcacccuaggcauggcccuucauggccaccgugaugguugccacugcuccaagcagcccucagucuaaaaagguagucccccaccgccugcccccucaaaucaggaaggaaaaccuuucagagaagcauccuacaggaauucuccuuacguuuaauuggccaggauucuguucacaugcucacgccuaaacugaucauaguuuccagaauggaauugccaugauuaucuuaggccaaugguccuuaagccagcuugcaauguaagaaaauguaagaaaacuguuggggccagauauuguuuguuuuuuuuuuuuuaagauccccaggugauuccacuguacagucaguauuaaaaccacuggcuuagccucaucagaauucaccaccauucaccaccccccagguaggagaaagggcuuccuugucuaagaacauaauauuaauacaacgaacaucugaacaaaacugggagauaguaauaaaggggagagggcaauaaaaaauggaaaguaauggguagauauaaaagauacucuaaagacaggauuuacaaagcucuguaauagggaagacgagaaagaaaugacaccaugaagcuugagcuuaguugacaaggaggacuauugaaguaggagaaagaaauauaaaugaaguaaaucuuuauuuggucuauuggaaaggugaccucagcuuuaggcugaugcuuugaaagaugggugauagcagagaggcaauagcauggagugacuaagaccccauacucgagucagaaugcuuggguucauauccuuguuuugucauucuaggacacuaauuucucuuugucuuuuggcaucuaacaagagaggauauuaauaguagcuaccccuuggagaucuaggggaaugaaaugagaaaaugcacaagguguuccuugcacagcaucuagcacauguauuuuaaacgccccccccgacacacacacuuucucucugaguccuaauuaugucauauuacuauuuuuuaagaggcuguuuguuaaauauguguuacuucugaucuggcucaaaauaauuuauaucaguuuuuauuucuauccacguuguaaccuaaauaucucugaucuguagcuauaugggccuggggacagacuuaucaacagauauccacguucgucuuaauucacugaauguuucuugagccccaccuuuuuacuggguacugggguagcuccaggcaauauagugaaaauccaucuacucucuuucuucaaugaauuuagucuagagaagaauuuuaaauguagugugcuuuuuuuugcuuuuuaagauccugaauaccaugaauaagaauugccagauuugaaaugcuuuguuaagcuuuuuuuaggcaugcaguucuauuuaaguauuaguaaugagaauaguuugcuuuuuugccauguuauagagauauuuuauuguguguguguuaaacauauauauguauauauaugcaugcauaucucuggcucagaaucagcauagaggcaaacuuagauuauauugauguuacuguuauuuuaagggcuguuguuagaaaaccuucaagagcuuuagaaauacauggaaauggcaaaucauugaaaguuaccuaucucuaugugcuucuauuuaugucuuuauaauuguguaacuuauuaaucuugacuuuuguuucauuuagauuuugaugcauacgaaagagaugguacaaaagguaauguugagcauuuucauuguguaaaacuuaaauaucauaacugguaacguuuuuguauucaaggaaaauuguaacccaaacagacuggaaauugcuucuuagguugccuaguuuaacauuuauaauccuuccuaauggauuacagcuuuuuucuuuuaccagugcugauaugaucuagccccugcuugaagccuauaugugaguguuucaaacaaauuaguaacagugcuaauuagaguuuauuuccaggccuuuauacuguaugugcucuaguguuguuuguuaugauugauuuuuuuuggcacucuucguguucuacuaaauacuguuugcaacuguauuaagaauuuaauauggauuugugccccugaauuuauagaauccauuauguuuccgcuucuuaaauugccaugaccacuaagcaugugguacaguggauaaauauagaccccauuuccuagucuuuuauucucuuuuuucucauuauuuaauuugguauuuuguuucaguugaaacuagacacaauucuccuuccacuccacucucuauuuuaagaaaauuugagagauuuucuugaugucagguugcuugccuuucugguuuauaggggcuuaaucuuuaauuguauacccugacaauauaaauaauaauuaacauaaacuuuugaaaagucuguggagccuguaauuucuguaguauggaaaaucuuuaguuucauuguauguaauggucacuguguuuuuguuaauuuuuauaauuuuugcuuuucaucagaugaaucuugaaguuauuuauggagauacagauucaauuaugauaaacaccaauagcaccaaucuggaagaaguauuuaaguugggaaacaaggugagauaauuuuaugaaauuaucugcuuuaccuauuuuugugaauucuguuucuaacauggaacacuauaaauucauguguauaugaaugugugugcuucugaaaauaauaaacuuggugucucucaauucuucuauuuuucugucuuucuuuauuauuuuuuucugagacagggucucacucugucacccaggcuugagugcaguggugcgaucagggcuugcugaagcguugaccuccugggcugaagugauccucccgccucagccucccgaguagcugggaccacaggcacucgccaccaugcccagcuaauuaaaaaacaauuuuuuuuguagagauuuuuuuugcccaggcugguuuugaacuccuggguucaagcgauccucccaccuuagccucccaaaguucugggauuacaggcaugagccaccaugcccaauccucuuuuuuuuuuuuuucgucuuguuuuguuuuguuuguuuguuuugacacauagucucgcuguguggccaggcuggagugcaguggcgugaucucggcucacugcaaccuccgacucccugcaaccucugacucccugcuucaagcaauucuacugccucauccuccugaguagcugggauuacaggcaugcaccaucacgccccccuaauuuuuguauuuuugguagagacgggguuucaccauguuggccaggauggucuugaucuucugaccuugugauccaccugccuuggacucccaagugcugggauuacaggcaugagccaccgcgccuggcccccucuuguuuuuaauuccuauuccagcuguuuguuucgagggugaaauucaaagguuuuuuuuuuuuuuuucuuuaaaugguagauacauuuuuccuuugaaaacagucuaaguguuauauguuuaagauguguucacguuaguacuuacuacauugugauucauaugucugguaggauucaggugcauuuuauacauaaauaccuacauacauacauauacacucacaacugugauuuuuacaggaguacuuaaaauauauuugaaaagucaaggggacauuuaaaaauaaucauuuguagccucuuaauagcaauuugcaaucgcaauucacaguguuuuagaaacacuugcuauguuaagauguuguccccaugaacuaaaacuaagaugucaucuuacaaacuaacaacuuccuaucuuucccuccuggaauauguggaauuugaaugguagucuucacuugacagcaagccuggcacauugugcucauacugggccuugaaaaguugaguauuuucccuggaggugauguucugugccuugacccugucagaaagagcagaggacucuuuauuuguucagcauguaguuguuugcuuauagucaagguguuaagggaggucuuaaacauuauuuuaauagucaaaguuugacuucuuuauuucuggucacauauuuaguuguuggacugucuauucacuaacuaacugaauaguuugaaggcaaguacuguauguaugcauuaagucuuuacauucaacaaggacuguuucauaauuuucauauauuaccuggggcugauccagccaguccuguccuuugguugcaugggaugaucuauuauugucucucucucucucuuuuuuuuaaucuauuuuugucccugcaguuuucaaugucuuugcuuuauacccaauguaauaucauguuacauacaagccaaguaaaauuccaauguuguaugacuucaaauucuguuuagauuaacucuugggaauuuguaacauguucaucuucucccuauuagauguuugagaagcuaauacuaauauuugaaauuuucacagguaaaaagugaagugaauaaguuguacaaacugcuugaaauagacauugaugggguuuucaagucucugcuacugcugaaaaaaaagaaguacgcugcucugguuguugagccaacgucggaugggaauuaugucaccaaacaggagcucaaaggauuagauauaguuagaagagauuggugugaucuugcuaaagacacuggaaagugaguucagcuuucaguuuugcuuuucuuguuugucuuuuaaaaauucaggugugaaugauguagagaaugcuuaugaaucugucaagcccaagaacacuucuuuguuauuuuuauuauucuuauuaauaagaauuauuaaucauucuuauuuggaauggaauuuuauagguagauuaaaacuuagaaaaagccaaauuugcucagugagaaaugccugcucuaagauacgucucaugaguuuuuaacucauaguaaggguaaaccuucacacuucagauccuuauagaguugguuucguugauguugguuuguuuugcucuauuguugcuauuagaaagugccuuguuuugugcuccugaaucuuccuagagccucuugagggacauaauuguuaagauuuucccauuuuauggcuuaaaauguucugggacucaaaaugggccauggagugagacuuuguucccacccguaugauuuguauauaaaagauucuuacuaauaccaaguuaagggcuccuucucaaauccuguguguaccucagaauuaguaaauaucaugauugaccuccuagcuuugcaccugagacugaagaaugugauaauaaggccugcuucuuuaagggucauauuaauguauaaagcacccauuucaaaaugaauuuuuaggccgggugcaguggcucacgcccauaaucccagcacuuugggaggccgaggcgggaagaucacuugaggucaggaguuggagaccaaccugcccaacuuggggaaaccccgucucuacuaaaaauacaaguauuagccaggcgugguggcacaugccuguaaucccagcuacuggggaggcugaggcaggagaaucgcuugaaccuugaagguggagguugcagugagccgagauugcaccauugcacuccagccugggcaaagaagugagacgccgucaaaaaaaaaaaaaaaaaaaaaagaauuuuuaggugcuucauguaccgucuuaauuugugaccuugaccaauucugaaaguagaagaauuuuuuauuuaaagcuaaaguucacaucaauuuuaauauucugaauguuggcauuuauaaacuuguuuucuagucuuccucuugcuaucaaguugggagauugaacaauuauugcuucugcaaaacuauucuugauuaggcaaaguugaccagcugaguauaggucacugugagccuuuuaccaaauguaaaaauguuugaaaugcuucauugcccccaaguguacccaaagaggaaaguacuuuguauggacuguggauuagaguguucucuucagcuuuguguuuucuaagaaaagacgcaucauaauagaaguaaauuucucuugaguuagaaauguauuaguaauuaaagcuauacaaauguuuuugucgggguucuuuuucuggcaaauuauaaugcagcugucaaacucucgcucugcauuuucucagaaauggauaaaauauuggcuuucuuacuccuuuccuuuuucuuuuuccuuugggucugguugaauaacaugaaguuuuuaaggaauagcguaagggagaacacugagcaacaaaaugaaggugaagaaagaaaaguuugaaaucuuuguuuuuuaaaaaaauuuauguaaaggacuucauauuucuacucaucuagcgcaugguuguugucucagguggagaugauaucuugauaucagagauaaugucuuggugcuuugugaggaaagugaaauauuugucuucuaaaauuuuaucuuaugaggagaauauaacugcuugugaauuuuguaauugcauaaaaauauaauggaacacaugcuuuucuucacauuuuauauaaaauauuagcugccacauaaaaaaugaucuguauguuuagggucaaaccccacauuagaaggcuggcaaacuuucgguagaguugguguuaaaaaacaaauaguaaccgccuuuucgacauuaacccucauauuagcucuuacuguagcuaauguuaaccacauguuaaucuaauggcauuucucuuccuucuucuccuuuacuaguaaaauauauuaaaaaaucaacugcugucuuuguuuuguuuuuuuuuuuuuuuuugcagcuuugugauuggccagauucuuucugaucaaagccgggacacuauaguggaaaacauucagaagaggcugauagaaauuggagaaaaugugcuaaauggcagugucccagugagccaguuugaaauuaacaagguaaauguagcauuuauugcugagcccagcugcugucauguguuuuucaccuccuucagauaguugaagaaccaccucauccuugcaauugaaauaaauucuagcuggugaugaaagcugcuuaacaacuaucucacagauugaguauuagcauaccucuuccagccacagguacugccaugucugccacagagaccuucucugucuaguccuuacuuuaauucuuggaagacuuguuuccagagguccuauggagugauacaguuuacauuccagagguccuauggagugauaucacuguaucacuccauaggacuggagaacacuacuuucuucauaguuccccuaaguaauaguuguuuggaguguaggccuguaagcuuauugugugcaugugugcauucauguguguguuuaacuucacagauggugauucuuuuggggacaaaaguuauuuagggacagucuuaguuguugaaaauagggaauauuuuuucuuaccuaauuugaaaaacagaaucuugguuuccaaaguauuguguaauaaacaaaauguuagguuacaaauuuauucccauuuuaguacccuuauauauucagaagcuaauuuugcaaauacaaugcuacccauuuugugguagauuucguugucaaagugcauacaaaaaaaauaaaagaaucuaaugcugacaguaaauggaaguuuuagaaugaagacucauucauaguacucugugcuaauguaaugcuugucauuuuugcacauuucuguacuguugaaaacauuuuuauauugcagcaauuacaguguuauuuagaaauauauuuucauuuaacauaaacauuuucccacauuuuuauauuaccuuaaaaaucaaauuaaucaguguauuaaaaagauguaucuguuucacugauacaucuuuauuuaaauuuguugauuauuuaauguuuucuauuauaaauaacucuauugaacaucuuuguuuauuuaucuuuuugcauuuggaugaauuacuuucuuauuuuagguuccuugaaggaaaauauuugagucaaaagaugugaauaucuguauggcuuuugccaaauugcuuuguaaaaggaugauaccaauugauaauagcaaaauaugccaguuucaccacaguuuugcauguaguggugaugauauuuaaauaaaacuuugcuaccauaaugaauaugaaacuguauuucacaguugcauugaauuugcauuucuuugauuccuagaagggaugaauauuuucuuacaguuuauguuuauucuuagguaaguuguuuccuguaccuugacuauggcauccuuaaugucaugaaagaagacauuuguuuauacauuagaaggggacaauguuucuugucacuggcucuccacuuuaagugaugaaguguacacauauuggcauggaaucacugugucaucuagaaaguagauuccuuuuagauuuuguuuucuuucucaaaaauuuauaugaguaagaguuacgacuuaagacuucuuuuggucaguuuuugcaucaauucugcauauuguaucccugauccugucuaccuuccuagaaacuuggguuucuaucacaagggcuuccagggaugaguuugggagugucaguccuagcaugacugcauaauuggcaaaauaacacugaacacaucuccuuuaggguagugggcccacacuguaacccccucauaugaaugaugacacaauauuacuagugugcaaaaagaaacuuagagucauagguauacugacagugucugcauucuuuuaaguuuuuauuauugaaauuucuagacuuauguaaaaguagagagcaugguaucauggauccucauguauucauuagucagcuucaauaauuaucaacuuauagugacauucuauuauuaacaauaauaguuaauacuuagugucuaguaugauaggggcugugaauagauuuuucuguggcagaacugaaacugugacuuacugucuuuauauucuccauaucacuuagcauagcuguuggcaaguaguaguuguucaguaagcauugaaagaauucauuugcuuauuuaaucauccauucagcaaacauggaguaccucuuauguacacaaugcugauucugggauauaaaguugaauaaggaauacgugguccauauuuucaagaugcugguggucuauuaaaaguauuuacugucggccgggcgcgguggcuugugccuguaaucccagcacuuugggaggcugaggcggguggaucacgaggucaggaguucaagaccagccugaccaacauggugaaacccugugucuacuaaaaaauaaaaaauuagcugggugaggugguaggcgccuguaaucccagcuacucaagaggccgaggcaggagaaucgcuugaacccaggaaacggagauugcagugagcugagauggcgccaccgcacuccagcaugggcgacagagcaagauuccaucucaaaaaaaaaaaaaaaaaaagaaaagaaaaauguauuuacugucccauuauucuuaacuuucauuuaauagagaagaauuucugcaguguugaugcaaguacaguaaauucugaugaaagggcuaucuuuauuguaguucuguaucuauuuacaguaagcuauucauuuguuaaaggugauauauccugaacaucuuuaacauuugucuaaaugcuugcacuauuuaaaacuugugagcuauucaguuucuacauuuuacugcuucgaaaggagaguggaauggaagagucuauguaugugacugguuguggauggucucaugacaauauuuuuuuuuuuuuuuuuuuuuuuaggugaugcugguagggcuugaaaaugacagguuaaauuaggguggagacaugcaugaagugaugggauuuaccuuuagagauuuuagcccguguugccaaaagcaacugaaaaacagcaugugugauuuugcugaacuacugcaaucuuagcuuaaauauauuucacaaaguaacacaaaauacuuugcagcugauuuuuauagcucuggcuaacuugagccuaaaccaccaggaagcauuuuuuuuuuuuuaaaugaagccuucuaaaacuagcuuguaaaguccccaaauagccuacaucuaauaauuggaaaguaugucagcugaaauuuagaauuucuuaacauugcacugaagaauaauccauugaagaagauaauggauuucuuaaguacuguuauaucaguuaagauuuuuauauuguauugcuuguccaagacaaucaaaacuucacguauuccaaguuugaggagauucaaauacuugggagaguuuccuaggcacucugcuacccugaguauggaauuuaguaaguuuacauaacuugggcaugugcagccauguuugaggaccugcuuuauucuucuacaucaguucucagauuucuuggucuuaggacaccuuuauacucuuaaaauaauugaagaccccaagagcucguguugaugugguuuaucucgauauuuaguguguuagaaaucuaaaaacauuuguuaauuuauuuaaaaauagcaacaaacugauuauauaauuacaacaaauagcauuucuuucuaugaaaaauagcuauauauuucaaaacaaagaaaaauuuagccugaggagugguaucauuuuacaauuuugcacaucucuuuaaugucuagcucaguagacgacaucuggguuuucauuucugcuucugcauacaaucuguugugacaugugguuugggauggaguauaggaagaaauccaguuuaacccaaacauguaguuagaaaaaggagaaguauuuuaguauuuuuuuucugauaguugaauguauucuucuuugauccugcaccagacgucuacagaugguauuuucuucguaauguggaaucugaagccauaucaaugaacuuuuccuguucucuuauauuaaaaucuguuggucucuguuguacuuugaaagaauauuuuacccaugcguggcaugaguugaucauuuguuaaauguugguucccugaauuauacaguauacuccaaaauagacacauucauuguacaauaucaaaaauuacguuuuaaaauauucguacuuauaucagaaaaguuuuuaaguauugggaagcuuuccggcucacagaaguagaaaaguuuucuaaaauucuaauuugcacuugaaagcuugaauuuuaucauugacaauauauacugucagauuuuuuuuuuuuugccuugaaguggcaggcucacuuuuuuuuugagaaauugucugccagauacccaagucagaauaacaguaguuugcccauuauucuuucaaguaaaaauuauauucugugaaaaaggcagcuaguuuagcuugcaacucaaacaguugcacaaaugcuuucccuugagcaaucuuuguuuuucagaugugccuuguguguacuuuguuuuaucucacaaaauaguagacuuguacucaaggguugagagcuguuuuuuuuuguuuuguuuuauuuuacuuuaaauccugggauacaugugcugaacgugcagguuuguuacauagguacacaugugccauggugguuugcugcacuuaucaacccgucaucuagguuuuaagcccugcauggauuagauauuuguccuaaugcucucccuccccuuccucccuacuuccccggcagaccccagugugugauguuccccucccuguguccauguguucucuuuguucagcucccacuuaugagugagaacaugcgguguuugguuuucuguuccuguguuaguuugcugaggaugaugguuuccagcuucauccaugucccugcaaagaacaugaacucacucuuuuuuauggcugcauaguauuccaugguguauaugugccacauuuucuuuauccagucagucauugaugggcauuuggguugguuccaagucuuugcuauugagagcuuuaaaaauaauucuuacuguuucaucaaggacauucuuaagugaaaguguuuuuuuuuaacuaugcaugguggugaagaauacagugacuguuaguacaguuugauaguaccauccugauucauguuuauaaggcaucagcaguuuugcccacuauugcuucuguaucaucaguacagguaguaucguuaugaaaauaguuuugaucucuggacccccugaaaggauaucaggaacucccagggcucugcaguccacacuuugagaacgggugagcucauccagcaguacccugguccccauccuuucucuugucuuuugaaaccuaccccuuccagggcuggguaucccccuccuuuucuuuaugcauacugaguuccagucuaauagaaugcguuuuuuucucaccuuuugccuuuuuguuuguuucucugccuggaauauucuugcccccauuaccuuuucuuaaaaucuugcuuuuccuucuagugccagcuuaguuuuuucuuccaugauuucuucucucagguggaaaucauucuuaccuuucuaaguucucuccauaacacuuuguucacaucuccuuuauggcacauauagcuuauuuuagagguuuuuuuuuuuuuuggaggggagguggaggguagagagucuuccacuaauagcagaugacugugucuuauucauccugugguacuuuauaauacuggaacaaauuauucugagaauuauuacagauggagugaaauaauuuauuccgcaaauauuuggcugcuacuguauaucaagcaucguuaggaacacugugcaugcaguugugagcaaggcugacauuguuccuguucucguaguacuuacuuucuguuacaaauucauucuaccucuguagagguugauugacagcaugaguaaauccagugauuucuagugccuuugggauuuauuaaggccagaggagccuuugagaaacaaucauuaagucagaguagccauuauucaucagucccaacugaucaguuaacucagugagauaauugcacacauuaagacugcauauaacacugaauuuauagucuuaacuuuuuaugucuaaguaucaugugauauggcccauuaacuuauauuucuuuuuuguugggguugcaucugguuauguuaguuauugaacaaaggagagaggagucuugaagaugggauguuuaaagauucuguagcaauauuuucuacauacagcuucugucauuuuuuauguuuauguggcuaguaugauucuagcaaagauguuuuuaguguauaucuguguaagaaggguuuuauuuuaaggcuuagaacuuuuuuguucccucuuuuaggcauugacaaaggauccccaggauuacccugauaaaaaaagccuaccucauguacauguugcccucuggauaaauucucaaggaggcagaaaggugaaagcuggagauacugugucauaugucaucugucagguaaacuauugacauucguaagacucugacaccucuuaagaacugaaaguaaaauccaaauuaccacagugucuuauuuagcauucuccccaauaauugauguuguaaagucugguuaguuucauagcauuuaaaaaacauuagagguguggcauaugucauuaggauuuucauaaaacauuuaugacagauuuguaacaguagcuacucuuuuaacccuaaauuaacuuuaaugcaaauguaaguuucgccauauguucagcaguaguccucauuuaucucuuuccuuuugcagcaguucccauuauaaauaucaguggaauaauaaaagaauaaaugccauuuuuucccuagcaaauguccaaauaauuaugugaaaaaauaugaacuacaugauuauacggagaaguugagagauccuaugaacauacccuaugaggaaaccacacaauucaaccaguuuuuuuuuuuuucuuccuucaaguggagagggcccaccuccuuacccuuccuucuccguuucacaagguaccucuaggccuucuggaacacaguuuuaagccacuaccaguucuuuugauaauagcaugccuauaaugggugaggagagagaguaagagagaagagcaguuuuuugacuuucgaagcccuuaacuauuuuaacaaaggagaggucucaucccuucuaucuguaaagauaagucagggucauagcauuuauccaaauucuuucaaauuacaaugguauagacuacuuaccauaagguauaauuuaucugaauaaaacuuuuuuaaagaaauuaaguuuuauccuaauuguuauugcauuguguuguuacaguaaaaaaauguuuuacauaaaccuaaaaaguaauugcaauaugauugauauuugucaaaccacaaucaauguguuuuuaaaucagagucuuuugaaaauuuaaaaguagucugcugauaccugcuauaugcuguggauguacauaacaaaugauuuaaguacguggacaggaaucagcacuugacucugucuccccccuaggguuacccuugauuaagaacuguuacagaaagccaauuccugcaggaaaauauuuccauaaaugucugacucgcucaagcccuuaaugugcuuugcauauugccucugacaagucucaucucaaaaaaacaauuuucauauuaugcaaauaaagauuuugguaaauaggcuagguuuuuuuuuuucacuuaugucuucacauacauggaaaagcucuuagauuggugaugagaagaacagauggcagcauacaacuuugaaaaauuauauagguucagugaaauagcauuaauaaugaaaucaagccacaauuguguuuuggccaaaccugcaaugaagaugugugguaacuuauaaaauaggaugaucauuguauuuaaaagucuguuuugugucccuugaugucugaauguuagguguuaagguuccuuuuucucaggucuuauugauaugcauaggcucaaaaugcuguugcuaauguaguacaguacauccaauuuuauguauuuuuagcaauuuccauccacugguaugugccuuauuugcuuuuuaaaaguaugauucauauuucuuuuuauuaacuuauucuccuuaacauaucccaagaaaaccuauaggacuuuaauuugccuuuguacccuacccaugggacaugcucccuuucaaccuguuugcuagccaaaucugccuaaauuuuuugcuuuuaagcacucaaauuauucuguuucauaaugcagccauauuuuuagaauaugcuuuugaaaauguaucaugacacuuuuuuuuuuuuuuuugagauggagucucgcucuguugcccaggcuggagugccguggcaccaucucagcucacugcaaccuccaccuccuggguucaagcgauucuccugccucagccuucugaguagcugggauuacaggcacgcgccaccaugcccagcuaauuuuuuuguauuuuuaguagaaaugggauuucaccauguugaccaaucuggucucaaacuccugaccucacgugauccuccugccucagucucccaaagugcugggauuacaggcgugagccacugcuccuggcccaucaugacacauuuuuaagaggacuguuugcugccuuaagcaaggguguccuccaagaauagccuauauccuaaacagguuuuguuuuguuuuguuuaaaauuuacguuuaggaaauaguacccuacugauaacuuauucagauggguucagagaguaauguuuuugguauguaauuuauauuguagguuguuagcgcauuaaaccuaugugaauuauuugcucagaucuuaaaucaacuuccauuuguuggcuagguuuuaaauccauaacuauuuaacuuucauuagacauaauuuccauaaggcaugccuuuaacauaauuauuuuaaggggcccacuugucuccaguuuaaaauauuuucccauuaguuuccuacuaacgaugacuaccuaguuuuguaugaaucgacugcaccugguugucucucugaaguauguacuuugugaaguucacaaauuacuacaugggcacuugaagaagaccagcguugcuucuuaaucuguucuuaaagauguaugccacguauucuugcacauaccauggggcccugcucagguuugagaaugaaaucuuugaagguuauuauuauuuuuuuuuaauuuugagacagggucucgcucugucacucaggcaagagugcaguggcaugaccacagcuaacugcagccuuuaucucccaggcucaaaugauccucccacuuuagccuccugaguagcugggaccacagaugcaugccuccaugccuggcuaacuuuuuuuuuuuuuuuuuuuuggucaaaaaaaaaaaugggggucucacugugucacccaagcugguguugaacuccugggcucaagugauccuucuggcucagccucuccaaguacugggauuacaggcaugagccacuguguccagccgaaggauguaucuuaggucauagccuaaauguuuuuccaauacgacauagcaaaaccugucaucuaaccaagucuuuugaauuuagccauguucgagcuuagauuuuuaaaauacccuaagaaauauguuugugucacuuuuuguuaaaacuagucuuuugugugaauauuuagaauaaaaacguuuuaaacugaaagcaugcucagaaaguuuucaacugcuuuuuugaaaaccaugcuuuacuaugagaacuacugaaauauuagaaaguaacucuaauauuuuuaaaggcaggugccuuuaaaaaauauuuuacauguauaaauucuauuuuaauucaccauuaaaaauuguuaaacucaacauugcuguaaucuuaaggguagaccaauuuuucauaauuccguaaauuguucagauuuuauguguuugguaaaaggcagucuaaauacaauugaguugugugaaaagacacugccggaggauuuuuucacgugguuuuuaucauugguugucaccuuauuaucaucuuaacaauucaagcuucugaaagagcaagaauuaaacuugauuaauuaugccuaauuccuuuuacuauguuguaaacuccugacaaauaauaauaagucuuuuaaucugaguuugcuuccuuuuuagguauuucauuuugucuuagaacagguagaaccugguugauaaacaggcccagguuguuuucaucaggagccuagccagaaaaagaggccccugccucuggucucugguaaagacagugguguguggaagguugccucugcuuugggcugggugcugagcuggaaagggacugauuguagcaggaaugaaagaauaggauucacauuauaaucaguucugcugagcagcugagcacugugaauaguuauaacuuacuaguuugaauauuaaauucuguuucagaugagaggaagagugagugaguuguuggauguugauccaguagagauaacuuuuugguucagagaugauggugacaucauucacaaggcuggauaugggccaauuauauauaauuucacagcuuuuauuuuuauagaguaaaagagaaaacccuugaaaagaggcuuucugacccaucuuccuuuucuugaggaggaaccagguaaaugauaccaaaugacaugcccuucauuccaguggccagauauuuggcuuuuagagcccugccacucugcuaggacacuacgucauuuuuacuucuuacuguaucuugcauauaaauuacuacucuauagauuucauuuccccacucuuuuccacuuguucauuugcuucucagugauacauggcucucauagaaaauauuacucccgggaucuuugaguuacuuugacuagaauucuugccugaagggaugacauuaacauaauaaaaaagaccauacacauguuuuuaaauuaucacuccuuaaaaagccuuucuggcuacacuaauuguuacuaagccuucucaguguuuggugauauggcaggugaaauuauuuaaucuggucauugcuaucuuguugguuucaaguuuuugcaaaaaauagaacacaacauauacuggauuuauauucuuggacacuggaugagaucucaagauugagauguuguccuugauuuuccuacucaaaauguucaacaauaggucaaaaagaggucuugauguuuagaaguagauacauaaaauuuaaauuguugccucucuguuugaccaagcaagugucugugauugaguugcucacaacuuuaccugugucuucuuuuuacgugucuuuuuaucauaucuucuuuuaggauggaucaaaccucacugcaagucagagggccuaugcgccugagcagcugcagaaacaggauaaucuaaccauugacacccaguacuaccuggcccagcagauccacccagucguggcucggaucugugaaccaauagacggaauugaugcuguccucauugcaacgugguuggguaagugucccaagcucacauagaaccucacaugguaacaggggcacauguagucuuccuugucucuugagaucucugcuuaugggcaugguauugugucuggcacuucuuuguuuauaguuuagaauguauuuuugugguuguuugguacugucuccacucauagacuaugagcuccacauacuugcuacuguaaccacaugccugcuucauaguugauacucacugaauacugagggaagagagggaaggcaaaagaaaggguaaagugaagauuucaggugccguuacagucaccgaguuuacauuguuauagcuuuaauuaguguaccuccauuuauaaggagauugaugcuaucuugauuauugguucaucuugucucugucgcugaagguauuuucaugucaaaugagaaaacauggcuuuuuaacaugaaauuuuuaauuuuuaauauucaauucauugugagaauccuacucuauaaguuauucuaaaaauggacccacuguuauccucuaggaauuggcugauuucuaaguuaucaucauccgaggagguaccagccaacccugagaccucaguauuacuuuggcuuuuugcuaugucaccagauugucuccguugcugugucauuauuacuuuuguuaucuuuugcuuagaaauguauuucauaaccagcccugauuucauuuuuagaugaccaaguacauaaagaguuacauugcuuuuaaggccuuuccucucucuucugugguaagcaaagaugaguguuuucagaguacugccuaauguccugagauggcuccucacuauuuguaagucaagcccaggugccacuggcaucucacaaacucuuaacuuuggcaauuauagacuuaacuuuccagcucccaccuauguauccagccuuauuucuuauucagucuacgcagugucucccaaauauggcacugcccauucugucccugcuucauggaagauucucccccucuuuuuacuaaaacaucuagcuuuagccaugggcuuugacagcauagggacccggguuucagugcugguucugcuauucacaagcuucugaaccuuggucuacaccuuagcuccuugagucauggaauagaguuacucugagggagaaauaagaugauaugugugagauguucagcacaaggucucgggcaaaggaaggacuccgugagugguagccaccucccacccuucuuuuaggcgucaguagaaauauguucauauuccuucagucuguaagauuuguauauacuuagugcucaacuacguuuguagaaugagacuggcuuuuccaucggugaauuaucaagucacauauuuucuguccugcaccuguucaguauguuucugagcuccucccugcuacccccaucgucacuaccccgucaauguuuacucuggaaguggaagcucauuuuuaacauuugccuaagcaaauauuaggaagauaaaauucuaccaccaaaauuaucauauguauucuccaagaugaguuguauuugaugauguuuauaaauccucagcugggaagagaggacuguaaaagcaagguauuuuuuagcuucacuuuuuucucugcuauacauugagcguuugcucuguuggauacagugauaaguacuuugcauuuguuaucucauucaguccuugugacaaccucacaaagguauguuggauuaacuccauuuuacagaggaagaagccaagguuuagagagguaacuaucuuggucuuggcacauagguaguaaguagccggcugugauuccaaagguugugaucuuaacuacugugcuaaacuugauugccuguucuuagcucuaaaaggcuaugaaagauguuuucaaccaggagcaggguggcauagauguauaagcauggggggcuucauguuuuucuugcucccucuauuucucacuguacucccccccgcucuccacugaaaaccucugaguaaaaccauuuuuuaaagaguagaucuccgaguuuuuccauuugugucuucaaaaaccugguguaaaacuguugcccuuuucuucuuugguuuugaauuuuuuggugacccagcacugagaggagguagauggaacaagccuugucucaugaaugacauuuaagauaaggacuugcguagccuuguaugucagcaaaagagcugagcaauaaagggugauggagccugcuuggguggauuggccugaugccugccuggaugugucaaggccagacauacuaagagggaccagacugauuuuguuaguuccagaagucauaguuaagaugauuuuuguuuauaaauugaacaguagcagauuuugacuugacagauacuuuauuauaacugcagcugcuguaucauaggcugccuuaugaauucaguuuucacaaauuauuuucaaagccaguaguagacaagugggucccaucuucagaaguuucauguuuuaucucauuauugaccaaucucaaucuacacagagaacccuccagacuugcacacggucccacccauauacccaucacuccugccucacaaccugaaaauucucuaggugcagccauggcuguguggacacucuucugggcagucccuucuuggugccauguagccaagucaagcugaugggagggaauguguccucggccuugagggaucugcaacugcuccucacuuuuggcuacuuuuucucauuuuuuuucuucugccacuugacagugguuuuuauaucgcggaugugugaaguugucaucauuguguaguccuccucuccugcuuguccucuucucucauccuacccugugccugcaccagcaguauauacacagccaucuauauuaguaacaaaucuuguaguccuuuccuucugcccccuuccaggaguuucagcauuaaugaaguguaggcccacaaguccccaucaucaugaagaucuguagaaaacauugaagcucaccaggcagaucucugcaggcauuagccuccugcucuauucaggagcugaauuucuuaucugcacccuuuauuccucuaccccaaauaaaaaauuaggguggcuauucaguaggggcuucgaggccccuguuaucaguucuacuguagccuguguauuuaggaggagggagggagauggggaagugguggcaaaguaagagaaguguuaggggguacgugguuucuaagaggugcaagcuguaggcauaaaauuacuguaauuuguuuuuaaaauucuaaaucuguuuucuuuauauaaaaaaacugcagcuagugaacugacaccguuaaauaaguugaaguauacaaauguauacauaaaauacaagcccuccaacugccuaaucacagacauaaaauaauucucuugcuuuuaauguaguuuuuaucuuugauuaaugaaauguauuguaguauugaaacuuuagugaaguuugauacuuuguccuuuuaguuaguacaaagaaaucaggaauaauggcauaauuucauuuaggaaaauuauuaagcucaugauuuuuuauuuuuaagacucuuuuguggagagcaaguauauuuuucaacuacuuuuuucuuucucuauugcuuuuauacuacuuuccuugaaaugaaaggcaagcaucaaguguugguuuauccuauggcuucacuuuggaaauucucuauuucuccccaucaagauaccuccugaagucugucugguggcauguugcauggccagguguuccguauggggagaccauuuuagugaaagggagagaggauagccuauuaaaugagugaaugaauaaggcucuugaauugaaagagaauaauuuguucuaauaacuaaugguccucauuaucccacaguaaaauauguaucauuuuucugaaacccaugcaagauuauugcuauugggcuuaaauaaagcaaaauuuuacucuuuuccaucugugaauaggaaaaaauauaguauuacucuucuuauacaauagcccuaugggaaacauggccacuaaaacuugaaacucuuagcuuuuguucucuagacuauagauuuuucucucucucauucuauugaaagcucucccguauucuguggaugaaauauucacaguaugcucaaacauccaaauagucuuccauaccuagcugacuaggccagugaugagaauagucuaaaguucauuuuugaauuucaucuuugaauaaauuuauguuuuauguauaacgguacuuagaauuauauguaauaucucuccuccaaugagcaaugauuuguacaguaguuauaaagaaccuuucuucggggucagugauaaaauuucaggcauuuggcuaucugggcaguuuucucauugguccugagaaauuauugagguuugaagaacaugagaauuuagaauuuaaucucugaaaauacugcuuaaaagaagacagaacacacuuaacccaguguguucugaguuaaauuggaaagcaaaaauuuccuuuuaaaaaaaugaugcauaccacucauaucacagagguuaguuuuugucaguagacaggguucaguaauaucaucuaagaaauaagugcgacagugggugaaacagggccaagcgauguuugggggugcuuuugacagauccagggagauccaccuacaaaaaagagaguaaaguacagauggguagggguagaaugaugccgccagugaguacuucagguauuacuuugucaauaaagaauuuugccuuuuuucauuauuaagcucuuauaaaaauaaaacaugaccauuuccaaacuguaaauauuuucuuuuucugucuuuuuauuuuuuauuuuuuuuugagaaagagucuuacucugucacccaggcuggagugcaguggcgcuaucucggcucacugcaaccucugccucucagguucaagugauucuccugccucagccuccugaguagcuggguuuacaggugugugccaccacaccuggcuaauuuuuguauuuuuaguagagacgggguuucaccauguuggccaggcuggucucaaacuccugaccucaggugauccgccugccucggccucccagagugcugcgauuauaggcgugagccacugcuccuggccccaaacuguaaauauuuucuauaacauaauuaauaguaaaauuaaaaaauguuauaccaaaugcauugcagaauguuaaaggaaaucuuaucagcugauaagagcaucucuuacaagauggagugccauuccaagcauaucauccaguggcucaugcucccagucuagucuacuuuuguauucaauauuaauugaagaccugcugugccuagcaccauaauaggcacugugaaggauacaaaguugagucaguuauggacccuuuauucaaauuacagcccagucauuucguugauuucacuguugugggcaagucuagugggcaacacaguguaugucccaaaaaaggugaaauaaaggguuaucaaauuucaaaggaagcagaaaccacuccuagcugggcccaccacggaagaguuuauaaaaguagaggcauuuugaggcauugcuggaaugggcuguggagaggcuagugugaaguugggaaugguugcccacccuacugcuuaccaauucuucuagccugaugaacugcagggguaaccuguguuaucucagccacccccaaagcacuuuagggaauucaaagagagccucuuuaaggguuucaguugaacgguccugcaucucagucucaacaaagugagcacacaguggguugcuucugugucgcuagcccacaauagagggccaguagugacacugcucaucucacauaagcagugagaccuuugagaacuuugaaccaaaccagagcauguuuagaauaauugcuuuggaacuuuuguaugaguuauguaacaacucuggcuuuguaacacuuagagguuuuaaaggaaaauugcggauuucucaaauuauuuaaauuagaucaauuuuuuaaaaagauaaaauuguuuuaauuaaguacaccaaagugacauuuaucaagaucguguagcuuauagaaaaauggauaagaccuaaaaauggguaaggauaaaaaaagcugaauacuauacagcauuguacacauacacguacacuguauuauauauguguaugaauaaaauagaaaaggguuaaggugaugaauuauagguucccccuuugcugacaaaauauuaauacuguuauuuuauuauuaauaagacaguuuuuuccaaaaccagaaguaaaacaaugguuaagcaauuacuaacucaccuucauuuauuuauuuauuucagaugguuuugggggaacgguuaguguuugguuauuacauaaauaaguucuuuaguggugauuuuugagauuuuggugcacccaaagcaguguacacucuacccacugugcagucuuuuauuucucacccccaucccaccuuuccccccaaguccucagaguccauugugucauucuuuugccuuugugucaucauagcuuagcucccacuuaugagugagagcauaccauguuugguuuuccauuccuaaguuauuucacuuagaauaauggucuucauuuucauccagauugcugugaaugucauauuuuuuuuuauggcugagcaguauuccaugguguauauauaugccacaguuucuuuauccacucauuguugggcauuugggcugguuccauauuuuugcaguugagaauugugcugcuauaaacaugcacgugcaaguaucuuuuugguauaaugacuuguuuuucucuggguagauacccacuagugggauuucuggaucaaaugguaauucuacuucuaguucuuuaaggaaucuccacacuguuuuccauaaugguuguacuaguuuacauucccaccagcaauguaaaaguguucccuuuuuaccacauccauaccaacaucuauuuuuuuuuaauuuuuugauuauggccauucuugcaggacuaacucaccuuuuagaaggugggugguuagggaccuugagccuagcuguuuuuccccagcaucuaccaacauagcuggaagagaaguaggcuguguuauaagacaagcaaucuuuggacuauuauuuguguuauuuuauauuccaaauauauuuccagcacagaguuaccaucuuuucucagguuuaaaaacaggaaaggaaggccagguaccgugcguggcucacgccuguaaucccaacacuuugggaggcaggaggauggcuugagucuaggaguucaagaccagccugggcaacauagcaagaccccaucucuacaaaaaauaccaaaauuagcuggguaugguggugcaugccuguagucccagcuacucagcugacugaggugggaggaucacuuaagccagggaggucgaggcugcagugagcuaggucaaggcugcagugagcugugaucguuccauugcacuccagccugggugacagagcaagacccugucucagaaagaaaaaaaaaaaaaaaaaaaggaagaagacacuugaaaagcuuccugccaagaaauacacaucucguuaaguuaaaauuuauauuugugucuauugucaagggcauuaaaaccaguugauugaagucaugagaaugcugcucaucaggcuuuuuauucugucaagauuuugagaauuaucuucuccaggaaaauaaaaaucuuggguauucauuuaaaccaaaggcucggcuauuauuucuucuaaaauacucagaaauuuuccauuuauauuaugaagagguguauuguuggugugaaagacaguuuugguugucugacacuuauacaguaaauuguuuaucuuuaaauuggaucuguaguauuuuaaaaacuuguugggcugggcaugguggcucacgccuguaauccuagcacuaugggaggccaaggcggguggauuacuugagaucaggaguucgagacaagccuggccaacagaacagggugaaaccccauuucuacuaaaaauacaaaagaauuagccaggcgugguggcgggcaccuguaauucagcugcucaggaggcugaggcaggagaaucucuugaaccugggaggcgagguugcagugagccgagauugcgccaguguccuccagccugggcaacagagcgagacuccgccucaaaacaaagcaaacaaacaaaaaaauacaacuuguuauuauggaaaaauguauauuauauauauauauaugguaguagagaauauaaaauuuuuucuaguaucacacauauuaaauuauaggguaagauuaaacccucauauacucaucacccaccuucaguauucugcacugguggccaaucuuauuauuccucuuucccaccuuccccuauuauuuugaaguauauccuauauauuuauuuuguguguuaauauuucauuuugcauuuccuuuuuuuuuuuuuuagagacaaagagucucacucugucacccaggcuggagugcaguggugcgaucucggaucacgacaaccucugccucccagguucaagcgauucuccugccuuagccuccugaguagcugggaucgcaggcaugcgccaccacccccggcugauuuuguuuuguauuuuuaguagagacgggguuucaccgugcuggccaggcuguucuugaacuccugaccucaggugauucuccugccuugaccucccagagugcugcgauuacaggcgugagucagugcgcccggcccauuuugcauuucuaaaagaaaagauuccccuuuucagcauaacuacauuauuaucacaucacaccaaaaaaccucacaauuccuucauuucaucuaauuuccaacaaguguuuauauuuccgugauugcacuaugaauacacuuuuuuuaaaaagcuccuuguuuggauuggaauccagucagggucaacuugguaguuaauuucuauuuuuuuuuuuccuuuguugauccucccaguuuguuaauuaaagaaacugggcuuuuuguccuauagaauuuuucucauucuggaguuuacugaucacauccuggugguaucuuuuaacauguuccucugucuccuauguuuccuauaaauaguuagaucuaaagaugugauuauauuuaggcucaauuuauuuuauuuuauauuuucuaaaauauaaaauacacacuucuuccuaggcaaugggguuuaugucuauuugaguuucaaugcauuuugcaacaaauucauagauguuucauaagaaauauuuagaaugcaauuuucucaccuuuccaagugugaauuuuucauaguauaacaugcauacagaaaaguacacaaaaccuaacuaaacugcuugauaaauuuucacaaggucaucaugcacuaguguagucauuacugagcucaagaaacaguacauuacuacauucccagaaggccccucaugucuccuagaaaugauccucuacauaccuggcaucuaauaacauagaugagguggauuuuuggggauauuacacaaauugcgucuuuguucuuugugucuagacuacuuuuacugaauauuguuugugagauucauccaugugguuguccuuccuuucuguaaauucuguauaauauuucauugucugaauauaccacacuguauggcuaucuacuggagguacaccuaugaguuguuuccacauuugagguauuuugaauagugcugcuuugagaguuguuguacagguccucugucaaacguaagcauguauuuuucuuggggauguacuaaggagaauugcuaggccaucagggacauguauguuuacuuuuaguagauucugccaguuuuccaaagcgguucuacucguuuacacuuccuacuagcaguguuugggugcuccacauucuuaccaacacuugguaagauaguguuuuccaucuucauuuuacaugguggcauagaguugugguuuuaauuuguauuucuuugaugacuaaugaaguugaacaccuuuucacaugcuucuuggccauuggaguauuuccuuucgugaggugccuguucaagucuuugucuguuguccuguuggcuuuucuuuuucuuauugauuugcaggcauuuccuauguguucuaauuacgagucuuuuggaaguauauauuacaguuugaguauccguuaucugaaaugcuuacgaccagaaguguuugggauuuuuucggauuuuguaauauuugcauauagauaauuagcuaucuuagagaugagacccaagccuaaacaugaaguucauuuauguuuuauauacaucuuauacacguagccugaaggcaguuuuauacaauauuuuaaaaaauuuugugccugaaacaaaguuuugacugcaacucaucacaugaggucagguguggaauuuuucacucgugguaucauguuggcacucaaaacguuucaaauuuuggaggauuucagauuuuuggauuagggauguucaaccuacacaaacaucuuuuccuauuuggcaugcuuuuuaagaguauaauucacauaauuuaccauaaaaugcuaaaaucuugaguauuauacaaucaguuaucuaggcacagacacagaacauuuucaucacuccagaauguucccucgugccucuucccagucagcaccucuguuauaguagcaaucgcucaucugaaaucuaucaguauaaguuaguuuugccuauucaagauuuucguauaaaugguuuccuacaguauauacucuuuuugugugcaacuucuuucacuuagcaugguauuuuugagauucaucugucuuguugcauguagcaguauucacucuuucauugcugaguaguauuagcugaguaguauuaugguagauuauaccaguuaauccauucacuuguugauggacaucuagaguguuuccauuuuuggcuauuaugaauaaagcugcuaugagcauucuguggauauagcauucaccauuugaaaauuauuuuuuucuuuaaucauacuaaauuuucaguucgcauauuguccucuaagauguccagauauaugaaagccuggacucaugcaaaagauaaaugguuuacuuccucuaagaaauuuuuacaaaaaaauuucacucaaugggauucuguuaauuagcuucccucauagauuaaaugauccauauuacaaacaacugcuuguaaauaccaguuacucccuuuacucauuuggaauuucauuuauguggauuuucccucuuccccacuugcaugaacauauguaaggguuuuacuguaguuauuugcuguugcacuaauagagaccuugucuuuugaaggaaggaaaguauuugauuaaauguaucagccucucuaauaacaauaugucucaaguuaugaacaguuuaaaaacuccuugggagugggggcaggugaacauucuaaaaacaggcauaauuuacaaugguuagaaagugcaaugguagaaaaauaauuuugugcuaaaugucacacugggggugugugugauaaggcuauggugacuuaaguaaagacaguacugcuaaacucauacacccugaugccuaugauguuacuuucuauaaauacuucuugaaacaugagaguuuugauccuguugccaaaauaaugugagauccuagaaauuuucuaauuauaaaugacaguauuuuaauuucauuccacugccucuuuuguacccucaaccccagcacaaaugaguccaucacuacaagccacauaauugaauuaaagcauacaucaucucagccuauucuggggggaaaccacggcugcucuuccuccagauaacuaguuuugcaaagcccaggcaggcugcuucuuccuucauucugugccucaccaaaagacuuaagucaccugucaagagcuagccuaaaagaaauggaaguuacuuuucucaaauggggcauaaaguuuguuccuuuaagccaguucagagaaagcuuucaguagaagcaauaaggaauuugggauucaguuuugcauuucuugcucaaagacuaauguacgcaguguaacauuaauuauacgguguagaugcauguagggcaagugcaguaauaaagauuuugcuuuaaugucauuuuugacagaaguguuuaauuuuggagugacaacaauuaaaaauggaauuauauguagcugcuguuuugcacauuuuaaaauucagaaucucuaccuguagguggcagcaccagauacuuguuucuuguuucacuccagacuuaaugaguuuaggguauaagcaguaaaacuuuaaagucuacugaaacuucgaaauaagcugcuguuaccaguuuugugagaauuuggaaaaacuaauguauguguugacuaaguuuggggcuuauuuaacccuggauuuucaccuuuucaaaaaagauuccagcagcaaugauccuuacuuuuuuaacaugacauuguauguuuucuuaaaaugauuuaauuuagcccucugugguuugccuguugaacuuauaacugcucucccaagaaaauaacuuuuuaauggcauuuugguauuuaaguaacuuguacaaggaucauuauauaccuaauauuuuaagcucauuacagucucuucucccuuuauauuuuuacauuuuagcauugaacuaugaccaagagacuauugagauugaagcuccuuccccuggggaaaaaaaaaaucaccuugggaauaaaucugaaguaauuagcugagccaguugacuuuguuacugccaugggaagauugagugauuuguagaaauggauauuuaggguagacauuuagaguagacauuucacagggccugguauuuuucgcaaguugcagccagucguuuggguguuucuccaugaguaaguaacaagauggcccacacccacuuuuagcuuacucugcaggcaggcugucccgggucagugcuugcagguucaugcacucaggugcaccaagugagccauggcugguggggagggguagagaguagcuccucuugguuccuuuucguagccuggccaauuuuguauaugugcaaaccagcauuguuuuguuccuuuauuuuuggacugugaaagaaacuugccuuuuagaaaaaucuugcuuauuuucuuuuuccuuaucuuuugauuaguguuggccugggaaauugauuaauagucauagggucagagaaaaagugaagcugcuuucucauaauugcaaauaaaucaaaacauuaugugaauacuuggauucacaacuagaguuugaauuagcgacaguuaccccucacuacagagaugaacuggccucauucagcgguguggucucucucaauuccucugaccauccuuagcuuuaaaugugagaguauauguauucccacauaauucucuaauuuacuauuucucuuagggguuagguaacuuguaaaauaagaauguauagugucuuggugacaaguggcccauguuaacauaauuuaugucacuaaugaagaacagcuuuucaaauuguucugaauguguauucuuuguuuuuaucauauacuaccacuuuaggaaauacuuuaauuccuacaacgaguagcuauuaacuucauaugcagcaugaacaugucucauauaguuuucuaaaugcauaaucuugagcgaguacagucuggauuaaaugauguucauucacuauuuuauuuuuucauugaaaugacauuuauuuagugcuugccacgcaguaggcagcguugaacucgguuuguucuauauuauccaauuuaaacuucaaaaguguaugaucagugaugcuaccuccguuucgcaggugagaaaagugagacucugugucucaguugucuuauucuuuguuuggccccuuucaacugugaagagucagccuccaguauuuuauaauuacuagaugucgcuugacagcugaccaaauaggauuuaggauucugucacugaauucugaaugcaucuguuagauuuaucuaccuauguagcuguugauaaauuuuaaacaauuuuuagauauuuuugguauuugugagcuuuuggcuuagugacuguuuuauauuacuuauuuaccuuuauacuaaaauaagauaguuuucucuuagauuuccaaaagcuuuuccuuagauuuccaaaagauagaaauauugucucuuauaaucuuuucuugaaagcaucccuuagcaaucccuaaaauucuaagaaacaguguagaauaauuauuuuuaaguauaaauucaaauaguaaauuuuggcacacauguuuugaccaaggguaaauuaaauugguuggccuaaaaauguuucuuuucuuuaauuaguuuguggaaacaaaauagcauaaacaugcauugauugauuucuuauguuguuuugaaugaaauauggaagguauauuugguuucaggauucucagggacauuuuggccuguagaaucuguagacccauuguuuuugcacauauuuuaaauuucugaauuucgaacaucaagaaaaccauguugcauuuugucucagaugcugcuacugaauuuuaaccacugaauuagauugcaaccuacaugcuguuaacuacugagccaagaugaaaucgacuacugcauugaaaucaggguuagcugugucugcacuugaaggaguuguaauggcagugaaccuguuuucuuuaaugggauuuuuauucccugauuuuauucucaguuuuaauugugacuuugauuuuaagagaauuucuuaguacacauuuauuugagguuuucauuguaacuuuaagagaauaauaaaaaacauccuaucgaaguaggugcuuccaaacccauauguucaguggcauauuucuguguuguguuguugcaguuacuuguuuuauuuauaaaguaucucuuguaaaaagagaagucauuuguccaugugcuuuugaguucaaaugguuguguguaugugcaugaauuuaaaauaauuuuuugugggaguuuucuucuuugggguauuuuuggaauacuuuucugaauuuguuuuuuucuuuuacauuaauaggacuugaccccacccaauuuagaguucaucauuaucauaaagaugaagagaaugaugcucuacuugguggcccagcacagcucacugaugaagagaaauacagggacugugaaagauucaaauguccaugcccuacauguggaacugagaauauuuaugauaaugucuuugaugguucgguuaguuguuucugucuuucauuuugugagugaacuuguauaaaggccuuacccccuucccccacuaugggguauauaaaaagggcgaaauaaacacacacauguugcuuucauguguuuaaagaauuuuagcaucaugugaaaucuaccuucacagcuugcuuuuauuucuguuugaaaacucuuacuugaaugugcuugaauauuguuuuggcuuccuagagugcuugaccuugguuuuuaaguggaaucccuuaaaaauucuaaauuaucuuaaaguauuuuuauuauaauuucuuaauuaguaaccuguauugucccacugucaacccccaucuauuaagacuuagaccaauauuuuuccuuaucuuaaaucaaguuacugggaacuaaguguuuugggaaaguuuguguuugucuuuacacaucccacuuaccuccauuuugcaaagguacucuuaucuuuucugcugucuuugcauauuagacauuuaaaaagucacagggagacauuccuuucaagaaguacugccaaaaaauguauuauugaccuuggaucagagcuugaaacuuggccaauuuacuugauuuccacugcaguguuaugcauguacuagccauuggcaaaggaauaggcagcagaacuguguaaaaccuugaaacugaaagaaaagacgcccuuuaucuaaauuaaaaguaauuauuuuaaguuaauuuggacaaacagcagauguuuugcauuuuuuugaaucaaaacaaagcagucuuuggaagcaagugcaaggaagaggcagacacagaucagcaauacuugcuaaauccuugaguuuugcuucauuacagcuguaaauaagauaguuaauugcauggaggcuugacgacuugcagaugggcuaacuguggaagagccgaugucaagcucugaaaucucuuccaccuggaauugcuuagcguggcggguaggguuauguaccagauuggagcaggaaaccaagauguuuaaguaucagaaaggaaaacaaaugcuucagaaaucccaacaguuuugcuauauauuacauuugccuugucuuuguuuaaaacaaaacacaacaaaacaaaauguuuucuccaaauauuaauauuuauuuauuucaaauuuuuacuucuccugccucccucccccaauacacuucauuuuuuggaaaaauugccaaaauuuuagauuugcuaagcagacaguaagugauacuguuuuugugguacuacacuuuuaacuuuuagacuuuauuuuuaaaauuaacuugacaagaugaaaacaaacuaaugugauaaaggcucuuguuuuucuucaaguuuguaaugaauaaauacaaauuuaaaguuuuuaaucaguaucucugagaaagagguuuauuuccaguaacaugacuucacugguauuuacagagggaaaauuauuuuauccauagagucccucguauagugaauguaaaauagugauuucaggguuuucccuuugacuuugcacuccauuaugaugauggcaaggaauggaagguauguaugacuaaagcggucuuugggaggaaaauaauugagaagauaggguuaacaacucaccaauaaaacgaauuaagaauauucaacacuaggacagcauguaaguuuuuaagcacaaaaacccuuuuauagccucacaguaauuuuuuguauacuucuccugacuuauguagggaacagauauggagcccagcuuguaucguugcaguaacaucgauuguaaggcuucaccucugaccuuuacaguacaacugagcaacaaauugaucauggacauuagacguuucauuaaaaaguacuaugauguaaguauccauaaugauauucuuacauacacaacuuauugagguuugguacuuguuuauugguuuucaugaaacuaaaauuuugaaaagacuuuugggaaaaauuccuagugaaauacuauuaauacaaauaugauaaaguauguaauuuuggcauauuagcaugacaaauuauuugauaauuucucucaggcauuacaucucuuucauuuacgagcaguauuuuaaauaaugaaauuuuuacuucuuuuagaaaaagccagaauauaauuaagaaauguuuuaguuuauuguuaccuaaauaagacuaauuaaaugauugcuuagaucuuuggauaaaggaagaaaaaaaucacuauuggcuauugucagcaaguagagccauaagaucguguguagugaucuuaguggacugcccacacaaaacuaauacuuuguguuuauguagcacucuaaacgacuccauacccuaguuuuuugaggaaaucaaauaucuuuuaaauuuaaaugcaguuuuucuggcauucaaaagagaauaucuaauuuuuauaaauuuauaguaaaaaugccagaacagugagugauuugucuucauuggaaagaaggcuuuuauucagaguuuuuguuuuuaacgcauuucacaugaauuaguuuuuuucucuucaaaaauuaaaaauuucacauuucccacgugauuuuucuuaguguuucaguaugucauuugucaucuaaacaaauuuucuguuacuugaaaguuuacuguaacuucuuuuuaaaagcuacauuggcaacacauuucaaaaaaaaaaaaaagcucaugucuuaguuaaggccuaugacuuuucuaaagauuguucuguacuuuuuacucguauuaguuaacauauaauagcauuuucuucuuuaaaauagaacucauuaugugaaaaguaacuaucagaucauuaagaugaagaguaaaaacauagaguuccaguauuaugauuuugguguugaauauauuuaucagaaaagcaagucaguuugccuaaagauuauuaaaaaauaauaauuaugacuacauuuugggaaaaucugaaacauuuuagugaauaauccugugcugcccuuacugaacaguggaugggaauaaaaguuggcuguggggucacauuccucaguaggugagaugugcagcacaugaaaauuuaggccaaaucaaaacuauucagcuccucauuuacaggccucauugaacagaguaugauccuugcuugacucuugggaagaauucugagcuuucucucuguguuuagucuaucaagaucuucaccauggaaauguuaauacuagaagaaacuuaucuauuuccuucuuuaagagggaauagucuguuuugacuaaguugcaaauacucugaaaaaugaucuucuguauagcuagaaauaugcccugacugaaagacugauuucuaaccuaauuguguguauguugugguggugguuauauaaguauuuuucaagcuaaauaaccuacuuuuagggauccagauauuuaacacaagguuucuagagcauuugcuuuaauuguuuuuuugccagccaucucacuaacaucaaguaacagguuuuuguaguuaacugcccacuugauugacauuucuaagggauuucugaucaaaauagccauaugucacuccugggguuaaaaauugauaugacugucuugaaaauuaggaacuuauuucucuacuuucugaucugaauuauaugugauuggauggcagagaacgaaauccguuauucguucuuauggccucaugcuaaacaaauauuucaaauauuuuccagaucagagcuuuuguacaaaaagccccuguaccuuuagguucuacuuuauugguagaccauccuguuuccuccuagagguacauggcauugaguuucuuuuguuauugugccuugagugauacugauuacaguuauuaguucagugugauauaucauggugaugguaauccaauuggagacuaaucuagcaaguguacugagguaaggauauugauaguaaguauugagguuaagugauugucucugaagcuaauuaccaaaaugguuuucuccuauuuagcaacuuaaaaaauacuacccacuggacauaaaaguuguuugugaaaugaaggcaagaaucucaauauuguuuugauuuuagucuuagaagcacugcaggagaagucaaccugcacugagaaaggaagguaucuucaugagaaagggacuccaggaagaugaauggaauaugguacuugaccaaacacuauaaccugcgaagaagcauaguucuagaugacuaagaaauuagauugucaagaaaaaagggacaaaaguuugggguaacaaaguauacuucuaaaucacuuuaauuuuggaaaaguacaucacauucuguuaccuucugucaugaauuaacaggacugacuaaauaugauauaacaaauauuuguuuaaguuuaucugagaagcaaacuguaucacaucauaauauuuuaauaaauauuggcuccuuuaugggagaggagaggcuuuuugcuccucaucuguagcaaugauuguauucccugaauucuaguuuccuauaacauuuaaacuuugauauacauagaaauacagaaagcacugagccaggauauuuuaaguaauauauuaauuucuuuaggaagaagauaacucugugcuuugucuugagauuugaugaaguguugaaagacuucgagguagcacagaaagccuuauuucuaaguugauuucaugcccugguccuuguugguuccuuuguauaaaguuaaaauugaacugguauuuuuugaaaaucauaaaaaggcagcuuaaagacaauaacucuaagcuuuuaggguuguuuuugaaagauuccguuuuacagugaaaaauugauauguguucccccuccccuuaaauucugcuccagaagagcaaauagacauacacacacaaaagggagagaaacacuagcuaaucuaaauugggaaaugaagagggcuuuuuuuaagcaugaaaauuucaucaucuugucagcuggcagaaugccugcuguguggauucacaaaggcuaagaauuacacuuucaugaaauuuuccucacuaacugcccugguuaauuugaaagauaacccacuguucuaauucauuccucaauugggcggugcagguuuuaucuuugaucugacaaagcauuuguguuaaucguuuuggcccuccacuagacacucuugggauugugcuuuuacaauaaaugugucugugauagcucuuuagucuauuauacuuacaauagauccauagaacugguaauuaauucuccacugcuuuggaaaugggaagaauagguguagcucugucaagugcugcugggaaguuuguuuagcugguucauuuuugaaguguuccccucagccauccaagaagcagccacagaagagagucugagauugagaagcuggccuauccugaugacuugcugauaaaugggaaaugugaccccucuugguaccugggaggaggauauugggucauuuacauucaucucaaguacuguucuuuuuaaaguauauuaaacucucauuuuaauacuuaaagagccauuugccucuaacgguggagccucuagaagaugcaaucguaauagucaacucaaauacguuccuaaauuuucacugauggcuuaugcagguuuuagaguauucugauuggguaaaguguguuccccaccagccuucuaguguuucuagccacuuguacauuauaugaguacuuuacuaugauuuuuaaacauugcgauauugcuggcccuagauggggcuggcccuccaucucaaagaacacaugaacagcuuguugguaccaugcauaugauaaccucugauaguugcuagggccagaaauugguggucucacuccauagaaaguuguuguaggcuuuauaaucucaggauuuuccugaauuaagcuuuuugaggacaggggcugugcuuucuuuucuguuuuaugugugaucucugccacagcccuugcucucagaaguacguguaucuugauguuuaguagccaaggaacugacaaguaaagguuauauuuugcuguuuuuuccuuaaauuuuuuuacauugcugucagauuggcggaagacuuauuaguggccuacaggauucuuggguuaacacaaaauucuacaauauuuuaaggucaugaaagccaugacaaauaaagcucuuuguuacuuuucuauuuuuuacggcacugacaacucugcauuucaguauaugccuguccccaacucaauagcuuuaauuuguuuuuuccccaaaccaaauaccaggcaaagaggcauuaaccagaaauaucaucaugaugcacaauagcaccuagccuaaauguacuuucauuguccagauagaagaaucuaucucuauauaacguggcaaagaaaguggaugccuagcuuuguuacucucuuucuguucucuccuuguauuuuucucuuuuacuucuuaguauauugugucauaagccacauuuuaaaaucucuuuuggacccacauuuaugaggaauuuaaaaaauaaugugcaguguaugucgccuuaugaugcaaaaacuuccuuaugcacacguuuaagcacuuagggaagaagagagcauuugaccaaugaugcugagccuuagcaugguagcugugaguucuuuuggacgaggccacacaccaggaaguagaguaggauguuuuguaguguaugaagauuccauauuaagcuuguuuuucaucuuugcaaguuaaacaaaaaaacuuuaaaauuuuaaaguggauaugcauuccuugaagacaaaauuaauaacaacccccaagcauaauguuguuaagccagggauugaauuagagcugccuuuuaucaaaagugcaaugagggcaggguaaaauauugguuaaaauauuugcuccacaaaaauacccauuuagcaucacaaguaagcacaauucauggcucccaacaauacuugaaaaaggguaauuuuguuaggaaugcacaaaacuaaauaaauaaaucugauaaauuagagaugaagcagccucccacucuaucccuccugcccacacccauguaaaucacuaacagggcuucucauuuccauugucuuucacuucucaacagagcuaucuugugcagguggaccugugaguuuuagagccaugcaguggcauucaguaacucuacuguaguuucauugcaaauaugcaguguucaauaacccucaaaauuucucauuucuuaccuguggugaugugguuugauaguuuuuagguuauagguugcaauaugcaguagaaucacagguauauuaguucaaaaaguuuaagcacuuuuggaauuauuguuuauuuccuugcuucugcauuuauauuuagaacauuuaaauagaauaaauuugguuucuuuuuuguagacucuaacagcauaauuauaagugguacaaaggcauacaaagaagcaauagauauccaucccacccauucaacaucacaggcagcccaauccaugcugcccagcagcgcuugaagaaggauaauuuuuuuaggaauccauagaacucauccuaaaucuuguuaaaaccaaaugaaaagaacauauugaaaauuaguauuuauuuucgcuucauaguauuugauugggaagccaaacauaaaugaaugucagggauaccaacugcauuuuuaaaaugugauauucuuuauguuuauuccuuuuuuauuguuaauuuuuagagauagagucuuauucugucacccaggguggugugcagugguacgaucauggcucacugcagccuugaacuccagcaauccuccugccucagccucccaaguagccaggacuacaggcacauacuaccaugcccagcuaauuuuuuuuuuuuuuuuuuuucgagacggagucuugcucuucgcccaggcuggagugcaguggugcaaucucagcucacugcaagcucugccuccuggguucucgccauucuccugccucagccucccgaguagcugggacuacaggcaccugcuaccaagccuggcuaauuuuuuguauuuuuaguagagacgggguuucaccguguuagccaggauggucucaaucuccugaccucgugauucgccugccucggccucccaaagugcugggauuacagacgugagccaccacacccggccagcuaauuuuuuauuuuaaguuuuguauagacagggucucacuauguugcccaggcuggucuugaaccccuggccuccagcaauccucccuccuuggccucccaaaguguugagauuacaggcgugagccaccaugccuggccuuaaaugugguauucuaacaccaguguccauucauggaggguugguauguuuuuauucaugaauggcugauuuuuguuguuauugucguuguugucaagcaagcucauuuugagucagguauaacauuuugcugcuaugccauggcauguucucacagaaaaauuaagaaacaagggacugguggugauuggaauagaaucucauuguaaguaauuuauccuuguacaaaucuaagugaauaacagaucaaauccaauucccuaaaacaugccagcuauguauucuauacaagcagcuuaucaugguauauaguauuaauuguuguaaaggaguucuaauaagcaaauaaguucagaugcagccauuuaugccacuugacuuuuauccuucguagaauaacuaacauuuaccuguauuuucuacauuuaucagaagaccccuuucucuuuuauuucauuuaaucauaaucuuaugacaugaacccgguuuggggaggcucagaucuagagcaugauuuugggggacuaacauggaaccaucaccaaauucugaggugcugaaacugcagagaauauuguugccuauugaggacuaacccccagagccacugacgagaucugagcuugggccguagucucucccuuacccauaucauuucccacauauggauauccacccuccuaaguuuuuugucggggauggagaacuauaugggauaaugcacuuaaggugcugagaaagugccuagagagagcucguuauuaauuaucacuguuccaaucugagacauagugaaugaacauggcucagcuguguuccuuuugugugcucagaaacaccagagauucagaccugggccagggccgugaugcccaggucuuuucaagguaucuccaagguauucaucuggaagcuuuugucuuaugcucucccucucacauccauuuagaaggauaccaaacugugcuguguuuccucuuggcccucccuucaguuugccaguaaaguaguuuccuuuucaguguuggugaauagagucucaaagucagcauugggaaauggauacuaagcuauaacuccuucaaggcaauagcacagaauacugcagaauacuacagcacagaauauuacaauagcacagaauacugcagcacccaguauugugccuaacgugauaggugcucgguaaauuuuauugaaugaguucacgauguccugagagguuggugcuaucaagugacucucccaggucacacauaguagcaucaagacugugaccauacuuggagacccuaguccgguauccugcccauaauaacuuggaagacagccaguuauggauaccaaguugcuuagcaucuucuuugcagucacucuuagagcaggauugaucaagagccuucgcuauucgcauuacaagcuaggccaggucacaaggcugacuggggcaugaguccagaaggcugaugauagccauccagcaauggacuaguacagccauugaaaggaagcacguguugaaccugggguuucagcgacuucuguuaugguuugccuccucugacgggaaaauugaaagcuuucugaaaugcugaggaaaugccauaggaguugucagauaucugaaaacaaguggguaaaaacagaaaacuacuugugccaaaacaguagaauuccuuucuucaguuugauuucucuaaccugguguauuuaggaaaaacucaacuucaggucuaacuccagucaucuagagcuacugucuuguaguagaguaagaaauugaaccagaacagauuucauuuaaccuuucaaaagugagauuuucacacaguugaccuucuugacuucaaggaacaaaacgggacuaucaguucucugcugcaugcgucaacaagagaugggaggagagcgccccaggcgauggcuguuuuucauauuugguuugcccagagaauguacauuuugguucacauauggaaaucagcccuuuguagauaguuacagauaggaauuuccagaugauccugucuaccuuagucuugucuuaauggaauaaccauauuucuguuuaggaguggguuaauucagcugccuuuccaagguaccauggaaaaauucucuaagccuggauuccaagaaauacuacuauugaugagaauuagagcacugguguuuuucaaaugguggguguugguuuguuuugagcuuggcauaaaucacguguugaccuuagcuugcuuuuuuuuuuuucuuugagacagaguuucgcucuuguugcccaggcuggagugcaauggcaugaucucggcucacuguaacuucugccucccggguucaagcgauucuccugucucagccucccaaguagcuaggauuacaggcgcgugccaccacccucagcuaauuuuguauuuuuaguagagauaggguuucuccauguuggucaggcugaucucgaacucccgaccucaggugauccaccugccuugaacucccaaagugcugggauuacaggcgugagccaccaugccuggcugaccucagcuugcuuuugaaaaccaguguauaacuuuuugucuugguucaaaacucaucugacucuugacacuucuuccaaguuuuuguuuucguuuuuacugugcuauaguguaacucucaggguggguaguuuugugagguccaucacccagcuuguuucccggaagauccuuggccucauucagaccauucaagugcucaugguuucuuggcuguuugaggagcucuugauguuucugggaaccuagaugauuugccagcccagcucucaggagcccagccuagcagggcuuccgucuccauccaccaucaaagaauguucaagaaucuuggcaucaaguggcaagaaaaaaagaaaacuacccaggauuuacaucuauauguauacuaacgauuuauaaaucauguggauaaaguuauggcuaaucuuuugaggaugauuucucucaacuacagcuuucccucaagagccacuucuuccagaaauugaucagcaaagaaagaucaaaggaaagcccagauucaagagagaccucuuuaaaauuuuccagcaaaauagauucucuuacugacgaauguaugcaagugguauagcacagugguucucaaaccuuuugguuugugggaccucuguauacucuuaaaguacugaggaaaaugaagaguuuuaguuuauguggauauucuuuuuuugucacuacaccaaaucugguaaugauaugguuucuuaaagguuauuuacaauguggaaucugaaaucauaucgguaaacuuuuugugcucugguauauuaaaauccauugcucugucuugcacuuugagcagaucauuuacccaugcaugauuuuguaacaucaugccuuggucacuuagaaaauacugguucacugacaugaagaauuuccaauucauuauauaguuuuuugaaaucgcauuuguucauaucaucaccagucucaucagaaaagucuaaauauugggaagcuguugagcucaucgugguggauacaaauguuccagugaaaacuaauugaaagcuagaaauuugucguugguuacaaauacugucaguugguuuuucuugagguuacaggaucaguugguuaauuuuugagaagaugucugccagauacccaggucuggauaaccauaguuaucuauccguuauucuuucaaguaaagaugguauuauuugaacagagugguuaguucagcuugcagcucagacaguuacacaggugcuuuuccuggaaacaaauacuguacuucaacacaugauaauaaaaggauauauauuuaaagguugcaauuuaauaaaauuuuacuuucauugaggacuuucuuuagugaaacuggcuuaauuuucuauuuguuagauccugagcaugugaugaugagaaauacaaugaugaauaguacaguuuggggccacuauguuguuguuguuguuuugagacggagucucacucugucccccaggcuggagugcaguggcgcgaucuuggcucacugcaaccucugccuccuggguucaagugauucuccugccucagccuccugaguaccugggauuauaggugcccaccaccacgcucggcuaauuuuuguauuuuuaguagagacaggguuucaccauguuggccaggcuggucuugaacuccugacccaggugauucaccccccucgccucaaccucccaaagugcugggauuauaggugugagccaccgcgcccggccacggggggccacuacuuugauugaugcuaaugugccaggaguuuuacccaucauugacuuugcaccauuaaugcaaaugucaacacagugaaaaaacaccaauaauaucaucguaauauuauaaaaaauguuuugacuuuauggacuccagaaccuucaccuuugacuguagcaauuuauccuaaagaaauguaccccaggccgggugugguggcucacgccuguaagccuagcacuuugggaggcugagcaggcggaucaccucacgucagggguugaagaccaguguggccaacauggcgaaaccugucucuacuaaaaauauaaaaauuagccuggcgucuucgcacaugccuguaauccuagcuacuugggaggcugaggcaggaaaaucgcuuggacccaggaggcagagguugcaaugagcugagauugugccacugcaguccauccugggcgacagagugggacuccaucucaaaaaaaaaaaaagcccaaaauuuaugugcaagaauauacauugaugaauuauucuuuuugguaguaaaaaaaauuggauauaucuaagaauaaauguuuauuaaauacauuaugcuauaucaauggaaaaguauaugaucugagcaauuguagcaacauuuugugagaauaaagacacaggaaaaugugagauaaauguuaacgggggagaaaaggaggaaacagauuaguauauaaggaaugauucaguuaugugauaaagauacuauguacauauagacaaguguaaauaaauaauuggaaagauaaauacaagaauguuaauagugaucaucuugagugguagggauauggguguuuuaauuugugucuuuauauuucuguuagucuaaguguuguacaauaagcauguguuacuuuuggggggagggguguuguuugcauuuugcaaauuuauuuuuaaauuuauauucaguacaauucacucugguuuacaguucugugaguguugacaaaugcauagaaucauauaucuacuaccacagucaagauacagaacagggucauacuuucuggcaugaucuuccaucugcgacccaccauacugaauaugcugccaaucccaaagaugcacagaaugaaacuuuguaagguguguguuucuuugcuuggcaaggaguggguagguacaugaucugugaauauaaaaugaaauuugaaggacaauucccccaaaggacauuggaggaaaauucuaacauuuccauuggagcuucgucacaagaaaauuucagcucugaggauuugggaaagaaaacuaaaucauaucuucaauucauuucguccuuccagugggucaugaagacagagaacuucaacgccaugaucagugguuccaacagucaaguagucaucccuacguauacuagggguggggggcaguguuccauguauaccaaaacccgugcauacugaagucccacacuugaccccgcagaauccucggauaggaaaagccagcucaccauauguguggguuucaugugguuuggucuaaaacaauccauguauaaguugacccacacaguucaaacuuguguucuucaaggaucagcuguauauuuacuacuaucgcuuucuagaaauuaaaccuagauauuaagccauguaaaaagauaacuuuccuauauucaaauaugcauccauuuuaaccuacucaagucuauagcugaguuuguucuuuuacaaauuugagcauguauauagauucauacauucaccaccacaaucaagauagaaaacaguuccuacaaaaacccuaaaaacucccaaaauaguccuauaaaacucccuccugcuauuccuuuauaagcacacccuccuucccacuccuaacucugucaacuaugauauguucucaucaguagaaauuugucuuuucgagaaugucauauaaauagacucauacagccuuugagacuaucuucuuucccuugguucauuccuuuuauugcugaauguauucuaucauauggaucugucaguuuguuugauccauuuacucacugaaggauguuuggauuguuuccagucuggggaaauuaugaguucaggugcuauaaacauucacguacagguauuuugucagugcguaaguuuucauuucucuaggauaaauauccagggguaggguugcuggcucauaugcuaaguguauguuucaccauuuaagacauugccaaacuauuuuucagaauggcaguauuuuuuucauucccgucagcagcguaugagaguuccauuuacugggcgugcucacuggcacuugauauuguugguauuuuuuauuuuagacauuuuaauauguauggaaugguagcucaucaugauacuaauuuacauuucccuaaugacuaaugauguugaacaucuuuucaucugcuuauuugucauccuuauauccacuuuggugaagugucccaaguuuucccccauuuaaaaaaaauuggauuuuuuuuuuuuauugcuaaguuuugaaaguucuuuauauauccuagauacagauccuuuguuggauaugugauuugcaaauauguugucccagucuguagcuugucuuuucauucucuugauagugucuuucacagagaaaaaguucuaauuuuuaucaaguccaguauaucaauauuuuucuuuuauugauugugcuuuugaucucaugacuaagaacucaaauauuaucuaugucuaugauccauuuugaauuaauuuuuauaaaguuagggcagaguucaauuuuuuucuuuggucuguguguguccaguuguuccaacaccauuugcugaaaagucuguccuucuuccacugaauugcuuuugcacccguguuaaaaaccauuugagcauauuugugugggucuauuucuggacucuuugaucucuuccauugaucucucuguuuauucuuuugccaauaccacacaccuugauuacuguagcuuuauaguaagucuuguauagugcaauucuuccauuuuauuuuuuucaaaaaugucuuaauucuaguuuguuugccuuuccauauaaauuuuagagucagcuuguccuuauuaacaaaauuuuuauuggaauuguguuaaauccguaucaauuggggaacaauugacaucuuuauuaugucaagucuuccaauauaugaacacuuuaugucucauuuauuuggaucuucuuuguuuucuuccauuaacauuuuauaguuuucagcuuauggguccuguacauguuuuguuagauuuauauaccuaaggaguaccuuuugguucucaaaagaguacugaggauccaugaaauguuaaaaauauucuacauaaaugcauuguuaauauguagccuuuaaauuuuauuuuguaaaccuuuauugauuaguucaaauauucagccacauaauacugccaaguuuuuaaaauaccagcuuuuguauuguaauuuuacuuuuguaaaauucuuagauuuacauaaauaucuguauguguauauacgccuagagagauuucuaaaaggauuuuuaaggguuugaaaacccuuuaaaaauacauguuaaugaauucuaauguaccacugaauaguuaacauguaauuaccaugugcuauauaugagaauaugaaaguaaaagguauauauacuuucacgccuguaucaaguugauuguguacuuauaaauaagaagggaguuaaauuucuaaaacacaaaaaugaguucucaugugacccaaaauaauuuuuggaaagcaaaaauaaccauuguaucuucuucguauuuauacauuuuuagugggaauuuaccaugcuucuuaagucuucagauuuauugcugacucuugacaaauaguggaucauuagcauugcucaaccucgccucuucucuguugugaauaugauuguauaaaccuaggugaggaguagugugcauagaaaugucaucuuuccuguaucucuucuaggggaccugccuaaugauuucaugacaucaucugauccaguaugcugaggaauuauggucuuuccaagcuuuuaaaguaguuuugagaccuucaguucugucacuacccucucgaccuugacugugacucaccauagucucuuuuggacuagcuucagcuuuccaucuauaggaagugccuaguuuuuugcacagccuagcacuccaugagcagggccugaaagucaaaauggagcaaucccuaggcugcauuucucaauauuccuuguaggaaucagauaacagaaaugggauucugcaacuucuucagcauauaggaacuugagugaaaauacaggacugcccaucuuuugaaauguuuuggccuucuucacaguuccugugggaacuuugaaaauuuuucaaacuuguuuuacuuagcuaccugucuacacaagcaugucaguacugaaguaggcugucugaacccuccucccuaaacaccauuuucccugcucucacacaccaaaaguauuuaaagugccuucaaaaagugauuuuaaaagaggauuccauuauuguuaauauacauuguauuuugcacaguaccuugcaguuuucaaagcauuuuuuauacuguaccuaguuugucccucacaguauuccugugagguauucagagcaauacccuccaguauuucccagcccaggaugaccaaagcccacaaguuuccacauuggauaucgugguguuguauuauauuccacuuacauugccuuuucuuccauucucacugcuuuaauucaauuccuggucaucucguucuuagcuugcuaaucgaucucccuugucuuuguaucaguccauucucuauaucauuuccaggauuauuuuuccaaaacaggauuaaugucaucuuccagguuaaaaaccuccugugguuguucauuucuuaccgauuaaaauucagauuugggagcacugcauuaggccccaagccagccuuuccaccuucucuacccucaguaucccuugcagaccaucugccugccgcacuggagagcuuggcauuccucagggaucccuuaugcuugacuaucuccacacuuucacuccugccauuuccucugcguaguaccauagcccaccacuugugacaucccacuuugugaaauucuucugccuucagugguacagucucuggaaagccuucuucacucagcuguccaggcaaaaugucuuacuguuuucugcaugcucucauaaccuuuuguacacaccucuguggcagcaccuacugccaaguugauuggcucuuuuucccucacaggccuugagcuccuugugaacacaagcugugcuguguuguguugcguuuagcuucaugucaccugagcaaagcauagugccagggacauggcugacacaggauuugcuuauuugagcaagggagugauuuuuggaaccuucagaaaagcuguggguguaguauuuauguuugauggaauacccaauucuuacuuuuuauuguuaaugacuucacagccaguggauggcauuuucuaaaaugucaucuuuaaucucuugcugucuaaacuucaaucaccuuaggaaucucuaagaaauuaaacuuagucuugcaucauacacauacacauauuuugcagguuuucaccuuaaaauuauuuucuguguuucuagcuuguucuugaaccacaggugugguauugaucuuuucuuuuacuuaauagcaccuuuccugcccucacgaccaugaccaggaaacuggcuucuuagcaccaaggcugauuuucaaauucuuguugguuuagguucucuuaaaacuagucagucauaucuuuuuccuauuaacaccauaauuaaauacccagaguacaguuuugagaagcccuuagcaccauguguauauacauguguauuugucugguuuuacaugcucuuuuccuagcccuagcaugcacaagugcacucuugcacaagaaugacagagccuaguuggcuuuugccuccuuuuggagagcuguuauauuuauuggucauaugcccaguggacuuccuuccuguuccauacuugacugguaguuauggagcaccuaauugucugacagaagaagauaguucagcagagaaggcucauuauagaauuguauggccuugauuucagggaaccuguccccuuugucuaccuucagaauggcuauuucccauuuuuggaagauaacuugaguaugugguacagaauuaaguauuuucagauaauaguaaugcaguauuucauuucuguucugggguugcuaguagaagcaacucuguaggaauaagcuagagcaaaggagugaacaugaguuuagauggcuuuucuuuuugucagaccaucacuagccauugauagaagagcuguacuuuuguguuacuuuccuuuugucuuuaacagauagagugaaauauaauuugcaacacuuggaaccuuguaaaagacaaccaaccaaacagauaacaaaccaaaaagaaaucaccuaagucacacacuggauaaagcuuucucugagcagccucugacuccuuggacagcagucccuccccuuucagaauccuaacacccuguccccaccaccacucucucaguguucuguugagggcaagagucagacaccuagcuuuuguguuuggcuuuaaaaucaaaguuguuuuaucauguuaaacugccaggaccaugucuucuugauguaaaaccccugaaacaucuauuacaaugccauagacucagcagauacucaguuguuguauuuuuuuauuuuuguuuuguuuugucuuuuuuugagacaggguuuccacucccuuugcccagacuggagugcaauggugugaucucagcucacuguaacuucugccuccccagcucaagcgauucucccgccugagccccccaaguagcuggggcuacaggcaggugccaccauacccagcuaauuuuuguauuuuuguagagaugggcuuucgccauguuucccaagcugaucuugaacuccugggcucuagugaucugccugccucagcuucccaaagugcugggauuacaggugugagccaccacacccagccaacacucaguuuuaugugaagucacacucucuagaaggaucugaauuccauuucuguauuuauaagcauguagauuauaggaacaacucauuuucuaaacuaaugcuuuaccugguucucugguaaucuuuuuugugauuggaggccaucaucacagaaguuagauauccaucacgauguuugucuuaugagaagaaaagaugggcuauuuggaagaaacaaauuagguuuugguaauacuaagagaaucaguuguauauuucagaaauuuagggaaccuuuuuauuuguugaauuuauaaguaagacaugcaugaugucuaaccguuaccuaaccagagaauuuacuucaagccaaauuuugaacugcauaaauguuaacguuuaugaaaacggguucuaagcaauucuuuuucaguuguggugcuaaaugucuguaguaaaaaguauauaaauauauacuugcaucuuuauguauauuucuuuaaaaauuuguuuuaugaucuaagguuuaaaaaauuugauaaugcuggcuauaugcacacuuuuuuuuaagucaggaaucguuccuuuucuucuaaaguagacaaucaaaauaagcaguuugaagagauugauuuaagacagcaaaauuguuguaucuucagcuguguaaaagaaauacugcaccuuggaccagaaaauguauauuagugaugguuugguuagugacugcaaaagcaaaauaaauaccauaguauaaaauacaguuucaccugacagcauguuugacuaguacuaaacaucugcauuuagggagcaguuaguacuaaaauguguucugcuucuuugcaugaaaauacauuaauuugaaaucuuacagugccuuucucacugauuaauauuaggaagaggucuggucaggucuuguugauaauuuguuuucuagaaacguggggaaaaagcauuuuucacaaaccuauccaaaaaaaguugccuuauuucuccuccuuaagccuuucaaugacuuugcagaauaagguugcaucauuguuuauuuuggauguggaagguugaucagaacauugcuuuuuacuguaaaacggcaguguaaugacuuaaauaauaaacuuacaggcacagggagauuuucuucccuguguuaguuaaucuuuaaacaaucucuagcauuaagaaaaaagauacuguugaagaccccagauugcaaaagcagugccacuucuuuugagagcuuuggggcaauccucugauguguaauugcuuuacaucagucacaagagagagacaagaaugugcuuuccuugaacuuaacaguuugggcaauuuucuauaauccaguaaauacaaauuguagcuugauuauucaucuacgucugucaagcaaauuuuaauggaugaaugaaugagucaaaucuaugcauggaaauauacaaaugugcaaaauaugggucuaauuaccaggcugcugaauuuacacaaggucagguaaacaaggcaccaguguaaugauuauuaauuguuaauaaugccuuugggaaaacauucacauuuuccuucugaauaccuaacaguuugccuuucuagucauuuuaaacucugaaaauuuuagcuggucuaaaaaaacaaaaacauuuuuguccuacuuuuauccuuucucuauaauugcuuacuaauuuuuuuagaauaaagguaaaauguaauacauuuuugaggacccuguugaaaaucauaguuuaauaugauggugaaagaauuaagggggguagcauacucacagaacagaaugaaauagcugcuaucuuuugucuucauugaagggaagaguaugcccccccccaucuuccacccucuuuucaaaccuaaucgacauucuacaacacaaaaccaaggugguaauaaaggaaaggaaaucaaagcaggcuuuuuuccccucuauuuaccauaguaagucaacauuugacucugucuugauauucuauaaaaugaauguuggaaaaagaauaauaucaaugaguaguuucccaucgaaaugcccaagggccgaaauaauugagggaauacuugccaagguuuuucuuaguucaguaacucuugaucacugugcaguuguguagcugugcuaucauuaagggcucuccaugucuggaaggacaccccccucucccagcuuuaauccaaaagucauaaauuguagaacuaacaugucgucuacgggucacccaggcgaaaacacugcaucuugagaaaucuaucuuugugccacugugcuuugaaaaucuuuugaauauuuugcauuaauggugcucccgcagucucuugcugggcucucuccucaucuucacaagcuccauauugagaaguuuuuccucauaguuaaucuaaacauucuucucucuguucuaggccucacuucuuacuacauaccuauguucaguguuacaugaguauacccaccuuccuuuaugguuuuuucccaaguauuuuuaaguagcacucauaucucccuuucauuuucguuuuucuggaacuauuuauuuauuuauuuauuuauuuauuuauuuauuuauuugagauggagucucgcucugucacccaagcuggagugaaguggcacaaucucggcucacugcaaccucuacuucccggguucaagugauucuccugccucagucucgcgagcagcugggauuacaggcgccuaccaccacgccuggcuaauuuuuguguuuuuaguagagaugggguuuugccauguuggccaggcuggucuugagcuccugaccucaggugauccgcccgccucggccucccaaaguacuaggauuacaggcgugagccaccgcaccuggcuggaacucuuuauuuuuaaucgugauugcucuuuguggguuagauuauaguguauguaagccaaaugaauuugagcaaauuuuuuaccuuaacucuguaguuagcauccuauccuauuuuguauaccacucuagaauauaacguacacuuuauacauauuugugagugcuauagugguuuaauuaaauuuauguagcauuauagccaaacucuuuauucuggcauuugagacauuauaaauccaaccuucccuuuccacagacucuaucauccagcaacacugucaaauuaucauuccucuagacagaccuccuuguuuucacacaacugcugggauugucgucacccacuugccauuuuuaucuuuuucaauucuccuucaccuuuaagaccuaaacccaucucacuucuaggaagccuuucguggacaucacagcuauggaauguuuuuuuuuuuuuccucugaaucccuaaagaacuuuaaaaguauaacuuuucuccccccauuuucuuuaauauagucucuuauagucguucuuuuauuuggcaaaucauuuuguucccuauaagguuguagacuucuggagaacaggggaaagaagaaagacuaauauuuuuuuagcugccaaacacuugcuaaauauuuuuuacguauguacguuuuuaaaugguaucauuuaauucuugcagcaacccugugaggugggugguauuuuuuccauuuuuacagguaaggaagcugaaucuuguaguaaacacaaccaauguuagaaugguaauaauacauuguagagcugagauuuaaguuugggccucucugauuuaaagccuauaugcucuuuucagaaagccuccuccauaaaagaguggcaauuugcuuccuaaucugccaauuuacuagaaaguucaaaaaacagaauagguguucaguaaaugauuaaauuuaugacuguggaaaucugaauugcuuugacuucauuucuuuuaccuaucagcuagugguaauaugaaucagcaauaaaauagccaaagccuuaguaagggcccuuuguauucucaccaaaggcuaguaguacaugaaagguugacaguuguacuccaacauuaaggcuguuuacuugagacaaguuuuuuuuacuuguuugucuguuuuuaagcuuuucucuuguugauuccaacauucacugauauugcuaaaugucucuuuucucacuuaguauuuguauuucauuuuaagagaguaaauuucauuauauaauaguagcaugaauaauuuaugccucugucaaggaacuauuaaaacacagagauuuuuaaauaugcauauucuaaacuucauauaaaaacuacggaauggaguuuuuauuuccucucugaguguuuauucaggaguaaaccugggcacuuacuaaaaagcuauggucuuacugacuucaauuuaggauagaaugcugaguuguaauuaugucuauagauaaggagaaauugguguuuuaucuuuaguagaaaaucagcugauguacuuuuugggggcuuuuuacauuuuuuauuuaaaacaggaguuuuuaugagguguauuuauucucaaagaauuaaugauuauaaggauuaagaaggaugauugccaaccuaagaaugaaaagaacuuugauuugaugagcacaagcaaugugacugagcuuuggggugacaaaaauacgauguuuuagguaucugggguuucuucuuaucaacuuccacgcauauugauaaguucagccuauuuuguaaacaguuacuaaugccauaaugcauuuucccauauuuuccaucugaauuuuuacuauuauugauugaagauucaauugagaaauguguuuagaacccugcuuuccgugguaaucacaggagucagugggaagacaagaaaauuguauugaaagaaauugugugcguguguguuuuguguuucagcauagauuaucucugccaaaauaauagcugucauuuuguuuuuguuauauuaguggcccguagcuuaccacuacuccuuuugccuuaguuuugcuucugaccgcuggcuauucccaucagcaagaagaccuuuuuaauugaauguccaaauuugaaugauucuuguccuaauaucauuauaaucuugauccauuucaaauuagagaucccuaagguugacuucucaccucaguucaacaauccuuuaacauucagagacuuugaaacuucacuucuguuuagaauuucauaucaugcccaucauggggggaaaagauggaaaauguauaugcugagccuauaggaccuccugcagugcuuauuaauccuuuguggaucauuugaaauguuucuaguuuauuuaagcuuugcugcuuguaucagauuguuccuacgaaaaaagaaaaagugaucaugcuuugaauuuuuaaaaaugaucucacuuucaagcaaaagcacuuuuaugcuccauuaaaguugaauuugccaaacucuuaugucgcauuaacacaagcuuuacuggauagauaaauguguuguucaaagaccaacuugaacuuuaccaaacugcuuauuaagauuuuuaucuuuauucuucuuauuucuuaaauuauuuuaaaauaaacuaguaaaauagacuagauaggccuaaaaguacuacuuuaaugacaaaguaauuucuucauuugagguaaaaaaaauuaguauagaucguaagcuaauuguuuaugaaggcaaaauuaacgaaaauauuuugaucacuuuuauauuuuuauauuuguuuuauauaguaucaauaucacaauaaaacuugauuuuuuuuuaauuugcauaagugauuuauuguuuugacauuuauaauuuuuguucuagucuaucaugcaucuuugaaaauucaauauuuucuugaaauguuuaguaggucagccaauaaauugacuuuuuuuuauccuucucaauuuaguggguuuuuucaauauguguaggacaucuucuguuuucuaugaaugauaguguuauauucuuuguuucuauuuauuuugugacgauuuuagcuuggaaauaaucuuggaauguguaucuuuuugaccuagaguuacucggaaaguucuagucucauuuguacuauguuuucuggcucccuaauacaauuauaaggacuuagucuuuucauuuuuagucuccuuagccuugaggauuuaauuuaauguguuuguucuucagaaagaauguaagcuaguuuucuacuugaaacgucuuuuuguauuuuuaaauacaugaaaccuuuacagaggauuuguuuuaucaaaaaauaacuuacaugcucuuuuuuaaagcauuaauuuacaucaauauuuauagugaacuugaaaaaauauuuuaaugguaaugaaaauauaauuuaauaucaagcuaaaucuuuuucagcccucuuagauuccccauuuuuagcuguugagucacuggaguuccuaauaaagaaaaaugcguuuuuaggaaauuacuuuucuaaggcaaacaauaaauuguacacacagagggaaaggaaaggagaacuuuucaccugccucguguagggaaaaaucuaaacaauuacaugaaacacuuagcaaguuauuuuaauauuacagcuuuuccauuucugagaaugaugauaccuuguuaguaagaaacuuuauuaacacugacuucuaguguaaaaaucugcccuggauucauuuuucacuaauucacucuauuauuuucuccuaguguucccaugaccuuucagaaauguguaguucguauuuugugcuguacgaaagcugccccuuagguugcauugaguaaugcaaaguugaauuaugaacauaauggcaguucucuguggcauuuccaguucaugcuuacuuuuaguuugcuaaauucauaagugaaauguuuuuuaauguuguccacguuaggggaaagguuaaauaaugcugagcuuuucuucgugagcaaacgggaagagucauuuugguuguuugguagaagauuguguucccauauuuucauucuuuggccagcauagauggugcacuggauuguuuuggagcuuucagacaggacuuacauacaucuaaaauauuucauaaacugcucggguagccagaguauucuuguaucacugugcaauagcacuaaaaaucauccugggauaagaaaugugaagcauaacauuacuucccaaagucauguacuuugagaagccuugagaagaggcaagagaguaacaguaucuaugaauucucugaaaacucuuguuuccaguaggaagccugguuacccaccaaaaaguaggugaugagaauuuuuuuuaacuucaagcauaaucuuucuaaaaauguaauuuuacuugagauuugccucucauuaaccaacaaaccauauauuuuggucacauauuuaaugaaugcgaucaucauugaguuguuugcugugaagggacauagagaagaugcacuguuuuccauuuuuccaaguaauaugggucacaucauaaccuguaaguaauccaucacuaggcaguggcuccacagcauucggauaaaaauguuuuaaacauuccugaaagaagaaaagcccacaaauacugcccuguauauugcugggagagaagauaugagugcuuguaugugggaauuauucuuuugucuuuuuaaggcaggucucacucugucacccaggcuggagugcaguggugugaacacagcucacugcagccuugaccuccuggucaagcgaaccucccaacuccgccucucaaguagcugggacuacaggcgugugccaccaugcccagcuaauuuuuaaauuuuuuauagagacagggucucaccauguugcccaggcuggugucaaaacucugagcucaagcgauccucccgccuuggccucccaaagugcugggauuacaggcaugagccacucugccuggccaggaauuacucuugaucacacaagucuuuuauggcaguuugggacacuggucuuacauguugcucacagugucaucccaugaaagaggcaggguagguacacuugcaguauccaugggaacacacccaaaggcugauagggugaacggcuugcccaaggcacauggcuccugaagcagugaggugagaagagaucuuugaguuggcuccugcccuuccauuuugccacagggcuucuuuaucuaccuccugcaaggagggcacagugaaggaagguucggauggguuuuuggacucucacaggcagccuagccugagggaggcuagaguguucagccaucugaauuaaucucgauaucagagaguuuaguucccucaguguaaaauuaaaagaauauuucuucaucugcugcaaugcaucagacacuauccuagacuauagaggcucaaaguugaaugauagcaucucagagcucuugggggcugaggugguggccuucugucucccuuucuucuaccucuuuccuucuuuccuccauccacaaacuuuuuguccucuuauauauuagcacguuuggaccucuuccugcacuuaaagucaugccuaccuucaugcgcuccaggugucccagguaaaaagagccauuccccaagcgaugcuguugaaacuguuuuaauauagacccagcauguugcuugcccuuagcauucauuuuaauuauuugaagaaagugauucauacaaauauguacaaaguacagcccuuuugaagguuuuucacuuuaacagugacuuuacauauuauuuugauagugauguuccugguaugggcagcgaggauguaagcugggccagaagaaggaugaauccucucugcuuagggaaucaguuugcuggacaugugaauagcuauauccccacuccagauaacuguacccacauaguguuaugaucuucaauguuuuagugacauuguaaauguagcaauagaguagagagucuucaucauuucauacugguauguaaaaugccccagguaugugaccacuugaagcacccggcuuuuguaugcucaguaaccuuguguacaguuggugaccaguuagcgcaauaucuuaguccuucacucauccccaaggaauucaaaaaauucauccuguuacgaguggcuuucuuuccuugacaauaguuugaaguccagcauguaaaaauguaaaucucucugcuggcuucuaaugugcaaggccuucugagaguguucccagggaagaagaguugauuagguagagacuucucuguucuuaguaaauuaaugaccuacuccaggcccauuuucuucuuuccuggaggaacacucagugacagugcuuaugcagccaugucaaauucuuuaguuuuauuauauaaaacaucaaacgaggagccaaagagaaucuuuuccuaacagcaucuccuaagcccuagaauggaaucagaaguaaggcaauggacuagcaaauggacaggcauuccuaaaaucaucuuagugucgaugggaggcauguuaggcuugccacagaugagugagacaugaaaguagauucaggggcuuguuagaagauucagagcuaggucaagagagcucuggagaugaaucuaaagaacuuuucuuugaaccuguuucaauaacacaugaaaacaucuccuaagauggcagaucuuuuccuuacgguucuugcaauuuagaaauuguaggcccugggaauguguauuaaaauccguagcaaccaaaguauucagaggggaauaagguauuuugggcuuugagaggggcagcauaaugggcagaugucaggauuaacaacuaaugauugauacauauauauauuuuaagccuuuuaucugucauuguagcacucugccucaaccuggcuucuauauguuucacaacuugauagaauaugccauuuagucucaugauuuauacuuauuaaaccuuauuuguauaaauacaugcccauuuaucacugucacaccagugaggaccugcucaaacacagauugcugggugccacccuuagagugucugauucuuggucugggguaaagaccagagaaugugcaucucuaacaaguucccaaaugaugcugauguugcugaucucaggcccacauuuugagagccacugcuguagacauucaccgacauauauuacucagccgggagcacuugaaugaaaacaguaguaacacuaaauccuaacuuaaugguggaguaaugagauuuaguuaagaggaaauacuuucagugcuaggaauguguauauuuugcuaaccucaguuauggauaaaucaugaaggcuuauggggaaccuuauuuuuuuuuuuuuaaauuauguuguagaauuagagaauucucacacuugaacagaccuuacagucaucuauccugaugcaacacccaucuuuaugaaagaagggacugaggcccuuaaaauucagcucugccccauuucaaguugugguuuuuagaggcagagccaggagaaaugauugaauacuauaguuuaauuuaaauaagacuuauguuagggaagggaucuuuuaagaggacuaauuucccaaauauaaaaggagcuauuuuaauauuuagucaaccauucaauguccuuuagcuaaaguuucagucccaaaguugauuuuaggcacugugagacaaaggucucuacagaaucuguaaugauuuuaauaaaguuacuuuucuucaguugcagagauuccuggguggcuuaguucuuagguccauggacuuagauccuugggaaaucugcuagaggcagcccgguggaaauguugauaaauaucacauuuugaaaauauuaaccguuguaauuagaccaaaaaaaggaauauauaaaaauuggaagaagggggaaauuauuauuuacagaucauucuaacauggaaaauccaaugaaaucaaccaagaaacuaucacagacaaaaaauuuuaauaagguuacuaguuauaaaaucagugcuaaaaaucaguagcuuucagcuguauacacacaaccgauuagaaaacauaaugaacucucauuuauaaaugagauuauaaaucucauuuauaauacagguuaaaaagaggaaauaccuaggaauaaacuuaacaagaaaugugcuagauauauuugaacucugaauggcuuaaaagaagacuuggguaaauggcaaagcauauauucuuggcuaggaccacucaacauuuuaggauugucaguuccccuaaguuuauccauaaauuuaaagcuuccucaauuuuuaaaagaaaaucgcaggaaaauucuaacagagaaaaugacccaccaguccuaccgguuuuuacaauuaggauauuuaaaauauuuuggugcaaaaauauuuggugauuucaguggagcaacuauagaaagcccauaaauagacccaaaguugcauuuuguuuuuuaaaaggggguaguucacgucaguaggaauaaucaucuggaaaaaaauacaguugauuucuuccuuguuccuuacacugaaacaacuuucagaaggaucaaaaacuuaaacuuagaaaauggaacuauaaaaguaauguuguuaauaauuguggaauugagaagacuuuuuaaauaauugaguuuauuuuuuagagcaguuuuaggucacagcacaauuucagaguaagguacagagauuucccauauacucccugccccacacacguauagucucucucauuaucaacauccccugccauaguauguuuguuacaacugaugaaccuauauugauacaucaucacccagaguccauaguuuauguugagguucauucuuggugcugugcauuuuauaaguuuggacaaauguuucuaacauaccuccaccaucacaguauccuacagagugcuuucacugcccuaaaaauccucugugcuccacuuauuuuggaagacuuuuagguaauauauagccuaggaaaggguauagggaauggagcacucucauacacuguuggugggcaugaaaaaugguacaccuuuuggacaacaauuuggcaacaucaucaagauuguaaaugaacauaccguucuacuuugcaauucuaauuuggguaucucuccuuacacauguacaguccuuacagauauuaucaaagguacuauacaaggauauugcuugcagcguuauaauaguaauaguaagagacugaagacaaccuguuguugaucaggagagaauuccuuagauuauuacuaucauauaauagaauuuugugcaaccguuaacaagaacacugcagaucuauauguacugacaggacauaauuuccuccacuuuucagugaaaaaagcaggauuuagaacaguguauaugauaaacuuucauuuguauuuuuuaaaaaauuagagauauucauaauaugauaauacauuuuaauuaaccuguuugggugugguggcucaaaccuguaaucccagcacucugugaggcugaggcaggaggauugccugggcaauauagugaaacccugucuguauuaauaauauuuaaaauuuaaaaaauuuuaaauuaacccaauauauccaaaauggcauuuuauucuguaaugaguguuaaaaauaccacuaaacuauuuuauagucuccuuuuuugaacuaagucuuugaaauuugcuguauauuuuacacuugcagcccaucucaauuuggucuagccauauuucaagugcucaacagccacauacagcgacuggcucauauauuaaguagcauagauguaguauguaaaaagcacuggacuagaaguucagucuacaugcugugugacagugugcaaaaaacguacuuucuucugggucucauuuuccucacauacaacacaaaagauuagacaagagcucuaaagucucuuccaauuuuaaaauuuaggguuuaaauauaucauuucuuauuacuugucaaagucaaggguguaauugugguugcuuuccauagacacuguuuucaccagcacuccuaaaauucugugauucuaaguaaagcacauauuuuaagaacuauauuuuauugucagauugagguuguuuauuuguuuaaaggaagaauguuauuaagcuauguacaugauguaaaccauuuaguucuuguaauacaauuaagucagauuugaggcuuugauaauucuagugcugcauggaaaacuuggaagagcaagagugaaccaccaaaauaauaucuaaagaaagaguaaauguagaaagagaaaaagaguugagagauaauuuuuuaaguacaauucuguuuaugaaguucauuguucagaaaauaaucaccgguaguucuuuuugaacaagagagagaaugagaauaauaagguucucaaccuuagcugcacauuagaaucacuugggggaacuucuuaacaucccaaagcucauuucguaucccaggcugauguucuccaacugaggucccaaaccagcagcggcaguaucaccugggaacuuguuagagaugcaaauucucaggccccacccaggaccuacugaaucagacacucuggggguggcgcuguguuguaacgcugcccuggugauuccagugugccaccagaguuaagaauucuggagcaagaaguauuuggaacaggguuaacagauggguuuuauauugagugccagcuuccauccuauaguggucuugaggacagaguuggaaacggaacugcaauauaccugcuaaguguuugccauuccugauuuagugauuuggguaauuuauuaacauuauagaagguuggauguugcaaucacucguagaugagccuuucuaaacaaauauaugucaagcaucucagccaguuggcaaagaaaaaaggcgaaaagggaggaaaagcaggagaaaagaaaaaaaucacauuggaacagaagccacaaaagaaggggggaggaauauacaagguaaaauguuauaagugaagaaauuccagguagauuauaaaauauuuauauguaaggguuucuugaguucaagugugauggggauuuuaggcccauuucaagaucuaucaucaauucuaucugaucaaaaaguaccaaaggcuuguucagcccuuuaauuuggcauuaaggguuauauuucuucuuaacauucagacuuuugauaggaaugcacuuaauacagguaugguaaauuuggagugaacuaagccagaaaauaaaauauauuuucaaaguguaaagaaguuaucacugacugagaaggaguuaaugugucauauauccuuuugauuucuacucuuugagagaaaucacaguaucuauaauuucggaggcauauucggaagaauguuaaauugugauuucucuaugcugaaucuuagagaucugucagggagucuucagcccugacaaaauaagaauggacccauuauaguaucagguccauuugauuuuucaaaaguuaagggaaauaugcagaucguuucagagacuucucuuuuugcucuugcuuguuauaagacagaugaagggaagcaaacugggcuguguuuagaaugcaucuggagcugcuucucucucgagaucucggcaguauaacuucugcaagcccuuucuguguguauuuuucuuuucucauccugaaauauuccaucuugcaugagaaagucagcuuugauaauuuccaaaagcuaaguauuaugacagaauuugugccucuuagaaaaaaacugcuccuuuacuauaaaauagaaccuaccuuuuauaccugaguaaaaaauucugauaaaacuuuucuaaucguauuuauuauugaaaagauuauuuuugaggugguguuuacuaaaauauguugauuuuuauauuaauuucugaauacucaguuuauauuuuuagauuguuuugugaauugggaucucugaguauaaagugguuuucagcacauuggugauauugaacaucuuccucaaauagcaagcauaugcauuucaacagcuuucgggacaguacuacaguuaauaauuucuuuacaagacaaauguaugcuuuuuuauuguuagcauuauuuucucaucuuauguucuggcauuuaaauuaugaaacuucaucucggcauguagacuuaccuuguguugccaagaggaaagaaguggcuuuucugcaaagccaaauaguuuuuacuuuauugucugcuaugaaacagcugcugauuccaggaaaaugccgucucaucauugggccugggguguccaaaagaggcaggaaaaaaaaaugacuguagcucccugucugcccuggcacucuccuccuuucucucauuuucauugccaugaagagcaugagaacaauauucugcaauuaaggauuccauuaaguugaagaaaagagcaaaugggggauguuuguucucuaagcugaaaaaauuugucuggggucggggggggggauagugguagugguauggagagagguggguggagagacgaagucagggcuguuuguugaauauacuguuaaggacuguuaccauccuaauuaaucaaguuagaaauuacagcuguagucgguuuccccccaauucuuguuaucaauuuucuucucuuuugagacaaagcaaauauaaauuuuguguucauuugucauucguucuuugacuucagcaucucugaaaauaacaauguagcacaaaagcccaguauuuaccuaguuguaauguggguugccaugguguuuugcaaauuauugcaauuauguucaccaugcgagucgcccuugguaacuggcgaaaaaacugauaauccuguuuugaacaaaaggucaaauugcugaauagaaagucuugauuaacuaaaagauguacaaaguggaauuauuuccuaccauucagaaauaguucuugaucggguuugggggagggggugaguaaguacaucugauuacugaaguacaaagcauugaaaggauguugucuugagccuuucauguagucuuaaugguggcuuuuuugucaaauuuacccauuugcggcauugaaagaggcagcugcauuuaagcuggagagacggugcuuuuucaagaguucagugcauggaaaguucucagcaguaucugcaguuuacuaguagccccuggucuauuaaaacugaugugccgcauuugagcccauugcucucaguacuugugaaccccucuggcugaugaucuaauaaagugcucuuacuggacaaucucugaucagcuacuuaaaaaggaggcuggaggagggggccugagggagaagccucacaggcagugagucuuggagcaggccagaagaguaaagacaaguggcuaaacugaaagguuugucaccaugaugauuugugcuaaggcguuugccacaggguuuugguuuuugugccccagaucucccaacugugaucaugcuuuuuuucugaagagaaauuuuaguuuuaaguuagauaagagauuagaagugucucucugaauguuaaaaucuaccuugcaauuguuucuuaaauuauggccauucagaaaauauauaauccuacauucauguaaaaccaaaaguuucccauguugcagccaaagguuagauggauuucuucucuucugaaucuggcagaacaucugcagggagugaauuuuggagggagggaguuuuuuuuuguuuuuuuuuuuguuuuuuuuuuagugaccaccugaaaaaucaauucucaaaacuuuugagagugugugaaaguggcaugaaagcaaagcaaaccuuaacaaguuuguggguuuacauucuacaucaccuagcaaccuccugacucagccagaucucuugucuacccuuaguucuguuuacagacuauucaaacggcccuucgaaaccaugaaagauauucaguuucauuaguaccauucucaaggagaaaauaauuaaaguuaaaugaacaaacauugccuggugauaguuugaacuccauucugauuuuaagauguccuuugaggcaguaguagcuauaguucaguuuuaacauuugucguucacuacccaaaggcauaucacuugaaaccauaccaauaaauacuagucucugagcaaacaaacaauaaaaauuacuuuuagcuagacuugagcaaagaaaaacucuucugguaagaagguuuuaagcaugcaugccauuccaauugaauuuuguuuuauuugauucuuaccccaggacaucugaguugaucugugugcacacugaauaaaggcaggggagagggcguggggaacaaggcaccuuucuuuaaaacugauuuauuaccuaccuucagagauccaccaucauaaagaaagguauucaaaucauauuccauaaaagacugggugcauuuuagugaauggcuuaauuuaacaaaugauacuaauacuacuaauacauacccugucacuuucucauugagaauugcuuaugugauuaaauggaccuauuuuugaaauuuuagauuuaguaaaaaaaaaaaaaaaaauuuuuuuuaagaacagacuauuuuuuuucaugugcccuuucuuuccccauaagcacauucccugaaaauuuaucuuggcagcaagcauacacaugguauagcucagaauauuuuucagcuguguuagugauuuaauuauauugcaagcucuuggcaaaacugucuccucguuaauaauucugauuauaagaacaauauacacuuguuguagaaaauuuugaaaauacagaaauagaagaagaaaccacagagauuacuagugauagcauuguagaguauuuccuuccagucuuuuuuuugugcauauagugaugaaaccaaaccuugaguucacuuuugaaguuuauucauuauuguguguacauagcuaagguggugguuuuuuucagaagugaagacuugacaggcaggaauggcguuggaaguaaugaacaauuuuucuuagagguuucaucacuaaaacauuaauauaagcaccagaguaaccauuuuaccaucucauucuauuugauucuuuccuccuuucccuuguugaaaugacuaugugccuuaccugacacauccauuuauuaucauucauguuagaaagucagacauucauuacaguuggaauguuacauccccaagucacuuguagcuucauauagggggaaaaaaguauuuucugaaaagauuuguaauauaauagagauuaauggaauguggaaaggaaaaugcuuucgguuucucauauaaaaugaaagcaggguggcuagaaaaucuuguauucuuguuauuuguauuuuguuagaucucuaacauccacaguacaugacuggguugcaugagcucuuuguguuuuguugacaguugacagacaaagcaaaauuauuccugaagcaagguacuguguacuuaguugugaccuauuauagccuaggaauguagcuugcuuuugaguuggaugaauagggagaguauuuuacagaauagacuugaauauacuaagagagguuuuuuaguugcccauacagaaagauacauguccucuauugaacuuuuuuccccaaaauguaauuuuccauauaaagucuuuuaaguauauuuucccugguugcuugcauggagacaguuuuaacuguucugguauuguccucuagggguaaaauacaauugcugguaauuguuggccuucugugcucacaguauaacgagagaagauggcuugcaugggggcucuuuaauguaccucagguacaucuucugaugcucaagcucugauugcaaauuaaaauagcaaggcucuguauuggauuugaugugaggcaaagcagaccaagucgcuaauuuaucauguaauauacaaucgcugaggcuggaauuuguccacuuguagugcuauucuguguguuuaaaugaggaccacuguuugcauccaaccuaucauaacaguuugggagugcuccauuauccuuucagcaaacugauggcagagucugguccuuguacaaaugauaagaucaauaaguuucaaauaacuuggaugaaaugacauaugacuguucauuuaaagagaugucuuacuuaaaaaaucaauuuuaauaauauuuaagauucuuacauugaccgaugaggcacuuucuacuucuguuuugauaauuuuguucaaaauauucuuguauuaacuucggugaauaguuaguuuauguauuuauuuuuccugauuuacucuuucaucuccuacccuaguaccuuucugggacuuaauaaucacucuuugacaugccagcaugcugcaguguagaagauuuaacuuuaaaagcaaaauuauauuccuguuaaaacuuccccuggagaucuuagggaaauuuucucccaguuuuggguacaaaugugggucagaaagcaauuuguuuuuugauauuucuggaaauuccaaaucacaacaugucauucuucaaaagcagcugugggcccauacugugcacuaucuauaaggagacccauuuuuugccacuggggauaauucuguggcagaaaaaugugccugcaagggaaccccggaacauuuauaaaugguuuagggugaaaagagagucugauguucucagaguacaucuaguuuugguauaggggugguuaauggccauuauugaaaacuaguaauaaucugaugaacucaaagcaugcaugcugccagaccccguccugugacccugucacugcauuccuggugagccauuacaauuuaaacuaaaucguacgucacugcagaaccaugcugucucuugaaaauccgugaauccggaaauaaagcaaagacagccuccucuuccccugcugccuguuuugccgucuauaucuucacuauauuuuaguuugaucaggaaaaaaauacgaaaauuucacuuauguugacuacacaguuguaauauuuugcauucaaauugagaagcagcaccaccuaaucuuacuguuuauccauuauuuuaguucugcguuuuguaauaacaccagauggacacugaccaggcucuuuccugguuaaaauggugcauuuuuaauagugcacugucagcuauagcuuagcaauaauguuccccaauaccagagacaggauaauaacaauauuuuacauuuacucaacauuuuugugaguuuucuuauuugauccccugaacaacacuaauagaguaaauauuaccuccuguuuuauagaugaggaaacugaggcucagaaagagguucagugaguugcacaaaauuaucuguuaguaaaugggaggaaagaaacccuacucaugcaguuuuucauaaccucaauucuguauucuucguugauugugaaccuuugugguagagacuggggaggacaguaccagcuccaaaacaaauuguuccccaggggaccgaccauccauguagguaggcaaaacaagaugguaaaauaagaugguuaagagacagugcaccgcaguguguguucagcguuagguggaauaaggaagaaaucccuguggaucgggaaaauuucacaaaagacgaauggaacugaugaucaaggaaucgaccuuuuaggcagagguucuccagccuguauaaugauaaggaggugaaaacaggcaaaauauggugaguacagugagaaaaccaaucugauugggcaguaaguuuguguaagagaaugaugagaaagggcaggggagugggaugagguuguaaggauuugaaagccaggccaaugaauuuguucuuaauuguuuguggaaggugugugauugggagaugggaguggagagcccuuugcauuggauauaagagagaacggagucagggaaaccagggaggaggcuacugaaauagaacagucugaggucuggcuuugaugagguuggugguaaugggacuauaaaggaaagaccaguggacaaacuuggugacugauuggaaaugagaggggaagggcccacuauguauuugacucaaguaugcaaacuacuaugcauuguuauuuuccuuauuguuuuuuauaaacuugcuccucuacauuuuuauuugauugcuucuguucauuuauucagaagacuuuuaaaaauauaacuccaacuuuuauuuuagauuuagggggcacacgugcagguuuguuacauggguauauugcaugacacugagguuugggguacaaauaauccugucacccagguagugagcauaguacccaagagguaguuuuucagcccuugcuucccucccugcuuuaguagucccagaaucuguucccaccuuuauguucauguguacccaauguuuagcucccacuuauaagugagaacaugugguauuugguuuucuguuccugcauuaaucugcuuagcaugauggccuccagcugcauccguguugcugcaaagaacaugaucucauucuuuuuuauggcugcauacuauauauuccaugguguguguguguguguguguguguguguguguguguguguguguaucacauuuucuuuauccaguccauuguugaugggcaccuagguugauuccaugucuaucaugaauagugcugcaaugaacauaugagugcaugugucuuuuuuguagaacaguuuaucuuccuuuggguauauacucaguaaugcaguuccuggguugaaugguagcucuuuuuuaaguucuuugagaagucuccaaacugcuuaccacaguggcugaacugauuuacauucccaccaacaguguauaagcguucccauuucucugcagccuugccagcaucuguuauuuuuugucuuuuuaauaauagccauucugacuagugugagaugguauccuauugugguuuugauuugcaucucucugaugauuagugauaagcauuuuuucguaugcuuguuggcugcuuauaugucuuuugagaaguaucuguucauguccuuugcucacuuuuuaaugggguuauuugguuuucacauguuaaguuguuuaaguuccuuauagauucuggacauuagaccuuugucagaugcauaguuugcaaauauuuucucccauucugugaguugucuguuuacucuguugauaguuucuucaaaagauauuuuugaggaccuccuaugcucuacaguuucagaucuagaugauuucuguguguauagccuucuacaaauacaaauguacacaaaugaauaacaguuuguguuuaaggugcaacuacuaggaacgccucaguuacaaguggaaauugaucccuuuuuaacaugugcagaagaagccauuuuaguugaggccucaaaaauauaauuuaguaaucagaaccaaucaacauuugacacaauuucauacacaaugauuuuaaggaauuagugaugcugagauuaaagcaacaagucauagagcuuggcauauuuugguaaagguuuguuuugcuauuggacaggcugacuucaccucuuuugaacuuucuauuuauaaauguggcuaagccaggcaacuaaaaauuuauugaccuuauugcuauugguuaugauaauuugugugcggcauuacguaauaaaauuacguauuuggauagcagacauccuuaaagugauucuagagguuuuuauuaaaauccaaaucuuuuuauagguugaguaguuccaaggaacuacacuuuuauuaaaaauguucucuucuguuuacuugucaauguagccuugggcuguacaggcuauauguuauuucugaaaaugaggaaugaaaguaaguuaaguuuugucuuugugagugaucaaucagagugaacuuaugcaauauuauuauuuucauuugcuuuguuuuugucauuuuuaagaaacaaaauucaguaugagaucuuauaagauuugcaucaucauggaauauuuucaaauaccuguuauauuuauuuauuuuuauuaaaaaaaauuuuuuugagacaggaucucacucugucacccuggcuggagugcugugacauaauuacagcucacugcagccuugacuuccugggcuccagccaucuucccaucucagccucccgaguaacugugaccguaggugcgugccaccacucccagcuaauuuuuguauuuuugguagagacaggguuuugccauguugccgacgcuggucuugaacuccugagcucaggcaauccaccugccucggccucccaaagugcugggauuacaggcauaagucaccaugcccagccuauauuuauuuuuuaacagcacaaauguuccuugaagguuagauuuagcuagccgguuggcauuuguugggggaacaagggguuaaauaaaauguacuuuacaaaauugaauugaagcaaagcauauauuuaauaugauuagggccuauuuccuacauagaagaguuuuguuuaaaauacaccaugaccaaaagcuuaauuaucaaaauaaaacaagaagcauaaagaguuacaggcuucuaauauuuuuuucagccccaguucccuucacacaguuaucagcauguuuaauuuccaugcauaauagcacuaguuauuguugucauuuguaaagggagauuaacagauaguaaguacaaacaaacccaaauaagcacugaauagagaggugacaaaggaaaaaagaccuccuuaauguuaauuauaacugguaggaagucuagacaaauuauauuaucuguuuuccauaugauuugaaaggacauuuaguuaguaccucugucagaguuaggugcuugcuuuaaaaacaggugagaugauaacuuagcauguccgugguuggcagcucccccagggaguugugaagucguaguaaauugacagaaucaaguuucaaaaacaucugaaaagaacucuauaguuuuugaacauuauauuuuaaaaauuaaauaauuuuaauauccagguuauauuuuggaacugaauaauuucuuaucucaaaaccugauaguuauuaccugucugcuuauuuuuuuuaguuuuguuuagaauuggaugaauuacaacuaugguuggcaguguuaacuaacuacauauuccaaagcauguaaagccucagauaccaaauuuaaaguaacaaacccaaugaaugauaaaggagugguccaguccuguaugguuuguuuccuuuauuaauauaccuaaauggguacuucaagaaaacaacuagucuuaccuuuaguguuuauaggcuacauuuaaaauguaauaccuguucuugcugucagcuccacuauuccccacuguaucucccaugccuagaacagacuaaaccgaaguaucuuguuucucucucucucccucccuccuucucucuuuuuuuuugagauggagucuuguugugucacccaggcaggagugcaguggugcaaucuuggcucacugcaaccuccgucucccggguucaagcagucagccucccgaguagcuggaacuacaggcaugugccaccacacucggcuauuuuuuuguauuuuuaguagagacgggguuucaccguguuagccaggauggucuccaucuccugaccucgugaucugcccgccucggccucccaaagugcugggauuacaggcgugaaccacugcgcccggccaguaucuuguuucuuuaauucuaaggagcugauugugagcugcacucuugacuuaacagcuuuuuugaaggaaacuaaaguacauuauuaagcuguacauguccauuauaaaugcaucugaguuucagaaauaguaaaacgugaauauaaaugucucucuaaaucaagaagauguuguaauacacccucaaaauuaaacagcugccugugacuccaaaacacugauugguucaugaucuuuugcugugguaguaguaguucaucucagacacuaaucugucccuucucuguauuguuagcauuuauaguugguaccacgcaacuugguucuuaaagccaagccauacugaauugcuuuuauagucuuuauguguguggaccuugcuuuccuguuuagauuguaauuuccuaaaacuguaccuggggcccuuuugccuauucuucacaauauuuaauguaauucugggcauauauuacaaguuucauuaagggcucauugagacccucccuguacuugaaaagcucauauuaaauuuuaaaauaguuuagccuugaaugaagguaggaauaaugcuuacuguggguguauugacuagaugaauuuuacauucuuuaaagguagcauaauuuuuuuauucauacagaucuauaauacacuuucccuuuuugugauagucuuaaauggagcuagaagaacugauucuuggugcuuuccccugaguuuuguuauagcuacuuccagaaaagccuauuccgaggaaugaggucaaacggcacagcagcaagugagggcaucccucagcuuuggauuaacaccacauggaaacauuacuaaguggcagacuaaaguaccugacauaaugaaccaacacucauguauauacugcucuuaucuaaggggaaaagaccaacaaguuguucagucuagaaauaggauaugugguuaugcguguuauugauuccuuuauuaaugauaacucagcauagcucuuucuggccugcauucuuugacauacauuguucuuucuguguaaguugucuuuucugccuucucuacuuaccaaacuuccacucauuuuucaagaccgguucagaaguugccaugucucaaaaugcuccaagaucuacagauagucaggucccuacugggggcuccacaggugagaacaccauaagacaagggagcagcagcauaccguguucaccuuuauaccccagcaccucacucuaacauuugccuuauacuuacgccucuguggcaaugcauguagcacgaaagcccacagaccuuggugccuuaguaugaacaggugaacuuugaccccauuugugaugucuuaccuccuuuguuuaacagauaacguuuuauaacauaagacugauuuaaggucuuagguauauucuuaucacaucacuaugagaaaauucaaacaagaucagcaagggagaguaacugaagaaggaaggugagaagaggguucuaaaagacagagaagugagcgauagcuguaguauuucaaaccucuggaaaauagugaucaguugaaguuguccuugaaaacauugaagcuaguuuuaugucucuagaaagcacauauaagagaaucuauuuuuguuugcaugaaauaauugauuauauuuauuaaguguuucuuuuaugccaaauauaauccuagacacucuaaauguguuccaucauugcaacaacgguauacgguaaguacugugguauccauuuuacagagaaggaaacagcacagcaauuaaguaacuagccaauagucacucagcuauugggaagguuauacauguauguggugcauucuuugguaauggucuuuacuaaugaacuaaaacacauugguuuacauucugccuguaguagaaguuuuuguugggaaguuuugauguauuggagugaggaaggguguuucuuuuaagaaaaaaaaauaacaucucaugugauuuucuuuuuuuuuuuuuuaacuuaaugguuuuccuaacuucuaaguuuggggcauagaucuaucuaauuaacaugucaggagagagagauaacuagaguuaugucagaauuucugagaaaagauuaaauaaaaugagucuaucuugauaaccaaaaaaagguuuauuacuuguauuugucgauggugauaagucugaaguuuucccuucucuccagggcugguugauaugugaagagccaaccugucgcaaucgaacucgucaccuuccccuucaauucucccgaacugggccucuuugcccagccugcaugaaagcuacacuucaaccagagguaacagucucauaaugcuaaagaaccauguagaagaggguagagggcugcuugcuuugagaaguagauacugaguauuugcccuaugaagaugcccuacuaccauaugcauauacuaaucuuauuuuuaaaaaauacagauuucagaaagauacaugcuuucuuuuuuucacaugucaugagcaauacuauauuuauauuuaaaagggaaacugacuaauucucauaugaguuauagauuucuuugguugccacuacauaauuacaaaagaagacauggccauuccauucuagaaacugcuaucgucuuugggcuugaucagaaucccauuuguaagagccagaaauccucccaauucuguacccugaaugguuuauuuugugggguuuuugguccccucugcuggauuaauuguuuauaaguagcugcauagaugaguaguucugaagccauuuuucuuuguuuuuuguuugcuuguuuuuuuuuuuuuuuuuuuuuuuuuuugacggagucuugcucuguugccaggcuggagugcaguggcacgaucucagcucacugcaaccucagccuaccgaguagcuugggacuacaggcgcgugccacugcgcccagcuaauuuuucuauuuuuaguagagauggaguuucaccauguuggccaggauggucuugaucucuugaccuugugauccgcccaccucggucucccaaagugcugggauuacaggcaugagucacugcacccagccuguuuugucuuuuugagauggagucuagcucugucgcccaggcuggagugcaguggcgggaucucggcucacugcaaucuccgcuucccauguucaagcgauuuuccugccucagccucccgaguagcugggacuacaggcguaugccaccacaccuggcuaauuuuuguauuuuuaguagagacaggguuuuaccauguuggccaggcucaucucggaguccuggccucaggugaucugccugcuucagccucccaaagugcugggauuacagacgugagccaccgcacccggccacucaagccauuuuucuaccuuaauauacacaccugagguguaagacauacuaucauuaaugacucccaacuagaaagcauggcaucuggaaacacuucucugguaauuaagaugccuucccucuguugaccccuuugagcaucuucgacccaaacagcauuuuccaaacuguagugagaaguuugcagguucuuugagcaaagaggguuuugugaucaaguauaucuagcagaugcugggcuagcuaaaauuaaacaaguuuauugcagaucuuuucagaaccuauaauaugauaaugugcaaucugucucacuaggacagguccauaaugugccucacuuuccaaauucgucuagccugaagauuuguaagguuuuuagugagaagaaggugagacuugggaaccuguuguuuauuuacuuacuucuuaaaugcagaggcaggccuauaaucaaguuuugacuucaaauuuuccugcugaaaaggguugauacacagacuaguuuuagaaaaauauguacacacaguuuuagaaauggaguccugcuauguuguccaggcuggaaugcaauggcuauucacaggcgcaaucauggcucacuacagccuugaauuuguaggcucaaguaauccuccugcuucagccuccugaguagcugggacuacaggcaugugcccagcugaaaauauuuuauuuuaaaauaauaaugacuuaauuuuaggauaauauaucauuucacaaaauuuggcaacuagucaggaacugcaaauagcuaccaucguuguguauucaguuguucuuuugcauauccauauguauuuuuuuacaugguugccaucacaaugaagauauauacuuguaucacauuuaucuuuugucaagcauuuuuucuguguuguacuucauuuucaguacgauuuuuuuuuuuuuuuuugagacagagucuuacucuguugcccaggcuggaaugcaauggugcgaucuuggcucacugcaaccucugccucccagguucaagcaauucuccugccuucgccucccgaguagcugggacuacaggcgcgugccaccaugccuggcuaguuuuuguauuuuuaguagagauaggguuucaccauguuggccagacuggucuugaacuccugaccuugugauccaccugucucggccucccaaagugcugggauuacaggcaugagccacaacaccuggccuccaguaccaaaaauuuuaaacacaaauuuaacuauaccuuucauugggcauuuuaggcuauuuucaauaucucuacuugaaauuuugugaugaauauuuuucugcuuaaaugauuuuuucuuuauuugacauuuaggauaaauucuuaucaacaauacauacauacauugcauaaauacaauauggucaugauuuauauugccaaauugcuuuccuaaugggcuuucccaacuuauacuguauaccaguacuuuaugaacauaccaguuuuaccauagccuuucuaacauuuggacacuaucauuuauuuuuuaaaacuaauuugaucagcauaaaaaguuccuugcccuuuuuuugguauaccuuugaugauuagcaacuuuuuuuaaaauguggaauguuagaauuagcugucauugaauuauuuuuacgucauucuugucucaagacuugcaucagcaggugcagagagagaacaaaaguguauguauuuagugugacucaucaauccgguuguaggcuuuaggggaaucaccuugcuucaugaacugaugcugccuuugagacuuuuuaaauaucuaacucaucaaguuaaguucaaugaaaaucaaauuacuucuuagaaaaucaaccaguuuuaugauugcauucuugguaagagaagguaaaagguuagucuauaaucuuagaucguuaagcuauuagaccgauacauuucgaggaugauguugauagugguuuaguauaucagguuaucuuuuaacauuuauuaaucuuuuuagauuucaaagugacuuguuuuuuucuucauauccuuguccuucucaaaacugcagcguuuuagacauguguuucucaagguuaucagcuacucuucccaaggagaagcuuucauagauuagcuccucugguuccggugcugcucaggacaugacccuauggaguuacucaguuucagagcaggcugguuggugauacuuuccuuagccauuccugacagggaccuugacagugggacucagaacacucuuauguacucgauuuugaguugcuaauaaugggcgaggaauuucuuaauucuauuugugagguuccugggcuuuucuaguaggagggaaaaaugcauuuuuccaaagauaguucuagagaaguucaaaaaacaguugugcaauggacagaauuauuguaaucaucagaggguuuuccaaaguaucuauucugcaggauuauacucaucugguucucaaguucucaguugcucugucucaaucauaccuuacuuucauuuaauaauuauuuauuaaacaacugcaacuacauccuaggcacuuugcuaggugcuagaaacauguuaaugaacagaacauuucuuuauuuauaaaacuauuuuaacauuacacagauuauauaaaauucuauaaaguugauaucugugggcaaaaauaggcauuuauaaaugcccauuuggacagaacacuagacauuccuagugcuagacuagugggagcuuuaaauauguuguucaaguuugaugguaaagcacuggccucuuacugugccagucuuaucugcacauaauaaaccuauucucacuuaguccuggguugcaguugacuugaguacuuuccagaauugacuuggaguaggaaagcuggcucuucugcuggcucgcauugccagaguuagaagaagaaagccgggacaguuuuuuucucaggguuuuacacguguaucuucucucuucucagauauuucauucauauauauauauauaucucacaguuaaguuuuuuaggcucauggaaauucccaguauacaaguugcugcuuaagacauauauucccugaguauuuuuugcuauauaagaggugcauuuaaauacgagagugaaaauuuugaugcauguuuaaguuacuaaguaaauagaacccucuuugacaggaucauucaugugccaaaccucagcgucacacaauauacccauguaacaaacauguacacguacccucugaaucuaaaauaaaaguugauguuauuuuuaaaaaucgaacucuaucauacuggugauagagaugagacuuacccaaguuaggcaauaaauauuuuaguaucucuuuguuuuaagaaugugguuuugacuuuuuaauauggugaaauguguauggauguguauggaaucccuccacagaggauucuguauuaguaauucaccaaaaauaaagcuuucugguuuuguuguuguuauuauuauuaaucucucauuaucgaacugggauuucaaaccaaauuaaacuuuuucucauuaacguauucauucuugauguagagcugagaaaaugucuguaugugacucucacgaucaugguagaaauaaucugucgaaacuguauagucccuggggcaggagcaguauaguggagcccuuuauucaauuauuuaaucaacuaaauuucuugaaggucacuuauaaggaaagcagugaaaugacuucuaguccuacuuugagaaacccccuaguguuucucacauuuuccucacuuguaaaauugcuaaagucuauuauaacagaacacauaauguguaccauuguaggacuucuguccuuaaagggagaggagaaauaaugaacuuauaaucauuauauguuaccaucucaaaauggcuauggcugaacaaauuguugauuugaugaguagguuagggacagugagaauguugccaagcuaccuggggaaguuucuuuuuucagaagaaaacaugaaaauaauuguggucucuuaaggcaguaagcaugaguccguguaggaagagaaccuuagaacuaugaccuaaagucuuaaaccuagucauugguuauucuccaguagggaauggugguuuaccaugaagggucuuuuggagcucuccuuuguuauuuugacaugcauauuugaugcaaagagauuacuaaauucuauuuacagcuucucuuacugccacaugggugcuagcaaccuuuuucaauuuacuuuuuuuuaauugggguauaauugacauaacauaaaauuaaguguuuuaaagugaaccaugcaguggcauuuaguacauucacaaugcuguguggcuaccaccaguaucuaguuccaaaacauuuucaucaccccaaagaaaauuccauaucuauuaagcagucccuccccauuucccccuccuucuagccccuguugucacuauggauuguaccuacuuugaauauuuucuguaaaugaaauuauacgauauguaaccuuuugugucugacaucuuucaccucgcauaacauuuuugaaguucaucuguguuguagcauguauuaguacuucauucuuuuuuauggccaaauaauauuccauugaauagauaugccacaauguguuuauucauccauugauggacauuuggauugcuuugucaguacacuuuuaaaguuuauuuuuaauuaaguagacaggucuuacauuuggccugaauuuuuuuuuucuguagcucacucauugguccuaccucagcugaaugguaccacacaaagcuagacugaucccuuuuucugucucugccuucaguaagcacuuauucagcaccuauucaaugcccauguuaugagagccucuuagacauauaaaaguagcugucuuccugaguguucccuucuagacccaauauuccugagucuucguuucucuagagcucugcuuucagaauaaugaucuuaguaaagacuuugugucuugauaaauugaggagcccaaaacugcgugcaguauuuuaggugcucucacuagcacuaguauggagcagaagaaaccugucacugcuaccuuuucuagguaguaaauuucuguuaagucuguucagaguuguguuaacuuucuuggcauccauacuugcaguguuuuucguuuugagcauucucuaaauuaaaaugccuagcaauuuuuuuuguacaugcaucugcuaagccaugucuuaucauggauuuuuuggacccaaauggcuuauuuagaccuaaguguaagacuucaguagguaguauauuaacaaaguacuacaaacuaggugacuuaaaguaauagaaauguauuacagcucuggaggcuagaugucugaaauccaaguguuggcggggccauuuucccucugaaauuuacggggaauccuuccuugccuuuucuagcaucugcuaauccuuggcuuguagauacaucacuucaaucuccgcuucuguugucacauggcagucuucuucccugugugucucuuucucuuuuucuuauaaggacaccagucucauauuggacuaaggcccagccuaauucacuguaacuucgucuuaaugugauuuccuguaccaauacucuauuuucuuucuuuucuuuucuuuucuuuuuuuuuuuuuugugagacagagucugacuguaucaccuagucuagaguguaguggcacagucacagcucacugaagccucgaccuccugggcuuaagugauccucccaaguaucugggauuacaggcaugugccaccauaccuggcuaauuuuuauauuuuuuguagaaacugggcuuugccauguugcccaggcaggucuugaaauccugggcucaagcgaucugccugccuugaccucccaaaaugcugagauuacaagcaugagccacugugcccagccccgccccuauuuucuaauaaggccacauucauaggaacucgggguuaggacuugaacauaucuuuuuaggaacacaauucaacccauuacagguaggaauugcacugagcuaaaaguaauggagaccaaaacuaacaguagcuucaaaagaacagacauuuaauucucuaagaaacauucauuccuuaucaugugaaagaaauccagguuugggcuauccaggauugcucuuguggcuccacagugucaucagggcauagucucuuccugcucuuuucugucauucucaaagucaugauguguucccaggagacugcacacgcuucugaagccaucaaaggguacaagauggagaaaaggcugaaggauccaaaggaugugcuucccagccuugucaguucuuuaugcagccuuucuagaaguuccauucaauacucuugcuugcauuucgugggcuagaaauuagucauguggaaauaauugcucuuuuuguuacuaaagaaggaagaguagacuggguauuggggaccaaccagcacucuaugcaacagagaccuuccaaugaacccugucaaaucuccccuugcuggccucagcccaucacuguuccauugugggauuuuugaauccugauucugccauguacccagccauuuggcuucugcaguucuuggagaagauaaaagaucucucuuuugucuucuccaaaguauugguuaaaauguugaagugcauuuaugcacaaaacgguggauagaugccuucuucuagauggacauugcuccauuuuaaucaguaugcuuuguguaggauucuucuaauuaucuuugcuucuaguuuguaauuuuccacaaggggaagaagcccuacuucuaaugggccuguagucuaauggaagacuuagggaaauacaaauuuuccacacuccauugaccaaagggacaaaaagggcugcaacagcuuuguaaucccagugcucccuaaucaauaagguaggaaagauaauagagaggugaggauggugauuauuagaugagagccuugauccuuaacugggggcaguuuugccccccagggaacauuuuugguugucauaacuggggguuguagcuggaguggggagggaggugccgcuggcaucucuugaguagaggccagggaugcugcuaaacaucuugcaguacacaggauagcuuccagagcuaaagaaugaugcagcccccaaagucaauaaugucaagguugagaaacuuuggacuacaguaaccuguccaacccacagcccaugggcugcauguggcccaggacggcuuugaaugcagcccaacucaaauuuguaaacuuucuuaaaacaugagguuucuuuuuuguuuugguuuuugguuuuuggguuuuuguuuuguuuuguuuuguuuuuuugcgauuuugcuguuuuguuuuguuuuuagcucaucagcuguuguuaguguauuuuauguguggcccaagacaauucuucuucuuccaauauggcucagggaagcuaaaagauuggacaucccuggacauugaggguaucuagcacagaugccuuagaguagaauuugaaggcagauuuuaaaaaggacaccuuuuagaguggaacaaauacauguagcaauggcugugauugguuggguacagagaaugacauguagacuuuucauggcuguuaaagaguauagaaggcaaggcaucuagaagaugaaaacaguuauaaaauaguaccccuuuacuaccauaggcagaagcuuucauuuuaauuagcuauugaagguauuugcuagauucguaagacgagagacugggaagccuaauuuaagugcaaggugcuuaacaugcccuugauacgguucgaagaguuugaagagugcauuugggagcuguguuggaauuccagggagcacuucacuuugcugaugggcugucuguccugugugaaucgaguacagaaacagaagauaguauaagagccaugaugcuauuggaugagaagggucaugugcuaguaaaaugugauuauauaugcucuuuauuggugagguguaaauauggcccuggaaaucuagagaccuauguaaucuuagagaagucauuuuaccuuuugggaccucaaguuccucauuuguaaaauagaaggcuuacagcaucagaaaaggccccucaaaggagaguggacuuugggaggaaaacaggcauagggcacagaaguggggggcuguucuggacaggaagaugaacaaaugccuuccucuucucuucacugcccccccccccaccaacccccaccucagcagagggaagggaugcaucugcuauccccacucaucacuggacuccccaagggccaggugugcaguucguucaccucagggagauccagugccuggaacucagugcauacccaagugauguuuguugaaugaaugaaucuuaguuagagcccacgucuacaaacgaaaaaagagcaaaaagcuuguuuccauuuccaguucuuguuucugaagaaaaugaagggcuuuucuuucuccccagagaccacaucuucuuggccccucuaccuagaccaaugcagagauguuccagggauguucagucuagcccccuuucaguuccuuacucuuucccaccuauuccucucccuucuuagauccuucuuguguuuaugcacaguauuuguuuggcaagugccuugggaacuagcaaaaccaugaggacauuuuccugucaccgauacccucuaaugugucccuuuugaguuggcagcuuaaacugcuugcugaauaaaacauuaacuucuucaccccaaccuuguccuuacucaauucuggcuucacagcuuuauugacagcaaugcuuaucaacccacuuuuauggugggcugaaagagauugacuauuauugugcccagauuaaaugggggaguaaugccaccccugucugauuguguuguaauuggucagaguuauauacaggugcaauuuguaauauuuucaguaaauuaaauuuuuuucucuuuggcuuuuauugauguauguucagaugcccauuagggcuuccuuuuuuccaguggaaauugcagcauguuaauuuucacacaaauuacagcaauagcagguaucucuauuugauacauuauaacaggagcaaucaaggauaauugagugccuuucagauggaaacgggugcauucacuucaauucaaagcgaguccauuuaucgccuaaucggucuuuaaacacuaaauuucuggaacaaaaauucuugucauaauuuugcuuaaguguauuuggaaaucacaguccuuugagcaaggauaauugaaaucaaaucccuuucaauggaggugacauuucuacauuuucccaauugaaauuaauuucaaaaauugagcaugaauaucuucaaauggcaggcaauuauagcuuucaaugggaagaaauuaugcgcacaaaaaaguggagacaucaaauaccgcuucagcuaaaugucuuuguuuccaacuguguuugccuuguaaagauuuacauauauugacuuauuaugcaaccuugagaugcagaucgccuuccuuuuucaucugagcccauuaaaauuaacuaaaauuggaacguucuuguuaagcuucaucaaaacuguuuggaauuuacugcagcugcagaaauguguucauaauagaacuuaacccuucaaagacuugaauucuacccccauuuuuuuuaaaucuggaauucuaacuucagcgcauuucauuguuucacuuuuaaugauucaaaagaggaguggugaagaacugauaugcuaauugucuucucuuuuugucaucugguacccaugggaucucagguaaaucucuggagccuguccccuuugaaaacugcccugaaggacaauacugaguucccagagggcaccaauaugccaaccuuuaauauuuaaauguaaucauaucaagccgauuucccacuccucacaauaggaauugcucuuauuguuggacugugacaaacucuguggguuuccugcugcggaccuuuuccuacuaagaaccuuuucucccaauuguuuuauugccacauuaaugcugcuauuaagauccgugugcuauaaauuagauaagcuuuauauauuuuuuuauucaucgugacuuucuucuguuuuccaaggguaaaaguauauugagaacugacucuugcaagcacuuacuuuucgaaaguaguuuagaagcaaucuagccauguuuuacaguuauagcggcaauuguuucaacaaccccaaaaaaauugcauuacugaaauauauuucaugggugcaauuggccagggacagggagggcagcaggccauuucuuuuauuaaggucuugcgcaaauguuaugaagagggcaguaucucaagaaacaauuucacagcugguuugcuccuaagccacucaagccuaaaaaugcaccgaauuccugguggaaaaaaaagaaauagaugucacucccaaacaaagacaggugcuaagcugcgggagaugagagaaggggugaaaacaguauccagcuuuaauagcaaaagcaaaugcuagcuaauggcccauucucaggaacucguuaagucaucucuaagcaaccacaggauaauacacucguuauuucugcugguauguuuccuaaaagugaggcguauugcuuugagcccagaaucuuaguggauagugcgccucaccucuguauuaaccuguuggcacgagaccuuuccugccgucuuaugccuucuuaauggaauuuuuauuagucauuuggguguucuuuuuuacuuuauuuucuuugcucuuaauuuuuagcuuuuuaacuaaaaauguuuuuaaguuaccuaauguuuuuuguguccuauaagagaauuuccccccuugguucaccugcugauugguuuuuguguaugauaaauuauucagagcuuaugcaaaguguuuaauguauuuuccaaguuauuguuuuaguggaagauggacauuugucuuuggguaggaauauguggguuuuuuacguucaaagcaggaguuguuuucugcucaaauuugauauuuguuagccuugauguuugaaguacucaucggugaccaauaagcuguuauacagccuugaacacugacugaagggggucugaaauaccauggggauuaaaaauagcaaaaccacaugcugaaauuagaauuuauauuuagacgauauauugucuuucacucacccugcagaauuuuauuuuuaaggcuguacauuguguggcucuguguuucucauuuuagaaacacaaggaacucacuggaaagccagaccugguuaauacaaacauagucugaguaaacauacaggaguugcuaugcaggauaagggcagaacauucuucaccaacaccacauugguucaguauaaucacaaacacugaaauuuuucuuugugaaagugacacugugaaauguguaacaaaauuuuucaaggcauuuggggauguauaguucagcauucaacaggaccaccaaagauguaggcagaugcauuuccgccgcuucaaggaagggugccgaaugugcgcaggcccucugugcuauccuucauuguuccugcauuuaccuuccuacuucuaugcaauggagugcaaagcuuguuuauuggcaguccugaaggcuuugcagagguacugaaugguggaaacugagauuuccaaauccuccuagguuuuagggcagcacucuuuaaauaggauuucugagucccaaaucuuucuuauauccuugauaauuuuuauauuauuucuuccuucagacauaaccuugauaugggcuguguguccuuggaaugccaagcagagaucauuuuaugcuuugaggucauaguuauaaauaauguuacuuaucauauacuccaaauucauucagaauuuagugagcaccuacucuggaccaacacugauacagccaguagguauacagcaggaaucuaaaauuaagucccuguccucauggaacuuacauuccaguguggggagacagauaauaaacaauaauuauaugacauggcagguagugacaaaguacuguggagaagaauucagcugugugaguaggaaagggacuggcacaaguaggguuuguuaauuuauguaggguaucuagggaaguucuccuugaaacaguaauaguaagcaaaggccagagggaugugaaacagugggccuugcagauaugaagaggaagggcauguauaagggaucuggaacagcuaguauaaagggccuaagauaggagggugcuuggcauauuuaaaaaauaggaaaagggccaguguagcaagagaaaagggaacgauggggaaagccgaaagagguaaggugagagaauuugggcagaggguggagacacugugaagagccauguaagccauuguaagggcuuuaguauauaugcuaggggaaauggggagcuauucaggaauuccauguggaagagugcaguaucugacuaaguugacugcuuugacugcuguaauuuaggcaaaauauguugaugguagcuuggcccaaggaauagaagggaaucugugagaagugguuagauucuugaugcauuuuaaagcuaaaacugauaggaguugcuacuccaauccuucuuccccugugacguuauauagaaggaaauggaggagagauuccuucuuacaggcuacugauucucaauugaauucuaauguauuuaauuauucaccuaaaacuaagaucuugccuauggaccccauauagcauagcaguauccuuacucuuaauagacuuuaggggaaaaaaaugaguuguguuugacuuucagcucacagucuagccaaugaggcaaaauuacagaaccagagaaaccccucugcgcgugcaugugcgugcacacacacacacacacacacgcacaccccuguacaugcauguacagaucccugaaagucaugagaagcacagcuggaaugagccauugucucagauggguguguguucauaugcagguguguugaagggguggugggaaguaauuaacaacugcuguacuaauuuuuaauguaaacauguacauaaguaguuagaggagaugauaagagaagauugcauagaaaaggugagauguaaacuaagacugguaggaucaguaggauauaaauaggugaaguugaggaggcagaaagacauucuugucagucccuucucugugcuucugcuucgaagguagaggauuuggugccuucuacucuuucucuacauaaucuauuuagaagaugcuccaguguuaugaaaacagccuuaggaggcuguaugacaucuacuuagaaacaguagauugaaguuggaucuuuagagcaaacuauucuaucaugugacuguuagacuccaguuuagugguaucagacuaugcccuucuuuuuggaugguuauagauuaaaggaaaaucuucuagggcaaaucuugaaauuaagaaaguauuaagggugugcuccauacucuguuccuuguuuguauccuuaugccuuguccuuccaccagucuucccucuccucuuccuuuacacucagcuguccuguaaugcaauguguguguuccuaaaaaucacuaagcuauggaaaaucauauaaugacaaccacacaguuuauggaaaaacagaaagguuagggcaacacacaaaaacuucaucagugacacauaaaaaaggauauaggaaccuaaacaaaaacaaugacauaguuuuacacaucuucaguagcuaagaaauauauaaauauuacaauaaauaugguacuuuaccccgaaaaagacuugaaguuugcuuguggaaguggacucagaaggauugcagcugugagucaugaugacguagagaauggaagguuaucugaaauuggaaggaaaguugcaacaaacaccagaugugggugaguguagcacagugaacugagguagcugguugauguuugagguauuugcguauguguguuuuauguauuccuguauugcuugggugcauuucuugcauucaccuaauauuucuugcagacaaaaucaugcacgagcaaacacgaaauucauguuguguucaaacuguuccgugauauaucaauggcacuggaauaaauucucauauucaaaacaagcgcuguagcagaaccaacuguaucucguuuugucuugaugauuaaccagcaccuuaacugucucccugcuuuauuguuuucucuucauucucauaauguacaaagacacucguauuuuuagaaagacugauuggaacaucugucaaccagauaauuaaacuuauugaauauugucuaucuccagcauccuggucugggacgugggaaacaaaaaacguuuugaaacaauggguucugccuuuauacugcuugaauauggggaacuaagcgcagaccuuugaagcaaaacaacaguucuuaaaauaugacaacauauagaauuaauacaucagugcugaagagauaggguaaaguaguuaguaaagagauaggauaaaguaguuaguaagguaaagcuucuuagaauauauaaauuuugauccagauuguaaacaaaguugugaacauggauuggggaaguagucccagaagaugaaaacccuagcaucaaauucuaccagcauuuugguuccagguaagauggaguaagaauaguucuuauugucuccaaccgaaagcaacuguaaaaccuggacagcauggguggagcaguuacauggagaccgaaaaguaaacaguagcagguagguuaaagaugaagaccagauuucuuuuuuuuuuuucuuuuuucuuucuuucuuucuuuuuuuuuuuuaagaccgguucuuacucugucaaccagguggagugcagugguaugaucaaggcacccugcagccucaaucuccugggcuccaguguuccucuugccucagccucccaaguagcugggacugcaggcacuuggcaccaugacuggcuaguuuuuuuauuuuacuuuuaguaaagaugaggucuugcuauguugccuaggcuggucucaaacuccugagcucaagcacaccccgaccucccaaagugcuaggauuacagacguaagccaccgugccuagcgaugaccagauuucaaguaccuuuaaacuagcaguaaguuugccauuuuguccccugauauuccccugccuaaaugcagcacagcguaaaaccaagcgugggcaccaagcuacagacagcaaguuccaggagaagcaaguaguggcaaagguaacacccagagagaauguagaaauccccauggcuuucuuuuguuuuuuuuuuuuuucuucaugcccucaugcaucagucuucaaguaaccuuaugguggcaacagaagcugcagugagagucagcaggagccagaacuccaaggaagggaaaucucuucccugaauccucuuucucuuucuuccuauccauugguccuaaauggaguacagucacaaaaauacaugacaaguuagauaacuaaagacacagcuuucugacuggaggacugaaaacaggaguuaccugcagggaacuagaagguaccaggaagaugacagagaaagccuuagggaaacaggccccauaagguuguuuaugagucgggugcagugacucaugccuguaaucccagcacuuugggaggccaaggcaggaggaucacucgaggucaggaguucgagaccagccuggccaacauggcaaaacccugucucuacuaaaaagacaagcguuagccggcgugguggcacacaccuguaaucccagcuacuuaggaugcuaaggcaggagaaucgcuugaaaccaggaggcagagguugcagugagccgagaucgugccacugcacuccagccugggcaacagagcaagacucugucucaaaaaaaaaaaaaaaaaaaaguuguuuaugaacuucugggccuguggaaagaaagggucuaauccuaaucaacauaccaaagacauggagaacugaaauaaaaaccaucacccagaacccaggacuaccuaguagugcacagaggagacagauccaaaaaacugcaaaaguuuugacagcugaacugacauuggcgacacagaaaguggauuggagcucacagcccaaauuuaaugaagucaauugccugcuaaaaugaaaauaccaacaauuuucauaggauugaaagaagacccugagacucauacuauucaaaauauccaggauauaauucuguaagauagaaccaggaaaauccuauaagaagaaccaggaaaaucacagauugcuggggugggggggugggggugggggaggagacggaacacgaacaaaaagaugccaaugcugagaugauaauaauauuagaauuauaugauaaagacuuuaaggcaguuauuauccaaauguuccaacaaguaauggugaacccccccccccuuuuuuuuuuuuuuuuugagacagaguuucgcucuuucacccaggcuggggugaaguggcgcaaucuccacuuacugcaaccuccgguccccgggcuuaagugauucuccugccucagccuccugaguagcugggauuauaggcacucaccaccacgcccggcuaauuuuuguauuuuuaguagagacgggguuuugccauguugaccaggcuggucucaaauuccugaccucaggucauccaccugccucggccucccaaagugcuaggauuacaggcaugagccacugugccuggccaacacuuuuuaaaugaauggaaaaauagaaaaucucaacaaagaaauggaacauguaaauuaucggggaaaugcaaaugaaaaccacagugagacaccaccuuacugcugcaaggauggccauaauuuaaaagucagaaaauaaauagauguuggcauggauguggugaaaagggagcacucuuacacugcuggugggaauguaaacuaguauaaccucuguggaaaacaguauggagauuccuuaaagaacuaaaaguauaauaccauuugaaccagcaaucccacugcuggguaucuacccagaggaaaagaagucauuauauggaagacacaugcacaugcuuguuuauagcagcauaauuugcaauugcaaaaauaugaaaccaacauaaaugcccaugagcuaacgaguagauaaagaaaaugugguauauauacaccauggaauacuacucagccaucaaacgaaaugaaauaguggccuuuguagcaacuuggauggggcuggaggccauuauucuaagugaaguaacucaggaauggaaaaucaaguaucguauguucucacuuauaaguggguauguucccacuuauaagggggagcuaagcuaugaggaugcaaaggcauaagaaugauauaaugaacuuuggggacuuggggggaaggauggagggggugaggaauaaaagacuauacauuggguacaguauacaaugcuuagguggugggugcaucaaaaucucagaaaucaccacuaaagaacuuauccauguaaccaaaaaccaccuguacccccaaaaacuauugaaauaauuuuuuuuuaacucacagagugguuggaaacccucauaauggucuccacccuccugggggaaaaaaaaaagaaauagaagauguaaggaagagucaaauggauauaucagaagcaaaaaauauaauuaccaaagcaaaaaacuuagugggcucaaucauagaauggagacgacaggagaaagaguaaaugagcuugaagauagaucaauagaaauuauccaguguagacgaggcauggugccucauaccuguaaaucccaacacuuugggaggccgagccggacaguucacuugaggccaggaguucaagaccagccuggccaacauggugaaaccccaucuguacuagaaauuuuuuuaaaaauuagcugggcguggcgguacuugccuguaacccagcuacucaggaggcugagacacgagaaucauuuaaacccaggagucggcgguugcagugagccaagaucaugccauugcauuccagccugcgcgacagagcaagacucugucuuaaagagaauaaaagaaauuauccaguauacagaagacaggaaaagacugggagggggaaaaaggagccuuggggaccugcggaacaauaacagaaaaaucugacagucaugucauuggaauaacaaggaaagaaggaccauagggccaaaaaauuauuugaagaaauaauauuugaaacguccugaguugggcagaagacaugaauuuacagauuuaaaaagcucagaaccccaaacaggauaaaauaaauuuauucccagguaaagcauaauaaaauuauuuaaaacaaaaaauucugaaagccagggaaaaaugacauauauaagaaaaaaagauuuaacugaugauauauuucucaucagaaacccuggagccagaggaaguggaacauuuuggaaguguuuaaacaauuaucaguacaaauuucuauguccagcaaaaaauacucuucaggaguaaaagugaaagaaagacauucucagaugaguaggauaauucauugccagccgaccagcucugagaauugcuaaaggaaguuauucagagagaggggaaaugaaugcuggaggaaacuuggaacaucauggaugauggaagagcaacaaaaaugggaaguauaauagacuauuuuucuccucuugaguuugcugaaauauguuuugcaggugaaaacaaaaaucauagcauugucugaugagguuuucaauguacauagacauagagacaacuacagcauaaagagagaaauggggucuauauguguuuuugcauuccacuugaagugguaaaauuuuaauucuaaguguguacauugacauucugaaguauagacuauauaaagagaugucaaaauccaauaauagcuaaauuauaauaaaauuugcaauguucaaauaaccaagaagagggcaggaaaugggaaagaggaaggaauaaucagaaaauaaauaauaaaaugguagccccaaaaugauuuuuuuuuaaugaugcaacucuaagcugccuucaagaaacucacuuuauuuuuauuuuuuauuauuuuacuuucguguaauuucuuuuuuuauuauuauuuuaggguacacguguacaacgugcagguuuguuacauauguauacaugugccaugcuggugugcugcacccauuaacucaucauuuuacauuaaguauaucuccuaaugguaucccuccccccuccccccaccccacaacaggcccuggugugugauguuccccuuccuguguccauguguccucauuggucaauucccaccuaugagaacaugcgguguuugguuuuuuuguccuugcgauaguuugcugagaaugaugguuuccagcuucaugcaugucccuacaaaggacaugaacucuucauuuuuuauggcugcauaguauuccaugguguauaugugccacauuuguuaauccagucuaucauuguuaggcauuuggguugguuccaagucuuugcuauugugaauagugccacaauaaacacacgugugcaugugucuuuauagcagcaugauuuauaauccuuuagguauauacccaguaaugggauggcugagucaaauaguauuucuaguucuagaucccugaggaaucgccacacugacuuccacaaugguugaacuaguuuacagucccaccaacaguauaaaaguguuccuauuucuccacauccucuccagcaccuguuguuuccugacuuuuuaaugaucgccauucuaacuggugugagaugguaucucauugugguuuugauuugcauuucugugauggccagugaugaugagcauuuuuucaugugucuuuugucugcauaaaugucuuauuuugagaauugucuguucauauccuccgcccacuucuuaaugggguuguuugcuuauuucuuguaaauuuguuugaguucuuuguagauucuggauauuagcccuuugucagaugaguagauugcaaaaauuuucucccauucuguagguggccuguuugcucugaugguaguuucuuuugcugugcagaagcucuugaguuuaauuagaucccauuugucaauuuuggcuuuuguugccauuguuuuugguguucuagacaugaaguccuuucccaugccuauguccugaaugguauugccuagguuuucuucuaggguuuuuaugguuuuaggucuaacauuuaagucuuuaacccaucuugaauucauuuuuguauaauguguaaggaagggauccaguuucagcuuucuacauauggcuagccaguuuucccagcaccauuuauuaaauagggaauccuuuccccauugcuuguuuuugucagguuugucaaagaucagauaguuguagauauguggcauuauuucugagggcucuguucuguuccauuggucuauaucucuguuuugguaucaguaccaugcuguuuugguuacuguagccuuguaguauaguuugaagucagguagcgugaugccuccagcuuuguucuuuuggcuuaggauugacuuggcagugcaggcucuuuuuugguuccauaugaacuuuaaaguaguuuuuuccaauucugugaagaaagucauugguagcuugauggggauggcauugaaucuauaaauuaccuugggcaguauggccauuuucacgauauugauucuuccuagccaugagcauggaauguucuuccauuuguuuguauccucuuuuauuuccuugagcagugguuuguaguucuccuugaagagguccuucacaucccuuguaagguggauuccuagguauuuuauucucuuugaagcaaaugugaaugguaguucacucaugauuuggcucucuguuugucuguuauugguguauaagaaugcuugugauuuuugcacauugauuuuguauccugagacuuugcugaaguugcuuaucagcuuaaggagauuuugggcugagacaaugggguuuucuagauauacaaucaugucaucugcaaacagggacaauuugacuuccucuuuuccuaauugaauacccuuuauuuauuuccuucuccugucuaauugcccuggccagaacuuccaacacuauguugaauaggaguggugagagagggcaucccugucuugugccaguuuucaaagggagugcuuccaguuuuuguccauucaguaugauauuggcuguggguuugucauagauagcucuuauuauuuugagauaugucccaucaauaccuaauuuauugagaguuuuuagcaugaagcguuguugaauuuugucaaaggccuuuucugcaucuacugagauaaucaugaagaaacucacuuuaaauagaagaauauugguccauuaaaaguagaaaauggcaaaagacauaccaugcaaacacuaaucaaaaggaaguuagaguggauauauuaguaacagaaaauuagacuucagguuaaagaaaaugauuagagcuaaagaggaauacuacauaaugacaaaagagcuaagucaccaagaauaacaaauaauucuaauuguauaugcaccuaacaacggagguucagaauaccugaagcaaaaauuggcagaaaggaaaggaaaaauagauaauccacaauuauacuucgcaagcgugacacuacucucucaacauuugauagaaaugcuggacauaaaaucagggauauagaagaacugacaaucugauuaauauuuauaaaacaugcucuccaacaauaacaccauccacauucuuuucaaguguacauggaacauucaacaagauagaccauauucugggucauaaaaccuuaaugaauuuuaaaaaauugaaaucacacaaauuauauucuugaaccauaauggaauuaaauuuuagaaaucaauaaaagagugauaacaggaaaaucuucaaguacuuggaaauuaaacagcacacuucucaauaaguuaugggucaaagaagagguauuaaggaagauuggaaaguauuuugaacugggugaaaaugaaaauaucagacagugaaaaacacaauauauacugugauguguacuguaauacaaaguaggucaauuaccgaugcucauuuauucaucaugaacacacaaaaucaguaaaauacucaaauaacaaguuuuaagguauugguauauucacccaguugauaaaaaucagccaguuaauuugacagauaaguauuaaauaaucaggcuguuagaaucaggugaguaaaggagaaaguaaaaaccugaacaaaguaggaugaugcagguaaagcaaugcuuagaggaaaauugauaguauuaaauguuuauaugaggagaaaagaaagaucucaaguaaauacccugaguuugcaccuuaaaaaauagaaaaagaagaguaaaagccaaagcaagcagaggggaggaaaugguaaagaugagaccagaaagcaaugaaauugaacacaggaaaauagagaaaaucaaugaaacuaaaaucuguauuuggaaagaucaauaaaauugauaagccucuagcaaggcugacaaagauaagaagagagaagauacaaaucagcaauauccagaauucuagacccccauggacuucuuuuaaaaauaauaagggaauacuccacauauuugacaauuuaaacauaauggaucaauuccuugaaaaccauaaacccuaaaacucauccaagauggaacagauaaccucaguaguccaauauuaugucuaugaaagaaauuguauuuauaguuaagaagaaagcaaaagagaauaacauuggaggaaucaauacauagcuuuaauacuuacuacaaagcuacaguaaucaagacaguguggaacuggcaaaauaauagacacguagaccaauggaagagaauagacucacaaguguggccauuuuauuuuuagcaaacaugcaaaagcaauuuaauggagaagggguaguccuuucaacaagugaugauggaaaaaguggauauccauaugcagagaaaaaugaaccuugaccuaaagcucauaccuuauacaaaaauuaacuccaaauauaucguagguguaaauguaaaacuauaaaacuuuaaagaaguaaugcauaagagaaaaucuucaugaccuaggguuaggcaaaguguucuuagacaugaaacuaaaauugugauccauaaaagaaaaauguugaucaccuggacuucaucaaaauuaaaaaccuuugaucugcaaaagacacuguuaaggcaaugacugccacagacugggagaaaauguuuucaaauuacauaucuaacaaagguccuguauccaguauauauaaagaacucucaaaacucaacaguaaaacaagcaauccaauuuaaaaaaaaacaaaagacuugaauagauucuucaccauaggaaauauaaggaugacaaacaugugaaaagauguuuaacaucacuagcaucagggagaugcagauuaaaaccuugacaaaggcuggguacaguggcucacaccuguaaccccaacacuuuaggagguugaggcugcagugagcagugacugugccacugcacucuagccugggugacagaguaagacccugccucaaaaauuaaaaaauaaauaaaaauaaaacugugaaaaagauacggcuccacaccuauuagaauggcuaaaauacaaaauacugacaauaccaaaagcuggcgcagaugcaaaacaacaggagcccucauauguugcuggugggaauguaaagugguaucacaaccccagaaaagguugacacuugcuuauaaagaguaauauacacuuaacauaugauccagcaguccuguuccuguguauuuacccuaaagaaguacaaauuuauguucauacaaauaccugaauucauauaugaauguuuauaguagcugaauucauaauagccuaaaacuggaaacaacuguaaagaaacuguaguacuuuccuaccauggaauauugcucagcaauauaaaggaagguacuacugauacacccaacaucuuggaugaauagcagaggcauuaugcugaguggauaagccaagacucaaggguacauucuguaugauuccauuucuugaaaauaaacuauaaugauguagagaacagaagagugguugucauggguuagagaauggugugaauacaaaggggcagcaugaagggguguuugaagcauggugggacuauucuucagccugauugugguguguuacguguguuuaaaaagucgugguaaggccaggugugguggcucacaccuguaaucccagcacuuugggaggccgaggcgggcagaucaccugaggucgguaguucaagaccagccuggccaacauggugaaacccugucucuacuaaaaaacauaaaaaauuagcugggcaugguggugggcaccuguaaucccagcuacuugggaagcuaaggcaggagaaucgcuuaaacccgggagauggagguugcagugagcugagauugugccauugcacuccagccugggcagcaagagcaaaacucugucucaaaaaaaaacaaaaaaaaaacagucaugguaagccgggcgugguggcucacaccuguuaucccagcaucuugguaggccgaggcaggcggaucacccaagaucgggaguucgagaccaacguggccaacauagcaaaaccccaucucuauuaaaaauacagaaauuagccaggcgugguggcaugcguguguaauccgagcuacuugggaagcugaggcaggagaaucacuugaacccaggaggcggagguugcagugagccaagaucguaccauugcccuccagccugggugaaaagaaugaaacuccaucucaaaaaauaauaauaauuuuuuaaaaaaagucauggcaugacuuuuuagccaggcacacuagcaugugccuuuaaucucagcuccucgugaggcugaggcgggaggaucgcuugagaccagccugggcaacauagugagacccugucucaaaaaaauuuuaaaaaaaucguggaacuguaccccaccagucaguuuuacuaugcaauaauuuuuaaaguaagauuuuuuuuaauagaauuucuguggccugauaagauauaauucugcuuuaagaacuucugugaauguccaacauugagaucaucacaagguaauucccaaaacugccacacugaagacaaggcacaccuaaauaaaugucacugggagccccugcuaaacuuuuuggccaggaauccauaccaaggaacaaguauccaacuaugacaaaggaacaaaacauucauauucucuuugcuaaagcacauuugugaaaguaaaacaucuccccccacccccgcaaaaaaaaaaaaaggaaagucauuccuaaaaauugauagaauagauuuggacaucagagugucaggccacucaugcaaguucuagcccuucaaauaagaauguaaagccguaauaacaugacagcauuuugaauaggaaaaucuggauuugugaagcaguguguguuuuugacaacaguaguuccgcauucuuuuaugcaacauaaacaucgauuuguuuaaaguuaccauucuuuuauuuauccagcgggagcauagauagcaucauagggaaaaagagacucuauccugauuuguuuucucuuuauuucacuacagccagcauucuggaaccccuuucaaacaucccuuccuguggguuaagggagauuauuuaaaaacaaacagaccacacaaaaaaacagcacaguuucuaaauuuuuguaauaauaauugaaaauguaaauuaguuucaaucaaguuccuuuuguucuccugguuuaaaauuacugguuaagguuauuuugcauucacaaauguuaaacaguauaucugagcaaggugaaauagauuacagaggagucauauuggcgggugggaccuccuuacaggccugcagaugacugaaggcucauacugccuccaguggcuucugcuuaagccccacccaccuauuacaauucugaaggggaacaguauuccaauaaagauauuuucuuuccuauuauuuuauuuuuuaauggcugugauuguauaccauuucauauuaggcuuagcaaauucacauacucaucuucacuugaugaucuaccaauuugcucuuuucauuucuucacaaaauuaacuggccuguguugaagagcauaaaucucuaguuccuaaauucuugauacacuuuguggaauuuuuuuacuagcauuaaaaaguguuugaagcugcauucuguggaugaggccccaggcucuauccaaagauaucccuggaguauuucucuuuuuauuuguuuuauauaugaaguugcucuauaaaaguuuaucuaaaagaaaagggguuccauuaccaagaaaauauugugaacgccacucaccuggacaaaugaaauucacagauaaugagaacuugaguuuuuaaccagucauccccauuucccaucccucuaaacuuuaaguguugcuaacagcaaaauuugacugauuucaugcuuuauuugucaacauuggaauaguguuuauugaauaccuucuauaugccaguaccauauuucaggggggugcauuacuuuaucuuacuuugccuuuggaaaaacugcugagaagugaaguggcuaaggcagaaaaggggaagaaugaggacauggauuaucugucucagaguaauugagugccacgguguguacugacuaaugugccagaccuucaaaugagauaaaugggcgguaaaaagugauuucagagaaacagaccugcuagagcucagauugaggcacuucuguuauagucauagaagauuacagaacaauuagagccaagaggauugcagaagaaacaaaacacuuucauguuaacacagccugccaaggaaucagauaagauauuggcauaacauaggcuugggaauugaagaauuccuauguuguugauccuugaaccuucuguucaaaucccagauagagggcaauagauagguaagacagaaaauuuacaguggaauggcaucuaaauauguugaggcuagaaugaagccuauuacaagaaccugagaacuuuuuuuuucuuuuuucuuuuuuuuuuuuuugaggcagucucgcugugucgcucaggcuagagugcaguggcacgaucuuggcucacugcaaccuccgucuccagguucaagcaauucuccugccucagcuuccugaguagcugggauuacagauuugcacuacuacgccuggcuaauuuuuguauuauuaguagacaggguuucaccauguuggccaggcuggucucgaacuccugaccgcaggugauccacccuccucagccucccaaagugcugggauuacaggcgugagccaccgcgcccggccacugagaacaauuuuuaaaagaggacagagaacaucaaugggauguauuaucaaaggacuucccauacuuugagaccuagacuggggagauguauagcgugggaaggauuuuuguuuuguuuuucugauuuuuccaaacaauuuuuuugaguugcaaaagcuuaagauaaaaguuacaggaauugaguguuuccuuucuuuaggugaaaguaguugagagagaacacauuuauggcuaugcauuuuauuccaaggaaaauccauuagccaauuuguuuuuuguauuuuuuaaauacuucuuuguagaauaguuucguuuucuaucgcauguagaaagcagccuagguaagcuuucagugggaaagaccagaucuuguauacaagcaaaucuaguuucuaauuaaacaaguuucuaacacuuuaaugucuaaaaagaaaaggcaggcugggcaugguggcucacgccuauaaucccagcacuuugggaggcugaggcggguggaucacuugcgagaccagccuggccaacauggugaaaccccgucucuacuaaaaauagaaaaauuagcugggcauggugaugcaugccuguaaucccagcuacucgggaagcugaggcaggagaauugcuugaaccugggagguugcagugagccgagauugcaccacugcacuccagccugagugacagagugagacuccaucugaaagaaaaaaaaaaaaaaggcaaaaagcagccaagucaucuuuuuguuggcucuguuuuugcagugccauuauuguccuggcaaauuggaagaauuuagacaaggaauuagugaauuacacaugcauguguguuaauacccuuucuuuuauuacuuuuucuuugguuuuugaaauuuaauuugcugacauuugaaaauauaccuacaauuacuuguuacugaauaacuacuuauucaaaauaucauggaggaaaaucacaagaccucuaccgugauucaguaacuaaauuauguuaauagcuaccugaaauuuccuaaagaaaguccaaaccaauggacuccacuaaaugaucucuuagagaauuacugcuuaucucucauuaugauggcugguuaggauagagagucuguguccucagagccuagcagccauguuuaggggugggcuguaugaauauauuucauugacugagcuggcuagaacaggauaauggccaaauguagucugaccaguagaaaugaacauugacaagaauuaagucuuaaugaaauaggaggauauaguuaaugugaauugagggcuuaccaugugccagacaguagacuuuugccaaacacuuuauaugcauugucuuauuuaaucuuuacgacauucugauggguauuuuacagcuggguaaaccaaggcuucgagagguuaagugacuugguagaaccagaauuugaagcagucuguccgacucuggaagccacacaauuaacuacuauuuuauaucuauuaucauuauaccuguuaucauuaaugugagaccaaaugauaccaaaaagcaaaguuugaggauggugagcaaagaccucuccaaaaucuaccucuacacuuucugcugaaggauagcugauacacaccccacccaucaccaccaaaaaaaaaaaaaaagcacaccauuucucgaauauuccuaagcaucauuuuugaaaauuucauuguuauguauaugaaucuaugcuguucucugaaacuauuagucacuaaaacuacauucauagauauaauuuguuucauaguagcuuauaagggauauaaccucauuauagacugacaaacacucuagaacaaagcagagacaguagagauacauuaaagguuuguuguagccaaauuuaaccccccaaaaaagauuuaaagcaaacauauaccagcuacuauguuucaggcacuguucuaagcauuuuuucuauuuaaacucauuuaauaugcaucauaauccuaugagguacuguuguuauuccugcuuuacagaugaggaaacaugguuagaugcugucuuuauuuacuucacauuacuauuaauaugaaagaauaccugagucugggugauuuauuaaaaaaagagguuuauuugacuugugauucugaugucuggagaacuucaagacaagauuggacauuuguaucagaugagggccucgggcugcuuccucucaugggggaagaugaaggagagcuggcuguguagagaucgcauggugagagaagaagugagagacagaggaggggaggugugaggcucuuuuuaacaaccagcucuaaagggaauuaauagaguaagaacucacuuagccacuccuucccuuagggagggcaguaaucuguucaugagagaucuacugccgugaucaaaacaccucccauuagguccuuccuccaacauuggggaucacauuucaacaugagauuuggaggagacaaacauccaaauuauagcagauaucuugcccaagaccacccauuuaauuaagaaguagagccaggauuugaacccagucugguuccacagugugugcucuuaaccaccacacuauacuugucucauuucguauuuuuacauguaguaguuuaaaauaccuuggcuuuacuuagcuccuuucuucuaaagaacguauucuucuagccuccugauucucucuaugccagauuaaguucuugcaagugucucuuuaucucgggaaacuucccaaagacaaauauucauagcuaauaaauaguuauaauacucacugccauuuacuuagcacuaauuuuaugccagauaccguacuguuuccuauacauuaucucauucagucuucguaacagugccuugaggucauguucccccccaccaccaccauuuacaaaugaaagguuaccuggccucucugagccucaguuuuuccauuuguaaaacugagaaagccucuugauguucuguuaggaauuucuaaaggcaaaugaacacguauucaaguauauacauagacuguggaacauaaauuuuacuucuaggaacucaaauuuugacaucuuuauauuucaauuuuuauuuuaaguucuaggauacauguacaggaugugcaaguuuguuacauggguaaaugugugccauggugguuugcugcaccuaucaacccaucaccuagguauuaagcccaacacgcacuagcuauuuuccuaaugcucucccuccccaguuuuuuuuuuuguuuuuuuuuuuguuuuuuuuuuuguuuuguuuuucuguuuuuuuuuuuuuuuuuuugagacagagucucacucugucgcccaggcuggagugcagugucacgaucucagcucacuacagucuccaccucccagauucaacugauucuccugccucagccucccaaguagcugggacuacaggugugugccaccacacccggcuaauuuuuguauuuuuaguagagacgggguuuugccauguuggccaggcuggucucaaacuccugaccucagaugauccucccgccuuggccucccaaagugcugggauuacaggcaugagucaccgagccuggccacccccucaccccccacaaauuuugacauauuuuuaaucaaaggugcaauuucuaaaggugcuucucagaaugaagagcaaaaauuauaaaauuaaguugacacauuagacguugggucccuagcacaacaaugguacacauuggaaagcuugucuauuuggcuuggucaguuucucauugcagccuuugccucuagcccgcaggcccaugaccuuuuuuguggcccugugcuucagccacuuggaccuauagugaacuauaaccugaaugugacaucauuguagccugugugagggagguaccaggugcauaugaauggaccgucucuggcacacaaagcaaguaugucagauugaaaacuggccacaaaagaacugauuaacacagaaugacauaguugaaaaugcaucaauaaaaaguggcauaauaaaaggaucaaggggcuuggacacugaaaaccuggcaucaaguauuggcucugccacuuacuagcugcaugaccuaaggcaagcccaguaaccucuuugagucucagcuuucuuauauguaaaaugaggauaaucagaauagguagcucacauguugaggaucaaaugggagaaaccauaaugcaaaggagagugcucugaaaacuagaaagugucaaauugacauuaaucuaucaugcugaacuucauuaagccccuccuuuggcauacugugauuuaauccauauauagcgugcauauauggacuuuauuuuaucuugcucaauccuagaccagcauuucaugccaagaagugagaugauguuuggaaauaaaaauaugccgccuucucgauucuagcuaugaauaaucauucuaguuuugacucuaccaguuuuucuaagagguuucaaacaaaccauagcuaccccauuuacugaccagaucuaguauuauaaacagaugacuucaccuugaugaacuuuguaaaauaagggaaauaaucccaguuuccccugaccucacagaguuauucugaggauugaaugcuuugaaaaauaucacauacuaugcaagugcaaggguugugaauuuuuuuuauuguuuagcagaguaauucauuuaguuauugaacaggcauauugauaaaaauauugucaggaauaaaaaaaugaauaugaccaucaaagaccucucaguguagcaucggaacuaaaacacacaaauaauucuauuagaaaaugaaaagugauacaugccauuaaaaauuauagaaagacagugguugacaugaagagagggguauauaaauggaaauauccacauuuaacugugucacaguauuggagaagauguacccacaccauacuguaagcuucugcaaucuuucaguauuuuucucuuguccccugauguagcccuagcagcuagaacagugccuucgcauguaguagauucucaguauguuagauaaaugaauaguugucuuucugaugaauacagguggcucaugcuaugagaguaggcugacuuuaacuuacccuacguuuccauaugaagcagaacuucuucagaggugucaccuaacccagaaugcaccuuaacauccagaucaaauuaaaagguuaaguuuucauccugauguuacuccaauguauuuauaguagccauguauauuuauuuuagucauuguugauauuuguuuaucacagcaccaagggaccaguuauuaagauauuugaaagcugaccaaacauuccagaugucaguuuugccuuuugugugugugugugugauggggguggaaugggaaauaauagagaauuuuuauuuuaacaagauaaugugccagggaagaggaacaaguggcuuuuuuuggccaauaagaagacaaagucauauugcaguuuuucauccagcuuagaucugaaaagaaauccuagaaauuacugaaucgaagaaaacccccccuuuuuuugagacaggaucuguuugugucacccacauuggaguauaguggcgugaacauagcucacugcagccucaaauuccuggacucaaggagguccuccugccucagccucccaaguagcugggacuacagacaugcgcuaucauacccaacuaguuuauuuuuuuuuuuuuguagagauagggucuugcuauguaacccaggcuggucccaaacucuuggccucaagugaccucucccccgcccaccuuggccucccaaagcacuacaauuacaggcuugagccacuguuccuggccccauuuuuuccaaauaagauuucaugcagaauucccaucuaugaaacagauaaauauuuuuaucaauauagaugucuauuuuaacuuuguuuuuuacaagucugucagugagagcaccaguuaauacauuggggucuuaaaggucuuaaaaguugguauguagcacaugugagugaaccuuuuaaauuuuuugaugaauauauacuuuaauaaaugaagaagccccugaggcccacaaauaguacauauuugaacaacacuaaucuagcccuauccauucauaccauagauagggaguuugaaacuaaucuguagaaccucauucuaccacuacauuuuacuuugugaugugguacuauuaauaaaucugaacuuggcccacuaucucagcacuuugagguuuuaagggugucuccagcuuaagcaucaauaaacauuucuagaccaucuuaaaguuccaguggaauccaaggguaugacuuacaaaccuugauuuuuauguuauuguuucuucugguuugaaauuuauauuuaaauuuucauugagguauugauacaugcuuacauguaagagagggcaaauucaaucuuuuuuugacauuagguuaaccuagaaauaaugacauuaaggaaaccuuuuguagggaggacaguaaacaguccucagucccagugaggaccccauggccaauauuuggauauuucaacaucugcaguauugaagccagccgugucuccucagauggaaauugccaugugcagaaugacuugauagaaaaugguguacauucuauauaaucuucuaacagcagaaugcgaccaguggcacuuccccuaaaaaaaauaaauuacccgaaauuugcagcacauucauauucaauuucaucacagcagaugcucauuaguauguuguuauuaauugguauucacuuuagguuuuguuuaaaaugaagauaauaauuagguuuuaauuacugcaucauucguggggguggggguugucuguggggagagggaaagagugaaaugccucuuaaagcacuaaaauauuuccugaugcuuauucagcaacguguguugccaaagacuuugaaaaauaacuucaucuuuacaaaaaaaggauucugaaaugaagaaauuacuguguguuuuuuaagcccaucguuaucaagaacuugcuguaaauugucuacuugauggacauacugaaucagaugauaaugugcaccaccauucuuucuaaucaaauuaccaaaaagacuucuuggaaaaguaacccucacaagcggcugauuaaugaagugguggcaauguuuuguauuagaacuaauugaaguaauccaaauaaguuauuucuguagccuauggaaauaauuuccuuugcaaagaaguacaguggaguuggcaaaccaguauuuuuuuuucacccucuguuguuccacauuugcaaaauagcuaaguuaacauagauauugcaaauaaaauagauagaaaacuaaguaauugaguggcagggaaaacaggaaaguuuauuucaaccuuuucauaaucaagacgaauaauuuaccuaaagccuaaagguguauggaaauugagcgauacuggaauucgaaggcauaucuuuaguaaaaugcuguagaaauagcaguuuuuaaugcauucauuuaaaagagacacucauguucaagaguuuagacauguuccuuagacaaaacuuucuggagaaccuguggcuggcauggcauuguguuuggugcacaaaucaaacccuccagaagcuuaucgucuaauugggaaacguauaggaucuaucacauauccacuguguacuucguagcagucauggugcucggugcuuuuuguaugguaucuuguuauuuuaacaacauuccugagacacguuagucuuguuuuacagauggagaaauugaggugugaauauguuaagcaguuugucaaaggucacccaagccuuuagugguagaacuacauuucaagccagauucagucugaccccaaagccuauggucuuucugcuauuccagucuuccauggggauauacacauaggacacauuagaaaucaauucaaaggacuaguguuguaucauuaagcaauaugcaugugguccccgcccucagcagcucacauccuaggaggcucaaggggugauaaaaccagugaggacuaccuggggugggagcuguaggucagaggguguagugagccauguggucacaggauaggcaacuaugucugucagguggaaagugaacagacagaauuauggaggcacaaacggcuucccgaagaugaugaugacuguggggucugaugagguggauaggaacugacuggaucuuuaaucaagaccagaaggauagaccugaaagggguggaauugcuuggguaaggguguggaggaaggaaggauacauuuccugacuguagcaggggauggugauaaggguggcguggguauauggccaggcuggcaguugaggggcauguagaaaacuugugagaguggaccugaaggguuggaacuuuauccuguguguggugagggugcuaguagggauuuuucagcaaagacuauccuaagcuggauuuucauuucuagacauguaccucaugaucucugucagugcuagugagguuuagaguucugaaucugcuauaugguaugauaccuagauuuaacuguaucuucaccauuugcaaaguaaugcaguuuaauacaccuucauuauauuuuacaguuauagcgagugcuggauuaucuaugcuucuacuagaacgugguguuuggggguacguuuuggguuuuuuggcagcugauuuuccuucaugauuugauauuuuucaggcuucaccaaaaugaauuuuacaucaaugagaauguaccaguugaugaugcaaggaggcaggccuugcaucuucuggguuguaugagggugauaacuugagauuaagauuuugcuguggauaaucucuaaggucaugagcccaacucuucauaccucaaggaauuuaauucagggacaaguuguguuaugagaugacuuuagcuaauuucugcugucccuacaaaugagagagaaaagacugguuauguucccaugcaaauaucuuagaaauauaaaguaaaagacugucuugucaaaccaguucaaaagaaagucagaugaaaucgauaccucagaaaacaguuuggcaguaccuacuaaagcugaacauuugcaugcccuaugacucagcauuuccccuccuccaaacuguaaucaacagaaaaugauacauauuaauaugugcuucaaagacauguacaggaauauucacaguagcaucauuccguuuguuuguuuguuuguuuguuuguuuugagauggagucuugcucuguugcccaggcuggagugcaguggcaugagugagcucagcucacuacaacguccaccuccuggguucaagcguuucugcugccuccggaguagcugggacucacaacaaugagaagaaaugcgugacugcuacacaggacaacauagaugaaucucacaaacacaauauugagaaaaagaaggcugggugugauggcugaggaguucgagaccagccugagcaauauagcaagaccucaucucuacuaaaaguuuuuuuuuuuuuuuaguuagcugggugugguggcacgcgccuguggugccagcuacaugggaggcuuaggugggaggauugcuugagcccaggaguucaaggcugcaaugagcuaugauugcgccacugcauuccagcaugggcaacagagugagacccugucucacaauaaauaaaauaaaaauagaaagaaaccaaauagaaaagaacacaaacuguacgacugcaugcacauaaaguuuaaaggcaaaucuauuguuagcuuuaaggggaagauggggaauaauuaggggaauaaggggggccucugggauacuaaaaauguuguuucuugcucugcguacugaucacagagauguguucauuuugugcaucaagccguacaccuaguauuuguguacuucuuguguuuuuauuauaauucaguaaaaauuuaggaccaaaaaaaugcaagucagcuuuaacacugcccuguauuuuauguaacagaaaauauauccuauccuaaucuugaaauaacuugcuuaaacaagcaagcaucuuccucagaaaugauucucaugaaaacuucucagccuauuuuggauaacauaaauuccuugaucuugagccagauuagaaggaucagagucuaugguucuaaaaguauccccgauacagguaguguguagcacagcaguucucaucucagacugcccacuagaacuaccuggcagcccuuuaaaaugcucauauccagcacuccacucuauacucucauuuaguuguucuggggcugaggucugaucaucaguacuuuuuuuuuuuuugagauggagccucacucuuuugcccaggcuggagugccguggcgugaucucggcucacugcaaccuccaccucccagguucaagugauucucccaccucagcgucccaaguagcugggacuacagccaugcgccaccacacccagcuaauuuuuguauuuuuuuuuuuaguagagacgggguuucaccauauuggccaggcuggucucgaacuccugaccucaagugaucugcccuccuaugccucccaaagugcugggauuacaggugugagccaccacacccagcuaucaguacuuuuuuuaaagcucuuggggugacugguuugcagccagguaagggaccacugauauaggaccucaucagaaaucucaggagagagacuggauaauauugauaaauggauucaggacuauguuuuggucauaaaguacuuugacuuggagaaagaaugaaguuugcguuguuucuaauauaaucugauuacaggauucaaaaagaacacauaaaaaacggugguauuaaagcauuuuccuuuucccuucauuucuucaacaauauuugccaagucguccccugugccagguaucaaaacagaguucuuuccuuaccccuguguguauauggaccuaugagugcacccguggcccacccuuauuacucugguaacacuccaaguaacuaacuugaaugcagagcgugauacauacaguagcuauuucagcucaguauuguccuuaccaaaucacagucggccacuuugguacaugauguucuaacuauaaaggaagacugaaagaagccuaggcacuguguugagugcaauuuucaaggaaagagcaagaaaucgaacauuuuaaaccaauaagugaaagcuggagagagaaagaaauguuaaaauaucaucuuauuuucuugaaguauuuuccauccaaucuuguacagucaaaaugagcauuuaagugugaggaaaaaaacgcugaagaucucagauaagacuagagagugucagguuucuugauuagaagaauuuaucaucaaaggcaaaagagaaaagaugguaaagauuuuuuaaaaaacaaaaaaucuccaagggaucacaaauuaguggugcaaaaucaagacaacaaaaguagguguuauucuuguucauuuaaacuauaguuuucucuguuucauguguguuuuuuaaaaccacuuaauuguauuugacauugaaaauguaauagggccuuuuguuuucaaccaguuuacuaauugcaaaauaugucaggaaucaaaagggcaggagguguugguauauuuuuuuaaaauauauaacuccuuuuuaauuuuuuccccuauuuuccuuauccauuuaggcagugacuuucaauuagccugccuacuaauaucaggucacuaaacuccguggcugacgcuuuauuccuucauguggguugucacucguuugcuucaguuggcuggcaaagguuguuguauauccauuacuagcaacacagcacuuugcauuucugaauugacaagcagcuauauugacccagcgcuuauuaugggucaacagcugcguuaaccaacggaaggacugaggggcaauuaaaaugaauuggcaaaaauauaucuuccuaauuuacuccaauuuguuauuuaugcuaacauuguauggcuucuauggugacacuaaacagaauggacccaauaauggcaauuaacauaaaaauauaauggcuaaucaaauugacagcaacuguuucucaucaucucgacacacaauacauuaucaaaacaaacuauuaugaaggagguaauuucaguguucuauucaaccugcagcaugugugcagucagggagauguguaccagcaauuacugcugaaucuaaaaaacuaaacaaauaacuuaaucgcugucguccuccuuuuuuuucccccaggaagcaguaaucaggauucgcuaaaaauaacugguguauaauaguauaaugaugaugcauauuguagaauagcuaauaagaaauaaaauaggcuucuagguguauacuuuuuaaaguagguucagguaaagaaagagagacuuguggaaggaaugcgcccacaaaaaagacaauagcccugaccgauaaauugcuccauguggguuuguuccugcuaccgaauauuuauagauaccauuuguaauggccaaagaaguauaaaauacacuaaauuuaguaacacauuuuauaagggaaugagcagaaaggugaagugugagcucuaauaacugaauuuuaguuacuccugcaccaaauuggguuggcuauaauuuuucaucauuaagacccagcuaggauccuuggaucuaauacuugguuacucaaagagauucccuuugaaaauagugcuauuuccauauccaguuguagauagugguuuuccuuaauuucuuauuuacaugauagucugugugugccaccuggccuugcugcauggauuguacaaaugacuuggcuguuguggucauucauaaauucauucauucaaccaacuuggcacacaguggguguucaguguugguuaaauuacaugucauuccaaggcagcaagggagaaacugguaacauguuugucauuugaucuucucauuugaaaaguucugagggcuuaguuguuucaccuugguaggaccccucaaagaaaacaccaaagcuugagcucauuguuccccagcucgcaaguuucccaagugucuaaccccuugggaagauggaaagaaaguuuguaggucaguugauuuaaaauagauagaagugcauuugaaugugacuccccaaauaauucucauauugguuauugaauugacugcauguauuuuuuucccacacagagugagacacaguugcuuagaauacacagugacucuaaauaaccucaggaauguuuaguauauguuugcugagugaauaguaguucagacacgucuccuacacuuuguugaauuggaacuuggcaaggucauuaaacgaguguuuugacaugggugggaugaaaagccuugguuauuucauuucacaugguacuucucagagaucauacguugcccacuuaggauuaccacagagcaaauagucaagauguuacugugagucugugagccaauccuggcacaggcaauggauugucaccacaaaucauaaaacggggcucaugguauagcaauauguauuaaacaguuuucagaauuuguuuaacuuccugcuagcauggacagggcccaguuaggaagcacauagcacuuuucccaauuaacagugcaaauugucaugagugcauaggaauuugcaguuugacaaaaucagguuuuugacagcagggguaaucagucugcagcuucgcaaguaguaaucuaugaucgaaguggcaggauuuauucugaauuaugaaagguguauaugcuauauaagagggacaaaccauuaguaugauucugcccuucuuacccacuuucuuuaaaaaaugcugcuugauuuggaaguugaaaguaggggauacacucugcugagagugauccccaucgcuucccccuccccaguaguaguauucauuuauuuucuguuauauuacaguauucugacaagucccuguacacccagcugugcuuuuaccgguacauuuuugaugcggagugugcacuggagaaacuuacuaccgaucaugagaaagguacguuaaaauacuguaauuaccuuugaguuuaaaguggaaauuugcauuauaaaagccagaccuacugugucaggcuguucaugcagcaucacauugcugucucagaagcaggccgugggggccuaugugaacacagggauccccugcaugaggggcgguggcauaggaauccccagcuuuggcccccacagccuguuucacauuguccucuauuaaagcaaggcuuugggggaggaacaguacaaaaaggacucuuuaaaugcuauauuuugaaaaugcuauuuucuacagaguuuaguaacuguaauaaaguaagcauaggcaacgugaucauugggccuacaaaaaccagauauuacugcaaaaaaauagacuuggagugugucucugcuguucgcuaaaagccuggguucguuuugagagagggaugagguggaguuccuuuauugacuccauccuaagagaguauauaggcgccucagcccguaugaucagcuguugcauggaacccucagcacucggcguuuccuuauacaagacuugcgggcacugugggacuuaaugggucugggaaaagcuuuguuacauaacuuaaaguauuugaaaaugucaugacaacugcauguuuguuuuuuuuuucuccuaccugaaaaucacauugacaacuuuucuauuaccugugaaaaauaaaaaaggcagauuuauacauuuuucuuauuaguuaccuacagaguguuuauguuguuugucagcgaguaucaauucaacguuuuguuggucgguacuagggcuggaaacaaccgcaaugacauuaaaaaccuacaacuauugcuagauuuccccgcauaagaauccccaugcugcccuugauuuguucucacuguuuuuaauuccagucauaauugacuuguuuuuccauccacaagauaggcuagaaauuauuuuuuaaaugccuugacuuauuugguuuugcuguccuuggagagagagcauuuuacaacugauggagaagcugguucagauauuaguaucuuaucucuagauguucaacaaggacuugagcuaucuccacagcauauuuuccaugaauuaguaaaauuuauacagagaauaaauuuauucugccuauuaauaacuaaguuuuagaacuuuuauucauggucaaugucuagcccauauauacuuguaauaucauuuacagcuguuuuucuuuuauccccaaggaccuuuccuaaagacaguuaugaguugagaaaauuaaguacugauuaucugaacgcauuaucuguuucuaucaggucuguuaccucuuucugaauaucaguauauuagaaccuguuccucuauuacuucuuuuuuuuuuugagacagagucuugcucuguugcccaggcuggagugcaguggcacggucucagcucacugcagccuccgccuucuggguugaaaugauucuccugccucagccucccaaguagcugggauuauaggcaugugccaccacaccuggccaauuuuuguauuucuaguagagaggggguuucaccuuguuggccaggcuggccucaaaccccugaccucaggugaucugccugccucagccucccaaagugcugggauuacaggcgugagccacugugccuggccagcccauuauuucuuucuaaaucuauccauccuagauuguuuucuauauguuauuugaggggaaagauuccucuucccuauacggcucuaaaauucuuaucugagaggcagaaucagucuuuuaugaucagcaguuuucaaaaggucuggcaacucuuggaggcauguagaggagugaucuggaaagucacuggagauuuagcccauccucuuagaggacacugagaagugcacguuauuacacccacagaaaauaagaggaaauaaguagccgcuuggaagccucuugcuuggcuaaaagggaaaaguauugacaggaucuguacacucagaguuuacuguagucccauuucacaaguuuaaggaucaguacacuuuuuuauuguuuguaucuaauaauauacuacccagcaauucggggcaaaaauggcauugaguuaucgauggguucuuuuauauaucagagggcuaaagaaaauaagacgagaagagaaaaaaauauaugugacugaaggaacuucaugaaauguuccaagagcccuuuuguuuuauuuauugaauuuuaccaauugaaacucuuugaguuuccugcuguuuauuuauuauuccugaauuacaguuugggaaugagugaauuagcugaaauuuacaugcuccaggcauuuucagaucaugcaguaaugcuaagugguauuaggguauucauaaguggugggauauaaaccaaaacuugggggcacacuuaccaagagcagagguuuccuaacacaugacaucugauaagcccucuccuaagagucaccuggggcauauuaaaaacccaaauccauagauccuauguccacagauucuaauucagaagauguuggggguagagcuuaggaagcuauaauuuuuugaaaauucccccagauaauucugccgugcagccaaguuugagaaccccucuccugggcacucuaaagacauaguuggaugguuucuaaauaaaagacaauugaaugcaaggucauaguucauagggaacaaugggggaacaagaauauucuuauaguagagaggagaacaauuauaggggaaaacaccauaaguuuaaaauaguauaacaaauaaaauugacuucucacuuuauaaguuggagugaauucucuuuugauuugcuauucaagggagaccugcuauuaaaaugaguuuaaaaucuaagggaaccggagggcaaauauauuuauucaauuuggaccauggccagaacaccaguagauguuaacaucaaaaguccugugaaaaaugacagucguuauacacaguuauauuauugagaauggagucuaagugucuucugucaacaagugccccguaacuggugugugaaguauuuacuguagacucuccuuuacugucaguaccuagcaacauuuccuucacuaagauuguuuuaccauuuccaucauaaagcccauauuuuaaggguuguaacuggauggugguuuuaauuuuuguuugaaacuuggcaauuugacuuagaaaaacauguacaaauuauuugaaagagguuuauuuuuauggggaaaaguagcucuugucaaagcuuuuucucugcuuugcuuucaaacgagaguuuacagaccauuaguccauaauguggauuaaccccauuugauauuuuuuccuuccuuuaaaaugguaaaggacuguuauucacguuggugaaguguuuacugcauauuugcuguaacugcauuacauuuuuaaaaucuuauuucugugggacuuuggcauuauuauuguaacugcuccagaauguacacagauggcauaauggauucaaaggcgguuuuacaggaacauaggggcaaucuaugaaguaaaaauccauuuccaggauggccgcaugaaauggucccauuuggcugccucaucccguggugccuuggccugaguagggguaagugaacaguucaggggaaaccugaaucaguucaaaucuaaaucuccuuaaaaaugcaggaagaaaaaagucucuuaguuuucucaacugaaccuuuguuguuguuuauucagcaacaguaaaaacaauuuguuuauauauaguuccuauuagguguugagugacauuccucaugucagaggaacaaagguggauggccaacacucccugcccuggaggagcuuagagucuguugaggaaagacagauucagcaacaacuaagugugguauggccugagugucaccaccaauagggugaaauuauuuuggaagcaaagagagggagccacuaacugcuuuuucacuucaguguuugaucuuucuuuaguucuagaaagaaacuuuuuuuucuguuucuguucucauuuaguagaugcuucucuccucauauucugugucagcuauuaauaguaagaugguguauucauuugcuaggacugcuauaacaaaguaccauggaugggguggcuuaacuauauuuccucacauuucuggaggcuagaagucuaagagcaaggugucagcaagguuggucucuccccaacuuuuuuuuugagacggagucucgcucugucacccagacucgaaugcaguggugcgaucuuggcucacugcaaccucugccuccuggguucaagcaauuuuccugccucagccuccugaguagcugggauuacaggugcacgucaccacgcccagcuaauuuuuguauuuuuaguagagaugggguuucaccauguuggucaggugggucucaaacuccugauuucaugauccagucgccucggccucccaaagugcugggauuacaggcaugagccaccacacccggccaggucucuccucaacuucuagggagcuaucuucucccagugucuucccucuguaccuaaucuccucuucuuauacugacacuggucauauuggauugggucccacccuaaugaccucauuuuaacuuaauucuuuaaaggccuuauacaguccauucuaauacaguccacuccagauacagucucauucuaagguacaaaggguuaagacuucaaccuaccuucaguaugaauuuugggggggcacaauucaguccauaacugaugaucuacuugaauuucuuaauaaauuccuuugaacacugccggaauuggaacacuaggauguagaauucuguugaagacagaaauuggaauugcagcauagaggcuagcuaaaagaugacaauuuacccauaggagaaguauccguuggaaagccugacuucccagugggggucucuuuaggccuagauggacuauucuucaggucacccuguuucucacaaagugcuaugggcagccuugagugccccagccuccugagcugcaccugcaaagauugcaguuuucuugcuccucucaaccaggugaaaucccacauucacuuccccucuugagccucauaugcuuucuuuucuuuuuuuuuccuuaaacuuuucagucucuugucaucucuuuucuucugucuuuucuuuaggccuggugguaacaucuguaggcccucuuguuuccuaacaugccacccagaagaacuaggcugccccuuuuaagguacuucauaguuuccuauuguccuuucacguguguaacacgaguucucacaguacuccugugaggcagcaguggauugugcucauuauauugaugaagaaauuaaaguuacuaaaguuccuugacauuugcagauuuaacgcuugucgcuugaacucuuugcaagugauacugaagguagguaacauguuaguguguguuauuuugcugaugccagauuuaaauugaacugaaagaauauccagucacuuaacuaaugagcaagccaagccuacugcuccucacccacacugccacgggguccuguucuguguuccccaucagcuaaguaguuacacucaugaagugcuaauaguuauauuacuuuguggaaaauggucuccaaaacaaagacaacagcuaguacugaaaagggucuuaaaagguaguauuuuuuaagccagaaaauaagaguuuuauagaagaaauuauaugcuuuaguguauaugggaauguggagauuuuggaaagucucaagaugggucccauuucaguguuaaggauuuccgcuauauuuccugaacuguuaaagugaaagcaggaaaguuucaucaugaaaguagcaaagagccccugugguccucucuaagcuaguugacauccuuagaauuuacuugguuaaauccuuaacaaaauauuaaaaagaagacugugucagagagcaccugucugguccuuuucuucuuauugccacuuuuugaagcccacugguuguguucuguuuuuugguuuuuuuuugagacggagucucacucugucgcccaggcuagagugcaguggugugaucuuggcucacuacaagcucugccuccuggguucacgccauucuccugccucagccucccgaguagcugggacuacaggcaucugccaccacgcccggcuaauuuuuuguguuuuuaguagagaugggguuucaccgcguuagucaggauggucuugaucuccugaccuugugauccacccgccucggccucccaaagugcugggauuacaggcgugagccaccgugcccggccugguuguguuauuccaucgaaaaacuguugcugaauuuugagggcaagcuuuuucuguuuuuaauaaguaauaacagguaaagcacacacaaaacaguucgcaucuauucauucuucuuaaaauuauauuuuuuauauuugugcaauuuucuuuagaaaaauagauuuuaagauggguaacuguaaacugcauuuuuaauuucauuuucuuacaaauaaaaaaaugaucugaggguuuuuaaaaauuguuucuuugauuaagggaauuuuuaugguaggaagcucugacuugacaguucagaacauagcugucuguuuauuauaaagaagugauuguagaaauacguaaagaauuuugguaagaaaaaagugguuuauauaaucuugagccucuggggguuguuauuguuagauauuacauagguuuaaucuuuaaugacauauauaaugauaaaauacaaaacuagauaacuuaugauucuaauuugugguguauaugcaagguagaaaaauuaguaaggaacacuagaauuuguuauaguuaucucuagguggauuauagcuuuucuuuuucuuuauaauuuuauauauuuucuacauuauguacucugagcauguacugcucucauaacaugaaaaaaauuauaagcacuaaaauguuauagagaauguuacucaacuugaaguaauuacccaaauaauuucacaauugagggaaaaaauaacauagaaaugaacccaaaccagcuuuuuuucuccguguauuuuuuuccaagucaaaccuaaggccuuguuacuccaagugugaucaguaacccagcagcauaggcaucacguggaagcuuguuagaaaugcacaauaucagacccaccccugaccuacugcaucagcaucugcauuuuaacaagauccucaggugauuccuccgcguguuaaaguuucagaagcacugaucuaagacacucucccuuaauaacuaaagccuacuucuauuuuauucauucauugauuagggccguccuuuugguaaaacuuuaaaacaacaacuaugcaggcuacagaaggacuacccaaguuuuaagguagaauucauaucacaaccuggccuuuugaaauauguuuuuauuaagcuaaaaaugcaguggucugacaagggcuaagagaggggaaaaaagccaaaaagcaugaguucuuccacuuuguuucuucguaacuagaaggaacaagggagaaguaaauuaggauuuucaaaauagcuuucagcuuuuuaagauuaguggcuuauaaaagaaagaacuaaggccgggcacaguggcucacgccuguaaucccagcacuuugggagcacuuuggcagguggaucaccugaggccaggaguuugagaccagccugaucaacauggugaaaccuccgucucuauuaaaaguaaaaaaauuagccaggcaugguggcacgugccuguaaucccagcuacuugggaggcugaggcaggagaaucgcuugaacccuggagguggagguugcagugagccgagaucgcaccauagcacuccagccugggccacagagugagacuccaucucaauaaaaaaagaacuggaguguaguucuacacccacuucguguaagggccacucucuaugugcccagaguaaaguuucacccuaucacuacauucuggaccucauuacaacauugauuuaguaguauuuuauaaagauuucaaggcauucaacuagauucuuuuaauggaaacaagauucuauuucuuaaauuuugcuacugaaaaguuuauuuugaaauuuucuuuuuccuacugucacugacuuuucugugauguuuuuauacucacuacaagaacgagaaaguugguauugucugauggcagcaugcagccugcuaacacugguuuauuuuucucuauggauacugccuguuuuguuuuuguuuuaacuugagauaacuuuacaaugugacagaagagaaacuacauuuuccaagaaauggucacuuuaguugcuuuccccauaaguagaagugucuuggcucuguacauuuucugccaucuucuucaagauagcuaaguuaguauaugaaaguugccauauuuuggagcagccagcuuccagauucuaauuaugugucuuuaagcccauuucuguaaauaugcacucaacguuugcacuuuuauguacaaagagacuuagaggcuuucuaugauaacagauguguuacucguucuauaaaaucauuucgcauuaugucuuuuuagugggcaaguuccuuuccccuuuuauagugacagguacagcaacacaagggcucugccaugucuaggugauaaugugguugauggucugcauuugcaaagcauauugucauuuuuuaguaggaaaaauacuaaagauugauaaguuuuuuuauguacuucuuaaaaauaugcuucuaucaccaaugaugaaaaaaaugaaacaauucgcaagcaguuaagccauaaugugagcuaaucacuuuauuuugaagaaaaguauuuuuaaacaguugagcuagugaauuuacuuuuaaaauguauugugcuuacacaguagaugguuuuauuuccaugauguuuuuuacuacauaauuauacaucuuaauuacguaauuacuaucauaauuauuauguaauugcauguacuuccacuaauuacaaaaucaggaaguguaauuaucuaguaaaaacuuuaugaaauuucaugcacuaaaaguuaguuaaaaggcuauuccaguggucuaguggaaggcuuuccaugguuagucuucuuagucauaacuuuaguuuagagcuggaacucauaggccaggacaaggauaagugccaacagaccaacacuaaacugaguauugugguauggguaagauagacuuugucccuugugauuuaaaaagucagagagcauuuuaauuuuuuugugacuauggagugugguaagaauaauaucuaaauguuugagguagguaccacaaaaacugucaauggaaagggcaguucuuucuuaggaaggaauugauuaauagaaucaacaaggcauuuagguuacacaacagcaaggucuucuauaauucuguaaugugaauggcuuauuuaauagcuaucucugccuuuaaaagcaauaaugauauucaguuuucuguuucuucaguuuggagaagguguuuuuccaguuuguguuuauauuuacuaagauaugagcaaacguaucaagagagcauacuccuuucuacuacuugaugucaaaagcagcuuuugagacauaaacauaagcgcacaaacauguaacaucagacccuaaauaaagacaaaagguuuaauucaauaaagcuaugaugccuuuaccauucaaaacgacauaaaaauugcacagugaaacaauagucaugacagcaaauuagauaugacaucuaaauuacacuacaaagagaaaucccagaaccguuuuuggucuguaggagccuauuuuagcccagguuuagaacccaaucuagaggcucugcuuuauugucuaaguaggguaauguuguagaagacuaauuggacguugguugaauuaauugcacaucaauuaggaggaaagggcuuguaauacucauggcagagaagugaguagauccuuuaaguaucaugauggaauguacuaugaguuucaggaauuaauauuaucaguauuuggguaauaucuguauaaucuauuacaacaugaccuaaaucaagcacuugggguuagauacagguauacuaauuuccuccccaaaauuagugcuucucacuagaaauguauugaaacagccacuuaaaauguaugaguuauuucuuuuaaaaauguagccuuaaacauuaaaagguucagcucaggagaucagauauucguuuuuuucuuaaaacuuucuaacgaaacacucauugugguauuaccaguuauugaauuugugacuuuuuuauacuagcugaaauuuccaauaagugugaauuuuuuuaaaaagucagugaacggugugaaaaugccagucccauuugcuucaggcaaauuauaggauuuauauuuauccagaauuguuucauggucucagagauguuugggauuuaaacagauuuagucugacucugcuauuuuucucuaguaguuagggguuauuuuaaaauugcauauuuuuuuccucuugggaaucuuuucucauuuacuuagcccagaauuuaaugucuuaaucauuucuuauuugccuuaacucuauugugauaacauuucuucucaugguuucagaaguguuuaugcucccucuaugagacagcacugccucucacguuuccucuuaaucuuuuguuuuuguuuuggugguugguauuuuuuauuuuuauuuuuuuuuacuagugcuuguaccaugccagaauagcccuuaaugguuaaaagcaaaguguucacuuaauccucaucuuuucaauuauaauacaaauuucauuuugaagcugacauuuaaacugacauuguuguguuuuguuuugcuuugcuuucuugcuuugcaugugaauuggcauaugucauuauccuauaauucuugauaaauuuuucauaauuaucuaagggaaucaaccguaacuuuugaagucuaauuauguccuugugaugucuccaguaacccuguaggcccaggccaagaacugauguugauuuucacauuauuaaucagugccauuuauuauuuuaugcuguacuaucugguucauauaaugcuacccuucauauacaaagaaaacccaucaucaauuugacucauucuuaaacuaguucuuccuguaguugucaugaauuuauuuagauccaucugcauucucuuaccuuguggcuaacaggacaguaacuagacagacuuaguagcccaucauugaguuaaaucaacacugauuacauucucccuguauaaaggcccugggaaacccuucucuccuuggccugugagcccugcaagcccuagcaccauccccuagagcuuaaggcuuaaacuaguucguagaaagauagauuugcuggcuaauuuuagacacugaugugcuuuucuuguucuaagaaauuauuguaauuucaaauagggucaaaaaagcaggucuguguguaagucuguuacucucuguccccucuucgugcccugaacccuugcccaguuuauucagcaaauauguauugggucucuguccuauaugauauugcuucuagaaguaccaauacuucugaccaauugcuuauucaugcauucaccucuaaauaccuccuuuuuauaggacucuacuuuuguggagaacauucacagccauuaucuuuuacauuuuccagacaauuccauuguauacggauauguaguugacacuucugagaugagaaacaaccccaaaaggaugaaaugacucucccaaaguagcaaagcuuagaaguguuaagagcccggcuuuucuuucugccauaucucagcugcccuguucuuaaucuauuagggaaacuucagccugaagacaaguaacucaaauacaagggaaugguaugaauugcugagggaucucagcauauaccucagggaagguuuccugguggagauuuccugaguugggccuuaaagaguaugugagauuuuaauaggcacagaugcagacauguaguuugagacgaaguuuugccuuucucacuuuucuuuaagugcccuauuuaucuugcuuuuauaaagggagaacuuccuuugacaaaugcaucaugauuugaaagcauaucugaauugaaaauuucgucuaaaagugcuuauuaagaagcaaagcuuuaaacucaggacuauaagcuugaagggcauuauuuuuugagauagggucucgcucugucaccuaggcuggaguucaguggcacgaucucugcucacugcagccucgaccuccugggcucaagugauccucccaucccagucccccgccccuaguagcugagacugcaggugcgugccaccacgcccagcuaauuuuuguauuuuuuuguagagaugggguuucaccauguugcccaggcuggccucaaacuccuggacuccagcaauccacccgccuuagccucccaaagugcugggauuacaggcgugagccacugggcccgcuguccuugaagaguauucucucuucacucuccacucuccacucuccacuguaaccagugguggugcuuugaaagaaauugauccauccuacaggauacaucugucaaaaguguaucaaaauguuuuucuaucuuaaauaauuuaacucagaauauaauaauguaaguauuuugacaugaaaauuuacauacugugauauauccacuuaucuuaaaacagacgucuuuaacuauaaagaaaaggagugugguaagacaaaacaaaauagaaauuggaauuaaaugggaugacugacagaccaaacuaguuuuauuuagacaauaaaaauuaaaguccuguuagcauuaugacgaaaaaaauguaaaaauguuuuacuuaaagcauggcugauuuuuuguuguguuuuguuuuuucacuaacaccauggugaaaguuuaaacauguaagaccuguuuaugaaguaaauguuuacugcugaacuaauucuucaaguuuacugguauauuauauauugccuuaccaaaaaaagucgaugcugaaaagucaguaaaauccacaguaaaagaaagcgucugaacaguagucugucuugggaaauuauucaacagagugcacucuggucucuguuagugaaggcuuuaucacuuuuaacaaauaagccgcaguaaauuuaucaguaugcuacaaagaaauuuucaaaauaauuaagacuaaacuacacuugucaaaauaaaugaaugaaauacaauuuugaaucaucuuucuucacuuauugcucauuugcauaauucaguaacuuacacaggagucuuucagucauuggugugaauuagcaagguucugcuauuccuuguuguacggcaggaauuacccuaccauguaauuagcuauuccagacauggacuaacgggaaauaccaaagggcacagcaaaaucuaaagaggcaaggcagggaaucuaaagacaagagacaaucaaagacacccaacaaacucaagcugguagaccacagggaauuuugaaugaagccucuuaauuuauuuugagaauaagaaaucaguaguaugagagaaaucucaacaagauuagcugacuaagccuacuuaaaaaaaauaucucuauagugcauggugcgccagguuaaccacuccuguuuguuagucuguauacagcucaacaaauaagcggcaaagcuuuucauggguauauaguggcuuuccauugagguuuucacucuuugaaggaggucauuuauaccaaugagaucuguagaugcaaauugcuuucccuauaugugaggggucauuccuuucacagccagcuugcucaucucuuuuauaaagguuuuguuauuuuuguacugcucccaaaggaaugaugagaauuaugcccccccacccccugucuaacuuagcauccaaaucuuuucccuccagcucugugaaacuuuuguguguugaucuuuggaaacaaaacaagcuguuggcagcagccuuuaacucugaaucaggaaacuuuuuuccuucuuucaaccugaaauaucaucucuuuagauuugccuuucucgccuaauucuaaggaaauaucuuuuucauugcagcagagugucacuguaacaugcuacaggcaugugggaauuccuggaagcaguguccucaaaaugccauuuuuaguuuggcucaaaugauguaagcucucacgaacuagaggaauagaaaugaagggaucgauuuaaggguuagcuaugaaaaccuagcuucugaucucauuacugaaguaaagggaaagauaauauuugucuuugccuaggcucuaaggaaucauacaaacauucaacgguucuaguuuguuguguucaggaguuuuaggaaggaggagcuucaggcauaccaugugaaugcucuguaaaauguuuguuguuuuguuccuuccuucugcuagcauuuguugaacaccaagggcauuggccuggguuucucaaaagcaauauaggguagugauuaaaaacucagucucuggagugagagugccaggugcaaauuuugacuuuccaccccuuacuagauaaguaaccuugaaguacaucuauaaaacaggaaaaaaauagcaccuaccucaaaggguucuaaauucagcaggaugacauggaaauaggcuaauauguaaaacgucugggacauuaaacaggcaauacguaaaaugcuuaggacagugccuggcacauaguaagcaugcaguaaaugucaguugguuuuauuacuucugagaauacuuugucuaaacgacuaucuauuauaguacuuaguguuacaacuguauuugaguugguuucugcagccugucauugaccauguuuuguucagauuuguauccucagcaucuagcacaacaccaaacauguagcaaaugcucgauucauuuuuaccaaaugguuacaguaugaaaaaagcauggucccuguucucaaggagcuuaaaauauaucuugauaacuguguuuuaguuuucuuaucuauugaaauagcaucaugucagaaguguauuaaaaagaaaacuuuaguucucagucuuccauacuuaauggaagaaguugaaacacgaauaaucugcaagccagauuucugauugaguaggucuggggugggacccaggcggcaguguauuuaaaaaucuccgcaggugauucugaugcacacccacaguguugggaaucucugaguuagugaaacucuucaaacuuuaauauugcuucuugucaaauaugcauuaaguuugacuuugauauagaaagggagacuggguggcaucuagauaacaauuuaaacagacaguagaaaggaaaaugaagucaaacacaagaauuauuuccuagauaaaggaagcauuuauggugcuguauacgcuaauguagcaucaaagauaaagugaagaaaaauaggcuagggaaaaguaagcaagaaggaacuguuuucugguaaugagcaaacugaagaugaaauaaaugcauuucaacaaaauuggcuauaaagcacauuauuuucccccauuaacuugcgucaugaaugaaggaauagggcugcuggggaggaugggggaucuuucaaggagacuggauagguaacuggggagauauuaagguggaggcuaacccaaacgugguacuuaggagcuucugugguuuggauuucugagaccauucccaccuccuguccucuucuacuuaccuugacacucagcugacuggauccuggguagagcagccuuccgcaacuuuauaauuuugcacguccuccaagcggucuggaacaggaugguaguaguagaggguuuaggaggauauuccuguguccugugcucaucucuuggggugcucaucucuuggggugcucaucuuaccugggguguccaggcaggagaaauagcuugacuggcuauagcuggaguuauaaaauagucucagaucaccccuuuuugccuagaaggauuaggacugcaccuuguugguacccacaaauuagacccuucuucaccagucccugagcaggccuugacuccacuauggccacauccuuuggcuggugugguuucccugccuggguuagccaaccucaacccagucucuguucauauucuauucauacuuuaaggccucccagccauaagugaucucuuuguccucuaaacuccuguaguucuuaagcacugucccucuuacauuauaauuauuugaggacagggaucaugcuugauacauuauuuuaugucugauggcaacuugcucaugauaggagccuaauaaaugguauguuaaauuaauguuuucuguaauagagcacuuucugacuccauccucuuuucucugcuauuuauuuccuauuauguccuucaacugugucauaaaaaauuuucuauccauguauguauacauucaucaaacauuuagcccauaccaucuccucauuccacauggacuuaauuucccaccuuaaucugucuacuuucugacaauuacuaauagaguugggcugugauaucauguaucuccagaagauuacauaaauuccagccuagaaauuucuuuguuuaaaccuuuagguuauauaaaucaaacugaugcucagucauauuagugggauuaaguuugaaagucuaaaaucauacuucaaaugaggacugucucaacccaggcacacuccuugcccuccagaauuuauauacauuugauagcagcugguuguuuucccugcagauucuuuuuuuuuuuuuuuuuuuuuuuuuuuuuuuuuuuuuuugagacagagucucacucuguugcccaggcuagagugcauuggcgcaaucacggcucacugcagccuugacuccccagguucaggugacccucccacuuaagccucccaaguagcugugacuacaggcaugugccaccaugccuggcuaauuuuuuguauuuuuuuuuuagagacaagguuuugccauguugcucaaguuggucugcaacuccugaacugaagagauccgccugccuuggccucccaaaguguugggauuacaggcaggagccaccgcauccagccaccugcagauuuuucuagugauucacaguuuuagcucucugcuccagauguguuauuugguuggcuagccuuuaauauaucuugaaaugucuggaggccaacuccagaaagcucucgugaaggugggaaggugaagaaccgcuaagagacuuucagacugguuuucucuuaucacccaugugacuuucaguugagcagcaugcaggcacacguauuaauggcaauguagguuuguaaacaauacuacuaauaggcuggggcugggggagaaaaauagcccacaagaaaucuggagauaccugucuugaguguaaccugcaagauauacucuaacagaguaaucauugcacgauaucauugugggagacugagcgaguuagaaaaucuauuccugguuugucgcugacucacuuuguggcaugggcaaaccauuauuacucuuugauuuaguuguuuuauuuguucgaaaaagggaaaauaacauguguuuaaaaagcacucugaaauuccucugaaaggaggucuauaagugcaaaguacuauuguuguuuuuauuauuauuauuaguguucuaguaugguuuaguuuuaugccauguaggucacagauguuucaauucuuccgacugaugaauuacaaaacacuuccaucucauucuguuuuauagcguugauaacaguuuagcacaucuuuguuuuaaccccaguuaaaguauauguccaaaauagaccucauuaauaaaauacaauuacuaaauuaaauauaucuaugcuacuuucuguuuuuuuuuuuccuccuuaaaaaggugguuaccaacaacuacuaaauaagaccuuuaauuacugccaaucuucucuugaaaguagcagugcuuaucuugaguaguuugaacuguaagugguauucaguacacagugggguuguaaugcgauuaugaaguguagcaaguuagugauaaauaagcgugauaaaccauauauuuguauuagaaauaauauuugaauuaucaacugaauaaaaaggcugcaacugcugauuccuuugggugggcaugugauaaaaauaaaauacaguuaaguauacuuggaauaaaaaauuguguaugcuucaauauaauagaaaccuuuuaaauugaauguguuuuugaguuuauagcauuuaaauuacugggagaauuaaaagauuugcuuugcuuucugacauuaagcuuuucaaauuagaauuuuaaaaaacauuucuaacucauucaucaguagaagacuuuggcuuuuauauaagauacuauaguucucccccauauuuucagugauuuuccaauggaguagcaauaaaaaaacuuuaauuacaguaaaacuugcauauaaaaucaugcaagaaggaauaauaucauuuucuugccuuuuuuuccuuuucaauauuuuaguaaucauagaaauaauuucuuaauacuggagaaugguaauuuauauaaaauaaguaauacugugacucuuauuuauauuucacaugaaaugagcaguaaauugugugcauuuauuuguaaguguccuaagacaugggaccacaugggaagaaguauagcugccauagcgucuuagaaaccagaggucgcauaguagcagccacaaacugcgcaugaccuuuaaauguguuuaauuugccugaagaacaccucaaauuucuaaaugguugcuaauauuuuuuaguguggggaguuccuauaaagagccaaauuucuggcauuuuuaaauaaaaucaauauguggcuacaguaggucaacauuccugaauggccacaauugacugaagcugaguagcagcuaagcaguuuggacagaauauggguucuccaguuugccauagccucacugcagcccacuucacucauuucuguuauucaugugguuacuauaagcauuuguuugcuaaaaaauaucuugaggcauguuuuuuuuuuccucuuuuuuuaaccagcccccucccuucccaauaaaaaaagaaaaagaagccaugaaacuuggggguuuaaacaguaaaaaaaaaaaaaaaaaauccagcagacauaaguguguuuauuaaaguaaaucauauaaaaauauaacuuacuagcuaaccuguuuauggcacuguauauuuuucuuuucuuuuucuuuuuuucucuuuuuuuuucuuuuuuuuuuuuaagacagagucucgcucuuuugccuaagcuggagugcaauggugcgaucucggcucacugcaaccuccaccucccggguucaagcgauucuccugccucagccucccuaguagcugggauuacagguacacgccaccacacccagcuaauuuuguauuuuuaguugagacgggggaucaccauguuggccaggcuggucuccaacuccugaccuugugauccgcccaccucggccucccaaagugcugggauuacaggugugagccaccacgcccagcuacuguauacuuuucaaagcacuuucacguguccuuuguccucuuauccucacagcaucucugggaguaggauaacaauuacauauucauuuuaccaaugagaaaagcaaguuuugguggacaccauuaauuuauccagauuugcaacugcuacguguuggagcugagcuauaacucaucuucagauuguucaucuagaguaacacuguccaccggaacucuuugcaaugguagaaguguucuguaucugugcuguccagugcuguagccucuagccccacauguagcuguugaacacuugaauguagcuagugcgacugaggaacugaauuuuccauuuuacuuaguuuuaauuaauuuaaauggaaauagugacaugugacuaguggcuaccuuauugggcaacacaggacuccagaguucuuuuccuccuucauugcaugguaucuuuauuuaacagucuuauucuuuucaauaaaguucaucaaaagauuucuguuagguuuucuguaguuacccaaguggcaaacaucuguuccaccaguaguucaacauauuaaaauauugaauauuuucuguaucugcuuagauugccuuccauaaagauuuugaaucauacacagguagcauucuuuguaacaaagucaggggacccaguauuaaaguucuuaauguauauuaucucccaagauuccuaguucagauaaagggcauaauuagagguguguuuaagcaucagaaacauguagaugacuaagaccaucuccuucccugguguuuuuuauuuucuaagauacuagcagcuguuacagagucauguaggaaacuuaacauucucugauaauugauuggcugguguaaguuggaacagagugacuuuuagaaagaugaccauuagcuaaacucuaucagcguuuaucauuaaauccaaaaugacauuaacuuaagacauguuccaauuucagagauguuauaacauaggagaggagauuuaucuuaaaauuggugaaauaugguuugucagugggcuucaucuacauuuggucagcuuauaaccagggacagcauugagauguaaaugucaacuucuguuuugcccugugauuaauuaaacccuucaucuucaccaaaacagguccccaccccacccccgcccccauugcucucugcacuuuggcuguccccuuccucacuaccuuauccugauuacaauuaauuaacagaaauccuggugauuaggaguaggcuuaagcucuugcucaguaacaguuugaucacuauacagauacucacuuucuuuaaacaccucccuacccccccccccccccaccaaaugcagacgaggauauuuuauuauaaauaauacuggaacaagcuuaaccaucaccuucuagcacacaggcaacucugcagcacucuuuuuuagaauaccacaugcuguaauucaaauuaucacauuagcuauccaaacacaccauuuguuuuuaaauacugguguguuuaccugaauauuuccccuuuucaucuucccgccccacuucaccaguacauugucacugcagugacagguuuauuuaugugccuuaauauccccauuucuuguuauuuuaaaaauguauuucugugucccuauaagggucuucuugaacaucuuaaaauauuaguuauuauguaaauucaugucuuuucuuuuccauuaugcccuuugaaucuugccuuuauucagacuucaaaauauuuaagcacuucuaaacuccuguauuacauuuuuaauaccaaucuuucucuggaaacugagaaugccuucugaaaccuuaacagccaucaaaagaaauguggggauuugaaucuauuaaaauagaagaguuucuuguccacaauggagucugacacccuaacaguuaccauuuuggacacugcuguguaaagguuccaaauacaagccauucagaguuuccacucgcaugcaaaacucaugcacgaguuaggggguaucauuuauuaggugguaacgaggaguccugagugcuuugguaaauguguugguuuguaccauauaaaauugcugacauuagaccauuuuuuuguguacaaaauguggcaacuucacaugggguccacccugauacuauaggugcagaccaguccagcucauauaaauugccuucucuauuuuugcuguuuucccuuauuuuuccucaauuaguaauuuuacucccauaaccuucucuuugcugccauccuuuuguauuucucaguuaauaguauuuucucuagugcccuucccuucuuaacuaauuccccaaaucuguuagcugcagaauuaguagcacaaagaaggcugguugcauaguauguaccuccaugaugcaaucaguacuuaccacuucaaguguuugaccuguuuugagguuuucauuauccugaaaggguagugucucgaauacauuuacugcccaauaaauaagccagcauaguuccuuacugcucaaaugaaaaaagcagaagggaaaaaaaaagcuacuuuuuuguucagugcugauagaagccuugcuaugugaugucuuuguuaugacauggcucagcuaaagcaucucuggagaauaaaauuaauaaguacccuuuguuauauuugccuuuguuuaacugaauauaaauuaauaaaugcaguuuuuuaguaguuuguugucuuuggaucuuugucucaagaaagaaaugagauauguuguauuuuauaauuagaagugauagagacaucagccaucacuuaaaaguuggaaaaaaaauucuagaaaucauaccauuuuuauuucuguccauuuguauuuguaaucuccuaguuuccagggugauguggugauacagugagugcugauucauucauauuuuuguuauuugguugccauuuuuaaagagaaugucaguaguugguagugauagguaaauaagaauaaaauaaacaucaaauccuuuacugaugaacuguucuuuacauguagucaugcuaaucuucacaauaaucugcugaauggaugcucuuauccccauuuuacagauauaaaacagguaaacuuauuuucuaggacaguaaauucuaucuagugcagacacgcauuugaaacuuagggccagcagacuccaaagauguuagccccucccgcccuuccucagugucagacauccuagcuauugaaaaagaaaucguuaaacaucuguguuacuuuagugccucuuuauggugucuauuauuguucuauguuauaaguuuguuuuuagcuuuuuguuguuguuguuuaccaugcaucaggcauaaacaagguaucuguucucauggcacauucuacagaagaguaaagagcaagaucauuucagauaguaacaaccccuacagagacaauaaaauggggugguuugauagaaguggauaggaaguucuuucuaagaagcugguguuuaagcugagaccugaaugacaagagggaggaaauucuggaagcagaacguucuacaccaggggaacaaccagaggaaaaagucugaagcuggagcaucuuaggacaguuaggaggcagguguggcuggaggacaggcaacgaagggaaaguaacagaagaucaaguuggacaaauaggcaggggcuagaucuugaaagaagggcuuugguaaggagugugguauuuccacugugggagcuuuuggaaggucccccuccaccaaaugugcaccugcuggaagcacucuguguauuuucucuagaaauuauguacggaggucuagaggaaaaugcuaaagccuuaaaaauuacauauuaauuagggagauucugaagagcaucacaacuuucaaaggugacugggauaaugcagucuuauucccauaucagcauguuguuucuugugugcucugcuaagcagcugcuagaguccuaaagaccucuaguaugacagugaguacauuugugaguuguguugccccaaauuauaguagggauggggauaaagaaauauguuuguauacaaauucuugcuagauacuaauaaccagugcuggagaaccuuccacauuaguuccaggaagugcacuguaaagaccuguugguuuuaguuuucucuugguacauuugaaauaugucacuggcuuuuaaaauuaaauaugcuuuuuaugcuuuuaaguauugucucuuuugaacuuuugagugugaggguugaauuuuuagugagaaaagaauuuuguuuggauuuguuuuuaauuaguauuuuuuaaaaaauauguuaagggcuucugguggugguggaaaauauuaauuccuuuaaaaaucuggcuguguugcuagauccacauuugcuuuucuguguuuuugugaacaacugaucaaauuagauucgucacucuuggcuuacggugauuugaaauugaaauggaauauauuaaagcagccaaccacacugauuacauugcaagccucauuuaauuucauacauucacacuuuacagugaaaggcagcuuuuuuaaugcaugauugugacuguaccuugagcaacuccaaaggucaucuguaaugggugcauaauuuguuaguguuagauaucugauuuaugguagguguuucucagccugauuuguacuaguaguaaauauggugagcaucaaaguaaaaucuguaagaaguuuagccugucacauuuggugguauugucuuauucuucacuggucaguggaccacaguaaaucauggacuagcugucauccuuaaaucgagaaagugccaguacugagccccuguagcacagggguuaaaugagcuauucuuuuuaagagggcaggcuggcccaggugaagguuauaacaguauuaccagcucaucuaacaguacuuguucacagcuacuugagcccuagucccaagaaggcuauaaaaggacuuucaguuucauaggagcauggacauuugugagcuugcucuuuuuuccuugguuuucuguagcagcgaagucuaccaacuucauuuccuuugugucuucugugugacaggcacuguggggcagcccucagagauccagagcagaauuugcuuuuuguuuguuuuuuguuuguuuguuuuugguuuuuuucucuuuguuuuugguuuuuuuuuuuuucuucucuuuuuuuuugagacagucucacucguuugccuaggcuggagugcaguggcgcaagcacugcucacugcagcuucaaucuccugggcucuagcagucuuccugccucagccuccugaguagcugggaucacagguguguacugccacccgcccacccccaccagcuaauucuuuuaaauuauuuuuuguagagacugggucuugccauguuucccaggcugaccucaaacuccugggcucaagcaguccucucaccuuggccuccuaauguguugggauuacaggugugagccaccacaccagcccagagcaggauuaagacacaguuucugcccucaagaagaagacaguuggauauggccauuuguuccacugugugguuuuaaaugacaugaaauggcuuuaaccccuucagugacucaggaacacaauuugcauuaggcaguccccauuguucauagcuuuaucacacaugggguggguuaguacagugcucacggagaauaagacugacauggacuugaugagaacuuucagcuacuuugagaauccagcugcagaguugccuuugauuuugguugugacgguggagacauguuuacuuugaucuucuguugcagucuaggguuuguucagagauguguagauuuguuuuuguuggcuuucaucaaccaguuuguuauauuguaguuuucaauaacaagagacaccuaaaaccauuuuuuaaagcuuuauuauugaaauuccugaaugggaaaaaaguaagacaguuauucuaccuaacuccucucuucucuaucggaggaauuacuuuuaauaacuuuaaaauauauaggccaagucugguggcucaugccuuuaaucccagcccacccucccuucagcugacgcagaagagucauuugaggccaggaguuauagaccagucugggcagcauagugagaccccaccucuuaaaaaaaauuagcugagcaugguggcacaugccuaucuauagucuuugcuacuugggaggcugagaggcaagaggaucacuugagcucaggaguugaagauuguagugaguuaugaucgugccacuguacuguagccugggugacaaagcaagacccugucuuuaaaaaaaucaacaaauuauauauacacauguauuuauauauauauuauauguuuauauauauuuauauauauaaaacccaaaauucccuaggaagguaacuucauuguuagaaacaaaauagacuuuauagauuaguguaggggaaaaaccgaaaguugaaggaccauuuaaaaagggcagcauucccaaucuguucuauguaauucuagugucauuaguauucccgggguaacaaagacucccugaccaaagaaguuuagaaaaugcuacauucuauaucccccgccccuuuguuguuuucaauguauauuagcauauuuaaggcucagagguguccuacaauagaaauuuguuuaauuuuguuuuaagccagcucucuccauauuuauguagaugcagggcauaguuuagaaaacgcuagaauagaauuuuggcaaucauucauucucuuuuaccuuugcuuaauaaauaguuaauaaaaauucaagacucuacuaucuccugaacuaacuuaaacaauauuuuugaauaccuguuacauaccuacaaaaggccaaaaaaaguaugaaacuaagaaaauaggcaguaaaagaauggaaggaggagagaagcaaguagcagccaugaacuaaaauuaauaguacugaugaguuuguggauaaagaagagagcugaugaugaaaagaccagauugggauggggguggacagacaggaccugcauaugagucaucaccuguggguauugccagcucccagaccucaggacuuguggacaccagcaugccacacagaaggcuguuggcuggaaugguucaagauuuuaguaguguguuauggccaccuagugcaggguucacaaacucaaaugccuuuaggaccaugaugaauuauacaugcuguuuucauacagaaaacaugagcucuguuuugccagauguucucauuuuucaaggagaggaagaaacacagaugguccuguggaauugucugauguuugaacacuggcuguaguuuuuguauugcuuuguuaaccaaaacuggggaauacugggugaggacauggaaacucucuugcauuugcugaugggaguaaguugguagaagaaauguggcaguaucuaguaaaguugaagcugugcaaacauaagacccagcaauuccauuucuagguguaugcccuagagacagacaccacccccaacccccauguaccacgcucaaggugauguuuauggaugaauauccgcacugucuauaauagucuccuagguaaguaagugacagauagagaaguacauauaaaaugauuuauauaaauuuuaaaaacaacauuaaaauaguaucuauguguuguuugugcuuauacaaauauauaguaaaaguauaauaugcagguagaaaagagauacagcaaauucagaauuguugccuguaggaaauggggguagacaagcuauguacacuaggaagccauugaagauuuuaagcagagaaggggcauggcaggaucugaucuguucuugaaggucacucuggcugcugcaucauaggggaacaagaggagacgcgaggaaaguaguuggaagauuuuagucaugguaguccugcgucuuggugggagagagguggcuugaauuccaaauauaguggagauuuucucaaccuuggcacuguugacauuuugagcuaggugauucuuuguuguggaggcucuccugucucaccccacgacugagaaccucuagccucagcuguauauugggagguuaagaguaaaaauuucuaauccauuuuuaagaggaagagaucagauggagcuugaguuagugggaaaagaaugaguggaggaggcgagacuugaggugaucuuugcgagaauggaacagacacagucauuccagagacacuaagcauugacuauuuuaaaacuuaacaaaagcuuuucuuuaaucuuauauuucccugcucccacuucuccuuuguaagauucuuguaagagagcuguauauaggcucuucacuucucuagcauuuaguucacucaacagcucuauugcucacagcaggguccuuagugacuuccuaguuacgaaacccaauggaaucuuuccaauccaucuaccauugaccucuccaccccauuuguuuuccauuuuuaaaaugauuuccucuuacauaaucaaaagugcagaucacaauguauguugagauguuaaucuauauguucauauaguuugaaaaauuguacguccuuuguaucauagaauauuggacagccauuacaauguguauuauuauccauguucuguaaaagugaauuguauguauuaagaaaagcagguuucaguuccguguaguuaauauacucuccccuguaguaacacacacacacauauauucaugaacaucaguuuagaaaaagacuggcaggaaaugcacugagaugccagcagucauuuuccugacaguguguuacuuuuauaauugaggcagggggcagcguacugaaaacauugguuuaucgaguuuccccucuguugucuucugucugugugcauucuccauggaugaucucaucuguacccuacacaccaaggacuccaagucuaacucgacugaucgaguccucuuucagacugacuuuuggacucgcauaccuauugaucuccuagauagauccacugagaugucugucccaugaacaucugucaaaaucaacauguccagaagugaagucauuguauuccuuguuccccacuagcuguuucuuuuacccucccuuucccagucacaggcacuccauaccuauccugucauccaagccagaaacaauccuauagacucuucucucccauucccuccacauccaguccauguccaagauuuguggccaggcacgguggcucacaccuguaaucccagcaauuugggaggccacagugggcggaucacgaggucaggaguucaagaccagccuggcuaacauggugaaaccccgucucugcuaaaaauacaaaaauuggcugggcauggugguacacgccuguaaucgcagcuacucaggaggcugaggcaugagaaucacuugaacccaggauguggagguugcagugagccaagagcgcaccacugcaccccagccugggugacagagcaagacuccaucucaaaaaaaaaaaaaaaggaucuguaagcugguucuaccucuaaguacauccugcggcucucuccuucuaccauuuucacuugcugccaccguaguucaggugguccucucaacaggauuccuagacaagucuuacugguuuuucuacuucuagaccugcucugucuguugcaguagccacuagccacgugugccuauugaacacuugaaacgugccuaguuuaaauugagaugcgucauaaguaucagauauaccucauuaauauucauacacugauuacaugcugaaaggauaauauuuuagauguacuggauuaaaugaaacauuaagauuuaccuguuuuauuuuagggguuuuaaaaauguggcuacuagaacauugaauguucucagaauggcauauauggcuuacauuauauuauuauauuucuacugggccgcacugugucuaagcagucauccccccuuugauuuauccuccacgcugcugucagaauuaucuugcugaaaaacaaagucccugagcuaaaaauucuuugaagucuuuugggauaaaguuuaagauuagcuuaacacaccaugccuucccuaaaggcauucaguuucaaaaacuuuugaaacacugugcuguccacaguguccgguuagauucagcugguagguugccagcuuccaacuccugaucuaaggacugucugucaucucuguggcaccucuacccucaaauauuucaauaguuguuagacaauugaugcacuauaaauagauugaaguagaguugagcauaugagaaaguacccuguaucaauucuacauucaugcuaaauaaaaaguuuuauacagacccuuaagggacagcuacauuccuaauacucuguugaaaguuauccacugagcugcgcaccucuuccuaguaggccauauguguuagugggcacucugaggagauugaaguggcuucgaggacccagcccccacuaagagcugacggcgagugaaccaacugggaaaagaaaccuucauguguugacaguaucagaaagauucgauggaaagcuacuaaauuugaaaaaucgauccuuauaagauaaucuuucuuuuggaguggggggauuacaaacaggaggauguuagauaaaauggcaaaauguuuaaaaagcucaacucauaggaggauguuggauacaaugacccuccagaaaaggaguucugaaauacuaaauaaacuuaaaacagcuguaucguaacaauauuuugacucuccaaaauauguuuuauuuguccauaaguaugugucuaggauggcugacaaacuuagagaaccauaucugagguauuuaucagugaggacauucacuagguuguauccuaaccagcacaauuugauacguauguaaugccagaauagccaugaacaaggcagaacuaaaguuauuuucagauacugaaauacuguuuuuacuuuggcucugcuguugaaccacagaguuagaggcuuaauuuucuuucuaucaauauauugcuuuuauuuuuucugcacaggaccuuaauguucugcauguuuagugaggacacuucuacuuccaguguaauagcaucaugcuuuuagagaugcacuuguuagacauuugcagcuagcuguuccuuucaugaccuugugacuggggcuuccauaaagaugcacuccugcacaacuccuuucuugccucccacuacaaaacuguaaacucggggauacuagucugguuugcucagucaguuucugcucuuuuucaccaucuugcuuggauggcgucccuuuggugucuagcgcucuccugcuaccuugccuccuucucaaucucuaaaauaaagggaaaccuucuguuuguaccauucaaaaacugaaaauauuucuuuuuugauguguuuauauuauuauuuccaggguuauuuguauugucagauuuaacuugcucuguuuuauguggaaauagugccaaauauuagcaaguagaugauggguuauauuuggagcaggguacuuucccguuguucuuaaaaucacauauacacaaaguugucccuaaggucaacccuaaaagcacaccugauuuauuuccucuucgagugcccaggagaaaagaccuccuuucuacuuccucuucucccaaaguaagcaagacucacuaagauucuuuggcugucucuggaaccaagaauggguuucaccugagcucagccauuccuccaacagagagauucuccacuucaaaugcccaauaaagccuaacuuaggagcuuuuuuaaaaaaaucugcccagaccaguuaaagcucacucucugagauggacccaggcaucaguauaauuucaucccagcauacagcagcaguugaauaccacugcucuaaaaagucuuaaccaccuucaugccugaagcuuguuccuagccugaaaguuuuugagaauauggccauuaaguuccacaggggaaagagcauugugauguuagucaugacaaacuauaaugcuaccaccugcugacagcugccauuuauugaucaguucugugucaggcauucugcuauuucucuauguaaucuuuauguuuuuacugcaucuuuauauauauauuauauuuacuuuuuaugcuuuacuauguuuaaucuuaacugugaaaugggucuuauuaccauuucacaaagaggaaaaggaaauguuaaagaggauaggugaugugaucaaaaucacacaacugguaaacgaggagaaacaguugguaauauugaucacauguuagaucaagaacaaagaagugaaaaacuguaaaaaaaaguaguuugacuguauacuaauuacaguaaauuauaccaacaguuuaccauuugugccuaauuacaauauagcacaauaaugauuaugauuauaaauaccauuaaacagauaucgcauuaacuugggcaaauuucuuuugauuacagaacagcuuaaaucuuuauuauaaauagguguggaaugaauagcugauaaucauaacuaauauuuuauugaguguuuacuauauguuuuaggcaucacaguaaggauaaggacuuugcguacauuuuguuuaaccuuuaaaaacuaaaacucugagguugguacuauaauuauuauuagaagagaggaaacuaaggcuuggagagguugaauagcuuacuugguaaauggcauauccagaccuuccacucaggauugcgggacuccaaugcucuucacuauuccaucuccuuauauaauaugcugcagauucauaggacuguucguguuugcucagccuuugcacuuguuacuaaugugggcugguuaucuauucaaaacuuucaacaugacuugugagauggauauaauuauuuuaaaagucugcaagaguuuccuucuaagcuauuaauaguuuuaauuuugaauauauauaauggguaaccccaugaaaucucacuacuauauaagaauggucccaauuuaguuauucuccucucccuucaaugacauaaaaucaacauauccucuuagauuaaauaauaguaauaacaacuuucagggucaucuuaguucuuugaacuguggguuuuauuaaggaauaguagaaucugugcauauuuaaaauaaucauuuuguacugaaaacugaccccaaaacauacacauagaaaggccugauuaauaacaaacauuauuaugaaguguuuuaggugggaggcauucaguucuaaagauuauauacaaaauaaaccugaaccuagaugaccuucaguaaaauaucagcauauuaauaugccaagaaacucaauggcaugucugauuccaauucaucgugaugaagaaagagccaucuugccccaacucuugcucagagcagucgcacaggauuguaagugaucgucuuaaaagacucuuugucucaccuuugucaaaauccucuuucagggguuacagccgguagagaacccauagguuugggggucagaaaaccuggguuccuguuguagaguuucuaugaagucuccagaagauuacugugcugugaguuuuccagucuuaaaauagggacaaaaacucauuuuucagcauuucucaaagagauauugcagaaucaguaauaacuugguaauguuuuaguaaugccuguccuuuaaagaguaaguauguagacuaaauaagauacauguacauaguugaaauccaguaaaugccacucauuugauauauuaugguaagucuacaauaauacagaacucuuauuuguaaucauauaaggcaucuauagaauguuuuaaaaaauuccuuaaaaacaaaaggcaacauauacuaugucagcaaaaucccauuuuuaaccacuuagaaauaaguuauaccuaauuuuucccccaaacuaauaacucccugccagucuguuuuggcagcguagaaguuguuuucaaaucacuaaaacccucaugaccuaaaaguugugaaauuugaaggaguuugugcugccguuacucuuaaguuuuucccuaggugcuaauugagucaaguuuguucugcauuaugaucuaaugcaggcacaaucaaggaucagaugucagggugucagauagcaggaagugcugauuggugggaagcuggggaaugcaagcucuacccaaaggcauuaaaauucuugaaaaauaguugaacaccauuagcuauacagacacaccuucuagcuagauucuacugaagauccaccaauucacagacuuucagcuaauaaaugucuuaugauaauuaauucuacccccagaagggaaauagucauaugccacuucaugcuuuuuaauaaguugauuguauguaaagauuugaguuuaccaggaaguuuacaaaguaaauuauaguuauuagaguucaaauaaaaauguuuuuaugacaaacaacuaaagagugaauucucuacaugaauucugauguucuuauauacauccuagaaaucuugaauuguauaaaauguuauccugacauuuaugucuuaauuuagcuuacugccuugcgcagagcacacaagaaguauugaaauuagguagcugacaccaaauaaauacuuaaggcucuuuauaauacguuauuagggaaucuguaauuucaaguuauggaccauauuaauaaauacugcguauuuugaaaggcacuugacaccagucacauucaccuagaguaauucugaguaguuccucacagauuccauggggaaaaacauaugguucaagucucauaauuccauaggcaauuaauauaucaauaaaagagcauaacauuuguagcuguccucagccaaguaccuacuaugugccggacacaguacaggcccuuuuuaugcauuuugucucaauuuacuccugaugcuaauucugggaggcauuauugcuauuucaccaauugcagauagagagucucagugagauucccaugaagaugguaagaaaccuuucugcugcuaaauccugugcugguaagcuaucuauaccauauaucuauaguuuaaaaaaucaauaaggacaucggugaauggacugcagcaauuaaacgaaccuaguuaaccuuguaaaucccccuauaucagaucacuauagggaaggaagggcucgauaccuuaaaauucccaguagaggguguaugcccccauugaccaaucugacuggaugucaaacuuugguauccguuguacacugugugcagaaucaguaugugcuagaauuauguauaacaaacuaaaagccuaccagauguuggaaaacaguaacaugcugauaccaaggugggcuugguaagugaaggaucagcauguuuucuuuucuaaguuaaacuucugaauuuucuucaaacucuucugucucuacucauggucccucagcccaaaucuggcuucuucuguggucuccagauagaguuaaacacuuccucacauagcuccuuguauguuuucucacauauguuucuucuuaugcaucucucuuccacuguaugugaguuccuuggagccagggcuaauugcuuuuucauccuuguguugcuaagcacuaaauccaacagugugucugaugguggcugacaaaugaaugaauggauaaaaccaguaaaacugccugaccucagcaccauuacucccucccaucuuuuaguucuuggcuaguuagaaggccagguucuguggcugagcucguaaaaguucagcuguauuguagaaauacacagauauauaaauauuguagaaauauacaaagccuuugcuuucaugguuuugaggaaaggaaaaggugagcaguuagccaaacucuuagauuaaaaagagcaagaagagugauuccaggaaaguuuucuuuuucacuuguauguuuuugcagcuuuuuucauaguuuucaaaguuguggaacccucuccugguguuaagaaccugcuucgguucuuaaaauaaacaaagguaucaaaaaguccucuugcuccaauauuuucaccucugauuggcaauucaaauguggaaagcuucugaaacuaucuuuaaguagcuucguaagaugacaaaagcccuauauuuaguaaugucuaacugaaguuuguuuuaaugauuuagaaaauauccuaguauucauuauuauaaaguguuuauuuugcagaguuuucauuugaaaaacuagcaacucugccuuaccauagaaaugcaucguucuucaaguuuuugaaaacauuuugguucuacauauuagacuuuaacucuugaaugcuagcccugccuaguaauaaaacauguuuuuuuuccagugccacuuaauggcaagucucuucaaguuucucaacagucaacugcuguaaauguaccugagguacauucucauuuucuagagggggaacaggaaaaauuccacugccaccauccaccccugucauccaaaagcaaguuuauuagugaacuucaagucagcauucuaacccuacuaucuggucucucuuuuuuacuuuuuuauccuuuuggguuuaucaaguccuuauuuuaagauuaacaugaagaauacuuaauguuguaaaggcuacauggaugguuuugacaucagagugacaaaauauguuuuaaaaggauaacaauaucugagugcauguuuguaagagcagcuagauaacauggcaaacucugacagcaaucauuucuucacuccugccccauuuuuccuaagcaaauacacuuagggugcucuucagugguaguguauauaaaggauggucuccaaaaagagauuggcagcuuuaauuuguuugauaugugcaaucaugguccguguuaaauucaaaaugcuuguccaaucaaggauucaauauagaaaagaggcaguaacaagcaugcugcacacuguaauaaagaaaucuguugauugaaaacaguuuguauauuuuggaaaugauagggaauguaauugguaagaaagaaaaggauagggcuucauaaauaaugggaaauagagcauauuuuuuacugauaauacuaacucaauuuaauaacauuuugguguugaauuuuugugugccagaaaauaagaaagauggguucuuuuuuguuacucuaaaugucaugauucauggguugaccuuuuuuguuuuuguguccaucgagagcagcuuugacagguugaaucaggcaauagugggugauacguuccgguucuuugagaacuuucacagaacauuuuucuuuuguucucucauccaagaagacgaaacauauuuuuaacuguuuuuuuuuuuuuuagguacaaguacuacaugaaugcauuucugugguaaaagaucuaaacaauagagaaauauacagagcaaagucuguauacuuuucguacauagaugucuggguagagauuuguaugcugauuguuugaggggcuguaguauuaagaaauugaggcugggcgcaguggcucacgcuuguaaucccagcacuuugggaggcugaggugggcagauggcuugagcucaggaguucgagaccagccuggguaacauggcgaaacccauuuuauacaaaauuuagccaguugcagucgugcaugccuguagucccagcuacuugugggacugcaacaggaggaucgcuugaaccugggagguugaggccauagugaaccgagacugcaccacugcacuccagccugggggacaaagugagacccugucucagaaaagaaaaagaaaaaaagaaauuggauuuuacuauucaugucauucucaagcuuacuuaagaccucacagauagaaaaacauauauaaagucacucuggagggcugcuauuaguggcucuccacuagaaacauguugaugcggacaccacuagcugugccuggggugaguuagcugggacccuuuucaccaagcaccaccccaggucacaagugucccuuuggagcugcucagcucaguuggccaguauccagcuuuguccucucugaagaaaaacaucaacaauuuaaacugcgagcacuaaauacacuuaaugguaccuuuaccuguccuuuuuuuccuguuauuuaguuccuuuccccauuaauuuaaaauucugcaucuagacuuagcacuaguaaucucaucuuguacaaaaaucuaacuauucagaaaguaccaacuagaaauuuucaguguaccaugguggcagguguucaugaugauggaauacucucuaacucauaaaagagauuguguacaauauaguuuuguuauuaauuuaugcuacuuuauuaacauuuuaaaaaguggucaacaguccuuuauuaccuucccauuaaccaucauguugagguaacuauaauacccaguucccugcaucuguucuaaacaaacuggauuuuacuagauaaaaaaugaaauuacuaauaaaagguuaagugauacauuuagcauacaucaucagauuaagcauuugcuauaagaagaauccaggccgggcgcaguggcucacuccuguaaucccagcacuuugggaggccaaggcgggcggaucacaaggucaggagauugagaccauccuggcuaacacggugaaacccugucucuacuaaaaauacaaaaaauuagcugggcgugcgugguggcgggugccuguagucccagcuacucgggaggcugaggcaggagacuggugugaacccgggaggcggagcuugcagugagcggagauugggccacuguacuccagccugggcgacagagcgagacuccaucucaaaaaaaaaaaaaaaaaaaagaauccauuguauugguaagcuguuuuugugugagauugcauuucuuccucuccaagcgucuagcacagcacuuuggauuccaaguucaccaaacuuucccccucuauucaauugcauuaaacauguauuaaacaucuucucuaugucaugcuuucuaagaugcaaaaaaguuaguauccuucuucucuaagaauccauaaucuagcaggaugcgguggcucgcgcauguaaucccagcacuuugggaggcuaaggugggcauaucacgaggucaggaguucuagaccagccuggccaacauagugaaaccccaucucuacuaaaaaauacaaaaauuagcugggugugguggcacacgccuguagucccagcuacuugggaggcugaggcaggagaauugcuugaaccugggaggcggagguugcagugagccaagaucgcgccacugcacuccagccuggguaacagagcaagacuccgucucaaaaaaaaaaaaagaaucuguaaucuaauggcagaaagggggccugcauagaagagguauucuucauucuguugagguggcagaacccuuuaucucccacuuauaacagugugccaguggugaaaaaagcaaggugagaacagucugaagucagggauaagaaaggaggcauccccaugcaccccaggaaagcaccccuaaugauagaauuuaucccugcagggaaaagguaaaccaagauaccaugcaauuguauaccuggaacaguacucuucugaacuuguuugauuucauacucuuaacauuaauuuuuuuuuuuugcugaaaucucugauauuuauauauguaauuguagauauauagguaauuugaaagagcacuaauguacucuuccugugcaagauauccuguagaacauacgcaaaauaugcauuuuuuuuuuccuucaacuucuauuuuaaguucagggguguauguacaggauuugcauauuuguuacauagguaaaugugugccauagugguuugcuacacagaucaucccaucaccuagguauuaagcccaggguccauuagcuauucucccugaugcucucccuccucccaccucagcccccucugacagccccuccccccacaauguguguuguucuucccaauguggccauguguucucaucauucagcucccacuuaaaagugagaacaugcagcguuugguuuccuuuugcuucguuaguuugcugaagaucguggcuugcaacuccauccaugugccuagaaaggacaugaccucguuccuuuuuuauggcugcauaguauuccaugguguauaugugccacauuuucuuuauucagucugucauugauggauguuuaaauugauuccacgucucugcagacauaaagacaaauggaacagaauagagaacucagaaaucagacuacacaccuacaaccaucugauguuugacaaaccugacaaaagcaagcaaugggaaaaggauucccuauuuaauaaauggugcugggagaacuggcuagccaucugcagaaaauugaaacuggaccuuccuuauaccauauacaaaaauuaacucaagauagauuaaagacuuacauguaaaacccaaaacuauaaaaacccuagaagaaaaccuaggcaauaccauccuggacauaggaacaggcaaaaauuucauaaugaaaacgcaaaagcaauugcaacaaaagcaaauaucgacaaauggaauauauauuuaaacuuaagagcuucugcacagcaaaagaaacuaucaucagagugaacagacaaucuacagaaugggagauaguuuuugcaaucuauccaucugacaaaggucuaauauccagagucuacaaggaauuuaaacacauuuacaaggaaaaaaaaaaauuaaaaagugggcaaaggacaugaacagacacuucucaaaauaauacauauaugugccaaaagauacauucuuaaguggauaugguugaaaaacaguauuuuuuaaauauugguguguuuuuaauccaggguguuuuuuuuaaguccauuucgagauuuuuaauuuaguuaaaacuaacuugaucuuguuaaagccacuuaacuaugcaaacagaaacuucacuauaucccacuggacugaaagugaaccugcccaagaggggcccucuaucaaauccuugcccauggaacagggucaaaaacacaagaaacgaggauaccuucuaauuugagcuucacacgcagcaucugacacucaaaccaagcaagguggggcuaauguccacccaacuagcaaauauuaguaaaucucaggaucuuuguuuuagauuuuaaauuuuuuuaaauaaaacacagauguauaaauuaguccagaagguuugugacccucaguagccauccugugauuucaauacaugucuucuucccuggucacaagaggcaaagggucaaaugagcaccacuucagaagggugagcacaggacagugucgaugggucuguucaaucuugaacccucuucccaaagcugggaguguaucuguuugcuuuaaauccugugaagccgggaugccccuuacaccugaccugcuuucagugcagacugucauguacguggaccucagugaaugaaaccuggguguccauaucuuaccugcugcucaucaaaacugcaagaaagaaagccucuuuugaugagcaguuguacuaccccuaccaggguauauucagauuggugguuuuaucauuuccaaggagauaagacagugagugacauguagcuagugcaaagcaacaaaucauagcaugggcagggcagguuuuaagaguuauuugccucacacuguccccuggcacuucuaccuggcuguugaagccaucauggcagugcuaccaaccuccacucaaccaggcaccugugacucuguuuucaccccuggaaauacacacacccauacagauaggcauuuaagcaacaugaggacuggcuggcuguuuuuauauuuacuaaccauggaagcacuaucauuauaaauuaaucaaaauuuucauuuccauaaacauauaauaguguggcuuagagaguguaaagggugaauuuaucucccugggcuaaguauuaccucacuacucuaauauguggaccaagauauuauucaggauuuuaaagauggaggggggauuucaugaaaagggaauggauguggaagauuuuauuuuauuuuauuuuauuuuauuuuauuuuauuuuauuuuauuuuauuuuagaccgaguuucacucuuaucacccaggcuggagugcaauggcacguucuuggcucacugcaaccuccgccucucagguucaagcgauucuccugccucagccucccaaguagcugggauugcaggugccugccaccacgcccggcuaaguuuuuuguauuuucaguagagacaggguuucaccaugcuggccaagcuggucuagaacuccugaccucaggugauccacccuccuuggccucccaaagugcugggauuacaggcgugagccaccgggccuggccggaggauuuaauuuuuaaaguugcuagaaccugauaguuuguuuaaaauaaaauauucagaagaacuuaggggaaauuaugaguggguauuauuaugguggugaauuuucugacaucuucuuuauccugcucucucaccucuuucuaagcaccugaucuguuuggaccaccaccauaccuagaguuuuagauguaucagaaaccaccaacauuggauagaauaugcucacccugcaguucccaaacguauaugcugcacaagucuagcaaccugaacugagaaaggaccucuuucuuguucucuguuccaauuccaagucccgggaaaaggcugucggcaucacccuguauagaauaacugcuuaggggcacacuguuuggaugaggaaggggaccaagagucugggagagguuuuccauagaccuggcugucacagguuugcagaauacccugcuuaucuaacaaggucuggauaaaucccuugcuacuugagcucugacaagaugagagaguuuuucaaauaaccuuuccugagaagcuaaggaaucuguaaaagucagcaggcuuauaggauaaguuccacuuuuuuucauccacaauuagcuugccuguugauaauuaaccagcaugguugacaaggcacccaguucuugacuuuuuuuccuuccauuagccaauucuggcuuagauauuggagaagggacccuagacaaagaagcuuagccuucuggcugaggaagauguggguaagguauguuggcagaucugguggaguccgugaucauguuaagaaacaucuucuggcugggugcaguggcucaugccuauaaucacagcacuuugggaggccaaggcuugcagauugccugaguucaggaguucgagaccagccauggccaacauggugaaaccccgucucuacuaaaaauacaaaaaauuagcugggugugguggcacuugccuguaauccuagcuacuacuugggaggcugaggcaggagaaucuugaacuugaacccaggaggcgggguuugcagugagcugagauagcgccacugcacuccagccugggugacaagagcaaaacugucucaaaaaaaaagaaaaggcaagaaagaaaaagaaagagagagagagaaagaaaggaaaagaaaaaagaaaguccuccaauguuugugccuaggccugaaccuccuagauugucuccacuggcuucaggcuguguccacucuaaaacaucucuagccuucaggguccuaucuuggccuuugucauggcaugucuccagaggguucucccucuucccaggguuaccugaguauacagccugcaguaaccugcucuuucucuaggugcuuccauucaccugaaauguaguuauucuccaaaggcaggcucucuuugguuauucugaacugggcucuccauaaucccuccccucccaccauggucgggagucuuccugggagccacugacuuucuuuggcgaccaucuacauuguauugguugcugcggacaaccaaaagcaaaccuguauguacuguuuuccuaguuggguacccacccccacacaagcuucccuuucuugggggaugugucuaguucucagcccauuuucagaacagaaaugucgugaauuuaguauuugaccaguuuuuuuuuucccccuaggcccagauucucuugaguagcucauuguucauacuuguuuucuuuuucccauuaaaucaccuacccaggagaguauuuuguuuucuaaaaaauagucacuuaucaauuaaaugacaggaaaaaaaaaauccaccccagagaggagaccuaguauuuauuggacacaugggaaaaaugagccuuucuaacagagggauggucaucuuguacaaguacacugagggcagcuguucucaaccaggaugauuuugccuccccacccgagggaacauuugacaaugucuggagacauuucauugucacaaguuggggagaagcaggagggaggcugcugcuggcgucuaguggguagaggccaaggcugcuacuaaacuucuacaguggacacaagauagacccacaaauaaugauuggcaccaaauguuaguagguuaagauagcaaagacuuggaaucaacccaaaugcccaucaauaauagacuggauaaagaaaaugugacacauauacaccauggaauaccaugcagccauaaaaaaagaaugaguucauguacuuugcagggacauggaugaagcuggaaaccaucauccucagcaaacuaacacaggaacagaaaaccaaacacugcauguucucacucauaagugggaguugaacagugagaacacauggucacaggaaugggaacaucacacaccggggcauguugggggguggggggcaaggggagagagagcauuaggacaaguaucuacugcaugcagggcuuaaaaccuagaugauggguugauaggugcagcaaaccaccauggcacauguguaccuauguaacaaaccugcacguucugcacauguaucccagaacuuaaaaaagaaaacaaagaaacccuaauauagggcuagugagauggcugugugagcgugagcuggugaggaagggcuuggggccacugugccagugcugacggaauccucgauaguauuuugucaagucgaaggacaguaauaaugauaaauguagcaaugguuuucuagacacgaggaaaauggccuuggucuuuggguggcuacuuuguuuguuuguuugagaugaagucucgcucugucacccaggcuggagugcagugacaugaucucggcucacugcaacuucugccucccagguucaagcaauucuucugccucagccucccaaguagcuggaacuacaggugugcgccaccacgccuggcuaauuuuuguguuuuuaguagagauggguuuucaccauauuggccaggcuggucuugaacuccugaccucgugauccauccgccuuggccucccaaagugcugggauuacaggcgugggccaccgcacccggcccuuggguggcuacuuucauagaaaggcagcuaugcuauauugauauggaacagaggcuuauuuauuaaauaaauucacuuuagcaauaauaaacucauuacauguuaacauagaaaccuuuuaugaaaauagcuauaucuuucaaaacaaaaaaaaaaaauggugagaagagcagcauuguuuuaaauuuuggcaaaucucuuuauucucuggcuuaauagaaagccagccugauuucucaucugcuucugcauucaaucugugguaacaucacacaucauguagccucuggaaacuccacuguagacccaugagagaaugagaguggaaaaagccaguaaugucuucguaugauuucgaaaaaaguuuugaccuugaagaccccuaaaagggucacuccagauguccccuggcccacacauuguaaacugcugcucuagaacugugagaucugugaagcagaauggggaaaaagucacauguuuaauuucacuacucuuuaacuagaauuuagcgcacccuucaaauauggauggaggccucagaauacagugguauuagcaguaucugacuuuguuaucagcaguagacgucaaggauguuuucugaucacauuacaguuguugcagauaucuaaaauaucacuuagcauugcuuugaaauuuuacucaccacagugcuagaucuugucuauaaugccuuaauaagaaaguacauacacuacuauaccacagguguguucuuuaauaccgacaaguauauuucaguguaauugcuuuacuuugcacuccuauguuguuuuauuuguuuuaccuauuuaaaaacauucugagauaggagcugugggcuuuaguugacugccaaaggaguccucgguacaaaaaaccuucagaagccuuacucuagaaaguuacacagccagaaaggcaugccuuggccauuuugggaaagcaguacagccccaaagcaagcucaaaucggaguguuugaagaaagcaaguuccauugccacuguugucggccuguguccugcccaccucuguaugcacagccacaacuucaaguaauuacaauaaaguguugaucaugaacacucccaguuuucaaaaaagaguuaaccaccccuguaauguacauuuuggauaaaaauuuccuuuaaaaguucucauucucauaauucacaauaaauuccagucuucucagcaaauucagcuacccuaagaguucuagagcuaaggugcuccugucacuugaugaaaguuaauaaagcuucccaaauauuccuggacagacacagaaauggacaaugauugcuucuaagaaaggacaugggaugagugggagacuucuuuguugguugguuaauuuuaauuucauuaguuaaacaugcacauaauuugaauuaucagaaguucauaugucugguuacaaaaagcagucccuuuccuucccauuucccagucuucaaacacaaccacuugggacuccuuccacugcuguuuucaguauucaccuccuuaucucuaaauaauaggcacagagugcaucucccaguaaucuccuacaaugagaaaagaggccuuaacaccuccagccaugguccucaggcaguuagagcaugauuccggcagacugauugauugauaccaauagccacuauugauacauaccaauucuuccucugcuuuucuaaaccugcucuuaaaucaguucacacauaacugguaucugagcugaugacccucgcggccugaugcacagcuguuauccugggaaucuuccuuuaccaucaucuggguauugccuucacauaucacuuauuucagagucccugugcccuacagucuguaucuuuguuuacugucccucuuuuggggagagguaaaacaucucuuccaguagcuuccugagaaagaguacuuggcagaugaagcuuuugagaccuuucuugucuuaaaauguccuuaauucacccucauacuuaauugauaguuagauacagaauucuaggcuggaacucaguguuccucauaauuuugaaaacauuguucuacugucaucuuuuuuaguguugcuuuugaaaaguugaaagcuuuucugaguccuaauccuuuauauauuugaccuguguccuuuuuuuuucuccuuccuuguuagacacuuggaggauuuccuuugcacccagugcaugggcacauucaugaugguguguuuuggucuggggcaguuuucauuuauggugcuggguacuuggugggcucuuuccauuuggaaagucaagcccuccaguucugggaaguuuucuugaauuucuucuuugauuuccuuccuaccauguccaauuauguuuuaauuucuaagaacuagaauuuucuuguuuuugcaguguuccuguucucauggaugugaucugucaauaacuugagaucucuucuugugugcuggucagauuccccagaauagauccagucuccucccugaagaggauuagcuggcuucgggcaucuggaacuuggggucuuggcacagcaugccuuggugggcucagagacccucaucaagagaauaagccuucugccagaguggagguggggguuuggggucucugucuugaauauacuuugaaccggucuucacucauacuuccagagauagcuuggggcaccaauucaugagccuuugggaguaagucaucucuuguuuuucugcucgcuagcuuuugcugccagcaccuccacuacuauuuuccucuuucuuggaguuucuuuugucuuuuaaaaagucccuuacuguaauuugagugaggauuugggaguuuacagagcaaaauauguguauuuagugugccaucuauaaccagaaaucagagaguuuucaauguaggcuuuuuugugugcauuuugaauuuuguccacauuuuuguacuaggaauucaauauuuguaaaucaagcuuccaucuuuguucuuacaauuaagagggaaauguccacuucuguguguacuauccuuugaacguucaaaggccucacaauauuuguauauuugguacaauguaccagauguuugcagggaucuuuuuuacauauuaccucauauuccacccaggucaaauuugaugagaaagaguucuuuuuucuuuuugguuagauucuagaugauacccacaguucaaacuguaaaagaauaaguuugccaauaguaauaauuaauagcauuuauugaacacuaagcaccagacacuauuauaagcauguucuguguuuuaacuuauuuaauuuucacaacuacccuaugaaguagguacugcuguugucccuaaaugauagaugaggaaauggagguccggagagguuuaaaagccugcucaagguaacauagcaaguuaauggcagagucaggauugcaaccccaauagucuggcuguagaguacauuuuaaacauaacuacugugugcacaaggcuaaugauuuauggauugcaugaauaacuaaagaugauguccccaacuuuguuagagauauccccaaacuuccuuaauggaucgguugucauaacuucaccaacuuacagcucuuuuuuuccacauaaaacuugccaaaaugccuucagacugaagggagaaaaaauuuaacuguuuccuucaaauuaaauuuuauuagcagagaacuaguauuaagaucauugcaugaagaaaauguaaauuagccgcuuacuguaaaauaguauuagagaaggcaagugauaaacaugucuauuccucuuuuucccuuuauuagugguuaauaaucaauaaauagcagcuuaaugauuaacauuauaaaagauuacauaagaguuuuagaagaauuuagauuuucuuuacuagguagucaucuucauuuuuauaaaacugacaucaguguuaagccauuuuuaccacagguuaaaauuugacugaccuauucuguugcugacugagucauaccaggucacugaaaccuaaaauaaguauguuguaagcaucgcguaacaauuauaaccuauuuagauccaagauccacuuaagacauguugacuucuuuucugcaucacugagauggccgacacauccaucaauaaugugcugaaguucucauuagcucucuauacagggaaggaugccagcaaaauguacagaaguaaauucacuggaaucucuggucagaaauuaugacuguucuauaugucagcccauguguugcuaacagauuuuuuucuuuacaaaaauguguuuugugguuugauuugacccaugguucaucugaauccaggcaauuacacuuauauuaaggguucuacuguccacuuucuccucaucuugagaaaugucaaaaggcacauauccugcaucugaaggaaacacaagaaacaaaaauggaaaugccugaagagugcuuucaccugcauuaaucaagggacagcugcugccauucccaaggcgcugcccugcaguuggcugagcagacccacaugggccugcugaauuaagucugaauuaagagucagacugcgagugaugcugccucuguguuuaggugaaaaggccacuuuagcaaguguaauaaaauguauagacucaggugagacuccaggggaaauuuugccccuugaguuuggguuggagaaaugaccuccagaucucuaauaucauucacuguggaggagauguggaccauguauuuuuuccuuuucuucccuuuauaagaugguaauuuccccuuagggauuuggguuucucuguuguaugcauuaauagggagaugggggagagagagagagagucacaaauuaaagucauuuuaugguaagugucuaugccuuuucaccucuaugcuucacuuuguagaacucgucaggaaaaucauucaggugacgacuaugcauuuugauguuaacagauccgacucuuaccggguagacgaccaguuaacaacaugaaauaaggcagugaugguuuuugaaaugaaauaauguuugauguaaccucgaguuucucucugaacucugaccacacuguagaaaccccuaggaggaggugagcagcucugucaggcacagaauuacacccagggaagaaaaauuaauuccaauacuaagggagaaggcuguguucucuugcaugauauuuagcagcaagagcaaggagagggauguuuccuucuuuguguaaugugcaguaguuacaauaaacacaagauuuccaaaucucagaggacucuucuugacaguugcuugauaacagcuuuuuucauuccauaguuuugacaguuuguguguguugccauaucuaguguaaacuaaaacaucacugucauucuguuuuucuuuuguauguggcuuuuuuuuuuucaucuuuaggauaaugaaaaagaugggcuuuucacuuguagacuagaguaaggcaaguuguguguggagauuagcauguguuuauaaguuuugaaagauucaaguugacagcagaacacugcuuuaaauaauuuuuuucuccauaucgcuucaguaaaaguacaagugggauguguaaguuuucucuuaaucuuuugauaaauagcaaaccuuaggcaucuguguggguaccuauauuauuuaucggugguuauugaaaaugaaugacuacaaugaacaucucuagagcuccuggcuguguagccuuugauaaguggugagcauccuguaucuuacuguuaccagggucuugcccugccccacguaggugcuuuucagucccucgcuaugcuucccuucacuugauggauccccuaucccacccaccucugucagguuuauagcuaugcuacguuauugguuuguguccaaaccaacaggaugauauuguuguugugguugaugauuuaucuggaguaacucuagaaacuacauugcaucugcacuguuugagaggcugcagggcaggugaugggccagaagcccaagucaggaucagagcagucuuuacucaucagaugugaacucucagauuccccaaagucaggaagggaucccauaccugagagaccuuccccccuccagccccaauaaccuuugauuuguagaagucucagugagguuauuuugccaucaaaccaaauuugcuguagcauagcaaagcucccaaugccgucaucuggcauguuacagacaaauuccaauuacuuuucuacuucgagcuauuguuaaacacuacaagcuagcugacaguaaaauuauaaauacagguguugucacacuacacuauaaucagaauuuuaauuugaauuuucauuuguaaagccuuuuuuucagaugaaaaugggaauagaauuaguuuuauugacaguaaaaagacauuuugaaagcuuccuaaaucauuaccuguauuuagcaggaggaaaaauuguauauguccauguaaaaagaagaguuuuauuaucacauauuuacucauuauauuuggugguaaauaaaacggggaagacauguuugacaaaugauugacggaacucacuagguuuuugcuucaucagaacaauagacagacauaaauauauauuuugcuuuuguuuuguucugcuauuacuaaugcagaccuguagacaaaaucuguuucuagcaaauuaagugcagccuauugggagucugcaugcaaugcuaaacuuuuuauuuggcaauuuucucuuuucacccagauucaucaucuguggcgcucuuuuuaccccuuuugcguggugguuggaguggguucccccuucucaggucccuuuuuuuuuucccucaaggcauuuagugucgugucugccagauuucagugaugagcagcgaauugcuuuuaaagugggcauuaugccaguucagcagcacaauggaaaaccaaucuuccaccauucuacuuuugaugcuguuauuguagcauuuuagauaacugcugccacaaaaaaaaagaaagaaaaaaagaugugcucaauugcuaccaguuagucaaguuaaauccagaguagcauuaaaauuacucugaaaacucuuugucagaggucaugugccgucuguggcugccacacauaggauggauguucuguucagguggggguuuuucccuuuauuauuacugugacugaccagcucucuaaauagcccuuuacuaccuguuuacuuauugucuucaccucccuguugaaaaaaugugucaagcagaaauguugaaaaguuucuuuaaagugcuggaaauagcaggagagugagucguucagggugcuagaguuuguacaaugugaaagcaaaaaaaaaagucgggggagagcaagaacauaauucucugguuucuauagcaagauuacuguuuucuucuuuuuaucuucacuuuucaaccacuggguucacuguucuacuuuuuuuuuaauagcacaaauggaauuuaucuucucuccaucucaagucccuccccucccuccacuggcuuugcuugugaaugaaagggacuccuacuaugacuaaggacagauggcagcuguauacguuguauuugauguauuuuggagugagccauauuuuaaaauucagggccaauagaugggcuauuuugagaguggcacuagcgccauccuuuaagccugcuccauuuccuccaaauuuauuuacauuuuaaaaauuauauaaauaagcuauaaucugugcucaaaauaauugaguugugaucuuuuaacuguauugcauuaauaauaaaagcaacucagacuucugggcugccuuucuucuaaagaguauguguucauuuaucuuuauguugucucuaauggauuuuucucguuuauguuaaucauaucucuaguauuaucagauucugauccuaaugaaggcaggcacuuuugucuguuuuguccauuccuaugucccagggcuuagaauaguaucuggcacguaguaggcacucaguaaauauuugcugaaugaauuaauaauucauguuucuauggguacaucgaauuguaguguauuuacuuauuuguauguuuuccucuccagcuagaaugccaaacugugcuccugaaauacagcaggcgugcuaaggcauuuuggaauccuuucuucaucucuacccuaucccaaauuguacaugacacccagucaguacuuaauaaauauuugucaaauaaacaaguagagaagcccaaacgcaauuuauuugccagugaaagauauggucauuuggugguagagaugaggauagguuaauggcccaucaaucaguauuguuaagagucuccacguucuuagccuuauguuaauucagaguucuuucccagguauccuauugguuuucugggcuuauugccaagcauauuuuagauccauauuuuccuucaguuuacaguuuaagagcauuuuaauuuuugcuaaagcuugcaaaaaaaggcucugauaaugaugcagucaauaucaguaaccaucccauuugcuagugccaucuagaugaauccauuguguagaucguccugucuuaauaugggagggagacugcugugcauggugggauggccuauagcaguuagaccucucuaagcaccauuugccucuucuguggaauugugguuuagucauucugucguguccucuacuaccugccucccccaaaacucccugcuuccgucugcaaaaugaggaccuagaggcugcuuaacaaggccagaggcuucagagaauucagugacuuaaucaagaacuguacuguguaagagacacacugcuuucccuuuaaaucauugaguguaagagacacaccgcuuucccuuuuaaucauugagucauaaaugugacauagcuuuaaauggauagcaacaauuugcaaaucaauaagacccauuuuguaauuagcuuuggacuaagcauuaaaaaguauacauugaggauuaugguaguuaaaaugcugagcaguguggggauucuuccuugguagcugaaacugugcauaauaaacauacagaaaugaggauggcgaguuucaguuuuaccacaagguuaugcauuuauuugagaagaaucugagaugugcaauacaacauucccuaauaugcucauuucaucuucucugcuaucauugaaccuucaucuaagaagagccaaggaacaaacugaaauaaggauucagauuuuuauuagaguaaauguaaacacauguagaggggaacauuuugccuuacauggccuaccaucaacguuuuacaccggaaaaaaaaaguguguguuuauuccagcauccugcaucaauacuggcaaaaauucuaaagacuugcaguugcuugggccaaagauggaaaauuuuauauaagaaugcugaggagaccuuuugcacuuuuuuuuuuuuuuuuuuuuuuugagacggagucuugcucuguugcccaggcuggagugcaguggcgcgaucucggcucacugcaagcuccgccucccggguucacgccauucuccugccucagccucccgaggagcugggacuacaggcgcccgccacuacgcccggcuaauguuuuuguauuuuuaguagagacgggguuucacuguguuagccaggauggucucgaucuccugaccucaugauccgcccgccucggccucccaaagugcugggauuacaggccugagccaccgcacccggccugcacuuuuuaagauaaaucaugcaggcuggagaguaggaguuuugugugugugugucccuuuacaaagagaguuuagaggaaagagcaugaauuaaauuuguggcguugugaaaagccucuuugguccgguuuccucauggcuauggugucucuucuguuuaacuuaugggacuguuguuaggaugaaauaagauauguauuuuuugaacccucuauaccaggaguuggcacacuuuuucuaugaagagucagauaguaguuucagcuuugaggaccagucuccuuugcagcuauucaacuucuccacaguagccauagauaacacagaaacaaaugggcauggcuguguuccaauaaaacuuuauuaacaaaaacaaguggaagccgagauuuggccuucaggccauaguugcuaacccuuacuccauaauaaugaaaucaugaaacauaaaauaccaaauauucuaauaaccccccauuuggaagucagccauuggagucaguaccuggccacucuuguacaguguaggccuaaagggaguaucucuuucuagagaaagccacuuuccauuguuuuuaguucagucuucucaauuuuucacuaaacccucuagagagaauuuaaauucaguugaauauccuuguacagguugaauauccuaaaucuggaaaucugaagugcuccaaaauccaagacuuuuugagcaccagcaugacgcucaaaggaaaugcucauuggagcauuucagaguucagauuuucggauguucagcuggugaguguggugcagauauuucaaaauccaaaacacuucuggucccaagcauuucagauaagggauauucaaucaguauuuaucaguggcuucacuuuggccacccacugucacaaaagcauccagucuuuucucuaagaaaggguuccuuccagccaggcgugguggcucaugccuguaaucccagcacuuugagagacugaggugggcagaucaccugaggucaggaguucaagaccagccugaccaacauggagaaaccccgucuguacuaaaaauacaaaaauuagcuagacgugguggcacuugccuguaauccuagcuacucaggaggcugaggcaggagaaucgcuugaacccgggaggcagagguugcagugagccgagaucgcgccauugcacuccagccugugcaacaagagcgaaacuccaucucaaaaaaaaagaaaggguuccuucuuuaugacaguuuccucagagccaugacauuaaucaggguggagaagggaugccaguauuaaaauagcuaaguaggguggagcacugccacccauuaccuccacugggcaauccuugagucuuugguugguaagaagaguugaaaagagggacaguggcuauguuagugaucaaccaguuaagauuucaagauaugugaguucaaagcugcaaugagcuaugaccacugcacuccagccuggacaacagagcaagaguaagacuuugucucuuuaaauauauauauauauagucaggugaccgguagcucacaccuguaaucucagcacugugagaugccaggaguuuaagacaagccugggcaacacagcaagaccccaucuccacauaaaaauguaaaaauuagccagguaugguaguacauaccuauacuuccagcuaugugggagucugaggugagaggauuauuggagcccaggaguaugaucaugccacugcacuccagccugacagaguaagacccugucucuuaacauauauauauauauauguauguauguauguuuauauauagucacuuuaaaagucugccuuugacuuuauuaucacucugcuuucucagauuucuuaaguccuuaaauuucucccccacucuuaggugcuccacacuaaguuacugaguuccccuguauuuccaccaguuauccagagcguuggcccucucugauaggcagcuucuaagauggcacccagugacuauuauuugugcagugguccucuucccuuggguauggccuggaccaagugacucucuucuuaaaaaggaauacagcaaaagcaaugaaaugucacuacugagauuaggguacaaaagauguugacuucugucuugagcauucucacucucucacucacucacucugagggaaaccagcugccauauugugaguuggggaagcccaugugaugaggaacuggggccucaguucagcaaccuaagaggaauagcaguccacaugaagagaacuuggaaaugauccuugccccguugagcacucaggagacagugggacugacaccuugauuguagccuugugagaaaccuugagccagagaugcccagcucagccaugcuuggauuccugucccacagaaaccgagaaauguauguauuguguguuauguuuagccaucaaaucauggggugauuuguuacacagcaaugguccacuaauaaacccuuuaaagugcaaugcuuauuuaagcuucuguuucucauaaccuguuugacagugccuugcauguagcagguuauccacagauacuuguuuacugauccgcuuacacuaaauguauagucauauguuucauuauuauuuugccagaauacugauuuggcuuaaucaaaaauguucaucuuuuucuccacaagguauguaacucaccaucuugagguauggcaucuguggauccaugauacccaagcaggaagggaauguucccuacccgcaaacaaauacggaacccaagaaaggcugagugccccuggaaucguuguaacuuuauccuuccccagugugcagaagggaaaggguguuacgagaaucuugccuucaugucaggauuuaggaaggcacgaccucuuuucuacacucuauccagaaugugauggugaccuggaaugguaagggccccaccaagaagaccuguuuauagcacagcuguuaccuucaccauccaacuguggccucgcuuuaguuccagcuguuuauauuagucaaaacugucccuaacaccacagcauaggcugugagaacaagaggcuagugagaagggaagauauccagaggauuaagaagcaaccaagccauggccuauguucuuuugacuuuauccccaaaagaacaacagcuuagcugaugguacagccuuuggcccaagaaauguaaaagccauuccuucaggugccuauuugcauauuucuacacccugagggcuuuuuucuucucccaccugugguaaaugacuguguacacuggacuguauuuacugccuaucuguugucaucauugucaucaacuaacauuuguugaccauuaacauggucucagaaacugccugggcacucuaauccgucagccugugcauucauuaaagugaaggaaaauaagcagaggcuugacauucagaaauaagagcccagaaaugaguccagaauuuccgauucuaaagccagugccaacucccaggccacacucacugcauuuaaugcauaugcauuuucuuuuccucacaucugcucuuccuuugcaagaaugucccagccuguguacacacccauauccuguuaccucuccagaguaaacgauuuccaguuccuguggauauugcaugucaccacauaggauuaaacagccugaauuuuuuuaugugcccaucuuuagaagccuuauaaguagagauuaagauguuuaucaagauuagaaaugcggcugggcacaguggcugacaccucuaauccagcacuuugggaggccgagguggcagaucacuuaaggucaggaguuugagaccagccuggucaacauggcaagacccugucucuacuaaaaauacaaaaauuagccaggcgugguggcaggcaccuguaauccuagcuacucgggaggaugaggcaggagaauugguugaacccaggaggcggagguugcagugagccaagaucccaccacugcacuccagccugggugacaaagugagacuccaucucauaaauaaauaaauagauuagaaaugguaugugagcaauaaagauguuguguaugcuucuuggauauuguugcugacucaagacuugaaaagacuggagucuucaggaagaaugguacugguggaaaauguuauuuccauaauaugaaguugugaggucaucaaaaucagacauaccuaaaauuuuuauaguccugguucuuaguugaggggggcaguauaaacuuaucaaaaucuugggaauguuuaagaagcacaaacacauuucucaccuuccuuuuccccacaaaaaccugugagaaccagguuggauggugaacacugguugaauauguugacaaauaaacuucccaggauucgacuugacucugucccaacccccuaaccccccugagcaccacugaccugggacugaucaucuccuugucugucauggaauauuaauuggacauuaagauuuuuagauuuuuuuuuuuuuugagacagggucuuacucuguugcccaggcuggagugcgguggcacaaucacagcucacugcagccucuaccuucugggcccaucucccaccucagccucccauguagcugggaccacaggcaugcgccaccauuccuagcuaaugaagauacucagaaugcuuccauuuucucaugacuucauguguauuaaaaaguagugcuuacaucaaauuucacuguagucacuaucccauuggcuuugauuaaauuacaagcuucuguguagaaugccgugaaagguuuuugcgaauugcaguaauagccauggggggugggggugggugaugaacauguuuucugcugggguaguaacucagaacucuaggccuuugguacaguugauccuuaauaagacuuaguuucagguuggaaacuguuuguugaaggucaacauuuuguugcugcuuuuucugcucaaauguaguauagaaucauguggaggauaaaauuuugcuaguuguucagcguauccagaacagaguucuggcaguuaaggcguacaauacucuuguauaccucaaugauggcgcuuuuuaaacauuaggguaguuuuaaaaaauugcaauaaagucauuguaauucauagaccaugcuguaauacagagauacguguaaaauacaaucuguguaccugauugcagguaacagaguuaaauguaccagcaauuucaaacacaguuugauauuuccuauaauaaaauauaauguaaaaaauuaaauauccaauaucaauggauucuaaaugguuuugauauuucuuuuuguccuuucccaugaagaguaauuuauuucccuuuuuaaagugugggcagaaugauuacuagcgcacuguaauguaauuguguugcauugauaaaauaaaaauuguccuuuaucuguguccugauaauguucaauuuacaggcuggcuucucugccaccucuucagugcuuugaguauuccaguucuccucccuuccugcucugagagcgcacagaacuguuugaaauccacugguacaauugucaaaucaauuauucauucucugcaauuaugcucgcacaaagaacauuuugcuggucugaaugaugauuaaauuaacagcuauuccagcugccugauaacaucuaauagaauauucauaagcccaaaauggaaugaauuaucuccauuaacuucaucaugcucacuuaauuacaugcuuguuauuguauuuacaccuuguuagauaccgcugaagcugauccaguggcuggccgggaauuggaagcgucugucauggggcaguuggagcgcguuuuguaggaaaugcuauuuauuuuaaaugcuccaccugcugggagccgagguuagucagcagcacugagaugaauugggaaacgggguguaaaaagaaauaaugugcuucugacaggcuccguggcuuuuaaguugcucucauucagccacuucacaaaaaauuauuuuauuccaucucucagugaugaugacaugauugcuuuuugguaaucauuuaccauucugauuuuauuuuuugaaguaaauugucugaaguaauagguucuuggaauuacagcgugccuugcuuuuuucuuagaacuuuauuuaagcuugucuuccagcauuuaacccgaguccccucuuucguuugaucuucuaacuuuauuuauacaacagugcuuaaugauccugcacaauguguuucuuuuuuuuuuuuccuucucuacaaccuccccccccacacccacccaaaaaaaaauucuguccaguaugguugacaguacuuuuuauaaccucagcaagggggcugcaugggcaauuuucuuccgacaugacaaaugcaaacacccaaaacccaacccugagagaaucacuucauccaguugaaaggaaauuuuuuaucucuuucaaggugacucuuuugccacugaaacaugguaaggggcacgacucuuaccuucuauucuugucuauagaaguggcauucuuuacauugcuuuauucugucuccucccuucucgcaucggccucugcucuuccccaaacuuccacugaacaacccuuccugguaguugggccccauggcaccuccauuugcuuugagugugaagggucacuguucaccaccaccaggcugcagcaagccuguguuuauugaacaugaaccagaccaaugguggagagaauuauaaucacacuucuaaauacuugucagaucagccuacagccuaguagagcacuugagcuaaaccauggauauuuuauucuucuugaaggcuguauuuugguaucaacauaaaagaagaaaaaagaaagaaaacugaagauaauuauuucuaaguaggaauggaacuggauaguggacuaacagacucuucaagccuucagaaauauuuuagcaucuaagaugugauuuaaugggugagaaugguccucuaggcauuggcuaauugauagacacauugaucacugugugugccuggcacugugccuugugaauuuuuuuuuucuaaauaagaauugacucaaagauuauuucuuuucauuucuuacuuugagaaauguuuauguacuugccauuugauuuggggcccuaaaugucuuugaguuuaaaauauggaugucacuugaaaucuuucagguacugugcauagccggaagcucaguuauauggaucgauauucaggaaaaaggcaggccagaggcuccagcagcucucuguaggucggauggcucuacguguagagagcguagaggggugcaguuuucuuucaaauuuuucuaaagcuuccugcauuccaccccuuacugcaaagcucacguugcauugagggagggaggcuauggauuggaaaaggugggagaacugagaacuguauggugggaagccaugcaauuaaaaaacugacugaaauuauuaccugauuucauaauugacagaauauuuaauucagauauaguaaauugacacaccucuacacagagacaauuaugacugacuguauaacaccugacagaaucaauuauaacugacuguuguuugauaccuuuguacagaaauaaaugaaacagacauucagaacagagacggcugcugccugugugccuaagccugccuuaauuaaaagaaaauaaccaguaggcgauguuaaaaugucuuugccucgugguuucuaguucaguguguuucuuuaaguccaaaaaggguuuuauaaagaguaaaguugaaaagagauuuuugguuuacugacauggaacuaaaauaugugaaguagaguuaguuuccuuagaugggagaauacuccauuauuuuaauagagcuagcauuuuauuugaucaguugacuuuuauauaaaauauuuaagaaaggucaaccuacagaugauggucuaguucaucccauauagaaaagaauguaacuuucauuauuuugagguuuuagauucuaaucaauagaaaucaacuuuuaaaugagcaguucauuuuguagucugauaaaauauuuugugaauaauuaguaucuaggcuacccuuuuuuuccaucguuuucauagggguuagggacagaauauuuuugguaauuaacauauaaccacagggaaucagagcauguagaaaggaucagaguaaauaagcuuuauauacacguuccucgaauguuauucucaagaaaaguuuaaaaaggagauuagcuuugcugauguauuaagaugagugauuucugggugauacuucaagccauuagaguauauuucagugacgcacuuguguguaggaagagcauuuccuccccgaucucgacaaagguuggcuuuguggugcugguggcggagacagcaguuaccagggccaguggcaucucuguggacagggaugggauggcugcggaucuucucuggcucuugccuaauggcauguuggaaucuuuuaacaguuguuauugggcaccugaccugcagcaccugaggugauggcgucguuacugauaggcugacucucaaaaucaaagcaggaaaaggaaucaggguuuuacuggccacauuaacuggccuccaccaguuaacaccuguauuuucccuugaguucuaaagugguggauauaguauugacagaaacaggguaacaguuuaaugugaggccuaacguggguggcccaggugccuaaagggggaagagaaaaaccaggaaggggugacuccuuccccccaccagccccugucccugacgcagccugugacagcuaguccaguucuguuuccuagaagaccuuccauauguuauugauuaaauucucuuuggggaagcaagugggagcuuuuaucugcaucucuaacuggcguggaauggugccuuggccguauugacuggcuaugggauaugcuggcggucacaguugucuuuuaggaggaagagcaccgagugacgcugguugucauucuaacucugcuguguggcagcguaaauaguccccuuucuaaccaaccuggugggaaaagucaauaucccaucagcagaggagguaaacacaucaggagcuauguccucucuuuuccuccccugcuccguauuaccgcagcucuuuaaaugugcucuccccagucaucagaugcauuugugucauucacaugcacgggguugcuggccuguggcucuggccugccgggaggcagccgacacugguuggggccauuguuguuuauucccagacucagaucauuagaacuuucaaauugucuuucuguugcagccccccucucuuuuuccaccccuuuugggcauuuuaauucucuauaaaaccugugguuguucuuuaaaggacaacuuauguaauucagaaaagguuguggagagcaaaugcgaauguauagccaagaaacaaaaaucuggagucugaguuuucguuuuccggguguuuuguagacuucccguguugcuguuguuggagguuugcuuucugugaguggcgcgcucuccccuccguguuuccuuccugaccgguuccuaucgggaggugcugggcagccuugcugcucccaggcccuuuggcacaggccagcaucuuaugggggcggaggccucaccucaggaucagcugaugucugaggccugcaaauuucuaugugggaguagugauguaguggcagggggagugggcagaagugagccucuccucaggugcgggcuggggguucuggcuaccuggguuugcgugucuacaacucugauuaccugcuguguaaccuuggguaagugacuuaaccucccaguuuccucagccaucaaauggggauuggggguggggggggcgcggggaaagcagccucuccagacaccuuaccagguuccugaacacagcgucaucccccacgugaucacucucuucacccaaaagaucagaccugagcaucacagccccacugcuccuuuaaaagaacaacauguagggccgggcgcaguggcucacgccuggaaucccagcacuuugggaggccaaggcaggagaaucacuugaacccgggaggcggagguugcggugagccgagaucgcgccacugcacuccagacugggcaacaagagcaaaccucugucucaaaaaaaaaaaaagaaagaaaaaaaacaacauguagaaguagcaggcucugggaagggaaaggagaggggucuuuucucuggcugguagcauccugcucagaagggaaaggccagggaugaauggguuaaaggagcaggagugccgcauacccugaguucacacaguguggacaaagaagagcaaagaaaucuuggccauggacagacaggugcccucggggccgcucaccucucgccucuuucagcaaaggaaauuuuguuuagcagagggacuugggcuggagggacuagaaaaugcuuacuaggcccagcugaucuggggaguuggggcuggaaggcaccagaggccauagcucccuuugagacuagguguuuccugccacguccagacuucgcaagcaguugcaugcaugugcucgcagcgccggugaaaguggcgucugcgaguagagcucaccuugucugcugcacaugagggugcaccugcaguucacaucaguagaggguggcccugucccccagugcacugagucagcuaggugcugagaggcggacagacaggggaaaggaagaaaagcuuucacagaggaauggucggcgggggcugcaucugacuggccccagggguagaccagagauaagaugguggagauacaaauggaaucagcauccccuucucugguggaauacugaauguucuuuaaagaaacuaccugagacuucuaaucucucucucucucuuuuuagauaaauugaagaagcaauuuuuuacccccaaaguucugcaggacuacagaaaacucaagaacacagcagagcaauucuugucccgaaguggcuacuccgaagugaaucugagcaaacucuucgcugguugugccgugaaauccuaagggaaucccaggaguaaccaaggaggggguaguugaaaaaucccagcuuccucugugccuccacucuggcccuaaaugcuccuccagcaucuguuucucccuugggacugugucucauguuugugugaauguagaccaggaaagggggcugcaaaaauguugagucuaauguucguaagcaucauagaaauuccugucuucauauuaagauguacugcuuuaaaacacaacuccagagccccuccccaagcuccccuccccaagcuccugaagacccgguuucugagggagggaaauugcuacuuggauugagaguagcuggaauguaagugaccccaggcuuugccucagggccuuuagccuaugucccccccacauaaagagagcuucucagagccugacugaagagcugacguuuugcuuuuucauaugccaauuaaacccggucuaaauccaaaugcuucuccagccauccaggaguggcuguccuuuucagucuugucuuuuauauagguagcugagggggaagauuuagaagccuugcacucacuaaauagauuaaacagagcaggcuuguuuguugaauugcuccaaaguccaacagacacacacugagcagguguuuuacacucacauucccuuuuugccccuuaaauagaaagugcagguaaagguuuauacaacaagaaagcacauugaaaauaauuugauacucuaacaauccauuaacauguguagggguuacggugaggaucacuguguuguauucagaaaaacggggagagggaugcuuaauuggcccuggcgcuugcuauuuuuuucucauuucuucacaauaggaccgucuuuggcagcagcaaaauguauuucaguauggcagucuuuccucucuuacauuauugguaagauuauacuaacaaaauguuuccccuuguacaauuaugcuguguuuuuaaaaaacauugaccuguguguuuuuauaaaagaaaaaguauguugugccuucuucuuaagaauaaaguuuucuaaagggaaagcag

SEQ ID NO: 19070 - RNA, 114877 nt, Homo sapiens
aaagugcaauucugcaucccuuuauuuauaaacgaguugagaauggugugguccauuugagagcaagaaugggauaggagcaggggggcagggggcgcgcagaguugggggaggcugauuccaguaguucgcguuauucagcaccagaguaaaugcuugggcauaaggucgugcuuuaacccagacaggucuugucuuauauguacagcauagucuuaaguauguaugcucuacuuauggcuuugucccuggacacaucgcagugacacaacagaggaaaacuagaaagaagucuagagaggagaaguugcaaaugccucaugagcuauuucuuuuuuaaaaaucugauggccaagacuagugcugaacggaugccuaagaaacaggcacaucucugcuagagacgggcucaucugcuucagcugagccagugacaccgucucgcaucucucccugggguaugacuagaugcuaaaauaaguacugaagacggagagaaaauaaauccgugcucuuccugucccucccucagggggugaaauaacaguaucuaguagccuaagagcaaaacugaaaucccuaagcugugucucuuccacucagaccagguuagaagccaggccaaugucucacguccugcuccucuugagccuggcauuucuuugccuugguaagguccugacacacaggagcaugcuugccagaagcaagucguucagugugacuuauggcacagcaaucccacccuuguuucuuagcugguggaggggugaccaguucauuuuaggguccccauaagcagcuaauauagaagugcugaaaugaagcaaccagagaggcagggaccccauauccugcaugggcauuugcuaaccuugguugugcguaaaaggaacccuucccucuucaccugucagggggugaguuaacacuugaaagggagcggaaaaucggcuggacgccguggcucgugcucauaaucccagcacuuugggaggccgaggcgggagaaucaccugaggucaggaauuugagaccagccuggccaacauggugaaaccccgucucuacuaaacauacaaaaauuagcugggugucguggcaggcaccuguaaucccagcuacuugggaggcugaggcagaagaaccccuugaaccugggagguggaggcugcagugagccgagauugugccauugcacuccagccugagcaacaagagcaaaacuccaucucaaaaaaaaaaaaaaagaaagaaagaagaaagaacaaagaagaaugaaagaaagaaggaagaaagagaaagaaaaagaaagaaagaaaaagaggaaagaaaaagagaaagaagaaagaaaaagaaagagagagagagagaaagaaagagaaagaaaguaaaagaaagaaagaaagaaaagcggaaaaucacuacccuccugcuccccuacaacuucagucccacuuucucccaucuucauaagcugcccccuucugcaguccuaaguugcuauccuccagcccucauucugaagcuuccuuuccucacuagggcaaaaagaaucucuuuccuugcuuuguguuauuccugcuuaccccuccaagcuuggggcauauuucucauuccagccuuaacucacucuuggccauuacaguugaccugcuggcccuaacaaagugcaacccggucucugccugggagcagggaggugguguggggguaggggcugggagagacugagagauggccaaaaaguaucaaaaguuggguuguagaauccuucccauuccuucucaguagauuugcagccucaagaggguggaacggggggacucacugcagguuaggagggugagauuuagaacccauuuaugugugguuugggcucaucccuggaauaggcauuaguuauuucccauaauuggcagcaauggugacauuaucugaugagucacguaaguggcaccugucaguauggcguguaaggccugcaaauguauagucagccugauacacuauuugcuccagaguauaagauucagguaaaagugaaucuaucugcccugggccauggagcaggggcacaaaggccuucccaagagagucucaccuguaaagugagguccugaaaugguuuuaugagagcagauuuucuuuauccuccuuuccucccuccaggaacuucuuuccuccuuuucucuucccuuguucccgccaccuucccuugccuggcuggccucauccuucacugcuacaagugccaacuaacucaaaugguaggcagacuugcauggcuugaccugagugcaugauggaagacagagaccaaauggaagaaugaggcccuugucccucucugaagagcaauauucuggguggcccuugacugcaaaaagaaguuuucuucuucacaugccauguuccugccagcccucugucccauaugagugcuucccagaguccuggagaaggaaagugccaagaacaaagagguuccaagccagcucagccucauaguuuugcuucacagcagacagcacucaucuccaaguggauagggagguaguucaaccccaacaagaaggggaaagacaugccgccuuccuucacugguuguccccuugucaccuagaaggcugguucccaaggccucugaaaagggguauuucuaucacaagagauucugggcucugccuacaaguugcugguuugggccucuauucagucagaccccagcucugugucugaauuuacuggcauacccauacaauaacccaaagaguuugguucuaugccuuaacucucccugcucauuucgcacaggugacuaaggagcaggaccuuuggacaacucagcaggaacacuuagagucuucauccuacuuggcaaaccuagggccagagauaauggugauacuaccuagaccauucagaugcugagaucauaacugagcccacaguucucuguaaaaagucuugaguucuccuucacccaaaaauguuauaggaggccacgagaacaaaauacuaauuuccugguugggauaaaacguuuccacaggaaucuggaauaagcuugacaaagugcccaagucacaagagaacagauguuucuugagaccaaggauuucagaggaguauuaugguggagcgcaggaguggggucuauuauaaaaugccaccacuauauacucauauugcacaugggauacacccggggaugacauauuggagcauauauagaacagauacgugcagguagcacccccuauugguauacuauguuugauaccucaaacuguuacuugaggucuaugaaacuguuaacuggucagaaaugggaaaagccauuccauaauagcauccuuuaaggagaagcuucaggagacauuucuuguccgcuaaaccuggaggcaaagcaaagcagcuccucuuuuuuauauauuaggaaguuuuucuuuguugcaguucccacggauuaagguaauuucugcaaaacaaugaagucaaaccagugaugagaaaguacaaccaggagcacaucaggccuuacguggaguucuugacaaaacuguccuuugaauaaaaaguuaagguucacacuagaugaccuuuuauaaccagccuaaagcaaggcuuugucuaugagccacauucauggaacuggaaggagcugaugcguuccaacaucaggucucaguggcuggacugaggagguuggaaucugucuuuuucucgacuauuucagaagcacuuugccaccucuauuggaaacaauuuuauucuggcagagcugggguggugggaggcaacgugcaggacccuuauggacgcagaaguagcagguugagggaacagccgcugccacaggugguuuacuuggugggggugguggaaggaccaaagcagaagucaccccaucagugcaagucucucuagggaacucugcauccuuccuuagcaagguuagagugacucuagacgcuaagguuuguguagguuguccagcuagaagucucugcaccucgcccaacucuucagcuguacggagagugagagagaacuggucccaagaccuucccuuagcagaguucagggucucucugcugagcugcagcuccugugacuauuacccuucaaacaccacccaggcaacccugugacucucgcccuccuccccauccugcauggugcggcucuugccucccagcagccucuacuuuucauccucaucccccucgcucaugcugcugauagaggcugaggcugcuuugggugaggaagggggugagguuuugaguggaagccaugagaaggugggcgauggggagcgggaaggggaccggcuccggguugggcugcucacagggcucugcuucggggauaaggccugcagcauccggcugcuccucuccuggaacaucugcuucuaaagauaaauuggagagaaggcaucuguuaacuuugcaaucugaggcagcagcaaaacaaaaagguaaggcaggcaggagagccacuaccccaaaacuccugagcccacaaaccuacacucauaccacaucccguguuguccaagacuauguauaguaaggaaccgagugauauucagggguagugacagaagauuacagucaccacugguucuuuuuuucucuuuuuuuuuuuuuuugagacagagucucgcucugucacccaagcuggagugcaguggcaugaucuuggcucacugcaaccucagccucccagguucaagcaauucuccugccucagccucccaaguagcugggauuacaggugcccgccaccaugcccggcuaauuuuguauuuuuaguagaaacgggguuucaccauguuggucaggcuggucuugaacuccugaccucaggugauccacccaccucagccuccuaaagugcugggauuacaggcgugagccaccaugcccagcuaccacugguucuuaacacucuuuccuucuuccuuuuuuuucuuccaucuacaaaauuuaacugagugucucugacuagccaggcaaguagucaugaccuacggacuggagggguggcagaaaacaaaaccccugaccucauacccucacagauaugaggaggaaucacacaauaaacaaaauaugguaugucagauggaucuguggucugugagaaaaagagggcgagaggauagcaaguggggcugggagcagggcagcugcgauugcaaacagggugcucggggaaggccccacugagaaaacgcuucuugagugaagaaccuggaagagauaaggggagggaccaggugaauggaaaucagagggcagcgcacuccagacagagcaccccaagaaaggagcauggaacgcacacccaggaagcgcaggcagggcaccgcggcugccuugagggcugauagauggggaggagcugagggaggcgguugggaagagguugccagagaaggcacagagggcugugccauggagggccuuggcagccauugugagaacucugccuuucagucugaggggacccaugcaacaggucccaggagaggaggaggccaucguggcaguauggagcgagcugguggggaagggagagggggaggcacugcgggagaucaggccagagacauaucaggcggcaguuucacguacagucuccucugagaagagaaaccucuggagaauucugagcaaaggauuaacaaucugcugcuuguuuucaaaagaccauucugacugcuguguugggaacagauggcagugaggcgggggcaggaacagggagcccacuuaugagcccguugcaauaagaauccaaggccaggcgcgguggcuuaugccugcaaucccagcacuuuugaaggccaagucgggcagaucauuugaggucaggagaucgagaccauccuggccaacauggugaaacccuuucucuacuaaaauacaaaaaauuagcugggcaggguggugggcaccuguaauccaagcuucuggggaggcugacgcaggagaaccacuugaacccagaagguggagguugcagugagccgagauggcgccacuguacuccagccugggcaacagagugagacuccgucucaagagaaaaaaaaaaaaauccaagauggugauggagccuggcccggcccgggaugauggcagugugcugaaaaauggcaggauuccuaguauauuuucccccauauuuuuacugagguauaauaaacucacccuuuuuaguguacaguucuguuaaguuuuuguuuuguuuuguuuuuuuguuuuuuuguuuuuuguuuuuuuuugacagagucuugcuggagugcaguggcgcgaucucgguucacugcaagcuccgccucccggguucacgccauucuccugccucagccuccccaguagcugggacuacaggcgcccgccacccggccuggcuaauuuuuuguauuuuuaguagagacgggguuucaccguguuagccaggcuggucucgaucuccugaccucgugauccgcccacuuuggccucccaaagugcugggauuacaggugugagccaccgcgcccggccaguucugugaguuuugacaaugcauacaguugagugaccaccacugcaaucaaggcauaggagggucccaucagcucccaaauucccucaugacccuuuggagucuccccucccccagccacuggcaacagauguguuuucugucccuacaguugugccuuuucuagaaugucaucaaaauagaauccuacaguauguggucuggcuauguuuucaugguagagccaacgggacucacugacagaugggacauggggugugggaggaacgggaaucaagugacugcagucucggguccaagaaauuggaaagcagugaugccauuucccaguuuggggaagacuguggggugggaggagguuucggugguuaagaucaguuuaccaguuugggaccucaugugaugguugcugggugcuuucagaauugagcccuucccugaagcuccccacugggcccccagugcucccagccuacugugccugcugccugcugcucagccucccagacgcugcaucccaccaacuccugagcauccugccugugcugccuggggucuuucaauugcucacauuugagccuuagcccccagccacucaguucaauccuuugauacaaaacuggcccugaaagccaauucuccuauuuaccaucuuaggcuuugcuuguccuuuggguuauucauuuuacaaaccguuacagagaucuucuggggaccaggugcuacacaggaggaagggggggaagaagaggguagaagagguggucaugucucagcugggucuuugauaaugcccaggaagagguggguggagauggggaguggguccaugggggcuaguagaggauggccuuucuaaacagagcaugcuaaguaaggaguacuaagucuaaguugcuuaguguggccagaaccccaaaugcccaugggguggcaauggucuggaccuagagcaccacaaggagacuggauuuccuacucaagaaacccagaaagauuuuaaucaagggcggagucugaucagaucuguguuuuagaaauaccuuugggugucagcauaaaagcaaagaaagaaaccauaaaggaaaacauugacauuugacuacacaaaauuuuaaaacuucuguaccucaaaaaaaaaaaaaacaccaugaaauaagaaaaaaggcaaaaaauaguggaauuuuuugcaaaguuuaccuacaaaugauagaucucgguauauagacagagcuuauaaaucaaaaagaagaaggugaaaagcuuaguagaaaaaugaacauauggccuguauagacaagucacaagagaaauuuguaaaugagcuagaaaaacuguucagcaucacuaguagucgaacaaaugcaaauggcugaaauaagauacauuuuauauaucagauugcuaaaguuuuaaaaauuuguuacagcuagugagggcucaggaaaagggcuaccuucauguuacugcugguaagaggauaaaacagcaaugccuuucugauggggaauuuggcaauagaugcaaaaacuucuauuuucugaggagauaaucagagauguaaguaaaucuuuauuguguaugauggacauucaaugcaauguauaacacacaacacugcaaauucucuaacuagguuagaaaaaccuguacaacuccaagaugauauaauaagcagaugaggagaaucagguucuuaaauaauauuucaucaugugagaaaacacucaugagcaacugcaaagccaaaaugauuuuagaacacuauguucugcaugaucucaaguuuguagaaggaauguacauauacggagaugggaaacagaugggagugauaacccgaaaugcuaacagagagacugcucuggaugaugagacugcgagugauuuucagucccuucuuuacuuucuaaugguuauauaaugaauauauauuacuuuuaucauaaaaaagcaucacaguaggaagaaagaacucauguaacccaugcaaggagaucaggcggaagggcagguguuacaauaaugacauugguaaggaacuauuaaggccacaggcgcaucaccaauagcacugccugcccccaacacucauuuuuccuuucuaagcucuagcccguuacuuuguagagucccaaguuuccucuagcagauauaauaacagaugauggcugauugcucaggucuuuuccagauuuaaaauuccacacgucugcuaauauaccaauuauuuaccuuccauuaaggcauugauaauucugccaaaagauaucaagccccccucaaagucaaacagaaaaaaaaggugcaguacaacagcacucccuuagauuaaacccauuuaugaggcaaauucaaaugcuauaaggauuugguggucuauuauuaacagcaacauuuaaaaacauucuugaacuucuagcaggcacuuuaaaauauguguuuuuauuacuguaaucuuuaaguauauuuucuguggcagccauuagcccuccugcuguuaauggauugucaggauuuccauuagaaguucacuuucuaagaaaucuacgacuugucuacuauaguuugaaucaagcucauagcugagaacauucugccugaggggaugaaagaacuugaaucuuuaaugauaaacaacggugucgcacuucauaaaaugcaauauccaugcaaaauaacucccagccucaauuugccagcucucugaucuguuucuggugcauuuugaagggugguucccuugcaaaggagcggaauucaauacagucaggagacaguuuguaaugagcuuccugggaagaaaagcacuuuagaaauauaacaaauaaggaagaguaugcauggcauuuuccaagaguaaagguauuuaaauucagucucucacuguauuaagagguuuccauuuauaauguuuucccucaagaaaauaaucccauuuauaguccuguccauacgaaaguaguuuucuauuucucuccuaugaaguuuucccuuuuaagaaguacuuaacaucggccgggugcgguggcucaugccuguuauuccagcacuuuaggaggcugaggcgggcggaucaugaguucaagaguucgagagcaaccuggcuaacauggugaaacccugucucuacuaaaaauacaaaaauuaccugggcaugguggcgggugucuguaauccuagcuacucaggaggcugaggcaggagaaucacuugaacccaggaggcggagguugcagugaggcgagaucaugccauugcacuccagccugggcaacagagcgagacuccaucucaaaaaaacaaaaacaaacaaacaaaaaccagaaguacuuaacaucuaguggggcaauaaaugucuugacaaaugccuuuaaagguuucaguauuucagaucuauucugguuuaucugccgaaaagaaaugauaaaguuccugguacgaucugguuugguuuggcccuuggguaagcaagaugaaacucaaggagagaaaagggcccaugcuucaguucuggccaaaucaauaacaacuaacccuuacacggugcccgacacaggugccaggcacugcucuaagggcguugaagugugagccagucugggugcgauggcucaugccuauaaucccaacacuuugggaggcugaagugggaggaccgcuugaguccaggaguucgagaucagccugggcaacauagugugagacccccaucucuacaaacaauuuugaaaaacuuagcugggcauggugguaugcaccuguagucccagguacucagguugaguggggagagggccuaggugggaagaucgcuugagccugggaguucaagguugcagugacccaugauugugccacuacacucuagccugggcaacaaaggaagacccugucucaaaaaauauagauuuuaaaaaugaaguaugaaccaauguaauccucgcaacagcccuauguggcagcuaugcuuacuuuccccauuuacugaugcuaugacuaagucccagagaggcaaaugaacuugccuuaagucaccuacccagagagugacccccugcucaugaccaccucucuuguaauuagccaguugcauaauaagaaacuuuucauguuuauucacauuuuacuuguaccuuuguuuaaggauaaaaauuuggggccgggcgcaguggcucaugccuauaaccccagcacuaugggaggccgagguggguggaucacuugaggucaggucaggaguuugagaccagccuggccaacaugguaaaaucccaucucuacuaaaaauacaaaaauuagucgggcaugguggcauaugccuguagucccagcuacucaggaggcugaagcagaagaaucacuugaacccaggaggcaaaguugcagugagccgagauugcaccauugcacuccagccugggugacagagcaagacucugucuuaaaaacaacaacaacaacaaucuuuuuuuaaaaaaagauaaaauuuuuuaaacugucaaagucucaggugggaaaucuaaugcagauccacaaacuauauuuuguagcucuuuucucaaaaucaaaaaucuuaaaaauuagcagugccuaaaauuaggacgauuauuuaaaaaaaaaaacaaagaaacagaaaauaacaaguguuggugaggauguggagaaauuagaucccugugcauugcucguggaaauguaaaacugugcggccacuauggaaaacaguaaggcggcuccucaaaaaaauuaaacauagaauuaccauguuguccagcaauucuauuucucaguauauacccaaaagaauugaaagcagaacucaaacaccaauguucacaucaacccaaacauccaucaauggaacaauggauaaaaaagaugugauguacacauaaaguggaauaucauucagccuucaaaagaaagaaaauucugacacaugcuacaacauggaugaacccugaagacaucaugcuaagugaaauaugccagccacaaaaggacaaaugcuguaugauuccacucauaugagguucauagaguggucaaauuuauagaggcaggaaguagaaggcuggcugccaggggcugggggcagaaggggauagggagcucuuguuuaaugguuacaguuucuguuugggaugaugaagaaguucuggagauggaugguggugaugguugcaggacaaugugaaugcaaccauuuaaucccacuaaauugugcacuuaaaaugguuaaaaugggccgggcacaguggcucaugccuguaaucccagcacuucgggaggcugaggcaggcagaucaccugaggucaggaguucgagaccagccuggccaacauggcaaaaccccaccucuacuaaaaauauaaaaauuagcugggcauggugguggcgcacgccuguaauuccagcuacucgggaggcugagacaggagaaucgguugaaccugggagguggagguugcagugagcugagaucacaccaucgcacuccagccugggagacaagagcaaggcucagucucagaaaaaaaaaaaaaaaaaagguuaaaaugguacauuuuauguuuaugaauauaugaauauauuugucacaaauuuguuuuuugaggcggaguuucacucuuguuccccaggcuggagugcaguggugcaaucucgagucauugcaaccuccgccucccggguucaagugauucuccugccucagccucccgaguagcugggauuacagccguguaccaccaugccuggcuaauuuuuauauuuuuaguaaagaugggguuucaccacguuggccaggcuggucuugaacucuugaccucaggugauucaccugcuucggccucccaaaguacugggauuacaggcgugaacuacugugccuggccaccagcugacgucuuaacugcaacuucaugaaagaccgagucagaaccauccagcugggcugcuuccugguuccugacccucagagacugugagauaauaaauguuugucguuuuaagccaccaaguuuugagguaauuuguuaccaccaaaagcuaacuaauaggcauggauaccacacuuucuguuugcugagaaagccuagagacagcaguacaguggagggcugagagugccuaucauaaaucuagauggccuggucucaagcacaauucuggcaacuggcauugucaaaggccuuagagggauguugguagaccucaguuucucuacagugacacaccccgaccaaaggaaaaugaagcaaaaugacugcaucauguggacauuccuauggugaaggauacagacaugaccaggagaaagaggcuagccccaggcuccauccuaccgccuaccaacuccugugagaccacgggaaaguuucaucguauaauuuuguaggccuuugucuauaucuauauauuuaucuauaaaauguaccuuccugugugauuaaaauggguggcgggaggccaagguggguggaucacuugaggucaggaguuugagaccagccuggccaacauggugaaaccccgucucuacuaaaaauacaaaaauuagccgggcgugguagcacaugccuguaguccuagcuacucgggaggcugaggcaggagaaucacuugagcccgggaggcagagauugcagugaaccgagaucgcgccauugcauuccaccuggggugacagagugagugagacuccaucucaaaaauaaauaaauaaauaaaaauaaauaaguaaauaaaauggguagaauaaaugugcaaggacauugaaaaaagaauucaaccugccauacaacuuuuagacaauaucaucaucaucaccuucuuauuuacuaucaucaucaucaucaucaucaucaucacuacuuucuacucagagauagcauguaagggcuucaauuuuauauuggcauccuuaaugucaaauaugaggucacuuggggagacuuaaaagacuauggccaggcacuguaaucccaguggcucaugccuguaaucccagcaccuuggugggccaaggcaagagggucucuugagcccaggaguucgagguuacagugagucaugaucacaccacuucacuccagucugggcaacagaguaagacuguaucucuacaaaaaauuuaaaaauuagcugggcaugguggcacacaccuguagucccaucuaucugggaggcugaggugggaggauugcuugagcccagaaauuugagguuacagugagucaugaucaugccacugcacuccagccugggcaacagagugagacccugcuuuaaaaaagacuauaccacaaggagcaaauucaaauauucccuggggccagaugggcugcauaaaugugugagucagguuaggggaggggaaaggagcagcggagcaaggugugacuauggcaaacaagagcucaugccuucccuaaaauaaauuuuaaaacauuguuaagggcaaagcacaccacgucuguguacugaauuugauccaccaaacaccaaguuguaauaaaguccuguaccuagcaccauaagcaauaaaaggcuaaggcuaucuaucugcuuaucaucuaucuaucugucuacauacacacacgcgcgcgcacacacacacacacacacacacguauauggggugggggauuuaggcuuuagcacacaaauccuuugcagaugcuggaagguucugugaauaggucuucuucauacauccauucauucauacauucauuuaacccagaaacauuuguggaauacccacuauaaguuacauacuaugcugcauaccuaucucauuguaccagaacuuguaucuuaaauccuucuauuuugugccuuuccaaguuuggguuguuuguaacaguacuguauuugccgguaauacagaucuucuauuuuaagaaaugaguuccagucccaaauucacaaauaaggaauuauuauaauaauagcauauucaugaaaagcaaauuacuuaucuuggcguuuaacauccuuguaacuauuccuguauuuuuaacgucaacagaaaaaaaguaaugucuuagucuggcugauaugguaaauuaaugguaauaacaguuuugacacuaauagcaaguuuuaaaaagaaaaaccuccagucucuaaacuggguuucauuucuuaaaaaucaccuuggcuugcugucaucagacucccaagaacaauuccagcuacuauuucaccuucacugggagccugaaaugacuaaggucuauaaaguuuucaucaaauuauauauauauauauauauacacacacacacauauacacacauacacacacauauauauacacauauauacaaacacacacauauauacacacauauacacacacauacacacauauauacauauacacacacauauauucacacacagaaauacacacacauagauauacacacauauacacacacauauauacccacacauauacacacacauacacacacacacacacacacacacacacacauauauauauauauuuuugagacagagucucucucugucacccaggcuggagugugguggcaugaucugggcucacugcaaccuccgccuccugggcucaagcaauucuccugccucagccuccugaguagcugggacuacagauacgcgccaccacaccuggcuaauuuuuuuguauuuuuaguagauacgggguuucaccauguuggccaggcuagccucaaacuccugaccucagguaauccauccacuucggccucccaaagugggaaauuacauuuuuucccugccuuuacucacuccaaguggagaaaacauccacccucuugaguuacuauaccaacucuuaucagcagagacagguuucugaaucccuguaaacgaaugaacaccuacaugguuucauuaaaaaccacuaguuguuucuuuagagccuggaaauuaguugugaaaaugugaacuauuaaaauacacacuagauuaaauagaaaauuucauaccauaugucauagagacgagagaacagggucuguacuuugucuguuuuuauguucuucuuuaugcauagugccaugcauagacaaaaacauuaagaaauguaccaggaauuaacuuaucugagcugaaauuuuuaacaggccuggggaaaaugaaaaggagcccagcccuuggcuccuccacucuugccagcucuuucuaggagucuuugaaggcucaugcaguccuuguaaaccuuucaccccucucagacucagccgauaggacaugguuggccuauaacacccacgucuauaaucacuuagaggcugccagguguuaagcaaagcaucucucccaacuucccaaacauuguucuuuuucuauuacuaauugaguguuucacuuuuagauaauccuauaaugaaugagcucaaacaagcagagguagcagugacaacccgucaauaaaauaauuaagucaaaguggauuuugguagagacuucucauauuauaauaggaaauccaggcuacuuaaaaucagagaaaucaaauggaauuuuuucuuuuuguuguaggaggaaauuuuguuuuuaguaucucuuucauacaacccucgucaacccuuuagcgucucuaaaguaaacuuuucgaaucucuuuuacagaccccucaucaacucuccugauaauacugguauuuacuugggaagggcaugcacaauagaaauaccaauaaaguaccaguggagguuuccagaauuuucuuuucccuuuccauaguuaucauucaaaguuguucagauuuuaggcaaggagacccucuacauuuccucucaguuuuaagauucagaucauguccucaguccccaaagacuguugugccuuaucccaacacuugcgugucaugaaaaaccaggggaaaaucagggcacgaugggcacagaugcagggcaaacuccuacuucuucucucucugucuugcaaccaguaaaagaggagggcuccucacaagaaaaacugacugacagaguacauuucuuuggauucuccuccccaaaacauaaaugccaguaguugauccaagaucccaugauccaugucuuguaacacaagcuccgugcugccacuagcccacuucaucuguacucccaaaguuucaucauccccaacugggagacugagaugagcgacagcaucaacuccugaaguaagagacacucaagugaucaccagauggcuuccaagcucuggauaagaacuagaaacugaaaccagacguggcuuugugugcuacugggugccauauugacgaguaaagcagaaacucaguaaggaagugacauggacuugaagucauucaggcugaugccuaaaguagagggcaugcaguggaucugagauaaggggcacccuugaguggcuccauaaaaaggaggauaaacugaaaacacucaucauugugggguaaagugaaaucauuacauacccaugcuccaucagguccaaacaguucuaggaaguugccaaugaauucccuugacuucucuucccacuuuugaauuagaucauggcucuuuucuuccacucuguucacaaauuccuuugaucuuuccuccacauucuugacuuuuuccuucauuuuguccacuugguucuggaaacgguaccucuucuccuggugaaaguuuacaggaaaaaaaaaaacagauuuauccaagaggacaugagagagaucaaucauucacauuaaaguucauauuuuauuccaauuuguauuuguuccuaaccugaagagucaagauguugccauuucccaagggcuagguugauggaaaggcacaucucuuguaagaaaagucaucugccauuaauccauuuggauauguaaagggaacuacaagugguuuuaauaucuucuuucuuuuaaaugucuuugaguuggauucacuuauauaagaggagaauaaaaaacacacaguugucuuuuguugugcauagauauugggcaaauaaccccauucaauucugcugggacuuagacaaaaguaugaauugugcacacaaugacuauucagaagcugccugaguucgcuguuuuacugggauaugguuaaaacaauauugcuugaaauaagugggccauuaacugggccuuagaaccuauguguuauacuaaaauuuccacuguaauauuuuccacuaugcuaauuuaacuguauugauuuccuugguggugaugaaagcuuuugugcugauaguuucucuagacucagauuuuguucuucuuauagucuuucugcagcaaugucuacuuaugugcuuggaaaccaucguaugcugggcaagucacauaucaccucuaaaccucagucuucucaucuguaaauuggggauaauaaucaucccuaccuuaggguugcugugacaaugcaugcaaagugcuuggcacaaaggccagcauuuaguaaaugcucaguguauguuggcuguuucauuaguauuaaguggcagaggcauuugucuguguuaccugaugagagcaguauuaaaaccaugaaaauaacauguggcucuucccccaugaaaucaugauguuucuccuaaagggguaaggcuuaucauuuuucuuuacuaugugggacuaaaguucauuuuguguuucagaauuuuauuuuuuugaaauggagucucgcucuguugcccaggcuggagugcaauggcaugaucucagcucacugcaaccucugccucccggguucaagcgauucucaugccucagccuccugaguagcuggaauaacaggcacacaccaccacauccggcuaauuuuuuguauuuuuaguagggacgggguuucaccauguuggccaggcuggucuugaacuccugaccugaagugauccacucgccucggccuuccaaagugcugggauuacaugcaugagccacugugccuggccuguguuucggaaguuuuugaaacaccuggaauauugcaaaacuggguaaagaguccuugauuucgaccuuccaaaccuuccugcagccucaggcuggggcaugagcuauguguguugcuacugagagcuauauauauacauauaugugcuaugggaggucacucugucuuccguuacuuacuaggugaccuuaggugaguuguucaaccucucugggccucuguuuccucauuucuauguuggacauagucauccuacccacccuuguaggcccaucaugaggauuaaaugagauaauccaaguaaaacacuuagaugagcauaugaugaguucuuggcaaauguuagcuguugccuuuauaucauucuuuuccacaguucauucugcacuggaaauaguuacuauacauggcucucagggcagcacagaauagcugaaugagcacugggcugggagucaugagacuggggaguugcugcugccucuaccucucccugaccugaaggaccuuggccaggcucccuuucugggcucagcguuccucaucucuaaauugagggacuuggacugggugacugacuggcaucaggucccugucaccucugagguuccgugauuugucuacacgcccaugcaacacauuagauuucaucucugaacugcagccagguuugucgucacaggaaggcagugagugcauccgaacugccugcacgguuccuugagcuaaguggcuuaucuaaacgccguuuaaagagagugagcaauaacuuuugaaaauggcuugacauguuuggaugguugaccgaauucaauuugaaagaacagacaguuuaauuuauugaaauaaccagggcuuuauucucuaucagauacuaaauaaucacuuugacugaauuauguucagccacuuguuccagugccacucaaaccugacauuuuccgacauuuccugacauuuuguugcccggcuuauaugaaguuacagagccuagacucucaacacucccugccuugugaggacaacucaugaucaacgauucacaauuaaugagccccuccuauuuugaagguaccaaugaucaauugugugagcuauuggauaauuauagcugcauguaauuuuaaguaucuagcuuugaagaugaaucauccuuugaaaauacagcgucuauuuuggggguuagaauucuguauguacggaggguucuuauuuuaaucaaagauaucggcaccucacagcccaggcaaauacaguugcucagaaucacuaacaucaucuccagcaacugggcugcccucuuugcuuuuuaacagcuuguuuugcuuauuuuaaagauuguuuuuauuauuauuauuauauaaaaauggcauccugagggaaucuaagucacuguuaauguucuuugucuacuauaaagacacaugcacauguauguuuguugcagcacuauucacaauagcaaagacuuggaaccaacccaaacgcccaucaaugauagacuggauaaagaaaauguggcacauauacaccauggaauacuaugcauacauaaaaaaggaugaguucauguccuuugcagggacguggaugaagcuggaaaccaucauucucagcaaacuaacacaggaacagaaaaccaaacaccgcguguucucacucauaagugggagcugaacaaugagaacacauggacauagggaggggaacaucacacaccagggccugucaggggguggggggcuaggggagggauagcauuaggagaaauaccuaauguagaugacggguugaugggugcagcaaaccaccauggcacguguauaccuauguaacaaaccugcauguucugcacauguaugccagaacugaaauauuguuuuaacaguugcucuauuauuaaacuaacagcaguccugugggaacaauaugguagaacuacaaaaggaagccaaagacuuuaggcuuuauuuaagcagcuguaauuucuuuggacaaugaaaaauggccauuaagguuucuaaugagcaucuguaaggccuuaaucaaaugaaaauuuuaaaacguuagaauaaaaaaguuucucuggguuuagcuuucauugccucuucccuccucccuuuccuuucagcagaagauaacucuugccuuuuacaaggggcagaucucccagaaacccuucaaucaagucuaaaaacucuaaagagagaguuugggguaagaggagggaagcaaggaagcaccuuuauaaaaugugaagcucacuaccuguguucuuugguuaauuuauguuaccccuguagauacugguuuugucaucuguaaaauggggauaauaauacaucauggguuauuguguggguuaaaugagaaaauaaauacaaagcguuaaggacacugcacaggcaugguggcaaaugccuguaaucccagcuacucaggaggcugaggcaggaggaucgcuugagcccaggaguucaagaccagucuggacaacauagugagacccugucucaaaaaaaaaaaaacaaguuaaaucaaacuuaaaauauuauacacagugagaccccaucucuacacaaaaaaaaaaaaaagagagagagagagggagaacacugcauagcacuuaguaagugcucaauaaacagcagcacuggugguggugguguggcaugguggucuucagaggguuugagguggcaugcuuacauuuauaaagcugacauucaguuccuuggcuguauacccucucuggagguuacgucgggcauaaacaucauagucacgaacaauucugguaaugauguccgauguugagaugccuucuguucucugcguuggaacgaacaucccuguucaaguagaaaagagcggauagaggaaaaauuaagaucaccucaguugacccaucuccuuuaauggucccccuuuacaggacaaaguuggagcuccuggguaugccaaugaagacuuuacgucuggccccaagugacucuuccacccucaguuccguggaauuccucucuaccuuaaaugcuacauguucaucaucccagaccuguuuccaggacauaccauguacuugccuggccccugcuguuuauccaugcugagccuuuccuuucugcccuggauacccccucccugcucauauuaacugcaaagcucuuccucauccugcaaaguccagcuucaagguuaugccucugggaagucuuuucugacgucaucagguagaauccacaacauucagaaccuaacuuaucuuucauuaacaaaaauauugggccagccaugguggcucaugccuauaaucccaguacuuucgaaggccgaggcaggcagaccauuugaguccaggaguucgagaucagccugggcaacauggcaaaacccugucuuuacaaaaaauacaaaaguuagcugggugugguggugcacgccuguggucccagcuacuucggagacuaaagugagaggaucacuugaguccaagaucaaggcugcugugagcagugacugcgccacugcacuccagccugaccuugucucaaacaaacaaaaaaaauuaaauauuugucuccauguagaaaaugaacauuuugaaagcacugauagugccuuaacugucuuugcauccccagcacccaccucagccccugugucuagcacauggaaggugcucaauaaauggaaauugagugagaaaguaaaugaagacuaacaacugagucaaugaauuagaucacagcaacucugcuucaucuccaaggaagucugcucacauuauacuaaaggaaaagaagaaaaaguguacuauuugugucgucucugaucuaaaggcaugccuguagggaugguuagaugauuuaucuuccuaagaacagucuacuguacaugguaguuucaccacucaaaggcccuuucaucuagaauauguggggcugaguaaaaaauaaacaagcacagaggaugccaaguucuaauagaacuuccuuaaagucuucaaagauaaauguggguauaucaacagauauagagcuauaaagaggucacaaauauuaacaaaggcaagaaucagguuuaugcuuacacuucuguugugaacugaaaugacauguuguuggcaacugagaucuuucuaucccauaucauuacggcaacucagucagaggcaucaggcaugggacaguauggacaaagccuggggacaagggcacuggguucuugguuuguagacgugggcaagucacucaaacccucugaaggcgaguuacuuaacuguagucuccucagcugagaaaaaggugauuggacaugaugaccugggacucaucugugccauuucuuucucucucacuucccacauccaaccaaguucccaaucuacuucuuaaauguuucccuaauucacucacuuucauccauccuaaaccaauucaacaccaucuuggucaaagaucacagcaagaaccucaaaaccagucuccagcaaugucauuuuugucugccucaacccagagagcaaguucuacagagcauucuuacuaaaugcaagucagaggucugcucaaaacccuccacuggcuuucugcucuucucuggauucagagucaaauccuuaacuuggcugugcaguagcuugcaugucucuucccugugcuucucuccaauuuuaucucagacccucucccuuucacucccuaaaccaaggccccccugcuauacaacugcagggggggacugcuguuguauucuguggagcugugcaguaggcugacccugccucagcccagccaugcuggguuucuucaguguccugaaaggguugguuccccuccccucacucugccacagacacaaucuuuaccugguuaacuccugggcauccacugggcuucagcuuuagugucacuuccucaagcaaauaucucaacccucagacuaggucuucugguguguuguuccuucccauggaccacuccccuucccuccaaauacagcaagaucuuuauaaaauaacuuguucaacaacugucuuguugacuauaagcuacacuagggaagggaucaugccuuucucguccucuucuacauucucagcacugggugacaaacaggcaccauaggaauauuucuugaaugaaugacuagaugaauauugaucucuaagugcccuuccaaacccaguucucucugaauguuuccaucuugcagccccaaugagggugucucuuuggagcuuucuuuugaugucauuugcacauuuauaguaucaguagcagaguggcacugcugauguuagagacaaaacauccaguuucuuauguuccauggucagaggacaguugggguuugccacuaggccaaacacuucuuuuaucacuuucuaggagggaagaaucuaacacggaaaaccaaauggaaggcagaagauguaaccaucuaaacacacgaacauaaauagcacccaaauugacccagcugugcaggaggcucuggugggugggggaacccucagacgacauccccaccuuugugggaacaguggggaacauucuggugagaaauccaucccaucuuucagcaggcagauauuuuacccacaccccuccugcugaaauaauaagacgauucucuagugacuaauggauuuuagcaagucauguaagacauugaugccaugagcuuacccuuucuuugaagccagaaggugaagucucuguguuugaguaacugaaaguagauuuggcuuagggagagauuugcuuuggcugguugggagguaggucucugaaagaagccaaguccucuguugacauaaugagauacccggcuuccuucaaauccuaauuauugcucugcuaaaaauauucgguaaugagcaugaucagagaaccuuuuuuaucaugcuuuucagaauugcggcauuugguuauggagcuauuuuaagaagcagcaaagcacauguuaaugaaggaaacuuucaacaguaguaggcaauauuagaauggugaugaguaauguggaccuuacagucuauuuaauuuaagcuccaucuuuucauccagcuuugcuagaggauuuugacacauaguucugacaagcagagcagaguguuguaaagcuuaagucaugcccuugauaucucugguuucauuuaaagagacuuuugacuuucaaaauaagccaugauuugaguaugaaagccaaauauggaugcugaggccauuucugagcaucuuucucccaugaugaauucuggccuucucuaccugggucccaaauagaucauuacugugauucucccuccugcuaaggaaucagcagagcagauuugauggagcacaaggaaggguccuugcacauaggaaaaguuacaucgagucuuagccugugcuacuagggcaaguaaaaugcuaccugacuauucaauuuggaaagggcauuguggugcauuaaagauggcccaauucccuuccccuggaaucugggcuggccucagugacuugcuuguaccaaaugaacguggcaaaaguaacucugugugacuuccacgacuaagucagaagaagccuuguggcuucugucaagauugcuuucucucuagauauuaccuuucagcugccaugcugugagaagcccaagcaacaugaagaggccaccuguaugccccaguggcaacugcaacugagugccaugaucauagccagcauccaaggccagccacguaaguguaccaccugggagccccagcccagucgagccuucagaugaccacagcccccaccaacaucugauuacaacuguuugagagaccccaagcaagaacuacccagccaagccucugcuaaaauccugccccacaaaaucaugagugaaaucaagaggcucuuuuaagucacuaacuuuaggagucacuuucuuaugcaacaauagggaugcuggauugcuagaguuagaaaaauguuggacuuguuccuacaccuaaacaacuggaacuugacauuuuauuccccaaaucaggaaagcaacauauucuuagcucacugacagccacucacccagaaagaaaacugccaccaaaugcuuauuccuauacacuauaagguagccaaggaacuacugcccccaggaaacacugauucaagaaacccuggggauaacucagcuggaugagaaugccugguccagaucuuugcuacuguaagugaggccuauggaccuacagcaucuaacaaccugagagcucacuagaaaugggaaucucuggccccaccagaccuacugaaucugaaucugaauuuucacaagauuccacagaugaucugaggcauaucuaaguuucauaagcacuggucuauaacaaauccuuauggcaauuuuaggaaaggagcagcuggcucauaguucagaucuuacaaugacuuuaaaggguauuuaucaggccaggcaugguggcucauagcuauaaucccagcacuuugggaggccgaggugggaggaucacuugagcccaggaguuugagaccagucugggcaacauagggaaacucuacaaaaaaguuuaaaauuagcugggcaugguggugugugccuguagucccagcuacuugagaggcugaggugggaggaucgccugagcccaggaggucgagguugcagugagcuaugaucauaccacuguacuccagccugggugaaagagugagaacuugucucauaaauuaaguaaguaaaguaaguaaauaaauaaauauuaaucacgccaugcuguaacccaucuugauguaacugaggcaucugccaguuucuucuccaguuccagagcagacuuccaaguccgaaguguaugagguuuccuuccuuggaacuccucacaaacaagauugagacuugagaaugucaggccucccauuauccaaugcucuugacuucucaggaaguccuuccuaagaggaugguacaguccccaccaccagcccugcaggggauggcauggagcuucccaggcuggcccacaaggagugugaaccaacaaaaaugccaucagggagaauacauacauuuuauguaacaauaauuuuucaaaauaguauccaauguuguuuucauuucuagggaucaugucuguccugaggcccuguucccauggacacugagaacucgaugacuucagggggaggcagaugaagcugagaguacaggaggccguguucagccuucaacuucuaaaacaggcucuuuuuaaggcucauuuaaaaagaagaguuaagaaaggcaagaauuccacuaggaagagccaagcuuugaggaguauaaaaaggguauuauaaaucccagaagugucuuuugaacuauuaagaaccagaggcugaguagacucaggguacagaauguuugacuauaagcccuggaguguauauuaacccugggaaggcaugaaauuaauuaaggggcaguuuucugcucuccaggaagaagaaaagcaccucugggaguugaggggaggagugcagagagggauugggaagcggacagcagaaaugagagaacaggagugcggucugucccuugcucugacucagguucaaauaccaggggcaggggcaggaaagagaccccuuuagaaagcucagugcagggccacuggcaccuuguuuauggccaggaauuuuggaaagaaauaguuuuacagaggccaacauggcgggcaggucagacagggccugacauggcuuacugacauugccugguuucccuugcccucuaguagauuauggaggacaguuuuuaaauuuccuggggacucucuagaggaauauggaaggaagccaagauuuaagaucagcaugacugcugggcagcacaccuauagcacagggaagggaauccugcggcagaugcuguggccaggacaggccaaaguggggaggugacagucucaggccaaaguggggagaugacagagucucagaggcugccacaggggucugguaaguggggcugauggcuaagcaggucuugagaccucacaacuaaagauccccaucccaugccaggccagagugcuccagaaacuuagaucaccucaggagaaaaaggcaaaaaguuuacucuacacagucuaaguacaaaccuagaagagucugaaugauuucacaugucaaguguauuuuuuuuuucugucagcuguggaaaugggguuuccuaguuaaguuuaguuauggaaaccacuuauggccccccaguugcuccuucccacacaaaagaccugaucacgacacuccccugccucagaacaguauuugguuccauguaacuucauauggaagcaagccucaaccagcuuguccugccagucuccaucucugccucccaccuccacacacccuacacuacauuaacauguuuauuuucuccagacacgcugugcuucauacagucccaccuucgaacaugcugcccuggccugcuguauuguauauacucugccacaggcugguuauauuuuggguaauuauuuaugucugucucugcucucucucaagggugaggucuaugucuuauucauuuucucuuauacaauuccuggcuuauagaugcacucaggggauucauauauuaaacaaugacagccaaaaccauccaagauggaacgggcugccucacaaggcagggaguucuccaucauggggaauguaaaagcaucaguucugccaggagcuggcaaugaugccaagaaggagauaggagccugggucagugacccuuaggagcccauccuaccucaagaaucugaagguccaugaguaccaagaaaaggcuguaguggcagcaggcugagugggaaauggugggagcaagcugaguggagucucauugguccccaggaguggggaagauggcucugauggcacaugucaacaauggcucuaguauaagcagggagcacuagacuucuugaaaucccuaugcauaugguaacucacuauaguaucugcaccugccagauuaugguuuaauguauguaggaagguaugcauggguguaccuacagugccuauagaugagaugcaugguagauaguaaaauagcagaaaauaagccaagccauuaaaacauuuacccauuuuuuuuugccuccacauaugguaccugauaauauuacuaacaugugacaagaugacacuagaaauauggcaggacuaacuuuggacagaaggaguccagauuauuaacuagccaguuaucuaccugcuucuggaaggaaauuucuugggaguauccaauaaucucauugugaagacuuaauuaugaaugaggaaaauggcugccauuuaaguaaugggguccugcacuuuucgucugaugaccccggaaauuaagccuuagaccugaaguugagcacuuuggugcucagguucauuccuauauaaauaccuaaaugguaucugugccauaacugagccuuagcacaugcuaacaguggcuuguagaagccgccugggggacaccuaaaguuguaacucccuguuuguauacacugcagaugucccagggcagacagaugucucuuauugcaccugauuauugugaugugguugacaggugagcacaggggaaugccucaccugcuuccuuuaugugcuuguaaacaucaucagagccagcagaggaauacggaaugucaucaugagccacaaagucaaucuguugaagagagagaagagugaugucaccacugggauggaugugcaugucugcagauuugaaggggggaauggugacuucauaaugccuuuucaaaauaaggcaguuguauguuacauuuauaguggagaccugaauccuuggcugaaauguauuuccaacuauuuucauuucuaugagauaaugggaacuagaagaauaaauguuuugguuucucuccuuugcuggucccucuuucuuguccuaccccagagaguaggauuucuuggucuucuguccuucugcaucuaaaguuucuccuugagagaacucauuaauucuuugaauuuuuaucaucccuccuaugaugaggaacccaaaucuucauuuccugucccauugauggcaaugggcacucacacuuaggucacauuuuauacugugaaaaggaauuugucucuuuccucauucgauccucauaaccaccuugugaggugggcaggccacauguuacuacuucaguugggacauaaggugcugaaacuagaaaauuuguuagauuuacccaaggcuuaaagacuggagugggccgcuggggcaccaggccauguuuagcgggcugccagggcaccaggccaggugggcuuaauucccacugcaucccucucuuuuaccacuugcugucacuuuaaaucaucuuguccuguccuguccugaauuuaauucaucuuccugaaaacgagugaccccuuccaauggcacuuuuauuuuauuuauuuugggucuuggggagacccaaaccuuggaauaagccucuuuucucuacuuauuucacucacccuagguucugcugggauguguguguguguguguguuugugugcacacaugcauauguaggugugugcccaucauuuucucuccauugcaacuacaccaaauccaggaccuggucacccagauuacugacaccaacuuguaucuggccuuccucacuguaggcccccuccucuccaagccauccugcugucacaugggguauccuccuuaaacagguuuuuuuguuuuuguuuuuguuuuuuucuggucauccucaugccugcucaucuuuauuccuguuuccugcaacaucaagcaaacacuccuugccuagauuuuaaagcccuguauaacaagcccuuuauaaugggguuucacucuaccuugagagguaauuuagaguagcaguaguuaaauacuugagagguaguuuagagauaguuuagaguaguaugauucccugccccacuacuugcuggcuauauaacucauaaguuaggggaaagauucaauuaggauuucucaagcucaguacuagugacauucgggacuggagaauucuuuggugucgggaguuguccugugcauuggcacaugcuuagcuuuuacccacuagaagccgguagcaccccucuagcugagacaaccccaaaugucucaagacauugccaaauguuccucagggcaaacucaccccaguugagaaucacuggauuaaaugacauaauuauguaaaaaugcugaaaaacaauuaguacggaguauauccucaauaaauguuuauuauuauuauuauuauuaauucuauucuuaguacucaaacuuaguuccuuuuccucuccaauguauaauaacaacuucucaggguagcugugagauugaauucaauucauauaaugacaaggcccuuagcacagugccgggcacaugguaaauacucaauaaauuacagccaucauuaucauuauaaguaucccccauaaugccuagcacauguugaauauacaauagaugcuuaguaaaaaugugguagugauuacuggaaguaaaucauauuguaguuuuuccuuuuucuuuuuauucucacugggaaauugucucuucagcuauuacucaugcacauuuaucaguguucucuauucucuucugcaucguggcuuuaaaaauagaaaagaaaauucuuagaacagcuuaaucuuauuuuuuuuguacugcuuauaaaaggaaagaauagcuccuaauguggggcugguagggagauacaaagcacauaauuugaugcagaucaaaagaaucucucauguuuccaacuaauaaaaaucuuaugucaguaggauucucagggucacaaaaucauagauauaaaguucuuucuuuaaaggcugaccugugacuuucuggauaagauguguguucauuugucccaugaaaaagaaugccugugaaucgauaagcaucaauaaugacgguggugaugguggugacaaugacauuuuuggagcucuugcuaugggccagccaguguucuaacugcuuaacuaagauuaccucuuagaucuucaaaacacguccacaaggaagauaccaacaucaucccauuuuacaguugagguaagcgaguacagugugguuagauaucuuguucaaggucccacaacuaggaagagauagaggcaggauuuggaccugggcgguuuagauccagggcccacacucaaagaagugagaggauaccaguccucgggcuugggcggacgaaaggugccacaucaagcaguuccacaugacaguuccugaaguuaccucuuuuagaaauugagagagacuuugggcuuuccguagucuuggcugcagaaccagacucccuaaucuugcuacuuagagaaugugggagaaugagaaguaccuuguguuuuuccagaaacucuggcgugaguguccagggagcaucucugauaacuucgucuacguagcgacagugucugagagcuucguaucucucggcuucauucaucacggugaaaccuuugaauuugugggugagaucaucacugcaaacuaaaacaggcaaaugcauuaaaugccauuacucggcccaggaccugcucacagccacccugguucagacaaggcuucuucagcaggacaaaagaagcacagccucgcuaggugcuugucauaauuguacucaguuuuuaaagggaacaaaggauuuggagagcaaaguaagcuaaaauccaccgacaauucagaauuucauuuuaaugcuaauuacaucugcauucuccacuguggcuucuauuaaaauuauucucuacacuaccuaaugugacuuucauaucuuuuuauuuuccuaucccaccccucagugaaaauuaccauucagaaauaaaaugaccaaaugaacagacacaggagggagagaaggagaggaaccaagaggccugauuuacaggagguuugaaugguuugaacaaucaguuccaauuauuuuacuagauuauuguacuuuguaacccaagugugagacagacagacagacacacacacaaauacauauacuucuguucccuggauugagggccagucacuacacaucaggucacucaaucaagagaagaaagucauaaaaucaaagguuugaucuaguagaguucauccuuucacaucucucuuuuuuuuuuuuuuuuuuuuugagacagagucucgcucuaucgcccaggcuggagugcaguggcuccaucucagcucacugcaagcuucgccucccggguucacgccauucuccugccucagccuccugaguagcugggacuacaggcuccugccaccacccaggcuaauuuuuuuguacuuuuaguagagauggguuuucacuguguuaaccaguauggucucgaucuccugaccuugugauccacccaccucgggcucccaaagugcugggauuauaggcgugagccaccacacccggccuccacaucucuuauauuuucuagaucucagguuccugaacccucaaauggggauaucuuccacuaucagccuuagaaaagauguuucgagaacuuagaaaaaaagugcuuuuaaacaaacugaacaauaaauacuauucacuauccuaucuuuugguuggccaaggcagcuuuccuaagaucuccuaugugucaggaagaaauaucauuguggguacagucccuguuuaccaagaucccagugagagccuugcgguggccagucagaacuacccugacugcucuuugcaaugaaauuuuuuuuucuuuaaaauauuauguacuuacaauaaauucacuaauuuuuuuuugagacagaaucuuguucugucacccaggcuggaguucaguggcgugaucuuggcucacugcaaccuccaccucccagguucaagugauucuccugccucagccucccuagcagcugggauuacaggugcgugccaugacacccagccaauuuuuguauuuuaguagagauggguuuucaccauguuggccaggcuggucucgaacuccugacugcaagugauccaccggucucagccucccaaaguguugggauuacaggcaugaggcacugugcccagccaacaaauucacuaauguuaaguguacaauauguguuuaauuuaaaaauuuuaauugaugcauaauaauuaacauauuuaugggguagagggugauguuuccaugcauguauacauuguauaauaaucuaaucaggauauuuagcauauccaucaccucauaccuuuaucauuucuuugugguaagaacauucaaaauucugucuuauagcuauuuugaaauauacaauauuguuaaccauagucacccuaaugugcaauagaacaccagaacuuauuccuccuaacuguaacuugguacucguugaugaacuucucccugucccccgucaucuaccuuccccagccucugguaaccacuguucuacucucuguuuccaugagaucagcuucuuuagauuccauauauaagugguauauaaacacaaagaaauacuauuuagcuaugaaaaagaaugaaauccugucauuuauggcaacauggauggaucuggagguuauuuuguuaagugaaauaagccagacacaggaagacaaauacugccuaaucucacaagauguguuuuaagaacaaaaauaugaucauuuucuuggaacugaaugaugacccacacccagaaucaaaucuggccacagaguaagcacagccaacagucacacucagcauccuuggaaaaccuucuuuuguagucccuucacauaauccacacccaagccaucaggaaaacugcaggcucugccuucaaagcacacccggaagccauguuuuucucagcaccuccacugcucccauccccaccccuucaucaucucucccagggaugacugcaguagccucuuaacugaucuccugauuccagccuugcccacucccaacaaccuauucucauuggccagaaugagccuguugaagcuugucagucugugucauucccaaauucagaacccuuccugucucauucagaguaaaaccaaaguccuccaguggcugacaagaccuacgccucugcccacuccuugccucccugaccagucuccuaguguaucccagcuccccggccuugcaguuucuugaaugcuucuucucagguccgggccuugcacuauucuccaaaccuggaauaguugugcuccaaauacucauagagcucaccuucuccucucccucaagucuuucccccuacccucuucuuuuuuuguuuguguuuuuuggacagaguuuugcucuuguugcccaggcuggagugcaauggcacgaucuuggcucacugcaaccucugccucccggguucaagcgauucuccugccucagccucccaaguagacccacccucuucugaauugugauccucugcugcauuacuucuccccaugacacuugucucauguagcugucuuauuuaguuuuauuguugguguuccccuauaaauuccccgagggcagggacuuuuguuucauuuucugauguaccauaccuggccccuaguaggcuuuuaacaauauuuguugaaugaauuaacaaagccugauacauauagauacucaagaaauauuuauuauuauuuacaauaauagauuuauauuuaucuacagguuccuucuuuuucuuuucuuucuuucuuucuuuguuucuuucuuucuuucguuucuuucuuucucucucucucucuuuccuucuuucccuuucuuucuuucucucuuucuuucuuuccuuucuuucuuucuuuucuuuucuuuucuuuucuuuucuuuucuuuucuuuucuuuucuuuucuuuucuuuucuuuucuuuucuuucuuucuuccuuucuuuuuuuguuuuggacacagagucucccucuguugcccaggcuggagugcaauggcgcgaucucagcucacugcaaccuucaccuucuggguucaagcaauucuccugccucagccucccgaguagcugggauuacaggcaccugccaccacaccuggcuaauuuuuguauuuuuaauagagaugggguuucgccauguuggccaggcuggucucaaaguccugacuucaagugauccaccugccucagccucccaaagugcugggauuauaggcgugagccaccgcgccuggccuacaggaacguuucaacaacauacacgcaaaggagagacuaaugagcuucuagaugcauauaaauauauauauauaugccucuauaucuccuauacauacuuccugagauguuuucuauuauaaaaguuuauauuaccaaaacaacaucaaccauaugucuggccugaaaacugaugaguaucagaaucacccaaggagcuuguuaaacacauguaaagaaacccagcucacucccugagauuuuugauucagugagucuguaguggggcccagauagcucugucuuugacaagcuucagagaugauucugaugaagacaacauuugaaaacccugaagcauauuauaaauaacuugagucaagagcucugccugucuuuaaaucacccauuaugcccagaggugggggggaaggugggcaggagggacagguaguagggccauaauaacuauguguugauuuauugacuauauuaguuuuugaccccauaaacaggaauucuuuaugggccaugcaauaugauuucaaaaccaaucuaagacuuuuugaauguucuuuuaggaccuuauuaaaauaccacccugagaaucauauugagcagaaauggauuucagauucauccauuuuccauuuucuauuuuaaacagcacaaaacuaggccgugccacauccucccccuuucugaaucugcaccugagcaauuugguauaacuucuacaugaccgagauaauggccuacugauagagcacaaagaaaacaaacauccuguuuaugccaauacaggguccuauuuuccuaucccaggagugaccucaagaagcagcugaacaugcugaccaguuauugucuaaacauuaauuacgcccaaagcagcacuguuguucuugagucuuggcaaaugcacucugacaaccagauggagagcucugggcagcgguauuccauggaugaauucauugagcuaucugggaacucaugcugcaacuaaccuaugcuggcagcucacugugcucccacaggagagaaaauacaacauaggaauugagcuugggagcccaacagacucggguucuaaucccagcucugcuauuaccggaaaaguuacucaaacucucugagccucaguuaucuggucuuuaaaacauggugaaguuuugagaauuaaauuugaucaucuuuaugagcagagaguaaugcugaauaauguuagccauuuacgaauaguaguaggaaaauacgaucacucauggaucuauuccuucagauuuuguguucugucuuuucccugcccccuacuccaagcagguaugagggccccgugguacagacuccuuuguaggugcugugagcucaaguugcuaguagacagccugccuuccuggcugcuguuuuccugaagccagagcaacuugagggguauucuggaaagaagaagacaaugagagaggagaucucuccaaauugcagggaaagggccaaaugucuauggaucccacaagcagcagaugccaguggcaggaccucaagagagaugagaaugugaggcccuaggcaugggaguucuaccugggaacagacugcaggugacugaacugugauaggugcaaugaaucugcucccuucuaguaauuaucugggcucagacagugagggcagugcaaaaauagcccuggguugaagacuggaggccccgcuccuguuucuauaaacauuguggacacuuguuugacucuggggagguaaagagagcccaguaaagucugagacuaggccaggcgcaguggcucaugccuguaaucccagcacuuugggagaccgagguggguggaucauuugaggucaggaauucgagaccagccaggccaacauggugaaaccccgucucuacuaaaaacauaaaaauuagccgggcguuaguggugcacgccuguaauuccagcuacucaggaggcugaggcaggagaaucgcuugagccugggaggcagaguuugcagugagccgagaucacaccacugcacuucagucugggcgagagagugagacccugucucaaagaaaaaaaaaaaaaaaagacugagacugaauuuccuaccagucaggcaaaagggacucuuaaagaauauuuaguuccaauuaaaauauaauaaaauaaacacaaguuuguggaguaaucuuuaugucuucuauaguaguaguaguauguuuacuguuguuauuuuuauugcccuccugcgaagcagagguggcuauuuggugacucuuuaaaaauuuuuuuagggaaaaaaacacacuaguauaaauuuuaauuccuuggccuguuuuuaaaugacacaaacuuguaaauuaaaaugaaggaaaaaagagcuuuacaaguggagagucucaauucacuaaaauaaugccaacaagguaagcuugcauagaagaauuuucaaauuauuacuggcuacaugcuuaaaaaauuagaagugcagguauugggccaggugcgguggcucaugccuguaaucccagcacuuugggaggccgaggugggcagaucacuugaggucaggaguucgagaccauccuggccaacauggugaaacccugucucuacuuaaaauagaaaaguuaaccaggugugguggugcaugcuuguaaucucaguuacuggggaggcuuaggugggaggauuacuugaacccaggagguggagcuugcagugaaccaagaucaugguacuguauuccagccugggcaacagagugagacuccaucucaaaaaaaaaaaaaaaaagugcugguguuauaaucauagggcaaaaccaugacgauuguggugccuuuuacugccuaagguugagaaauagacuauaguaccuccaguuaucacaguuucugguccuuuaauaaaugauuucugacaaauaccaaguauuucuaccaaauacuuguccccauacuugcccugaccaaagugguuucaugagugaagucuucgcuccacccaagggaacuccuacagcaaaccuaccugcauauggaaaggggacccuaguuaauauggcaggcccauuuaacucacuguaagcauuuuacauguugaccacacauacaguaaucaagauccagccuuucaaccaacaacacaggacaccuauucuugaagaccucccuaacuuuccucaguauagaauugucugccauuaaguugguugguuugucauucuccagaaagacagucuaagauaaaggucuccuuaaacuacgauacauauacccucauggacacacacagacuuuucuuuuuucuuuucuuuuuuuuuuuuuugagauggagucucgcucugucacccaggcuggagugcaguggcgugaucucggcucacugcaaccuccgccuccuggguucaagcaauucuccugccucagccucccaaauagcugggauuacaggcgugugccaccacgcuuggcuaauuuuuguauuuuuaguagagacgggguuucaccauguuggucaggcuggucccgaacuccucaccucaugauccgcccacucggccucccaaagugcugggauuacaggcaugagccaccgcacccagccacauagacuuuucaaaagguauccaugaacagcuaguuuuaaacgaaucaauguccagauucaacuuccagugguacacuuuccuaauauuaacuaggucaagaaagucucuggguccaaagccaugcuuacuccacuuuacaaaagaaaggcaccacccaaaccuuaauauguugcauuggaagggguggagggcgauuuagccuucagggcaaaccaaauggaaaucucaguuagugaccauucaaagcaccaugaaccuaugaaagcuuccugucuuucccugucuuacacacauuucuguuacaggugaagccuaguguuagaaacucaauaugguagaguggagaauaaugcaaauuuuugcccaacaacuuugccucuucucccaacuauugucaaaaaacacauggaucuuuagggauaaggcccaagaacucaaagcaaaaggagcauuggaaagaaauagugaauucuaaaaaaauggcuuuuucauguagucaaggguaagcauuuuuucagcuauucuuaacacucauauugaauccuaaaaauggcuuuucucuuguagauaagaguaagcacuuuuuuccagcuauuuacuugaaaaucacuucaauaaaccaaagcuauauaggcugguacugcugcuucuuagaaaugugacuagaauauuuucuagaauuaucaaauuuuucaagauacauuggaauagacacauggguaaaacauuuacauaauuuuuuacaggcuucauacgcauuacuuaaaaaggaaguuaaaaaccuguguuaucaacuuauaucauaaaauauuuauucuauuuacaggucauccuaauucaucucauugucuauaauguuuauuuucuaccucuuuauaacaaaaaauaaaauuauuaucugccuccagaccaauuacuuuuuaauaauauaugcccccuuucuaucuuuaaauacauaggaaaaguuuagucaugguaucuacuaaagauaacuauuucuguuuuucauauuuauuugauuauucccaaaaggcaaacacuagaauuugauauauauauacacacacacacacacacacacacacucacacacacacgugugccaauauuuagagaaggaauaacaugccuuuuaaaaaucauacucuucuucguauaaauaucacauaauuuuauguauaaauuacauugcauuacuacaaauuaagugcauugauuuauugucuugucuuguuuauaacuuauuauauuagaucuacaucauuuuaaucuugacugauucuauuuuacauaauccauucuaucauuuauuuuugaguguuuuuuauaaagcuucuugaaauacauuaauacauuugaacugaaaauacauuaaugcauuugaauugaaaagacauuuucuugguuuguagguuuuuaguagguuugacaaugaggacugguuuugccaauuugguuggaugguguuuucugcaaaguuaguaaucugaaacuguagcccugagauuuuguuuuuuaaaaaagguuguaagcaaaugauaaaagcauuuuaucaaaaauuacuugauuggcaaugauguaauuaaauuacuaauauuuccauuucccaaauccuuucuggcuauaucuaguugaauaaguugcuuucaaguaaaagaauaagggauauaauuaagagucauuuaauaacucuugauauagccuuuuguuagaagucccagaaagagaaaaagcaaaugauucuaauagcuuggcaacaaauccuuuugcaggucaggucauuucuaauccauugcuugcaacaaauuugaaggaggaucuuaacaaauugucacuugauagaccauuaaaauuacuuuugauggcaauaauaauaauaaauuauguuguuauuuuugguaaauaacucagaaguucaaagaauugaguggcaucacuguaacaaacuccuuccauucuaucuacacauuugcaugaacaacauauuucagcacuuauaacuaugacaaggaaaaaauagggauaaaauugauguuaaacccugccucauucuagcagucaguuauauucauccauaaguacaucuccagguacauacuauucaucucauuaagagauacauugcuguccaaauuuaugucuauguuaacaauuauuuaucaaaguguauauaauguggugcuuugguuaguuaugcucuaauuuauauacauauuuuuguuucagagaaguaugauacagugaucacuaaaagauuugcaaacauuaaaacacaucacauuaggaaaaauuaugggagagaagcagaaugaaaauauaaguuugagggaaaaaaugaaacuuauaaauauuuaaaaguuaaaaaauagcuuguuauauguuuuguaaauuguugaugauauauuucaaagcauuauaguauuuagaugccaauagaugcauuaaagugaugggguaacaauuuuguuuuuuauuuauguauuuauuuauuuauuuguuggagauggagucucacucugucacccaggcuggaguccaguggcgcaaucucagcucauggcaaccuccgcuuccuggguucaagcgauucucccaccucagccucccuaguagcugggacuacaggugcacgccuggcuaguauuuuuguauuuuuaguagagaugggguuucaucauguuggccaggcuggucuggucucgaacucuugaccucaagugauccacccaccucggccucccaaagugcugggauuacaggcgggagccauugcgccuggcccauaauuuuguuuuaaaaugucaauauuggauuucugguuuccagucugguagguaaggagcuuaaaaguggccacucgguccugacaacaaguaaaaacugaacaaacugacaaaucuacaggucuucuuagauccaucagagaacugaggucacagggcaaaccacuacucccaaaauuggagagagaaacaggcagauagagagaauauuagcuuacuagagcagaaacccacaagcagagcuaccuccccaggaaccagugcugggauaggaaaauuuaaacugacaaaucgcuggcaccucaguguggacaagucuaagaguucaagaagccaggggacaaauacuuuuguggguuuuaccuccaggagcucaaguagggccucagagugacagagcaaaacccugucucuuaaaaaauacauaaaaauaaaaauaaaaguuuauauggaaaggaaaaagauccagaaaaaccaaauugauauugaaggagaagaaagugucagaaaacugacacuaucugacuucaaaaccuacuauaaagcuacaguaaucaagacagugugguauuggcaaaaagaacagacaaauacaucaauggaacagacagaaagcccagaaauagacccagacaaauauacagagagccagucuuugacaaaggagcaaaggcaagcaaacauagaccuuucaacaaauggaacaaauggacauucacaugcaaaaaaaaaaaaaaauuaaucuagacauaaccuuacauccuucacaaaaaucaaauguaaaugccaaacuauauguaaauguaaaaugccaaacuauaaaacucuacagaagaaaacccagauggguuucuucuggguaugguggugacuuuuuagauacaacaccaaaggcaugaaccgugacagaaacaauugauaagguggacuuuauuaaaauuaaaaacuucuguucugcaagagacaauguuaggagaaugaggaaacaaggcauagacugggggccgggcacgauggcucacgccuguagucccagcacuuugggaggccgagguugguggaucaccugaggucaggaguucaagaacagccuggccaacauggugaaacccugucuguacuaaaaauacaacaauuagccaggugugauggcacaugccuguaaucccagcuacucgggaggcugaggcacaagaauugcuugaacccgggaggcagagguugcaguaagccaagaucgugccacugcacugcagcccgggcaacagagcgaaacucuuucucgaaaaaaaaaaaaaaaaagacauggacugggcgaaaaauauuugaaaaugauacaacugauaaaggaccgcuacccaaaauauacaaagaacucuaaaacucaacaauaagaaaaaaaacagcuggauuuuaaaaaaugggcuacagaccuuaacagguaccucuccaaagaagaucuacagauggccaggaagcacaugaaaaauguucaauaucauaugucacuaggaaauugaaaauuaaaacaaccuacuauacaccuauuagaaugacaaaaguccaaaacauugauacaaccaaaugcuggcaaggacaugacgcaauaggaucucucauuuauugcuggugggaaugcaaaaugguacagccacuucgaucugcaguugaaugcucuaccucugagcuauacccacuccugguacagccacuuuggaaaacaguuuggcaguuucuuacaaaacuagacauauuccuaccaugcagucuagcaaucacacuccuugguauuuauccaaaugaacugaaaauguauguccauacaaaaaccuccacauggaugcuuauagcaacuuuauucauauuugccaaaaugcggaagccacuaagauguccuucggcagaugaauggauaaacugugguacauccagacaauggaacauuauucagcgccaaaaagaaaugagcuagcaagccaugaaaagacauugaggagcauuaauugaauauuaugaaguaaaagaagccaaucugaaaaagcuacaugcuguauaauucuaauuauaugauguucuagaaaaaguaaaacuacacuaaaaagaacagugguugucagggguuacagggaggaagagaugaauagguagagcauauaggauuuuuagggcaguaaaaauaguaucuguaugauacuaucauuguggauaccugucauuauacaauguacaucuaugaguuuggacaauguaaaauuuuauccaaacccauagaagguauaacguuaagagugaacccuaauguaaacuauggacuugaggugauaaugaugugucaauguaggcuaauggauuguaacaaaugcaucaggcuggggcaggauauucauaguaggggaaguugugccugugcgagaaaggaguauacaaggauucgcuguacuuuccagucaauuuuucugugaaccuaaaacuucucuaaaaaauaaaguuuauuaauuuuuaaaaaggcuaauacucacaauauuccagaauuuacaucuuuuauaacuacuuaaauuaagaagcagauaucuaaauuuuauuuacuuauuuuauuuauuuauuuauuuauuugagauggcgucucgcucugucacucaggcuggggugcagugguacaaucucagcucccugaaaccuccaccucccagguucaaguggcucuagugccucagccuccugaguagcugggauuacaggcaccugccaccauacccagcuaauuuuuguauuuuuaguagagaugggguuucaccauguuggccaggcugguuuagaacuccugaccucaugugaucugccugccucggccucaaaaagugcugggauuacaggcgugagccacugcacccggccugauauauaaauuuuagacaucugcuuuaaacuguauaagaagguauacagauuuuucaaaauucuuuuagagauuguggggaacaaaauuucaagacuccuagucuaagacagugguccucaacaaggauuucaucauucucuaggaagcauuuuggaaaucugugggccaucuuuaauugucauaaugguuggaggcagcuaccagcauucagugggcaggggccaaugaagcuagucaucuugcaaugcauguggcagcucugcaugagaauuuucccacaucccugcaagauuuuugaaagucccugcauaauauuuaaaauuauuugagguugagugugcuagcucaugccuguaaucccagcauuuugggacaccuaggccagaggaucacuugagcccgaguuugagaccagucugggcaacauagugaaaucccaucucuacaauaaacaaaaacagaaaaauuagccaggcaugguggcaugugccuauagucccagcuacuugggaggcuaagaugggaggaucacuugagcccgggaguuugaggcugcagugagcugugauugcuccacugcacuucagccugggagacagagcaagacccuaucuccaaaaaaaaaaaugauuaaauaaaaaacuuagaaaaauaaaauuauuugagucuagaaucugccuuuguuuugcauacaaucacaaaguauuucugcaacaguuaugauagacacagaauuuuagaggaaggcaauuacuauguacaucaaaggaagauugcacuuuguuuuguuuacaauuuuaccaagaggcauucaccauuugggaaaucacacccagacagcaaugccacucuugggauuugagcucuuauaccaugcccccauagcagucugccuauacacaggagguuagagauuccauuuaacagacuugggaucaaauauuaaauuaauggagacauaugaaauacaggaugucacugaauuuuuuuuuuuuuugagacagaaucucacucugugguccagacuggagugcaguggcaugaucucggcucacugcaaccuccgccucccagguucaagcaauccuccugccucagccucccaaguagcugggacuacaggcgugcagcaccaugccaggcuaauuuuuuguuguauuuuuaguagagacaggguuucaccacauuggccaggcuggucucgaacuccugaccucagaugauucacccaacucagccucccaaagugcugggauuacaggugugagccacugcgcccagccaggaugucacugaauuuuauuagcagagugguuagaagauauuucauaguauuacaauucgauuauuuuaaaugagaugauaagaauaagaaaucuacagagaaaagaacacacugaaauuauuuauuauuguuuguguugcccaugguugguguuuuucuuguuuguuuuagagaugaagucucacuguguugugcaggcuggaaugcaauagcuaugcagagguacgaucauagcucacuauacccuugaacuccuggguccaggugauccucuugccucagucuccuggguagcuggcacuacaggcaugcaccaccaugcccagcuuucacucuuacucugucacuguucccagaagucuacauacuauuucuuuauagcuugaugcuguauuguuuuauuuucuuccuguacuccaguccuugucacuuaccaaaggauacagucucauggucauccaaguaguucaauaugcccuugacuuccacaacccauguaauagccauuaagggaauaucugaaauucuguguaaaccuacuauagaggacaucguucuuuggauuacucaaugccccuuacacagugacccucugaaacaguuaucucagaacucaggcaggaaaaacuaguucuuccugaugguacaauucagcuucuagaguuugagagugauagaaugacuguguggcccccuuugcuauagcugcuaaaaaguccaggauuucuuauugaaauuuuucuccuucucuucugcuuuauuucuuggcuccaaacuucugcccauauuaauuucccugaguacugaaucaucugugcuuuuauggaaagccuccuuaagauacacaaaucaaaaaacuaacaugucaccaugucuucucugcuugccucacacuguugucuugacuggugagaauccugcacaaggaagacuggauguucuggcuuuugagugcuuuuauuucauucaggucucugcacaaaugucaccuccucagagaggucuucccugaccuuuauaccuaaaacaucccuccuuccuccgcccagucacucuuuucucuuuuccuauauuucuucauaguaccacuacuacauauuuacuuguuuagugggcaaugacugccucucccucagacugcaaguucucugaggacauagacagucuguuuuguucauggcugcauccccaguguacagaaaaaugccuggcacauaguaagaguucaauaaagaguuguuagaugaaggggccgggagcgguggcucacgccuguaauccuaacacuuugggaggcugagguggguggaucaccugaggccaggaguucgagaccuggccaacauggugaaaugcugucucuacuaaaaauacaaaaaaguagccgggcaugguggcaugugccuguaauccagcacuuugggaggcugaggcggguggaucaugaggucaggaguugaagaccagccugaccaacauggugaaaccccgucucuacuaaaaauacaaaaauuagcccggcaugguggcacgcgccuauaaucccagcuacuugggaggcugaggcaggagaaucacuugaaccugggaggcggagguugcagugagccgagaucaugccauugugcuccagccugggugacagagcaagacuccaucucaaaaaaaaaaaaaaaaaaaagaaaguugucagaugaagaaaucagugagucagugaaaccauuguugccuaaugaccuagagagcugcugauauuaacugacugccuccuccaauuuacaagaacguacugaaaacuacacauuuccuuuuaucuuacuuuggaugugauaacccagggccacagcuaguguuccuguuaacugugacccacaccuaaccaccuccaaacuuaggccacccaaaugaccaaagcccaaacacugcagaggucucuccagggccccaguagccuaggaccagacuccaggugguagugcucucucaaggaaugguuuucaggcuaaagggaaguaagcaaggguuggguucucugccuguuuuggguucccucugcaugacuugcccaguaaccauugccuuccaccauuuccuccuucuggaaagaacuccauucaaugguccuguggucaccacccuuggcaaaaccugcagaagaguuccucuuaaauguccaacaagugguuuuuggcugggcacaguggcucacgccuguaaugccagcacuuugggaggcugagguggguggaucaccugaggucaggaguucaagaccagccuggacaacacggcaaaaccccaucucuacuaaaaauacaaaaaaaauuagcugggcguggugguacaugccuguaaucccagcuaugcaggaggcugaggcgggagaaucacuugaacccaggaggcagagguugcagugagucaagauugcaccacugcacuccaguugggcgacagagugagauuccgucucaaacaaacaaacaaacaaacaaagugguuuuuaauugcagaagguaacaaaauucuuuaaaaaacaguuauguagucucuuaccaguacuuuuuucccccaguagagguguaagacuugauggugccuaguuuauaugccacaaaaacugauuacucugaaugaauaugcuccuuccugaagcugcacaagugaaauacaggucuuccuagucagguacuaucccuuuuagccaaaaagaaauaggccuccuggaggaggaaaauuucaguccacaucuaacgauccuucucuuuccauagacuuagcgaguaaauuggucccuucguugugaaccaagauuaccucgguauauaaaucuccaugucuuuaacacacugcuacaaauucaacuaaguggggcuguuacaagccacuaguguuagcacaacauugucuuaagugcugcaggucacacaaaagaaauagacgaugaccuuguuuguucuucaucauccuaacucccuuuaguucuuugagauuugaaaucagaauaauauugcuucucuuaucccucuagaaaauuuuaggaacauaauuuggaucaagccuuaaacacuaauagaaaggcauuaauggaaaacaugaagcauuuacccuuggugguacuaucaguccaucucucucugaggaucaggguuauacaaucccaugauguaacuuccccuaugguuuuucaaacaucauuuuaaauuucaggcagugaacaagcgagccaguaugggcugaauuggaagcauuaacaaugugagauuuuuacugauggaacucugaaaggggcucuuuucagaaagcauacaauaaaagaguuuucuagacaaaaagaaaaugcacuucuuaccuccuaccaacaaguagcuguugggaaacaguguuuuugcuugcauaagggcucuugcaugaccugaguggaagaggucaaauauuccaucggcguauacucugacaggccugucagcugugggagaaagaaaacacuguuaacagaacugcagaaugaggaaucccaguuaccuucuaucagucguaagaaacuuucuggauaagacacaaucucuacauaccaucaguuucauaucagugcacgaaauugauuuuaaagggguucuucugaagacaucaaagcagagcaaaaacauaacaaacuuaagaucaaaccagggaacacacuauuuuagccaacagaagagacaaaaacagagcacugaggaguucucuugacccagaguggagucuaggugccugagccggcagagucagcccagcuggaacacguaggcaggaguaacugaggagcucaauggaaaaggcaaauggcuucauccuuggguguggcaguccugaaugaagaccccaagucccuguucucaaaggcaacgauguacuggaaucuguucacauggcucaccuuacaaccuuucuucccaacuccaggucacguugguagccugaagucagccacgauagagugcuuccacgacagaaguuggcaaaugcuacaaaucagggcuuauuucccgcuagaggaccagcuguuaaaccuuuacuagcauaccacugcaaggccacucccuaaccucuuugguauaauaagagauuagggacauacgccucaaagggaggagagucaggauguaauguugcauguagaaguggugcucagggcugaagaugaacaaccaacacuauaguccuuccuagggagaaaggucaaaagugaagaggucacacagacaguggcaucuagugcucuaaaaagugcuguuccaagaggaagagggacacacuucaguacagcaccuccaggaaccaggagaccaggauaacacuauugcucagccaggccaaagacccauccccuucaagucagagagagaaauuggguauagacuuccaucaauuugguagacaaagcaagucacaaaauuauucuuuuuaacugguuggaggaaggaaguugcagcucuguuauauccccaucaugauacucuggaagaugccuccuacauuuauauagaaaauucuauguauuuugccaaccuugacaccuuucuagacucucaacaaaggaacuagaaugugaaaauccaagaagauucaaaaauggaugacaggagaaagaaguaguuucucauaucaaagugcucucauucuaagcacccuugucaccucaucuccacggcuacaaacaacauagagacauuuuauucuugcagugagaaggaaagagacauauguggccacaauaguguuuuuuguuuuguuuucuuuuuuuuuuucuuuuugagacagagucuugcucugucgcccaggcuggagugcaguggcgcaaucucggcucacugcaaccuccaccucccggguucaagcaauucuccugccucagccucccaaguagcugggauuacaggcacucagcaccacauccagcuaauuuuuguauuuuuaguagagacaggguuucaccaugguggccaggcuggucuuaaacuccugaccuugugaucugcccaccucagccucucaaagugcugggauuacaggcgugagcuaauaauguucuuuaaaaggaaauacaaagaccaucaguuaaauauggugaacugaacauacacauuaucucuacuuucucccagaaacaccacaacaauuacuaagaguuaaaaguuacagaguuaagaguuaaaaguuaaaguuaaaaguuaaguuaaaaagauauaauccucccaagggcagagaaaacaagaaaggcaaugacaauggaugagagaugucaacaacauuauggaaaguugacugucaaguguugagugccuacagggaauaagaaucaggggugaagaagguggagaaagggaccgcuaguuuucuuuauaagcugggaguacuacugacuuuuaaaaauagucgggcgugguggcucaagccuguaauccaugcacuuugggaggcugaggcagggguggaucacuugaggucaggagcuccagaccagccuggccaacauggugaaacccuguuucuacuaaaaauacaaaaauuagccagauauggugguaggcgccugcaauacuagcuacucgggaggcugaggcaguagaaucacuugaacucaggaggcagaggcugcaaugagcugauugcgccacugcacuccagccuggguggcagagauagaccgugucucaaauuauauauauauauauaugcauguauuacauugauguuauaaaaauaaauuuaaaaaagaaaucaaugccaacuucuguuaaaugaucuuuaagacuuagauuuaaaauugugauuauuucuugaugcaaugcaaccucauuaauuuggaacauaaagaaauguuacauuaauagauucagaugauacaauguuucuaauaaauuaaauuucucuaauaaaaaaaguugagagacuuuaugucagauagggaauugcaauuauuuccaauuauacacaaauuugaacaaacagaauugccuucauaggauuauacuguauucuaaauaaggcacaguaaauagaaaaugcuuugaaauaacaaacugucuaaugagggagccuugcuuucaauguucuuauucaaugugaauucaauugaggaaaauuuguuuuaagauauaaaccccaggggaaagcagauggcaguuuuguaaaacuuuuuguuauugauucagaggugaucaagagaaaugaauucaggaagcagggaggaaagaaaaguaaagaaagaagacguaauuacugagaaaaaggccauuuaguaaaucugaagaguauuuacaaaguugauuuugcaauaagcucacuuuuaaaaauuguggugugucagcaauuuccagacugugggaaauucuccaggacuccccucccugccaaaaaaggacccugaucuuucaucucuucaacaaauaaacuucaaggcaaaaaagagagagagagaaagaaaaagagaaaugaaagggggaucugcagauugaaagagauuuuaaaaacauaucaaccuacuguaaaguauggacauuauuggguucaaacaagcuauauauaaaugaugacauaagauaauuagaaauuggaacacugaauauuuggugauaucaaggaauuauuguuuuuucagguaagaucaugauacagugguuauguuuaauaaaaccagagcucuuauuuuucagacauauacacagaauucuaggaagucugggauuuuguuucaaaucauucaagaggacagaguagacagaggugugcauggugcaagacuggccauggguuagugguuguuagguaugagugacaggcacaggaagguucauuauauuguucuacuucuguguguguuugaaauacucuauaauaaagcuuuaaaaaaaaacagaguauggcuuuuuaguuuguauguugaucuguuuuaaucuuuuguuugagauuuuucuggauaugcuuuuaggcaucuggggacucuccagagcaucuaugugagauuccagagcaucuaugugagauaccacugaccugugaagcuggagguuuggcaaugaccaggagccaauugaaaacaaaaaaagaugucagaguacaacuauugcauggcuaucguggagagacguuaagguggcuccuaaugaucucugccuccuggugcccaugccuuuguguaauucccaccccuugaagugcgugugggaccuguaacuugcuucuaaucaguagaauaugggaaaggugguagacauuauucccaugauuauguuacauuauaagacuccaucuuggccaggcgugguggcucacacuuguaaucccaggacuuugggaggccgagguggguggauuaccugaggucagaaguuugagaccagccuggccaacaugcugaaacuccguaucuacuaaaaauacaaaaaauuagccuggcgugguggcggacgcuuauaaucccagcuacuugggaggcugaggcaggagaaucucuugaacccgggaggcagagguugcagugagccgagaucacaccacugcauuccagccugggcaacaagaaugaaacuuugucaaaaaaaaacaaaaacaacaaccacaaaaagaaacaaaaaggguccaucuugcuagcagacuuacugucuuucugcacugguggcuuugaagaagcaagcugccauguugugaaagggccuauggagagggccacauggcaaggaccugcagguggccucuaggagcugaggguggccucuggccgacaacugguaagaagcucaccccuugaucuuacagucacaaggaaauaaauucugcuaacaaccugagugagcuuggaagcagaucuaacaacaguuaaccuccagaugagaacugagccuggggugacaccuuaaaugcagccugugagacucaugacguuugcucuucaaaagacauuuuuacaaaaaugaaaaggugagucauagacugggagaaaauauuugcaaaauauaggacuuguaucuagaauauauaaagaacucucaaaccucaguaagaugaacaacccaccacccaguuaaauaaagcaaaaauaucgaacagacauuucacuaaagaaaauaaauacaaggauggcaaauaaacacaagagaagauccucaauaacauuagucauuagggaaauacaaacgaaaaccacaaugagauaacacuucauacacacuagaauggcuaaaaaauguuuuuuaauuggccauaccaagugauggugagaaugcagagcaacuggaaugcucauaaacugcagauaggaauuuaaagugguacaaucgcuuuggaaagcaguuuggcaguuguuuaaaaaguuaaacacacaccugccauacagccaaacaggagguaaucaccaaccacguuacguuuaaauucacacuacugugggguauguuaggcguuuuuugguauuugcuucagauucaagcaacaauaaaauagugauugaucaucuuugauuauggcuauuaacaaggcuuggauuguggcuauuuuaaggcauuuaaacaguaccuuagaaauacacacaauucacaaaacacauguauuucacuuaaucuuugcaucaacccuaugagggagccaggugaaaguagacuuaucauuucauggaugggcaaauggaggcucagugaaguuaagcaucuuacccaaugucauacaaccaauuuacgaugauguuugagugcaaaucaaacucaccacucuuucuucuaccuuguugguaccugcuagaaaacuacaugcugauaugaauucuugucuuuaaaacaaaacagaaacuauuauuaaacacccaguaauuauggcaacuaguacuguuuuuuguauaacugaugugcaaaaaaaguggcacaaguuaagcuuuuaaaaucuuauaguuacauauuuauuuuauauaauuuauguaguuuuauauaaacuuuguaguuaccuucugcuuaucauuagccauugcuacuagcuaaugauacuauuuucuguaaaugauagugauugauguuugcuuuuuaaaauacauuaaaguuuuagaacagugaguauauguaaagaaaaauuauuaaguaaauuacaucacagaugauacaugaauaaggcagauucauuaaggcggcucuugaaaaauguagucagggaaauucuacacacuguggaaacagauaauacaaacuuccuuuuugaaaaggaaaguagaaaaucagaaccgagauucccuuuaagaaaagucaguuuagggccggguacaguggcucaugccuguaaucccagcacuuugggaagcuaagguggauagauggcucgagcccaggaguuugagaccagccugggcagcauagugaaaccccaucucuacaaaaaauacaaaaaauagccaggcaugguggcacaugccugugguccaagcuacuugggaggcugaauugggaggauugcuugggccugggagguuaagacugcagugagcugugauugcaacacugcacuccagccugggugacagagcaacaaccugucaaaaaaaaaaaaaaaaaaaaaaaaaaaagaaagaaagagagaaagaaagaaagagagaaaagaaaggcaguuuuaaugaaaaggaaccuaugaaacaaucuccuggacuuuuccuuuaugucaagacaggauuuauucuccaugcaucagaauacauacaacacuguguaugugcacagcuccacagcuggacuagcuaagaccaaaggugccgauucugauugcuuuuuugauuuauucuguucuuucucuugaaguuucaucacccuugugaccucacaaacaaggucaaaaagcuaagagcuaugggcagaguuugucauuaccucuucuagaauuuguacccccagccccuguuugggcaguucuaaauuuguaaaacacauuuuaggcaauuauauuaugucauaaaauauggcuaguguaggagaugguaagagaguccaguuauagcuauaaucuaggccaggcacaguggcucaugccuguaaucccaauacuuagggaggcugagaugggcagaucacuugaguccaggaguucaagaccagccuggccaacauggcgaaaccagcuccacuaaaaauacaaaagaaaaacaaacaaaaaacuauaaucuugaagagcauuaucaaauaccaaauucugcuauguuuugucuuuuuugagggcacgcucaagacagugccacaaacagguaaauugcuuacuacccuugaaaccaaacccuucuugaaacucuugaaaccaaacccuucuugaccaaacccuucuugaaacucuugaacaaacccuucaaaaaaguaacguuuuucuuguuuucuuaaaugguaaucaaacagcaagauucuuaaaaauucuccgagcuuuucugcuaacaguacaaugcuccaacaauuaugauauuggauaaucucccuaccacuccuucuaaccacugccgacaguugcucuuaugcugugguucucaaaguguggucccaggacuaguagcagcagcagcaucaccugggaacacgccaccacgccuggcuaauuuuugcauuuuuaguagagauaggguuucaccauguuggccaggcuggucuugaacuccugaccucaagugauccacucgccucggccucccaaagugcugggauuacaggcaugagccaccgcccucggccugauauuugaaguucuaaauaaagaaauuucuaacacaaguacccuggcuagguacucaucaacaucacggauuuucuuagauaauuucccagggucaucaccucagguuagugggcagaauuucucuucuaaagaucaggaguucaucuuuguuccaucucacucccccucuaaugaccuguauuauuucaaaauacaccaccaucuuauuacugcuuaaacugcuuggcagcaggcaauguacaggugcccaauuucacccaguuagcuugauaccagcucaaaaugccagaacaaacucucucugcuucuauuuccagaggaagaacuacuucucuugucccacacuuuuuuuuuuuuugaggugaaguuucauucuugucgcccaggcuggagugcagcggcucgaucucagcucacugcaaccucugccucccagguucaagaaauucuccugccucagccucccaaguagcugggacuacagacaugcaccaccacaccuggcuaauuuuguacuuuuaguagaaacaggguuucaucauguuggccaagguggucucaaacuccugacuucaggugacccgccugccuccaaacuuucauucauucacucacaaaauauuuauugaccgcagcguaugcaacaaguauuucucuagaugcugaugaaacagcagugagcauggcauaguccugccacuacagaagaucacagcuacugucugagcauguuuucacuuagcuccauggccugcuguggaccaugauucauaaggcagaucguugcaguaggcaaagcagggguuugaggcaaaauggacuuggggucaaauuccagcucuacccagucaacuaggacacuugacaaguuacuuuucaguucugcaagucuccuuugucuccucuuuagaaaggauacaauaauagucaucucacauggucuuugcaaagaguacagagcaucacaucgagcagauauauacagauauauaguaaguucuacuucccuuuccuuucccuagaaagguagaggcccuuucaguuugggccugaugcucacccuuuaacuuuaggucaagucuguuuucuucauaaccaccuggacuuuuuuuuuuuuuuuuuuuuuuuuaaaaaaacagagucuugcgcugucgccuaggcuggagugcaguggugcgaucucggcucacugcaaccucugccuccuggguucaagcguuucuccugccucagccuccugaguagcugggauuacaggcaugcgccaccacgccuggcuaauuuuuuguauuuuuaguagagacaagguuucaccauguuggccaggcuggucucuaacuccugaccucaggugaucugcccgccucagccucccaaagugcugggauuacaggcaugagccaccacgcccggucagccaccuggacuuuuauuuggcaucccuuggauauauugcuggguugguauuucuguguguggucuccagaccacuaacuuuagaaucacccugacuaucuguuuaaaaugcagauggcuugccugggccccaucccagauuugggaagaagggaaugaaacaggaaaucugcuuguuuaacaagcauaccaggugauucuuuguacacuaaagccugggaacaacagcuuuggcugcucugugcuaccuccccaaccuuguuuugccuuuuucaaaagcagcucacacgaaagcuuccuaacucugccuacucugcuccucacuucacucuauugaaggcuauucuuauaggaagcacagugucaugguugagaggucaagcucuaagaccaauagguuugagaccaaaucccaacuuuaccacuuaccaaugguucucccagugugaucccuggagcaguagcaucaccuggaaacuuguuagagauguaacuucuugggccccaccccaguuggacugaaucagaaacucuaggaguggaacccagccaucuggguuuuaagaagcccucuaguagauucuaaugcaggcuccagugugaaccacugccacuuaguagugaaugaccuugugcagauucacaacuucucuaaaccuucauuuccucaucugugaaauacuaaaacuacuaaucacauagaguugugauagugaaaugacaugauacauauaaagaucuuaauacauaguaaguacuuaauaaguauccauuauuauuguuaagcaaacuguucuucauuccauggauucucuuaaguuugguuuguuuguuuuuuuuuuuguuuguuuucugcaauggcaacuagaaaccauagaguuaugccauguuauuuuauuuuauauuauuauuauuuuuuuuuuuuugagacagagacucacucugucacccaggcuggagugcaauggugugaucucggcucacugcaaccuccaccuucuggauucaaaugauucucucaccucagccucccgaguagcugggauuacaggugccugccaccacgccuggcuaauuuuuguauuuuuaguagagacgggauuucaccauguuggccaggcuggucuggaacuccugaccucaagugauuugccugccucagccucccaaagugcugggauuacaggcaugagccaccgcgcccggccgaguuaugccauguuaaauggcuuaaaguuuaccuguucaacuagucuuauuuuucaccccaucccaaucaacuaaaacaacacucacuccuacacagcugucuauuucugucuucacuauuccucuuccaccugucugcaauaccuuugcaucuucugcccacacaguccaaaucuuaguucuccuaaaaugucuguucugcucccucccggaagucuugcaugaucacucaggccaaaugaaucugccauucucuaagaaucaguuaucaucuguguugcagguuuuaaccccuaagcaccugcacacaugcuacuaauguuuuuuauuucacaucuaguugucuugucucuugaaaaacagaugguaccuuauaauucuuuccaaaucucuucccuauccauccucuggcauaaugcuaaagggaugaaugaaugaacaaacuucuauagcacaacccacucuuuuuaaggcacacuagaaacuuuuuuuaaaaaaugcauacuuuuaagaauggcaauaauuauaguagcuuagguuuguauaugccuucaugguuuuaaaaaugcuuugguacuuuugaugaaucuaguuaucacagaaaccuugugagguagguauuguuaucccuguuuuaaggaaacagauucagaucuuucuagugacuugcccaaggcuguagaacuaacaagugacaaagcuggggcucaaacucccuguauucugaugcaucuuuuucuuggcuccuuugguuggucugguuuaucacugcuaguguuuacccuucuuuacccuugcacugcguuauaaucucuaaguucaacucucugcuugaaagcaagugcugcacaaauaaugaugggccuuucugauacuuuuuuuuuuuugagauggagucuugcucuguugcccaggcuggagugcaguggcgcaaucucggcucacugcaaucuccaccucccggguucaagcaguccucccaccucagccucccaaaguaaguagcugguacuacaggcgugcaccaccacaccuggcuaauuuuguauuuuuaguagagaugggguuucaccauguuggccaggcuggucucaaacuccugaccucaaggugauccacccaccucagccucccaaagugcugggaucacaggcaugagccaccacgcccggccccuuucugauacuuuaaaaugucaagacagggcccauuuaagacaaagaaguacagccucaccugguguuccuaagcgggccugagcaauggucaguuuuucauggggugcuugacacuggcaguugguuucaucagcaaauggggcaggugcagucagggucuagaagggagaaaaagaaagggaauacagucugacaaacuuuccuuuggcacuaacuuccucugaaguuuuauuccuguuggcuacacagguaugauuaagaagucaaauauauccacugagucucagagaaauacuguacuguuagacauaaaaauagggcaucaucacugaaaccuuuugguuuguuuuuuacugaugcuucagaaauaacaaaagcucuucagugucuauaguaugccagguacuagaugagauacucugcuguuaucucuuuuaggcuucgcagcaccccgugaugaauagauacuucuauccuucuagagcauaggauaauacuaucccuauuucacaaaaaggaaacugaggcucauuagaguuaagaaauacgccaagucaugcccuuggaaagucacaaugcccagcuucgaacauuucacaaccgagggcagucuucaaacauuuagacucacccacacccaggagacuuggcuggaaagagugccauacucagaagcguggcacgccaucuccuauauuucacacacaccagcuuggccaaugacaaacucugaugucucuuucaaugcaaaggccaaagcuguuaucugugccuugggaaggcuuaaaagcacagcaauuugggcaggcugcagaugacuucuccugugguagcuucaacagcgacuagcggcuagaggcccugccccaggcagcuugggcuggggcucuggggaacgcugugagaaagauguagucacuuggaagccugcccagaaaguggcccugcauuuuuuagucagccucuuaaaaugaaaaccucacucucuccagacaaagcaagcgguguuuuuguaaacaaggcaaaugcaauccagaguuguccauuuguagucuuugaacugugccgugauugcagucaccacuacaucaucuuugugauuuuuaaagcuaaaguggaucagucaugguaaacauuauucacugugcuguaucaauuguuucuuagagauggagacagguuaagauguguuccuuaaccuggggacacuagacugaagaaugauccauacauuuggacaggggcuaugacucacuucugccauuuauuuauccauucacucacucauucaaauaaguggcaggcacuaucuuggaaucuggggauagaaguagggauaagaccaauaaucccugcccuuggggagcccccauucucugcacugacgagaaccgaucccuccccuguccccauccccucuccccauugcagucccuuccacccuagaagcucaauguugucuggaggccucccaguuaucugagauuuucuuagcccucaccuucuccuccagggcucuggaagcaaaccaagacuugggacaaggauucaggaaacuuggguucacuauucguucuuuuucagauacauuauggcgaccucauaggcugugguagaccacaguggcauuuguaauguagcaaaggggugcagugacaagaacaaaaacucuguauccacaaaccccggguucagauccccucuccagcacuuacuagccauguacuuuaauuuggcucuucugguugaaaggaacugacacucacuaacagacacucacuaacauuagcucaaaggauggaggauuucuuuuaagacuacccuggaacugaaacuguggaaaagcaggaaaggggcagaauguggccccagagaaggugcucugcaccaacuuggcugcucucugcacaugauccuuucugucccacccccacugacuccauuuccuuccacugcauuaaagccgcugcuugcuuuccacugccccacagcuucagcucuaauaggccggcccaucauggccuccucagccucucuucacaacacucauuuaacaacuuuccauugugccuuucagcccuagacuccuaccaacuuauugacucuuuccauguuucccaauucaaauuccuaagggagaaucugauuggccaaguucaucuuuucaaaucaggccuuaaccaggauuggcuggcguucggucaggcgcccacccuggggcccaacagauguggugaggaaagucaugagugacccaccacuaccacuucaggaggagcuauacuugaggcaggaaauauuuuugacuuugugugcuuaaaagcaaguuccuuaacuuauuugaaccucaguuucaucuauaaaaugggcuauucauuuugcaaggcuguugugaaaagcagagauaauauguguaacauaccugguacuuaauaaacuguagcuauuauuacugcuauuauuauucacuauuauauauaauaugauauaauaauagauaauauaguuacccacagaaacaagcaaauugacucauuuuuauuuauuuuuuauuuauuuauuuauuuugagauggagucucacucuuucucccagguuggagugcaguggugcgaucucaccucacugccacauccgucuccuggguucaaguaauucuccugccucagccucccaaguagcugggacuacagguaugaaccaccacaccuggcugcaaauugacuuaugaauggacuuuuagcacacaacccaaauggauaaauggauuggcaagugggauuagcuuacauuaaugauucauuaccuuuuaauauaugugggcaaugaaccuuuuucacaugaccuaaaauaaauuacuauuuggagaucuuguaugugcuacucacaaaguuuauuaaagaggagauaagguguugccauuuuccaagaaugguguguucuugauggugugaaaucugguaauuaaaacagagauagggaacguuguaaagcaacaauaguuacucaaaggggaagaaaagguuuauaugcaccgugcauuuuguucuuaauuauuauggccuagaaguaggaaagaaggagaaacaaagagauggaaggcagagagaauuccuaaaugugcgaauguguuuguguuugcaugugugcacaggugacuaucuuuaacagcaguugauauggagaagagcuauuucuuguuauguauaaagcaaugugcucagaauggggagaaugaaaaaauaaaugagccacagccuugcuguccagaacauugcuuucuaaagcacagcaggguacuucuugaguugaucaagcucugcauucaggaagacuuugguuaaggcccagcuacuaccaaccagcccggugaccugagacaauguuuuuucaguccaaacacaccagauuacaauuaaaaaaaaacuccuucucugagccagaacaaaucauuugcuuuauaaaaaauucuaugcuccuuagguucugucucuuccauauacuagaggcagaucaacuucaggacaaugugaguaagauagaggcuucugggaggggcaggaacugaacuaacuucaccauuugccaaagcugagaugcuuccagggauccucugguguagacccuacauaaaacuaaggccugauaacauaagguaauagcuaaaucuuugaguaccuacuuagugccauguauccaucgauauacuaagcacuuuaaauguauuugcucauuuaauuuguacaacaccucugugagguagauauuaucuucacugaaccagucuucaaggugacaccaagugacagcaagaagcaacagcagugguagaucccucaaacucaguuaccuuuuuggcucccugugagcugaggaaacccucaggauuuuuagacuauagggauggaaaaaccucgaaaaggggauacaugauuuccugauagagaagggguaacucaaacaauuaacugaagaaauaaaagcauguaaccauauuuuuggccagacuuaaugaaguaggucaaaugacuugcuuguaguuauuugcaagccucagguuagacuuuaaaucagccagaucacauuuuguaguguuuauuagcacaugauacauguuuaauaugaugcuagggguuuggaggauagagaaauggaggagagagauaagaaaggcaggaacagaauuggcuuugcagcagcaaucuucuaaagugaagaaugaccguuuuagaaugggagaagguauucguuugaaagggcauguucauguucauguucaguuuucaauaacgucagauuuggggaaaaccacuacucuuuugagcaugaaaaucauagaaacuaagcuucugaacuugugaagaucacagaagacagacuaugcccuucuagagagccauauuccaaauuugggguuugguuggcacaugagauuuacauauauauauauauauauauauauauauauauauaacuuuaaauucuaggguacaugugcacaacguguuuagcagaagacagcaaggaucauaaaggguuaagaagcccuggcccagugcccuggaccucacauaugcaagggccuugccagaccacagacuuggagcuagguugcaauaaaacuucuuucuaccuaauugaagauuucaaaauacucagucauuacaaggugaauauguuacccauuugucacauaaguucugguuauauaaacuaugccauagaaucauaccaaagccacauuucaucaggcuuuuaaagaagacauuauauguugagcauuucauguauagaaucucuucaguuggacauugucaaauauuuacuuaaaacaaaagcuauuagguacuggacaauggacaaugcaaauauuacuuaagugcaaaaaaaugguugcuagaaccugcacuuaugcaauguacaucgcugacugacaacuggaccaaucagacaacaagcuaaucaaccaaucagaacuuagcacaguacugcugauggugauaggccaacugcagaguugcuuguuuaagcuaagcuauacuuuuuuuuuuuuuuuuuuuuuugagacagagucucgcucugucgcccaggcuggagugcaguggcgcaaucugcucacugcaagcuccacuucccggguucaugccauucuccugccucagccucccaaguagcugggacuacaggagcccgccaccacacccggcuaauuuuuuguauuuuuaguagagacaggguuucacuguguuaaccaggauggucuugaucuccugaccucgugauccgcccgccuuggccucccaaagugcugggauuacaggcaugagccaccgcgcccggccaagcuaagcuauucuuaacuccaguggggcaaucccgucagacaggccugaguucaaauccuaccuccauuauuuaauaucccuuuccuauuuuuacauuugauuuuuagcaaauugcugguucuuaaccucucaagccuuaguauccuuguuuaugaaaggaggauaagcuguugugaggauuaacuaaaagaauguguggguaauaaauaucuucccuuuugccucuccagaauccacucucuuucuacccuucucuaugcuuuuccucuacucuuuucuguauggcuuccccaauggacugcaccaaugggaucucugccuccugcuuccaguugguugggaagcgugcaaaacaguggaggucaggacaagagugagcucaggguauuugucucccuggcuuccucucugcuaggaagcaguguguugguucuguccuuuuaccaaaauucacagcuucugugaggggguccucuuuauagagcugucugugugagguucugguaaccacacucaccccuugccccuaccagccugggggauggcaaucccccauuguuucuaggccaaggauacuauacuauuccuugagguuuccuuaaacccugcccauaccuuuguaaguauuaccuuuauuaaacucucuuucaauuucaccuuuagagugagccaucugugucuugacagagccuugguuaauaccgugucuauaacaguuugucaggcucaaacauuagcuagaaaaugcugaugagguauguuagaagcauagaaaucaauugaaaagugaauuacccagaguaacuaaaguuauaaccaucucaagaaugucucugguagaaaagaauuuuacaaagacagaacauuuuaaucaggauaugcaaaaaaagauaagaacaggacuucagaaagaaucuacuucuuccagguaggccuuuugcugugaaacucaucagcuuuagaaccacaaauucagaauuacaaaaagacaucacaaaaucuaauccagcagccucauacuguuagguuuauauuuacuuguuucugaacauauuuuuaaaaccuuauuuauuguggagucagaauauuuugucuuuugaagauagagaggacagaaaaaaauagauaauauaguuaaccaugggcccaacacacacgaaucacuggauucuuagacugugucacugauuauguagacucuuaaaucaggcagcuggugcaaagucaucaccaauaaaugucacuggagagaagaaaaaagaggcccaguaugugguucagcaccaagaaauauccauuuuuuucauuuaguuauguauggaauguacauguuauaaguaacaggcaccauugaaaacagcaagacagauacguauguacugacagggaauuauaucuaagacauuuuguugaaugcaaaaagcaagucacaaagcaauauguauaauauguauguauacaugcuaucuaguaugaugucauuuauaguaaaaagagagagaagggggaagagagagaaaaagaagaaaagagagagguaauuguguagaaauaguuuagggacaggcgcgguggcucaugccuguaaucccagcacuuugggaggccaaggcagguggaucgccugaggucaggaguucaagaccagccuggccaacauggugaaacccuauuucuacuaaaaauacaaaaauuagccgggucugauggcacacaccuguaaucccagcuacuuggaaggcugaggcaggagaauugcuugaacuugggaggcggagguugcagugagcugagaucacgccacugcacuccagccugggugacaagagugaaacucugucucaaaaaaacagaaaaaagaaaagaaaaagaaauaguuuagaacugugcuaauaugguagccauuagucacauggggcuauuuaaauucaaauuauaauuaauuaaaauuaaauaaaauuaaaaguaguuugucauucacauuagccacauuucaggugcucaauaacccaugugacuacuggguacuauacugggcaaugcagauauagaacauuucuaucaucacagaaaguucuacuggacagcacuggacuugaaugauacacauugaauuguuaauugggguuaccucuugggaaggagauaauauuuugagagaagagaugaagagauuucauuguuuauuccauauaugucugucauuuuguuuuauuuuuaaaaugagaaugcauucaugcaauguucauaaugcaaaaauaaauuuaaagaaauaucuccucuccuuuaaauucagagaugcagaaaauuuaaucaaggcucaggucucccaaauguagcagggaugggggagggaggucuauauuaagaaaagaggaguauuuugaaaaauaaaaacuauuauccagaaauuaacuguuaaaugauaugauuugcagguauauggaauauuuaaaacucauuugagcuuuaaaaaauuuuuaaauuacuuucaugguaucuacccguaauucauuuuucuaacaucagacaaacacuuuuugaguccuugcugugugccaggcacuguucuagcuucugaggauacaacagggaacaaaacaaaacaaaaaauuuugcccucauaacacuuaaaaauaauaaacaagcaacaaaaaagaacauaaaacauguaguauuuuaguuaaagggugauuaaguguuauagaaaaaaauaaggcaaggaaagggaauagggaguguuggggguaucacuguaaauaggauagucagagaaguugauguauguguaaauauauaaaggaucaagugagccauguggagaaagagcauuccuggcagagaaaacaguaagggccaaggccaugaggcaugaacaugccuggcuucuuccaggaauaacuagaaggccaguaugcuuggaggaagcgagcaaaaaagaaaagauguagccagaggugagaccagaagaaaggagaugagaggcacccagucgugugagcuuuuuaggacacuguaaagacuggcuuucacucuagggagaugggagccaucagagcguuucguuuuguuucguuuuugagagggagucucacucuguugcccaggguggagugcaguggcgcgaucucggcucacuacaaccuccgccuccuggguucaagagauucuccugccucagccucccaacuagcugggacuacaggcgugugccaccacaccugccuaauuuuuguauuuuaaguagagacaggguuucgccaugcuggucucgaacgccugaccucaggugaucuaccugcuucagccuuccaaagugcugggcaucagagcguuuugaacaaggcaugauaaugaucugacuuagcuuuaacaagaccaucuggcuaauguguugagaauaaacuguaagaggucaaagguagaaacaagaaaaccacugaggugucugguguaauaaucaggcaaaagaagacagaggcaggggucagggugaucgcagcggaggugguaagaaguggucagauucuggauagauuuuggauccauaaaacuugaaacagauuggauguagggugugaaagaaugagaggaaucaggauaauuccaaagcuacuggccugaagaacuggaaggauggcauugccauucccuaggagggguaaaacacuggaagaguaggucuaggggugggagggacaacaaggauggggaaauuaacaauuccauucucacagauuugguuugacacaccuauuagaucuccaaguggagaugucagguagacaguuggauguauaagucugguguuugggagaaaggacuaagcuagagaugcagguuuagaaacugagagaguaugugauauauaaagccauuagacuagauucacucauucagcucagggcauggaugcagguagaagagagguccaggucaucagaugaggaaacauuguauauuuaagcuccgucucucccugcuauuagggaagcucuaagaaagcaaggacuuggucugucuacucauugcuauaucccuauuccccagggcaguaccuggcauauagaagguccuuaagaauauuugcugaaugggggaauuuaaagucacaggagugagaaugauaauugauaaagacaaauacagacuuuaaacucaauaauaaaauaaauauauuugucaaucuuucauagcuuuuucuuaucaucaucauaauauauauuauagaaaauuugggaaaguuaagagaggaaaauaaaagucaccaauaauucuuucuacuucccagagacaacuauaguuaacuccuucuauauuucauuuuaggcuuucugguaugacauauauacauauuaacaaguuuggaaucuugccggauagacaguuuuuuucacucaauauaucaugauuaucuuaucaugucacuuaaauaguuuucaaccucacuaauuuugauagcuguaaaacauuucacugaaaaagaaccguaauuuaaauacuucuccaucauugaauauuaaauuauuuauacuuuacuaauauaaauaacaugcuaaacauaauucugaaccucugauuauuuccuuauaacagaugccuagaaacugaauuacuuagaucagggguaugaacauuuuaaagauaaauauuugaagaacauuucaacauguauugguaaauugccuccuacaaaagcuguaucauuuauacucacauuacaacguaugaaagcaccuaucuugcugccaucucacuggcauugaguauuaccuuugucaauuuuauagaccaaaaaaugguagcaugcuguuucaauuugcauuauuuugauuacaaaaagauugaacauuuuucaaauguuuauuggccauuuguauuuucuucagagaauaaucuguccuuugccuauuuuucuauuguugagaauaaguaucuugaaguugguuaaaacuaaaacaagagcacaguuuaaaaauuaucuuaaauaucuuuuaaaaacacauuuuccaggcugggcucaguagcucacgcuuguaaucccagcucguugggaggcagaggcaggcagaucgccugaguucaggaguucgagagcagccugggcaacauggcgaaacccucucucuaugaaaaauuagcuaggcauggugguguacgccuguagucccagcuacucuggaggcugaggugggaggauugcuugguccccggaggucaagccugcaguaagcugugauugcaugccacugcacuccagccugggugaaagagugagacccugucucaaaaaaaaaaaaaaaaaaaaaaaaaaaaaaacaacacguauuuuccaacuuuauuuagaguucccacauaauaaguucauuuuuuaaaccaguaaaccagugccugaaugcucacaucuaggucagcuuaguacauacugcccuuuuggugaucagagaucagaauuuuuauuaugcccuggagauacaggcuuccuuaaaacacugaccacuuauaaaccaaacuccaucucaugcggccacuuuccaaccucacagcagugagugaauaucaaauagcuagaagacucauaguacuauaaguaaagucacauuucauugauucuaaaauguacauuucuccccacauuuuagcaucucugagaguaggagggaucuuacaauagauauuaucuuaaaaucaguguuggccauuuuuucacauuguaacaccauugaaauggaagugcaacuuaccaugaauagccucuuagacucauuaaaugcauagaugcuauuaacaauagaaaacaaucuuuaccaagauauaaaaauuccacauucuaaauaauuuuuucuuagauaauugaauuuaaguuuauagugaacaucaauaacaauguuauaucauauucauauuccaccuccuuccccaaagaacuugaggugauuuuaaaaauaaaauuugaaaguuuaaaauaauaguugcaagaucuggggugaggaggagaaauauguuuuuugauguuuuuuguuuguuuguuuguuuuguuuugagacagagucucgcucugucacccaggcuggagugcaguggcgcgaucucagcucacugcaaccuccacccccugaguucacgccauucuccugccucagccucccgaguagcugggaccacaggugcccaccaccacgcccggcuaauuuuuuguauuuuugcuagagaugggguuucaccgugucacccaggauggucucgaucuccugaccucgugauccgcccgccuuggccucccaaagugcugggauuacaggcgugagccaccacgcccagucaaaauauguuuguuuucuaaaggucaggggugaaaugagcccaaagaaaugcauaucacaguccucuauauuucaaaaagguaagacuacaaaaauggcuuuaagcucccaguagucacagcaaagaggaaaacaaaguuaauguuguccuuaagcacaaagcaaaauagcuauugaggaaaaagcacagcauuuuccugaugcugaguucugagagaaauuccucccguggugccaccuuaaaggguaugauggguaauacuguaguaacaucgguacugauacacucaacaacagcccccuaguacagaaaguccuguuuuuguuuguuugcuuguuuguuuuugagacggagucuugcauuguugcccaggcuggagugcaguggcgcgaucucagcucacugcaagcucugccuccuggguucacgccauucuccugccucagccuccugaguagcugggauuacaggugcccgccaccaugcccggcuaauuuuuuguacuuuuaguagagacgggguuucaccauguuggccaggauggucuugaucuccugaccucgugauccgccugccucggccucccaaagugcugggauuacacgcgugagccaccgcgccuagccagaaaguccuguuuuuuuauguuugucuccauagugccuuccauguaaggcagaaccccagcaccaaaaagcgguucagaaaagcauuuucuuuaaggggccaaacgaacgugcacccugaaaauacaguuuuuuucucccugaugguuggauccaaugguaagauuuagaaugccuaaaccaauguuuucuaaugugggaugggcaagacaauccauuagacagcaacacuuguguuuauaccucagauccuugaauaaugucauuuuguucgaugaccuuucauuauaacguggaugagaaaaaaaaaauauuuugguuccaggucagggcuacuguccgugaagcauuuucgcauucuccucauaucuguguggguuuucucuggguacucugguuuccucccacaucccaaagauguacacagcagguuaauuagugucuuuaaauugucccaaugugggcugggcgcaguggcucacgccuguaauuccagcacuuugggaggccaaggcgggcggaucaccugaggucaggaguuugaggccagccuggccaacauggugaaacccugucucuacuaaaauacaaaaauuagcugggcacgguggcgcaugccuguaaucccagcuacucgggagggggagguugcagugagccgggauugcaccacugcacuccagccugggugacagagcaagacugucucaaaaaaaaaaaaaauugucccaguguuaugaauguguugugugugugagugugcccugcgaugggaugguguccuguucaggucugguucccaccaggugcccugaggugccaggauaggucccagucacccauuacccugaacuggaauaagcuggcaaauaauuaucuuguuuuuauuagucuuucuuaaauguauacauagcucacauguauuucaauguugaaugauacuagcaguguuuuggucuuuauuuagaaguguggugguguugaaguggcuucuuucucaguauaguuauugauuuguggugacaugccugaaucagccaagucuguuccugcuccaaagaagggugccaagaagguggugugaccaagagccagaaggauggcaagaaucacaagcauagccacaaggaaagcuacucuaucuacauuuacaagguauugaagcagguccaucucaacucuggcaucucaucgaaggccaugggcaucaugaacucauuugucaauaucuucaagugcaucauuccugaugcauuacaaguacucgacgaucaccuccagggagauccauacagcuugugccugcugccuagggagauggccaaucacacugugucucacaacaccaaggcccucaccaaguacaccagcuccaagugaacaacuucuacuuucaaaaagcaaaggcucuuuucagagccacuuaagccagguauagaaagacaaauacugcauguucucacucauaagugggagcuaaacaaguugaucauauggagguagagaguggaaugauagauaccacuaucauugagauaguggcugggaagugugugugggugagcggggcuagggaugaagagagguugguuacuggguacaaacauacaguuagauagaaggaauaaauucuaauguuugauagcagaguaggaugauuauaguuaacaacaauguauuauauauuucaaaauagcuugaaaaguggccgggcacgguggcucacgccuguaaucccaacacuuugggaggccaagguggguggaucaccugaggucaggaguucgagaccagccugaccaacauggugaaaccgggucucuacuaaaaauacaaaaaugagcugggugugguggcacgugccuguaaucccagcuacucaggaggcugaggcaagagaaucacuugaaccugggaggcggaguuugcacugagccaagaucauaccacugcacuccagccugggcaacagggcaagacuaugucucaaaaaaaaaaaaaaaaaaaaaaaagcuagaaaacaagauuugaaauguucucaauacauagaaaugauaaauacucaaggugauggacacccuaaauacccuggcuugaucauuacacauucuaugcauguaacaaaauuucacauguaccccauuaaguauauacaaauauaauguaaucaggccaggcacgguggcucacaccuguaaucccagcacuuugggaggccgaggagggcaggccacuugaggucaggaguucuacaccagccuggccaacauggugaacaccgucucuacuaaaaaauacaaaaauuagccgggcgucguuacaugcgccuguaaucccagcuacuccggaggcugaggugagagaaucacuugaaccuaggagauggagguugcagugagccgagaucacaccauugcacuccagccugggcaacagagcgagacuccgucucaguauauauaucaauaaaaaauuuuaaaaagaaguuuggugauguuguuguggccagaaauacgccauacgaacuuaacucuuguuuacauaaauuagccuauguuaaaacugguuucauuccacaucauuuugcuuaaaguuacaguucccaagaaccucuugauaauguuaugugaggacuuacuguauuuauuuuucaugucaaaaaauaagaaaaaaagcuuuacaaaaaccaagaaaaauaucuauuuuuguuugcuuguuuugagacaggaucucacucugucacccaaguugaagugcgguggcaccaucaccacucacugcgcccuccaacuccuaaguacaagcgauccucuugcgucagccuccuaggacuacaggcacauaccaccaugcucaucuaauuaaaaaaaaaaauuuuguagagauagugucuuacuauguugcccaggauggucuggaacuccuaggcucaagugaucuuuccaccucagugucccgaaguguuggaauuacaggcaugagccaugacgccuggccuucuaauucugauauauggguuuacacuggugccccauuucuguccacaucaaauacaugagguauccuaaagggaaugugaaaguuggguggccugcaucgccugacauuuuuucauuugcuuucagcuuauugcaauauacugcaguucaccugagccuagauaaagguauuuguggauuauauuaucuaguuuuaacuaaaccaaugcacauaaaucagcagguggcuuaaaacauuuccugcaggccgugcgcgguggcucacgccuauaaucccagcacuuugagaggcugaggcaggcggaucacgaggucaggaguucaagaccagccugaccaacauggugaaaccccgucucuacuaaaaauacaaaaauuagccaggcaugauggugcaugccuguagucccagcuacuugggaggcugaggcaagagaaucgcuuguaccugggaggcagagguuguacugagccaagaucacgccaccgcacuccaggcuggggacagagugagacuccaucucaaaaacaaacaaacaacaacaacaacaacaaaaacauuuccugcaaugaaauaggaaagcaaagauaaugcaaacacaagugaacaacaagaaaauggcagagcugacccuucuacucccuguaaaaguucugcagccaccacauuaucagguaccaaccacgacaacccaaucugaucugacaagaagauagcugaauugaaaauuaucucacagaagaccauuagaaauaucugcuaccaauaacauuaaauaucaccuugagauauuagcuaaugaugguaugaaguuauuguaauuaacauauuuuaaaaugaagcauccagaacaugaagauaaaccucuaugauuuuuccauguuuaauguuucaauguugugagucaugugauacucaauccagcaugucacaaaauacuguuacauguaacgauaaauguuuagaagccuuuuugaguuuccauaacucaauagagaaaaaacaaaagucucauaccauugcaaaaucaucuauucuucaugcuacaguaaaacuagcugcucuaauguguagaaaaaaaaacugaugucaaacuaaaaugcauuccuuugucagcaaauauauuuagaagacauauagaaaacauuguugaagauugaaagaaacaagcauuagaacaaauuaugcagugugggagguuugcaauauacuuggauagaaguacagauauuucuaacaugucucagcuugagguauuugcuagauucuauuucaauaauaaaaccucuuuuuuucugagucacuaaaggaaagauguuccaaagaugauauuuucugcaaaguggaugauuucuuuaacagaaaccauauuuuacaagaaaacuguaacuaccaguaaggugauugcuuuacccuuggaccucugaucucccaccuauuugagaaguacucucugucuucuuuuccugacucuuugucuauuggaucucuaaauguugucacucaggguuccauccuggaagacugugggguaaaguagauuaauuuaaccagauuuccuguagcaauaggcagauaaaaggaggauucuaaaagcuuuaauuacagcucuucuauuuuuccccuucccaaacccugaugcaaaggcucugggucagcuauuuucuagaauucacccuguagcaggguuauucugagguacucuugcuaccuaaccaaugccauccauuuccucagcccacaaccugucugacugugaggccaggcauaguacacaauugggggccacggauuuuaauucacagauuaccugacuagggcuggacugguccuagacauaagguguuucguucaagugcucacuagacucucuuuggggcuggauauacuggccccuggaagggcugagcacuuugaagcucuguuagcagccaagagcuauaauuguaaguaggaugugaugccuuuccuuagaguuuauuagaucaccagaauuauuuggaaaugggaaauacaauguagaguguucccuuucuucauuauugugaauaauaauaucuuuaaacuuugcacuaaagaauaauagacuuauagagaaguacacauaucagccaggaacaguggcucaugccucuaaucccagcacuuugggaggccgaggcagguggaucaccugaggucaggaguucaagaccaggcuggccaacauggugaaaccuggucucuacuaaaaauacaaaaauuagcugggugugguggcacaugccuguaaucccagcuacucaagaggcugaggcagaagaaccgcuuguaacugggaggcggagguugcagugagccaagauugcacgauugcacuccagccugggugagagugagacucugucucaaagaaaagaaaaguacacauauccuaagugcagcucaauggacuuucacaagcuaaguacacacagccacauaucacguaaccuaacacuuccagcguccaucccaugcuccuaccacuacaccgauuucuaacaucaaagaugagcuuugccuauuuuauuuuauauuuuauagaaaugaaaucauguggcgcauauuaguuuguaucuggcuucuuucauucaauguuacauuugugagauucauccauauuccugcaggugguuguagauucuucaaucucacugcuacccagcauuaaauugugugaguguacuacaauuuuuuuaauccauucugcuucugcugggcauuuggguaguuuccaguuugggguuauuaugaauaacacugcuaagaacauccuaauacuaguuuuuuugguggccauguguacaaauuucuuaggaaugcaacugcugggucaaaauauuuacauugaauuucuaguuuuacuacaaagaacacagauaucugauuuauuucuacuccuguucccaaacacagcagauaugacugggagggcuaaauaaagcaucucuaaaagugcaucuaggcacaucuugcuuccgaaucaccugggagcuugagcaggcaauucucugcucacugaaguuugugaacuaugugucauggaaauaggggcuuuagaagucagacaaaccuaauuucaacucccagcuuaaucaguuaauauuugaucuuuggggccgggcacgguggcucacgccuguaauccuagcacuuugggaggccgaggcgggagggucacuugaggucaggacuucaagaccauccuggccaacauggugaaaccccaucucuacuaaaaaaaaaaaaauauauauauauauauauauaaauuagcugagcgugguggcgugcaccuguaaucccagcuacuggggaggcugaggcagaagaaucacuugaaccugggaggcggagguugcagugagcugagaucaugccacugcacccagccugggugacagagcaagacuucaucucaaaaauauacauauguaucuuuuuggaucuuugggaaauuacuugauuauuuauuuccuuacuuauaacaugaggaauaguaaugcuuauuucaugggucugcagccugauuaaaugagauaauacauauagagcauucaacacagugcccaauacagugugcacugugaaugguuguucaauuccccgacuugcccauggagaaaaaggagugagaccacuagccuugcaucccauauagaacaauuaccuuauaacuaaacaauuuggagguacaauagaauuuauuauuaugugacugugccuacagucaauauuaggcacaccagagaugaaacacagaagccugcauguaccaggaaugggcuuucaacaucauuugguuggcaauaggcuguacacaucauucaugauguuucuauuaaccuauuaccguuguuauuuuucuuaaaugacaguuuaaauaacccucagcauccugaugucagguucagcaugcaugaauuaccgaguagaaaacaaaaacaccaagucaaagauuuuggcgggagggaggagauuauaugaaaaugaauucugcucaauaggcuagccccguguggcccugcacacuauuacacaggcgcacacuaccagggcucacugcuuuauuuucuaaucacuguguuuucaagucugccuucaagauuguugagugcuaaacugucucuuuauccccaagcaaggucagcuucccagccucccauacaacccaguucaugcugggauaaagaggaagguaggaauguuaaaacaauaaugcuauggucugaggccagcaacggguaaucagauccuagcaagguagaggcuguuaccugggagauuauuggaagaaaauaggccuagcuugcaaugacuuaguuuguuucuaccuuccuugcuuuuuuuuccuuuucauucuuccccccagugaucugaugggauaauuauuuuccugcauuuauuucccuaacagucacugagaagcuuuguguggggcaccagcuaaagauguaagaguuuugggacuacagccugacccauugcuggacuuuaaccccaaguagcaagcuuagauggacaacauugauuaagaaaggccucuauaguucaagcccauacugccaugccucaaagaaggcccaauguuucaaacuucuguaguaugaaauagauaaauuaggaggcuacuguucacauuaagaagagauucaacacagguuucccgaaacaaugaauagaacauuccauauaugauuuggaauacauucaaccugucugagaaagcaucugaagaauaaaacagaagacagcagaagugguuuguacaacaucaauguaaaacuucaaagugcuugugaacauuuguuauucauauuuagccagugugucuuaccauaagaucaugcaaccuguuuuuaccccaaauggauaaaaccaacagggggugaggaaugggguagcccagacuuuugauaggagcaugagcucaaacagaacauacugcaguagaccaaguuccaaggcaaugaaagcuagaaucacacucuaaggaucuauccaauccauugucggggacagaauggaauccagagaggaaagugauuugcuuaagugcacacaauaauucaauggcaaaacugacacuggaacaagacuaugggcuccagcaaguccagaccaagcuuuagcacauuugucuugacagcccccuguccuuucaccgugggcuaguucagcucucccuggccagaucuagacuuggcuugaugggcauugguguggagucccagaggccacaacgaagcagauccauuugcucucaucacugcaucucaucaggaaccaucucagccuuuccacuucucccuacccacagccuggaggccucaggagaggacauauccuggggcuggacucaacuacccaggauauaccagaauuauaguuccguacuagccagaaauaagccaccaugauuuugcuuccaccuucacagaugaaaaacaggcuaucagauagagaggccuucaacuuucaguacccuuccucuuauaacuuguucuugcccaaaccauccuugccagcuuccuugccacuacagugggagaggugucuuuuuuucucccugaagccaauccuuccacuugugcacuggagcccaaccuguccagccuaagagacauucccuucaucaguuguccccaucaccaucgccccuucccucucccacuggcucuuucccauuuauauuuaggcacaaguugcuaucaucuuaaaagaaugagccaaccaaaagaucugacaucuuggauggaugaaaggaaugagaaauaaaaggaaaaaaagaugaagggagggaagaugaaaggaacgaaagaaggaaggggaaaagcuagucucuaguaacccuaagcccugauuuguccaccucuggguacuguacauucuaucugcuuccucucucagucaagcuuccacuucccuaccaccuauaggcuccucaaucuacugccauccagccuccgcucccaccacuucacugaaacaucaccacugaccucuucuuucuaaauccaaaggaaacuuuuccuccuuaacucauuugaucucucuacugcauuugauucuauuggacauucccuccaugaaacuuacccugcccuuggucccuugaucucccaguuauuugagaaauacuucucugucuucuuuucaugauccuucuucuauuggcccuuuaaguagucuuucuuaggguuccaaccugggaagauucugggauaaaguagauuagcuuaaccagauuucauguagagacagaugaauagaaggaggagucuaauagcuuuaauuacagcuccucuauuuucccccucuaagaaccugauaggauggcucagggucaguuacuuucuagaauuagcccuguagugggauuauccugaggcacucuuccuagguaaccaucuccauccacuuccuucucaguccagaaacuaucucaauuucacucucauccauuucacugccucaauuucacuuccaucuccuccaugcuaucucccagaucuauaucuccagcucagaacucucuccugaguuccccaaccaaacaugaacuagacaccuccaaguggaaguccccauggcaccucagacauaacucucacaaacucuacuucccuggcacacccaucucagugauggcacucacuaguuggagccagaaaacaaacugugccuuccuugaucuuuuuguuuuuuugagauggagucucgcucugucacucaggcuggagugcagagggaugaucucggcucacugcaaccuccgucucccggguucaagcgauucuccugccucagccucccaaguagcugggauuacaggagcacacuaccauacccggcuaauuuuuguauuuuuaguagagauggguuuucaccagguuggccaggcuggucuugaacuccugaccucaagugguccaccugccucaccucccaaagugcugggaucacaggcauaagccacugcgccuggccccuugaucuuucacugaaccugccccaugcucagacuuaguuaucaaaucuuggggcauuuaucucuuuaguguuucccauauccaucuaguucucuccuuucccacuguccuucuauaauuucaaacuuauuaacucucaucuagauuacugcaacagucucuuaacugaaauagaauaagauaggauagcauagaaaguauaagagugcaaaacaugaaguaaggaaaagugauguuugguuuuaguuaugacuacauauauguauacgugaacugugcaacaugaaaaguauuuaucauuguagguccucagaacugauccuaacagggcuggacaagugucuaagcucccuguaaagccacauguagucacugagcacuugaaauuagcuaguccgaauugagauguauugcaagcacaauauacacauuggauuucagacuuaguaugaagaaaauaauauaagaucucauuaauaauuuuuauauugcaugcugacauaauauuuuggauacaaaauuaauuucaccuuuuuuaaccuuuaaaacuguggccacuugaaaauuuucaauuacacauguggcucaugcuguauuucuacugggcagagcuguucuagaguucuaggccaguaugugacccacaaugggggcuuaagauccacucaaaaauggauugauccuuuccaugucccaaaauauguauuggggugagcaaguaaaaccuuuucuucaaaugcagggacuuuucuuaacuuggggauuggguuaacagaguccucccugcugggaaguacuuccccucaauggauaaaaaauagcuuuuaagaaagucuaauauguuaaagucaaacuuacaaaaaagcucucuuaagggauuucagcauccuggcaugcuuccacaaaccaaacuacuaccuucuauuaaacggaaaugccccuuuaggggcaagggguuuggauucacuucuuuuauuucucuccacagcaccuggugcauugcugugucuggaaguuguuaaccaccuggcugacuguggaucccauggguaaggggaugguagggguugguaaggauugguaagagacucaguuuucucucaguuaucuuccaaaacucugcauugcuaaauacuuuaaaucuuccucacugccugauugaggacauauacaugcacucuuuugauuucuauaugcuaaaucaucaaaauaaaacacagaagcuaccuauuauauuugauuuagguuuauuucuuccauaaggguuuagcauuaggcaaauuggguuggagggguagugagagaacaaaccuaaaagaauggaagaaacuaauugauugauuccaugcuaaauacaccugacuaguaucaauuugcaagacauggauguugcauuuggauagagaccagcaggaagauaccuaauaauaaccuuaggcagaauuccaguugaccacaguaaauacccaaggaagcucacguuuguuuauuuucgccaauauugcgcauuaagaguguuucacuuuuaaaauguaugcuguucuggguggcuaaguagauggcaauauuagcaaaggaagccauugaugucucuggaaaucuggucaucuuuuugaauacuagcagaugagcaugcuaccuccaaacugacauaaugcaccuucugcaagacagcagucucuuggcacugcuccacuuugaaguaaaacccgaaaugaacuccuccugcuaauguggcauguugaaccaacccuuuuuuauuuccaaggccuucucaguugauccauaguauauccaucuucauggaagugacuauugcagucuagaauuacaauuccuucugacaacagaaugcaccccuagaagaacuuguccaaggucauuaaccaaauucucaagcagacaacuuucaggguggcugggccuuguuagaaagggcuucugggacaccugcugagcccagaggaucuuucuaggcauaaucugagggcugggaagauaugaggacacaguccuugcucagaggaguccuuguaucucaggaguuagauuuccaagaagggcuauuacaucauaucacccaaggccacucaguuucucaucuugacagucaagcugaugagucaccuugcaucauguuuaaucaggaaaauaguaaagaacugaaaacaagucaagaaucaagaguaaacauuguaacaauguaaagaguucucagaagcaucucaaaucagagcaccaugguaaaaugguaagaguaguaagauuauauuccuaaaauauaggcucuaucauaaaaccuagguaaugcuuuuguuauuucuuuucuaauuucuuuaucagaguuacugcauucuauuuaaucgucuccuuucuuauauuuuccucuaaugaagaauaaggcagguagagaaacuacaaguuuuccuggcagaagaacuuccccuugaaauauaauucaaucauaucugcaauauuauuaucaauuuguuacuuacagggaucuaaaauauagacugcuuuaaagucuauuuauucacucacguaugccagcuccccacuucauuucagcaacuaggagaaggagccugcccucugaaggagaauccaaguguggagcuucaauccuaaacaggcccccugcaaauauuucauacacuuuccauaguuaguuaagcaacucaguagccacacucuguugauggcuguggugucagugacccacauacaauuuggagcuauaugccugggugcugggagaaaugcagaauuuauacaauuugaaauaugaagacacuagcaaagcuacaagaucaacagaaacuacuaaaaaccagagaaagaaaugcuaauuucauguuuucacuugcugcucacucucuucaucaacaaacuuuuuuauuaaguaguuagcaugugccuuaguuauuaaaguaagaucauuagcaaaggaaaguuaggcuauaaaguauaaaucuaaauuuagaauauaacccuacagugaucaaaguuagcuaauaagagagaaggcaauuugaaaauuuuaguaguguuuuauaaauugguugcaagccccuguuuaaacagagucaaauuucaguagcccaugacaaugaugaacaacguggaaaauuuuguaucauaaguaaaucaaagcaggugcuucaacaguucaacuuauguacaucuguaucauaccuaugcaugugcaugauacacacacacacacacacacacacacacacacacacacacgaaaccagaacugccaaaaagaugggaagggaauguaucucacuuaugaguauguuauagaagaaagaucuuccacuuuuccgguguagagcucuggguucaaaucccagcucugcccccuucaaagcagugugacccuugggcaagucacuuacccucucugaaccucaguuuccuuauuucuacaaugggugggaggugaggguguagagcacauugccagcuuugcgugguucuugugaguuaccaccuggaauaagcugucacgagugaaaguggaaaguaacuuggccaggugcagugggucacaccuguaaucccaauacuuuggaggccaaggugggcggaucaccugagggcaggaguucgagaccagccuggccaacauggcaaaaccccgucucuaccaaaaauacaaaaaaauauuagccaggcauggugcugcccaccuguaaucccagcuacucaggaggcugaggcaggagaaucgcuugaaccugggagguggagguuguggugagccaagaucaggccacugcacucuagccuggaggacauagugagacuccaucuuaaaaaaacaagaaaguaacuugaacuuucuucuuucccuuaauuuucucugcccaucucccucaggcagaagcaaucaagaagcagaauagcuaagagguaaaaauggaaggaaaaauaguaggcaaaagagacugaaaugaugcacaaacuggagcuggaugccgccuuucucuccucugcccuuuaccucugucaggaagguaugugaugcaaauuugaagauugugguuacuuuaaaaaauauauuuuuggguaagcaugggcacaaauauauauacauauguguguauauauguauauauguguguauauacauauauauauauacacacauauauauauugguccagugcuguggcacaagccuguaaucccagcuacuugggaggcugaggcaggaggaucacuugaguccaggaguucaaguuugaggccagccuggaaaacagagugagucucucucucuauuuauguguauauauguauaugugcauaugauaaucuuguaauaugcuuuuaguggucauuuuccuuuaugcuaaaccauaaguuguuuagugacucaaaggaaucccuuaguaacaaacuuauugggaugguuuguaucucaugagaacauagacacugcacuguguaugucauucaguaaguggcuaaagugcuagggcacaguuacuauuaaacugcccuaagagaaaacauuuuuaaaaauagaagcauaggggaaaaaagcccacagggcucuaauauaacuuccucuguauuugugcuuuuuaggaaguuguucuaagccuccuuugaacccuuauuaacucuuauuaagaaauaacaguuuuaugauggguuggccuucucaucugcgagcccuaauuuugcagguucacagaaaaugcuacaucacaaaauccuuuuuuaaaaaacucuucccagggucaaacuccacagccaaucaaaauauuccaccuuuuaacuugagggaaaucgcuaaaggaaaggauagcuuuaacuagugugucuuuuggauugggggacucaaagagaggucuccccaaguuccacaagacuucggaccacagaaaacccaccacccaugcguguuuuugauuccuugaggacacaugcugaggugguugggaacgaaguuucacaucuaccuaaaagaucaugaccagggauagagagacgaccaaauuugggagagcaguuacggugcaguuacggaggcggaaggacgcucucaguaccccguuuccacacuuucauucuuaaaggcaugcaaccccuuucuaaauaaauguagcuccccagguuuccacuaccugaagagaaacccucacagcacacucuggaaauguuuuacaauucguuuuaaaugcguauuauuucuaacuaaaucauugagggacuccuauguauuuauuuauuuauuuauuuugaacauuuucaaacggauggggaaguuuugcuuccauguuuccauuuuuuuccccccaaauuggcauuaggcaccaaaaucaguugaggaacgaagcauuccuuagcuagaauuuaaaacuuaacaagggacucuucccgagcuugguaaagagaauaccauuuuaaaauugcacuguaggauuuuuuuaccuucagacaagaacacaccuaaaaggaaaaaggcccuccccuccucccgaagcacaaaaacacagcauaucccaagcagcccguuuccuacccagccaauacaauaacgcuuuguaaacugagagcagcgcccgguauagaagcuaaguauaaacagcugagaaggauuaggcgguagcgcucuucucauuuacaugaaaauccucuaagcaucguuuuccucgcuggcugcgggcgcauaaggaacucuuuuaugccauagccacgcauacauuuccauccuuugucuuuacuuaccagucgaggcugugggcaugugugcucuauuuccuccaugguuucugagggaggcucauuggaaagggauuuugggauaccuguuucugacucagcaucagugguaacuacuggcauggccagugaaugcucccucuagcucuacacccucagagagucuccucccaggcagagaauguuuucuuugucacguauuuuucuccccucuacccuccacccauccccccgcuucuucuccccuucuuucugucuucccuaggggaaguaaagagguuaccccccgccccucucucucucucucucucccagaagccaagaggcaaggccucaguuuaucacuauaacaaccagacgacacugaagcggcuggugcgggauacaguaucucauuugcauagagcgcgcugguuggcuacugucaucauaguaccacuccgccgggaagcggccgggccccauuggcuagcccuccguacccacgggcccgaacuugcugcuuuuguuucuucuguuuaauucaguugcaaaggucuccguccucucugggcacgggacccgggcugcgccacccagauaacauaaaaccgcuuccugaggggccuaggacgccuugagaaacaacauagcagaccuccacuaauaaaggaccaugucccugggaugagcuagugcaugaugugcuguagucaggauauuugccaaauaggagucacccugaagacaaagccacuuuugagcccaaauucauugugcuaauugccaguggagggccccuccgggcauucacuaugggcaccugaguguucgaccccuggacuucaugcaacgugaacccuggcagauccccucguggccugguguagcccuggagcccuccccuggggcugcccuagggggaacuuugaaggagguagauugucuuuaacagccugccuccuacuccuggcugcccuuucgcaguugcuuccucugucagccacucuuccccuuccccagcuauucaaaguuuccucaagaagucuugcuguugugugccuuucaauacacuguuccaugcacugcucuauuuucucuugguuccuacuuuaccagucgugggucccauuuccgaaguacccugcucucagccaaaugcucauggcaaucagagauggaauguuaacgaucaggugcuuuaaugucuacauuaucuagggacauucacauuuuaagaggagcauucugaagacacacauccaaagaacuuaccaagguauucauugugaauugucacuuuuaauauuaauaaaaaaucaugaugaucccuggcauuuauuaagcacaagcacggugcuaaguacuuuaccuaguucuuguuuaaucuuugugagaacccaaagagguagauccuauuguuauccucauuuuacagguauucacauucacaaaauucuaaaauaaugcagcugggauuugaaggaauuuuuuuuuuuuuuuuuuuuuuuuuugcgaagggcgagguggugggggcgggcgcguagggaccagggaugcagcagguguaguaagaaaaggaucuaggcaggaguccucuuaggacaagucccugggcuucuacaucuuucauuuuuaucuacaguagugguuuucauucaaguguggucugggaccagcagcaccaacaucagcaucaccagggaacuuguuagaaaugcgaauuauuggcccccugccagaccccggaccugauucaguaagucugggguggggucagaauuugcuuuucuagagaguuucuggguguuguuaaugcugcaggucugggaacuauacuuugagaaucaguagcccaaaggaugggauaaaaauaccgggcuugccuccaucacagaaaggagaucaaaugagauaucaugucauugcacuuuuugaauuagaacgugcuaugcuaauauaaggggacauuauuuuuauuacuccucaauaagcaaagagggcuaguccuaaaagaagaagaaaauggauucuguagcagagaauuacaguuugacaguuuuagaugcuggcccuuuaagucagaauaacaucacuuaagaguauuaugaccuauacaggacagaacuccaguguugugagaauuccagugaugcuuccuacccuauuugcccuccuggaagcacaaaacacuuccagcagcagguuuaacucuaccagcucaucaccuggaagagccaagcccuguguuacauuuaggagcccuuuuccuacguguacugggugacgugcaaaugacaugguuauucuaaucucaauauauguauuuuugccuuagagcagugguucucaaaguguacuucuccaagaagugcagcagcagcccuggucacuugucagaaauucuggauccccaccccagaccuacugaaucagaaauucuggcuucccacuccagaccuacugaaucaaaaccuccugguuugggaggcauucugacccacgcuaaaguuuacaaaccacuaccuuagagucacuguucacauuggaaagcaccuaaaccccacuguauucuuggccacugagccaccccuugguuccuaauuggucaccuaauucucucuccagaaugagagguucaccuguucaccugcucauuuuaaagaguucugaugucuagcugaguccuugugaacucuuguccaagagccuaggccauuccuuuagacucccaauaucuucugucucccuuccucaccuucuucuccuccuaauccuccccugucccauugaaccaagauacugccuuugccuaggauaucuucauuguauuacccacaucaaauccuuagcuuucagugcuacuuugugcuaaguccgucacaccugacacuuacucaucccaaguccuugaacuuugaaauuuagacuucugucuaacugcccugagggucagcucuauaacuaauuccauucccacuaauucugcuccagccuaguccuggcuucuuccugcuccucuccccacaguccugugauugaaucucagcaugucuugcagucuuaauggcagaaauaggcucuuucaggcaccacucugagaggaguccuuaacagauccacccacuuuggagaccaguccuggcagcugcuacaaccugacucagaaacuucuugauaauacuugagugaguuauuuuaacuugggggcauuguaaugcuaucaagacaauuagcuaagaaugaucaguuaauuccacacuacagagcuaaauauuccauaaggguuaugaaggggaugacuaugaagggauagcaggagagaguuuauugggguaauggaauuauuauguagcuuuuuuuuuuuuuuuuuuuuucagacaggaucuuacucuguugccaggcuggaaugcaguggugcaaucucagcucacugcaaccucugucucccaggcucaagcgauccucccaccugagccucccaaguaucugggaccacagguguaugccaccacuccugucuaaucuuucuauauuuuugguagagacaggguuucacuguguugcccaggcuggucuggaacuucuggccucaagugauucaccuuccucggccucccaaagugcuaggauuauaggcgugagccacuguggccguccaagaaucauuauguaucuugauuaugguaaugauuucaaaaaauccaugcauguguuaacuucauuagaaauuccauagaggauauuugucaguauaugcuaacagccuuuagaauauucauacccuuugaccuagggauuccacuugguaauuuaucccaaaagaaauagagaagcacacaaauaauuauguacaaagaugcuuaaugcagaauuauuuauaaaaggcaaaaaagauacaacuuacagcaauaguaggaauaguucaaauaaaaauaaguccauauaauauaguauuguacacucacuaagagucauguuuuugaagaaauucuaauguuaugggcacguguuagcauuauaguguuagaaaagcaggcugcaaaaugugauuccaaaaacaugagcccaauuaugucauauguacaugcacagaaaaaagcauuggaaggaaauauaucaagaugcuaaaagugaaaucuuuaaacugugggguuauggaagauuuuuguuuuacuuuaaaacaaauuuuucugccuuuaacaaauauucaaggcugggcgcgguggcucacgccuguaaucccagcacuuugggaggcugagguggguggaucaugaggucaagagaucgagaccauccuggccaaacagugaaaccccgucuauuuuaaaaauauaaaaauuagcugggcguguuggcaggaaucuguagucccagcuacucuggaggcugaggcaggagaaucgcuugaaccucggaggcggagguugcagugagccgagaucacgccauugcacuccagccugggcaacagagcgagaugccaucucaaaaaaaaaaaaaaaaaaauauauauauauauauauauauauauauauauauauauauauucaaaaaugagcauauauuauucuuuuuuuuuuugagacagggucucacucuguugcccagacuggagugcagucacgugaucacagcagccucgaccucccagacucaggugauccucccaccucagccuuccagguagcugggacuacaggacacgcaaccacgccuggcuaauuuuuuguagagaugguguuucaccauguugcccaggcuggucuugaacuccugagcucaagcgaucugccugccucggccucccaaauugcugagauuacaagcaugaggcaccgcaccaacccuauauuagucuuauaauuagaaaaaaacaaugaacauuacuguccuccccaaagucaucaagagcuggguauuaggguuggggugagacaggcaugguuagcucaugagcaaauagaaagaugcacagaccucagugagaggaaacaaaaaagcugaaaccgaggaacaaagcuggagcaaaguccuaaaguccuaucuccaguuagcagaggcagaggaaacauguuggagguaggcuguucagaaaagucccagagaauguuuaggaacagggcuucugagucccaugaccucuacaagaagagcaugccuucugugagaacuugucagaucagugcugucccuaacaaggacuaucaugauuauuucuacuguuuauugaguaccucuuaugucuuuagcacuaugguauuagguuggugcaaaaguaauugcaguuuuuaccauuaaaaguaaugacaggccaugcgugguggcucacgccuauaaucccaauauuuugggaggccaaggcgggcggaucaccugaggucaggaguucaagaccagccuagccaacauagcgaauccccgucccuacuaaaaauacaaaaauuagccaagcguguuggugggcgccuguaaucccaucuacuaaggaggcugaggcaggagaaucgcuugaacccaggaggcggagguugcagugagcagaaaucacaccauugcacuccagccugggcgacaagagcgaaacuccgucucaaaaaaaaaaaaaguaaugacaaaaaaccgcaauuauuuuugcaccaaccuaaugcuuaucauagccuaccuauagcccugacaacacccaaucagauagguauaguugccccacuuugaagaugaggaagccaagccauagagaccuuaacuucagcuuggaacacaccuacaaaugacaucuaccuuccuacaagcaguccucacaucaacgucaucaaauuguugaaaacauuauuuucggccaggcacgguggcucaugccuguaaucccagcacuuugggaggcugaggcgggcagaucacuugaggucaggaguucaagaccagccuggccaacaugaugaaacccagucucuauuaaaaacacagaaaauuaguuaggcgugguggcacaugccuguaaucccagcuacucgggaggcugaggcaguagaaucgcuugaacccaggaggaggaggaggugucagugagcugacauugcaccacugcacuccagccugaacgacagaggagacuccaucuuaaaacaaaacaaaacaguauuuucaaagaucugcaaagaagaacuacuagguuggugcaaaaguaaaugcaguuuuugccauugaaaauaaugacaaaaccgcaauuacuuuugcgccaaccuaauaaaguacucucuuuggaggagaugcugucugaacccugccgaaauccccucaggacuuaccauaaugacuaugacguuaccauagucaacaccugacccacugucaacugccagcaccugcaucucucugccugagggcuuuaucuggccauuggaaagcccugcccucccaacaccaccauuaagucagaacuaaagggccagaaaauuaacagcccauauccccaagagcucucaaccaaugauugauagaagucaguguauaaauacccuaguuuccucagcccucaagugaaauaacucugaacugcauguucuacccuaacucccagagucccccagugggauuaaguuccacuugccacagggcacccuuuaucaguugccuuccuuuccuuguuucacuuacccaugcuccuguauuuccuggaaucggaucaucucccaaauaaacuacuugaacuugaaucuuucuugcagagccagcuuauggggcaucucagaaggucucaagauaccauuaaggugcccaccauaaaauucuuuuuuuuuuuuuugagacaaagcuucacucugucacccaggcuggaguguaguggugugaucaucuuggcucacugcaacuucugccuccugguuucaagcgauucuccugcuucagccucccaaguagcugggauugcaggcacacaccaccacacccagccaauuuuuuuguauuuuuaguagaggcggguuuucaccauguuggccaggcuggucucaaacucuugaccucaaaugaucugcccgccucagccucccaaagugcugggauuauaggcaugagccaccaugcccaggccugacucuacuauuccuuccacguuucuuuucuuucuuucuuucuuuuuuuuuuuuuuuuuuuugagauggagucucacucuguugcccaggcuggagugcaguguggugcaaucucggcucacugcaaccucugccucccagguucaagcaauucuccugccucagccucccaaguagcugggauuacaggcaugcgccaccacgcucagcuaauuuuuuuguauuguuaggagauacgggggguuucaccauauuggccaggcuggucucgaacuccugaccuugugauccgccugccucggccucccaaagugcugggauuacaggcgugagccaccgcgccuggcccacguuuccuuuuuuauucauuuucuucucacugccccagauuuaccaaacaagaaauuuauggcgggguggcgugacucacaccuguaauccuagcacuuugggaggccgaggcagguggauagcuggagcccaggaguucgagaccagacuggguaacauggcaaaaccuggucucuacuaaaaauacaaaaacaugagccaggcaugguagcauguaccuguaguuccagcugcucugggggcugaggcaggauugcuugaaccugguaggcagagguugcagugagccgagauugcgccagugcacuccaaccuagaugacagaguaagacccugucucaaaaaaaaaaaaaaaaaaaaaaagaaauguaucaugaagaaggaagggaggaagggagauggaaaacacgggguaaagaugacagaagaauuucagauuucccagaaagcauuauuaccuccuauggaauuuugcuacuuuuaugucucuguuuugagccacuuucccaguuguccacauguggcuuaaggucugggccuaauaguacaggaaaauacucuaccauacuaaguaaugaaauccauacauaaauccuuuccacccauuccaggaaaauuauaguaguaaaaauauuuuucaguagaaagcguuucaccccucccuuggugcuuuuacacauugacuuauaauaacacuaugagacugacauguuuuuauacugaaaaauuucaaaugaaugaacaaauucagagcaguuaagugauuugaccauggucacauaguaagugguagaaguaucacuugaauccaggucucuugaaucaaaguucaacacuguuuuccaccaaaccacgcugccucauugugugauacacaguaguuagauuugcuuuauuaacaagccugcugagcuaacucaugcagaucucaucaucuaauauaaccccuuaaccccuuuucuauugaauucauguacaugaagcacucuuuacuuuuauucauucaguucauuucauauuugugcaaccguggauuuggacucauuuuaaaucuugaauuuacuaaugacaagaaaaauaaacacaguugcggccaagugcaguggcucacgccuguagucccaacaauuugggaggccgaggugggcggaucaccugaggucaggaguucaaagacagccuggucaacauggugaaauucugucucuacuaaaaauacaaaaauuagccaggcgugguggcggacaucuguaaucccagcuacucaggaggcugaggcaggagaaucacuugaaccuggaaggcggaggguugcagugagccaagauugugcuauugcacuccagccugggugacagagugagacccugugucaaaaacaaaacaaaacacaguugcauuuccagggacaccagugggucaagagcucggcugauucaggucuaugaccuauaaaggccauuagggggaggccaaggcagguggaucaccugaggccaggaguuccagacaagccuggccaacauggcaaaaccccgucucuacuaaaaauacaaaaaaaaaaaaaaaaaauuagccgacugguggcaggcgccuguaaucccagcuacucggggcgcugaggcaggagaauugcuugaacacgggaggcggaggcugcagugagccaagaucgcgucauugcacuccagccugggcaacaagagcgaaacuccaucucaaaaaaaaaaaaaaaaaaaaaaaagcccauuaggggaaaaaaauaauggugagacaugaaaauagucagggcuucaaaaucuauuauugcagggggucgcgggggggggugguaaucaagaagacagaaugaaagugcuuuguuuuauuauuaaaauugauuuucuucuuuuucuaacuucuauaauaaccaaaaaagaaaugaccuucacucaucaaugugaccaaaauuugaauguaagugcaguuuuaaggagcuagggagaaacugcgcagacccaacaugacaaaccuauugcauacaugaaaauacagcuaacaaaaugccauuuuacaucuuacauuuaaaagaaauauauauuugcaauugguuggggagaugaacaguaaggagcuccaauauucuuuuuuuucuuuuuuuccuuuuuuuuuuuuuuuuuuuuuuugagacagagucuugcucuguuucccaggcuggagugcaguggcaugaucucggcucacugcagccucugccuuccgguucaagcaguucuucugccucagccucccgaguagcugguauuacaggcaugcgccaccacacccggcuaauuuuuguauuuuuaguagagacgggucucaaacuccugaccucaagugaucccccaaccucggccucccaaaacgcugggauuacaggcgugagccacugcgccaggcccagcuccaauauucuuagcacucaaggacaccagucauugcaccuguguuuaagaaggucuuaaaagagauauuuuuaaaaucaaaacaagauguauuauuuaaaugcugauaaaaucaguuguauauaugauauauuuuguuuugcucuagcaaaacaaauaugacggcaggguuuuuugcauaaauuaaaguugcccuuagcuggaauaaaucauucuuauugacauuagcagcuguguagucaguaaagaaugauuguugcuauuacuuggugguauuuauaaacacuuuuauuuucuaagugcuuuacaaucacuuauugucuaauuaauaucuaaucauccguuuacaaguaauaaucacacauguagugcaguuuaaucaaaacuccaaauacagccgccaucauacucaagagugccauguaaauuuuggucccuucuuuaugggguuugaguccagacaugcagcugaaacagauaauacaucagaaaaaaaauggauaaauauuccucacuuauauuugagcauaauuuggauucacaacuuuugcaugccaaauauauuaucugaaugucaguggaugaguaagaccauagguaauuuucaacacuuaagggcucauuugcacacacauauaaaauuguaauuuauuuaacccacaaaauuggaugauaguuuaugauaaauguacaaggccaggcacugacuuaacauugaaacucuuagucacaaucacuguuucagucauuuuaaugaaaaagagcaaauguagcaaagguggcucagagaccuucaagguuaauaaucuaaccagguucaagucuacaccaagcuacgcccaguaugaacaccugccagucuuaauuagcuaacauaaguggauguacugcugucucccuucagucuccccaaguguuauucuauaagcaauuauaggaaccagaaaaggauuuuuuuaagcaggugaaugaugugcauauuaauccaguuuuucuccuucuaggaugaauuuucuuaaaguagaauugcugagucagaguauuuauguuuuuaaagcuuuugauacauguuuuuuugacacuguuaucaaauuauccuccagcaugggugaccauauguacacuucuuugcauaccccuaaagaguggucuuucuugauuauugguguaccauaaccagauuuccuccuugcuguccuaccaggcaguuucccaguacuacagcaaguacugcaggguccugaggauugugccggggggccuucugcauaugauacaaaugagcuugauugacaagugagucaucaggaccaucugacgccaggagggauacauucauuugcaaguaaacuauuauuacaaucaucggacuuuauacuaauagauuuugaaugacauggucuccaaagugauucuuugucuugcaaaaucugcacucagagucuuugaaugcucaaagagagacuccguuuaaucuucugugcuucuguguguuuucuacggcugcuguaacaauguaccagaaaugugauggcuuaaaacaacacaaagauauuaucuuaaaguucuggaccagggucagaagucugaaaugggucucagugggcuaaaaucaauguaccugcaggacugcauuucuucuggaggcucuaggggaaauuguuucauugcuuuuuuuuuuuuuuuuuuuuuuuagcuucuagaagcugcaugcauuccuugacuccuggccugcuuucuucuaucuucaaagacagcaauugcaucacuccagccucugcuucacuggucacauauucucuaagucuccugccuuccucuuucacuucaaaagacucuuguaauuacauugaguuccuuuggauaauccaggauaaucucucccaucucaagaccuuuaacuuaaucacaucuauaaagucucuuuugccauauaagguaacauauucacagguucuggaaauuacaauguagacaucuuugggaggcccuuauucuuccuaucacaucuuccuuagcaugagcugggccugguaucucaucuccagauauuauggaaauauggcuaacagucauucaauugcagacaauugcuaacauugucuacaauuuuaagacuuaguaauuuaugacauccuucucuguaucagaaacaggcauuaugucuaguuugcagauaagaacuggggcucagagacauuaaauaauuugcucaaggucacagaacuggucaguggcagaacugaguuucacauuuaggacugugggaccucaaagcccccacucaaugcaugaugccuugguaccucaacauuuuuaaugcucugcucauucugcucuuuuuggauagccuucacguugaaagcuuuucauuuaguuuguuugacauuuaauaauacaaccuagcuagauaaaagcuuuuauuaaggcccuauaaauaucauauuugacucauucaguaagugccagugcaggaugucaucacaaaacacacauugaagauaaugucuccauauccucuaauaaaucuuccuaaaaguggcaucaaauggguucuuccucugcaauacaaacagaaguggccucaccagguuuucuucucugugggcaauguguaaaucugugaauaacagguggugcuggugagaaaugaucuuuccaaaagcccacgaguauacaaauauccuauucuugacaaagagugucuaacacuuuaggggugucuuagucuguuuuaugcugcuauaacagacuaccacagaguggguaauuuauaaugaacagaaauguauuuggcucauaguuguggaagccgggaagaccaaaagcauggugccagcaucuggugagggccuuuguguuccaucaucccauggcagaaagcagaagggcaagagaaggcaagagcaaggaagcaagagggaguugaacuugcuuuuauaacaaauccacccuugugguaacuaagccucuccuguguuaaugacuuuaauccacucaugaggucagagcccucaugaccuaaucaccuauuauuagacacuguugcauuggggauuaaguuucuaacacauaaacuuugggggacacguucaaaccauagcaggaagucuaaguuaaucucuuaauaaagacgcuuauccacuuugcuuuauucuggaagguucucaaccuugguugugcauuagaaucaccuuaggagcuuucaaaaacacugagggcugauuccugcucccuaaagauucugaucuaauuguccugggguuuagcaucagggcuuuuaaaaguuuagaacaaaaaaaaaguucagaaccacugugaugaaggagagaugaugagacacuuuauucauacauggauuuugaccccaaaacuauuuggcucucaaauagaaaaaaaggaucucuauuuuguuuguaucaagagugagaaacccuauuuguguaugugucccaggaagcuggcuauguaaaaacuuucaauaucuccaaaagcaaucauuuuaaacaccuagucuacuaaaaugccagaugagaggccaugucaaaugacacuaaggaggccagguaugguggcucacgccuguaaucccagcacuuugggaggcugaggcgggcagaucaccugaggucaggaguucgaaaccagccuggccaacauggugaaaccuugucucuacuaaaaauacaaaaauuaccuggaugcgguggcaugcgccuguaaucccagcuacuugggaggcugaggcaagagaaucgcuugaacccaggagguggagguugcagugagccaagaucucaccauugcacuccagccugggcaacaggggcaaaacucuaucucaaaaaaaaaaaaaaaaaagaggaaaaaaaagacacuaagggugccugagaguagcuauaugcggucaaugaucuuucacagaagcccacccuugcuuugagaagauauucucuugaguaagcaaguaugauauaagcacaucuucaaagaaaaauaauccuuuauuucuacaaaauggucuggauaacaaccucauuccaccauucaauugcaggaacucaacaggagcaaaaccauuagcagugaaccauggcagucucuagcacauaugguacuaccauugcucaaaacauuuuuggaauaagucuuuggucaucauuugaaagugugaagauaacaauacucauaugaauauauaaguuauauuauccuuuuuaaaaaaagauagaaaucaucaaaaagacuuuggagacuccugacagccaaagaugaaaaguuuaagcaucaauaaggauaagaacugcaauugauggaaacguaucuaauguuuuucaaugcaugaguucauaauacuaucaaaaguaaccccuaagccucauuugucugcauugaaggaugcuagagaaaaacacauuauuuugaaaacugggaaaugaucaagccuuuauuuaaccuuuccuauacaaacugucccucuaggucaccaaacaagagaaguaucuugucuuagaaugaguaaugaagaagguaagaugguaaugaauuauguccacuuuauaaccccuaaggaaagauugggcuuaggcacuuagcaucaacuacugcuaacaugacagaaagacaggcaauaccaaacauuauguacuccuaauagaaguacauguacuaccuaugaaauagucugccaaguaaauagaaccuggcuuugaucacaccucuugaucugaggccaauuuacaggaaauacagaagggauaaaggaguauguuaacaccacagggaugcaaucagcaaaaucuagauuguggaaaacucuauagaacaaaccuuguuucuucaaccaaaaaauugcaagaagccuauggauuaaaugagaucuaaaagacauaucaaucaauugcaauauguacacuguauuauuugaauccuaauucaaaacacuguaaaaaugacaauguuuauaaaacaguuagaaauuugaacaauuucuggaugcuaugaaggaauuauuguuaauuuauuuagguauaauaaugauacuguagcugcuugaggucacucacaccuguaauaucagcacuuaaggaggccaggaccagagaaucccuugagcccaggaguuugagaacagccugggcaacauggugagacuucaucuccacuaaaaauaaaaaagcaaaacuagcugggugugguggugugcgccuguggucccagcuacuugguaggcugaaaugggaggauuguuugagcccaagagguugagacugcaguaagcugugauugcgccaccgcacuccagccugggcaacagagugagacugucucaaaaacaaacaaacaaacaaacaaacagguauuguguuuauguuuucaaaacuauuuuagaaauauauacugaaauauuugcagaugaaauauguuguuuggauguggggaguggauagaaucagugguucucaacuggguacaauuuugcugcaagguacauuuagcaaugucuggagacaguuuuuguugucacaucuuggggcugggggugcuguagacaucuagugggugaaggccauaaaugcugcuaaacauccuacaaugcacaggacaaucguccacuguaagauaauggcucugccccggcacccugaugaccuugaauguguccauagaggcaaaggcuugacgugcagcucaucugaguguuggagaacgccuugugauccuccuggaacaagcucuccuggaacagggaggccugugaagaguuguuccagggcuauuugccacucaccuccuuaucuccccugagcaacugucaugaagcaguuucuaauagucucuuuguuuggguugggauaugggucuuccugcccugccccucccaguacaaaguuacagaacagaaaaacacuuaguugcaaucuacagugggcuccucagcaaugggagucgagguuauccggccccuuuuguuguagaguccuucuuuuugguaugugggacaagcacaguacgaagcuggcaccacaggcuacuguuuccuuugcuauguaaguaauaaacugucuuaaucuaaaagugauuaguuauacuuuuaccagucaagucauucagaccuugccuugucuugugugugcuugacacccaugacaaacaauuuucuagcccaaaaugucuauuaugcugagguugagaagcucuagaugaagcaagaugggucaugaguugauuacuguugaaguagguggcaaguacaugaacaguacaaaugguaauguacuauuaauaucuugucuaauuuuguguaugguugaagcuuucccuaauaaaaaaaauuacuuuaagaaggauaaaaacuggucaccuugcuuuuuuagauguaugacauuuuaaguacauauacugaggcaauaugcacaaaugcacaaacuuugcugucagauuucuagcuccaccaguaaguuacaaacucuguguucuugagcgaguacuugaccucuuuaagccucaguuucuuccacaauaaaauaaaacuacuuaugcccccuggggguuuuguggggauuaaauauaagucaaguguuuggcugaaugccuuaaauaaauaccuuuauuagaccaucuuccuuuguucuuuuugccugcugcuuuucaauacagaaaugcaaagagcccuucuuguuaucuggacaaguaauuuugaucuagucgauuucuuuccaaauaauucccuggaaaauguagauagauggcccugaucugaagcguuuuauucuaaguguuuaaaacagcaaacuggccaggcgcaauggcucaugccuguaaucccagcacuuugggaggccgaggcugggggggaugacuugaggucaggaguuugagaccagccuggccaacauggugacacccccaucuguacuaaaaacacaaaaacuagccacugcgugguggcgggcacuugugaucccagcuacucaggaggcugagacaggagaaucacuugaacucgggagguggagguugcagugagccaagaucacuccacugcacuccagccugggugacagagcgagauuccgucucaaaaacaaaacaaaacaaaacaaaacaaaacacacagcaaacccuggagggcuccaggggauggggaaugagaaggaauguauauggugaauucaguaguucucagcuacugaaugggggugaucuugucccacaagagacauuuaacaaugucuggagacauuuuugguugucaugacuuggggaaggggaguacuacugguaucuagugguuagagaccagggaugcuauuaaacauccuauguccuaugcacaggacagccccuacaacaaagaauuaucuggcccaaaauaucagucauaccaagguugagaaacccugggcuaauguaaccaaaauuucuugaugaaccuuuccuggguaauuaacuuugccuuucuuuguucuucuuaccuaacgcauacagguuauuaaagacaugcucaggagaaauucgaaaugugauuacucuagcucuguggcccuaauuuguuauucauuucuuuaugagaaaaaaaauccaaguaguguucugauuuuauugccuucaaguuucacuuaccaaacucaaagcaugcacugauuaccuucuuaauuaauagauugugaaagcggggcaucacuuuauuaacucguggaaaggacguaccaucuccugacagcucuguagucuuuguuuccaacuauuaugccaaugggggaggauugagaugaaggggauucagacacugcuccacaaacagauuauauuucucuuguuaaaauagcccaucuuuggccaggugcaguggcucacgccuguaaucccagcacuuugggagguugaggcagacaaaucacuugaggucaggaguuugagaccagccuggccaagauggugaaacuccaucuccgcuaaacauacaaaaauuaccugggcaugguggcgcacgccuguggucccagcuacucgggaaccugaggcaggacaaucgcuugaaccugggaggcagagguugcagagagcugagauagcaccacugcacuccagccugggugacagagcaagacugucucaaaaaaaaaauuaaaauuaaaaauuacuguugaauuagguaagggcaagacaacuguaaaagcuaggggacaacauugaaaaacaccuaggauuccauauucaaaguguuuugaagauaucuuaaguuuucacucaauuuagaauaaacuaaaaauggaaauaauaggcaaugcauaugugucugccuaaugaaaaaauacaacacagagcucuaaucaguggcccaaucaaagguuuggcaaauuaauaauauauuuauuuuaaauuuaaauaaaauguuuaauguaugcauuuaucacuuuuaagugaguccccauuauacucauuuuauuuuucuuuucuuuucuuuuuugagacagagucucgcucugucacucaggcuggagugcaguggugugaucucggcucacugcaaccucugccuccuggguucaguugauucucuugccucagcccccugaguagcugagauuacaggcgcgugccaccacgcccagcuaauuuuuguauuuuuaguagagacaggguuucgccauguugaccaggcuggucucgaacuccugacugcaggugauccaccugccucggccucccaaacugcugggauuacagucgugagccaccgcgccuggccccauuuuauuuuucaauuaacugaccaacugguccccacuguagaggguaagaagacuucuacuguacuuccuggugacuauaacucucuccuaccuuguauaauggagaaagcccuacaaagcuuuuuuauuaauucuccauuuuuuuguuuugaauucuuugugugagacuuaagaaaguccuucauuugccacccuaagguaagauguaguaaccacauggaaaaaaauuuaugaggcagguaggugcacaagucuuaccuaucucucuucgaggcugccccagcuccugccuaccucugagaaagcugaggaguuguagaagguugagucugccaucugugguaucucuaggugggucucgccuggccuucagacaucagaaaccucuaacaacccuaggagucuggcaggguugagguagagagccuuguaaacagugaucacaacaucuguguugcugguguuaaugauaaugucaaucaauuuagacgcuagggucaaguuggaguugguccauccaacauugauccaugucucacucaaaaucuggguugaaacccacucauucuccugaacagccuagagaugaccuuagauggacaaacucaggaguuucucugggcaaggaggauacagaauaaacagugauuuaaauuccuuucacucauucuacagacauuuacuaagcauguuggaagucaugcauccaagauaaaugugaucaucuccacucucaaaggauauauagaacaagaagauauauguaaagauauauguaggacaaacucuuaaagauugauuuuuugguaaauauaaugguacuauuaaaaauuaucauguuagucuuugcuuccaaaagaaauuaucauuaaguuauucuauacuuuuauuuaugacuuacaucaauggagcuaagaaaaacagauuugaaauagguauuauuuuugucuuucuccugggccauauuuaccaauuuuuaaauuuucuuuucucuuuccguguaugugugugagugugugugugugugugugugugugugugugagagcgagagagagagagagaauuuguaguucauggaaagacaaagaaaacuuuaaaauguucuaauaccuggggcaggacugauauaaaaaauauauuucacuucuugaggccucauugugagaauggggcaaaauuaauuuuaugccaguugcaccauuuucuuuaccccauaguauuugagagcuggcuccaaguccuugagaauaaagggcaaaaauaagauaaacucauaagacuuauuuucucucacauuguucccagcacugggaagacuggggaagccccagauuucacaagagacacucacaagucuagccucucacuccacaucugcuugcaugguaauugggccauuucagggagccaaagaggaguuagggaaggcauggucaccaaaacuugccuuagaggaccacaguggguaggaaucuagggucugccagggagagguuagugcacucuagagagccagauucacgucgcuucuuggccuuuuggcuaagaucaagcggagagccagauucagaauuagccuuugcuccaccugucaauguucagagugagaacuaucagcagagcagccuauggcagugauuauacauccacuaggugaguuaagaggacucuugaaucagccuaccccuuaguuucugaaggagacaaaacuguguuggguuagcuugaaggcuguacacauacauaccuguaauauuagggcucagguagaggaauugcagggagauagauaagaggaaagaaggccuacugauguuuggaacaaaagauaaaaauaaggcuggaugcaguggcuuacaccuguaaucccgacacuuugggaggccgaggcgggcaguucacuugaggucaggaguuugagaccagccuugccaacauggugaaaucccgucucuacuaaaaguacaaaaauuagcugggcaugguggugggugccuguaaucccagcuacucaggaggcugaggcaggagaaucgcuugaacccgggagauggagguugcagugagcugagaucgcaccacugcacuccagccugagcaacauagugagacuccaucucaaaaaaaaaaagguaaaaauauaauaucuccuuucccuuuaaguggcuuuuaaaaaauguucagauaucuaagcuucauaaauuuggagaguuuuaaguuguucaauuccuuccaaauaaggacuaaauauuuaauguacauuuacauuguuucuauuaauuuuucuuuccucacuauggcuaaaaauuuuccuuaaagaagacaaggaagggacaaaccauauccuuugaugcucacugcuaaauugaggaauuggguuuuauuuuugcuaaaaagacauggcauuaauguuugcuauaugucauagaccagucccagcaagcuguaagaaaccaccucugcuaaggauauuauggaaaugcaagugccauucuucucuaauaacucaacauucucucuucucuccuauuuauuaccuagaaccagcaugggaccuggaacaugugccccacagaucugaggacugauggagcuaacugaugacuggugucugggaaggcagcauguuugccacccuguucucacuucugaaggagcugaaagauuuaguuuccaaagccucuggccagaucacacucccccuccccgcaagugaaugccugggaaucaucucuuucucacagacaggaagcccuuaucucaccaugaagacuuggcagcaaagacugguaaagaggaaagaacaaacugggagucaguuuuccuuuugauaaauguauucgcuguagaaaaucggaguccacuucaauaaauggucucuugaaagaacugucucugucagucaaucagcagauauuuauugaacccuuauuucauaccaggcacugugcagagcccacaggaguaccuuuuccagggaaucacagaauauaguggaagaagugagggcuuuggaauuagaucuugauccagucaaaauuucagugugaaaguguuuuaugcuaccauucuacuuuaauauccaaaggcaaggaggaagguuccuuccuccuugccuuuggauauaaaccaaguaguguaaaaugauuucacauagaauuucaaaauagcagaaggguugguagaaauaacuaggcuaaccacauuauuuccuacaagggcaccuuaggggaucccuguuuuaaugaauaaauaaaaaugauguguaauuaucauaucaauugcuugcaucuaagugagugcuucuggaguuauuugauggugcuuaaaaaucuuuggucucugaagugcauuuaaccaucuucuuaacucuuaucuauauuauuaauuugcagaucaaaguuaacuuugugcuaugcaaaugaggggacuucaaaugaaugagauuuuacuguaaaauuuaaaauccauauuacuuguaacagaacugcaacauauuuugaggacaugccucagcauaucuaaaagagauauuaugguuuaaagcagaauuuucugcaaugauggaauauucuauaucugcguuguccaaauagaauagucacgagccacauauaacuacugagcacuuaaaauguggcuagugucaguggcucaugccuguaaucccagcacuuugggaggccaaggugggcagaucacgugaggucaggaguucgagaccagccugaccaacauggcgaaaccccgucucuacuaaaaguacaaaaauuagcugggcaugguggugggugccuguaaucccagcuacucgggaggcugaggcaggagaaucauuugaacccaggagccgagaucgugccauugcucuccagccuaggugacagagugagacuucgucucagaaaaaaaaaaaaaaaaaaaaaaaaaaguggcuagugugacugaggaacugaauuuuaaauuuuaauuaauuaauuuuaaguaauuaaaauucuaauuuaaacagcuguaugugguuagcggcuaccuuauucaacaguguagauuuaaagaaaaagugaaauuggaugcugggaacccaaauuccagcucuauccuugcuaucuuggacaauuaaccucugugagcuucaauuuucucacuugaaaaugggaauauaggcuagggcucaguggcgcauaccuguaaucccagugcguugggagguuuagguggaaggaucgcuugaggccaggaguucaagaccagccugagaaacacagcaaaacccccaucucuacaaaauauuuaaaaauuagccagaugugguggugcaugccugcaguccuagcuccuuggggggcugaggcaggaggaucacuugagccuaauaguuugagguuacagucagcuaugauuccaccacugcacucgagccugggcaacagaguaagaccuugucucaaaaaaaaagaaagaaagaaagaaagaaagaaagaaagaaagaaagaaagaaagaaagaaagaaagaaagaaaggaaggaaggaaggaaggaaggaaggaaggaaggaaggaaaugggaauauaaauaauaucuacaucacaguauuugaaguaagaggaauugagguaaugucugggcauucucuuauuuccaaauaaguaccaaccaaguaccaaaauuaaacauguggaaaauaaauacucaacucucuuauuuaaagguaguuuccauuuccugagagcuauaaaagauuauuaaguucaugauuauuuucaccuuucagauucaauauuuagcagcaaugcuuguaacuauuggcuguuaaguaacuccaccagcaguaaccagaaauggucgugugucagcuuggguggggguaucaaucuaugguacacaaagggcugguagucagaaaguuuaauuuacagaaguugagccugccugugugagaaaaguacacugagaaccgaaaagcaugagaaaaauguuaauaaaaucauucuuuauuauuguuaccauuaauaauguaauccauuuuaauugcucaaggagguuaaauaagccuauucaauuuaauagagaaaucaaggcacaaauuagcagcauaggcaaauggucaggagcuugaguccuuuuguugaauacaauuacauaaaauaagccauggaaaguacuuagcccgggacaugucacccuauaaugucaacuauuauaauaaugauaagugauacauuugggagaccaugaaauuagaggccuuugucuauuuucaauuugcaaaagguaucagaauacggagugauauuugcacagauuuaauucuacaugacuggaacauagaagaaucaucucaacuuuccauaucugcaccaguccagaacugaaucuaguuguuuuuuuuggcaacagagucucacucuguuacccagucuggagugcaguggcaugaucuuggcucacuguaaccuccaccuccuggguucaagcaauucuccugccucagccucccaaguagcugggauuacaggugcccaccaccaugccuggcuaauuuuuuuguauuuuuagucgcgaggggguuucaccauguuggccagucugguuuagaacuccuuaccucaagugauucgccugccuaggucucccaaagugcugagauuacaggugugagccacuguggcuggccuacaucuaguuauuuugauacuacuucaaaucuaauuuugaaaugaggcaugaaugaaugaaugaaugaaugaaucaaucaaucaaucaaucaaugccuccugauucccccauuaacucaauacaauuggcuaguaaaacucaugagucuucaauauacaguacaaauuucuccaaauuuaagauaacauggaggugacuggggaagggaccaacugggcgaaaugaucaaucagucauguagcucaagugucugcuggauaugaaccuagacuacuuucugaguaauauggugcuuaaaccagccacccauauccauuccaaggggcaugagaagguuuugaagggaugcugguacaggaaagaccagggccuguguccauucucaggguaguggagugaaaccagcuucaccguuaagcagagaaauucccucugccucguuguugggaagcugccucuggcccucaaucucuucuucacaucaucugggguccuucuuaacacuuugucccacugccuaaacuuucuccaucuagaacucauucaguuuaacaagguuccccuugaaauacauucuccgggcacccucugcccaagagaaaagaccauauacaguggucucacuuaagugacaguugcauaacauugaauucagaaauggauugucuucacuugaggucaggauuucgagaccagccuggccaacauggugaaaccuugucucuauuaaaagcacagaaauuagcugggcaugguggugcacgccuguagucccagcuacuugggaggcugaggcaggagaaucgcuugaacccgggaggcagagguugcagugagccgagaucgugccauugcacuccagccugggcagcaagagcguaacuccaucucagaauaaaaggaauggguauucuaaucaggauuuugugacguuucuacuaggagaauuucucauuucauaggauaaagaacauuuuguuaaaacauuucugcaauacccucaggcucccauagcauauugaucugaccuuuuuuuuaguaagcaaauuuguucuugucaucuaagucuauccagggagcugacauacucugcaaggggauaaagaaauauuagucacaauuuguuuuucuuugucuuuuuuuaaaucaacuuaagacggagaagauaauguuuccauuuuuagugugacuauuaauuagcacagauucauuacacuugcagauacauaggacuuuacuuuuugaacugacuuugauauucaauaaggcaaaaaucaauaagaaaguauucacauuaccuugcgccacaauuggggagcgcgauuguccucuuccaugaugcacuccugauggccuaccaugccugcuccugaucuuuuuaucuucucuagaggccucuacccuuuggaguucuuuugagucacaggaugaaauuuuuguugcucacuugaccaaaggucaagcaggcucucugugcccagcgcucaaagauaagcucggaggagcucggagugucccaguuguugaauaaggagagauuugaguugcuaggcacucuugcuuuacuuaccacaagccuccucuuguccccucugggcuguuguucauugacaauugcugugcucugaacuagcgcuaugauggccuguugugcggggacaggcggguuguggugaaagcugcagucg

SEQ ID NO: 19071 - RNA, 5166 nt, Homo sapiens
aaagguguuaagucuucaucaggauuccuuuugguuucucaugaauacauauucacaugguuuggagaccuggagcccaccaccaaagcacacugaguuaauguuuugaaagugcauuuguagguagauccuggggcugggguuuuauuuggccuguuuguagaauugaagccucuuugccucaguggucagcacaucccaccagacauccggcagcaagcuuucgucaccuucagagcucuagcauaaugauaaaggagcacuagugacagccuugcuguaugcaccaagcuccacccugggcagugccuuucccuaaugucuguccuggugugaaauggagacuugaagaccgguacccacauguaagagagguuaacgaagggaggguggcagagagaggagucaugugaaggaaagcuaccuuuaguccuccaucgcaauacuguccagugucuccagcgugcuagaaacugugcugaaugcugggcacauggcaggggucaaagcagacagaaaucccugccucaugaacccacuuucuauuaggggagacagacuagaaacacaaaaaggacauugaauaguacgauugagagaugagugcuauggagaaaaauccagccagaaagggagaugcagaagauagcaccagaucuucucaauguuguuuucaucauggacaggugcguuccuuagaagaugaaguguuagugauuccugaguuuuucucaccuucacgucgauugaucugaauuuggagagucuguuuucugugucuggcucugcacucaacuuuguaggggacccugucgagguccccacacuguggcuucagguagacagagcagaugggagcccauuucaguucauugucuugcugaccaauggggaacuguggucaggugagaggaggcagcuuuuacaaucagacuucauugaauagugugggcugcuguuuccuuguaacaaaaccccauaaugauggcaguuuccggaugugucuuuuuaggacuucagaacuuauuauuugaauagaaguuuaaagcaucuggaugaugaugcuguagcuaaaacagcugcuugucagaagagacccuauuuaacacuucuaaacuuguuucagagguggaggaaaggauaaucugggaaggccucccucucaaguccacagguugguaucagcuguguucaucccccaaaaggaaaauaaaaugacaacaauauuuuggucacagaauuccugagaaaccucuguuucuaucuucaugucuuuaagauagggacaugaauuccccaugaucugggugauaggguuaggguggccaggacacuguuacuuugugugugacacagguggcuccucaugacaguuccuccaugccuuagaacauguugucugucuggucaucccuggggguagagcugagugacccagcagugggagauuuaacaacuggagaagaagaugggauguguuuaauuauccccagagguagggccaauuugucacccuuuaaauagacuuauuugcauauaaacuaaagcaccuuagggcaucauuaccgaaagugucuaagcaaaugucugauauaguuacgugccugcauuaaaagaaagcagcccccuuaucuugccuuaauauccuuacaguguuuuaauaaguucauaaugcauccuguaugugcauuuuuugguauaaaacaccgaaagguggagaauugacuucaguucucuccauccuuuccccuuaaguguugguggcgcugcaggggcaacgugccucccauuggaaguggugacuuccucuuugauagagguuugccugucucuugaaaaugaaaagaagcggagauugaucucuggagucccaugguccaguuuggacuauugggaauauuuuuuaugggauguuaaaaacaauauuagagacgugagauaguaaauuugugguaauaccggauccaggaagcuuacagugaagaguaugaacuuaaccugaaaaguauuucucuguucuauaaaucucucagugacauuuggauuaaucaagcauaauuaaauguaguuagauuuuugucagauuguaguucaaaauaauauucaucuauggagaggguaauauauuauguagaaauuuuauuaagcacuuuaguuaagcaaacacuaaggagaacaaaaucaaccucaggaagguuaauuacuaaaaaaaucacaaaguauaguagauuauguaaaucauuuuaauuuugaauaccauggcuugagcuuuaauuuacauagagacguauuuuggauuuguuuuucacauuauauuuucuaguacaggauugcaauugcauucuugaaaaguucuacucauuuuaggauuccauuaaguuugcuuaacuuuuuucauguuauaauuuccaaaagcaaagaauuacaauuguauucuagcuaauuauuuuaauguuucacuaacuuuguguguauuguaagaccauauuuuuauuucuauacaaaugaugauuuuaagagaaguaucaggagagagaauguauaugaaagcaucgcguccacgccuggcuuugcaauaaguguucauuuaaaagaaagacauuuacaaagguaaaacauaagaguuuagacuauagcgauaaaucuuuuuauuuuaguaauuucuuuaaagggaaaaguaaagagaucaaaaugauuuuauauguauuuuuuuuguacucagagaauuacauuuucacuacccccgccugucucagggaauagccuuugauaagaaucccauggagaucucuggaacucuauuacaguguguucagauuuguuaguucauauguaaauuucagagcuagagcuucaaaacuagaguauuguaaucucaggaacauaagauuauccaagaagccugaaccuugcucuuuucaugauaaaugacauccaaauuuccuuugucuaggagauaagcauagaucccuuuuaucaugcuucucugagauuuucacagaacaacccugcaauuugauuuuguuugauaauuuugcuuuuuggcuuuucagugaggacucuauuuuccauuggaacugacuccuuuggggauaauaagcuuucacuuaaaagaacauuccauuagauaguucuaacuucaaugaaccuaaaaguggcuucuuaauuugaauaaucuggauaacuuuugcaaaugggucaaaacagcacaaguaucaacaaucacguauguacugaguaauauuugcccuccaguuagcaaagucaagaaaugucuaacucuggcacacagcacugguuuuaacuacucuuuaguucaucuuugccuuccaaauugguugaaaauggcaagcuuagaauggaaugcauauuaauaacagaaccacuuaauguuuuaaaauauucauaccuugagauucuuuuugagagaaaaaagaaaucuuaacauccaauucuaguuguuuuggcuuuucacauaugcuagacaugaaaaaggcaguuacaaaagugaaauccgauuggaagucagugguguccgccauugagccgugcuaaaugucgugucacaaaaggaguuugugaaaacaggaugaguagaaaauguuauacuguuguuucuaucguggcaccgcuuucuuauaaauuccauuugcuuuuugucaucugaacuguuacaaccaugggaaaccucaguccauauuuuuaaaagcacuauauacuuacaggaaaaaccgacuuaugccuucauugaaaaaauguugaaguuaauaucccaaauguuuaaugagcauguuuuagaauauuuacagcuaaagucugucacuuuagggauuugacaaaacuugagacugccugccaccgaagagggaccaggcagaaucuucucagccuuguaaccagcguuaaaaaaauauaaggggcuugaugagauccuagaucugcuccuuuucuccuaggugccuggguaacuccuggggaaagcaucauauuaaguccuuuucaagcaaggugugugauuuugaccaaugaauugagcugauaugugauuuugaccaaugaauugugcaucuauuuaaaaauuaccaaguguaucuugacucuugaguggacagucaaggcaaaguuuacuuaggaaauguaaaguauggaguguuuuaaaaaauucaaauugaguuuauucacuguuggaggaauugaauucuauugccucccucauuuccauuauguucauuguuacaauugugcugcucuguucucauugugaugcuuaguucucguguagaacugagugcuacauugugauuagaaacuggaguugugcuugagucaguccuggaaaacaggacccauuuuuaagaagaacggaacauaccacuuuggcauucuggcugacccuaauuucugcagaguuccuugguguuaaaaucauuugaggucauaguugcugcuuaugguuuauauacacaccaucugcugcucuaaguucacauccucucaaaagcaugcaagugcuugaaauuuaaauauuucccagaucuaaaacaacuugugacuaccuaagaaaugcuugaaccaaauaagaaacagcacuguggaauaaaauauaccauugugaacauaucugaugcugcaaugaaauguaaaguuccuuacuuugcugauuuuucaucauaacuccuugacucauaaaagcggugucuaaacugggaacagcugcuaauaggguaaaaguauuauacaucaaauaaaaguucauuacaauauuuguacucauaagucaaaaucugaccugguucgcuuugugccucugucagccuacuuacagugauaaauguacacacaaguccaguguugccaaggagcuuuguuuauagaaagaagcuugguccccucaguucuaugcuguuguguggccugguugguacaugccgucaugaugaaggaugacuuugguuugagauaauuugucacuccacauuccauggagaaaaguguuucauuuugauguuggaaaaacaugaccagagaagcaugugacucagauaauguuccccggaaguugcagagcaaucuguggugucugucauagcccaacuaguccuggagcacauggacaauucuguaccccaauaaucagaacaauaaaaugguaguugugauucacug

SEQ ID NO: 19072 - RNA, 74623 nt, Homo sapiens
ugggugaaaaauucuaagauaacauuucgaaugcuuuaaucaacagacauauacaaaugaauuuuaaaauaaaaccaaggcaucaaugaagaagaucuaacaugaaagucaccacaucucacaaugagaauccgaucagauggaagaaggcaaaagucuaaaucauagaguggcggagggaggcacgggagagacggagggcucugggacuaaaucaucagggcauggccaccugaugucuuccacuuucagggucccagggcccuagguggagguuugggacaaauaugguauuuggucacaaggagcaacaguacgaucugcuguaucuggaaugggaaaggcgcacagaauccuggaaggacugaagacaucagaugcuaugauaacaagauggagaguacgagggcacaagagcuguaaggaggcucugugcucuucggugacaggcaucaaucacaccacagcaagaugucauuaaaaaguuacuacuuuaguggaagaucuggaguagcuacaggaaaaacucuuugggaaaguccaggugguagagagaaaauacacauuuaagcacuaggaauaacugugaugccacgcucagagcaggugggagaaagcaguucucucuguuugacuugcagaaggcaaucuuucuucacagagaggaccacagcauucaguccucuagaaaguucuauuagucuugaucuugucucuacaaagaaaauaaugagaauauccauagugaguuugugaguacaaccuccucuguuuugaccaggacuuuuagaguauuucauuauagugauaauucaaaaacccuugccauaucucagaauuauuuucuacaauuacuacagaaauagaaugaccauuuaauuacuuauauauacuuuaaaacgguucuuuacugucagugaaaacucugguuagaaauauagagugacugcuaaaaacuaugagguuucuuuuuggggugaugaaaauaugcuaaaguuagugggaagggcugcacaacucugugaauauacuaaaaaauauggaauuguauacuuuuauuuauuuauuuauuauugagauggagucucgcucugucgcccaggcuggagugcaguggcgugaucuuggcucacugcugccuaugccuccuggguuugucucgugccucagccucccaaguagcugggauuacaggcacccgccaccaccgcccggcuaauuuuuguauuuuuaauagagacgggguuuugccauguuguccaggcuggucuugaacuucugaccucaagugauccacccgccauggccucccaaagugcugggauuacaggcgugagcuacugugcccggccagaauuauauauuuguaaagggugaauuuuauguugugugaauuaaucucaauaaaacucucacuuagaaacuguuuugaaaauaaauuuucuuagaaccucucauguauaaauaccuagugaauuuaccauacuuacuaaagucuuuccccaaaucucuaccgauuauuuguauaguuuaacaauuuuaacugucaggcuaagcauuuuaaaauuuuaagaacugcuuucugcuuaaauuuguucaccuaauaauauauuagaaguuaagacuaauaaucagcauacaaccuucaguuuaaaauuuaaaccuuaguuuaaaccuuaguuuaaaaauugccuuuaaaauaauauucaauuaaagccaccuuuuuacaaccaaaccuuuuucuaaagauggcuucugcacuacucaaauuacuccacauaucagagcaauaguuugagcaguuugaaucaacuggucacaucgaugcucaacauucuauuugacuuacauacagacugaaaauggaaucaacagaaauugauaugauccagguauuucaagcugauuuagcuuaaacuuggcugggaauggugagaguaaguauguuuguuuccacaaaccaaacuucucuaaacuucaucauuugagaugaguggccaguccagcaauauugcguagcaguccaccaugacacuuccauagaaaaaaauaaacauccauauggauaucauuuauaacacuugucagagaagaccaacgcuacuaaaugguacaauacugcaaagcuauauaaacuguauuuguguacaaauaucuuucuguugcauuguguuaaagauguuaaaaaucaagguuuucaggauaauaagaaauauauacaauuaaaauauauuggggagaaacauuacaauguuaaaauagaauaaaauaucaauaugaacuuaugauuuaaaauauauuuuaaauauagcuauauuuuauagcucugucugucaaggaaaagggccuaaaaaagguauaacaagcauccccaauuaucagauuagcaucucuaauacugauuaaaaagaaacagggcugggugcaguggcuuaugccuguaaucccagcacuuugggaggccaaggcaggcagaucaccugaggucaggaguucgagaccagccuggccaacauggcgaaaccccaacucuacuaaaaauacaaaaaaaaaaaaaaaaaaaaaauagccaggcgugguggcucaugccuguagucccagcuacuugggaggcugagacaugagaaucgcuugaacccaggagguagagcugcagugagcugagauugcgccacugcacuccaaccugggugacagagugagacucugucucaaaaaaaaaaaaaaaaaagaaaagaaaagaaacaagacuccuugagggaaacaguugauucuaggacacaggcacagaagguauaagaugaaucuaggauaucaucuugggcaagaaaagcuuucaaagauuaaugaguuuuggcaauagaacacuaaggauccagcuggaaauagcucucauuggccaaagguaugucaauucaagcaucaaaaaggaaaaugacuguuacaugcaauaacauggaugaaucucacauaaagccagacacaaaaagaguauagacuauguguuccuuguaaauucaagaagagaaccuauggugauagaguuagaaaagcaauuauaugguggaggagggagggacaacuguuugacuagaaaggagucuuuguggguagaggaaauauagauguaaaaaaaaaagcuguaaacuuaagaugugugcacuuuacuauuacuauauguuaugcuucaauaaaauaagugccaauuaaaacauaucaaaguaacaaaaucuacuauaacacuaaaaaagacaaagccauaaacucauuuguuaaccauuuaagguggcuuuuaacauauuucuuaccuggaaaauugguaacuugaagggaauuuaauugucccuuuaaauuuaaaaggaaggaguuaaacaguuaccagaggaacuguacuucaaaauaccuaaauggccuuauuugaugaggaagagcuuuacuuuauaggagaauaauugacaaaggaaugauuuaaaaaaaaaacauucuuuuauaaacccaaauaaaauuacuguguuaauuuuaacacaggccgaaaugaucaauugggguaaaaaccauuaggugaacagcugauggguaaguauacauuugcauagugccaaaauaacaccacacagauuauuuucuagugaaaaagggaaaaauaacuauaacucagagggaucagacagccaucaccuaaacuaugcucaaucauaacaucacuaauggugggucaaugagaugucaugggucucaguguaauucugcaacaguguuuauggauauucuagcaaaaaaugcuccauuagcucuuuccuuuccuuuccuucccuucccuccccuccccucccuuccccuucccccucccuuuccuuccuuccuuucuuccuuuccuucuuuuccuuccuuuccuuccuucuuuuccuuccuuuccuuccuucuuuucuuucuuuuuuuuuuuuuugaccagcauggacaacauggcaaaacccugucucuacuaaaaauauaaaaauuagccaggcaugguggcccacgccuguaaucccagcuacucagguggcugaggaaugagaaucacuugaagccaggaggcagagguugcagugaaugaucauugacauggaaagaugggaugguuaaaugaaacaaaagcagguuguaaaauaguaugaauaguguaaucucauuugcaaaaaaaauacauauauacacaaauggcaaaauaucuggaagaauauacacgaagcuauagcaguggcaaucucuggguuuugggaacacagagguuucuccuucuuuuuuggcuuacuuauguuuucuuucuucuucuucuucuucuucuuuuuuuuuuuuuuuuuugagauggagucuagcucuaucgcccaggcuggagugcagugguacuaucuuggcucacugcaaccucugucuccuggguucaagcaauucuccugcuucagccucucaaguagcuggaauuacaggcgugugccaccacacccggcuaauuuuuguauuuuuaguagagacagaguuucaccauauuggccuggcuggucuccaacuccugacuucaagugauccacccaccucggccucucaaagugcugggguuacuggcgugagccacugcgcccagccaauguuuucuuauuuuuuauaaugcacauauacugcuuuuuuguuaauacaggauuauuuuaaguuaaaugaagcagaaccccacuguugcuaguagaguugaagcuuaaggguacauagucagaagaaaacuacagauuauuuuccuuauuaccauaaaacagugaaacuuguucugugauugauaacuuuuccuuuauaauguuaacauuuuuuauugugauaagcuauacauaacauagaacuuaccaccuuuuucuuauuugagacacggucuuauucugucccccaggcuggugugcaguggugcgaaucauagcucacuacagccuggaaguccugggcucaagugauccucccgccucagcuuccugaguagcuaggacuacagacccacaccaccacacacggcuaauuuuaccuuuuuaaauuuuuugcugagacagaggucucacuauguugccuaggcuggucuugaacuccuggcuucaagagaucauccagccucagccucccaaaguguugggauuacaggcgugagccaccacacccagcccagaacuuaccaucuuaaccauugcuacauguacaguucaguggcauugaguacauucacgcuguugugcaagcaucaccaccauccaucuccagaaguuuuucaucuuuccaccugaaacuuuguacccaugaaacaaugccuccccauuccaucuucgucgcuagccccuggcaaccucccuuccacuuugugucucugcauuugacuacucuagguacuucacauaaguggaaucauaguauuuguccuuuuaugucugguuuauuucacuuagcauaaugacuucaagauucacccauguugcagcacauaucagaauguccuuccuuuuuaaggccaaauaauauuccauuggauggauagaucaccuuuuaucuugauugaucauuuuaacuuauuuuucaguuucaaccuacaacguuuaugaggacaaacugcaaacuuaauugcuuuuuaaauaaaauugauggcaggccaaaucccugcuugcuguugugaauaccucuacacugcaagaauuccuggaacagugagugggacaccuuuauucagacaaaucagauacuuuguaauggaaaucaaggugguauauuacuguuuugcuuuguauuuugaagcaucccuggguucacugcugggauugcuccaaucaucggcuucaggcguggucuuguaauggcgccaugcggacuuauuaaaaacuggaagucucucaaaugacucacuugaaagagccuauuggagaaacaaaaauauacaccaaaggucgacagugucauuuuucucaagugaaauaguaacccaaauuuuauuauuuaaaacaucagaaaccuuaauacauauuuucaaaaugauauuaaaauuacaccuuaguaguuuacuuagacuggccaggaaaacauuaaagcuuuuuuaaaggaaugaaaacauuugcucauucaaaaucagaacugaaauacacaugaccagaacaaaacauauuuuaauucagcucauacugcuuugagaugcucaacuguuuugacuauaccuggugacuggucucacaaagggcccaggaagagauacagucucaugcaucccagguuuauaaacacacaccaucaaguauauuaaauaucgcauuacuuagaugcaugggcaucuaagauaaauacucccaguaacugguuaaauucugguaucacauacauagguugaguaucccuuugaaaugccugggaacaggccgggcacaguggcucacaccuguaaucccagcacuuugggaggcugaggcagguggaucaccugaggucaggaguucgagaccagccuggccaacauggugaaacccugucucuacuaaaaauacaaaaaauuagccgggugugguggcucacaccuguaaucccagcuacucaggaggcugaggcaggagcauggcuugaacccaggaggcagagguugcagugagccgagauggcaguacugcacuccagccugggugacagagugagacucuaucucaaaaaaaaaaaaaaagaaaaagaaagaaacaaaaaaaaagaaaagaaagaaagaaaugcuugggaccagaaguaguucugauuuuuuccgauuuuggaauauuugcauugugcuuaccuguuaagcaucccuaaucugaaaaucugaaaucuggggugcuccaauaagcauuuccuuuaagcuugaccuuugagcaagcaucacguuggcgcucaaaaaguuccagauuuucaaccauuuuggauugcagauucuuggguuagggaugcuugacccacaguggcauguuaugccacuguuuaaaagaaugagccaguucuacauaaauggaucuggaaagaucucuaagacagauugcaaaguaaaaaaaauaagaaggugcugaaauuucauuuaugugggaaaaauucuauuuuucccauauuuauaaauguagaaucaacucuaggaggauccauaagacgcugagaccgguggugaucuucgcugaacagaacuggcgguuuagggccagugggaggagagacuucauuuuuccuuuuguagcuuuuaaauuuuuauuaugugccuauauuaccuauucaaaaaaauguuacaaauauucuagaguuuagaaauaaaagcccaaugaucaccaaugaauaagaaaaacuguguuacagagaaguuuguuauuaaaugaaucuuuuacauaaccauauuaugauuacugaauucuuguagcuuugggaaagccagugaguuuuuaaaacaaaagaccaaaauacuucaguuuaugaaaaucugccuucuuuuagaucagaccuuucaauaggcauguaguuuuuuaagucacaauuuaaaauuaugguuuuaaaaaucaguauuuuaauuuuuuuuuuucucuuuugagauggagucucauucugucgcccaggcuggagugcaguggcaccaucuuggcucacugcaaccucugccucccggguucaaaugacucuccugccucagccuccugaguagcugggacuacaggcgugcaccaccacaucagcuaauuuuuuguacuuuuaguagacaugggguuucaccauguuggccaggcuggucucgaacuccugaccucaggugauccacccaccucagccucccaaaguccugagauuacaggcaugugccaccacgcccggccaaaaucaguauuuuaauuucuauaccuccacguuucauauuuugcuuuaucugagcauagaaucaagcgugaggcauaacaugguuuucaugggaaaaugaaguaaaucugagaugaaucuaagagaugauacagugcuguucucaaucagcgauuagaacuuacagcuuuaaaaagcaaagaugccucauacuaacaaauaaaacgcaguaccuucaaauaaaugacagcaucaguacccacuccuuccauggaauacaguuucagaucuccuugaaaauaucuagcauacagacgggaaauuggcaaaccauaaccaaauccagccuauugagaaaagaaaauuaauacagugagacaggcacaaaugcuaacacauuuuauaugaugaccauucagagaagguuaaaauaaauucuugauucagauuuaaaucaaauaaauuacugacucaaccuuuacaaugauguauauccucuucuauggcaaacaaccccuuuauuuucacccugcaaaaacaugucuuauauguuuggauaauaauagaaauauucuaauuuuugacuaaugcuuuuuuagcauuuuaaagcaaaauuuuaucauuuuuuuaaaagcacauuccaaggccgggcacaguggcucacgccuguaaucccagcacuuugggaggcugaggcagguggaucacuugaggucaggaauucaugaucagccuggccaacauggcgaaaccccaucucuacuacaaaaauuagcugggcgagguggugggagacuguagucccagcuacucaggaggcugaggcaggagaaucgccugaacccaggagguggagguugcagugagcugagauggcgccacugcacuccagccugggcgacagagcaagacuccaucuccacacacacacacacacacacacacacacacacaaaagcacauuccaaaucaaguggaaugugaccugaugacaaaacuaaaccacaucauuucaaagucccaugaucagauuuccuugcuuuugcaagugaaaaucaauagcgcagugcugaguacaaaucuaccaguaacaagacgagaacauggaaaggaaaacaauuuucugagaggcaacuacuaagguuccgggaaugugagaauauuuugguauauuguaguucagguauuuuuagagauuaaaaaaauuuucaguacccuccuauaucucuaugucaaggaauccugacugucaauaacagguguucuauggacaagaacaguaagaaucaaaacuaaauguaauaccauuuguggugguaguggggcaggguggggaaggagauguaacaccaagcuuccucacuucugguuaaaucuaugaacaagguuaaggaaggagggcaggggaccaugugcacagagucacaugggccuuagacucagacagacccaguugaaauccacuuucugugcgacucugagcaguuuacucaaccucuuugagaccauguuuucaucugaacauaugauaaaaaacugaccucagagcugcuauaaggauuaaauaauauaacaaguauaaaaucuuggcacagugccuaacacaguaaaacuaaauaaauugaggcugguacuauggcuacuaggagcagcaauuuuaugaaguuacacagauuucugccauuuucuaacaucucuccuugauaccuucccucaggguaggguuuaacugaaagggcaggggguaaaagaacguaccccauuauuuaagggcuuugggacuugcugaauauggccaguagugaagaugagauauuuauaguagugacucagguaaccacagcaaagaaacuagcucacucuaggaagagaugugagcaaaucugccuucuauguucaagcaaggcccagagccugcccucauguccaacacagaagagccgagaacuccgaggccaaugcagaugugaguguaagcccagacucccaaagaaugcagaggaggggucuggaccucggauuugcugagguucaggaaagguuucccagagugucaaaggaucagcaggaguucgcuggguggauauucucaaacagaaaugcacauguaaaggcacagagguguaaaagguguaaaaguguaaguugcucaaugaggaaauuauguuuucuaguaguacauauccaugugcccacuuuaaagcugaggacaguuucuuuuucuuuucuuuuuuuuuuuuuuuuugaggcagagccucgcucugucgcccaggcuggagugcaguggcaugauauaggcucacugcaaucuccaccucccagguucaagccauucuugugccucagccuccugaauagcugggauuacaagcaugcgccacugcucccgacuauuuucguguauuuuuaguagagacaggguuucaccauguuggccaggcuggucucgaacuccugaccuuaagugauccacccgccuuggccucccaaagugcuaggauuacaggccaguuuccuaacugggagagccacuagcagaagcauuucuucggccacguaguacacuggaaagaacacagacauggccagcaccagcucugcaguuaauuaguucaaugacuuuggacaaggucauuuccucauuuccucaucuauacaaugggagugcgcaugcguuaacuguuaaaagucucuuacaagcccucaguuucaauaagaaaaaaaaccuaugauauaacagcuauccucaagaugcuauuuuaagaccuggaagagacaaucuauauuucuuuuaaacaacuggggaaggugcuagauuuguuuguggugccuuuuuuccuuuugauguguauuuaagugcaugccagagccuagucaaggcaacgccucucaaaugugaucuuucaugaauuuucucgacuccuauauaaaugauuuccuguuuccaacaugcugaguuaacaaacucugucucaaauaaaugaugcaaaguguuugauuuuauucauacaaauaaaauauaaucuuaugugcuuaucagucagguacgacuuuaaaaugaaacuuaauuuauacccugaaccauuuugcagacugauagauauguugcuguguuuaaugacaaaggguucaauuguuguuugucaauuagaaacacucagcaggggaagcaaguguggcccuaccaggaucuaaaugcuaccaugguaaccaguggcuuuucucacugccuuaacagggcugaagguuauuuccagagugagacagaaagggcucugaaaaugcauacaccaccuauauguuucaugcuaauguuauuuaacauaaaaauuuaauguuuucauaauuuaacauuuuaauuauauaaacaaauuugacaguggagauuccaaggcacuaggugauucgcgccucugugguacgcacgccagagugcgcaggaccaagcggcagcuaugcauucaguacugucccuuugcucacccacuggcaacuuccaccccuuccaaggguagcacaaaguggaaaauggugcuacaguagcagucuuaccacaaugagguacuuuuucucuguauaugggaaugaggcacucagcuaggaguguuucuuagacacaaaucagagaggaaauugaaguccaaaggauucacaaagcaaguagccaaggcaaaaaauucucccuccuccaaaccauaauacacgcaaccuucuaaaucaacuacacuaaugugacaaccuggggagagaggcagcucccucugagccccuuccuguguuuaugaucuuuccuucagcagcacuuucagaugcuuaccaaaggggcagcucugguaggcuccaggcugggucuaggagcaguagaauacauguaguuaaaaagacgaucuauuuuucgaagugggacaccaccaccuaggucacugaucugcaauguucaaaauguuaacaaucaaaacaaagaaguugaucuauacuuaguaggaggcaauggguucauuaaauaaaguacauagcagauuacuccacaauguacaaggacuuugaaucccccagugacauacgguuccuuugugaacaguguaaaacaaaggaggccgaaugguacagugggauccaacaggcuugguguugaggucuuguucaacucccugaauaacaagguucuaaugaaguuuaaauaagguaacuuaagccaaggaucuagcauagaacuuacaaacaggacacucaauaaaugucaauuuccuucccucugauuuuucaaugucuagauacuauuaaaucacaacugauaauuaaaguauacaugcacauaaaacaguuaccuuaauggauaagucuucuuuacccaaaguaacgaggguuuuaacagcaggguagcccucuuuucugucuucauagaguucaacugucgcucucauugaguucuaaaauaauaagaucuuuuuauuaaucauacugccgaaucacaaaccacaauuuuuaaagagaaagaagcgcaagaugacuuauacccaacaacccuuuuuuggggcaaauauuaguuggauuuuuauggcauuuuucccucuaaagagcuuagcuaaacgugcucaaaucaaggaaaaauuuccugacacuuuguuuuucaccuaguuuuagccucauccaacaugcuaaauauuuauuuuucuuuccuucuucuucuuccucuuuuuuuuuuuuuuucgcuuuacgguauuuaaauuauucaacucaacccagaggaauguuuuuaucgcauguaaugaggcuaugcagaggcugauuugugcacuuuaaauccuauuuaucagucugcauuuauagagcaccuuuucucuaaagaaggcagaaaaacugaaaggaugcaugcuucccacaaaaauuaaucauuuggcugaaaaaaguagaagaaauauugguuaaaaagaaauucugaaaaagccacagcugcugaagagaaaguucacaauugaaugcccauuucaaccuuaaagcguuacaucaguaacauucuaauuuuuggaagcaaaucagcauaacugauuuuucagguguucaauuuaguguuucacgcauuggaagaaaugaaauuuuagcucaaaugccuugugccuguaauacugcuacuguaaaugucauuagcuacugauuaacaaaagcaacagcuuaaguugcagacucuaaagaauuuggugggggggaggggugguucuuuugguccagcucaucuacaucuuucuccucugccucucuuggaucuucugaauugauucaaauauuuuauaaaagaguugcaggaucucucaggacuggaacaaccacuaauguaccagugugguuaauuuucagaagcauaaauauguauaaacauguuuuuauuuugaucuggcuaucaccaguaaagccuuugccagguuuggaaacuaaaaagcaucucuaaucucauaacuaaagaaaaaacaguauggauuuuacauaaaaucacuaaagugcaauuaagcuucaaaaucaauauguacuaauauucacaaaaacuauaguguacacagcaauuucucaucucacaguguacaaauuauaaaacccacaggauaucagaaauagaauuuuuaaaaugguuaugcaaaaccuuuuucuuaugcuaaucuaaugaauccauuaugcccugaaucaaaguaauuuaaaaugaagacuucuuuccacguuuuuaaaauuccacuuaccuugaacaacucaaauagcauaugaaacagaugugagggcacauaaaccaccugaauagguuugucuggcgcuuuggcugaaaacagagacaaaaccaucaaucaauaaggacccaaaguaggagaaauucaagaaugauguuugcauucuauuuuccaaguguguaaaacagagcucuauaaaaggcuaauuugaguuuccaccucuaaaggcagggcugagcaaaagcauaugcuuuagaaucaaacaaaccuggggugacacccaguuccuucacuuaccagcuaugugaccuuggauaaaucacucaaucucuuugaaacuuuguugagcagaauuggaauauuaucaccuaugccauaacauccugaguauuacagaaggccagucagauaucacuugguguuuuucaaauugggggcuaccuucugccacugaccccagggggaauuccacgggagaauguggagcaacaggaaaaaaaagggcuggugaacuggacuaaauggcaguguucaguuuuguuaaauuaugacaaacaaggcaucuuauagcauagaauguaagguucacauaacuuuuucucaagcagcuagcacauaaaccccuagagaccuaugaucuuuuccccuugcaccaugggucaucugaagacaaucugagaaacaccaaaacccaggugaagcaauaagaacagugugcgguacagagcagaugcucaaaaauacaguccuuccuccuccucaugacccaaaaucacuuaagagauugaaacuacaugaacucucucagguagaaugcuguaauuucaaccagcuacuuccucuaauaaaguaauuaacaguaauacaaauuagaguucacauuugcuugauucuuagcagucuacacagagcuuucacauacauuauucaauugacuccuccugacaacacuuccuggcuccuagagggguggugguguuuagaggucuggaaacaggcuuugggaagccugugugacuugcccguggucccagaaguggcaccgaaaccagacaccugaacaaagagcuuuugagucuaaaucccgaacucuucaaagagcaauuauuuuuauuuuuauuuauuuauuuuuugagacagagucucacucuguugcccaggcuggagugcaguggcgccaucucggcucacugcaaccuccaccucccggguucaagcgauucuccugccucggccuccugagugucugggauuacaggugugcgccgccacuccuggcuaauuuuuguauuuuuaguagagacgggguuuugccauguuggacaggcuggucucgaacucccgaccucagguguuugcccaccucggccucccaaagugcugggauugcaggcgugagccaccgugccuggccugagcaguuguuuuuaaaaucacuuaguaauauauguaaacggcuuaaaaauuuaacaaaagaagaaaaacaaaaguccuucccccuuuccuaucuuauccuucagucugaacccagaggcagccacucuuuacuacuucugcuguagucuuuggguugguaauauuuacauucuguucuguaacccaaauuagggaugcuguaaauugccuauagguucuuucaagaaaguagaaaaucaaguguuggugacauuauaacuauguaaauauugaucacuguagaacaaccacaacaguguaccuagacauuuucuucccuauuaaugcaauaacaaugauucaugugucccuuggaggagaauguucccagccuuaacaugaaauggaguuucuuuauacuccuccaacuggucaacaucaugcuacccuuuuuggguugcuucauaguugguccaugccauuucgcuaagaucuuccagcuuacuggaagcuuccauaccuacuuccaguuuccauaccuacuuccagcuuccauaccuacuuccagcuuccauaccuacugcaugguauccaguccauucuucaagauuuuucaaauuagaaucaauugcuuugcaaacaugcugcauagccaucauccuaaaguuguuuuugauugaaguucuagaauguuuuccccuuucuuagaugcauauuauacauaacaucaaggcagucagguaaccuaccucagaaagggaugcaugggagacacaucugucaaucuuuacaccucugaucuauuugauuaaagguuuggcuagauagagaauucuagguuugaaaugauuuucucucagaauuucaaaagggggguuucuggcaguaacaguagagcugauaaguuuaaugccaguuagguuugguucuugcugcuggcuuuugcugaaggucugauccaucuugguugcaauauucuuguuugagaaugaagaaccggauucacuguaugagggagcuggcguucauaucccccuggggcucuccauuaagugggaagccugacuuagagcucucuggacuggucaagacuuuucaacuuggcuugaggaugagcagguaguaaaugggccucugagcagagaggcccccaaaugcuuaaacgaacagggcuuugcugcaggguaacaacacucacaugaaaagcccuaauucuuccuagguuguucucgaacaaaauacuuaguugccuguuggcaggcugaacccggccagaguacagcugccucccgucaucccuccaugcucuuucuuagaccagcuuucaguuaacccuacccucugccuucccuucccauuccaguccauugcaccaccuggcccugcccccagagucccuccaggacaaucuucggcaaaccaguugccaccucugcugcagccuccuccccuguggcugcuucugcucugucccaccaaucagcauacuuccaucuagugacccucuuucaaaaguugggauucaugccucuuauggacggaauguuugugugugucucccccaaauuccuauguugaaauguaacccuugaugugaugguauuaggagauggggccugugagaggugauuagguuaugagggcagagcccuuauggaugggauuaaugcccguuuaaagaaacuccagagagcucccucgcuccuucccccauggaaggaaacagugagaagccagcuaugaaucagaagguggguccucacuagacaccaaaucuccaggaaccaugaucuuggaugucccagccuccagaaccaugagaaaugguugcugaagccacuuggucucugguauuuuuguuauagcagccuaaauggacuaaggcacugguccacuaaugagcuccucugcuuuccuuugcugcuuuucuuuggauuccuuuaucgucauuuuauuuuuauuucuuuuuuuccccucuuuuuuuuuuuugagauggagucuugcucugucgcccaggcuggagugcaguggcgcaauuucagcucacugcaaccuccgccucccagguucaagcaauuaucuugccucagccucccuaguagcugggacuaaagaaacaugccaucaugcccagcuaauuuuuguauuuuuaguagacacaggguuucaccauguuggccaggcuggucucgaacuccugaccucaagugauccgcccaccucggccucccaaagugcugggauuacaggugugagccauugcgccuggcuccuuuauugucauuuuaauggggcucgaggaacaagcugggugcucaguuuaucuuguaccaaauggcaugauuaguuauauaaacagccuuaugaauucaaccuuuucaccccaaaucucaagaaaaggcaaacaccuuuuauauaguggguuuuuuuauuuuuauuuuuucaguuuaaacaacauucucuaggagccaucuaaaggcuugcucaauuaccugcacuuuucuuugggaacauuacaguuuagauuucuuuccuuccuuuuaaaaccaugucaaaugcuuuuguccaugacucuuuccuaguucugggucucgaggcuggcuguuaaguagcagaugcuuaauagauguuugcugacuuauaaaauaaguagaauaugaauuuuccaucuaaggguacauuuuuaaaagucaauuuaaaaauggccuagguuugucaugcucaagacuucagaaauaaugaagucucuauuuuguacagucauugcuccaaaugccauuaguugaaacagcauuuaagaaauaccauuagauauaaggaauuuuauuuccagacaguucuccuuccagaauaaaaaagcauccacuuaagguguucaggaucaaccuccaaccugcaucuccaacauagaacuuguuaaggcgaaagcacauuccuuaaucaugcucacaagagagcucuagcauuaagaacuuauacauaaaaauaaucacuacacuacccaaagcaacauaaagcuagaagcuaccuagaaacaccagcauucauuuaucuuagugauaggacaaggggcuucaaaacaugaucgaaagggggcuucuguaauucgugagacaaugccaaaaagagucggaaagcuccucuccuggugggugagcugcccagcaugacagccucagcggggacagaaugugcugacauggcuggcacuugggaaucagcaagaacaggccugcugcuuuggccuuuagaaugagggaggcugccacucacgcaaaagagcaauuuguuacuaccugcagaugugagaucagcuccugccuaguccauaggaagagagagaaagaauauuaagaugguucucaucaggaacacuccagacaagcccacucgguccugguaguauauuuauucaauggggacaugacucuucucagagaacccaagagaccuugaaagcagcuuugacuccaugccuucuagucaaauggaggggccauguccuucaacagcagccugaacuccuuucacaguuuuaucucauuauaagagaaauacauuuuuaguguacuccugagggggaauuugguuuaucuuuuuuuuuuuuuuuuuuuuugagacagagucuugcucugucacccaggcuggagugcagucaugugaucucggcucacugcagccucuaccuccugggcucaagcgauccucccacuucagccuccugaguagcugagauuacaggcacaugccacuauguccagcuaauuuuucuauuuuguguagagacaagguuuugcuaccuugcccaggcuggucucgaacuccugggcucaagagauucuccugccucagccucccaaagugcugggauuacaggugugagccaccaugccuggccugguuuaucuuuaacuguaaaugcucacacccugcucagucauuccacaucuaggaauccaaccugcagaaauacuuccauacguucacaaauuuuuccacccuccccaccucucacacucuuucauagcucauuauauggaauauaggaaaacaggaaauccuaaauguauacccauaggaaaacaguuaaauaaauuaugguaaguuacacuauggauaaucucuaaaugagauuaauacuugcaaaggucuucaaggugaagugaaaaccacguuauaaauaggguuaaagcuauacaugcuuuaugcaaaaaccaaagcucuauaugggacugagaaaguugugggggauuucccuuuucagucacauuucuguaucuguauuuuugugauaagcaugucucuuccauaauuugcaaauaaaaaaaggaaugugcaaauaaauauguaaucauaugaugaacguaaaaaucaucuguaaccccauuacccagagagcugcuauuuguauuuugguaguauaaauccuucaaaauauuuuccaaugaacuccacuacuauaaacuuuuguagccuguauuuuuuuaaaaaucucaauuuuucccauacguuauucguuuaaagcauuauuucaaagggcugcauaguauucuaucuaauggguguaccacaauucaguuaaacaaugcucuauuguggaaaauuuggguuguuuucuaacuuuauaagaaaacuacugugaucaucaaucuuguacauaaaucugugcaucucuauuuucauagauuuuuguuuguuuuuugagaugggguuucaaacuauugcccaggguggagugcaguggcacuaucucggcucacugcaaccuccgccucccggguucaagugauucuccugccucagucucccaaguagcugagaauacaagcaagugccaccacgccuggcuaauuuuuguauuuuuuguagagaugggguuucgccaugucacucggguuggucuuaaacuccuggacucaagagauccacccacuuuggccucccaaaguauugggauuacaggugugaaccacuguguccagccucuauuuucuuauaauaaguguucugaaguuuaauuuacuggaccaaagaauaugaccauuauuaacuuauuuacugggccaaauagaaagaacauugcuggcauuuuuuagaaagggaauaccacuuuuagcuuauacaagaaauguaugugcuggugagaaaguauuuuuaugggcacaaauucaaagcauuaaaauguuuuaaucacugucauuuugaaagacaaaaauggcauuuuuggcugggcacgguggcucacgccuguaaucccagcacuuugggaggcugaggcggguggaucaccugaggucaugaguucgaaaccagccuggccaacauggugaaaccucgucucuacuaaaaauacaaaaauuagcugggcaugguggggggcaccuguaaucccagcuacucaggaggcugagacaggagaaucacuugaaccuggaaggcagaggcugcagugagcugggaucacaccacuguacuccaacccgggcaacagaacgagacuccuucucaaaaaaaaaaaaaaaaaaaaaggcauuugucuguguuuuuguuugcacuuccuugauuagugaaguuaaacacuuuuccauauguugaucgacugcuugcauuuguuacuuugagaagggccuauuuauaccuuucuacauacucuaccuugauuauuucuguuccaagaauucuggggucuaacacauuacacauuccuguacaaaaacuccuuacaauaauauaucugguugaccaaaagcguagaaaguuuuaaaaagauauaagaaaaugaaaaaucaguauaauuuuuggagcucacugaaauauggcuuagguauaaacagcuucuuagucagcuuuuuugaauguaagguuaaaauuaguuuucuuuuaccauugaauucuucaacuuccagcucuggagcuaccagguaauacuguucacacagcaucuuggcuguuucauaugcaucugcaagaaaaggaaaaaguuuagcugcuguacuaauaacauaggcacaagcgugugugugugugugugugugugugugugugugugugugugugcacaugugcauguauauaucuauagguacauaagauaaacugucuaaacggauggauguagaauuaaucaacuacaaccuuuuacaaaauacccuuuuguggcuuuaauagaauuaccaugacuaaugcaaaauuucucuuuucuauuuuuuccaagacagcgucucacucuaucgccuaggcuagaguacaguggugugaucauagcucauugcagccucgaacuccugggcucaagcaguccucccgccucagccuuccaaguagcuggccuuacaggcauaugccaccaugcccagccaaucucucuuuucuuaaaggauuuucuguuuguuuguucguuuguuuguuuuuugagacagagucucacucugucacccaggcuggagugcaguggugucaucucggcucacugcaaccuccgccucccagguucaagcgauucuccugccucagccucccgaguagcugggauuacaggugugugccaccacgcccagcuaauuuuuguauuuuuaguagagaugagguuucauuauguuggccaggcuggucucgaacuccugaccucaggugauccacccucuuuggccucccaaaagugcugggauuacaggcaugagccaccgugccuggcuuucuuuucucaaaguuuuaaugaccauaacaaugucaacauacuagaauacuggcaauucagcuagcucuauaccaaacacguacuuguuuaacuuauacuauuaccaaaauauauuuuucaugaaaauuuaggaacucaagacuauacguucuaagcaccaugcaaccugacuaaauuguagcaaaagaauauuugucaugaucuuaaaaauaauaaugccaacagucuugugauuugccagaguuauuuguaagugaaaccucaguaaguauuugcugaaugaauagauuuccaugagccacacaauuuaaguuacuggagaugccacuaucacuuuaaaagguccuuugaguuaguuaaagguaacaggcuggggcugauauuuaucaaagucugaggagcaacaguccgcuuuuuaaaggauaaaauaaaagacauaugguaagaagauaagagccauuacagaaacagccggaagacagaauucaggagauucaaagauggggagcagauucagaaagcaaaggugcauuacaagacauuggacauugcauauaugccuuuucucucgaacuguaaacaaucugaagucagcguuugugucuuaacacuuguuucauaacuugcauagaacuucguauagugccuguguagauggucaacaaacaguccuugagccgggugcaguggcucacgccuguaaacccaggacuuugggaggccgaggugggcugaucacuugaggccaggaguucaagaccagccaggccaacauggugaaacuccaucucuacuaaaaauacaaaaauuagccaggcaugguggugagcgucuguaaucccagcuaguugggaggcugaggcaggagaauugcuugaacccaggagguggagguugcagugagccgagaucgugccacugcacuccagccugggggacagagugagacuccaucucaaaaaacaaaaacaaaaacaaacaaacaaaaaacaaccuuaguuugauaaauuuuaaaccuuuugguaauuuacuuuuuaaaaaucuuuauuggagauaauucuuaugccauacaauucacucauugaaaguaaaguguacacacagcugggcacaguggcucacaccuguaaucccagcacuuugggaggccgaggcagggggaucacuugaggucaggaguucaagaccagccuagccaacauggugacaccccuucucuacuaaaaauacaaaaauuagccaggcaugguggcgggugccuguagucccagcuacuugggagguugaggcaggagaaucgcuuggacccaggaggcagagguugcagugagcugagaucacaccacugcacuccagccugggcaaaagagcaagacuccaucucaaaaaaaaaaaaaaaguacauacaacucagugguuuuuaguauauagucagagcugugcauuaaucacuauaaucaaguuuacauauucaucacuacaaaaagaaguuccgaacccauuagcaguuacuccccuccacccagcccuaggcaaccauggaucuacuuuaucucuauagauuugcuauucuggacuuuuuacauaaacggaauaauaugcggucuucugugacuggcuucuuucaccagcauguuuucaagcaucaucuacaucacagcauguaucaggaucucauuucuuuuuauugcuauaucacauuccauuguacaaguauaccauauuuucuuuauccguucaucagcugguagacaucuggguuguuuccacuuuuuggcuauuaugaauagugcugcuaugaaccuuuauguccaaauguuugugugaacauaugccuucauuuaucuuggguauauaccuaggaguagaaaacugcugcuucgugggcgcauuuggaauguucucaacaggauuaucagcucuuugaagacaggcucuuauuuccuuuauauuccccacaucaauaccgugcaaaguaaauacugugcuuguuuaauauucaagaggugagagaaagaaggaaggaagcaaagggggaaaaguaagcccuacagaauguuaauguuaaaaauugacauuauuaaccuaaaauaauacaaagauaagauuaggguauguucagacuauaaauuuuaguucauugacuucauauugcuaccaaauuaauuaucuauuauuugaccucagaguaagaauucugauuccuuuacuaaacuuuuagaauuaaaucucuauaaagaaccaaagauagagacauuaaaauaacucagacaaggugaaauaaugagggacagcaaaaaggaaacagcaguaagaggagaaaaaaaauguuuaaaagaguugaucaguaugaaaauagacacuuaaguaggauugaacuucaauccugaaaaaaaaguuaaaaauuuugaauuguacuaaauuuacaaguguuuuccuaggcuauaauaaaccuuaucaaauaucuguaaaguacuuuugucaaaagaagagaaaucaagacucacuccucuugcuuagccuaugccgccaaacaaugcuacaucuccaccuagugacgugaaagcacaaagcugaacacaaacuuccaagaucacaagcacugaaaccuaaaaacgaucauucauuaucgauacacaaagccaacacaucuucacaaaacaacuccuccagguauguaauaaagauguuuaaacagugcucuuccauucacuacaaaacaaaaauaaccuaaacccacuaaaugugcuaauuccucauggaauucgcuugcccaguagcaugauuaugacagcguuguuaagaaaaugugcuacacaaauuuaacaugugaaagaccaagccuagacagaagcagccaacucgaaacacaaagacccaguacagcuccuaaaaccacgugcgaauaagaauuuuuaaagcaucacuacaacuuacaguguaucaacguuauaauuaagaauugcaugaugauccuugaagaacucaagucaucacaauguagacucacauacaccagcuagccaaaaguauuuugagggcauuaaugguauuacauauauacuaugcaucuuuguaaauuccuuggacacaaugcauguugcaaugccuuggacacaauacacacuuagcauuuguuaaauggaacgauccucugacccaugauuaaguucucaacaugcaguaaauuacacugacgggagguguuccuuuuggugagacugggaacuagaggccuagacucauuccccaaucuagcugugugugggauucguuaccaaauuuaaaagaaagaguacagauuaugaaaggaaccccuggaaauuccgaggcaguagcucuauguugaggccugagaguccacauucuuaaaacuuagcagguaauucggaagagaagcuaggccacuucccuggaaaaucaagucugagucacgcuaauucugccacucaucucucccaggauaugaaugauuaugagguucugggguaacagcacuuauauacucaaacaggacauuucuguuuaaguaaaauaauuuaacauaaaaaugaaaaagcuuuaaaaaaucgccaucaaaaccaaaauucaacucauggcuuguaauuuacauuuagaguaaaaugcaaauucuacuuauaauaagcuuucuaaucaaacuuuucuauuuuuuaaauuagaaaucaaaauuucaaaaaagauaacugccaaauuacuuuuaugugcauacuggggccaauauuuaccaucaaucuuuagaagaaaauauuagagaauuauuauugccacugaauauaagugacaugccuucuuuuaggaaucuguuuucaaggguuuuaagguacugauuauaaaguaauuaacaaaacugcagguguggcucauacauacuuccccagguuaaaauaucuaaacuguaaaugcauuagacuaaaauuuuaaaaggcugagaacagggugaagguucacacagcaaucagcccaacagaaccaaacuagccaugaauccguuuuaagaaauagcacacaggaaaauugaacagauaauggagguuguuucaucagauuuuccuauucaaaauucaccacagaacucugcuaucaaauauuagccucuaucuugaaugcaugcaaucauuugagacaaaaaauaugagaggcuggacuaggaugaauuugagugagugcugaaaaaauuaaaaggaaggugccaaggucccuaacuuugagucuaacagaauacagaaaaucauaaagcugaaguuuaagaagccagugucacaaaaagguaaauguaaaugaccagaaaacauuagaaaagugcugaugggcuguuuuuaauuguuuuuauuuuauuuuuuaauaaaaacaaucccacagcauuuacugucaucugguaauaauauauacagauaauggaaacaaucugaacaggcauuuuagaacuauacucccaacaaaugacaccuaaaaaaacaaguucucaauagugucucacuuccuugaucauuucugguuagagacauuuuguggcagaauaugaucuccuuuagcacgaucuggcccagggguuuucuuggcuuuguuucacaaugaaucgcuucugcaucaucugauaugagguucacagacucgucaaaaccaaugacacggcccucuaucagcauauucacuugcucauagagccauaccugaauccgagaucuauuuugcaaguaucugaagaugaagguaagguugaugggcuauauucaccuucugcacuuuuuggcccuggccacagugcaccaugguagaacccacagagacaacacuggcccgcaccccaccuucuggaauugauaugcugccuuuuaggaacccuuucaagucucaaagcaauucuaauaaggcaugucuaucaucauccuuccuaccccaaacccaucccaagugggauccaauggagauuuuuuaaaggaguaggcccccacaccucacgcuccaaaccacagcagacugggcaagugggagugggagcagaauauccaaucuccagauugaucagaauccuaaaacuugugaucguagggggaaagaaaaaaaaagauaagcugaguuaauuaaauucaucuuuugggaauucagaaucaagaucgugggcaaaaaaagauaagcugaguuaauuaaaugcaucuuuugagaauuuaggaucaagacaguuggggugaucaggcagggcagaagccaaaaugguacacugaaaauuaucaugaucugugaaggacuagagugcccaacaagcugccacugagucguccaguacacagacaaaaacagguaaaggagcaggcacagagaaaggcggaaaggccaugacuuggcaacuccagcugcaaagacacacagaaaacaaccuuguuuucuguuuccuaauuccaauuucuuuuuuuuuucugauggagucucacucugucaccaaggcuggagugcaguggugcaaucucagcucacugcagccucugccucccauguugaagcgauucuccugucucagccucccgaguugcugggaucacaggcacacgccaucacaccuggcugauuuuugcauuuuuagcagagaugggguuucaccauguuggccaggcugauaauuccaauuucuauagcuccaacuauaaagugcuuccuguccuuggauuaucaugggaccuaccagguucuuuugauaaaucuuucuugagcuagcgugagugggucucuguuacuuguaaccugaagagcccaaagugagagcacaagacauuauuucugaaccagaauaaugccacgcgcucugaggauaccacuugugugcuauuauauuaagcaguaauagcauguaagaacaacacaggcaacuuagcaucgcugugagaaucgauuuuuacaccaaguauuuaaguuuauacuuucaaaaugaucuuacagcaggauuuuccauuuuauuuccuagcuucuuacaaagaaaggagggaaaagggucacaguggaaggcaccucccaaaggauaauaggaccugcuuuacaacacuaauucuagcauucacuaccuggggucuauaauuuguagauguguaaagguagauacuaaggugcuaaauaagcagcaaggaggcauguuucaguguucugcacauucaauuaaugcuacacaagaugcaccccacuuuuauauguugauacaacugucuagucaaaaauaaaaauauugucucuacucuucuacaugggaguuuucuguaaucugucucaagagaucuaaggaugggagugggcuuaacacuuguuuuguuguuguuguuugugugguuuuuuuuuuuuuuuugagauggagcuucacucuuguugcccaggcuggaguguaauggcgcaaucucagcucacugcaaccuccgucuccuggguucaagcgauucuccugccucagccuccugaguagcugggauuacaggugccugccaccaugcccgucuaacuuuuguauuuuuaguagagaugggguuucaccauguuggccaggcuggucucgaacuccugaccucaggugauccacccgccuuggccucccaaaguguugggauuacaggugugugucacugcaccuagccaacacuuauuaaaccuauaaaacacacaugugugcacacaaagaggcucacacacagacgcccacacagggucauuugggcuggacaucugacuaugcuuaaaccauguaggauucucacagcuaagaaaaucauuaguagggcugucauuaaaaccuggagcccuuacucucguaacauccaacugcuuaaaacaaaaggaaggaaauaaaagauuagcuauagagauucugaguuagaagauuaacuaagaaaucucagaggauaguggaagaagguacaaagccagggugaaaauaccaacuacucuaaaaagaggaaggcaacaguaagacuucacuaagagucaaaagaggcugacauccauuucuucccuuccuuggcaacacuuggcagggauugguaagaagagcuggugaggccugggccucuugagaccuucugaugguugcuccuggggcauuuggggauggagacuccagugccuuuuagcuagaagacacagaagaaauuucaggccuuucaaccuuuggcgcucugugccuucuuuauucucucucagucuuacuuggagguagaaagagcuucugcauaagcauuugaugcucaaaaaauuaagaggaggguccauaggaaaugaagcagacagucgacuggagacaucugcuuuggucuacaaggaaaagagaggccugcagguuuccuucuagguugccuagcccauuugccaggguagaaaaaguaacugauguaaggccaaucccccacugcagaauaaagguuaugcacacuuggcuggaaagaccauuuaaauauacagauaaugaguaucacagauuagacacaggaagaacuccaaaauacugacgcagacagcaggauagaggcuucuaccaugggguaucaaauucagccaggaagggugugugugaugggcauuagugcuggagauagagaaauucaaaaauacuauggauuucacggagacaaagauuagacacaauauuugcagcuacacaccuaucuauaaaucugauaugaguucaaauguauaaaacaacguucucacuaaauuaugaaaacagguaauuuuuauucucuucucucuuuucccauauuuucuaaacuuucuucgaugagcacuuuuauuauuuugggaaaauggcauuagucuucuuaacuaucccaacugggaaaaggaguuggaugauuaacaaaaauguuggguaaagugggaaaccguaaaaugugauuacuaucguaaacauuaacuuaaaaugcacauuugaacauacaauuuauuuaucugucaguauauucauauaaggccuuuccuuugaauguggaucaguuugggguuccaguucgucuuucuuggaugaacaauaucacuuacaucuaugaauuccaauuccuauuucuuuaaaguauaauaaacuuaaagauacuugugaagcaaccuggguauaaauuccagguaagauuuuuacuccgugcugcccuguaaucuaaucguuuucuuacucacaguaauuucauaacauuuuuaagaguccuuccaaagcauucaacuugguuuuaacagaaauaagucucuuucuuguaugcauauuucuucaguuuacauaacauuuaaauaaauuauauagucacaacagucaguauaacuuacaccaagggcuuggguacaaauaagugacccuuaguaagcaugcaccucaccagguggaagcagaaguacaaaagcauuccagaaaacacacauaagccaagaguauuuagugugcuguggguaucgguaugcaucguuuaugaagggaaugaaggaugucagaaaguugauuauguggcugcugcuuuagaggguuauacacuuucggaaucugaaaccaccuccacuguuuuuuuccuuaagggaggaugcuguugagagaugaaaaaccaugguuugagagaggcguggggaauggggagcaugccaguccuuccugcuuaccccaugaguguggaggugggauuuguauguguguacauguccaugcgugugugugugcauguguauguguauguguguguugggggaagagggauuuugagucacaaaagggcacaagaagugacuguuauuguauagggcuucaccaggaacuccaagcuuuaauuaugcuaagugaguggcaggaaugauuaaguaagggaagcaguaaacuuuguucacagugcaauaauggguauaauauaguuaauaagcgcaggagaaagacuaaagauaaagcugugaguacaagaagagggaagaaaaaggaggggacuguggcucagggucaaaacugugucuaaaagggacaaagcaaagaggaagcuaugagguagacauuggcauaaacuuccaggguuuuuucuuucaauuauguauugaacuauucuucauauaaccuucagcuacuuuuugguacaaaacuucugacccuaagaggagugaugcaaaagcguauaagaauaauuccagaccuuuagaaauugacacccuagauagagagagacaaauaggcuggggaugguggcucaugccuguaaucccagcacuuugggaggccaaggcgggcggaucaccugaggucaggaguucaagaccagcauggccaacaucuggucaaauggccucaucucuacaaaaauacaaaaauuagccgggcaugauggugggugccuguaaucccagcuauuugggaggcugaggcaggagaauugcuugaacccaggaggcagagguugcagugagccgagaucacgccauugcacuccagccuggacgacagagcgagacuccaucuccaaaaaaaaaagaaaguacaaauaaugacaaggccagguaauauguacuaaauaugagagaagaguaacacagacaguaagugccauaaaacgaucgauucuguucacauuaagagucaaaucacagucgauuccuccucacacucugacaccucugacucacuuuagcaccacuuaaucgcucuguucuauagaagugguaacaguuucauaaaacucccugcuacuuaucuaguuguacugguucuugguuaaaagcucccuaaaaauuagugaaagacuuuauuugugcagaaacaauaagaugaugaaaacaaguguuuuuaaaacuucauugauacgguuuggcucugcacccucacccaaaucucauguugaauagugauccugaguguuggcgguggggccuugugggaggugauuggaucaugggggcagauuuuccccuugcuguucucaugauagugaguucccacgagaucugguuguuuaaaagucuguagcacauuccccuucgcugucucucuccugccaucaagugaagacgugcuuacuuccccuucacccuucugccaugauuguaaguuuccugaggacucccaagccaugccucuuguacagccugcagaacugugagucaaucaaaccucuuuucuucauaaauuacccaguuucagguaguucuuuauagcaacaugagaacagacucauacauuuaccgugaagaauuccaaacacauacccaaguacagagcauaguauaaugagcccaugugcccaucaacagccucaagaauuuucaacaaaugcccaguccuuuucacuccccucccuguguauaauuuugaagcaaaucucacaucauuucauaucauguguaaauauuuuuaaauaccucucucaaagcuagcacuccuuuauaaaaacaagaccagauaccaauaucacaccuaaaaaguuaacauauuuuuaaugucaaauauccaguguucaaauuuccaauugucuuauaaaagccugaaaugacuuuaaaaaauauuuuauaauuuaugccagaaacaaaauaaaggcaccaaccuauuauauaaucaauggcguacaugggaagccaaaugacaugucugacacccaaggacugucugcugcuaguaaaccugucuacagccuuuacuguguacuagcauugcuuuagggguucuacaaauaugaacucauuuaacucuacaauauaggugaauuaccaagagcaucauuuuacagaugaagaaucugagccccaaagagguuacuuaaucaagucugagaucacccaacuaacaugaagagaaaaauaaaauguguuauauucauacaauggaauauuuuucagccauaaaaaggaauaaaguacugaaagaugcuaugacaucaaugacccuugaaaauguuaugcugagugaaagaagccaguuaccaaagaccacauauuguauuguuuuguuuauaugaaaugucuauaauaggaaaaucuauacagagucagaaaguagauuagugguugucuagggcuaaagagaaggguagaagggagugacugcuaacagguccaggguuucuuucuggagugaugaaaauguucuacaggccaggugugguagcucacgccuguaaucccagcacuuugggaggccaaggcagguggaucacaaggucaggaguucgagaccauccuggccaacauggugaaaccccgucucuauuaaaaauacaaaaauuagcugggcgugguggcaugcgccuguagucccagcuacucaggaggcugaggcaggagaaucacuugaacucgaaggacagagcuugcggugagcugagaucguaccacugcacuccagccugggcgacagagcgagacucugucucaaaaaaaaaaaaaaaaaaaaaaaaaaagaaagaaaaaaacaaaauguucuacaacuggauuguggugaugguugcacaacucugugaauacacuaaaaaacacugaauugagcauuuuaaaugguugaaguuuaucauaugagauuguaucucaauaaagcuguuuuuaaaaguauauucucaaaagauuuaaaauguaucaaaccaaggaauauuuauuaaucaccuacacaagcacuacaguugguucuaugcaaguuauaaaacaaauauaagacacaaacccugaccucaaauugguuacaguucaagagaaaaugcacacauaccauauaucacaaugcacuuuugcuuucuaaauugugccuuuuucucaaagggguaaucaacugucugaaccaaguuuucuguuucauaaaaggcacugagcuaaggccuaaugaacauguaagcuaugauaagacugacccuuuccuccuugcccccggaggccuuuggagguucugaucaaccacaaaguuaucuugugagagagcaaccaauaggauuccuagagcugaggcugggcugauucaccuuacaacugaaauaaugugaguaaaucuguugugacucaacagaggccagggcagccagacaauccuaggcuaagcuaaaaccaacaggucugguccuccucccuggguuuaggaaugcccaggguaaacaaauuacagagguuuuccuuugcuauggcugcugaagagcaaugaagauccuugaugaagaucagagagaauugcagccaugaaacuugggaggugagcguuuaaagaagggagauaaaggccaacacaggagauacaaucugcagaaagggacaauuuggggaucugagguugcacaaaguaaccguaacaaugaagaaaacugaagagguaccugguggaucgcucacaaccaggaagguuucuuggagauagcauugaucuuaaaugaauaaauaaugaggaaacugcuguucaaauucaaagugccuggguaccagggacuuacggauauagggcuugguucuucccggaggauacuggaacaaugucuagcuuaaaguccaaugaacccaugaagcuuacaugccacauaaauucuaaagccagaugugaacaacagaaauauguuuaaauuuuauagacacgugaauucaaccuaauuuuaugauaagaauuuggauucucugaaauuuucagauaacaguggcaaucagaaucuuacuuaaauguuuacuguuugagacagaacuacaaaugaaacucuaaucaauaaaguagaaacucacauuuugagccuuaccaauuaugcugaacugccuagaaagaacugccuaccugaacugccuagaaagaacauuucaucuggauccaguggcuugggcccagagugaccugaugaaucagcagacugcacugcaaaauaacccuauagccaagcugccuccaauaaaccacaauccaauuugaacuacgaucgauaccauuacaacggucuccuuaccuuucaccacauccgccacguuacaggugggaucgauacuuccuauguguuuaggaugaacaggauuagugucacccccaaacagaagugcuagacgaacacaaaaggaaagggaggggauuaaaacacagcaggcugggauggucacacagggaaauauaggggcuuauguuuagaaaggauaucuuauguguaaaaaucauuuuagcauccacagcaacuuagagcaauggaauacacacaauugaugggugaacaacucuuauuggucaaugaaggaggaggaugugguuuaaggucugucaguugcagucagcagguucuaaagcagugacacgugccaggugcccaauccguucuuccucucccaaugugacauggaugaagaaacuuacuuucauccuuagucaaguauacccaccuucuuaguacuacuccagacacaaacuccaacuuucauuaaauauuuagaacauguggucuauaccauuuggacaagcuugcaaagugucuucgcuggcagcauuucagaugccucccccauggagauuauguuucaauguuguguacacaaacaauacuuguucaaguauuuuuaaaaauacacucagauaauuucacaauauacaagauuugcaaaauuuuguuucugaauaaaagccaaaagaagccccaaagaaaaaagcaaucugcauccaaauauuuauagguguucuuauuuuuaaaucaagcaaaaauugcgacuaacaaaagaaggaugccuaaauaaaauaggggauauuuuaaacuaugaaaaaugauaaauacaggcauuaggcuaauuaauaaaguucgaacugauuaaggggaagaaaaacagagauguguaggccuaacuaaugaucuaaaaacaugcacguauauauguguacauguguauuuagaucagaaagcaacuggaguuaucuaaguaguuuaguugaacaguauuuaggcucuuuuauuccuguaaauugucauacauuuccauuuugaagauauacauuuaauauaaggccacauuuaauaguucuauaacauucaguuauccaaauaaaucaaauuacuaaaauaaagaugguuuguccacuuugugaugcagcaaacagggugaauuaugcucuagacauguggaugcuuuuccucaaggauuauaaaaucagccaaagagacagugcugaagaugagccaaaaaguuuuuuguguggagggaauuuuaguuguuuuuuucauaucugcuuaguacccucaagagcagacuaaaacucucaauacgggauuauggacugacagucuggcuuaaucugacuucacugaucacugugaaauaaagaacugauggcuccuaucaccaacauccaauucaauauuuccagugucaauguuuuuaaaacuaaaaaggaaaacacauaauauccuggauaaagaaaauaauacaaucugagauacauaaaaguauucagagaugaaggccggcugccauuaaaggcggucccucauccccaucaagacuguaucagcagagacuuaaaagguaggcagugguccugucucuaaugugagccucauaaaagccuuucaaacauuucuuuuaaccaagaauacaaauuaauagcuuuguaauggcuaggauucacuuaggaaaaaccgaacuagaaaugaaauuucuacaaccaaaaaugcaggucaguaaauuaacaacaggaaaacauuugggagaaaucacuaugguuaccuuuucaaaacuggaccaacaaacuccaacuuacugugcugauuaauaagcaugcggaaagagaugcgguugguauaaaaccgauccagaaaauauuggauguuagugcuaaugaaaggaucaaacccaaacuucuccuuguauucaaucacuccuugugccauuguaggaaccacaucauugugucuauuucugacuuuaaucagaacuuguagaaagcugugugagagggaaacaaaacguggucagucuuaauaucucaugggcugaugcacagacuucccagcucuguccccagacuaguugucugcugguauuuuuauaaguagagacauuauucuuacuacauagaacaaggaaccacccacaagaaacuaaaguaugagccaaguuuuugcuugaaacuuuuuuucuacagaaacccuucuuucagaagugcaaaaaguaaaagguucuaguacagaaaaaaaaugcucaaauacccuuuuaggaauccagacuuuuuggauaagugauugcauauaacacagguucuauaaaaguugaauaaagaauugcagaacauaucaguacuucuucugagaacaugaggacaauccccacaaaaucuccaaggacugauuaaagcaaucucaaagcaauagcuuccaugaauaaagaaauaaugucacacuguuuuuuggguuuuguuuguuuguucuuuugacggagucucacucugucacccaggcuggagugcaguggugugaucucggcucacugcaaccuccaccucgcggguucaagcaauucuucugccucagccucccgaguagcugagacuacagguguacgccaccacgccuggcuaauuuuuguauuuuuaguagagacaggauuucaccauauuggccaggcuggucuugaacuccugaccucgugauccgcccaccucagccuccuaaagugucucauacaguuuaagaguaaaauuuggaaauaaauaucucgcagcaguaaaauacagugaugaaaugcagacagaacacaggaaauuaaacuauucaaguaucuggcaucuuauuguaaauaugcauaugggaaaauacauuaagaaugguauaagacaagucagucaauggaacuaaauaaaaaguuuaggaccaggcccaugagugaguauguauauauaaaaaucgagcauauugagaaagugacauugcaaaucaguagguaaacaaucaaacuaauaaucaaguuaacuggaacagcgggcuaacaauuucagucacauccuaauuucaagacuuaaaaccaaauacuggauuaaaaauguaaaagggugaaaucacagaaaugauaacagaaaaaucaggugaauaaguacauaaucuugggauaaggagggcuguucuaagcuuaauaucaaagguagaaacaaauaaugugaagaaacaaaugauaugacuauguagaauuuuagcaauccuauagggacacacauuaauaaaugaaguagaaaaaaaacaaaaaacuuaaaaaaaggaaaaaacuagcaccccaucagaaaacuaggcaaaggaucugcuaucaaugcaaaauuuaccaaagaagaagcacaaaugccaauaacgucacccuuacaaauaagaaaagcaaaucaaaacaaugugauacuuauuauucuccacguaucagcaucagcuagaguuuggggcuuaacugaggcacuucucaggacaaucagcaacauacagcaaaagcccaaagaaaauaauuccacuuggaggaauugauccuaggaaaauaacuggaaaaggugaacagcuguuuguuuguuuguuuauuuauuuaugagacagagucuugcucuguugcccaggcuagagugcaguggcacaaucuugacucacugcaaccucugccucccgcguuuaggcaauucuccugcagccucccaaaguaccugggauuacaggugcccaccaccacgccuggcuaauuuucauauuuuuaguagagacaggguuucaccauguugcccaggcuggucucgaacuccuggccucaggugauccgcccgccuuggccucccaaagugcugggauuacaggcgucggccaccaugcccggccaacagauguauuuaaaagcuguucuuuaaagcauuguuuauaguagcaugaaaacuacaaaccagucuaaaauccagugauagaagaucaaauugcaugaacuaucugaagauggacuauuaacaugaauauuaugaaacuauuaauaaugguguagaucuauaauguugacacuuguuauguuuguaaaaauauuuuacgcauauaaauauaugcaugccuagggaaaagcacggaagaaaggaaaauaguaauagugguuguccccugguaguagaaauuuggggugacuuucuuuuuacuuaucucaauagucuuauuuuucugaaauauuugaugaaauauuugacgaaauauuucuguaacaaauacauacguacaaugacaauaaagauguaaaacucugaaauuaggccaucgucauucacaaaaaauuuuauaauagacaauuuguccuuuauguaauacucguugcaauguauuuguaaguuaaauauuacuaaagugaaacgauucauuauaguagagaagugccucaacuuaucugaaguggggagacuuaccucaauggcucaaugcucagaauucuccuccaaucuuccgggcucuucuaaacucuaucauaaaugaucaacaagcuuguccucuaagcuacuuuugcuuuacuaaaaugauuucccugcuggugaucccauacaaccucuugguaaacagaaaaggcugcuaccaugauacucgcucaccuuucacuccuuccuucaccaagaacaucagccuucucaaaugccaacuaucauaacuaaccacaugaaccuaggcaagcuacaaaacucacggagugagagcucagcuauuauugcuaucgucaagcacacacuggauucagcacugacaguuugcaaagcaggcucguggccauaaaucacaucggauaaccuguuccagaaacugagacgggacuccgggaaaaacacagcagaaauuuaacaucguguauagucgucucucaguauccgcaggggacugguuccaggauccccgcagauacccaaauccucagaugcucaagucccuuaucuaaaauagugcauacagccuacucacauccucucggauacuuuaaaucaucucuagacuaguuauaauaccugauacaauguaaaugcuauguaaacaguugauagacuguauuuuaaaauuuuguauuauuucuuauuguugcauuguuauuuuuuauugcuuuuuuuuuuccugaauaucuuuucaaucuguggcugguugaauccaaggauguggaaacugccaguacaaaggaccaacuauacuucuacaaauuuguucuaaaauuuggagcuacaguggucagcccuagguuuuaggauuucugccaaacgguuaccagcuaaugacuuuugagaaaacaaagcuccuggauugaauucauuuaauaaucgcuuaaaugacagcaguggcuuauaucaaggaaaacgcuacaucuggggcucuaacccaaugcuucccugccuuccacacuucacagauccaucagacaaacacccaacaaaguauaaaauaggugagggcuuuuguuuuuccuuugaauuuuaguuuacaacuagacuagaacuagcuacucauggcucagacguaaacauagcuuauagguccagcuuugcuaugaacggucacaaucuugggcaagucacuucacaucucugaacucaguuuccuuaucuguggauugagaggacuggguuaaauaccuccuaagguugcuuguauaacaugguguuucccuaguucuucuuauggaacaucuauuaagucagguguucagucucauaacuauguggacuaguuuauacuuagaaauuucucagcacaacaggccuaccauaugcauccacuuacauauacaugaaacaggaagaaauuaaugugaaagggauauuuaauuucucuuggaggggaaaacauacucacagcuagaguuaguguuccugggauaaauaaaaaugaaucucaucagcaugauaauuugccagucugugcauaaagggagcaauagaauucagguugcuauauaaaaaaacauacuuuuaugccucuccaaaauaaaaccacuacaguuuuugagcucaaauguaauauccuauugaaauuuuuuuuuuaauuguaaaggauugaguagauaaauucauguauauaaaaaggccacugcauucuuaaaacuaccacuagauggaacauuuacugcaguguuuauagugacugcccaguucaccuuggguaaagguauuaaguauuagaucauaaaagcaaaacugaaagugucauuauuacuuuuguauuguguuacauucuuagcucgaauuaaaaaaaaaaaacucaauguugagucacuacucauuaagaaaaugaacgcuuuuguccacauucauacuccuugagucuuaaugacuugaauuacauuuaccaaaaucuuucuuaccuagauauuuuuacuuucagcuaagugguaccauacuuacuuauccaagaccuguggauccucagggcucuuauuuucauauucuaaaaguucaagaaaacucugcauauaccuaaaaggaaaaaaaaaaaagaaaaagaagaguuacuauguuaguugccugcccagcauccaccccuccucucccucuuccuaagaacacuccaaaauuucacucaggucuccaucccauccgcaucccccauguggcuuaagugcaucagggaagccagugccuccaaagauccuggguggucccauuuuucucugggcaauucuauuucucuugucacuaauuauucauuagcccaauaguuuaggucuaagccuaucacugugugcauuccccugaacacagggaauggcucaggaauggacauacugucucaauucaggccaguaaaaugacagaaaagacucgcuagaggacuuuggcagagaaaucaaccugcucugcuuuugugcagugcuguguggauuggaagccuggaacugcugcagcuauucugccaccaggggggaauccagucugaaaaugaagccagcaccaucgaaagcagggccucgauagcuucaugaaucucugaaucaaaccaacaccaaaagcucacccuacggcuggaccuucuagugacaugagccagguucgguugcauuuuuucuacuuacaaacagacauauccuaacuuauauaccaagucuacaguuugauuaccaaaaauguacuuauacauuuuaagaaacacaugugugacacugaagugccugccaagaacuuagaaacuagaagugaagaaggguccuucugaguuaaauuaauuucaucaguacuuaaugggggagaaagaaggccaauuaaacccucagaaacagcuucuggauuaagaauagcuccauaucucaaucagggccaguauaagaaacagucuguccaacauuaaaaucuggagaacacagaaaaaugagauccagagaggcccauuagugcagcagcuauauccagccaggaucuguuggaucugguggggauucagauauuccaauuagagauaugugaucucuauuugggguuuuaacauguccugaaagaauuaucccuuuauucuaauuauuucuaagcuuuaauugccacuaauccuauuaucuacaccuuuggauagaggaugaggacacucuaguaacuaaaaaugacuguuacacauauaaauacuccaaugagaaugccacuugauucaucagcuucaugugaacuuuggacaaugcauuugauacuaaugaauguucauugauggacauacuuuuuaaaagucucugggggcugggcguguuagcucacgccuguaaucccagcacuucgggaggcugaggcgaguggauuacuugaggccaggaguucaagaccagccuggccaacauggcgaaaccccgucucuacuaaaaauacaaaaaauuagcugggcgugguggcacaugccuguaguccuagcuacucgggaggcugaggcaggagaaucgcuugaacccaggaggcagaaguugcagugagccgagguugugccacugcauuccagccugggcgacugagcaagacuccaucucaaaaaaauaaauaaaauaaauaaauaaaagucucugggcauauaaggcuauggauuagauauuguuaaaaucauugggucaaaacgccaagaggucaaagccagccagccccagugaugcccuccgcccugccacaugcaagcaagcuagguaggcaucccguccuuuccaaaggggacaguuggagaaagucauaaauagcagggagccaaagauuauucugggccaggugcgguggcucacaccuguaaucccagcacuuugagaggccgaggcaggcggaucacaaggucaggagaucgagaccaaccuggcuaacacagugaaaccccgucuuuacuaaaaauacaaaaauuagcagggcaugguggcgggcgccuguagucccagcuacuugggagguugagacaggagaauggcaugaacccaggaggcggagcuugcagugagcugagaucccgccacugcacuccagccucggcaacagagagagacucugucucaaaaaaaaaaaaaaaaaaaaaaaaaaaagauuauuuugagguucccagccugacagucaagagagcaaggaggacacacugugaccaaggggaugguggugggggucacagcccauuaugcauaagauucgcuuuuaaaaggaaaaaauggcagugaaacacaaugcaugauccugaaguggauuccuaaaucaggaggagaaacugcaaaaaaaaaaaaaaaaaaaaaaagauggggguaguaucaggacaauuaguaguaaagugagaacaaguucuacauauuagaagacauuacuguaucaauguuaaauuucccaaauuugaugaucacauugugguuuucugagaccuguuccaaugaaauacaugcuaaaguauuuagggcaaaggggcaugauguagacaucguguauguguaccauauauggguguguguaccauauauagacauagauuauauauaugugugcacgcacguguguguguguguguguguguguaugcagagagugagacagagagagagaaucugaaugacaaugguagaacguugccaaauguuaacaauguuaacaauuagugaaucuacgugaagguauacuggaauucuuucuaccaguuuuacaacccuucuguuaaguaggaaaguauuucaaaauagaauguuuaagaaacaagaaggaagaaauggcaugcauuuguuuggaauggauacggaaaaggaacaguuaaaagacaaaaaccaaacaauagaguugacauagcaauuuguucaagccuauacuuugccggaauaauauaacacauuuaaguacauuuggucuuugucccugcuuccuggacagagcucccaaaacccuuggaacuaccugaaugauaggauugucuucugcuauccauaaggagccgccuuugaccacaccugaguuuaugcuaauguggugacuuaggacgggaccucuagauagccucaggauggggcuggucaccagaaaggccaagugauucgaggacugcaacuuucagcucuacccucaaccucuggggaggggagagggcuggagauugagcucuaucaaaacccuugaacgaccaucagagagucuccagguuggugaacauauggggguacugggaggguggugugcccagagugggcauggaagcuccauguguccccccauaccuugcccuaugcaucucucccauguggcuguuccugaauuguacccuuucuaauaaaccuauaaacauaggugaaguaucuuccugaguucugugagccguucuagcaaauuaucaaaucugagaaaaggggcauggaaacucaaugucuagccacucagucaaaagcacggguggcccaggacuuugugucacaaauucaacuucuucaguuaaaugacauaugcuuuaagcaucagagcuauaacugauuuaaguuuauguuauacucugucaaaauuuuuccuacuuuucauggagcaaaugaagcaaaggagggaacugauauuuuuccaaucugagguuccccuuuaaaugacuuaauuuguucuacaagaaguacugacuucaaggaaugucuuuacaaggaaaacgaaaggaguaagguuaagacuugauaaaagcagcaaauauccugucagaagaacugcaaucccaccacacacaagaaaaacucaggaaagugucuaguauaacuuaacaagcauuuucacuaaaacaacuuuaaaacaaacagcucuaaaagaaaaaaaacaaaacaacuuuuaauugcauggaaaacccagcuaucccaaaugacucauuccuaccuagacgggcaguaugugcacuuuuacagagaauggucucgcugccaaauguucacagcauugugggaagauccauuuuaagccacauuguuuacuuaccaacucugaaccaaucccacugaagggcgguuaaguaaauuauccggcagaagauuaacuucucucauuguguuagccagccgcacaggaaguuccuuucguagaaacauauaugaaguuuucucacaugcauuaucucucccuauuaagacaugaaaaauguuccaugauuuuauagucuaacagauggagaaauaaagugcucccacgguagcacgguuacuacugguuggaaagagaaaauuaaauaauccugcagucucuaguugaauuuuuauccuuugaaauagcaaguucaagaaaauaaguuaauuagcagagaaaaagaacauucauuacaagaggcaacuuugaaagcaguuuuuuuuucuuaacacaaaaacguuccuaguguuaccagcggcaauacaaaagugaccugggauauaaucugaacuuguuuucaaauaaacaccaugggaaaacugccaaguacaaagguaacagaacguguaaauccacucccauucauagggcuuuccaggaggcaacggauccauucauuucacaauuauuuaccuacugugugugccaacuguuuccuaagauuuuccuccaguguguuucuucagggaccauagcucugccccucugggaaguagccacagaccccagagacccugugcuuccagaggaggggcucugacugagacacaggguuggcaugugccagagaaacaugccagagaaacuaucuccuggguauacucagaggcagagugaucuaccaugccacaucggagaggguaagauguggguugaccauaaggaaggaggucagugccuucuggaggcuucccugagcuagcugugcauaaaauuuacauaaacaagacgccaugagaggaaacauaccuggccacuuaaaagaggaaaccugagcucuuuccccugcugucauguggcaggaagaguucuagcaucagccuggccugcaacccccagcccugcuggaaacuccaugguggcugggaguggagggccugauagaaaaggcaugagcuuuggagacagaaauguucuccagccccaacuccuccauuugcagguugugaaaccuuugguaagcuucuucacuucugagucucagcugccuuaaucuguaaaauggggauaaaacuaguuuguguaaggacuaaaugugauacugugcauggaggcugacacggagcaaguguuggacaaacacugguccuuccggucuccgugguauugagggguccaucccaucucccucgcccugccuaggccucuuugcugcuccauauucccuggaggcugcacagaaaugggcaacaucauggccaggcccagagagagacgagcagagccauuuaacaauuuucucuuccaaacucuccuuauucuucuguacgucaugaaggcagcaagucagagauucagaagugaauccaauuuucuaacacuuccagucauauucugguuuauucauuugcucucccuaccaaauaaaacuugaaaaaaagaaccuaaucuagaaaguaaucugcagaaccuuucuuccccacucaucccugacccccuucuccauucucaaaaaaguuacaauaaaagaugaaagucugaaauaauccaucccucauuucccucauccuaagugaguauauugaaggccuuugguaaaucuuuuaacuaaaugaugauucacuuuucuccuucauacuuucacugugauaaguaccucaauccccaaauacccacuucaaguaagaggagaagggguguaaugcccccacaaugaccuuccaacaucuauucuauacacauucauuuggccuuaggcaauuaacauuuaaaaugacucuggucauuuuuuuuuuuuuuuugacggaguguugcucugucgcccaggcuggagugcaauggcaugaucucgacucacugcaaccuccgccuccuggguucaagugauucuccugccucggccucccaaguagcugggacuacaggcacccaccaccacgccuggcuaauuuuucguauuuuuaguagagacgggguuucacuguguuagccaggauggucuccaucuccugacucgugauccacccgccucggccucccaaagugcugggauuacaggcaugagccaccgcgcccagccagcucuggucauuuugcuucaaauaauauagagacaguccccaacuuaaaacaguucaacuuaugauuuuuugauuguuuaaucuucucacuuuaugauggguuuaucuaauuauuaagggcuuuuuuguuuugagacagaaucucacugucacccaggcuggagugcaguggcaugaucuccgcuuacugcaaccuccaccccccagguucaagcggcucucgugccucagccucccgaguagcugggauuacaggcgcccgucacaaugcuuggcuaauuuuuguguuuucaguagagauaggguuucaucauguuggccaggcuggucucgaacuccugaccucaagugauccacccaccuuggccucccaaagugcuggcauuacaggcaugagccacugugccuggccaagugcauuuuugaguuacaauauuuucgacuuaugauggauucaucaggauguaaccccacuguaagucaaggagcaucuguauauuauuccuaaaagguucuggaugaauauaauuuuaauuuuaaaugcaauaaaauugcugauauuuaucacagugaaucucauuauaaaaugaauucccuauuaucuaaguuaaaauaaaagucuagcuuuucacaugccaggaaaaauacuuugcauccuggcuaaacagaaaggaaauuaucuuuaaaucacaaaagaaacauugauguucucacugugggaugacaaagacucucuccuuugaccaaacuugaaaccgguucuucuggguuuguuugcuuuuggagacagggucucacucugucacccaggcugcagugcagugguacaaucacgguuuacuaccaccucaaccuccugggcucaagugauccugccaccucagccucccagguaggugggacagcuggcuaauuuuuguauuuuuaguaaagaggggguuucgccauguugcccaggcuggucucgaacuccugggcucaagcgauccucccgucucagccucccaaagugcugggauuacaggcaugagccaccgugcccggcucugaguccucuuucugacuaggccucgacuuuggguucuaucuugaccugcuuaguccagucucagcaaaaauccugcugagucauuuuagugaaaauccccuacccuuggugucugaucccccuacccucgauaucuuaucaugcuggccugccuucaacaagaauccccuccaaccuggauuuuuccucuuaguaacuuuccacccauugacccacacucugcuccuuggcuauaaauuuccacuuguccuuguugcauuaggaguucaaccugaucucuccccacuauugcaaaacucccacuguaguggucccucuugaauaaagccuucccuaccaucuuuaacaaguaucagauaauuuuuuuuucuuuuuucuuuuuuuuuuuuuuugagacagggucucgcucugucacccaaccuccaccucccgaguucaagcaauucucccugccucagccucuggaguagcugggauuaaaggcauccgccaccaugcccggcuaauuuuuguauuuuuacaaagagauaggguuucaccauguuggccaggcuggucuugaacuccugaccucaggugauccgcccaccucggccucccaaacuguugggauuacaggugugagccaccaaccaugucuagccaguuuuuuuuuuucuuuaagaggaaaaaggaaguucuggaauagggaagaaguagaagaauucugguguuaaacugaaacugguaguaucaguaugaacuaauaauuuuuucacaauuaugaguuuuugaggguaaugaaaguauacauguuuaaauuuccaaguuggcagccuguuaggagucacaggauacgagcauguugugagcagugagagcuggcuggcaggugugagguggccauagucagcuucucaucucuucucuagaaguugcagaucuagaugguuucagaauuuaaagguuuuucaauuuuaggaagguaaaaaggagucuauaccauacauuguacaauacagaguauuagagagccacaacauagcugcagugaaauacgugaacauuuccaguaaguaggauaaggacuauggaaucaagucaguucaggucugguuuugccacaaaaugaguuguggcagcaaauauaugaaaaagaaauucaauuuucagaguuuuuugaguucaggauucagagaaaagcuuaugguccugcggggcguugaugacaaaggucaggugcugaaguucgaugacaaaggucaggguuugaaucuugacuagagcauucacaagcuucaugagcagggguaaguuucuuuacacuucuaaacuucauuguaaccaccuauaaaaaaagagcaguaucuacuucacagagauuuggugaggguuaacaugugcuuaacauuuaaaccagaggcaguggcucacgcccguaauccuagcuacuugggaggcugagaugggaagaucaugugaggccaggaguucgagaccagccugggcaauguggcaagacccccaucucuauaaauaaaaacuuaauaaaccacaauauuuaacagucacauauucuuaaaacuuagaagaggggcuaauuaaauagcaaucacuaaugacgcugaugaugcucaaacagaauagucugaggccaugggauacacaaucgaacugucaguuacugcuuggucagcccugagaacccauucccugggcucaucugaugauucugcaauaguuaaaacucaacuacuaggcauggucuaagagaaccaaauuucaggaagcauuuucuucaagcuuccuuggauuaucagccuguuauaaaacucauguggaaagaaacuuuuaucugucucucuaucccccauagcacauauuauagugccucgccuaugguagcuucucaaugauuuuuucaaauaauagauaaugcuuucagaaguuuguuuuuuucuuuguuuguuguugauuucuuuuuuuuucuuuuuuuuuuuuuuuuuugagacagagucccacucuguugcccaggcugaagugcaguggugugaucucggcucacugcaaccuacgccuccuggguucaaacgauucuccugccucagccuccugaguagcugggauuacaggugcccaucaccacgcccagcuaauuuuuguauuuuuaguagagaugagguuucaccauguuggacuagcuggucuccaacuccugaccuuaagugaccugcccgccucagccucccaaagugcugggaugacaggcaugagccaccacacucaguccagaaguucguauuuuuuaaaaagaguaguuggaaaauuucagguuuugucucuuacauucuacauuagguuuagggacaaauucuuuguacucagacaccuuaauuauauaucagcuuaaauaggaggauaagucuuuuuuaguuaauuaguuagccuaaaaauaaguaugaaaugccugauuuuuauaaccuuucugugcuuucuucacguacauugaaaguaucuuuccuauguauuaaugccggauacucaguuuaaaugaaaagguucuaacaaccauuuuuuuuuaaauaauaaacuuaccaagaaaaacauuuugguuuuaaaugaauguccucgccagaggguucuguuuugauaagucuucugguauauuguguauuuuccaguucugcuuuccaauuauuugacuucauuuuuucccuacuuacuuggcuucucuacauuccuuaauuuugacuuucuauuuuuauucugcauuucucaauauacuucaucuuauucaaauuuaccaauuaaguuuuucccugguaucaguucaaagaugacaaagggagcaggugagggggcuuggaaaacucugacuuaguggaugcaaacaggucauuagacucaaauacacucaugugcauuucuucuguuuuucuccuaaguuugacgauccuuucauucuccuuuguuucugguuuguuuguuuguuuuugagacagagucucucucuguugcccaggcuggagugcaguggcgcaaucuuggcucaccaaguggcggcaaccuccaccuccugaguucaagcgauucuccugccucagccuccugaguagcugggauuacaggcaugcaccaccacacccggcuaauuuuuguauuuuuaguagagacgggguuucaccauguuggccagguuggucucgaacuccugaccucagaugauccgccugccucagcuucccaaaguucuaggauuacaggcgugagccacugcgccuggccucuguuuguuuuuuauacuuuguccuuuuauugggaagcuggagacaauuacuauauuugcaaaagguaugauuugcuuugucuagaaagguuccauauagcuucacauucaccaagaccuagggugaauagacacagaaauauaaaugacuuucaauguaaugcagggagccuucccuauggugggaccaggagguagccaagagcguuuagcuagccaccugagagcaggagcucacagacauauuucuuuauaccugguuuacauaguggcugauaacccuggcuucguuuuaauccucuuuucgacuaauuuacaggcggcagaaaaaauaauuauuucuucaauuaaucaagucaccugauaauaagugucuuuuuuuuuuuuuuuuuuuuuuuuuugagauggaguuuugcucuuguugcccaggcuggagugcaauggcacaaucuuggcucacugccaccuccgccuccuagguucaagugauugauaguaaguaccuuuuaauuaaagcagaggcugaggacauauuuuguacugucuucaaucaacagagaccaugccuccuaaaauguagagucuccucugucuggauuacuugaaggcuuucuuuguccauuguucagcuuuagcaguugguggggguuggggggugguuugggaguggcaauaaugagauaaagagcaauacauggaaaaauuacccgcaaggcaccaaaaaaccccaacagaaugauccagcucauucugauaauuuuuauuaauaucaucaacuaaaugcuuucgauuaauaucaccaacuaaaugucugaguuggcaauguacuuuucccauuagccauguuuaaauugguaaaauauaacugagaacauauuauuuuaagcuuuuuaaaaaaaauuuucaacuuuuauuucagauacaggggguacaugcgcagguuuguuccauguguauguugcaccuaggcagugugcacaguacccaauagguaguuuuucaacccgcgcccacuucccccuccgucuaguaguuuacagugucuguuguccccauguuuauguccaugugugcaggugagcucuucaacuucuuuucucuaguuguaguuauaagauuucaaucuguugaaaacacugaauuuuagaauaagucauuaauuuuuugauuuacuaggguuaaacaaugauuaauugaauaguccuucagaagaaacaaucugacaugugaauggagaccuaccaaaugguugugaauguccuucaaagaaucacuuuuuuaaaaacuuaguuucuacuuuuaaaauguuuguuuuguuucaugagcaguuucucacugccuuaagagcuuaagaguuuuccuuuguucaagaacauuuauuucugaauuuaagaaggaucaaaauaggcugcagauuuggaaucugccaaacuuggggcugccuccacucuaggccagaccauguuuugguuauuaauaacagugagccaauuaugccuguaaucccagcacuuugggaggcugaggcaagaggacugcuugaguccaagaguucaagaccagcccaggcaacauagggagacccagucuccacaaaaaaauaaaaaaucaucugggcaugguggugcgugacuauaguuccagcuacuuaggagacugaggcaggaggaucgcuugagccaggaggucgaggcugcagugagcugugauugugccacugcacuccagcccaggugacagagugacaccccauuucaaaaaaacaaaaacaaaaagagugagucagaacuucagagacaaagagccaaauacuggggauuucacgcacacuuuauucccuaucaaauucagugccccaaaacaucuagauauuacacgacuucuuucaguccaaaguccauauuaugauacucacagaugcugugagucaggaauuuagacagcacgcagaagggauggcuuaucugggcuucagcugggaaaacccgaaggcugcagggugacuagaucuugggucuggaaacauccgagggccccuucacuccuaagucugaugcuugggacagacaacugcacaacuaggacugcccaucugagcagcuugggguggccucuuccugggcucccucacaucacggcagcuucgggcuaguuggauccuuccaccacuucagugaaaagacagcagccgcauggccuuuuaugacccaggcucagaagucacacagcuggccuagucugccacaaucaauuaggcuaaguagccagggccugcccagacuccagaaggaaauuucgacuccugcuccugacagaggggugccaaggucacacuguagaaaaguauccucauggccaucuuuggaaaaugcgaucuucucugggauguuaaugggggguuguagaugauuuauugcuaaauuauauuuuaaagcacucuuuuauggccagucagauuuugucucuuuuggggguuaauguccauuuuucugucuuuguuagucucuuucucgcuguaggcuucccucagacguguggugaucuuugguuguucagucagguuugggaaggaagcaggcuaaagacugggagcccuguggggcucuuggcggagagagcucccugaauuccugauuacacuggggcuuuucagugggcgcuaauaccacaccagcuucccugauucuccugaaauaguuccaucagugucuuuagagaagaacccccuuuuguccuuuaccuugccgauagggauaacugccugcuguuaauguucuagaggucagaacagaggguggcccuucugucugcagacuuuuaguucauucuccuguuggcacccagccagccuuccugccacuccugcccgcuacuggucugcugcguugcugagguaggaguccccuauccccccaccccgggcucugcugcacuaugcucagcacccuccucugcuacagugccuucugagaguguucuagaccugagaacuguccaauauaggaacuggcagccauuacaagaaauuuauuuauuuauuuuuuuguuuuacuuuuuugagauggagucuugcucugucgcccaggcuggagugcagaggcacgaucccagcucacugcaaccuccgccucccagguucaagagauucuccuauuucagccucccgaguagcugggauuacagaugugcaccaccgcgccuggcuaauuuuuguauuuuuaguagacacaggguuucaccauguuggccaggcuggucucgaacugcugaccucaggugauccaccagccugagccucucaaagugcugggauuacaggugugagccauagcgccuggccccauuaagggaaauuuagauguuccauuuuauuuuuauaucaaugauaaauuccccaaggguaauaacuguaucaugguuauuaggagaauacccuuaagcugaggacauacauacuuaaguaucuagggguaaagaggcaugaugucugcaauuuauucucaaaugguucagcaaaaaagcauaaagcauguguaugugagagagagagagagagagaggaauagggauggauggagagggaaaaauaaagcaaauacggcaaaguaacucauaaaaaucuuccuauaacuagaacuauucuauucuuuaaaaaaauacaaaaaucucauacaaaauaugcuacuauaugcagagcuuccuaauggggucugacacccgugguacccuucauguaaugauuuuuguucuucugauaggaaaaggggguacgaaggugauugggauagaguucuuaauuaagguaguagucccuugauccccucucuuuagaaauccuguuuguuugcucuuuugaaacauauaucugcacagacuagugagaaaacugcugcucuguauaacaaagccaaagcaagcugugaauggauuucucugugggcccagaaguugugcccugugcuugggcaaugcccucugccacugccucagucacugaguucuaugaguucuauguccuguaucaugauuccucaaaagauugaagaguccauuaguacaauaccugguacauuguagguauucaauaaauauuuccuggcugggcaugguggcucacaccuguaaucccagugggaagccaaggugggaggaucacuugagcucagauguucgagaucagccugggcaacauggcgaaaccccaucucuacuaaaaauacaaacaaauuagccagcuaugguggcacgugccuguagucccagcuacuugggaggcugaggcaugaaaaucgcuugaaccugggagguggagguugcagugagccgagaucgugccacugcacuccagccugggcgacacagugagacuuugccucaacaacaacaaaaaauuuccuggcugggugcgguggcucacaccuguaaucccagugguaggccggggcgggaggaucacuugagcucaggaguucgagaccagccugggccauauggugaaaccccgucucuacaaaaaauauacaaauuagccggauguggcagugugcaccuguagucccagguacucggaggcugagaggugcaaggaucgcuugagcccaggaggucaaggcugcagagagccaagauugcgccacugcacuccagccuaggugacagagugagagccugugucacauacacacacacaaaaaaaccucggaucgcaacugaaaauuaaaacacccaguaaguuuaguuacaaacuuaacauagcaaauaaaauucagagguucaagauaacauuugcagguaacgguaaaucccucuuacaggccaacuucauucuauauauuuguuuaaggguauucaauccuuaaaaucaugagaagagccaaaaggcagguaggaagacaauacaguggcaguaacagucaauauggugugucaggccagagaguggaagagacaugauguguucagaacagaugucacaaauaaagcugugacgagcuagagcaugugaguaacaagcacuaugcagccaaagccgccaugcauccauaucaaccuaauuccagaagggaguuuagaaucuaguccuaacgguaaauuggugaguuacaggaugcccuguugucauggaagcaggaauagcuaauggucacacuguacucauauuugagguuaacugaggcaaaucauuuaguuagccaucacagugaucaaagggaauccaaagcaagucacucucaaagcacaaaagagcugaaagugcuauguuucuuggaaaaugaucaguuuuguacagcugagaccuucagccaauaaacuugaagauaauuaacauucaagguuaagagcucccuacccagcuuuuauucuuagcagaaagcugacuucaucaaggaaaugcugugucacuaacuucucauaguaaauucauaaccaacaucuaccaagcaccuaccauguguuaugcacuaugccauacguucucaaucucaucaaugcaaccauccuaugauuagccacuagcauuucuauuuuguagauaaggacacugaaguguagugggauuaagugauuugcccaggcucacacugcugguaggcaucagaaauuaagacuggaguacaagucuguauauacugcuucucauauucccagagaugauaaugcagacuaacaaguagugguuuucagaaguagaauuauuucauuguaaguaaguggaguagguaucaaucugauaguucugaaauaauaaaacuagauaagcauuagauuauaccauuuccugauuguguaacagaauaaauuuagacaaaaccucagcauugcuaauagagacuauauuugcuauaaagaauugcacuggggacaaugguauacuauguuaaacugaaaagagcguagguuuaaaagcucaaucuugcuuguaaucccagcacuuugagaggccaaggcgggcagauuacuugaggucaggaguucgagaccagcuuggacaacauggugaaaccccauuucuacuaaaaauacaaaaaauuagccaggcguggugaugggugccuguuaucccagauacuugggaggcuaaggcaggagaaucacuugaaccuggagguggagguugcagugagccaagaucacaccacgcacuccagccuggacgacagaggaacacucugucuccaaaaaauaaacaaacaaacaaaccucacucuaccugaauuuuaaccauggcuuugccccuaacuuugcuuagguaagagacuuaaacuaucuaagcuuuagacucuucauccaagaaauggaaacacuuaauguggacgcugugagaauuacagcuaaccacuauuguguuuagcagagaguggcacacaaauguaaguucccuuggccucauaaaaagaauaauuucugguucccuuuggaagagguggccaagauguuauaccaaaaacuagcugaugacuggcauagucucuuccuuacuuggggcuucuacuuucucauguguaaaauugggaagauuacagaugaucucuguauuaguuuguucucauguggcuagaaagaacuaccugagacugaguaacuuaugaaggaaagagguuuaauugacucacaguccacauggauagggaggccucaggaaacuuacaaucauggcagaggcgaaggggaagcaagcacaucuucacaugguggcaggagagagagagagcaaagggagaagugcuacacacuuuuaaacaaccagaucucaugagaacucacucgcuaucaugagaacagcaagggggaaaucugcccccaugauccaaucaccucccaccaggccccaccaccaacacugaaaaucauaacucaacaugagauuuggguggagacacagagccaaaccacaucagucucuaagcucaaguucccacugaauuagucuaagaggauaagauuuuuguuugucucucuauacaguuauuuaucauacacuaaccuugccuacuaauauaaauucuaagaaaacucuggagagcagugcuaggaguaaacagccaaggaaaaaagguggaagucaagaaaaaggggccaggcgcgguggcucacgccuguaaucccagcacuuugggaggccgaggcgggcagaucacgaggucaggagaucgagaccacggugaaacccugucucuacuaaaaauacaaaaaauuagccgcgugcaguggcgggcgccugcagucccagcuacuggggaggcugaggcaggagaauggcgugaacccggaaggcggagcuugcagugagccaagaucgcgccacuccacuccagccugggcgacagagcaagacuuugucaaaaaaaaaaaaaagaaaaagaaaaagaguaugcacauuuacauuuuguucuucucuuugugaucuccauccagaaagccuccaacaacauuuuggauaaaggacaauuggguuaacaccuuaccuguucccagaaaccacccuuauuucaaaaaccuuuaagggcgagguagggacagcagcaaaaagauaccacaaaauuauaugauucauccuucugacuagcauacguaaauuuauguauuugucccagcuucucauuuaucuaugagcuccucaaaggcaaugaauaugccuuggcaauuucccaaugcuucuuaguuuccauuucauuccaaauccagaacuuucaacuaaugcugauggacuccagaaugacuucgguguuaaccuuuggcaucucacucacagacucuauccccuaaagugguucauagcucuugggcaaaaauuucaccagcucuaacacugugguuuuaacucuggaagaauauuauuacacaaucgccuggguaacccaaaagcaccagcaccuagacuccuacccgcagcaauugauuuaauugguuuauguagggagcaggugucacucauuucaggcgcuccccagacaauucucaugagcagccaggacugagaaccauggacuagcaucuaaucauagaaaauucaaugaggguaaacaaaucaaagaacuccucaagcccagacaauggcuauuaagcauccccaauuuuuuauuuacccauguacuguugucuuuauuuucaccuuugaguuuuauuucagccucuugggaaacugaucacaaacaucuuuguacucuguaagagacuuuucagugucagcucuuuuuuucccuuucacuuucagaugaucuuaaauggggaagauaaaaacuaaacaaacucgagaaggaaacggcugugcuucaggaugugguaaugcuugggaggcggugacaaugcacucgaugguccuuuccuccaguuuguuuugcucacacacugcgcccaaucccucaccuacuuucucugcuauaaagaggugguaagacgaucaggcgggcagacauguggcucuacuaccuauuauacgugugagucaucuucuuacccgcucagaacuucaguuuccuaauugguaaaaugggcauggcuguugugagaauuagaugauauccuguuuuaguugguaaguacucaguaagugcuagucgaaucuauugaaucuuuuucaggugccauauaaaguccuuuuuuuuuuguuuguuuuuuuugagacggagucucacuccaucgcccaagcuggagugcaguggcgcgaccucgguucacugcaaccucugccucccugguucaagcgauucuccugccucagccuccuaaguugcugggauuacaggcacgugccaccgccuggcuaauuuuuuuuuguauuuuauuagagaugggguuucaccauguuugccagacuggucucaaacugcugaucucaggugaucugccugccucggccucccaaaguguugggauuauaggugugagucacugugcccagccaagaguccauuuuaauuuccuucuccaauagcuucacugaagucaagcucaggucaaagaaacaggaauaggaguauguaggccagagauaacacgguagagaauauguaaggagcucuaacaaaagaagcaguacccuggccaugaagggcaauuucuagagaacaggagacucccugagacaagcagcuuccucccagaagagucuauuacaaauaaagugcucacaugagcacaucacaugaccaaugcaggaacaguaauacagcaauaaccacuuugcuuucuauuuaacagcagaaucaggaggagaaauuaaccaaaguuauacaaaauccacaggcugguauuaagaaauaucugcuagcaagcuuaaggaaacauuauacccuacuaggacagauccaagaaaagguucagauagaagccugaguguucucuggucuaugaaaauguaacaauugugggaaaauauauguaaguuacaaauuucaaaaggcccuacuguuuucuggccagcaacacauggcaaaauauuuaacuucaugguaugggaaaauguuagagagaugauaauuucuucccaacagugagacuauuauauacugaccuccaugcccugguaagagagaaagcaacacugguacaacucaaaugguuaaggagaaucauagaucaaguccaagaaugaaaauaaaaucacaacuguuuaggugacccuuagggaaauaacauaccacugaguuagaacccuaaguauucaauuagagcgaauauaaaugcugaccugugcaaauguaauaguuuacuacaauuuuucugccauucauuauggcaaaagguuuaaucucagaguuaagaugaggcaaugaccaggaaugggguucuccuugagggauaugaaggacauccaccaugggucacaaucaaacccagcucucccacgaaggcaaguauagcguaaacuagccuuccugccauaaaagcgaaauaggcuaacugaagauacuucagugcuaguuuuuccuuuguuuguuuguuugugacagagucucauucuaucacccaggcuggagugcaguggcacgaucucggcucacugcaaccuccaccucccagguucaaacgauucuccugccucagccuccugaguagcugggacuacagauaugagccaccacucccagcugauuuuuuguauuguauuguauuuuuuuuuaguagauaugggguuucaccauguuggccaggcuggucucgaacuccugaccucaagugauucacccaccuuguccucccaaagugcugagauuacaggcaugagccaccaugcccggccucaaugccaguuucaaugccaaguacauggcaaagauguaaacccuaaaacaccacguaacccauccacaguucccuuagcacacuuuugaugauaugcuauucaaggugcacaaugacuaauuuaucaagaagaauuaguacacaagaaaagcaagaauuauuuaaaauguaaaguaauaaauaaggaacugcccucaccaaauuucaacauaaauuacaaaguuaaaaugugauauuuaguuaaaaucagaaaaguugccauguugacuagaauccacaaauacaaacuacucugagagcuuagcauaugaucaaagagaaacggccaagauaaaagagaaacagccaaguuucaagagaaaaacuugaggucuuaauaauuguugggcaacuugacagcagaacaggguaaaaaugaguuagcuacaaaggcucaucagaaaauggcaauagauuccagagagauuuaauaacuacuuacaaacucugcuauaggugacaaaucugaccaugauaaaagcaccguaaaugauauagguaacacugagcauaugaaaacucagacugugcacuagauaaaaaggaaaccaacauacaguguuaacacauguaaauauaugggcaaaagcaggaagggcuaucacaaaaaaacagaugaauuacccauauuacagguaauauagcaauucuuuccaaaugucuucaguuuuauacuuugauaauuacuuugccaaaggaaacgauauuuacacagcacaagagcuuacuaugccaaauauacacaggaauuuaugcaaaugauaaaaacuucagauucugguuacaaaauggccaauggcacuuuacacagaacaaaaagcagacaaaaaacccaagcagaggaaaaagcacuuuucauuccuauguuaccuaugaugcgauuaaaaucauaaaaccucauuuuggcagggcuacggagaaacugauacagauaaacuuugcugacagcccuggauaaauuaaaccuauaaacugucaacagcuuucauaugguaauuccacucugaggcagauauccuauagguaaaccacccgauuaccuggaaaagccuucacuaccccaaaagucacacuccagauagucaaaguuuauuguuacuagcauacaggagaaacagagcuuuaccacuuaaauggaaauuaagaccaaucacugcucaguucuuuaaagagggaacugauuugucuuagaacagggaacaagaaacuuucuguacgggaccagauaguaaacauuuuuggcuuugugggccauauagucucugucaauacucaauuucugcuguuguggauggacaaaagccacaaacaauaugugaugaaugagcauggcuguguuccaguaaaacuuuauuuacaaaaacaggaguugucaaaacccgcagugugcaacacaaagaaugagcccuaauguaaacuauggacuuuaggugauaaugaugggucaaugcugguucaucaauuauaacaaaugucccacacuggugcaggauacugauggcggcagagacuguguuuggggguggggagggguucugugggcacucuguacuuccgcucaauuuugcuguaaaccuaaaacugccucucaguaucugugggggauugguuccuggacacccuuggauaucaaaauccauggauacucgagucucuuacauaaaauggccuagaguauuugcauaugaccuaugcacauccuuccauauacuuuaaauuaucucuagacuaguuacaaggccuacacaucauuucauuuacauggauucaacauaguguucaaggugaggcaaauucaaauuuugcuuuuuggaaauuuguggaauuuuuuuucugaauauuuucuaucugagguugauugaauccauggauguggaacccacagauauggaggacgaacuguacucuuuuuaaaaaacagucuauuaauuagaaaaaaaaaaacagguggccagcccucaggcuauagguugacauucuuagaccaggguauuccuaaaauaaaaggauuugcccaacucuaaaaucagauuaccauggaaguaaaauaauggaaugccuauacauauacaggaaaagaaaaagcagugauauuuucagauuccauccaguaacaaaaccaagguuucccaaaccuugccaacagucugaucaauuuuccaaaagcuuaaugggaggaaaccacccaaccaucaauagaucaguaacugcagcugucuccacuuucaaaagcacacaaaacauaagugcuacaaagacagugaggccaaagccaugacuuuggugccugagagcugccccagagccagauaaaccacgccauguuaaaaugcagccuuaucagaucuuaaaggcccaaaaagcccucacuuccucccuucuuuccuuccuuuccuccuuccgucuucuaccuuuccucccuucuuuccuucccuuucuacuucccucccuccuucuuuuuuugagacauggucuugcucuauuguccaggcuggagugcagugacgcgaucccagcucacugcagccucaacuucccaggcucaagcgauccucccaucucagcuucccauguagccgggaccacaggggugcaccacuaugccuggauaauuuuuuuauuuuuuuguagagacaggggucucacuguguugcccgagcuggucucaaacuccuggacucaagcgauccuccugccucagccucucaaaaugcugggauuacaggcauuagccacagugccuggaccaauucuuucuuuaaauuuaaaaacuggucaagaugcaauaagccaaguuagauaucuuuacccucaacuaaauuuuucucuuccccuuuaauucugaauaguugaucccuuucuccaaacagguuggucuaauucuuggugacaccuuguagcagaaaaacuacugcuuacagggaaaaaaaaaaaaaaucugucauuuacauauguaaagguacaaaauaaacacacucggaagcagaaugagauuguuuuucccuuuuccuaacauaauuuuuuuaaaaaccuuuccauuuucuccaagaacgcaaucacuguuguccccaguggugaucaggcuucaaggagcaaaaugacuuaaaaagccaagacuuugcgaaagggagucauuuggaaccaaaguaucuccaaaguaucuuaaaauauguucuaaaggaaaagaagauggcugggcccuuaaacuuuaagaauaguaagaaugcggaaacuggccgcuaccuucuaagagcuaaaggcucugagguucacagagccggugugauuaugacagaaaucaaaauauuuaguuuugugaaaagacggcagggcuaucagcaaucugcuuucuggugguuuugagagaugcuauauuuacacauggggacacuauggaaguuuaaacuuggcugggcacaguggcucacgucuguaaucccaacacuuugggaggcagaggcggguggaucaccugaagucaggaguucgagaccagccuggccaagacggugaaaccccgucucugcuaaaaauacaaaaauuagccgggcgugguggcgcaugccuguagucccagguacucgggaggcugaggcacgagaacugcuugaaccugggaggcggagguugcagugagccgagauggugccacugcacucuagccugggcgacagagugagacuccgucucaaaauaaauaaauaaauaaauaaauaaauaaauaaauaaauaaauaaaauaaacuuauauaacugacuaaaugaaaguggcauaauguuuaauaaccucgauauggagucaggcaugccaucaguaauugccauuuauggagcaccugcucugugcagagcaagcugagcugaggaagcuguaagagguuacaaaaaagaggugagcgccugcccuuuggaaagagacaauugaggauaaaaucuaagaaaaggaggcaggagcaaaaucucuuuaaugcaaguguggcugugcaaaaguaacuggaaaaucaaacaaaugggacgucagucugcagggaggggagaaaagugguuaauaugggaaccagaagccgacagggcgagacugaaagaugaaaagcaaguccaaaagaaaaugugaaucauuuccuaccaacucauucaacauucagaagguucuaucuuuaugccauaauaguccaaguucuccuuuucuuauauaauuaagagaauuuuuaauuuaucacaacugcuuaagggaaagagaacucaaauuugugcaaauauaacaaggagccaccauaacauuaacugccagucaaaaacaauacauugauccaaaaauccagagagguuuauagaaaaaaauauggaacaagacaugugaaaguuauauuucaggaaauaaauucaggccaggcacggugacucaugccuguaaucccagcacuuugggaggcagaggcggguagaucaccuaaggucaggaguucgagaccagccugggcaauagggcaaaaccccgucucuacuaaaaauacaaaaauaagccaggcgugguggcagacaccuguaaucccagcuacucgggaggcugaggcaggagaaucaccugaacccgggaggcagagguugcagugagccaagaccaagccguugcacucuggccuaggugacagagugagacucugucucaaauaaguaaauaaauaaauaaauaaauucaacaaaugugugguugguuuuuuuguuuuuguuuguuuguuuguuuuguuuuuugagacggagucucacucuagccaggcuggagugcaguggcgcaaucuuggcccacugcaaccuccaccucccagguucaaguaauucuccugccucagccucccgaguaccugggacuauaggcgcccaccaccaugccuggcuaauuuuuguauuuuuaguagagacgggguuucaccacguuggccaggauggucucaaucucuugaccucgugauccacccaccucggccucccaaagugcugggauuacaggcgugagccacugcacccagccaauaaauguuuauucugaacauuaaaaugugauguuuucauugcucccaauaaggaauuaacauauauuaucugaagccacacuguccaauauaaauaugugagccaggccaggggcuguggcucaugccuguaauccuagcacuuugggaggcugaggugggcagaucaccugaggucgagaguucaagaccagccugaccaacauggagaaaccccaucucuacuaaaaauacaaaauuagcugggcauguaggcgcaugccuguaaucccagcuacuugggaggcugaggcaggagaaucacuugaaccugggaggcggagguugcggugagcccagaucgcaccauugcacuccagccugggcaacaugagcaaaaacuccgucucacaaaaaaaaaaaaaaaaaaaaaaaaaagaaagaaagaaauauguaagccauauauauaauuuaaaauuuccuaguagccacauuaacauaaaaaagaaauaaaguuuuugauaauauuccauuuaacccaacauaucuaaaauauuaccauuucaacaugcaaucaauauaagauguacugauauuuuacuauuuuuauauuaagucuuugaaauccaguguguauuuuauacugaaagcacaucucaauucagaggcuaaauuucuaucagaaauaauugaccuauaaagagauuuccuaaaauuuacaggugauaaaguggauuccauauccaaguuauucuacacagauguaaaaauuaacugcaucaaguauccauuuuaaauuuaaauuaagucaauucaguuuuucggccacacuagccacauuucaagugcucaaaggucuccuggcugacaaguggugacccauaugggacaaaggucuauagaaauaaaguaauaacuauaaagauaaccacuagaaccaaaaauucaagccuaguuauuuauuaaaauaaauauggcaaaacaaagcaaauauauaacauaggaaaacugagguauuaaaaacagaaagcaacagaaaauuacaaaugcuuaucauuacagaugacagaucuaucauaccaguaaguauaaauagguuaaacuuaccacaugaaaaagacugauucacaaagcaaaacccaacuuuacacuacauuuagagacauauuuagagcgaaguaauucagaaaaacugaaaauaaaaggauggcaaugcuaucccaggaaauguaaacaagaaaauagggaacuagaucucaaugucaaauaaggacgaauccaggccaaaaagccuucaacuaguaaaagggcagcacucuaaugcuaauggguauaucucacaaugaggaugugaguuaauaagcaucaaacauaacacugauagucauaaagcaaaaacaauaggagcuauacggagaaagagaaucauuauuaggagacuuuaacuucucuuguguuugauccaugacaaaucagguggauaaaaaaaguaaaguuacacaaaaccuaaauaacauaauauugcagagcugacauaucacacucugcaaccugagaagagaguauaaccuucuuuucgcugcccaaggaacauucacagaaaacaaccauauaaugagcuucaaaguuaacaucaauaaauuagagaauaauucagacaacauucuguaaucacagugcaacaaaacuagacauaaauaaaauuaaaaugcagaaugcaccuucacuggaaauuuuuaacuccuccaaacaacucuucauucauaggaaaauaaaaaccugaagacacagaagagcuaagagaaaaaagaccaaauacacacaucagcugcuaaagcagugcucagaggaauaacuaaccuuaaacauugaaauaaacaagacaaagaagaaagcauuuaauuuuuuuuauuauacuuuaaguucugggguacaugugcagaacgugcagguuuguuacauagguauacacgugccauggugguuugcugcacccaucaacuugucaucuacauuagguauuucuccuaaugcuaucucuccccuagcccccccaccucccgacaggcccuggugugugauguuccccuugccguguccauguguucucauuguucaacucccacuuaugagugagaacagaaagcaccuaauuuuuaaaagaacaaaauaaaccugagaccagaaggaauuauuaaagucaaaucagacaauaaacuagauaacaaaagucauaaaacuaauaaauccaacccaauaaaucaucaacuaaccuacucaagaagaaggggggggacaaaugucacagggaaaauuaagacuguucagugacaacuaucucagcuauccaaacugacuuaaaaaccucaaugaguaggauaauuuucuuuuuuucuuuucuucuuuuuuuuuuuuuuuuuuuuuuugagaugccguuucacucuugucacccaggcuggaguacaagggcaugaucuuggcucacugcaaccuccgccuccuggguucaagcaauucuccuaccucagccuccccaguagcugggauuacaggcacccaccacuaugcccagcuaauguuuguauuuuuaguagagacgagguuucaccauguuggccaggcuggucucaaacucccaaccccaugugauccaccugccuuggccucccaaagugcugggauuacaggcaugagccaccgcgccuagccaaguaggauaauuuucaagaaaaauauaucaaaauggacucuagaagagacagaaaaucuacagagaucaauaacacagaauagagaaagcuaucagagagcaaaacuccccaaaacauacaggcuuaaacacuuucauaugaaguucuaccaaaucuuuaagaaccagauaauucaaaagauaaauuagucuuagcauaggaaaagaaaaaaauuuaucuuuuugaaaacaaaaauuuaucuuuuugaaacaagcaugacuuugaucagaaaaucuaacagaccacacauacaacaucuacagacaaauagcaaauggauaucaauaaaacaaacccaggaguucaucauucuauucucucuacuucuguaaauguuuaaggucuagagaucuaaugcacaacaugaagaauauauaauagauaauaaaauuguacuguauaugggauucaugcuaaaugaguagauuuuagcugaccuugccacaaaaauaaaaaaggguaacuaugugagaugauagauauguuaauuucacuguaguaaccuuuuaacuauauguaucccauaacaucauguuguauaccuuaauuauacacaauaaaauuuauauauguauuuaccuauacauguacaucccccaggcuggagugcaguggcagaaacacagcucacugcagcuucaaucugggcucaagccauccuccugucucagccuccugaguagcuaagaccccaggugugcgauaccaccacuccuggcuaaucuuauuuauuuauuauuauuauuuuuuuuagagacaggaucucacuauguugcccagggcuggccucaaacuccuggucucaagccauccucugucuuggccucucaaagcacuggaauuacaggcacccaccuaaguuuuuuuuuuuaauuuccacaauaaaaaacuaaaauaaagacaucuuuacucaaggagaaaaaaauucuaucuagauauaucauuuuuuuuuuaccuaucaaaaguuugacaacaauguggugaaggcauaggaaaacagguacucucagaaacuucuagcgagggggaaaacaaacaaccuuuauggaaagcaauuugacaauguucgccaaaauuacaaaugcacauaccugcugauguagcaaucucacguuuaggaaucuguccuacagauacacgcggacaugcaugaaaugacaaugcauauaauaauucacuggagggcagguugccacagcaaagucuagaaacaaccuauuaauuguagccaucaauagggaaaguugcuaauaaauucugguacauucauauaaccaaauucucagaagccauaaaaaagaaaaacaaaguucugcagguacagauauacaaaaaucugucucuaagguauuaagcucaaaaaacaaggaacagacaaagcuauaaacugccauuuaugcgaaaaaaggggaggccagugggcacaagugggaagcaggcuuuucuguguccuuuugaacccucugaauuuggaaccaugugacuguaaucuuaggcccaaaagaaaaaucucauuuuaaaaaaugccacccuuuggaauguacuauugccauaauaaauuaaaaauccauuuagaacacuuguuauucuugcuauauuugcuaacuguguggcaggcuauauuucaagucaagauggaguucaagaaacuuucauuauuuuaaaaagcauagagaaaaauacugcacauagaugaaagggggccagcagaucagacagaagaucaucugauuaauggugcuuaacccuggauaugcuuuagaaugacagggggaucuccuaaaaauaccagugcucugcucuccacccccagcacccccagaccauuuacaacaaaaauucagaguaugaggcccuggccugaaaaccacucaaguaaacacuuccaaacagugauucaacagaaguccaggggacauuuugcucccccaggggacauuuggcaaugacuggagacauguuugguugucacgacuuggagugggaggugcucauggcaucuaguggguagaggccagggauguagcucaacuucccacagugcacaagacagcuccuaccaaaauuaccuggccugaaauggcaagagugcugaggcucaggaaccccugcuuuaaaauaaaagcacagcuucugaaguaacaacaaguuuuagccuccacuuuugaacauagcaaauaaucuccuuauuuacugaugugcaguacauccacauaagaaagccuauuuaucaagguuguaacaaauuguguauauccuguguaucuccuuucucuggucccugucuaguuacucuagucaaaauguacgucccauuuguaaaguacccauggagaaaggcaucaaguucauaaacuagcagccugugggccaacuugauccauccaucuauuuuguuuaugccaaaguucucuugaaauauacugaauuggugccaaucagcugccccuuuggagcuagcuauauaccaggaauuuaucacgguccucaacucguuggcuucauucacuuauccacugcccacuaccuggugcuuuaagugccugaguuggcccucuccugcaguuuucucuaaucauacaggggcaugaagccucuucacuccuccucucuccucaccuuaaaaauaucccacacccauucugaauucuccaacucccacaucaauugccaaaauagaacugcuaucaagagacagaacuaagagaaaaguagaaguagagauggccuuuuugcaacaacucccgucuuuuaguuguccugucauuaaagauaggcugauuagcaccugauucaucucuggguguuacaaacuagccuugucacuucuagcaaauuccacuacaacuauaucuagcacuucugugcgcuuccuuauaaggaaaaccuuaaauuauuaugcuucucucaugaccuuagugaaucccuccaccccucccaaaauaggucagaagacuuuuauaggaaauaucuaucaaaagauuugguaguuuucuuuuagaaaguucaugccucuuccuuugaaaucacaaucguauaguggugagcugugcuuuuaaagaucgccugauacaaucuacucauuuuauuaaugaggaaaaugaaccccaagugagguuuggucacuuagucaaggccacauucugagcuaguggcagagccagaauuagaacauuuguuuccagauacuggccucacagguuuuccaugauaacacuauccuccacugugguuuuccuacucacauaacauccuuaccaaaauaccuauuaacacggguagacacuagcugcuauggaaaucaacuaaccaaaauuuuggcuggcuauuggagcuaucacuuaaacuuugaggguggaaagaacugggaguuucuggauuccuuuuguuccuuuuauugugaauuauccuguuucaguuuacacuaaugaaaggcugauaccuucagaaucuucccuaaaccauaaagauggaaaacuugccuauauuuauagcaauagcaacauuuucuaaacucuaaagucagaaacugccucaaaccucuacaauucucgagauaguaaguaaaacuaccaauagcuuuugggagugaaguuugaagaugcagaaaucaacgugucauugaacuuugacuuucaucaucauucucuggcaaauuggcuucuaaaauuuuaauuuggucucaacuuuaaccuauuccucucuuccuauccuagcuuuuaaaaaaaaaaaaguauggacaucacuuuuugcauaucaggucuuccucaaauguucuaccuacucugcacuuuaguuuuuaugcccaacugacacuaucacugacacccuugacauuuacauaaaauucauuaaaugaacagacacccuacgauuuccccuggagagcuuagaacaucuuugcugcuggauuugauuuuccuccagggaugcugaguuccauucugauaccucaaugcaugcguuuuacuuuuagguguuucacaaccagcuccuucguuuucuggggaaacaugauucaguuaacagaaggugguggaaucuauucccaucucagcuaggccugaggcaggcugggaacccgaaucuucuuuggucccaccucaauccgugaaagccgcccaccagcccaccggacagggagaaugugggugggacaccaauggagaagagaaacgaaaggugcuggcacuaaagccagaguuguauuagacccugcucugaugcuaggaucccagacguccgcucuucccaagcaucuaaggcgucugcaggccaggccucuaacugauuuaacauaaccugaugaagacaacaguucgaguccugccacuccagccacacagcaacaccuuagagcagaaaaggaacaaaaugccauugcauaauuuauucaaccucaagguauuucuaaacaguucuuacccaaccaaaaaaaaaaaauucuaaaaauaaaaacauuaaaaagccacccacaucucguucugaaguuuuaagggcugugagguuugugucaagcagauuugaagcuaacgaccgcagguuuggggagucucgccugcgaugaggguccugcaaugagacgccguuucugugucuccggguaagucccaggcugggugcgagggggccaggcccugccccuccgcgccccgaaauccgagccccaggagagccccccggauauucccuagccccgccugcgguucccacagacuuuaccccgaagcugcggagauccgggguggcagcccgaauggcggcggccccgggcccauggggacccuuggccccguacucaccgaaguccaggaauuguuugauggagagcggcgacggcgaaaagcgcgaguagcgcucgaucugcuugggcaccggcugcuucagcagccaccggaacagccgcauccucgcccgggcggcgcacagacccgccuagacgcccggguggccgcaagggcuggcgcagccaagccgcacggauagggcacguuugcgaagcgcgcaccccggccucgaucucggccucggcgccgccggugcagccgccgcagcagcagcagcagcuccaggacagcggcgggccgcccgcggcuucccuaggcuccgccucgcugggcggagucgguugcugcacg

SEQ ID NO: 19073 - RNA, 74623 nt, Homo sapiens
cgugcagcaaccgacuccgcccagcgaggcggagccuagggaagccgcgggcggcccgccgcuguccuggagcugcugcugcugcugcggcggcugcaccggcggcgccgaggccgagaucgaggccggggugcgcgcuucgcaaacgugcccuauccgugcggcuuggcugcgccagcccuugcggccacccgggcgucuaggcgggucugugcgccgcccgggcgaggaugcggcuguuccgguggcugcugaagcagccggugcccaagcagaucgagcgcuacucgcgcuuuucgccgucgccgcucuccaucaaacaauuccuggacuucggugaguacggggccaaggguccccaugggcccggggccgccgccauucgggcugccaccccggaucuccgcagcuucgggguaaagucugugggaaccgcaggcggggcuagggaauauccggggggcucuccuggggcucggauuucggggcgcggaggggcagggccuggcccccucgcacccagccugggacuuacccggagacacagaaacggcgucucauugcaggacccucaucgcaggcgagacuccccaaaccugcggucguuagcuucaaaucugcuugacacaaaccucacagcccuuaaaacuucagaacgagauguggguggcuuuuuaauguuuuuauuuuuagaauuuuuuuuuuuugguuggguaagaacuguuuagaaauaccuugagguugaauaaauuaugcaauggcauuuuguuccuuuucugcucuaagguguugcuguguggcuggaguggcaggacucgaacuguugucuucaucagguuauguuaaaucaguuagaggccuggccugcagacgccuuagaugcuugggaagagcggacgucugggauccuagcaucagagcagggucuaauacaacucuggcuuuagugccagcaccuuucguuucucuucuccauuggugucccacccacauucucccuguccggugggcuggugggcggcuuucacggauugaggugggaccaaagaagauucggguucccagccugccucaggccuagcugagaugggaauagauuccaccaccuucuguuaacugaaucauguuuccccagaaaacgaaggagcugguugugaaacaccuaaaaguaaaacgcaugcauugagguaucagaauggaacucagcaucccuggaggaaaaucaaauccagcagcaaagauguucuaagcucuccaggggaaaucguagggugucuguucauuuaaugaauuuuauguaaaugucaagggugucagugauagugucaguugggcauaaaaacuaaagugcagaguagguagaacauuugaggaagaccugauaugcaaaaagugauguccauacuuuuuuuuuuuuaaaagcuaggauaggaagagaggaauagguuaaaguugagaccaaauuaaaauuuuagaagccaauuugccagagaaugaugaugaaagucaaaguucaaugacacguugauuucugcaucuucaaacuucacucccaaaagcuauugguaguuuuacuuacuaucucgagaauuguagagguuugaggcaguuucugacuuuagaguuuagaaaauguugcuauugcuauaaauauaggcaaguuuuccaucuuuaugguuuagggaagauucugaagguaucagccuuucauuaguguaaacugaaacaggauaauucacaauaaaaggaacaaaaggaauccagaaacucccaguucuuuccacccucaaaguuuaagugauagcuccaauagccagccaaaauuuugguuaguugauuuccauagcagcuagugucuacccguguuaauagguauuuugguaaggauguuaugugaguaggaaaaccacaguggaggauaguguuaucauggaaaaccugugaggccaguaucuggaaacaaauguucuaauucuggcucugccacuagcucagaauguggccuugacuaagugaccaaaccucacuugggguucauuuuccucauuaauaaaaugaguagauuguaucaggcgaucuuuaaaagcacagcucaccacuauacgauugugauuucaaaggaagaggcaugaacuuucuaaaagaaaacuaccaaaucuuuugauagauauuuccuauaaaagucuucugaccuauuuugggagggguggagggauucacuaaggucaugagagaagcauaauaauuuaagguuuuccuuauaaggaagcgcacagaagugcuagauauaguuguaguggaauuugcuagaagugacaaggcuaguuuguaacacccagagaugaaucaggugcuaaucagccuaucuuuaaugacaggacaacuaaaagacgggaguuguugcaaaaaggccaucucuacuucuacuuuucucuuaguucugucucuugauagcaguucuauuuuggcaauugaugugggaguuggagaauucagaaugggugugggauauuuuuaaggugaggagagaggaggagugaagaggcuucaugccccuguaugauuagagaaaacugcaggagagggccaacucaggcacuuaaagcaccagguagugggcaguggauaagugaaugaagccaacgaguugaggaccgugauaaauuccugguauauagcuagcuccaaaggggcagcugauuggcaccaauucaguauauuucaagagaacuuuggcauaaacaaaauagauggauggaucaaguuggcccacaggcugcuaguuuaugaacuugaugccuuucuccauggguacuuuacaaaugggacguacauuuugacuagaguaacuagacagggaccagagaaaggagauacacaggauauacacaauuuguuacaaccuugauaaauaggcuuucuuauguggauguacugcacaucaguaaauaaggagauuauuugcuauguucaaaaguggaggcuaaaacuuguuguuacuucagaagcugugcuuuuauuuuaaagcagggguuccugagccucagcacucuugccauuucaggccagguaauuuugguaggagcugucuugugcacugugggaaguugagcuacaucccuggccucuacccacuagaugccaugagcaccucccacuccaagucgugacaaccaaacaugucuccagucauugccaaauguccccugggggagcaaaauguccccuggacuucuguugaaucacuguuuggaaguguuuacuugagugguuuucaggccagggccucauacucugaauuuuuguuguaaauggucugggggugcuggggguggagagcagagcacugguauuuuuaggagaucccccugucauucuaaagcauauccaggguuaagcaccauuaaucagaugaucuucugucugaucugcuggcccccuuucaucuaugugcaguauuuuucucuaugcuuuuuaaaauaaugaaaguuucuugaacuccaucuugacuugaaauauagccugccacacaguuagcaaauauagcaagaauaacaaguguucuaaauggauuuuuaauuuauuauggcaauaguacauuccaaaggguggcauuuuuuaaaaugagauuuuucuuuugggccuaagauuacagucacaugguuccaaauucagaggguucaaaaggacacagaaaagccugcuucccacuugugcccacuggccuccccuuuuuucgcauaaauggcaguuuauagcuuugucuguuccuuguuuuuugagcuuaauaccuuagagacagauuuuuguauaucuguaccugcagaacuuuguuuuucuuuuuuauggcuucugagaauuugguuauaugaauguaccagaauuuauuagcaacuuucccuauugauggcuacaauuaauagguuguuucuagacuuugcuguggcaaccugcccuccagugaauuauuauaugcauugucauuucaugcauguccgcguguaucuguaggacagauuccuaaacgugagauugcuacaucagcagguaugugcauuuguaauuuuggcgaacauugucaaauugcuuuccauaaagguuguuuguuuucccccucgcuagaaguuucugagaguaccuguuuuccuaugccuucaccacauuguugucaaacuuuugauagguaaaaaaaaaaugauauaucuagauagaauuuuuuucuccuugaguaaagaugucuuuauuuuaguuuuuuauuguggaaauuaaaaaaaaaaacuuaggugggugccuguaauuccagugcuuugagaggccaagacagaggauggcuugagaccaggaguuugaggccagcccugggcaacauagugagauccugucucuaaaaaaaauaauaauaauaaauaaauaagauuagccaggaguggugguaucgcacaccuggggucuuagcuacucaggaggcugagacaggaggauggcuugagcccagauugaagcugcagugagcuguguuucugccacugcacuccagccugggggauguacauguauagguaaauacauauauaaauuuuauuguguauaauuaagguauacaacaugauguuaugggauacauauaguuaaaagguuacuacagugaaauuaacauaucuaucaucucacauaguuacccuuuuuuauuuuuguggcaaggucagcuaaaaucuacucauuuagcaugaaucccauauacaguacaauuuuauuaucuauuauauauucuucauguugugcauuagaucucuagaccuuaaacauuuacagaaguagagagaauagaaugaugaacuccuggguuuguuuuauugauauccauuugcuauuugucuguagauguuguauguguggucuguuagauuuucugaucaaagucaugcuuguuucaaaaagauaaauuuuuguuuucaaaaagauaaauuuuuuucuuuuccuaugcuaagacuaauuuaucuuuugaauuaucugguucuuaaagauuugguagaacuucauaugaaaguguuuaagccuguauguuuuggggaguuuugcucucugauagcuuucucuauucuguguuauugaucucuguagauuuucugucucuucuagaguccauuuugauauauuuuucuugaaaauuauccuacuuggcuaggcgcgguggcucaugccuguaaucccagcacuuugggaggccaaggcagguggaucacaugggguugggaguuugagaccagccuggccaacauggugaaaccucgucucuacuaaaaauacaaacauuagcugggcauaguggugggugccuguaaucccagcuacuggggaggcugagguaggagaauugcuugaacccaggaggcggagguugcagugagccaagaucaugcccuuguacuccagccugggugacaagagugaaacggcaucucaaaaaaaaaaaaaaaaaaaaaaagaagaaaagaaaaaaagaaaauuauccuacucauugagguuuuuaagucaguuuggauagcugagauaguugucacugaacagucuuaauuuucccugugacauuuguccccccccuucuucuugaguagguuaguugaugauuuauuggguuggauuuauuaguuuuaugacuuuuguuaucuaguuuauugucugauuugacuuuaauaauuccuucuggucucagguuuauuuuguucuuuuaaaaauuaggugcuuucuguucucacucauaagugggaguugaacaaugagaacacauggacacggcaaggggaacaucacacaccagggccugucgggaggugggggggcuaggggagagauagcauuaggagaaauaccuaauguagaugacaaguugaugggugcagcaaaccaccauggcacguguauaccuauguaacaaaccugcacguucugcacauguaccccagaacuuaaaguauaauaaaaaaaauuaaaugcuuucuucuuugucuuguuuauuucaauguuuaagguuaguuauuccucugagcacugcuuuagcagcugauguguguauuuggucuuuuuucucuuagcucuucugugucuucagguuuuuauuuuccuaugaaugaagaguuguuuggaggaguuaaaaauuuccagugaaggugcauucugcauuuuaauuuuauuuaugucuaguuuuguugcacugugauuacagaauguugucugaauuauucucuaauuuauugauguuaacuuugaagcucauuauaugguuguuuucugugaauguuccuugggcagcgaaaagaagguuauacucucuucucagguugcagagugugauaugucagcucugcaauauuauguuauuuagguuuuguguaacuuuacuuuuuuuauccaccugauuugucauggaucaaacacaagagaaguuaaagucuccuaauaaugauucucuuucuccguauagcuccuauuguuuuugcuuuaugacuaucaguguuauguuugaugcuuauuaacucacauccucauugugagauauacccauuagcauuagagugcugcccuuuuacuaguugaaggcuuuuuggccuggauucguccuuauuugacauugagaucuaguucccuauuuucuuguuuacauuuccugggauagcauugccauccuuuuauuuucaguuuuucugaauuacuucgcucuaaauaugucucuaaauguaguguaaaguuggguuuugcuuugugaaucagucuuuuucaugugguaaguuuaaccuauuuauacuuacugguaugauagaucugucaucuguaaugauaagcauuuguaauuuucuguugcuuucuguuuuuaauaccucaguuuuccuauguuauauauuugcuuuguuuugccauauuuauuuuaauaaauaacuaggcuugaauuuuugguucuagugguuaucuuuauaguuauuacuuuauuucuauagaccuuugucccauaugggucaccacuugucagccaggagaccuuugagcacuugaaauguggcuaguguggccgaaaaacugaauugacuuaauuuaaauuuaaaauggauacuugaugcaguuaauuuuuacaucuguguagaauaacuuggauauggaauccacuuuaucaccuguaaauuuuaggaaaucucuuuauaggucaauuauuucugauagaaauuuagccucugaauugagaugugcuuucaguauaaaauacacacuggauuucaaagacuuaauauaaaaauaguaaaauaucaguacaucuuauauugauugcauguugaaaugguaauauuuuagauauguuggguuaaauggaauauuaucaaaaacuuuauuucuuuuuuauguuaauguggcuacuaggaaauuuuaaauuauauauauggcuuacauauuucuuucuuucuuuuuuuuuuuuuuuuuuuuuuuuuugugagacggaguuuuugcucauguugcccaggcuggagugcaauggugcgaucugggcucaccgcaaccuccgccucccagguucaagugauucuccugccucagccucccaaguagcugggauuacaggcaugcgccuacaugcccagcuaauuuuguauuuuuaguagagaugggguuucuccauguuggucaggcuggucuugaacucucgaccucaggugaucugcccaccucagccucccaaagugcuaggauuacaggcaugagccacagccccuggccuggcucacauauuuauauuggacaguguggcuucagauaauauauguuaauuccuuauugggagcaaugaaaacaucacauuuuaauguucagaauaaacauuuauuggcugggugcaguggcucacgccuguaaucccagcacuuugggaggccgagguggguggaucacgaggucaagagauugagaccauccuggccaacguggugaaaccccgucucuacuaaaaauacaaaaauuagccaggcaugguggugggcgccuauagucccagguacucgggaggcugaggcaggagaauuacuugaaccugggagguggagguugcagugggccaagauugcgccacugcacuccagccuggcuagagugagacuccgucucaaaaaacaaaacaaacaaacaaacaaaaacaaaaaaaccaaccacacauuuguugaauuuauuuauuuauuuauuuacuuauuugagacagagucucacucugucaccuaggccagagugcaacggcuuggucuuggcucacugcaaccucugccucccggguucaggugauucuccugccucagccucccgaguagcugggauuacaggugucugccaccacgccuggcuuauuuuuguauuuuuaguagagacgggguuuugcccuauugcccaggcuggucucgaacuccugaccuuaggugaucuacccgccucugccucccaaagugcugggauuacaggcaugagucaccgugccuggccugaauuuauuuccugaaauauaacuuucacaugucuuguuccauauuuuuuucuauaaaccucucuggauuuuuggaucaauguauuguuuuugacuggcaguuaauguuaugguggcuccuuguuauauuugcacaaauuugaguucucuuucccuuaagcaguugugauaaauuaaaaauucucuuaauuauauaagaaaaggagaacuuggacuauuauggcauaaagauagaaccuucugaauguugaaugaguugguaggaaaugauucacauuuucuuuuggacuugcuuuucaucuuucagucucgcccugucggcuucugguucccauauuaaccacuuuucuccccucccugcagacugacgucccauuuguuugauuuuccaguuacuuuugcacagccacacuugcauuaaagagauuuugcuccugccuccuuuucuuagauuuuauccucaauugucucuuuccaaagggcaggcgcucaccucuuuuuuguaaccucuuacagcuuccucagcucagcuugcucugcacagagcaggugcuccauaaauggcaauuacugauggcaugccugacuccauaucgagguuauuaaacauuaugccacuuucauuuagucaguuauauaaguuuauuuuauuuauuuauuuauuuauuuauuuauuuauuuauuuauuuauuuugagacggagucucacucugucgcccaggcuagagugcaguggcaccaucucggcucacugcaaccuccgccucccagguucaagcaguucucgugccucagccucccgaguaccugggacuacaggcaugcgccaccacgcccggcuaauuuuuguauuuuuagcagagacgggguuucaccgucuuggccaggcuggucucgaacuccugacuucaggugauccacccgccucugccucccaaaguguugggauuacagacgugagccacugugcccagccaaguuuaaacuuccauaguguccccauguguaaauauagcaucucucaaaaccaccagaaagcagauugcugauagcccugccgucuuuucacaaaacuaaauauuuugauuucugucauaaucacaccggcucugugaaccucagagccuuuagcucuuagaagguagcggccaguuuccgcauucuuacuauucuuaaaguuuaagggcccagccaucuucuuuuccuuuagaacauauuuuaagauacuuuggagauacuuugguuccaaaugacucccuuucgcaaagucuuggcuuuuuaagucauuuugcuccuugaagccugaucaccacuggggacaacagugauugcguucuuggagaaaauggaaagguuuuuaaaaaaauuauguuaggaaaagggaaaaacaaucucauucugcuuccgaguguguuuauuuuguaccuuuacauauguaaaugacagauuuuuuuuuuuuuucccuguaagcaguaguuuuucugcuacaaggugucaccaagaauuagaccaaccuguuuggagaaagggaucaacuauucagaauuaaaggggaagagaaaaauuuaguugaggguaaagauaucuaacuuggcuuauugcaucuugaccaguuuuuaaauuuaaagaaagaauugguccaggcacuguggcuaaugccuguaaucccagcauuuugagaggcugaggcaggaggaucgcuugaguccaggaguuugagaccagcucgggcaacacagugagaccccugucucuacaaaaaaauaaaaaaauuauccaggcauaguggugcaccccuguggucccggcuacaugggaagcugagaugggaggaucgcuugagccugggaaguugaggcugcagugagcugggaucgcgucacugcacuccagccuggacaauagagcaagaccaugucucaaaaaaagaaggagggagggaaguagaaagggaaggaaagaagggaggaaagguagaagacggaaggaggaaaggaaggaaagaagggaggaagugagggcuuuuugggccuuuaagaucugauaaggcugcauuuuaacauggcgugguuuaucuggcucuggggcagcucucaggcaccaaagucauggcuuuggccucacugucuuuguagcacuuauguuuugugugcuuuugaaaguggagacagcugcaguuacugaucuauugaugguugggugguuuccucccauuaagcuuuuggaaaauugaucagacuguuggcaagguuugggaaaccuugguuuuguuacuggauggaaucugaaaauaucacugcuuuuucuuuuccuguauauguauaggcauuccauuauuuuacuuccaugguaaucugauuuuagaguugggcaaauccuuuuauuuuaggaauacccuggucuaagaaugucaaccuauagccugagggcuggccaccuguuuuuuuuuuucuaauuaauagacuguuuuuuaaaaagaguacaguucguccuccauaucuguggguuccacauccauggauucaaucaaccucagauagaaaauauucagaaaaaaaauuccacaaauuuccaaaaagcaaaauuugaauuugccucaccuugaacacuauguugaauccauguaaaugaaaugauguguaggccuuguaacuagucuagagauaauuuaaaguauauggaaggaugugcauaggucauaugcaaauacucuaggccauuuuauguaagagacucgaguauccauggauuuugauauccaaggguguccaggaaccaaucccccacagauacugagaggcaguuuuagguuuacagcaaaauugagcggaaguacagagugcccacagaaccccuccccacccccaaacacagucucugccgccaucaguauccugcaccagugugggacauuuguuauaauugaugaaccagcauugacccaucauuaucaccuaaaguccauaguuuacauuagggcucauucuuuguguugcacacugcggguuuugacaacuccuguuuuuguaaauaaaguuuuacuggaacacagccaugcucauucaucacauauuguuuguggcuuuuguccauccacaacagcagaaauugaguauugacagagacuauauggcccacaaagccaaaaauguuuacuaucuggucccguacagaaaguuucuuguucccuguucuaagacaaaucaguucccucuuuaaagaacugagcagugauuggucuuaauuuccauuuaagugguaaagcucuguuucuccuguaugcuaguaacaauaaacuuugacuaucuggagugugacuuuugggguagugaaggcuuuuccagguaaucgggugguuuaccuauaggauaucugccucagaguggaauuaccauaugaaagcuguugacaguuuauagguuuaauuuauccagggcugucagcaaaguuuaucuguaucaguuucuccguagcccugccaaaaugagguuuuaugauuuuaaucgcaucauagguaacauaggaaugaaaagugcuuuuuccucugcuuggguuuuuugucugcuuuuuguucuguguaaagugccauuggccauuuuguaaccagaaucugaaguuuuuaucauuugcauaaauuccuguguauauuuggcauaguaagcucuugugcuguguaaauaucguuuccuuuggcaaaguaauuaucaaaguauaaaacugaagacauuuggaaagaauugcuauauuaccuguaauauggguaauucaucuguuuuuuugugauagcccuuccugcuuuugcccauauauuuacauguguuaacacuguauguugguuuccuuuuuaucuagugcacagucugaguuuucauaugcucaguguuaccuauaucauuuacggugcuuuuaucauggucagauuugucaccuauagcagaguuuguaaguaguuauuaaaucucucuggaaucuauugccauuuucugaugagccuuuguagcuaacucauuuuuacccuguucugcugucaaguugcccaacaauuauuaagaccucaaguuuuucucuugaaacuuggcuguuucucuuuuaucuuggccguuucucuuugaucauaugcuaagcucucagaguaguuuguauuuguggauucuagucaacauggcaacuuuucugauuuuaacuaaauaucacauuuuaacuuuguaauuuauguugaaauuuggugagggcaguuccuuauuuauuacuuuacauuuuaaauaauucuugcuuuucuuguguacuaauucuucuugauaaauuagucauugugcaccuugaauagcauaucaucaaaagugugcuaagggaacuguggauggguuacgugguguuuuaggguuuacaucuuugccauguacuuggcauugaaacuggcauugaggccgggcaugguggcucaugccuguaaucucagcacuuugggaggacaaggugggugaaucacuugaggucaggaguucgagaccagccuggccaacauggugaaaccccauaucuacuaaaaaaaaauacaauacaauacaaaaaaucagcugggagugguggcucauaucuguagucccagcuacucaggaggcugaggcaggagaaucguuugaaccugggagguggagguugcagugagccgagaucgugccacugcacuccagccugggugauagaaugagacucugucacaaacaaacaaacaaaggaaaaacuagcacugaaguaucuucaguuagccuauuucgcuuuuauggcaggaaggcuaguuuacgcuauacuugccuucgugggagagcuggguuugauugugacccaugguggauguccuucauaucccucaaggagaaccccauuccuggucauugccucaucuuaacucugagauuaaaccuuuugccauaaugaauggcagaaaaauuguaguaaacuauuacauuugcacaggucagcauuuauauucgcucuaauugaauacuuaggguucuaacucagugguauguuauuucccuaagggucaccuaaacaguugugauuuuauuuucauucuuggacuugaucuaugauucuccuuaaccauuugaguuguaccaguguugcuuucucucuuaccagggcauggaggucaguauauaauagucucacuguugggaagaaauuaucaucucucuaacauuuucccauaccaugaaguuaaauauuuugccauguguugcuggccagaaaacaguagggccuuuugaaauuuguaacuuacauauauuuucccacaauuguuacauuuucauagaccagagaacacucaggcuucuaucugaaccuuuucuuggaucuguccuaguaggguauaauguuuccuuaagcuugcuagcagauauuucuuaauaccagccuguggauuuuguauaacuuugguuaauuucuccuccugauucugcuguuaaauagaaagcaaagugguuauugcuguauuacuguuccugcauuggucaugugaugugcucaugugagcacuuuauuuguaauagacucuucugggaggaagcugcuugucucagggagucuccuguucucuagaaauugcccuucauggccaggguacugcuucuuuuguuagagcuccuuacauauucucuaccguguuaucucuggccuacauacuccuauuccuguuucuuugaccugagcuugacuucagugaagcuauuggagaaggaaauuaaaauggacucuuggcugggcacagugacucacaccuauaaucccaacacuuugggaggccgaggcaggcagaucaccugagaucagcaguuugagaccagucuggcaaacauggugaaaccccaucucuaauaaaauacaaaaaaaaauuagccaggcgguggcacgugccuguaaucccagcaacuuaggaggcugaggcaggagaaucgcuugaaccagggaggcagagguugcagugaaccgaggucgcgccacugcacuccagcuugggcgauggagugagacuccgucucaaaaaaaacaaacaaaaaaaaaaggacuuuauauggcaccugaaaaagauucaauagauucgacuagcacuuacugaguacuuaccaacuaaaacaggauaucaucuaauucucacaacagccaugcccauuuuaccaauuaggaaacugaaguucugagcggguaagaagaugacucacacguauaauagguaguagagccacaugucugcccgccugaucgucuuaccaccucuuuauagcagagaaaguaggugagggauugggcgcagugugugagcaaaacaaacuggaggaaaggaccaucgagugcauugucaccgccucccaagcauuaccacauccugaagcacagccguuuccuucucgaguuuguuuaguuuuuaucuuccccauuuaagaucaucugaaagugaaagggaaaaaaagagcugacacugaaaagucucuuacagaguacaaagauguuugugaucaguuucccaagaggcugaaauaaaacucaaaggugaaaauaaagacaacaguacauggguaaauaaaaaauuggggaugcuuaauagccauugucugggcuugaggaguucuuugauuuguuuacccucauugaauuuucuaugauuagaugcuaguccaugguucucaguccuggcugcucaugagaauugucuggggagcgccugaaaugagugacaccugcucccuacauaaaccaauuaaaucaauugcugcggguaggagucuaggugcuggugcuuuuggguuacccaggcgauuguguaauaauauucuuccagaguuaaaaccacaguguuagagcuggugaaauuuuugcccaagagcuaugaaccacuuuaggggauagagucugugagugagaugccaaagguuaacaccgaagucauucuggaguccaucagcauuaguugaaaguucuggauuuggaaugaaauggaaacuaagaagcauugggaaauugccaaggcauauucauugccuuugaggagcucauagauaaaugagaagcugggacaaauacauaaauuuacguaugcuagucagaaggaugaaucauauaauuuugugguaucuuuuugcugcugucccuaccucgcccuuaaagguuuuugaaauaagggugguuucugggaacagguaagguguuaacccaauuguccuuuauccaaaauguuguuggaggcuuucuggauggagaucacaaagagaagaacaaaauguaaaugugcauacucuuuuucuuuuucuuuuuuuuuuuuuugacaaagucuugcucugucgcccaggcuggaguggaguggcgcgaucuuggcucacugcaagcuccgccuuccggguucacgccauucuccugccucagccuccccaguagcugggacugcaggcgcccgccacugcacgcggcuaauuuuuuguauuuuuaguagagacaggguuucaccguggucucgaucuccugaccucgugaucugcccgccucggccucccaaagugcugggauuacaggcgugagccaccgcgccuggccccuuuuucuugacuuccaccuuuuuuccuuggcuguuuacuccuagcacugcucuccagaguuuucuuagaauuuauauuaguaggcaagguuaguguaugauaaauaacuguauagagagacaaacaaaaaucuuauccucuuagacuaauucagugggaacuugagcuuagagacugaugugguuuggcucugugucuccacccaaaucucauguugaguuaugauuuucaguguuggugguggggccuggugggaggugauuggaucaugggggcagauuucccccuugcuguucucaugauagcgagugaguucucaugagaucugguuguuuaaaaguguguagcacuucucccuuugcucucucucucuccugccaccaugugaagaugugcuugcuuccccuucgccucugccaugauuguaaguuuccugaggccucccuauccauguggacugugagucaauuaaaccucuuuccuucauaaguuacucagucucagguaguucuuucuagccacaugagaacaaacuaauacagagaucaucuguaaucuucccaauuuuacacaugagaaaguagaagccccaaguaaggaagagacuaugccagucaucagcuaguuuuugguauaacaucuuggccaccucuuccaaagggaaccagaaauuauucuuuuuaugaggccaagggaacuuacauuugugugccacucucugcuaaacacaauagugguuagcuguaauucucacagcguccacauuaaguguuuccauuucuuggaugaagagucuaaagcuuagauaguuuaagucucuuaccuaagcaaaguuaggggcaaagccaugguuaaaauucagguagagugagguuuguuuguuuguuuauuuuuuggagacagaguguuccucugucguccaggcuggagugcguggugugaucuuggcucacugcaaccuccaccuccagguucaagugauucuccugccuuagccucccaaguaucugggauaacaggcacccaucaccacgccuggcuaauuuuuuguauuuuuaguagaaaugggguuucaccauguuguccaagcuggucucgaacuccugaccucaaguaaucugcccgccuuggccucucaaagugcugggauuacaagcaagauugagcuuuuaaaccuacgcucuuuucaguuuaacauaguauaccauuguccccagugcaauucuuuauagcaaauauagucucuauuagcaaugcugagguuuugucuaaauuuauucuguuacacaaucaggaaaugguauaaucuaaugcuuaucuaguuuuauuauuucagaacuaucagauugauaccuacuccacuuacuuacaaugaaauaauucuacuucugaaaaccacuacuuguuagucugcauuaucaucucugggaauaugagaagcaguauauacagacuuguacuccagucuuaauuucugaugccuaccagcagugugagccugggcaaaucacuuaaucccacuacacuucaguguccuuaucuacaaaauagaaaugcuaguggcuaaucauaggaugguugcauugaugagauugagaacguauggcauagugcauaacacaugguaggugcuugguagauguugguuaugaauuuacuaugagaaguuagugacacagcauuuccuugaugaagucagcuuucugcuaagaauaaaagcuggguagggagcucuuaaccuugaauguuaauuaucuucaaguuuauuggcugaaggucucagcuguacaaaacugaucauuuuccaagaaacauagcacuuucagcucuuuugugcuuugagagugacuugcuuuggauucccuuugaucacugugauggcuaacuaaaugauuugccucaguuaaccucaaauaugaguacagugugaccauuagcuauuccugcuuccaugacaacagggcauccuguaacucaccaauuuaccguuaggacuagauucuaaacucccuucuggaauuagguugauauggaugcauggcggcuuuggcugcauagugcuuguuacucacaugcucuagcucgucacagcuuuauuugugacaucuguucugaacacaucaugucucuuccacucucuggccugacacaccauauugacuguuacugccacuguauugucuuccuaccugccuuuuggcucuucucaugauuuuaaggauugaauacccuuaaacaaauauauagaaugaaguuggccuguaagagggauuuaccguuaccugcaaauguuaucuugaaccucugaauuuuauuugcuauguuaaguuuguaacuaaacuuacuggguguuuuaauuuucaguugcgauccgagguuuuuuuguguguguguaugugacacaggcucucacucugucaccuaggcuggagugcaguggcgcaaucuuggcucucugcagccuugaccuccugggcucaagcgauccuugcaccucucagccuccgaguaccugggacuacaggugcacacugccacauccggcuaauuuguauauuuuuuguagagacgggguuucaccauauggcccaggcuggucucgaacuccugagcucaagugauccucccgccccggccuaccacugggauuacaggugugagccaccgcacccagccaggaaauuuuuuguuguuguugaggcaaagucucacugugucgcccaggcuggagugcaguggcacgaucucggcucacugcaaccuccaccucccagguucaagcgauuuucaugccucagccucccaaguagcugggacuacaggcacgugccaccauagcuggcuaauuuguuuguauuuuuaguagagaugggguuucgccauguugcccaggcugaucucgaacaucugagcucaagugauccucccaccuuggcuucccacugggauuacaggugugagccaccaugcccagccaggaaauauuuauugaauaccuacaauguaccagguauuguacuaauggacucuucaaucuuuugaggaaucaugauacaggacauagaacucauagaacucagugacugaggcaguggcagagggcauugcccaagcacagggcacaacuucugggcccacagagaaauccauucacagcuugcuuuggcuuuguuauacagagcagcaguuuucucacuagucugugcagauauauguuucaaaagagcaaacaaacaggauuucuaaagagaggggaucaagggacuacuaccuuaauuaagaacucuaucccaaucaccuucguacccccuuuuccuaucagaagaacaaaaaucauuacaugaaggguaccacgggugucagaccccauuaggaagcucugcauauaguagcauauuuuguaugagauuuuuguauuuuuuuaaagaauagaauaguucuaguuauaggaagauuuuuaugaguuacuuugccguauuugcuuuauuuuucccucuccauccaucccuauuccucucucucucucucucucucacauacacaugcuuuaugcuuuuuugcugaaccauuugagaauaaauugcagacaucaugccucuuuaccccuagauacuuaaguauguauguccucagcuuaaggguauucuccuaauaaccaugauacaguuauuacccuuggggaauuuaucauugauauaaaaauaaaauggaacaucuaaauuucccuuaauggggccaggcgcuauggcucacaccuguaaucccagcacuuugagaggcucaggcugguggaucaccugaggucagcaguucgagaccagccuggccaacauggugaaacccugugucuacuaaaaauacaaaaauuagccaggcgcgguggugcacaucuguaaucccagcuacucgggaggcugaaauaggagaaucucuugaaccugggaggcggagguugcagugagcugggaucgugccucugcacuccagccugggcgacagagcaagacuccaucucaaaaaaguaaaacaaaaaaauaaauaaauaaauuucuuguaauggcugccaguuccuauauuggacaguucucaggucuagaacacucucagaaggcacuguagcagaggagggugcugagcauagugcagcagagcccgggguggggggauaggggacuccuaccucagcaacgcagcagaccaguagcgggcaggaguggcaggaaggcuggcugggugccaacaggagaaugaacuaaaagucugcagacagaagggccacccucuguucugaccucuagaacauuaacagcaggcaguuaucccuaucggcaagguaaaggacaaaaggggguucuucucuaaagacacugauggaacuauuucaggagaaucagggaagcuggugugguauuagcgcccacugaaaagccccaguguaaucaggaauucagggagcucucuccgccaagagccccacagggcucccagucuuuagccugcuuccuucccaaaccugacugaacaaccaaagaucaccacacgucugagggaagccuacagcgagaaagagacuaacaaagacagaaaaauggacauuaacccccaaaagagacaaaaucugacuggccauaaaagagugcuuuaaaauauaauuuagcaauaaaucaucuacaaccccccauuaacaucccagagaagaucgcauuuuccaaagauggccaugaggauacuuuucuacagugugaccuuggcaccccucugucaggagcaggagucgaaauuuccuucuggagucugggcaggcccuggcuacuuagccuaauugauuguggcagacuaggccagcugugugacuucugagccugggucauaaaaggccaugcggcugcugucuuuucacugaagugguggaaggauccaacuagcccgaagcugccgugaugugagggagcccaggaagaggccaccccaagcugcucagaugggcaguccuaguugugcaguugucugucccaagcaucagacuuaggagugaaggggcccucggauguuuccagacccaagaucuagucacccugcagccuucggguuuucccagcugaagcccagauaagccaucccuucugcgugcugucuaaauuccugacucacagcaucugugaguaucauaauauggacuuuggacugaaagaagucguguaauaucuagauguuuuggggcacugaauuugauagggaauaaagugugcgugaaauccccaguauuuggcucuuugucucugaaguucugacucacucuuuuuguuuuuguuuuuuugaaauggggugucacucugucaccugggcuggagugcaguggcacaaucacagcucacugcagccucgaccuccuggcucaagcgauccuccugccucagucuccuaaguagcuggaacuauagucacgcaccaccaugcccagaugauuuuuuauuuuuuuguggagacugggucucccuauguugccugggcuggucuugaacucuuggacucaagcaguccucuugccucagccucccaaagugcugggauuacaggcauaauuggcucacuguuauuaauaaccaaaacauggucuggccuagaguggaggcagccccaaguuuggcagauuccaaaucugcagccuauuuugauccuucuuaaauucagaaauaaauguucuugaacaaaggaaaacucuuaagcucuuaaggcagugagaaacugcucaugaaacaaaacaaacauuuuaaaaguagaaacuaaguuuuuaaaaaagugauucuuugaaggacauucacaaccauuugguaggucuccauucacaugucagauuguuucuucugaaggacuauucaauuaaucauuguuuaacccuaguaaaucaaaaaauuaaugacuuauucuaaaauucaguguuuucaacagauugaaaucuuauaacuacaacuagagaaaagaaguugaagagcucaccugcacacauggacauaaacauggggacaacagacacuguaaacuacuagacggagggggaagugggcgcggguugaaaaacuaccuauuggguacugugcacacugccuaggugcaacauacacauggaacaaaccugcgcauguacccccuguaucugaaauaaaaguugaaaauuuuuuuuaaaaagcuuaaaauaauauguucucaguuauauuuuaccaauuuaaacauggcuaaugggaaaaguacauugccaacucagacauuuaguuggugauauuaaucgaaagcauuuaguugaugauauuaauaaaaauuaucagaaugagcuggaucauucuguugggguuuuuuggugccuugcggguaauuuuuccauguauugcucuuuaucucauuauugccacucccaaaccaccccccaacccccaccaacugcuaaagcugaacaauggacaaagaaagccuucaaguaauccagacagaggagacucuacauuuuaggaggcauggucucuguugauugaagacaguacaaaauauguccucagccucugcuuuaauuaaaagguacuuacuaucaaucacuugaaccuaggaggcggagguggcagugagccaagauugugccauugcacuccagccugggcaacaagagcaaaacuccaucucaaaaaaaaaaaaaaaaaaaaaaaaaagacacuuauuaucaggugacuugauuaauugaagaaauaauuauuuuuucugccgccuguaaauuagucgaaaagaggauuaaaacgaagccaggguuaucagccacuauguaaaccagguauaaagaaauaugucugugagcuccugcucucagguggcuagcuaaacgcucuuggcuaccuccuggucccaccauagggaaggcucccugcauuacauugaaagucauuuauauuucugugucuauucacccuaggucuuggugaaugugaagcuauauggaaccuuucuagacaaagcaaaucauaccuuuugcaaauauaguaauugucuccagcuucccaauaaaaggacaaaguauaaaaaacaaacagaggccaggcgcaguggcucacgccuguaauccuagaacuuugggaagcugaggcaggcggaucaucugaggucaggaguucgagaccaaccuggccaacauggugaaaccccgucucuacuaaaaauacaaaaauuagccgggugugguggugcaugccuguaaucccagcuacucaggaggcugaggcaggagaaucgcuugaacucaggagguggagguugccgccacuuggugagccaagauugcgccacugcacuccagccugggcaacagagagagacucugucucaaaaacaaacaaacaaaccagaaacaaaggagaaugaaaggaucgucaaacuuaggagaaaaacagaagaaaugcacaugaguguauuugagucuaaugaccuguuugcauccacuaagucagaguuuuccaagcccccucaccugcucccuuugucaucuuugaacugauaccagggaaaaacuuaauugguaaauuugaauaagaugaaguauauugagaaaugcagaauaaaaauagaaagucaaaauuaaggaauguagagaagccaaguaaguagggaaaaaaugaagucaaauaauuggaaagcagaacuggaaaauacacaauauaccagaagacuuaucaaaacagaacccucuggcgaggacauucauuuaaaaccaaaauguuuuucuugguaaguuuauuauuuaaaaaaaaaugguuguuagaaccuuuucauuuaaacugaguauccggcauuaauacauaggaaagauacuuucaauguacgugaagaaagcacagaaagguuauaaaaaucaggcauuucauacuuauuuuuaggcuaacuaauuaacuaaaaaagacuuauccuccuauuuaagcugauauauaauuaaggugucugaguacaaagaauuugucccuaaaccuaauguagaauguaagagacaaaaccugaaauuuuccaacuacucuuuuuaaaaaauacgaacuucuggacugagugugguggcucaugccugucaucccagcacuuugggaggcugaggcgggcaggucacuuaaggucaggaguuggagaccagcuaguccaacauggugaaaccucaucucuacuaaaaauacaaaaauuagcugggcguggugaugggcaccuguaaucccagcuacucaggaggcugaggcaggagaaucguuugaacccaggaggcguagguugcagugagccgagaucacaccacugcacuucagccugggcaacagagugggacucugucucaaaaaaaaaaaaaaaaaagaaaaaaaaagaaaucaacaacaaacaaagaaaaaaacaaacuucugaaagcauuaucuauuauuugaaaaaaucauugagaagcuaccauaggcgaggcacuauaauaugugcuaugggggauagagagacagauaaaaguuucuuuccacaugaguuuuauaacaggcugauaauccaaggaagcuugaagaaaaugcuuccugaaauuugguucucuuagaccaugccuaguaguugaguuuuaacuauugcagaaucaucagaugagcccagggaauggguucucagggcugaccaagcaguaacugacaguucgauuguguaucccauggccucagacuauucuguuugagcaucaucagcgucauuagugauugcuauuuaauuagccccucuucuaaguuuuaagaauaugugacuguuaaauauugugguuuauuaaguuuuuauuuauagagaugggggucuugccacauugcccaggcuggucucgaacuccuggccucacaugaucuucccaucucagccucccaaguagcuaggauuacgggcgugagccacugccucugguuuaaauguuaagcacauguuaacccucaccaaaucucugugaaguagauacugcucuuuuuuuauaggugguuacaaugaaguuuagaaguguaaagaaacuuaccccugcucaugaagcuugugaaugcucuagucaagauucaaacccugaccuuugucaucgaacuucagcaccugaccuuugucaucaacgccccgcaggaccauaagcuuuucucugaauccugaacucaaaaaacucugaaaauugaauuucuuuuucauauauuugcugccacaacucauuuuguggcaaaaccagaccugaacugacuugauuccauaguccuuauccuacuuacuggaaauguucacguauuucacugcagcuauguuguggcucucuaauacucuguauuguacaauguaugguauagacuccuuuuuaccuuccuaaaauugaaaaaccuuuaaauucugaaaccaucuagaucugcaacuucuagagaagagaugagaagcugacuauggccaccucacaccugccagccagcucucacugcucacaacaugcucguauccugugacuccuaacaggcugccaacuuggaaauuuaaacauguauacuuucauuacccucaaaaacucauaauugugaaaaaauuauuaguucauacugauacuaccaguuucaguuuaacaccagaauucuucuacuucuucccuauuccagaacuuccuuuuuccucuuaaagaaaaaaaaaaacuggcuagacaugguugguggcucacaccuguaaucccaacaguuugggaggccgaggugggcggaucaccugaggucaggaguucaagaccagccuggccaacauggugaaacccuaucucuuuguaaaaauacaaaaauuagccgggcaugguggcggaugccuuuaaucccagcuacuccagaggcugaggcagggagaauugcuugaacucgggagguggagguugggugacagagcgagacccugucucaaaaaaaaaaaaaaagaaaaaagaaaaaaaaauuaucugauacuuguuaaagaugguagggaaggcuuuauucaagagggaccacuacagugggaguuuugcaauaguggggagagaucagguugaacuccuaaugcaacaaggacaaguggaaauuuauagccaaggagcagagugugggucaauggguggaaaguuacuaagaggaaaaauccagguuggaggggauucuuguugaaggcaggccagcaugauaagauaucgaggguagggggaucagacaccaaggguaggggauuuucacuaaaaugacucagcaggauuuuugcugagacuggacuaagcaggucaagauagaacccaaagucgaggccuagucagaaagaggacucagagccgggcacgguggcucaugccuguaaucccagcacuuugggaggcugagacgggaggaucgcuugagcccaggaguucgagaccagccugggcaacauggcgaaacccccucuuuacuaaaaauacaaaaauuagccagcugucccaccuaccugggaggcugagguggcaggaucacuugagcccaggagguugaggugguaguaaaccgugauuguaccacugcacugcagccugggugacagagugagacccugucuccaaaagcaaacaaacccagaagaaccgguuucaaguuuggucaaaggagagagucuuugucaucccacagugagaacaucaauguuucuuuugugauuuaaagauaauuuccuuucuguuuagccaggaugcaaaguauuuuuccuggcaugugaaaagcuagacuuuuauuuuaacuuagauaauagggaauucauuuuauaaugagauucacugugauaaauaucagcaauuuuauugcauuuaaaauuaaaauuauauucauccagaaccuuuuaggaauaauauacagaugcuccuugacuuacagugggguuacauccugaugaauccaucauaagucgaaaauauuguaacucaaaaaugcacuuggccaggcacaguggcucaugccuguaaugccagcacuuugggaggccaagguggguggaucacuugaggucaggaguucgagaccagccuggccaacaugaugaaacccuaucucuacugaaaacacaaaaauuagccaagcauugugacgggcgccuguaaucccagcuacucgggaggcugaggcacgagagccgcuugaaccugggggguggagguugcaguaagcggagaucaugccacugcacuccagccugggugacagugagauucugucucaaaacaaaaaagcccuuaauaauuagauaaacccaucauaaagugagaagauuaaacaaucaaaaaaucauaaguugaacuguuuuaaguuggggacugucucuauauuauuugaagcaaaaugaccagagcuggcugggcgcgguggcucaugccuguaaucccagcacuuugggaggccgaggcggguggaucacgagucaggagauggagaccauccuggcuaacacagugaaaccccgucucuacuaaaaauacgaaaaauuagccaggcgugguggugggugccuguagucccagcuacuugggaggccgaggcaggagaaucacuugaacccaggaggcggagguugcagugagucgagaucaugccauugcacuccagccugggcgacagagcaacacuccgucaaaaaaaaaaaaaaaaugaccagagucauuuuaaauguuaauugccuaaggccaaaugaauguguauagaauagauguuggaaggucauugugggggcauuacaccccuucuccucuuacuugaaguggguauuuggggauugagguacuuaucacagugaaaguaugaaggagaaaagugaaucaucauuuaguuaaaagauuuaccaaaggccuucaauauacucacuuaggaugagggaaaugagggauggauuauuucagacuuucaucuuuuauuguaacuuuuuugagaauggagaagggggucagggaugaguggggaagaaagguucugcagauuacuuucuagauuagguucuuuuuuucaaguuuuauuugguagggagagcaaaugaauaaaccagaauaugacuggaaguguuagaaaauuggauucacuucugaaucucugacuugcugccuucaugacguacagaagaauaaggagaguuuggaagagaaaauuguuaaauggcucugcucgucucucucugggccuggccaugauguugcccauuucugugcagccuccagggaauauggagcagcaaagaggccuaggcagggcgagggagaugggauggaccccucaauaccacggagaccggaaggaccaguguuuguccaacacuugcuccgugucagccuccaugcacaguaucacauuuaguccuuacacaaacuaguuuuauccccauuuuacagauuaaggcagcugagacucagaagugaagaagcuuaccaaagguuucacaaccugcaaauggaggaguuggggcuggagaacauuucugucuccaaagcucaugccuuuucuaucaggcccuccacucccagccaccauggaguuuccagcagggcuggggguugcaggccaggcugaugcuagaacucuuccugccacaugacagcaggggaaagagcucagguuuccucuuuuaaguggccagguauguuuccucucauggcgucuuguuuauguaaauuuuaugcacagcuagcucagggaagccuccagaaggcacugaccuccuuccuuauggucaacccacaucuuacccucuccgauguggcaugguagaucacucugccucugaguauacccaggagauaguuucucuggcauguuucucuggcacaugccaacccugugucucagucagagccccuccucuggaagcacagggucucuggggucuguggcuacuucccagaggggcagagcuauggucccugaagaaacacacuggaggaaaaucuuaggaaacaguuggcacacacaguagguaaauaauugugaaaugaauggauccguugccuccuggaaagcccuaugaaugggaguggauuuacacguucuguuaccuuuguacuuggcaguuuucccaugguguuuauuugaaaacaaguucagauuauaucccaggucacuuuuguauugccgcugguaacacuaggaacguuuuuguguuaagaaaaaaaaacugcuuucaaaguugccucuuguaaugaauguucuuuuucucugcuaauuaacuuauuuucuugaacuugcuauuucaaaggauaaaaauucaacuagagacugcaggauuauuuaauuuucucuuuccaaccaguaguaaccgugcuaccgugggagcacuuuauuucuccaucuguuagacuauaaaaucauggaacauuuuucaugucuuaauagggagagauaaugcaugugagaaaacuucauauauguuucuacgaaaggaacuuccugugcggcuggcuaacacaaugagagaaguuaaucuucugccggauaauuuacuuaaccgcccuucagugggauugguucagaguugguaaguaaacaauguggcuuaaaauggaucuucccacaaugcugugaacauuuggcagcgagaccauucucuguaaaagugcacauacugcccgucuagguaggaaugagucauuugggauagcuggguuuuccaugcaauuaaaaguuguuuuguuuuuuuucuuuuagagcuguuuguuuuaaaguuguuuuagugaaaaugcuuguuaaguuauacuagacacuuuccugaguuuuucuuguguguggugggauugcaguucuucugacaggauauuugcugcuuuuaucaagucuuaaccuuacuccuuucguuuuccuuguaaagacauuccuugaagucaguacuucuuguagaacaaauuaagucauuuaaaggggaaccucagauuggaaaaauaucaguucccuccuuugcuucauuugcuccaugaaaaguaggaaaaauuuugacagaguauaacauaaacuuaaaucaguuauagcucugaugcuuaaagcauaugucauuuaacugaagaaguugaauuugugacacaaaguccugggccacccgugcuuuugacugaguggcuagacauugaguuuccaugccccuuuucucagauuugauaauuugcuagaacggcucacagaacucaggaagauacuucaccuauguuuauagguuuauuagaaaggguacaauucaggaacagccacaugggagagaugcauagggcaagguauggggggacacauggagcuuccaugcccacucugggcacaccacccucccaguacccccauauguucaccaaccuggagacucucugauggucguucaaggguuuugauagagcucaaucuccagcccucuccccuccccagagguugaggguagagcugaaaguugcaguccucgaaucacuuggccuuucuggugaccagccccauccugaggcuaucuagaggucccguccuaagucaccacauuagcauaaacucagguguggucaaaggcggcuccuuauggauagcagaagacaauccuaucauucagguaguuccaaggguuuugggagcucuguccaggaagcagggacaaagaccaaauguacuuaaauguguuauauuauuccggcaaaguauaggcuugaacaaauugcuaugucaacucuauuguuugguuuuugucuuuuaacuguuccuuuuccguauccauuccaaacaaaugcaugccauuucuuccuucuuguuucuuaaacauucuauuuugaaauacuuuccuacuuaacagaaggguuguaaaacugguagaaagaauuccaguauaccuucacguagauucacuaauuguuaacauuguuaacauuuggcaacguucuaccauugucauucagauucucucucucugucucacucucugcauacacacacacacacacacacacacgugcgugcacacauauauauaaucuaugucuauauaugguacacacacccauauaugguacacauacacgaugucuacaucaugccccuuugcccuaaauacuuuagcauguauuucauuggaacaggucucagaaaaccacaaugugaucaucaaauuugggaaauuuaacauugauacaguaaugucuucuaauauguagaacuuguucucacuuuacuacuaauuguccugauacuacccccaucuuuuuuuuuuuuuuuuuuuuuuugcaguuucuccuccugauuuaggaauccacuucaggaucaugcauuguguuucacugccauuuuuuccuuuuaaaagcgaaucuuaugcauaaugggcugugacccccaccaccauccccuuggucacaguguguccuccuugcucucuugacugucaggcugggaaccucaaaauaaucuuuuuuuuuuuuuuuuuuuuuuuuuuuugagacagagucucucucuguugccgaggcuggagugcaguggcgggaucucagcucacugcaagcuccgccuccuggguucaugccauucuccugucucaaccucccaaguagcugggacuacaggcgcccgccaccaugcccugcuaauuuuuguauuuuuaguaaagacgggguuucacuguguuagccagguuggucucgaucuccugaccuugugauccgccugccucggccucucaaagugcugggauuacaggugugagccaccgcaccuggcccagaauaaucuuuggcucccugcuauuuaugacuuucuccaacuguccccuuuggaaaggacgggaugccuaccuagcuugcuugcauguggcagggcggagggcaucacuggggcuggcuggcuuugaccucuuggcguuuugacccaaugauuuuaacaauaucuaauccauagccuuauaugcccagagacuuuuauuuauuuauuuuauuuauuuuuuugagauggagucuugcucagucgcccaggcuggaaugcaguggcacaaccucggcucacugcaacuucugccuccuggguucaagcgauucuccugccucagccucccgaguagcuaggacuacaggcaugugccaccacgcccagcuaauuuuuuguauuuuuaguagagacgggguuucgccauguuggccaggcuggucuugaacuccuggccucaaguaauccacucgccucagccucccgaagugcugggauuacaggcgugagcuaacacgcccagcccccagagacuuuuaaaaaguauguccaucaaugaacauucauuaguaucaaaugcauuguccaaaguucacaugaagcugaugaaucaaguggcauucucauuggaguauuuauauguguaacagucauuuuuaguuacuagaguguccucauccucuauccaaagguguagauaauaggauuaguggcaauuaaagcuuagaaauaauuagaauaaagggauaauucuuucaggacauguuaaaaccccaaauagagaucacauaucucuaauuggaauaucugaauccccaccagauccaacagauccuggcuggauauagcugcugcacuaaugggccucucuggaucucauuuuucuguguucuccagauuuuaauguuggacagacuguuucuuauacuggcccugauugagauauggagcuauucuuaauccagaagcuguuucugaggguuuaauuggccuucuuucucccccauuaaguacugaugaaauuaauuuaacucagaaggacccuucuucacuucuaguuucuaaguucuuggcaggcacuucagugucacacauguguuucuuaaaauguauaaguacauuuuugguaaucaaacuguagacuugguauauaaguuaggauaugucuguuuguaaguagaaaaaaugcaaccgaaccuggcucaugucacuagaagguccagccguagggugagcuuuugguguugguuugauucagagauucaugaagcuaucgaggcccugcuuucgauggugcuggcuucauuuucagacuggauuccccccugguggcagaauagcugcagcaguuccaggcuuccaauccacacagcacugcacaaaagcagagcagguugauuucucugccaaaguccucuagcgagucuuuucugucauuuuacuggccugaauugagacaguauguccauuccugagccauucccuguguucaggggaaugcacacagugauaggcuuagaccuaaacuauugggcuaaugaauaauuagugacaagagaaauagaauugcccagagaaaaaugggaccacccaggaucuuuggaggcacuggcuucccugaugcacuuaagccacaugggggaugcggaugggauggagaccugagugaaauuuuggaguguucuuaggaagagggagaggagggguggaugcugggcaggcaacuaacauaguaacucuucuuuuucuuuuuuuuuuuuccuuuuagguauaugcagaguuuucuugaacuuuuagaauaugaaaauaagagcccugaggauccacaggucuuggauaaguaaguaugguaccacuuagcugaaaguaaaaauaucuagguaagaaagauuuugguaaauguaauucaagucauuaagacucaaggaguaugaauguggacaaaagcguucauuuucuuaaugaguagugacucaacauugaguuuuuuuuuuuuaauucgagcuaagaauguaacacaauacaaaaguaauaaugacacuuucaguuuugcuuuuaugaucuaauacuuaauaccuuuacccaaggugaacugggcagucacuauaaacacugcaguaaauguuccaucuagugguaguuuuaagaaugcaguggccuuuuuauauacaugaauuuaucuacucaauccuuuacaauuaaaaaaaaaauuucaauaggauauuacauuugagcucaaaaacuguagugguuuuauuuuggagaggcauaaaaguauguuuuuuuauauagcaaccugaauucuauugcucccuuuaugcacagacuggcaaauuaucaugcugaugagauucauuuuuauuuaucccaggaacacuaacucuagcugugaguauguuuuccccuccaagagaaauuaaauaucccuuucacauuaauuucuuccuguuucauguauauguaaguggaugcauaugguaggccuguugugcugagaaauuucuaaguauaaacuaguccacauaguuaugagacugaacaccugacuuaauagauguuccauaagaagaacuagggaaacaccauguuauacaagcaaccuuaggagguauuuaacccaguccucucaauccacagauaaggaaacugaguucagagaugugaagugacuugcccaagauugugaccguucauagcaaagcuggaccuauaagcuauguuuacgucugagccaugaguagcuaguucuagucuaguuguaaacuaaaauucaaaggaaaaacaaaagcccucaccuauuuuauacuuuguuggguguuugucugauggaucugugaaguguggaaggcagggaagcauuggguuagagccccagauguagcguuuuccuugauauaagccacugcugucauuuaagcgauuauuaaaugaauucaauccaggagcuuuguuuucucaaaagucauuagcugguaaccguuuggcagaaauccuaaaaccuagggcugaccacuguagcuccaaauuuuagaacaaauuuguagaaguauaguugguccuuuguacuggcaguuuccacauccuuggauucaaccagccacagauugaaaagauauucaggaaaaaaaaaagcaauaaaaaauaacaaugcaacaauaagaaauaauacaaaauuuuaaaauacagucuaucaacuguuuacauagcauuuacauuguaucagguauuauaacuagucuagagaugauuuaaaguauccgagaggaugugaguaggcuguaugcacuauuuuagauaagggacuugagcaucugaggauuuggguaucugcggggauccuggaaccaguccccugcggauacugagagacgacuauacacgauguuaaauuucugcuguguuuuucccggagucccgucucaguuucuggaacagguuauccgaugugauuuauggccacgagccugcuuugcaaacugucagugcugaauccagugugugcuugacgauagcaauaauagcugagcucucacuccgugaguuuuguagcuugccuagguucaugugguuaguuaugauaguuggcauuugagaaggcugauguucuuggugaaggaaggagugaaaggugagcgaguaucaugguagcagccuuuucuguuuaccaagagguuguaugggaucaccagcagggaaaucauuuuaguaaagcaaaaguagcuuagaggacaagcuuguugaucauuuaugauagaguuuagaagagcccggaagauuggaggagaauucugagcauugagccauugagguaagucuccccacuucagauaaguugaggcacuucucuacuauaaugaaucguuucacuuuaguaauauuuaacuuacaaauacauugcaacgaguauuacauaaaggacaaauugucuauuauaaaauuuuuugugaaugacgauggccuaauuucagaguuuuacaucuuuauugucauuguacguauguauuuguuacagaaauauuucgucaaauauuucaucaaauauuucagaaaaauaagacuauugagauaaguaaaaagaaagucaccccaaauuucuacuaccaggggacaaccacuauuacuauuuuccuuucuuccgugcuuuucccuaggcaugcauauauuuauaugcguaaaauauuuuuacaaacauaacaagugucaacauuauagaucuacaccauuauuaauaguuucauaauauucauguuaauaguccaucuucagauaguucaugcaauuugaucuucuaucacuggauuuuagacugguuuguaguuuucaugcuacuauaaacaaugcuuuaaagaacagcuuuuaaauacaucuguuggccgggcaugguggccgacgccuguaaucccagcacuuugggaggccaaggcgggcggaucaccugaggccaggaguucgagaccagccugggcaacauggugaaacccugucucuacuaaaaauaugaaaauuagccaggcgugguggugggcaccuguaaucccagguacuuugggaggcugcaggagaauugccuaaacgcgggaggcagagguugcagugagucaagauugugccacugcacucuagccugggcaacagagcaagacucugucucauaaauaaauaaacaaacaaacaaacagcuguucaccuuuuccaguuauuuuccuaggaucaauuccuccaaguggaauuauuuucuuugggcuuuugcuguauguugcugauuguccugagaagugccucaguuaagccccaaacucuagcugaugcugauacguggagaauaauaaguaucacauuguuuugauuugcuuuucuuauuuguaagggugacguuauuggcauuugugcuucuucuuugguaaauuuugcauugauagcagauccuuugccuaguuuucugauggggugcuaguuuuuuccuuuuuuuaaguuuuuuguuuuuuuucuacuucauuuauuaaugugugucccuauaggauugcuaaaauucuacauagucauaucauuuguuucuucacauuauuuguuucuaccuuugauauuaagcuuagaacagcccuccuuaucccaagauuauguacuuauucaccugauuuuucuguuaucauuucugugauuucacccuuuuacauuuuuaauccaguauuugguuuuaagucuugaaauuaggaugugacugaaauuguuagcccgcuguuccaguuaacuugauuauuaguuugauuguuuaccuacugauuugcaaugucacuuucucaauaugcucgauuuuuauauauacauacucacucaugggccugguccuaaacuuuuuauuuaguuccauugacugacuugucuuauaccauucuuaauguauuuucccauaugcauauuuacaauaagaugccagauacuugaauaguuuaauuuccuguguucugucugcauuucaucacuguauuuuacugcugcgagauauuuauuuccaaauuuuacucuuaaacuguaugagacacuuuaggaggcugaggugggcggaucacgaggucaggaguucaagaccagccuggccaauauggugaaauccugucucuacuaaaaauacaaaaauuagccaggcgugguggcguacaccuguagucucagcuacucgggaggcugaggcagaagaauugcuugaacccgcgagguggagguugcagugagccgagaucacaccacugcacuccagccugggugacagagugagacuccgucaaaagaacaaacaaacaaaacccaaaaaacagugugacauuauuucuuuauucauggaagcuauugcuuugagauugcuuuaaucaguccuuggagauuuuguggggauuguccucauguucucagaagaaguacugauauguucugcaauucuuuauucaacuuuuauagaaccuguguuauaugcaaucacuuauccaaaaagucuggauuccuaaaaggguauuugagcauuuuuuuucuguacuagaaccuuuuacuuuuugcacuucugaaagaaggguuucuguagaaaaaaaguuucaagcaaaaacuuggcucauacuuuaguuucuugugggugguuccuuguucuauguaguaagaauaaugucucuacuuauaaaaauaccagcagacaacuagucuggggacagagcugggaagucugugcaucagcccaugagauauuaagacugaccacguuuuguuucccucucacacagcuuucuacaaguucugauuaaagucagaaauagacacaaugaugugguuccuacaauggcacaaggagugauugaauacaaggagaaguuuggguuugauccuuucauuagcacuaacauccaauauuuucuggaucgguuuuauaccaaccgcaucucuuuccgcaugcuuauuaaucagcacaguaaguuggaguuuguugguccaguuuugaaaagguaaccauagugauuucucccaaauguuuuccuguuguuaauuuacugaccugcauuuuugguuguagaaauuucauuucuaguucgguuuuuccuaagugaauccuagccauuacaaagcuauuaauuuguauucuugguuaaaagaaauguuugaaaggcuuuuaugaggcucacauuagagacaggaccacugccuaccuuuuaagucucugcugauacagucuugauggggaugagggaccgccuuuaauggcagccggccuucaucucugaauacuuuuauguaucucagauuguauuauuuucuuuauccaggauauuauguguuuuccuuuuuaguuuuaaaaacauugacacuggaaauauugaauuggauguuggugauaggagccaucaguucuuuauuucacagugaucagugaagucagauuaagccagacugucaguccauaaucccguauugagaguuuuagucugcucuugaggguacuaagcagauaugaaaaaaacaacuaaaauucccuccacacaaaaaacuuuuuggcucaucuucagcacugucucuuuggcugauuuuauaauccuugaggaaaagcauccacaugucuagagcauaauucacccuguuugcugcaucacaaaguggacaaaccaucuuuauuuuaguaauuugauuuauuuggauaacugaauguuauagaacuauuaaauguggccuuauauuaaauguauaucuucaaaauggaaauguaugacaauuuacaggaauaaaagagccuaaauacuguucaacuaaacuacuuagauaacuccaguugcuuucugaucuaaauacacauguacacauauauacgugcauguuuuuagaucauuaguuaggccuacacaucucuguuuuucuuccccuuaaucaguucgaacuuuauuaauuagccuaaugccuguauuuaucauuuuucauaguuuaaaauauccccuauuuuauuuaggcauccuucuuuuguuagucgcaauuuuugcuugauuuaaaaauaagaacaccuauaaauauuuggaugcagauugcuuuuuucuuuggggcuucuuuuggcuuuuauucagaaacaaaauuuugcaaaucuuguauauugugaaauuaucugaguguauuuuuaaaaauacuugaacaaguauuguuuguguacacaacauugaaacauaaucuccaugggggaggcaucugaaaugcugccagcgaagacacuuugcaagcuuguccaaaugguauagaccacauguucuaaauauuuaaugaaaguuggaguuugugucuggaguaguacuaagaagguggguauacuugacuaaggaugaaaguaaguuucuucauccaugucacauugggagaggaagaacggauugggcaccuggcacgugucacugcuuuagaaccugcugacugcaacugacagaccuuaaaccacauccuccuccuucauugaccaauaagaguuguucacccaucaauuguguguauuccauugcucuaaguugcuguggaugcuaaaaugauuuuuacacauaagauauccuuucuaaacauaagccccuauauuucccugugugaccaucccagccugcuguguuuuaauccccucccuuuccuuuuguguucgucuagcacuucuguuugggggugacacuaauccuguucauccuaaacacauaggaaguaucgaucccaccuguaacguggcggauguggugaaagguaaggagaccguuguaaugguaucgaucguaguucaaauuggauugugguuuauuggaggcagcuuggcuauaggguuauuuugcagugcagucugcugauucaucaggucacucugggcccaagccacuggauccagaugaaauguucuuucuaggcaguucagguaggcaguucuuucuaggcaguucagcauaauugguaaggcucaaaaugugaguuucuacuuuauugauuagaguuucauuuguaguucugucucaaacaguaaacauuuaaguaagauucugauugccacuguuaucugaaaauuucagagaauccaaauucuuaucauaaaauuagguugaauucacgugucuauaaaauuuaaacauauuucuguuguucacaucuggcuuuagaauuuauguggcauguaagcuucauggguucauuggacuuuaagcuagacauuguuccaguauccuccgggaagaaccaagcccuauauccguaagucccugguacccaggcacuuugaauuugaacagcaguuuccucauuauuuauucauuuaagaucaaugcuaucuccaagaaaccuuccugguugugagcgauccaccagguaccucuucaguuuucuucauuguuacgguuacuuugugcaaccucagauccccaaauugucccuuucugcagauuguaucuccuguguuggccuuuaucucccuucuuuaaacgcucaccucccaaguuucauggcugcaauucucucugaucuucaucaaggaucuucauugcucuucagcagccauagcaaaggaaaaccucuguaauuuguuuacccugggcauuccuaaacccagggaggaggaccagaccuguugguuuuagcuuagccuaggauugucuggcugcccuggccucuguugagucacaacagauuuacucacauuauuucaguuguaaggugaaucagcccagccucagcucuaggaauccuauugguugcucucucacaagauaacuuugugguugaucagaaccuccaaaggccuccgggggcaaggaggaaagggucagucuuaucauagcuuacauguucauuaggccuuagcucagugccuuuuaugaaacagaaaacuugguucagacaguugauuaccccuuugagaaaaaggcacaauuuagaaagcaaaagugcauugugauauaugguaugugugcauuuucucuugaacuguaaccaauuugaggucaggguuugugucuuauauuuguuuuauaacuugcauagaaccaacuguagugcuuguguaggugauuaauaaauauuccuugguuugauacauuuuaaaucuuuugagaauauacuuuuaaaaacagcuuuauugagauacaaucucauaugauaaacuucaaccauuuaaaaugcucaauucaguguuuuuuaguguauucacagaguugugcaaccaucaccacaauccaguuguagaacauuuuguuuuuuucuuucuuuuuuuuuuuuuuuuuuuuuuuuuuugagacagagucucgcucugucgcccaggcuggagugcagugguacgaucucagcucaccgcaagcucuguccuucgaguucaagugauucuccugccucagccuccugaguagcugggacuacaggcgcaugccaccacgcccagcuaauuuuuguauuuuuaauagagacgggguuucaccauguuggccaggauggucucgaacuccugaccuugugauccaccugccuuggccucccaaagugcugggauuacaggcgugagcuaccacaccuggccuguagaacauuuucaucacuccagaaagaaacccuggaccuguuagcagucacucccuucuacccuucucuuuagcccuagacaaccacuaaucuacuuucugacucuguauagauuuuccuauuauagacauuucauauaaacaaaacaauacaauauguggucuuugguaacuggcuucuuucacucagcauaacauuuucaagggucauugaugucauagcaucuuucaguacuuuauuccuuuuuauggcugaaaaauauuccauuguaugaauauaacacauuuuauuuuucucuucauguuaguugggugaucucagacuugauuaaguaaccucuuuggggcucagauucuucaucuguaaaaugaugcucuugguaauucaccuauauuguagaguuaaaugaguucauauuuguagaaccccuaaagcaaugcuaguacacaguaaaggcuguagacagguuuacuagcagcagacaguccuugggugucagacaugucauuuggcuucccauguacgccauugauuauauaauagguuggugccuuuauuuuguuucuggcauaaauuauaaaauauuuuuuaaagucauuucaggcuuuuauaagacaauuggaaauuugaacacuggauauuugacauuaaaaauauguuaacuuuuuaggugugauauugguaucuggucuuguuuuuauaaaggagugcuagcuuugagagagguauuuaaaaauauuuacacaugauaugaaaugaugugagauuugcuucaaaauuauacacagggaggggagugaaaaggacugggcauuuguugaaaauucuugaggcuguugaugggcacaugggcucauuauacuaugcucuguacuuggguauguguuuggaauucuucacgguaaauguaugagucuguucucauguugcuauaaagaacuaccugaaacuggguaauuuaugaagaaaagagguuugauugacucacaguucugcaggcuguacaagaggcauggcuugggaguccucaggaaacuuacaaucauggcagaagggugaaggggaaguaagcacgucuucacuugauggcaggagagagacagcgaaggggaaugugcuacagacuuuuaaacaaccagaucucgugggaacucacuaucaugagaacagcaaggggaaaaucugcccccaugauccaaucaccucccacaaggccccaccgccaacacucaggaucacuauucaacaugagauuugggugagggugcagagccaaaccguaucaaugaaguuuuaaaaacacuuguuuucaucaucuuauuguuucugcacaaauaaagucuuucacuaauuuuuagggagcuuuuaaccaagaaccaguacaacuagauaaguagcagggaguuuuaugaaacuguuaccacuucuauagaacagagcgauuaaguggugcuaaagugagucagaggugucagagugugaggaggaaucgacugugauuugacucuuaaugugaacagaaucgaucguuuuauggcacuuacugucuguguuacucuucucucauauuuaguacauauuaccuggccuugucauuauuuguacuuucuuuuuuuuuuggagauggagucucgcucugucguccaggcuggagugcaauggcgugaucucggcucacugcaaccucugccuccuggguucaagcaauucuccugccucagccucccaaauagcugggauuacaggcacccaccaucaugcccggcuaauuuuuguauuuuuguagagaugaggccauuugaccagauguuggccaugcuggucuugaacuccugaccucaggugauccgcccgccuuggccucccaaagugcugggauuacaggcaugagccaccauccccagccuauuugucucucucuaucuagggugucaauuucuaaaggucuggaauuauucuuauacgcuuuugcaucacuccucuuagggucagaaguuuuguaccaaaaaguagcugaagguuauaugaagaauaguucaauacauaauugaaagaaaaaacccuggaaguuuaugccaaugucuaccucauagcuuccucuuugcuuugucccuuuuagacacaguuuugacccugagccacaguccccuccuuuuucuucccucuucuuguacucacagcuuuaucuuuagucuuucuccugcgcuuauuaacuauauuauacccauuauugcacugugaacaaaguuuacugcuucccuuacuuaaucauuccugccacucacuuagcauaauuaaagcuuggaguuccuggugaagcccuauacaauaacagucacuucuugugcccuuuugugacucaaaaucccucuucccccaacacacacauacacauacacaugcacacacacacgcauggacauguacacacauacaaaucccaccuccacacucaugggguaagcaggaaggacuggcaugcuccccauuccccacgccucucucaaaccaugguuuuucaucucucaacagcauccucccuuaaggaaaaaaacaguggaggugguuucagauuccgaaaguguauaacccucuaaagcagcagccacauaaucaacuuucugacauccuucauucccuucauaaacgaugcauaccgauacccacagcacacuaaauacucuuggcuuauguguguuuucuggaaugcuuuuguacuucugcuuccaccuggugaggugcaugcuuacuaagggucacuuauuuguacccaagcccuugguguaaguuauacugacuguugugacuauauaauuuauuuaaauguuauguaaacugaagaaauaugcauacaagaaagagacuuauuucuguuaaaaccaaguugaaugcuuuggaaggacucuuaaaaauguuaugaaauuacugugaguaagaaaacgauuagauuacagggcagcacggaguaaaaaucuuaccuggaauuuauacccagguugcuucacaaguaucuuuaaguuuauuauacuuuaaagaaauaggaauuggaauucauagauguaagugauauuguucauccaagaaagacgaacuggaaccccaaacugauccacauucaaaggaaaggccuuauaugaauauacugacagauaaauaaauuguauguucaaaugugcauuuuaaguuaauguuuacgauaguaaucacauuuuacgguuucccacuuuacccaacauuuuuguuaaucauccaacuccuuuucccaguugggauaguuaagaagacuaaugccauuuucccaaaauaauaaaagugcucaucgaagaaaguuuagaaaauaugggaaaagagagaagagaauaaaaauuaccuguuuucauaauuuagugagaacguuguuuuauacauuugaacucauaucagauuuauagauagguguguagcugcaaauauugugucuaaucuuugucuccgugaaauccauaguauuuuugaauuucucuaucuccagcacuaaugcccaucacacacacccuuccuggcugaauuugauaccccaugguagaagccucuauccugcugucugcgucaguauuuuggaguucuuccugugucuaaucugugauacucauuaucuguauauuuaaauggucuuuccagccaagugugcauaaccuuuauucugcagugggggauuggccuuacaucaguuacuuuuucuacccuggcaaaugggcuaggcaaccuagaaggaaaccugcaggccucucuuuuccuuguagaccaaagcagaugucuccagucgacugucugcuucauuuccuauggacccuccucuuaauuuuuugagcaucaaaugcuuaugcagaagcucuuucuaccuccaaguaagacugagagagaauaaagaaggcacagagcgccaaagguugaaaggccugaaauuucuucugugucuucuagcuaaaaggcacuggagucuccauccccaaaugccccaggagcaaccaucagaaggucucaagaggcccaggccucaccagcucuucuuaccaaucccugccaaguguugccaaggaagggaagaaauggaugucagccucuuuugacucuuagugaagucuuacuguugccuuccucuuuuuagaguaguugguauuuucacccuggcuuuguaccuucuuccacuauccucugagauuucuuaguuaaucuucuaacucagaaucucuauagcuaaucuuuuauuuccuuccuuuuguuuuaagcaguuggauguuacgagaguaagggcuccagguuuuaaugacagcccuacuaaugauuuucuuagcugugagaauccuacaugguuuaagcauagucagauguccagcccaaaugacccugugugggcgucugugugugagccucuuugugugcacacauguguguuuuauagguuuaauaaguguuggcuaggugcagugacacacaccuguaaucccaacacuuugggaggccaaggcggguggaucaccugaggucaggaguucgagaccagccuggccaacauggugaaaccccaucucuacuaaaaauacaaaaguuagacgggcaugguggcaggcaccuguaaucccagcuacucaggaggcugaggcaggagaaucgcuugaacccaggagacggagguugcagugagcugagauugcgccauuacacuccagccugggcaacaagagugaagcuccaucucaaaaaaaaaaaaaaaaccacacaaacaacaacaacaaaacaaguguuaagcccacucccauccuuagaucucuugagacagauuacagaaaacucccauguagaagaguagagacaauauuuuuauuuuugacuagacaguuguaucaacauauaaaaguggggugcaucuuguguagcauuaauugaaugugcagaacacugaaacaugccuccuugcugcuuauuuagcaccuuaguaucuaccuuuacacaucuacaaauuauagaccccagguagugaaugcuagaauuaguguuguaaagcagguccuauuauccuuugggaggugccuuccacugugacccuuuucccuccuuucuuuguaagaagcuaggaaauaaaauggaaaauccugcuguaagaucauuuugaaaguauaaacuuaaauacuugguguaaaaaucgauucucacagcgaugcuaaguugccuguguuguucuuacaugcuauuacugcuuaauauaauagcacacaagugguauccucagagcgcguggcauuauucugguucagaaauaaugucuugugcucucacuuugggcucuucagguuacaaguaacagagacccacucacgcuagcucaagaaagauuuaucaaaagaaccugguaggucccaugauaauccaaggacaggaagcacuuuauaguuggagcuauagaaauuggaauuaucagccuggccaacauggugaaaccccaucucugcuaaaaaugcaaaaaucagccaggugugauggcgugugccugugaucccagcaacucgggaggcugagacaggagaaucgcuucaacaugggaggcagaggcugcagugagcugagauugcaccacugcacuccagccuuggugacagagugagacuccaucagaaaaaaaaaagaaauuggaauuaggaaacagaaaacaagguuguuuucugugugucuuugcagcuggaguugccaagucauggccuuuccgccuuucucugugccugcuccuuuaccuguuuuugucuguguacuggacgacucaguggcagcuuguugggcacucuaguccuucacagaucaugauaauuuucaguguaccauuuuggcuucugcccugccugaucaccccaacugucuugauccuaaauucucaaaagaugcauuuaauuaacucagcuuaucuuuuuuugcccacgaucuugauucugaauucccaaaagaugaauuuaauuaacucagcuuaucuuuuuuuuucuuucccccuacgaucacaaguuuuaggauucugaucaaucuggagauuggauauucugcucccacucccacuugcccagucugcugugguuuggagcgugaggugugggggccuacuccuuuaaaaaaucuccauuggaucccacuugggauggguuugggguaggaaggaugaugauagacaugccuuauuagaauugcuuugagacuugaaaggguuccuaaaaggcagcauaucaauuccagaagguggggugcgggccaguguugucucuguggguucuaccauggugcacuguggccagggccaaaaagugcagaaggugaauauagcccaucaaccuuaccuucaucuucagauacuugcaaaauagaucucggauucagguauggcucuaugagcaagugaauaugcugauagagggccgugucauugguuuugacgagucugugaaccucauaucagaugaugcagaagcgauucauugugaaacaaagccaagaaaaccccugggccagaucgugcuaaaggagaucauauucugccacaaaaugucucuaaccagaaaugaucaaggaagugagacacuauugagaacuuguuuuuuuaggugucauuuguugggaguauaguucuaaaaugccuguucagauuguuuccauuaucuguauauauuauuaccagaugacaguaaaugcugugggauuguuuuuauuaaaaaauaaaauaaaaacaauuaaaaacagcccaucagcacuuuucuaauguuuucuggucauuuacauuuaccuuuuugugacacuggcuucuuaaacuucagcuuuaugauuuucuguauucuguuagacucaaaguuagggaccuuggcaccuuccuuuuaauuuuuucagcacucacucaaauucauccuaguccagccucucauauuuuuugucucaaaugauugcaugcauucaagauagaggcuaauauuugauagcagaguucuguggugaauuuugaauaggaaaaucugaugaaacaaccuccauuaucuguucaauuuuccugugugcuauuucuuaaaacggauucauggcuaguuugguucuguugggcugauugcugugugaaccuucacccuguucucagccuuuuaaaauuuuagucuaaugcauuuacaguuuagauauuuuaaccuggggaaguauguaugagccacaccugcaguuuuguuaauuacuuuauaaucaguaccuuaaaacccuugaaaacagauuccuaaaagaaggcaugucacuuauauucaguggcaauaauaauucucuaauauuuucuucuaaagauugaugguaaauauuggccccaguaugcacauaaaaguaauuuggcaguuaucuuuuuugaaauuuugauuucuaauuuaaaaaauagaaaaguuugauuagaaagcuuauuauaaguagaauuugcauuuuacucuaaauguaaauuacaagccaugaguugaauuuugguuuugauggcgauuuuuuaaagcuuuuucauuuuuauguuaaauuauuuuacuuaaacagaaauguccuguuugaguauauaagugcuguuaccccagaaccucauaaucauucauauccugggagagaugaguggcagaauuagcgugacucagacuugauuuuccagggaaguggccuagcuucucuuccgaauuaccugcuaaguuuuaagaauguggacucucaggccucaacauagagcuacugccucggaauuuccagggguuccuuucauaaucuguacucuuucuuuuaaauuugguaacgaaucccacacacagcuagauuggggaaugagucuaggccucuaguucccagucucaccaaaaggaacaccucccgucaguguaauuuacugcauguugagaacuuaaucaugggucagaggaucguuccauuuaacaaaugcuaaguguguauuguguccaaggcauugcaacaugcauuguguccaaggaauuuacaaagaugcauaguauauauguaauaccauuaaugcccucaaaauacuuuuggcuagcugguguaugugagucuacauugugaugacuugaguucuucaaggaucaucaugcaauucuuaauuauaacguugauacacuguaaguuguagugaugcuuuaaaaauucuuauucgcacgugguuuuaggagcuguacugggucuuuguguuucgaguuggcugcuucugucuaggcuuggucuuucacauguuaaauuuguguagcacauuuucuuaacaacgcugucauaaucaugcuacugggcaagcgaauuccaugaggaauuagcacauuuaguggguuuagguuauuuuuguuuuguagugaauggaagagcacuguuuaaacaucuuuauuacauaccuggaggaguuguuuugugaagauguguuggcuuuguguaucgauaaugaaugaucguuuuuagguuucagugcuugugaucuuggaaguuuguguucagcuuugugcuuucacgucacuagguggagauguagcauuguuuggcggcauaggcuaagcaagaggagugagucuugauuucucuucuuuugacaaaaguacuuuacagauauuugauaagguuuauuauagccuaggaaaacacuuguaaauuuaguacaauucaaaauuuuuaacuuuuuuuucaggauugaaguucaauccuacuuaagugucuauuuucauacugaucaacucuuuuaaacauuuuuuuucuccucuuacugcuguuuccuuuuugcugucccucauuauuucaccuugucugaguuauuuuaaugucucuaucuuugguucuuuauagagauuuaauucuaaaaguuuaguaaaggaaucagaauucuuacucugaggucaaauaauagauaauuaauuugguagcaauaugaagucaaugaacuaaaauuuauagucugaacauacccuaaucuuaucuuuguauuauuuuagguuaauaaugucaauuuuuaacauuaacauucuguagggcuuacuuuucccccuuugcuuccuuccuucuuucucucaccucuugaauauuaaacaagcacaguauuuacuuugcacgguauugauguggggaauauaaaggaaauaagagccugucuucaaagagcugauaauccuguugagaacauuccaaaugcgcccacgaagcagcaguuuucuacuccuagguauauacccaagauaaaugaaggcauauguucacacaaacauuuggacauaaagguucauagcagcacuauucauaauagccaaaaaguggaaacaacccagaugucuaccagcugaugaacggauaaagaaaauaugguauacuuguacaauggaaugugauauagcaauaaaaagaaaugagauccugauacaugcugugauguagaugaugcuugaaaacaugcuggugaaagaagccagucacagaagaccgcauauuauuccguuuauguaaaaaguccagaauagcaaaucuauagagauaaaguagauccaugguugccuagggcuggguggaggggaguaacugcuaauggguucggaacuucuuuuuguagugaugaauauguaaacuugauuauagugauuaaugcacagcucugacuauauacuaaaaaccacugaguuguauguacuuuuuuuuuuuuuuugagauggagucuugcucuuuugcccaggcuggagugcaguggugugaucucagcucacugcaaccucugccuccuggguccaagcgauucuccugccucaaccucccaaguagcugggacuacaggcacccgccaccaugccuggcuaauuuuuguauuuuuaguagagaaggggugucaccauguuggcuaggcuggucuugaacuccugaccucaagugaucccccugccucggccucccaaagugcugggauuacaggugugagccacugugcccagcuguguguacacuuuacuuucaaugagugaauuguauggcauaagaauuaucuccaauaaagauuuuuaaaaaguaaauuaccaaaagguuuaaaauuuaucaaacuaagguuguuuuuuguuuguuuguuuuuguuuuuguuuuuugagauggagucucacucugucccccaggcuggagugcaguggcacgaucucggcucacugcaaccuccaccuccuggguucaagcaauucuccugccucagccucccaacuagcugggauuacagacgcucaccaccaugccuggcuaauuuuuguauuuuuaguagagauggaguuucaccauguuggccuggcuggucuugaacuccuggccucaagugaucagcccaccucggccucccaaaguccuggguuuacaggcgugagccacugcacccggcucaaggacuguuuguugaccaucuacacaggcacuauacgaaguucuaugcaaguuaugaaacaaguguuaagacacaaacgcugacuucagauuguuuacaguucgagagaaaaggcauauaugcaauguccaaugucuuguaaugcaccuuugcuuucugaaucugcuccccaucuuugaaucuccugaauucugucuuccggcuguuucuguaauggcucuuaucuucuuaccauaugucuuuuauuuuauccuuuaaaaagcggacuguugcuccucagacuuugauaaauaucagccccagccuguuaccuuuaacuaacucaaaggaccuuuuaaagugauaguggcaucuccaguaacuuaaauuguguggcucauggaaaucuauucauucagcaaauacuuacugagguuucacuuacaaauaacucuggcaaaucacaagacuguuggcauuauuauuuuuaagaucaugacaaauauucuuuugcuacaauuuagucagguugcauggugcuuagaacguauagucuugaguuccuaaauuuucaugaaaaauauauuuugguaauaguauaaguuaaacaaguacguguuugguauagagcuagcugaauugccaguauucuaguauguugacauuguuauggucauuaaaacuuugagaaaagaaagccaggcacgguggcucaugccuguaaucccagcacuuuugggaggccaaagaggguggaucaccugaggucaggaguucgagaccagccuggccaacauaaugaaaccucaucucuacuaaaaauacaaaaauuagcugggcgugguggcacacaccuguaaucccagcuacucgggaggcugaggcaggagaaucgcuugaaccugggaggcggagguugcagugagccgagaugacaccacugcacuccagccugggugacagagugagacucugucucaaaaaacaaacaaacgaacaaacaaacagaaaauccuuuaagaaaagagagauuggcugggcaugguggcauaugccuguaaggccagcuacuuggaaggcugaggcgggaggacugcuugagcccaggaguucgaggcugcaaugagcuaugaucacaccacuguacucuagccuaggcgauagagugagacgcugucuuggaaaaaauagaaaagagaaauuuugcauuagucaugguaauucuauuaaagccacaaaaggguauuuuguaaaagguuguaguugauuaauucuacauccauccguuuagacaguuuaucuuauguaccuauagauauauacaugcacaugugcacacacacacacacacacacacacacacacacacacacacacgcuugugccuauguuauuaguacagcagcuaaacuuuuuccuuuucuugcagaugcauaugaaacagccaagaugcugugugaacaguauuaccugguagcuccagagcuggaaguugaagaauucaaugguaaaagaaaacuaauuuuaaccuuacauucaaaaaagcugacuaagaagcuguuuauaccuaagccauauuucagugagcuccaaaaauuauacugauuuuucauuuucuuauaucuuuuuaaaacuuucuacgcuuuuggucaaccagauauauuauuguaaggaguuuuuguacaggaauguguaauguguuagaccccagaauucuuggaacagaaauaaucaagguagaguauguagaaagguauaaauaggcccuucucaaaguaacaaaugcaagcagucgaucaacauauggaaaaguguuuaacuucacuaaucaaggaagugcaaacaaaaacacagacaaaugccuuuuuuuuuuuuuuuuuuuuugagaaggagucucguucuguugcccggguuggaguacaguggugugaucccagcucacugcagccucugccuuccagguucaagugauucuccugucucagccuccugaguagcugggauuacaggugccccccaccaugcccagcuaauuuuuguauuuuuaguagagacgagguuucaccauguuggccaggcugguuucgaacucaugaccucaggugauccacccgccucagccucccaaagugcugggauuacaggcgugagccaccgugcccagccaaaaaugccauuuuugucuuucaaaaugacagugauuaaaacauuuuaaugcuuugaauuugugcccauaaaaauacuuucucaccagcacauacauuucuuguauaagcuaaaagugguauucccuuucuaaaaaaugccagcaauguucuuucuauuuggcccaguaaauaaguuaauaauggucauauucuuugguccaguaaauuaaacuucagaacacuuauuauaagaaaauagaggcuggacacagugguucacaccuguaaucccaauacuuugggaggccaaaguggguggaucucuugaguccaggaguuuaagaccaacccgagugacauggcgaaaccccaucucuacaaaaaauacaaaaauuagccaggcgugguggcacuugcuuguauucucagcuacuugggagacugaggcaggagaaucacuugaacccgggaggcggagguugcagugagccgagauagugccacugcacuccacccugggcaauaguuugaaaccccaucucaaaaaacaaacaaaaaucuaugaaaauagagaugcacagauuuauguacaagauugaugaucacaguaguuuucuuauaaaguuagaaaacaacccaaauuuuccacaauagagcauuguuuaacugaauugugguacacccauuagauagaauacuaugcagcccuuugaaauaaugcuuuaaacgaauaacguaugggaaaaauugagauuuuuaaaaaaauacaggcuacaaaaguuuauaguaguggaguucauuggaaaauauuuugaaggauuuauacuaccaaaauacaaauagcagcucucuggguaaugggguuacagaugauuuuuacguucaucauaugauuacauauuuauuugcacauuccuuuuuuuauuugcaaauuauggaagagacaugcuuaucacaaaaauacagauacagaaaugugacugaaaagggaaaucccccacaacuuucucagucccauauagagcuuugguuuuugcauaaagcauguauagcuuuaacccuauuuauaacgugguuuucacuucaccuugaagaccuuugcaaguauuaaucucauuuagagauuauccauaguguaacuuaccauaauuuauuuaacuguuuuccuauggguauacauuuaggauuuccuguuuuccuauauuccauauaaugagcuaugaaagagugugagagguggggaggguggaaaaauuugugaacguauggaaguauuucugcagguuggauuccuagauguggaaugacugagcagggugugagcauuuacaguuaaagauaaaccaggccaggcaugguggcucacaccuguaaucccagcacuuugggaggcugaggcaggagaaucucuugagcccaggaguucgagaccagccugggcaagguagcaaaaccuugucucuacacaaaauagaaaaauuagcuggacauaguggcaugugccuguaaucucagcuacucaggaggcugaagugggaggaucgcuugagcccaggagguagaggcugcagugagccgagaucacaugacugcacuccagccugggugacagagcaagacucugucucaaaaaaaaaaaaaaaaaaaaagauaaaccaaauucccccucaggaguacacuaaaaauguauuucucuuauaaugagauaaaacugugaaaggaguucaggcugcuguugaaggacauggccccuccauuugacuagaaggcauggagucaaagcugcuuucaaggucucuuggguucucugagaagagucauguccccauugaauaaauauacuaccaggaccgagugggcuugucuggaguguuccugaugagaaccaucuuaauauucuuucucucucuuccuauggacuaggcaggagcugaucucacaucugcagguaguaacaaauugcucuuuugcgugaguggcagccucccucauucuaaaggccaaagcagcaggccuguucuugcugauucccaagugccagccaugucagcacauucuguccccgcugaggcugucaugcugggcagcucacccaccaggagaggagcuuuccgacucuuuuuggcauugucucacgaauuacagaagcccccuuucgaucauguuuugaagccccuuguccuaucacuaagauaaaugaaugcugguguuucuagguagcuucuagcuuuauguugcuuuggguaguguagugauuauuuuuauguauaaguucuuaaugcuagagcucucuugugagcaugauuaaggaaugugcuuucgccuuaacaaguucuauguuggagaugcagguuggagguugauccugaacaccuuaaguggaugcuuuuuuauucuggaaggagaacugucuggaaauaaaauuccuuauaucuaaugguauuucuuaaaugcuguuucaacuaauggcauuuggagcaaugacuguacaaaauagagacuucauuauuucugaagucuugagcaugacaaaccuaggccauuuuuaaauugacuuuuaaaaauguacccuuagauggaaaauucauauucuacuuauuuuauaagucagcaaacaucuauuaagcaucugcuacuuaacagccagccucgagacccagaacuaggaaagagucauggacaaaagcauuugacaugguuuuaaaaggaaggaaagaaaucuaaacuguaauguucccaaagaaaagugcagguaauugagcaagccuuuagauggcuccuagagaauguuguuuaaacugaaaaaauaaaaauaaaaaaacccacuauauaaaagguguuugccuuuucuugagauuuggggugaaaagguugaauucauaaggcuguuuauauaacuaaucaugccauuugguacaagauaaacugagcacccagcuuguuccucgagccccauuaaaaugacaauaaaggagccaggcgcaauggcucacaccuguaaucccagcacuuugggaggccgaggugggcggaucacuugaggucaggaguucgagaccagccuggccaacauggugaaacccugugucuacuaaaaauacaaaaauuagcugggcaugauggcauguuucuuuagucccagcuacuagggaggcugaggcaagauaauugcuugaaccugggaggcggagguugcagugagcugaaauugcgccacugcacuccagccugggcgacagagcaagacuccaucucaaaaaaaaaaaagaggggaaaaaaagaaauaaaaauaaaaugacgauaaaggaauccaaagaaaagcagcaaaggaaagcagaggagcucauuaguggaccagugccuuaguccauuuaggcugcuauaacaaaaauaccagagaccaaguggcuucagcaaccauuucucaugguucuggaggcugggacauccaagaucaugguuccuggagauuuggugucuagugaggacccaccuucugauucauagcuggcuucucacuguuuccuuccaugggggaaggagcgagggagcucucuggaguuucuuuaaacgggcauuaaucccauccauaagggcucugcccucauaaccuaaucaccucucacaggccccaucuccuaauaccaucacaucaaggguuacauuucaacauaggaauuugggggagacacacacaaacauuccguccauaagaggcaugaaucccaacuuuugaaagagggucacuagauggaaguaugcugauuggugggacagagcagaagcagccacaggggaggaggcugcagcagagguggcaacugguuugccgaagauuguccuggagggacucugggggcagggccagguggugcaauggacuggaaugggaagggaaggcagaggguaggguuaacugaaagcuggucuaagaaagagcauggagggaugacgggaggcagcuguacucuggccggguucagccugccaacaggcaacuaaguauuuuguucgagaacaaccuaggaagaauuagggcuuuucaugugaguguuguuacccugcagcaaagcccuguucguuuaagcauuugggggccucucugcucagaggcccauuuacuaccugcucauccucaagccaaguugaaaagucuugaccaguccagagagcucuaagucaggcuucccacuuaauggagagccccagggggauaugaacgccagcucccucauacagugaauccgguucuucauucucaaacaagaauauugcaaccaagauggaucagaccuucagcaaaagccagcagcaagaaccaaaccuaacuggcauuaaacuuaucagcucuacuguuacugccagaaaccccccuuuugaaauucugagagaaaaucauuucaaaccuagaauucucuaucuagccaaaccuuuaaucaaauagaucagagguguaaagauugacagaugugucucccaugcaucccuuucugagguagguuaccugacugccuugauguuauguauaauaugcaucuaagaaaggggaaaacauucuagaacuucaaucaaaaacaacuuuaggaugauggcuaugcagcauguuugcaaagcaauugauucuaauuugaaaaaucuugaagaauggacuggauaccaugcaguagguauggaagcuggaaguagguauggaagcuggaaguagguauggaaacuggaaguagguauggaagcuuccaguaagcuggaagaucuuagcgaaauggcauggaccaacuaugaagcaacccaaaaaggguagcaugauguugaccaguuggaggaguauaaagaaacuccauuucauguuaaggcugggaacauucuccuccaagggacacaugaaucauuguuauugcauuaauagggaagaaaaugucuagguacacuguugugguuguucuacagugaucaauauuuacauaguuauaaugucaccaacacuugauuuucuacuuucuugaaagaaccuauaggcaauuuacagcaucccuaauuuggguuacagaacagaauguaaauauuaccaacccaaagacuacagcagaaguaguaaagaguggcugccucuggguucagacugaaggauaagauaggaaagggggaaggacuuuuguuuuucuucuuuuguuaaauuuuuaagccguuuacauauauuacuaagugauuuuaaaaacaacugcucaggccaggcacgguggcucacgccugcaaucccagcacuuugggaggccgaggugggcaaacaccugaggucgggaguucgagaccagccuguccaacauggcaaaaccccgucucuacuaaaaauacaaaaauuagccaggaguggcggcgcacaccuguaaucccagacacucaggaggccgaggcaggagaaucgcuugaacccgggagguggagguugcagugagccgagauggcgccacugcacuccagccugggcaacagagugagacucugucucaaaaaauaaauaaauaaaaauaaaaauaauugcucuuugaagaguucgggauuuagacucaaaagcucuuuguucaggugucugguuucggugccacuucugggaccacgggcaagucacacaggcuucccaaagccuguuuccagaccucuaaacaccaccaccccucuaggagccaggaaguguugucaggaggagucaauugaauaauguaugugaaagcucuguguagacugcuaagaaucaagcaaaugugaacucuaauuuguauuacuguuaauuacuuuauuagaggaaguagcugguugaaauuacagcauucuaccugagagaguucauguaguuucaaucucuuaagugauuuugggucaugaggaggaggaaggacuguauuuuugagcaucugcucuguaccgcacacuguucuuauugcuucaccuggguuuugguguuucucagauugucuucagaugacccauggugcaaggggaaaagaucauaggucucuagggguuuaugugcuagcugcuugagaaaaaguuaugugaaccuuacauucuaugcuauaagaugccuuguuugucauaauuuaacaaaacugaacacugccauuuaguccaguucaccagcccuuuuuuuuccuguugcuccacauucucccguggaauucccccuggggucaguggcagaagguagcccccaauuugaaaaacaccaagugauaucugacuggccuucuguaauacucaggauguuauggcauaggugauaauauuccaauucugcucaacaaaguuucaaagagauugagugauuuauccaaggucacauagcugguaagugaaggaacugggugucaccccagguuuguuugauucuaaagcauaugcuuuugcucagcccugccuuuagagguggaaacucaaauuagccuuuuauagagcucuguuuuacacacuuggaaaauagaaugcaaacaucauucuugaauuucuccuacuuuggguccuuauugauugaugguuuugucucuguuuucagccaaagcgccagacaaaccuauucaggugguuuaugugcccucacaucuguuucauaugcuauuugaguuguucaagguaaguggaauuuuaaaaacguggaaagaagucuucauuuuaaauuacuuugauucagggcauaauggauucauuagauuagcauaagaaaaagguuuugcauaaccauuuuaaaaauucuauuucugauauccuguggguuuuauaauuuguacacugugagaugagaaauugcuguguacacuauaguuuuugugaauauuaguacauauugauuuugaagcuuaauugcacuuuagugauuuuauguaaaauccauacuguuuuuucuuuaguuaugagauuagagaugcuuuuuaguuuccaaaccuggcaaaggcuuuacuggugauagccagaucaaaauaaaaacauguuuauacauauuuaugcuucugaaaauuaaccacacugguacauuagugguuguuccaguccugagagauccugcaacucuuuuauaaaauauuugaaucaauucagaagauccaagagaggcagaggagaaagauguagaugagcuggaccaaaagaaccaccccucccccccaccaaauucuuuagagucugcaacuuaagcuguugcuuuuguuaaucaguagcuaaugacauuuacaguagcaguauuacaggcacaaggcauuugagcuaaaauuucauuucuuccaaugcgugaaacacuaaauugaacaccugaaaaaucaguuaugcugauuugcuuccaaaaauuagaauguuacugauguaacgcuuuaagguugaaaugggcauucaauugugaacuuucucuucagcagcuguggcuuuuucagaauuucuuuuuaaccaauauuucuucuacuuuuuucagccaaaugauuaauuuuugugggaagcaugcauccuuucaguuuuucugccuucuuuagagaaaaggugcucuauaaaugcagacugauaaauaggauuuaaagugcacaaaucagccucugcauagccucauuacaugcgauaaaaacauuccucuggguugaguugaauaauuuaaauaccguaaagcgaaaaaaaaaaaaaaagaggaagaagaagaaggaaagaaaaauaaauauuuagcauguuggaugaggcuaaaacuaggugaaaaacaaagugucaggaaauuuuuccuugauuugagcacguuuagcuaagcucuuuagagggaaaaaugccauaaaaauccaacuaauauuugccccaaaaaaggguuguuggguauaagucaucuugcgcuucuuucucuuuaaaaauugugguuugugauucggcaguaugauuaauaaaaagaucuuauuauuuuagaacucaaugagagcgacaguugaacucuaugaagacagaaaagagggcuacccugcuguuaaaacccucguuacuuuggguaaagaagacuuauccauuaagguaacuguuuuaugugcauguauacuuuaauuaucaguugugauuuaauaguaucuagacauugaaaaaucagagggaaggaaauugacauuuauugaguguccuguuuguaaguucuaugcuagauccuuggcuuaaguuaccuuauuuaaacuucauuagaaccuuguuauucagggaguugaacaagaccucaacaccaagccuguuggaucccacuguaccauucggccuccuuuguuuuacacuguucacaaaggaaccguaugucacugggggauucaaaguccuuguacauuguggaguaaucugcuauguacuuuauuuaaugaacccauugccuccuacuaaguauagaucaacuucuuuguuuugauuguuaacauuuugaacauugcagaucagugaccuaggugguggugucccacuucgaaaaauagaucgucuuuuuaacuacauguauucuacugcuccuagacccagccuggagccuaccagagcugccccuuugguaagcaucugaaagugcugcugaaggaaagaucauaaacacaggaaggggcucagagggagcugccucucuccccagguugucacauuaguguaguugauuuagaagguugcguguauuaugguuuggaggagggagaauuuuuugccuuggcuacuugcuuugugaauccuuuggacuucaauuuccucucugauuugugucuaagaaacacuccuagcugagugccucauucccauauacagagaaaaaguaccucauugugguaagacugcuacuguagcaccauuuuccacuuugugcuacccuuggaagggguggaaguugccagugggugagcaaagggacaguacugaaugcauagcugccgcuugguccugcgcacucuggcgugcguaccacagaggcgcgaaucaccuagugccuuggaaucuccacugucaaauuuguuuauauaauuaaaauguuaaauuaugaaaacauuaaauuuuuauguuaaauaacauuagcaugaaacauauaggugguguaugcauuuucagagcccuuucugucucacucuggaaauaaccuucagcccuguuaaggcagugagaaaagccacugguuaccaugguagcauuuagauccugguagggccacacuugcuuccccugcugaguguuucuaauugacaaacaacaauugaacccuuugucauuaaacacagcaacauaucuaucagucugcaaaaugguucaggguauaaauuaaguuucauuuuaaagucguaccugacugauaagcacauaagauuauauuuuauuuguaugaauaaaaucaaacacuuugcaucauuuauuugagacagaguuuguuaacucagcauguuggaaacaggaaaucauuuauauaggagucgagaaaauucaugaaagaucacauuugagaggcguugccuugacuaggcucuggcaugcacuuaaauacacaucaaaaggaaaaaaggcaccacaaacaaaucuagcaccuuccccaguuguuuaaaagaaauauagauugucucuuccaggucuuaaaauagcaucuugaggauagcuguuauaucauagguuuuuuuucuuauugaaacugagggcuuguaagagacuuuuaacaguuaacgcaugcgcacucccauuguauagaugaggaaaugaggaaaugaccuuguccaaagucauugaacuaauuaacugcagagcuggugcuggccaugucuguguucuuuccaguguacuacguggccgaagaaaugcuucugcuaguggcucucccaguuaggaaacuggccuguaauccuagcacuuugggaggccaaggcggguggaucacuuaaggucaggaguucgagaccagccuggccaacauggugaaacccugucucuacuaaaaauacacgaaaauagucgggagcaguggcgcaugcuuguaaucccagcuauucaggaggcugaggcacaagaauggcuugaaccugggagguggagauugcagugagccuauaucaugccacugcacuccagccugggcgacagagcgaggcucugccucaaaaaaaaaaaaaaaaagaaaagaaaaagaaacuguccucagcuuuaaagugggcacauggauauguacuacuagaaaacauaauuuccucauugagcaacuuacacuuuuacaccuuuuacaccucugugccuuuacaugugcauuucuguuugagaauauccacccagcgaacuccugcugauccuuugacacucugggaaaccuuuccugaaccucagcaaauccgagguccagaccccuccucugcauucuuugggagucugggcuuacacucacaucugcauuggccucggaguucucggcucuucuguguuggacaugagggcaggcucugggccuugcuugaacauagaaggcagauuugcucacaucucuuccuagagugagcuaguuucuuugcugugguuaccugagucacuacuauaaauaucucaucuucacuacuggccauauucagcaagucccaaagcccuuaaauaaugggguacguucuuuuacccccugcccuuucaguuaaacccuacccugagggaagguaucaaggagagauguuagaaaauggcagaaaucuguguaacuucauaaaauugcugcuccuaguagccauaguaccagccucaauuuauuuaguuuuacuguguuaggcacugugccaagauuuuauacuuguuauauuauuuaauccuuauagcagcucugaggucaguuuuuuaucauauguucagaugaaaacauggucucaaagagguugaguaaacugcucagagucgcacagaaaguggauuucaacugggucugucugagucuaaggcccaugugacucugugcacaugguccccugcccuccuuccuuaaccuuguucauagauuuaaccagaagugaggaagcuugguguuacaucuccuuccccacccugccccacuaccaccacaaaugguauuacauuuaguuuugauucuuacuguucuuguccauagaacaccuguuauugacagucaggauuccuugacauagagauauaggaggguacugaaaauuuuuuuaaucucuaaaaauaccugaacuacaauauaccaaaauauucucacauucccggaaccuuaguaguugccucucagaaaauuguuuuccuuuccauguucucgucuuguuacugguagauuuguacucagcacugcgcuauugauuuucacuugcaaaagcaaggaaaucugaucaugggacuuugaaaugaugugguuuaguuuugucaucaggucacauuccacuugauuuggaaugugcuuuuguguguguguguguguguguguguguguguguggagauggagucuugcucugucgcccaggcuggagugcaguggcgccaucucagcucacugcaaccuccaccuccuggguucaggcgauucuccugccucagccuccugaguagcugggacuacagucucccaccaccucgcccagcuaauuuuuguaguagagaugggguuucgccauguuggccaggcugaucaugaauuccugaccucaagugauccaccugccucagccucccaaagugcugggauuacaggcgugagccacugugcccggccuuggaaugugcuuuuaaaaaaaugauaaaauuuugcuuuaaaaugcuaaaaaagcauuagucaaaaauuagaauauuucuauuauuauccaaacauauaagacauguuuuugcagggugaaaauaaagggguuguuugccauagaagaggauauacaucauuguaaagguugagucaguaauuuauuugauuuaaaucugaaucaagaauuuauuuuaaccuucucugaauggucaucauauaaaauguguuagcauuugugccugucucacuguauuaauuuucuuuucucaauaggcuggauuugguuaugguuugccaauuucccgucuguaugcuagauauuuucaaggagaucugaaacuguauuccauggaaggaguggguacugaugcugucauuuauuugaagguacugcguuuuauuuguuaguaugaggcaucuuugcuuuuuaaagcuguaaguucuaaucgcugauugagaacagcacuguaucaucucuuagauucaucucagauuuacuucauuuucccaugaaaaccauguuaugccucacgcuugauucuaugcucagauaaagcaaaauaugaaacguggagguauagaaauuaaaauacugauuuuggccgggcgugguggcacaugccuguaaucucaggacuuugggaggcugagguggguggaucaccugaggucaggaguucgagaccagccuggccaacauggugaaaccccaugucuacuaaaaguacaaaaaauuagcugaugugguggugcacgccuguagucccagcuacucaggaggcugaggcaggagagucauuugaacccgggaggcagagguugcagugagccaagauggugccacugcacuccagccugggcgacagaaugagacuccaucucaaaagagaaaaaaaaaaauuaaaauacugauuuuuaaaaccauaauuuuaaauugugacuuaaaaaacuacaugccuauugaaaggucugaucuaaaagaaggcagauuuucauaaacugaaguauuuuggucuuuuguuuuaaaaacucacuggcuuucccaaagcuacaagaauucaguaaucauaauaugguuauguaaaagauucauuuaauaacaaacuucucuguaacacaguuuuucuuauucauuggugaucauugggcuuuuauuucuaaacucuagaauauuuguaacauuuuuuugaauagguaauauaggcacauaauaaaaauuuaaaagcuacaaaaggaaaaaugaagucucuccucccacuggcccuaaaccgccaguucuguucagcgaagaucaccaccggucucagcgucuuauggauccuccuagaguugauucuacauuuauaaauaugggaaaaauagaauuuuucccacauaaaugaaauuucagcaccuucuuauuuuuuuuacuuugcaaucugucuuagagaucuuuccagauccauuuauguagaacuggcucauucuuuuaaacaguggcauaacaugccacugugggucaagcaucccuaacccaagaaucugcaauccaaaaugguugaaaaucuggaacuuuuugagcgccaacgugaugcuugcucaaaggucaagcuuaaaggaaaugcuuauuggagcaccccagauuucagauuuucagauuagggaugcuuaacagguaagcacaaugcaaauauuccaaaaucggaaaaaaucagaacuacuucuggucccaagcauuucuuucuuucuuuucuuuuuuuuuguuucuuucuuuuucuuuuuuuuuuuuuuugagauagagucucacucugucacccaggcuggagugcaguacugccaucucggcucacugcaaccucugccuccuggguucaagccaugcuccugccucagccuccugaguagcugggauuacaggugugagccaccacacccggcuaauuuuuuguauuuuuaguagagacaggguuucaccauguuggccaggcuggucucgaacuccugaccucaggugauccaccugccucagccucccaaagugcugggauuacaggugugagccacugugcccggccuguucccaggcauuucaaagggauacucaaccuauguaugugauaccagaauuuaaccaguuacugggaguauuuaucuuagaugcccaugcaucuaaguaaugcgauauuuaauauacuugaugguguguguuuauaaaccugggaugcaugagacuguaucucuuccugggcccuuugugagaccagucaccagguauagucaaaacaguugagcaucucaaagcaguaugagcugaauuaaaauauguuuuguucuggucauguguauuucaguucugauuuugaaugagcaaauguuuucauuccuuuaaaaaagcuuuaauguuuuccuggccagucuaaguaaacuacuaagguguaauuuuaauaucauuuugaaaauauguauuaagguuucugauguuuuaaauaauaaaauuuggguuacuauuucacuugagaaaaaugacacugucgaccuuugguguauauuuuuguuucuccaauaggcucuuucaagugagucauuugagagacuuccaguuuuuaauaaguccgcauggcgccauuacaagaccacgccugaagccgaugauuggagcaaucccagcagugaacccagggaugcuucaaaauacaaagcaaaacaguaauauaccaccuugauuuccauuacaaaguaucugauuugucugaauaaaggugucccacucacuguuccaggaauucuugcaguguagagguauucacaacagcaagcagggauuuggccugccaucaauuuuauuuaaaaagcaauuaaguuugcaguuuguccucauaaacguuguagguugaaacugaaaaauaaguuaaaaugaucaaucaagauaaaaggugaucuauccauccaauggaauauuauuuggccuuaaaaaggaaggacauucugauaugugcugcaacaugggugaaucuugaagucauuaugcuaagugaaauaaaccagacauaaaaggacaaauacuaugauuccacuuaugugaaguaccuagaguagucaaaugcagagacacaaaguggaagggagguugccaggggcuagcgacgaagauggaauggggaggcauuguuucauggguacaaaguuucagguggaaagaugaaaaacuucuggagauggaugguggugaugcuugcacaacagcgugaauguacucaaugccacugaacuguacauguagcaaugguuaagaugguaaguucugggcugggugugguggcucacgccuguaaucccaacacuuugggaggcugaggcuggaugaucucuugaagccaggaguucaagaccagccuaggcaacauagugagaccucugucucagcaaaaaauuuaaaaagguaaaauuagccgugugugguggugugggucuguaguccuagcuacucaggaagcugaggcgggaggaucacuugagcccaggacuuccaggcuguagugagcuaugauucgcaccacugcacaccagccugggggacagaauaagaccgugucucaaauaagaaaaaggugguaaguucuauguuauguauagcuuaucacaauaaaaaauguuaacauuauaaaggaaaaguuaucaaucacagaacaaguuucacuguuuuaugguaauaaggaaaauaaucuguaguuuucuucugacuauguacccuuaagcuucaacucuacuagcaacagugggguucugcuucauuuaacuuaaaauaauccuguauuaacaaaaaagcaguauaugugcauuauaaaaaauaagaaaacauuggcugggcgcaguggcucacgccaguaaccccagcacuuugagaggccgagguggguggaucacuugaagucaggaguuggagaccagccaggccaauauggugaaacucugucucuacuaaaaauacaaaaauuagccgggugugguggcacacgccuguaauuccagcuacuugagaggcugaagcaggagaauugcuugaacccaggagacagagguugcagugagccaagauaguaccacugcacuccagccugggcgauagagcuagacuccaucucaaaaaaaaaaaaaaaaaagaagaagaagaagaagaagaaagaaaacauaaguaagccaaaaaagaaggagaaaccucuguguucccaaaacccagagauugccacugcuauagcuucguguauauucuuccagauauuuugccauuuguguauauauguauuuuuuuugcaaaugagauuacacuauucauacuauuuuacaaccugcuuuuguuucauuuaaccaucccaucuuuccaugucaaugaucauucacugcaaccucugccuccuggcuucaagugauucucauuccucagccaccugaguagcugggauuacaggcgugggccaccaugccuggcuaauuuuuauauuuuuaguagagacaggguuuugccauguuguccaugcuggucaaaaaaaaaaaaaagaaagaaaagaaggaaggaaaggaaggaaaagaaggaaggaaaggaaggaaaagaaggaaaggaagaaaggaaggaaggaaagggagggggaaggggaagggaggggaggggagggaagggaaggaaaggaaaggaaagagcuaauggagcauuuuuugcuagaauauccauaaacacuguugcagaauuacacugagacccaugacaucucauugacccaccauuagugauguuaugauugagcauaguuuaggugauggcugucugaucccucugaguuauaguuauuuuucccuuuuucacuagaaaauaaucugugugguguuauuuuggcacuaugcaaauguauacuuacccaucagcuguucaccuaaugguuuuuaccccaauugaucauuucggccuguguuaaaauuaacacaguaauuuuauuuggguuuauaaaagaauguuuuuuuuuuaaaucauuccuuugucaauuauucuccuauaaaguaaagcucuuccucaucaaauaaggccauuuagguauuuugaaguacaguuccucugguaacuguuuaacuccuuccuuuuaaauuuaaagggacaauuaaauucccuucaaguuaccaauuuuccagguaagaaauauguuaaaagccaccuuaaaugguuaacaaaugaguuuauggcuuugucuuuuuuaguguuauaguagauuuuguuacuuugauauguuuuaauuggcacuuauuuuauugaagcauaacauauaguaauaguaaagugcacacaucuuaaguuuacagcuuuuuuuuuuacaucuauauuuccucuacccacaaagacuccuuucuagucaaacaguugucccucccuccuccaccauauaauugcuuuucuaacucuaucaccauagguucucuucuugaauuuacaaggaacacauagucuauacucuuuuugugucuggcuuuaugugagauucauccauguuauugcauguaacagucauuuuccuuuuugaugcuugaauugacauaccuuuggccaaugagagcuauuuccagcuggauccuuaguguucuauugccaaaacucauuaaucuuugaaagcuuuucuugcccaagaugauauccuagauucaucuuauaccuucugugccuguguccuagaaucaacuguuucccucaaggagucuuguuucuuuucuuuucuuuuuuuuuuuuuuuuuugagacagagucucacucugucacccagguuggagugcaguggcgcaaucucagcucacugcagcucuaccuccuggguucaagcgauucucaugucucagccucccaaguagcugggacuacaggcaugagccaccacgccuggcuauuuuuuuuuuuuuuuuuuuuuuguauuuuuaguagaguugggguuucgccauguuggccaggcuggucucgaacuccugaccucaggugaucugccugccuuggccucccaaagugcugggauuacaggcauaagccacugcacccagcccuguuucuuuuuaaucaguauuagagaugcuaaucugauaauuggggaugcuuguuauaccuuuuuuaggcccuuuuccuugacagacagagcuauaaaauauagcuauauuuaaaauauauuuuaaaucauaaguucauauugauauuuuauucuauuuuaacauuguaauguuucuccccaauauauuuuaauuguauauauuucuuauuauccugaaaaccuugauuuuuaacaucuuuaacacaaugcaacagaaagauauuuguacacaaauacaguuuauauagcuuugcaguauuguaccauuuaguagcguuggucuucucugacaaguguuauaaaugauauccauauggauguuuauuuuuuucuauggaagugucaugguggacugcuacgcaauauugcuggacuggccacucaucucaaaugaugaaguuuagagaaguuugguuuguggaaacaaacauacuuacucucaccauucccagccaaguuuaagcuaaaucagcuugaaauaccuggaucauaucaauuucuguugauuccauuuucagucuguauguaagucaaauagaauguugagcaucgaugugaccaguugauucaaacugcucaaacuauugcucugauauguggaguaauuugaguagugcagaagccaucuuuagaaaaagguuugguuguaaaaagguggcuuuaauugaauauuauuuuaaaggcaauuuuuaaacuaagguuuaaacuaagguuuaaauuuuaaacugaagguuguaugcugauuauuagucuuaacuucuaauauauuauuaggugaacaaauuuaagcagaaagcaguucuuaaaauuuuaaaaugcuuagccugacaguuaaaauuguuaaacuauacaaauaaucgguagagauuuggggaaagacuuuaguaaguaugguaaauucacuagguauuuauacaugagagguucuaagaaaauuuauuuucaaaacaguuucuaagugagaguuuuauugagauuaauucacacaacauaaaauucacccuuuacaaauauauaauucuggccgggcacaguagcucacgccuguaaucccagcacuuugggaggccauggcggguggaucacuugaggucagaaguucaagaccagccuggacaacauggcaaaaccccgucucuauuaaaaauacaaaaauuagccgggcggugguggcgggugccuguaaucccagcuacuugggaggcugaggcacgagacaaacccaggaggcauaggcagcagugagccaagaucacgccacugcacuccagccugggcgacagagcgagacuccaucucaauaauaaauaaauaaauaaaaguauacaauuccauauuuuuuaguauauucacagaguugugcagcccuucccacuaacuuuagcauauuuucaucaccccaaaaagaaaccucauaguuuuuagcagucacucuauauuucuaaccagaguuuucacugacaguaaagaaccguuuuaaaguauauauaaguaauuaaauggucauucuauuucuguaguaauuguagaaaauaauucugagauauggcaaggguuuuugaauuaucacuauaaugaaauacucuaaaaguccuggucaaaacagaggagguuguacucacaaacucacuauggauauucucauuauuuucuuuguagagacaagaucaagacuaauagaacuuucuagaggacugaaugcugugguccucucugugaagaaagauugccuucugcaagucaaacagagagaacugcuuucucccaccugcucugagcguggcaucacaguuauuccuagugcuuaaauguguauuuucucucuaccaccuggacuuucccaaagaguuuuuccuguagcuacuccagaucuuccacuaaaguaguaacuuuuuaaugacaucuugcuguggugugauugaugccugucaccgaagagcacagagccuccuuacagcucuugugcccucguacucuccaucuuguuaucauagcaucugaugucuucaguccuuccaggauucugugcgccuuucccauuccagauacagcagaucguacuguugcuccuugugaccaaauaccauauuugucccaaaccuccaccuagggcccugggacccugaaaguggaagacaucagguggccaugcccugaugauuuagucccagagcccuccgucucucccgugccucccuccgccacucuaugauuuagacuuuugccuucuuccaucugaucggauucucauugugagauguggugacuuucauguuagaucuucuucauugaugccuugguuuuauuuuaaaauucauuuguauaugucuguugauuaaagcauucgaaauguuaucuuagaauuuuucaccca

SEQ ID NO: 19074 - RNA, 2573 nt, Homo sapiens
aauggaucgagauuuagaacaggcucuggaucgcacagagaauaucacugaaauugcccaacagagacguccuagaaggagauacucaccuagggcgggaaaaacucugcaggaaaaacuuuaugacauuuauguugaagaauguggaaaagagccugaggauccucaggaauugagaagcaauguaaacuuguuagaaaagcuuguuaggagagaguccuugccauguuuacuggucaaucuauacccaggcaaucagggguauucugugaugcuccagagagaagauggguccuuugcagagaccauucggcugccuuaugaagaaagggcauugcuggacuacuuggaugcagaagaauuacccccugcuuugggugauguccuggauaaagcuucgguuaacauuuuucauagugggugugucauaguagaaguucgugacuacaggcaguccaguaauaugcaaccuccugguuaccaaagcaggcauauucuucuacguccaaccaugcagacuuuagccccugaggugaagacgaugacaagagauggcgagaaauggagccaggaagacaaauuuccucuugagagucaacugaucuuagcgacagcugaaccacugugucuugauccuucuguagcaguugccugcacugcaaacaggcugcuguacaacaagcaaaagaugaauaccgacccgauggaacagugccuccagagguauucguggcccucuguaaagccacagcaggagcagucugacuguccaccuccuccugagcugagagugucgacuucuggccaaaaagaagaaagaaaaguaggucagccuugugagcugaacauuacuaaagcgggaaguuguguagacacguggaaaggcagacccugugauuuggccgugccuucagaaguggauguggagaaacuugcuaaaggguaucaguccgucacagcugcugacccacagcucccagucuggccagcccaggagguagaagacccuuucagacaugcaugggaagcuggcugucaggccugggacaccaagccaaacaucaugcagucguuuaaugauccgcuucucugugguaaaauacggccacguaaaaaagccaggcagaagagccagaagucucccuggcagcccuucccagaugaccauucagcuugucucaggccugggucagagacugaugcugggagggcagugagucaggcccaggaaucggugcagagcaaagucaaagguccaggcaagaugucacacagcuccaguggcccagccagugucagucagcucucuucauggaaaacaccagaacagccugauccuguguggguccagucuucaguauccgggaagggagagaaacauccaccuccccgcacccaacuucccucaagcucaggaaagauuuccucagguaacaguuuucccccacaacaggcaggcagcccucuuaagcguccauuuccugcugcugcuccugcuguagcugcugcugcuccugcuccugcuccugcuccugcugcugcuccugcuuuagcugcugcugcuguggcggcggcggccgguggggcggcaccaagccauucucagaagcccucugugccucuuauuaaagcuagcaggcgccguccagcugccgggcgccccaccagauucguaaaaauagccccagccauucagguccggacaggcuccacuggccuaaaggccaccaacguggagggcccaguccggggagcccagguuuuggggugcaguuucaagccugugcaggccccuggcucgggugcccccgcuccugcaggaaucaguggcaguggccuucaguccucaggagguccacuaccagaugcaaggcccggugcagugcaggcaucuucuccagcaccccuucaguuuuuccuaaauacuccggaaggucucaggccucugacacuccagguuccgcagggcugggcgguucugaccggcccgcagcagcagucccaucagcugguuucccugcagcagcuccagcagcccacagcugcucacccuccucagccagggccacaggguuccacacuagguuugagcacgcaagggcaggccuucccugcucagcaacuucuuaaugugaaccucacuggagcagguaguggucugcagccccagccccaggcugcuguguugagucugcuuggcucugcccagguuccucagcaggguguccagcuccccuuugucuuggggcagcagccacagccgcugcugcugcugcagccacaaccacagccacagcagauccagcuccagacacagccuuugagaguccugcagcagccaguguuuuuggcaacaggcgcuguucagauagugcagccacauccaggugugcaagcagggagccaguugguaggucagaggaagggaggcaagccaaccccuccagcucccugaggcuugugguaguuuguucucuuuuaaaagcaugggagcacugacccacaugaauucccaguuuuuacuugaguuuuguuuuuuuucucauguuuugguauuuuacauuuuaaaauac

SEQ ID NO: 19075 - RNA, 66917 nt, Homo sapiens
acacauuuacugcgggcgggggucugagggccugcaaacaacucgagcuggagccucggccaggaccggcgcgagaggcgguaggucuccagggaggcccccggggggcggccgcggcccacgggacaugguggggggcggccgggccgccugccucuccgcggggucggccgaccgcggccccgcgcgggcuuuacggccgaggcggcggcggcagcggcgcguguguggcggcggcgggcgggagcgcggaggagguggaaagaaggggggcgcugucacggagacuccggccgccggagaccccgccgcagcgaggccacugggcuccccggucgcggggcgggagcggcgccgacacggggugccaggaggacccaccgggcggaggagggggccugucuacccuuccgcauuuuccugggucucucucccgggcggugacgugacgugcugacggcgggcccgugccggggagcugggccgcuuuuugucagcuccgagcucggccccuccucccucccuccgcccgccccaccagccggagcccggcccagugcuccagagaaaggccggccugcagcacccgccaccgucgccggccgcccgcacguccguccggugagucccgggugccgccgcggccgcggggccuagugcgcgcacagcggccuggucucggccuggucggcggcccgcaaggcgcccucccgcgcuaggccgggcggcguggcgcgcggcgccgagcaggccccgaggaggccgcaguuaggcccggggaggagcccggcugccccgagcggcggcggaggcgcgcuccguaagcgggcggggguugggggagggucgcccgguugugccggaggcggucgaggggccccgggucggcuccgcggccgaccuggggcaccgcgccggggugaggccuggcgaggaggcgaaggcugcaggcgugaggugaaggccgcaggccggccgggccgauuuucgcuauguaaauaucggugagggggggggagggacgggggacaagauggcggcggcucggcgccugcugcaggggacgauagaggggguugccgggagggggagccgccaucuuggaggcggugucuggagagaaaauuccgcuacagcccgugagggggggugggagagcgggcggcggcggcagcggcgccggugacgggccccggaggcccggcgcggcggcgugugcgcgcggaggggcgugcucgcuccccguggcggccauugcccuugccgccaugaugagcgcucgggcuccaggcgcucggcggcagcgccaccuuccugccuugccucccgcagccccgugacuggcugcaguuuccgcugcguuucagcugagcugccgcaggcggccaccgccgccgcccggacgccgggaccguuucacccucagcgccccuggcccugcgccuucccccgcgccuguagccacccgagggcagucggggcagguggcauuccggacaccugggcuuaccagggcauacgggaccccaggaaauguuauuuuugcuuaagucaaaucauauguggcugcuaaggugcuuucgaugcaguuguuuuuccaacaaucuuugccgccccgaguaucugaauaaaggaagaaaaauaaagauugaugggaaaguuuuugccauucuuuuguccuauagggaaaaaaauugcacaacacgagagcggaggaauaaaauuuugaaucauucguacucauuuauguggaaacaacuuucuugaaaaacgauuuaaguagugaucuguuggugguauuuuuuuaaaucgaggaauaagggcagacuuuuuuauuuucuuauuggaggacaacuuaguguggugcauauuuauugugcauuugccugucaugguauuucgauuuuucauuugugaaguuuuaaggcggaguuucauccccuaacguacuuuuuugauugcacacugugcaacuuucuugauaaacucggagccuacuguuagcgaugcaccgugcuagaugcuaagaaacauuaaaaagguucuuguaaugcagacgguggcugcaagaagucucauguuuagagguagguggggcaaggugaaaugcaguaaagugagagguacaacuaauuacugggauuuccgagggaagcaagguugccauuggaggaucagggagggacggguuccugaaguauuaauagguggcauuuugagaagguuaccgagggauggguaggacuuuguuagguagagguggagguggagaaaggacguuucaagggugaagcuucuucaguaaacaguaaguauuuacaguuuggcaaaaguggaugguauagguaggggaguggugggaauucaggcuagaaaaguuagauugcagaagggcuugcuugccagguggaggggcuuauacucaaugggguaggcagcgggggugcccucaacuagaagagugauggcacaccugagcugcaccuuguuauuuacuuauuuuuuauuuugagacagguucuugcuauauugccccaggcuggucucgaacuccugggcucaagccguucucccgccucccacugcccgccugucacugccgucuguucccugagcugugcuuuacgguacuuaguaguuccauuggacuaggaaaaguuucaaaguugaaaaauaaugagaguaguaaguugaucaguguuuucauuaucagaacgauuacaagaauguucagaaguuaagcaaauuuugcuacuuuuggaacgaugcgucucuauuaagacagcugcuccuuuuuucuauccugauuucucauccgaaauaaucuuuugcucagaguugucagaauuucuaugguacacaaauagggagggguuucuaacauuucauuuaccaugguugaaaaguacaggacuagugcuguggguuauuugacgaaaaugagaaaugaguauucccgugguaauuuuuuuuuuuuuuugagacugaaucucacucugucgcccaggcuggagugcaguggugugaucuuggcucauugcaaccucugccucccggguucaaguaauucuccugccucagccucccgaguagcugggacuacaggacccugccaccaugccugguuaauuuuuguauuuuuaguagagacaggguuucauguuggccaggcuggucucgaacuccugaccucaagugaucugccugccuugaccucccaaagugcugggauuacaggcaugaaccaccgugcccugccuguuuccuagaauuuuaugauggaaaccuuuagguggcauagauacccauuuucaguuuuuccauuuuucuagacuguaacaggucgugagcagcggugcuccaugaaagggcuggagggaaugagagucucauguuuauuauaaagggcuaugguuuagaaaaguucgagaaacagugcauugcaugaggcugacuagaagcaaguugagaaggcgggcugugguuguugagguguuaaggguaaacauaaacuuagaagaaccaggugcuuuuauauuuugacagcugggaaagacauagaagaacuauuaagaagauagaauuguuuugcugcgcaguacagcaacaguggauguucaagauuaagauuagagucaaguugugugauuaagacagguaaguguguaguuuaguuucaauuagaaaugguuaaauauaaaauuauuuuugccugaaaggguagaccuugaaacuuuggaaaacugacugguggaacaccuucgaacccaaccacccuggaugaauaagguguuaguuuuuaauuucuguguauuuuucagauagaugcagauuucuuuuuuuaaaaaaacaugcucacgaauguguuacaaauuuuuuuuuccacauugcuuuuuguaaaugcuuacucucauugcaaaugcuuacucucacuuaacccauuuagacugauucugucacugauaaucuucuuuguauuauuuguucuuguguacacuggcaauuccaaacuuuuuuucacucuuaaaacuacucaacggguccuugaaaucucucaucuucagcaaagauuacccagucuuucacuucacugagaaggguagauggccaucugauaaagagccaagucuccccucccuuccccuucaugccuuuccugucuucaccuaggccuuccuccuuuugccgcaggggagguugcaggagggauugcugucucacaagccccacugcugcucugagccugcucuucacccuggcugccuccuuagggaccaagcucugugcgugaugccgucucuugcaucauuaaccucucuuuacaaauauuccuagguuugcucaucuuacaaaagccucaccugucuucacuuucuuugcaccccacuuauucuuaaauccaguauuacccaaauugggaaacuugcacagcauguuaacagguguguuauauaaaagugcucuguguuucagaaacucucugugccuucucugucuucuauggugggauuccccuuaauuuaucauuuaauguauuauauuugaacuguguguuuauauuuuuuccuucuacacugugaauauagagacaaguucugauuuaucuuugucuccaagcaguaccuggcauauggaccauuaucucucaaagcaauaauuucgguuacuggguacagagaauucuacguaguuaauaguuuucagcuguucaaaaaucagguauccagucaguguguuuuuugacucagggacauacauauuaaggcacacuuauuagggcaccaggucaaggaguaaccccucccaccaccccuuaucugauuggaauauggccagccuauucuuauuccugccaaguuauuuuuccagacaacauuuuauaaaacccagguaucuuguaauuguauuuuacucaaaggaaguauacucuaaggaaauuguguggccuugagguacacagccauuaggcauuuaaaaaauauauuuaaaaaguuuuauggaauauuuuuaaauuacugaaaaucagaaucacccagauuuaagagaucuuaauauuuugcuacauauuugauucauaucuuuuuguuguuuaaagaaauaaaaucucacagauucaaagggucccuccccauccccuuccugucuucuuuucuccagaaguaaccaccugucccaauauguauguaccaaaacaauaucagguauugcuuguguguuuaacuuuacauaaacaguaucauaaccauaccuuauauauuauuuuuacuuaacaguguguuuuugagauuuauccauguaauguguuuaguccagcaguuuucaaagugugcugcagggauuccuggggaucccuaagauucuuucaggggguccaugaggucaaaacuauuuucauaauacuuuuuauuugcucuuuucacccacauuuuccuguacacuauaggaauacuguacagaggcugcaugacauaugaugucauaauagauagaaugcagaaacacuuacgggaauccagccgguuucuauuaagccagacaugaaagagauuugcaaaaauguaaaacagugccacuuguuuuacuauuuuuuuuuguuuagaaaaauaguuauuuuaaaauaaauaugcagccauaaaaaagaacgaggucgugucuuuugcggaaacauggauggagcuggaggcuauuauccuuagcaaacuaacgcaggaacagaaaaccaaauaccgaauauucucacauacaggugggagcuaacugaugaacacaaagaaggaaacgagacacugggggucuacuagagggugaagggagggaggagagagaggaucagaagagauaacuauuggguacugggcuuaaauaccugggugaugaaauaaucuguacaauaaacccccgugacagaaguuuacccaugugacaaaccugcacauguacucccgaaccuaaaauaagaguuuuaaaaaaaucucaacaaaagggaaaaaaggaauaaagaaaaaaaguauuuuuauggguuaauaagugcuuuuaaauaucucaguuuuaauuucuaguaugauaaacaucuauagauacgacccacguaaaaacucuuugugguucuuaauuuuuguuuuuuguuuuguuuuuuaaauuuuauugugauccuuaauuuuuaagagugcaaaggaguccugagaccacgaaguuugaaaacuacugauuccauucauuuuauuuguauuucaguguauaaauaaauauacugugguuuauuuaucuuuucuucuuggagggaccgauagaaacuguuugcaguuucugaauuucaaacacuacugcuaugaacauccuuauacaugguuugucuuucuugggauuauauacauauaguagaaguagaauugcuucauuuaagaagucugugcauuaucaacuuuacugggaauugccaaaauggcaaauugucuucuauuugacacucccgcuguguuugaucccguuucuccaaaucacugccaaaggauuagauuuugcaauuuuuucccaaucuguuggguauaaauggcaucuccuugcuauuuucauuuugcauuucuaagauuacuagugagguugaccuuuuuuccccauguauuuaucggccaucagaguuuucuauuaauugcuugugcauaccuuugguucauuuuucuguuggauuguugccuccuccuuauugguauauggguuuuauuuauuuauuuauuuauuugagauggagucuugcucuguugcccaggcuggagugcaguggcacguggucugggcucacuguagccucugccucccagguucaagcaauuguccugccucagccuccugaguagcugggauaacagacgccugccaccaugcccgguuaauuuuugugcuuuaaguagagacgggguuucaccauguuggccaggcuugucucgaacuccugaccucaagugaucggcccuccuuggccucugaaagugcugggauuacaggugugagccacuguggcuggcugguuuauggguuuuauauucuggauacuaauuugugauuauauacacugaaaauaucuuuuccuggucuguggcuuggcuuuuagcucuguuuguggaaaguuuuuuauguaggacuucauaauaugaugguagccaguucucaguuuuuuucauuuauggcuuguguuuucuuaugucuucaauacauucuucccuuaccccaagguuguaaugauacugugcuguuucauauuuaggucguuaauucaccggaguuuuuuguauauugugugacguaggaaucuaauaucuuuuucauguggauuuaucaaaugguucagcguuucuccccacugauuuauaaugcaacuccugagauauaucauauucccacauauguaucuguuuuuaguuucucucuuuugguuucauuggucuguuugccuaucucuauaucuauacuauccugauuuaauaauagccuuuuuuuuuuuggagacggaguuuugcucugucgcccaggcuggagugcaguggugcgaucucagcucacugcaagcuucaccuccugggcucacgccauucuccugccucagccucccgaguagcugggacuacaggcgcccgcaaccacgcccggcuaauuuuuuguauuuuuaguagagacgggguuucaccguguuagccaggauggucucgaucuccugaccucaugaucugcccaccucggccucucaaagugcugggauuacaggcgugagccacugugcccggccuuaauaauagcuuuauaauuaaaacugaguauaucuucuuuuccuucaggauuauuuuagcuguuuuccucccuuugcuuauuuugggguuaguuugucauuuucugugaaaacuguuggauuuuuauauuugccucaaauuuauagaauaaauacauagauucauguagauaaaugcuaauagagcugggauuugaauucuggguaugugcuacuacuuuucauaaagcucuugcacaacuuuuguuagauauuuuuguuagauacuguguaauuuuuguugucauugugaauaggauuuucuuuuaguuauaguugcuauuauugcugauguauaaggaucacuguugacuuauauguauugaucacguaaccuugcugaacucucaucauauuucauagauucugagguacacuuuuccccccuacaucuucacauaucugaagucaaaauagaucuuugauggugucccauaaucacuguugucuaggcagcagucaugauguaguuaucauugcuugcacaugcacaaacuuggucagggcucuucauuuugucaucacuuuaaaugaguaugugcauugcuguauuguuauuucaugccaaacaauaaaacuggaggcggaagaaauugcaaagugggugucugccuugaaagaaaaucccauaaauaauaauggaucauuuuaagaagugcugcaucaccaacacucuuauuggcagagcacaauauuguuagcaacaguugaacaguuuugaguggaagagcaauccauaguaggaccuugaaugugaaguuguaggaauaccuuaccaauuuauuuugcuucuuuuuuuucugucgcccaggcuggagugcaguggcacgaucucagcucacugcaaccuccgccucccggguucaagcaauucuccugccucagcgucccgaguagcugggacuacaggugcacgcugccacgcccagcuaauuuuuuguauuuuagucgagacagguuuucacuguguuucccaggcuguucucgaacuccugaacccaggcaaucugcccgccucggccucccaaagugcuaggauuacaggcaugagccacugugcccggccaauuucuuuugcuucuguauacacaagauaugauaaaagucugucuaaauaagucugaauugucuugauaaaucuagaaugaaaauccuagauaauaagaaaauacuguaucaguuuaauuggcaauguuuuuuucuuagucauguaaaauaaggguacagcuuacaauugguaucuucagagucagugaaauguaguaguaauaacaguucaugccggguguggugguucacgccuguaaccccagcacuuugggaggccgagacggguggacuuugucucaaacaaacaaacaaacaaaacaaaccaaaaacaaaaaaacacaguucauaauucuuuuguauauaguuuucaugucugugaauaauacaguuuuauuucuucuuuuccauuccuucuugccuccuguuucuuguucugguuuuacugcauugacuaauuccucuauugaaguguucaguagaagcauugauaaugggcauccuucucuaguuacuuuaauggagugcuucuaauguuuuaucauuaaauaugauauuguagugggcuuuuuugagagggggugcugaugauauuuuuauuuauuuauuuauuuugagccggggucuugcucugucgcccaggcuggagugcaauggugcgaucucggcucacugcaaccuccgccuccuggguucaagcccuucuccugccucagccucccagguagcugggacuacaggcaugugccaccaugcccggcuaauuuuuuuuuuuuuuuuuguauuuuuaguagagauaggguuucaccauccuggccaggcuggaugauauuuuuuaguugcaguucucuuuuacuuaucauuuuagaguuucuacugugagcaggaguuuaauuuugcuaaugcuuuugcuacaucuauuggcgugaugaaguccauuaaucuucaauuuuauuuuuaguuuuuuuuauuuuucauuuugagauggggucuugcucugucgcccaggugggagugcauggcucacugcagucuugaccuucugggcucaagccauccucccaccucagccucccaaguagcugggaccauaggcaugugccaccaugcuggccugauuuuuuaauuuuuuuguagagacggucuugccuuguugcacaggcuagucuugaacuccuggucucaagcaguuguccugccugggccuccaaaagagcugggauuauaggcgugagcuacagcguggguccuacauuuucuauuuuaaacuauuuuucgauucccggauauucgcauaucuuuguuauugccauguacuuuuccuuuuuuauguaaucuuguuuggauaacaaaguuguauuaaccucauaagauaaauuggggaguauuuuuuucuuuuuucuuuuaaacaguugcuguuuaauagagacaaucuguuucuuuucuuuuuuggagacagaaucucucucuugucgcccaggcuggagugcaguggcacgaucucggcucacugcaaucucugccucccugguucaagugauucuccugccucagccuccugaguagcuggauuacaggugcccgccaccaugccuggcuaauuuuuguaguuuuuaguagagauggguuucaccauguuggccaggccucaggucuggucucgaacuccugaccucaggugaugggccuaccuugaccucccaaagugcugggauuacagacaugagccaccguguccgagcgagacgaucuguuucuuaaaaguaagaacccaucugugagauuaucugugcuuggugucuuuugaguguaaauuugugguuucugauuuguuaauuguuucuuucaugaugauaagucuuguuuuagcuguucuugaguuuuuuuggucauuuauacaaaaugaacaauuuucuagaaaaauauuaaauuucaaaugcauuauuauaaaauacagauuucccugaugacuuuuaaaaaccuaauuuuguuaguuuguuccuuuuuuucugaucaguauugccaguaacugccuuuauuauuggauuuuuuaacauaguuauuuuuauugauccuuucuauuucuacuccugugguuaauauuuuccuucugcuuuauuugcauucauucugacauuuaaaaauguaaguuagaggcuuagcucauucauauuuaaucuauuuuuauaauauauauacuaaaaacuauaaaauuuucucuagacuauaauuggaugcuauuuaaaaaaauugaaaugcuuuuuuuuuuuuuuuuuugagagcgggucucgcucugucgcccaagguggagugcaguggcgcacucucggcucacuguaaccuuugccucccggguucaagcgauucucuugccucagccuccugagucgcugggauuacagacgugcaccagcacaccuggcuaauuuuuguauuuuuaguagagacgggguuucaccauguuagccaggcugguuucaaacuccugaccucaggugauccaccugccucggccucacaaagugcugggauuacaggugugagccacugagcccagccgaaauacacguauuuaugggguagagugauuauguacauguauacaauguguaauggucaaaucaggguaauuagcauaucugucacaccagcauuuaucauuucucuguguugggaacguucagaauccuuucuucuagauauuugaaaauacauaaugaauuauuuuuaacuauaaucacccuacagugcuauagaacacuagaacuuauucccccuauuuagcuauaauuuguaucuguuaaccaaacugucccuaucucuggauacuaugauuuuugacaugaauugguuuuuauuauuuaguucuaaauauauugugaucuccauaauuuuccuguugcccauuaaaauuauuuagaacuuuguauuuacaggauuuucuuuuuguauuacuguuaucucugugauauuuauuucuaauuuuauuguauuauacuuggggaacauugagaugcaaaaaucaacucuguuucucuauaccagcagcaaacaauuugaaaaucaaauuugaaaacuaauauaauuuauaauaaggucaaaaaacaucugauaccuugaaauaaauccaacaaagcauaccaagaccuucaguaaaaaccuuacuaagagaaaugaaagaagaccuaaauuaauggcaagagauaaccauguucauuggauuggaagugucaguauuguaaagauguccguucucucuaaauugauacauacagaaauucagugcaaucgcaauaaauaucucaauagggcuguugcugcugccacugcugcuuuuuuuucuuuuggauaggcuaguucucaaauuuacauggaaaggcacagggccaagaauggcaaaggcaaucuugagaaaaaguuggaagacuuaacacuaacauauaucaacacuuauuauaaagcuacagugauuaaauuagugggcgcaaagccagauugaccaguggcacaggauagaguccaaaaguugaccuacacauacaaggucaguugauuuaaagaaagguguauugggauuuugauugaauguagagguuaauuaagggagaagugauacuacuaaucuaacauauucuuuuuuuucuuuuucuuucuuuuuuuuuuuuuuuuuuaaagacagucuuccucugucauccaggcuggaaugcagugcaguggugcaaauuuggcucacugcagccucugccuucuguguucaagugauucuucuucugccucagccucucgaguagcugggauuacaggugugcgcccccaugucugccuagcuuuuguauuuuuaguagagacgggguuucaccauguuggccagccuggucucgaacuccugaccucaagugaucuaccugccucagccuuccaaagugcugggauuacaggugugagccauugcaccuggcccuaauguaacauauucaagagcaagauugcuuucucuauuuauuugucuaaaaaggaaaaaaaaaaaaaaaagaaaucucuagcugggcgugguggcacaugccuguagucccagcuacuuggaaggcugaggcaggagaaucgcuugaaccugggaggcagagguuguggugagcugagaucgugccauugcacuccagccugggcaacaagagugaaacucugucucaaaaaacaaaaaaaucccacacaguagaguuuuuaauuacucuuaucagugggauuuuuucauucuuagguguuuacaugagaaagcuuuugucuucaaguauauuaauuuuguaccagcacaccuuaugaauucauaccgauaauaguuuuucaguugauucucuuguauuuccuagauauagcauaugcaaauaaguuuaauuuccuucaaguaauaauuauaucuucuauuucaucaucuuaccuaauuacacuggcuggcauuugucacacaauccuauaauaauaguauuaauggccauucuuaauuuugacuuuagagagaauacuucuaauguuuuaccuuagguuuaauagaugucuuuuuguuauaaagugauaacugacaucauucucauaucccaaaacacauguucugacaugaacugguuuaagauugcauauacuugaguauuuuuuaaacagcuuuauugagauaaagcuauuauuaaaucuacccuuuaaaauguacauuucagugguuuuuuaguagauucagaguucuguaacuauuaucacuaauuagaacauuuucgucaccccaaaaagaaacccuacaccuacugguaaucacucuccucuccccgcuuccuucauccccuagcaaccacuaaucuaccuucugucuguguggauuugcuuguuccugacguuucauauaaauggaauccuauaacguggucuuucgugucuggcuccuuucacuuagcauauuguuuucaaggucauccauguuuuagcguguauccuauuuauuuaauuuguuaacuguuaaaauaucuaucccaauuugacucaaaaguuugcuuuaaaucaaaaguaggcguucaguuucaacuuuucagcaucuguugagaauaucaggcguuuuuuuuuuugaccuauuaauuugggccauuauuuggcuccauccuugaauucuagaguacccauacugugccaaggucugugguguguguguguguguguguacauguacauggaugugcuuuuuuuuuuuuuuuuuuuuuuacaugacggaucauauuugcggauacuugacuugggauucauaauuaaccaaguuuguaauuugguuaaauuauuuuuguuagguuuuuuuuuuuuuuuuuuuuuuuuuuuuuuugauacagagucucacucugucgcccaggcuggagugcaauggcgcgaucuuggcucacugcaaccucugccuccuggguucaagugauucucgugccucagccuccugaguagcugggacuacaggcgcgagcaaccacgcccagcuaaguuuuguauuuuugguagagaugggguuucaccauguuggccaggcuggucucgaacuccugaccucaggugauccacccaccucagccuuccaaagugcugggauuacaggcauuagucaccaugcccggccgccuagcuaauuuuuaaaauuauuuugucaagauggagucuagcuauuuuguccaggcuggucuugaacuccuugcugcaagugaucuccugccuuggcuucccaaagcgcugggauuacgggugugagccacugugcccaggcccccucuuuuaaaaaaaagaaaaaaaaaaaaaaaaaaauucauuacgaucggguuuucuuuuauugaguuaaugcugguaauuuacauuuuccgucacugugcuaguguagaauucuagaccauuuucauacaaguuguuuucuuuuuuucuguuuuuuuuuuuucuuauuucaaauuguauauguuugugcuuucucccaguuucuuccccucuuuuagauuauuaucuuguauuuuauugucuucccaacccccuggaaaaagcuugguuuggagauuuuuuugggguaaaaauuagcuggcucccuagcuuugcuccagagaauggucaugaaauuaaugguugcugauacucaaccuggagcaugccuguuguuggucuuuugagaagcaggcguauuucaaaccugccccugcauugcccagcuuguucuuuucuuuuauuauuuuuuuaaugauuaaaggauuuauuaaauuccaugugcaaaacacauugcugauugcauuagcaaaagaucaauguaaaaauaccccacaauucuggaacuguccauuuaaaauauuuguucuaguuguugaaaggcccaguguuauauucuugccagugcuuaagguauacagagaauacuguaaguguuaacacugaguuuacagaaccucauaggccgaaaguaauguauuuaggaaaagcaauaauaguaaguaugcauucauguaggugagauauaguauggucaauaugggucaaauuacagcguuggugaucagugacaagggaguuggcaagacaauuauguuaagaaagaucauaguuuaagaauauuuagggcugggcacggugccucacaccuguaaucccagcacuuugggaggcugaggcggguggaucaccugaggucaggaguucgaaaccagccuggccaacguggugaaacccugucucuacuaguaaaaaauacaaaaaauuagccaggcgugguggugcaugccuguaaaugccagcuacuuuugggaggcugagguaggagaauugcuugaaccugggaggcagagauuguagugagcugagauggcgauguugcacuccagccugggcaacaagagugaaacuccgucugaaaaaaaaaaaaaaaauuuagaguguuuugaaaacuguaaaccugcaaggcaugauuuuuacaacuaguuaccagaaaaugaaggaaagcacauaauuagcuugaauaaaguaacaugaaagcgagacugcacuaauuuaaaaaaaccccaaauccuaauacaguaucagaaaaauauuuucuuuucuuucuuuuuuuugagacggagucucgcucuaucaccaggcuggagugcaguggcaugaauuuggcucacugcaaccuuugccuccugaguucaagcaguuccccugccucagccuccugaguagcugggacuacaggcacgugccaccacgccuggcuaauuuuuuguauuguaguagagacaggguuucacuaucuuggccaggauguucucgaucuccugaccuugugauccgccagccucggccucccaaagugcugggauuauaggcgugagccaccacgcccggccagaaagauuuucuaauacaaggagacauauugcucauugagaagggguuugauaagaaaacuuacuaaguuaacaacuauguuaaugacuaguucagagauaaauuaaaugcccaauuuugggaaagguagcaggugcaagaaaaaggaaauguauaagaaaacaguuucugauacuuaaaccuuucuucaucauguacugcauuugacagaaauuaaccuuuuaaaaauuuuaccuaggaugguuuuauuucauuuauuccauguacaauguagucuaaaucuccacuugauaccaugucagaauccugucuucauccuuugauuacaucaaguguuucucacacugcucgaacuaagucugcaacuaaagguagaauacuucaguagaggaaacgugaauagaauuucuuuucagaauuucagcaaaaacuaauaagcuauuuuaaaguuuuucacuaugaaauaaaagagugauccaaagaguugaguuguuuuacucauuccauuaugauauaugguagaauguuauggaaugaacauggauauugcuaaauuauugaaugcauuaaauggcaguacuuuauuaaggaggcuguacugcuuuaaauaucugaaaacuaguuagaaugugugcauuuccucacaucaagcuaagccuuaaaaacaaaagcauuuaaaacuaguguuuguagcucauugguacaaguagguucagagaguauugugucaacucuuaaucugagcaggaauagaagcuuugagaaaauaggcuuuaagaagguuugucauuuuacagccaaguuuuaauagauugugaaaguuuggacucuuagauuuuaaacaaacaaaaccuugaaauuacugauuggcucagcgugguuuuauggaaaaacuaauacaaaaacuuggccuugacuauuugagcaaagccuacaaaaguuccagaugggacagggcaaggaaggauggggcucuauuuacaacagcagauauuuucuuuuccucuucuugacguggaguaggcagggcuauuugaaaauaaaauauucuuuucuuagagaauggaacuugaauuacaguuauuagauuaauaucgauuauauacauuuucucuuuuccuuuuagacuaguugaucuguuaaguguugauaguuguuguaaccuuccacuacuauugauuuuuuuuauuacugucucauagguucuuuugcuuuuuuuauauuuacauauuuccaugcuguuuuauuuggcacauaaaaaugcauaaugacuucaaauucaacauagacuagagaacacacacacuuauuuuuucuuccuucuaaaaucacauaaagaauauaaaaacaaauccagagaaacaagaaaaccucagugguaugaaucagaauaugaugaauuuuugguugaauaaagcaauuggaaaucaauuaaugucaaaacccaagagagcuuagugaacgugugaccuuauucagaaaguagaagggaccagccaagaauuggcauccugcaguaccaccaacaucaaaagcagggaggcacuuggagauagaacaagccaugaguacagccagauaauuaaagccauggaaagcuaagccauuuaccuauuaguauaggugcccgcaaugguuuuccugcugggauaaugcccaaaauucagcucucugaauugcuuguuuguccauaggaaauuccaaagugagugcuguauagcaagaaagauaggggcaguaguuuagguagcuuguggcuauccugaaggauauugaaccuccagcaccuggaagaugggauacucuuccaccauuaaaggagaaccuggcugguuacauggcuccuuucucgccuauggacucauucuagauaggacuucugugaucugaauuuaaguuuauuguugggcaaacaggaauuaucacuugggcugaagaaguucaccccagcagucagaauauaacucuagucuggacccucaucuacaaguaggaauagacaaccaggaagaaccaugcuuuucaggaaaaccagcaguuuaaaagagaggcaccaaauucaacuaacugaauaaugaaacaccagaggagacaguuuauauaggguacagaaugaacuuuaaauccacagagagauuugggaagauaccguguccacccaaaaaagaaaagauugcuauggaaaagaaacuauuagaauuaaaauaugaacuuuuaaagaaaaauucaguagaugggguggagaucaaauuagcuagcuuagaagaaagaauucagggauucucugagaguguaguagaaagacaaaaucugagagaaaaguuaaagcaauauagaagcuagauuuaguagccuuuuuacauccuguaauaaaugcuaguaagaaugaacagagaaaauggaggaaaguauagaaacaacaagaaacuuuccuaaguucaagaagggcuuaagucuuuugauugaaaggccccacauggucugcaugugagaagagaacuuguuagagugguagcagugauaauaaagaggaagugauaaguauaagaguuacuggcuuugagaugaauuuaauuuaagggcugauagagucagagaagagaaauaugacuccagauuugaaaaugagauaucuggagaaaugauggcuaacauugaacaacaugggggaaaaauuaggaaagaaaugcagcuuaagagagaagauauuaauuaggccuuaaauauaaguuuucaccaguucugauuucccucuaagacaaauuguuauagacacauuugccuuuguuugccuuuccugcagcuuaagcauuccuucuaccauguauaauaaaauuuaguucucugagugugacuuagugagaagaauuagaguugagucauagaauuaacaggcagugagguuuugggagaccuaaagcagaaaagugauuuuuauaugcauauuagcugcaaaaagcaaagugaauaaauaagaauccuguuaacuugcccaagagggagaucacagaaguaucuaagcaucaaaauauauaaaacaaauaaauuauaucugugaucccuaauuuaagauagauaaaaugccauugcuauaccuguuaacuuuuauugcuuuauuauauauuuuauuuauaauuaccuucuucuaggaugauauugcuuuaaagaauggaaggacauuuuugugaauuuccuggguucuccuagcccauuauuucccucaaaacuauauguuuuucuuuucuuucuuucuuuuuuuuuuuuuuuuuuuacuuucuguccucacagucuguucccaaaaacuauguuuuuccacugugaauuauuuucaggaucaugauucucguaacugggaagggaauaucuuacugaguuugagguguuaguagagucccagaaauaccuugagggcguuugauaguaagacuaaauguuaguacuuguucacccaaauucugagauucuugguucucugaaccauccuacuuauuugucuuuagguucaacugaucucugggcuugguuuguacuacaaaggcauggacaccgccaguuacauuaucacguaccuucuuccacccuucguuuaucauaucugagaacuccucugaguagguucuguucugagaacaguuucauucugauugucaaagggaguuaguauucuaacuccagagggguuacaaaguugagguauagucaucucuguuuagaauguuugaauuuuuguaaugacaaaaccgaagggaaaaugaccaggcaaaacaauaguuuguugaauaauuacugcucacuuaagaugagaugagcgggcacccccauguaggccagaauaucuauuaggaaaugcacgugauguaaaaggaugggaagaaagcaaaucagucuguuaaugguagcuuggguuaauacugcagagccuuugaguauugaggaacugcugaaguguucagagcagggaaguaguaugaucaaagcagugcuucaggaggguuaauuugccuacagauugcagaaaugccucaauacuuggcaccagcccuuacguguaguuuuaggguuucuagucauuuguugugggaguggcagaaaggagcaaggccaguccagaggcuauuuucaucccccagggaucaggaaauaugaagcugagugggaaugcuaacuaggaauuaaaaaaaaaaaaaaaagauucuugagaaguugagaauugacaagaucuggcaaucugacugugagcagagaagaagaaaaaggccauaguggucauaucaggagaaggcuggguuuuauccggaugagaauauucaacagucuguuggacauguuaggaugauuguaggaaucauuguuguggaaauaguaguugaaaccaugggaauaaagagaaagcagaagaggagaggguugagcacacaccugggcugagccgcaguaaggggugaggggagggugagcagccagcaguuaagaagagggaagagaacuagaagucacuuaaagcaacagaggaaggagagcacuucacaaauuagggaguugauuguuuaauagaaaugccaaggaggaugaaugccaagaaaaguuguucugcaaguugagaauccguagagcugaugggauuggguuuauguagggaaauuugugcggugaggggcuuaaauaccuuaauguauccccuuuauugccuucuuaauuggcuugcuuuaaugucauaguguuucauaaugcuuagaauuuuuuuuuuuuuuuuugagacagagucucgcucuguugcccaggcuggagugcagugucgcaaucuuggcucacugcaaccuccaccucccggauucaaguaguucucccugccucaaccuccugaguagcugggauuacaggcaccuaccaccacgccuggcuaauuuuuguauuuuuaguagcaaugggguugcgccauguuggccaggcuggucucgaacuccugaccucaggugauccacccgucucagccucccaaagugcugggauuacagaugugagccaccacguccagccaaugcuuagaagauuaauuuacguuuaucauuuuuaaaagggggaaaagguauucuauagccagaggugguuuugcgggaguggggcaguaauaacuuuuucagagcauguacacuuucuguuuuucauuugcuuuaauuuuuuuucuuuaauuuuuuuuuuuuuuuuuuuugagacggaguguugcucuauggcccaggcuggagugcaauggcaugaucuuggcucauugcaaccuccguaucccggguucaagcgauucuccugccucagccuccugaguagcugggauuacaggcaugcgccaccauacccugcuaauuuuuuuguaucuuaguagaggagggguuucgccguguuggcuaggcuggucucgaacgccugaccucaggugaucuacccaccucggccucccacggugcuggcauuacaggcguuagccaccaugcccagcccauuuacuuuuauuugaaacaguuugaauaaauaacaugaaacaugcuauuucuuaaaaaugaguagaauauaucucagaguugguauguugagaauuccuuuuaugaauguuaauuuucucaauuaacauuuaauggauauuuccauuacuauuccauguuaauggauuuuuuuaaggacuauauauguaauuuaguaucuguaaguaagacauauauaaauaaucauaauaugacaaaccaguacaauaagagaagaauagagugcuguggaaauuucagagggaaaaauuguuuccagcuuucucuuuuuuuuguggggaaggagauuuagagggaaagaucaaagcagagauaaugggggaaagggguuccagguagaaggaucccugaaucaaauaugaaguugggguuuuauggggauguugagcauuuuuguuuggcugaacuuuguguggguggggaccauguguuuguguacaugcugacagugguagagggaagugcuugaaggaaaguuaggggagaugaugaugggaagguaguuuggggccagaacuuagaagaugacagguguuugaauuuuauuuagagggagcaagaagccauuaaacauuuuugaacagaggaaugaugucaccuagcuuuagaaaaaugacuuguguuucuguuaauugaaauuuuaauaagcauguaguacuuauaaaaucagcaaaaaaaagcgguaaaggugaaaauuauugguuagaguucuuuuugucagaaguuuuuggcuuaaguagaaaagggagaauuaaggccauuggaaugucuuacaagaauucaaggcaggaauauagcuggaccucagauaggucuagaaccaggagcuaaacagcugucuccccucccugcuuacucuauucuguuacucaaggcacucacagucuaagccagaguugcaaaaugacuuuucucagcucuuauguuccagccaccaggacagagagagaaggagagagagagagagagagagagagagagagagagaggcagacagacagacagacacugauucuugcucaugguuuuggauucucagggauaggacuuugauuuuauugugcuuaaagaugagcuuacuguuuaccguuuuauagcuagugccaaucaacuguggccaggagaauauaaauacacuaugggaauuuacuucucuagaugagaggguuaguuaagagagguuaggcagaaucccaaggguuguuuacuacaguuaugcacuuugaauuuuuaucauuguguaaucuacugguuggaaguuaguagacuaauuacauauagagaauaugaaaauugugcaaaaauuucccccaguaagcuacagaauguauuuuaaguugaaucuuaacacaacugguuacccuugugggaacaugggguguuacagacugaggacacaagagugcuggggucuuaaaagcguucuauauuuugaucaggguagugauuacaaaaguuuauguauguauuagaauucaucaagaugugugcacuugauagaccuaagcaauacauuuauugcuucaacuuaaaaagaaguccaggcaaaguugacuuguuuaucugcccugcuuugucauauagaugcccauuuaucauuguaaaucaaguaaguucuauuuuacuuuagauaaguaaguuuuugauacacauuuaucuuucacauaauuugagugucucagaaaugaaacuaucaugauggcauuuaauaccugauaugaaaaaacuaauggcuuugguuuacuuuuuucccugauuuaggagcugugacugaugagaauuaaaggccauggaugaagaugggcuugaauuacaacaagagccaaacucauuuuuugaugcaacagguauaacuacuugaauuguuccacuucccaucuaccagauuuggaguugguugucaucaaugaauugcuagaacucucacauugaucauucacagguuaucuuguuauccugucaaaauucacagguguuacggugagcacauuauuauuacccuccucaaagauguggcucccucacaaccaacucucauauucuugucaguaacagcagcaauaucaaaccuuaguuuuaucuucaguuaugaagauaauaucuugacgaguuaugucccuaauuccuguuguuuuucccuuugaaaauauuccuuguuagcuuuguuuggaccuuuguuuaaaaaaagaaaaagaaaaaauauucuuuauuuacaucugcucuucuucauccuagugccuaccacauagacaggcucuacgucucauucuuagucuggaaauaacuuuugcauuauuuuccuuauccuuagucucucuuaucuagccugcugaucagaguacucacuguaaaauaacauguggauccugucauuucucuauucucuaauacccaguagauaaagaaggucucccacauugacccuguccuauuuuuauaacucucucucuugcaaguucccaaaaagagacuucugcuucaggaagauggagucuucacuccccauaguguacaaggaaaaauuauacucaggaaguucuaaaaauaggaaaaaaaacaguauuagaaaacauguauuucagauuacccaugguuauaauuauauaacguuguaaagugguuacacuugcguuuuggguuuuuuuguuuucagacagggucucguucugucacccaggcuggagcacaguggcgccaucuggguccacugcaaccuccgccucccaggcucaagugaucugcucagcuucccgaguaacuggggcuacaggugugugccacaaugucuggcuaacuuuuguauuuuuuuuuuuuuuuuuuggguagugacgggguuuugccacguugcccaggcuggucuugaacccgugggcucaugugaucugccugccucggucuccuauaaguauugggauuacaggcgugagccaccaugccuggccuauacuugguuuuauaacauaaaagggauuugaggccagacacgauggcucgcacauguaaucccagcacuuugggaggcugagguggguggaucacuugaggccaggaguucaagaccaaccuggccaacauggugaaaccccgucucuacuaaaaauacaaaaaaauuaucugggugugguggugcacacuuguaaucccagcuacucgggaggcugaggccugagaaucgguugaaucugggaggcggagguugcagugagcugagaucgcaccacugcacuccagucugggugauagcacgagacgcagucucaaaagagaaaaaaaauaaaaauaaaaaauaaaaggguuuuauaucacaccagguagcuaccccuuauuauaaauaaaaugcuaauaaguuuuccauuggacuguaaaugaucagauuguaguauauuaaagaaauagcaaucaacuuuaucaggaaauuaaaugucagugauuuuaaauuaaaauuuuuuuuuuuuuuuugagacggagucuuacucugucaccaggcuggagugcaguggcaugaucucggcucacugcaaccucugucucccgaguucaagugauucuccuaccucagccucccgaguagcugggacuacaggugugcaccaccacgcccagcuaauuuuuuuguauuuuuaguagaacgggguuucaccauguuggcuaggauggucucgaucucuugaccucgugauucgccugccucggccucccaaagugcugggauuacaggggugagccaccgcaccuggcccuaaaauuuucuuuuuauuauuauuuuauuuuucuuuuagcggcagggucucacccuguugccugggcuagaguacgguggcaugauuauagcucauuguaacuucagacuccugugcucaagggauccuccuaccucagccuucugaguaccuuggacuacagaugggcgccaucaagcccagcuaauuuuauuuuuuguggagacggggucucgcuauguugcccaggcuggucucgaacaagugcuccucccaccuuggccucucauggugcugggauuacaggugugagccacugugcucggucaaauuuuaaaauuuucuugaaucucuaaauccaguggggauguguguguguuucuuaacaacuugggauacucuuuuaacucguuugguaauuucaauuugauaaugauaaauguaagguuuauaauucuuucuuccuuggaacaugaaauauaaguaauauacuugaaagagacuaaacucuuuggagaaaaaugugcaguguuuguucacuuaaucuugccacaggcaaaccuagguaauggacuaagugguagauugaagggcuauugcguuuuagucuugauugauaacacuuaaugguauuuguuuaucuuugagcaagucacuuaaucugccagggccuccguuuucauaugucauaauaauaaugaaaccucucauuacaguuuuucagaacacuucccauacauucccauuugaucaucaccacaguccugugagguaugcauggcagauacuacuguccucauuuuacugaugaggaaacugaaacucagagguugaaugacuugcccaaggucacaaaacuaauaaguguccuacccugauguacucucugauuuagauuuugguuuuuuuuugguuuuguuuuugagauggagaauugcucuguugcccaggcuggaguacaguggccaugaucucugcucacugcaaccuccaccucccugguucaggugauucuccugucucagccucccaaguagcugagauuacuggugcagaccaccaugcccggcuaauuuuuguauuuuuaguagagaugggguuuugccauguugaccaggcuggucuugaacuccugaccucaagugauucgccugccucggccucccaaagugcugggauuacaggcgugagccaccgcgcccggcugauuuacguuuuauaaccagugcucuugccacuagaugcuuucaucuuuauguaugcuaaauggagauuagugaucuauuacuuaaugauaauauuguggauauugaaaacaaguuuaaagcauuuuguagaaauucuguagaaauuaaagugaacauacucuuuuuuuuuuuuuuuugagauggaguuuugcucuuguugccuaggcuggagugcaauggcgcgaucuuugcucaccacaaccucugccucccggguucaaaugauucuccugccucagccuccugaguagcugggauuacaggcaugcgccaccauguccggcuaauuuuguauuuuuaguagagaugggguuucuccauguuggucaggcuggucucgaacuccugaccucaggugauucgccugccuuggccucccaaagugcugggauuacaggugugagccaccguucccagccuaaagugaacauauucuuuuuauuauuucuagauguaauuaaaauagauauuaguugacuuccuauaauuucuaauauucuuuggccuuugauuuuuuuuuuuuuuuuuuuuuugagacagucuuacucugucgcccaggcuggagugcagugauacaaucucggcucaaugcaaccuccgucuccuggguucaaggauucuccugcuucagccucccgaguagcugggauuacaggcaugcaccacuacgccugguuaauuuuuauauuuuuaguagagacgggguuucacaauguuggccaggcuggucucgaacccuugacuucagguaaucugcccaccuuggccucccuaagugcugggauuacaaggcgugagccaccacgccagaccugaucauuuuugguuguugauuaagcuguguauuucucugagggccuggccagugacacauagucauugaguuaggcaccugguuggacucagccuggucugagucaaccagaggcacuaaucuacugaauagcuauguagguaagacuuauaaaacuuucuuugcuuuucuguagaacagaagccaagauauuuuauuuauuuauuuauuaauuauugagacggagucuugcucugucacccaggcuggagugcaguggcucaaucucggcuuacugcaaccucugccucuuggguucaagcaauucuccugccucagccucccuaguagcugggaccacaggcacgugccaccacacccagcuaauuuuuuguauuuuuuguagagacaggguuucacaguguuaggcaggauggucucgaucuccugaccucgggaucugcccacuucggccucccaaagugcugggauuacaggcgugagccacugugcccagccuucuuuuauuuuauuuuauauuuuugauaaggauauuugauucuauuuccauuugugacauucauucagaauaauauuuucugagcaccauacacugugcaaacugugugaucuugguuaagucauuuaaucucacugggcuucaacugauucaguccucuaccuucauuccuuaacugcaaaauggacuagaguaggggaacuauguuccgaggaacugccuugggaguucgggucuagggggacgggaggaggcuagauggaggcaacguacccuggugaaguuggggcagcuccugcuccaacuacucucaaccuccaccacuccagcgcagcugcacuuguauuuauccuaucagucuccagagccuccucaacccaguugucuuuccuccucaacuguggucuuuagucccucuuuuaauuuauccuuugauccuuguauguccuagauucagaggaugauuucuaaauuucuauagccauagauggagcauauuggugguauauugcaccagaacaaaaagggaagcgugugaagggagaaaggaaaaaaaauagaaguaaaagaaacacaugggagagauggaaagaagaacaaauaugaguugaggagagggagguggagcaaaaagguaaaacacauauaaugaaggaaaauaguauguuugucaccugaaguugcauuacuuaauuuuuuuuuuuuuuaagagacuuagagacagagucuugcucugucacccaggcuggagugcaguggcacgaucucggcucacugcaagcucugccucacggguucacgccauucuccugccucagccucccgaguagcugggacuacaggugcccgccaccacacccggauaauuuuuguauuuuuaguagagacaggguuucaccguguuagccaggauggucucaaucuccugagcuugugauccaccugccuuggccucccaaagugcugggauuacaggcgugagccacugcgcccggccuacuuaauuaauuuuuguaaucuucccuuaaguaccuauguguaugguuuucuuuucuuuucuuuuuuuuuuuuuuugagacggagucucacucugucgcccaggcuggagugcaguggcgugaucucggcucacugcaagcucugccucccggguucacgccauucuccugccucagccucccaaguaacugggacuacaggcgcucgccaccacacccggcucauuuuuuuguauuuuuaguagaggcaugguuucaccauguuagccaggauggucucaagcuucugaccuggucauccgcccgucuuggccucccaaagugcugggauuacaggacugagccagcgcgccuggccuuuuuuuuuuuuuuaaaacagucuugcuuugucacccagguggagugcagcagcgccaccuuggcucacugcaauguccgccucccugguucaagcaguucugcuucagccucccaggaaguugggauuauaggcuugugcuacccaugcccggcuaauuuuuguguuuuuaguagagaugggguuucacaauguuacccaggcuggucucaaacucuuggcuucaagugaucugcccaccuuggcuucccaaaguggugggaauacaggugugaagccauugcaccuggcuauauauggauuuuauuagugugccuaaaauuuuacuuucauguauguauuuuuucugugacugccucaauugcuuuguucuccuaauuuuuaaaaaucuauugauuugagaugauuacaaaaguucuuggguuaaaaacaugugauucaaaaauagauucccucuuuauuucuuuaaucuaucuuaauguuuaagaaaacugaggagcuaaucuguuuucccaguagaaauuaaguaacauuuacguuaauuguagucaugcauacuuaccugaaauuugucauuuuaauuuuuuuuuuaaggagcugaugguacacacauggauggugaucaaauuguuguggaaguacaagaaacuguuuuuguuucagauguuguggauucagacauaacugugcauaacuuuguuccugaugacccagauucaguuguaauccaagauguuauugaggacguuguuauagaagauguucagugcccagauaucauggaagaagcagaugugucugaaacggucaucauuccugagcaagugcuggacucagauguaacugaagaaguuucuuuagcacauugcacagucccagaugauguuuuagcuucugacauuacuucagccucaaugucuaugccagaacacgucuugacgggugauucuauacaugugucugacguuggacauguuggacauguuggacauguugaacaugugguucaugauaguguaguggaagcagaaauugucacugauccucugacuaccgacguaguuucagaagaaguauugguagcagacugugccucugaagcagucauagaugccaaugggaucccuguggaccagcaggaugaugacaaaggcaacugugaggacuaccuuaugauuuccuguaagucuugggguacagugauugucaaagguguuuuuguaggcugccucuucuaauuuacaucaggggugaaauuuucuugacuuaaaugucuguaaaaguaaaucucauagaccuaccugcauuguuguuuccauuugcagccuacaagauaacugaaaauuaagaaaagugaggccgggugugguggcucaugccuguaguccgggcacuuugggaggcugaggcagguggaucaccugaggucaggaguucgagaccagccuggccaaccaacauggugaaaccccgucucuacuaaaaauacaaaaauuaaccgggugugguggugggcgccuguaaucccagcuacuugggaggcugaggcaggagaaucgcuugaacccgggagccggagguugcaguuagccaagauugugcuacugcacuucagccugggugacagagcaagacuccuucucaaaaaaaaaaaagcugaaacaaacagaacugaacuuuggaaucaugaagaaugugauuaggcuguuaccagccuuuauuagaauuaugaacucucuugaaaccuaaaaggaguucaacuuggaaaaacaaaaagucuaaccaagcuacuuacuuuuuuuuuuuuuucggagggagagucuugcucugucguccaggcuggagugcaguggugcgaucucagcucacuguaaacucugccucucgaguucaagugauucucgugccucagccucccaaguagcugggauuguaggcacgcaccaccacgccuggcuaauuuuuuguauuuuuaguagagaggggguuuugccauguugcccagucuggucuugaacuccugagcucaggcaauccgccugccuuggccuuccaaagugggaggauuacaggugugagguaucacgcugcuacuuauuuucuugaauauggauacacgguacuguuuauguaauacuuauguacuuauauaauauguaaaacacugcauaacagauaacaugaaaaagagcucugguauaguaugaaacaugauuccaaaacaugguaucaaguaugauggauucauauuagguuauuggagaaaaguaaaguauuuugaaacacaccuuuacauguuuaucuuagcaucuggaaagacaaccguuaucuucuuacaacauacuucuugguaccaauuucggagauaaaauucuagauuggcuaggccacgguucugacccaguguggaaauucuuaugccuuaaggaacuaaacuuaaaauauaaaggauucacagacuauuuauaaauuuacaagaauauuugcuuuguucgaauaccuguuuucauacaggaauuuaauauaacauuaauauacuggaguccaccagcauuuuaggaaacuucuuugagauuuugaaacuccuuugaaaacuucuugagauuuugaaaaucaaagaauuauuuguggaaaagggaagaaaaugccuucauucaacacguuuauuggacccugaaugugugagacauuguuguagguagcguagauacagauaugugcuaaauaaauacauacauaagaccauuaucccuggagagcuuuugaucugcugugggagagaaaguuuguagugugaugcagaggugugacuaaacugccauggagaugggauggaguagcugaccuuugaaaucaaggaugaauucuaguuuuacaggaugaagggcacggguggcaggaagacauuccaggcauauaguauaguguauuaaaaaagaaaaaaguucuggccuuugcugauauugcugauaaugaugggaacuuuaggauacacuuuuauaucuuuguguacguucuauuuuauuccuuagaauaaauuuguagaaauagaauugauagaucaaaggguguacacauuuacaaguuugguuaugcuugaaguuugguuaaauucucuugguauuuugccuuaauauucccuucaccaaguugaugagaauguucauuucccuacacuggaaccaacacagaguauuauuuuucuuuuuaguuuucgccauucugauagggaaaaauacguuacccuguuucaauuuugaauuuauuuuaggaugaugauccuuguauguggaauaagacuuaagugagggagagauuaguggcagugaacuguugaaaugguucauauauaagaugaucugaaguacguuaauaauaguaaaggggacagagagguagcugcauucaagagagauuaggaagaaaaauggaugagauucgaugauagauaaaagaggcuagggguuugaggaagaaagauaauucaaggaugacccuaaguguucuaccuugggagauuggaugccuagucaugccauuaccugaaaggaggaguagguuuggugggggaaggugggggaagggggaagauuuaggaucuguuacaguuugaauugcuuguugguggauguuucuucuaggcaguugaaaauaugacuuuggugcuuuugagagaguuuguugcuagaggaagaaauuuaggacaacagaauguaggcaguaucauauauggaaauggaugguagucuccagagcaugcuugucgagugagagugucaaguauggcuccuuuagguauuuaagaaguaggcagaaaagaguccuugaaaaaucaggagguuuugggaagagaaggaggagaaaaaguauuuccaacacuguuaaggauagaguuucuacaaguuaucagccacugaggagaaagcaggcuuuuuuguuuggcauuuaggaggucauugguaucuaaauuagaguagguucaguaaggcaugggcuauuggagaggagauggaagagaugagcugugauggauugagaaguuaguggaaguagaguuaggugaagcgguuuggauaaauugccauuuuggucagcaaagggacuaaagaggugggaguauagcuuuugaugguugccuggauggcgaaaguaaguugaacauguuuauagacuuaagggaaaaaaaaaaucacuggacagagagaaccugaagauaaagaaaggaugggcuaguggagcagguuccagagaaggggaagggacugggguccagggcugcaggagauggcuguuagguaaguccuggagagggaaagugaguccccuucucugagacaggaagacaguuaaggaugaggccccuuuccagggacagaagguaaaaggaguacuugaauguugggagcuauuuugucugugaagcagguucaucugcacauauggaaggacugcagaggcuggguggaaagcugaaggauaauggcaaaggguugaaaagcuuuagucuuuaggggaugggccaguguaggaagccaagaauuuaugagauagauugcugaaccgcauugaggggccagcugagguuaggagucuauuuuauuuuauuuuauuuuugagauggagucucacucuguugcccaggcuggagugcaauggcgccaucuuggcuuacugcaaccuccgccucccggguucaagcgauucucaugccuuggccucccgaguagcugggauuacaggcacucgccaccaugcccagcuaauuuuuguauuguuuaguagagacgggguuucaccauguugccuaggcuggucuugaacuccugaccucaggugaucccacccgccucggccucccaaagugcugggauuacggacgugagcuaccacgccuggccgaaaaugcuauuuuaaaaugcagguugagcauccuuaauccaaaaauccaauaucugaaaugcuccagaauccagaacuuucuaaguacagacaugacaccacaaguggaaaauuccacaccugacacuugcuuucugaggguucaauguauauaaacuuuauuucaggcacaaaauuguuuuaaaaaauuguauaaaauuaccuucaggcuauguguauaagguguauaugaaacacagauaauuuuuuuuuuuuuuuuuaauuugagacagucuuguucugucucccaggcuggagugcaguggcuccaccucggcucacugcaaccuccaccccggcucacugcaaccuccacccccuggguucaagugauucuccugccucagccucccgaguagcugcgauuauaggcacgugccaccaugcccagcuaauuuuuuuguauuuuuaguagagacgggguuuugccauguuggccaggcugaucucgaucgaacuccugaccucaagugauccaucugccucagccucccaaaaugcugggauuacaggcgugagccaccaugccuggcugaaacacagauaaauuucauguuuagacuugggucccaucccuaagauaucucauuguguauaugcaaauauugcaaaauccacaaaagucugaaacacuucugguccaaguauuuuggauaaggguuacucaacccuuacgacugccagauuuucuauuacaagaccgggcaacccaggaccaaggcuagagaaagcagagaguugaguucgucccaguuugugaggggaagagggccuggugaaauacugaagaggauaaagcacucucgcuucuccuugacuucucucugcacuuucugcccuuucugucuuccucagcuuuuuugcuaaggaguaaaaugcaugguauugguuugcccuuuaacugcgcacuaucucuugccuuuacuuucuccucuuuuaggaaguucagcccuccaaggaagucauugaaaaaaacccagaaguugcuuuaguaacaauuuacucagcauaucagguucuuguauuacagaauuuguaauacaagacauguaaaauuuuacagacuuguaaaauuuucauuaaaaauuuuauuuauagucaucuuuaggcccuggguuucuucuaauuuauauagauuuuaauguuccugaaaaaguaaauauggaugaacauaaauggcuauuaguguauuuuauauauuuuaauauauguuuuauguauguguauauauuuugauaauauaauuucuuuccuuuuaaaauaaaacauauccaaacucaaauaaugcagagauacauuuaaacaaauacauacacacaugagcauuugcgugcacacaugugcuauuccccuauuucacuauaaugaaaugguuguuuuuaaguuggguuuagagaugguggccuuuaguaguaucuuuugucuucucuauuauuauguuugagaugaagucucgcucccuuacccaggcugggagugcaguggugccaucgcggcucacuaccaccucugccuccugcgcucaagcaaucuuuccaccucagccucccgaguaguugggaugacaggcaugugccaccacacccgccuaauuuuuacauuuuuuguagagaggggguuuugccauguugcccaggcuggucuugaaccuggucuugaaccagccugggcuuaagcaauuugcccacuucagccuccccaauuucuucaauucaggugugagccaccuugcccggccucuacagccacuuuugcacucuuacuucccucuacuucaucauccccuuuccuuucaaaguaaugaucauauuuuaaaauuuaauuuacuauuggcuuugggaucaaaccaauugaacacuuuagaauuaacuaauauuucucuuggcugugccucccagcaaagauacuuaaugaugcauuuuauuuuaauuaauuuauuuuugagacagagucuugcucugucgcccaggcuggagugcaguggcaugaucuugguucacugcagcuuccaccucccagguucaagugauucuccugccucagccuccugaguagcugugacuacaggcgcgugccaccacgccuggcuaauuuuuguauuuuuaguagagacaggguuucgucauguuggccaggcuggucucaaacucuggccucaagcgaccugcucaccucggccucccgaagugcuaggauuacaggcgugagccacugcuuccggccuuaaugaugcauuuuaacuuaaaacuuauauugaggucgggcacaauggcuuaugccuguaaucgcaacacuuugggaagccgagaugggggagggucgcuugagccuaggaguucagagguuacagugacccuugauugcgccacuguacuccagccugggcgacagaaugagacccuguuucuuaaaaaaaaaacaaccccucccaaaaccccccuaaaacaccuauauugauuucagaaguuaaggauuaacaaagguuuugucguaaguauauagaggaacuaugggcugauuuaauccaugauagagaaugugaagauaccauuaucgguagucaacuuuaaugcuuuucauauuaugaugagagaugguaguauuucugaaucuuauauuuauuaaacacucuaucuuuaggucagaaauguggccagauguccaaguacucucuuuucuacucucuucuuuaaaaauuucaguaaguuacuggaucugagugucuaauaaacagcuuuuacaaugucuuuaguauccaucuuggcagguuucuucccucugcacgucucauuuaaaaugaugaugggccagguaagguggcucacaccuguaaucccagcauuuugggaggcugaggugggaggaucucgaggguaaggaguuggagaccagccugggcaacauggcgagacuccaucucuacuccccacaaccccccaaaaaaaagauuagcuggugugguggcaugugccugugguuccagcugcucaggaggcagaggcaggaggaucccuugagcacagguguucgagguugcagugagcuguaaucauaccauuguacuuccgcccgggugacagaacgagaccccaucucuuaaaaaaaaaucaaaaaccaaaaaaccacacaaaacaacaauaaaugaugaugaagcaguccucauucuuuauaauaucaugguuguguauauagacacagauguucauugucacaguauauagcuaccuuugaggucaggaugacugccuucuucagucuuugcaaucuagauuuuaugauuggcuucuaaguuaauuauauguuucuugaggacaggaacuauuuacugcaucuuugcugcuuauguaucuuccccaucacaccguauguauauuagguaugaaauaaauauuuguugaauaagugaauauaugaauguuauagcugaaaguccguguacaucaugccucauccaaggcauuaacgauaaauuucuucccuaccaguagcuauugucucuugauaaaaauagguaauaguaaaucuucaauaaaugauaucuaugugccggaauugaaaauauaguuaguuuuugagaugagaucucaccguguugcccaggcauacauacauacauacaugccuguagaugugcaguggcuaucugcaggucugaucauagugcacugcagccucgaauaauagcuucuccaaggucacucccagcagcauuagggugaggcuuugaaaccaguuauguuuuauuccaaaguguccacucuuaauucucuuauuggcccccccuuucucucucugugucucucucucuguguuuguauguuuguauguauguguguauaauuuaauacuacaaagcaguagaguucaugauaaauagugcuuauugguagaugggggaggcaaauagaauuccaaagauaacuacaauuuacaauaauaaugaauuccaaauuucaacaauguuaaacaauaauuuguugggaggguuuaagcauuuuuuuuauuuaacucauucuagcagaagcccagacagcuuccaaaccccauccuguuguuuuucuaacugaaaaguauuaauuuuuuucaaauuuguauuuacaugagaaaaaggaaucauauauacgcuaucacuuuuacucuugccaguguugauuuuucuuuugccuucauucauucagaaaacauuuauugaucagccauaaugagcugcgaaccucacuagggguuggagauaaacagcaaagucccuggcuuuuuaaguucacagucugggagggaagauaaacagaaacaggcaauuacaguugaguguaggaagguauguaaauagauauagaaaguacuuuagaagcacuaagaggauggggcugggcacggugacucacgccugcaaucccagcacuuugggaggccgaggcaggcggaucacgaggucaggaguuugagaccagccugaccaacauggugaaacccugucucuacuaaaaauacaaaaauuagccgggcaugguggugcgcaccuguaaucccagcuacucaggcggcugagucaggagaaucguucgaauacgggaggcagagguugcagugaacugagaucaugccacugcacucuagccacugcacgcuggugacagagugagacugucucaaaaaaaaaaaaaauuuuuuuuuugguacgcuugagggagacaaaugcuacaaaagcguuauaaacugaaguucuauggaagcucacuugaagauauugaccaaguuuauuuuaucuccuauucauuuuccucccuccuguauuuuaagcaaauuccacauaacauuuuuuucauaaguauuucaguauuugcuuuucaaagacaaggauuaaaaaaaaacuguuuucaaagcuuuaaaaaauaauuugagaugaacucaaucugaaggguguauaaaauaaaauguucaugagguggcugaggagggaagaaaggcagagagaugugagacaucauugaguguucagagaccuauucuuugggugcuaauaaugucuggugaggaggauggaggaaguggugagaaagaagauuggcaaauagggcccaaaacauaaaggcucuugaacauagacgccugcuuuacuuuuuggacgugggaagcuguuaaaggauuuuaggcagauuaauaauaacauguuuagauuuauaguuuagaaagauaauggcaauguucagggcaggcgcaagguaagagcgaauucagaaacaaaaaguacauuucggaagguuauugugguagucuagguaagaaacagaugauaauaguuugagauaaguuuguguuuuguuuuuuugagauggagucuugcucugucacccaggcuggagugcaguggugcgaucucugcucacugcaagcuccgccuccuggguucaagcgauucuacugccucagccucccgaguagcugggacuacaagugcgugccaccacaccugacuaauuuuuuguauuuuuaguagagacgggguuucacuguguuaaccaggauggucucgaucuucugaccucgugauccgccugccucggccucccaaagugcuaggauuauaggcgugagccaccgcgccuggccugaaauaagguuuuaucgguagaauuuagcagaaacugauucaugacauauguaggaaguagaauuuggauuaaauuuaggguugaggaagaggggaggguuugcagcucacuucuugguuuccagcuuaugcaacugggcacauggcaaaacuguuacuagaagaggagcagauggacaugcuaaagauuuauuuacaggguugcugcauacaacuacaauguaaagggacuccugcaaauguguaaugagguggcccugguuugcccuggccaucuaguuuagguauuuugaccagucauucuaauauuagcuccuaauuaagcaugacuuuggucauaguagacauccaauaaaacgugguucagggagcgaauaaauacauaaaguccaaaccccuauguuuaauguauaaacccugagggucaacacaaucugauaguugauugauugauucuagggacuguuagcacagaagagauaguaaaauauuuacucuuucauuccaugggcuaauuauuggcuagguauguauuuuaccauuauuuuuauguauguacccuaccaguuuuuuuaaaccagggagcaaauaaauacauaaaguccaaacuccuaucuuuaauguauaaacucugagggucaacacauccuaauaguuuauugauugauucuagggacuauuagcacagaagagauaguaaaauauuuacuccuuuguuccauggguuaauuauuggcuagguauguauuuuauuauuuuuauguauguacccuaccaauuuuuuaaaaaccauuugauaaaacacaggaaaaaguuuggaauuugaaaacuauauaucuacaugggaauauuucugaaaugugagaaaaguguuauuuacugaacuaaggauauuuuggagaagguguauugaagauuuuuaaaauuuauuucauuauuuuuuaauuaaauuuuuuuaguugcccaguaaaaaugguauauauuuaugguacacaacaugauguuuugaaauauguauguguuguggaauggcuaagugaagcuaauuaacguauauuaccucacauucuuauuuuuuuguggugagaacacuuaaaaucuguucucagugauuuucaaguauacaguacauuguuauuaacuguagucaccucaagcaucuuuuuaaagcuuuuucagauaaaauucgaaaagugguuauuuuaauccaucuaaaauuguaucuuuacuguaaacugaaauuuauuuagaaaucaacacuacaauuaaugacuuaagaguuuucaguauaauguucaaucuagguguuggcuagcuuuauaacaagaauaaagcacucaaauaaggcaaagauguuuuaguuucucccuuccccugccaaaaacaagguugggaaaaggucucuauuuugaaagcauuacaagcaauuggagcuucagacuggccuugugguuaauauuuacuguuuaucugcugaaaccuagacaaaaaugucacccugcccuuugaacagauauaugauuacuuugugagguaaugggcuuggggagggaagagaaaaggagagagggagagagagaacauaccucuccuugccuaucuuagagaagcaacaucugguauauggaaacucagcuugcagcugagucaggcagccuuggauuuggauaccagcucugcuacucauuagcugaaugaauucgggcaaguuaacuaaccuuuuuguuuuagcuuccuuauuugugaaauggcagcaauacugcuugacuuccagggugguugugagaaugagagauccugucagucacugcuagcuguugcugugguuaucauccagaggcuuucagucaguagcauccauugggcuagcaaggcucaaucucgacuagcuucauuaugaccuuucuguugucccaucagggaauucuuccuggguaagggcagguacagggugggauuguaacaguuauuccuuuuuuuuccuccugaauguauaaagaaaucaguuauuguuuuacuaguuuuagaccuauucaacuauuuuucauuacuuaggucucugacaccaugcuacagaucacucuaacuuaggacagggaccugacuggcacuguuccuuuaauuccucgucuacggaaugaggcuaauuucacuaaaccuuugaaucgcucuaggaauguuucaagaauuaaaggagaucagaucguacccaauucuuucaagucucuuauaggcuauauaauaaaaauaagguggaauuuuaaccccacaaagaggguuccugaggaggaaguuaagagaggaaggucuaagagugaaauuuaaauguauuuaucuacuaaagcauuugccuucuugacagaauacuuccugcaaguuacucagucuuuuaggugcucuguuuucacauaugucaaguagagacagaacaucuaaguucugggguugucgucauugauuucauaauaaaauacagggaaacuacuuaccauagugccugggacauaauaguugcucagauauccuuuuaggaggaaauacccaucuuugauaucuucauuggauuuuuuuuuuuuuccgagauggagucuuguucuguccccccaggcuggagugcaguggugcgaucuugacucacugcaaccuccaucuccuggguacaagcgauucuccuuccucagccucccgaguagcugggauuacaggugugcgcuaccacacccagcuaauuuuuguauuuuuaguagagauggggguuugccauguuggccaggcuggucucaaacucccgaucucaggugauccacccaucuuggccucccaaaguguugggauuacaggugugagccaccaagcccggccuucauugaguauuaaauagccauccacacagggacccugaggauguugaauaauaucaagucuauccuacaguuuuucuuuugauuggauuuugggguuagagguuuaaaaaacauucugguaauuagguaguaagacuauuagacuugccauaguaaguuagaauaggcucauuguucacagaaccuaauuuuaucuuagcaauagugagguguaugguaaggaaaggccugguuucccucauugacaucagucccaagaucacaggugugaaucuuguuaaaacuuuagaaaagauuuguguauucauacugccccuugagguaacuuacuuaggaaguaaaaucaucuuuauuuuucucucagauuagccuguuuaaagauuuaucaggugucuggaaggcugggauuuagugaaugaauuuaugucuaccuugugaguauuggccguagguuuauugacuucaaguuuaauuagaguuugagacugauuguguccucauggcauagauuuucccucuuguuugugccuccuagauaauuucaguuguucucaagacgagcacaagaucuuuucaaucuuuauugaaauguggcaaucaguguugcaguguuaagauuuugaagccuggcacaauggcucacaccuguaaucccagcauuuuuggaggcugaggcgggaggaucacuugagcccaggaguucaaacuagacuugacaacaucgggagaccccaucucuagaaacaauuaaaaaaagaaaauagcuaggugugguggcacaugccuaggaggcugaggugggaggguugcuugagcccagaaggucagggccacagugagccaugauugugcacugcauuccagcccgggugacagagcgagacccugucucaaaaaaaaaaaaaaaaagauuuuauuggagcuuauuuuaaugacuguuuaaugacuucucuuuucuggguuuuauuuaagagaucauuucuuaucuuucaggucuuguuguuucuuuuauacuuccaaaggcuuaguacuuccauguuaugcccuucuagugucauuagcagacacuaguauauugguuuaaagauguaaaaccagaugggccauugaaaacauguucacacaaaaacuucugcacauucauagcaguauuauucacauuagccaaaaagugaugacaaccuugauguucaucagcugaugaauggauaacugaaaugugguauauccauacaaugggauaucauucagucauaaaaaggaauuaaguuuuguugaaugcugcaauauggaugaaccucgaaagcguuaugcuuagugaaagaagccaggcgaaaaagaccacauguuguaugauuccaucuaugugaaaugucuagaagaggcagagccauagagaaaguagagaagugguuuccaggagauugggggaagaaugaguugggccugacugcuaauggguaugguguuucuuuauggggaauuagaagggugcugaugguugcaccacagugaauguacuaaaaaucacuuaauuguacacuuuaaaauggauaauuuuguuauguaaacuauaucucaauaaugauaaaagccaaaugggccaagcaacaauccccuagagccuuuauuauuagcuuuucuauuuacuaaaggucccaaauuagcuuuuccucuuuaagcaauuacuuuuuucaguaaaauaucuucagguaucaugagggauguuuaaaaaaggagaggugauaguuguggaauuguggcaaaagcuuuuaauuuaguuuuuaaaauuauuguuuuuuaauuauaaaauacaccuacaauuuaccaucuuaacaauuuuuuaaguauacaguucaguggcauuaagugcauuuacacuguugagcaaccaucaguaucauccauccccagaacucuucaucuugcaaaacaaacucucuauauccauuaaacacuaacuccccgauccccuccuuucagccccuggcagccacccuuuuacuuucugucucuuaggaauucgacuacccuagcuaccucuuauaagugggaucauacaguauuuuuuccuuuuguggcuggcuuauuucaccuagcaugauuuuucaagauuuauucauguuguagcuugugucagaauuuccuuccuuuuuaaggcuaaauaggauuccauuguauggauagaccauauuguguuuauccagugaaaaacuauuuuaaagcaguaauccuuugccuuaccuacccuuuguucuuccuggcuuacccuucucccccccaccaaagcaacuguagcagguccuggaauaacacguuauuuccuuauaauguugaugagaaagaaaaucgacuuucuguuggggccacugucccuguggcguuugcacauucuccucauguccauguggguuuccucccacaucccaaagcugugcacauuagguuuauuggcaugucuacacugucccaaugugagugagcaugcccugugaugguuccugccugguacccugagcugcuggagaggcuccuacacccaugacccugaucuagaaucacugggcaaauaauuaucuuguuuuuacuacucuuucuuaaauauauguguagcccacauuuauuuccauguuuaaugcuacaaguguuuuagacuauauuuagaaguuuggugauguuuuugugaccagaaaugugccauaggaacuuaacucuuguuuauaucaauuagccuacaguaaaaaauuuuuuuuuuuuuuuuuugaggcagagucucacccugucaccccagcuggagugcaguggugcuaucucggguuacugcaaucuccaccucccuaguucaagcaauucuccugccucagccccccaaguagcugggacuacacgcaugcaccacccugcccggcuaauuuuuguauuuuuaguagagauggggguuucaccauguuggcgaggcugaucucgaacuccugaccucaagugauccucccacauuggccucccaaagugcugggauuacaggcgugagccacugcacccggccaaaaaacugcuuuuguuauauacuacguuguuuggcugaaagucacaauuuccgagaaccuaccaaugacauuacgugaggacuuacacuguacuucucuuucagcuauuucuaaugguacuuaucuauaugauuguaaauaauacgcuuucuugauuuuuuuuugagacggugucucguucugcacccaggcuggagugcaguggcgugaucuuggcucacugaaccucugccucccagguucaagcaauugucccugccucagucuccugaguaccugggauuacaggugccugccaccgugccaauuuuuuuuuuuuuuugagauggagucucgcucuguugcccaggcuggagugcaguggcgcgaucucggcucacugcaagcuccgccucccggguucacgccauucuccugccucagccuccugacuaguugggacuacagaugcccaccaccacgccuggcuaacuuuuuuuguauuuuuaguagagacgggguuucaccauguuagucaggauggucucggaucuccugaccucaugauccgcccgccucggccucccaaagugcugggauuauaggcgugagccaccaugcccggcgugcccggcuaauuuuuguaguucuaguagagacguuucacgauguuuugccauguuggccaggcuggucucuugugaucugcccaccuuggcuucccaaaguguugggauuacaggcaugagccaccacgcccggccacuuucuugauuuuuauuacuucuguuuuauauguucuuucuucacguccuguugugauagcugacaauuuugcucacuuuuguucucaccucccuuucccgugacuuuucaugauaaguguguuacaauuuuugguucuuugccuuuuagaauuuaaguaauacauuaacaucuuuauuucuuguuccaucaaauguggacaguaucuuuugacuccuccuuuuuaagaugaggauaucagugccuuugcccuccacuuuccuugagcuguucagccuaccuuccaaucuauguuuacuuuguauuguugaggcugauccaucuaaguuuauuuuuuuugagauggaguuuugcucguuacccagguuggagugcaguggcgugaucucagcuuaccacaaccucugccucccggguucaggcgauucuccugccucagucucccgaguagcugggauuacaggaaugcaccaacacgcccggcuaauuuuucuauuuuuaguagagacgggguuucuccauguuggucaggcuggucucgaacuccucaccucaggugauccaccuuccuuggccucccaaagugcugggauuacaggcaugagccacugcgcccagccaauccauguauguucuauaaccauuagccuuccaauaaaguagaaaaucaguacucagugcuuacauuauuuugauugugaaaauaucauuugcagcauaaccauugaucacuuugauuacauuuuugcauacagcuuuuuuccccuagaaauuuuaauugucuccuuucccccuuguauuaccuuuuuuuuucuuuugggagacaggaucuugcucuguugcccaggcuagagugcaguggugugaucauggcucacugcugcaaccuuggacuccugggcucaaacaguccuccugccucagccuccuguggagcugggacugcaggcaugugcuaccacacccagcuaauuuauuuuauuuguagagauggggucucacuauguuguccaggcuggucucaaacuucucgcuuaagugauccucccaccuuggccucccaaaguguugggauuacaggugugagccaccauguuuggcuguagguugguuuguuuguuuguuuaugcauuguauuuucaugcaugggagcccuuugaauuuggagauuuccucuaauaguagccacuagccacauauuuggcuaaauaaaguuguuaaaaugaauuaaacauacaguuccugcguugcaccagucacaguucaaguacucaauagcuacauguggcuagugcagagcauuuccuucaucaaagaaaguucuguugguuagcacugaucugcaggcucagugaaauugcaaacaauaugaugucuuuuuaaaaacuugagacaggccaggugugguggcuuguaccuguaaucccagcgcuguaggaaauggaaguggaaggauugcuugaggccaggaguucgaggccagccugggcaacacagaucccaucucuaccaaaacaaaaacauuuauuuaucauauauuacaaggcaauaggggcaguuagaguagaaauugacaaaauucagaaagaagcugaagagaaaaaaauaugaucaagguaaaagccaccagagaagcaacaauaagaaaaaauguaucuuagcauauagccaaggacagagggauugggcuuuaagaaaucacaaaaugaaauuguaagaaaauaaaauugugaaaaugcuuauggagaaggaggauagauauggagaaagauaaaggauacaaacacacauaagugaaauuccagaagagaacaacuaaugaacuagaaaaauauuuauaaugggagauuuuuuuccugagauaaagauuaggaucuuucuuguuccaagaaauugucaaaaugguaaaacaagcaaaucauaaucauacuguuauuuagugaacuuuaaggaucaagaauuacagggacauccacacacaaaugcucaaugcuaggagacaguggaacaaugucugcaaaguucugaggaaauuguaaccuaagaguuuuguacucagccaauucauucuucaaguaaaggccauggaccaacauuuucaaguauucaggaauucagggacuguaguacccauuggccuuucuugacagggaugggggaacuauuugguauugaaucuagcagaugaaaggaucaaucaauagaaagaacccuagaauggagaaacugauuuuaaaaaaacuagaaaugagcagugaauucauuuaauauaaaacuagcuauaaaauauuugggggaguggagaagucaaaauguuaacuuccacaucuuucacauagugacaguagaugcuggcucuaaaacuuauuuguguauuauaggcaaaauauggaugcuuuuauaauauuuuuucuuuuauuuauuuuuugaagugggguuucgcuuuguugcccaggcuagagugcaguggcacgaucaugacucacugcagccuugaccuccugggcugaagugauccuccuaccucagccucccgagcagcugggaccacagccccauaccaccaugcccagcuaauuuaaaaauuuuuuuagagauggucucacuauauuacccaggcugaagcaauccucccaccuuggccucccaaaguggugugauuauaggcgugagccacugcaccuggcuuuguuuuuuuuuuuuuuuuuuagaggguuaagaacuaauaucuuaaugaccaaacauuuacuugaagauuagcauucauauauuuaacgaaugaauguugcuugcuuacucuauaugcugggcaguauuguaggcacuuggaauacauuagugaacaaaacacagggaaguuucuuucccuuauagacauuacauucuagcagagguacacagauauaggugaguaauacagcauauuauaaggugauacguacuuagggagguaaaaagcaguauaaggaggauuuggguuauaaguauggucaggguuuugcugagaagguaacauuugagcagagacuuauuuuugagacaucugauagacaccaaagaggaaauacauguacaaaucugaguuauggagacaggucuagaguggagauguaaauuugggaguuguugguacauagaugaaauuuaagccaucagacagaaagagauaaccaaaggagugauuguagacaaacuaagacuaaggacuaagcccugggguuugcagcauuaggcgguaagaggaggcuccagcaaaagagugaggaggcauggucuugguuagugaggugagaggaaaccaagagguugggucaggggagccaagugaggaaaguaaaucacagagagugagcaucugucagaugcugccgcugcaagucacacgagggcugagaauuggucacgagugaccuugaugaacaguuuuggugaaguuaugggcaaagaaugaccugauugaagugaaucuuuuuuuuuuuuuggaggcagggucucacugucacccaggccgaagugcaguggcacaaucacagcucacugcagccucgaccucccagguugagguuguccucccaccucagccuccuggguagcugggacuacaggugcacacuaccaugccuggcuaauuuuuuaauuuuuuguagagauaagggucucgcuguguugcccaggcuggucucuaacuccuggguuuaagcaauucuccugccuuggccucccaaagagcugggauuauaggugugcaccgcugcacccaaccuugaagugacuuuaaaggaugaaaugaggcuaauuugagaaauggaggugguggagaaaugggaucaagaguuuuugcuuagccgggcacgguggcucaugccuguaaucccagcauuuugggaggcugagguggguggaucaccugaaguaaggaguucaagaccagccugaccaacauggugaaaccccaucucuauuaaaaauacaaaauuagccaggugugguggcgcacgccuauaaucccagcuacuugggaggcugaggcaggagaaucgcuugaaccuggaaggcaaagguugcagugagcugagaucgcaccauugcacuccagucugggcaacaagagcgaaacuccgucucaaaaaaaaaaaaaaaguuuuugcucguuuuaagcaggggagaaagaauggcuuguuuguauccugaugagaaugauccaguagaggaugcagggaaagagaggggagaggugcucaagcagugaagggccuucagaaagaggggaugggcgauaggaaggaacacaaugguuugugggaacaggcugaagacagcguuuaugggcuuaguugcugguagguggauuagaugugcuagcaaaucuucucuucugauuguuugaauucuaggugaaguaagaaguaagugaugauggggaggugguauuagacauuugaggggagaugagaauagggaaaagaggagagaacagaaaguagcagaaauggcucacugcagguucaggguuaugaauuuaaagugaaaccaucugcuggguguguguuuguguuucuguguguuuccagccacauuuagcuacauaggugcuagugcagaggcaaagaggcaaauuguaaagugucugauugugccaagccugugugaugaaacaaaagaagggguagggaaagggaauugagaucgugggcaagggaaugggaucgacuuuggaguuaaaauuguuuuguuguugaguuuaaauucuaauguuguaccuuuguuuaaaaagagcauguuacaauaucuuauuuucacaaaaaaaucucuguucuuucuuccauccuuuuauuuguaguaugcguggagaaaugucuaaugaucuguaaauucuguugauaguucccaguggcaggauuuugagcacauuuucauuucuuucagaagaugaagauaaaggucugaguucuaaagacaggcaccucacuuucucuuccaccucucacuuaguagcucacugacuuugggcaaaucacaugccauuucagagccuguauuucuuuaucuggaaaagaugagaaucagauguaauaaaaaaauguagaaaugcuaaggauauuacaaaaugccaugcaauugguaguuauuauuagaaguagucuuaauuuccagaaauuaugcucuucuauuuuggagaagccuuauucuaaagcucuaguucuucauuacuacauuaggagaaggcacuuaugcaggaaucauagguaggaugacucaauuuuaucgaagccuucuuugucuguuuuuagaaauucauuuuuaauaaugguagcuuuaaaaucauagugaaauuuugaguacuuaacaggaccauaaaagugucuuuuuuaaagauaaaucauuccuguaacauuucauauucagaauaauuuuauagauugaguuagugggauaaauguucaaggugaaaaucugaaggugaauuauauuuauguaauagaauagcuuugcuaccagguaagcucauauauuuggaauguguuuucccucacauuugugaaagcaaacaaagggcuuuuacuccaaguuacagguaaaaccaugacauuuugcaagcucuaaaaugauuggauuuucuagucaucagagguuuaaccugaaggguacagacaaauugacaugcaaaaacaacaagccuggcccuguucuuuguaaacacaaggacauuggauuuuccaguacuuguuagaaucaguuuugacaagccuugucaaaagaggccagcuuuaucaacaacaucaaacuguuucgaguugaguuauccaaagauguuacagauuucugccuaguuuggugauaacuuuaucccuccacugcuaccucaguuugaaauuccaaaccaccuuuaagaaaauaaccuuggcccaguuagccggguauaucauaaaaauagcuuugaaaaaggguaaguacauaucaguccagaaguaagaacauuaauauugacucuuucucccuacaaaccauuuuuauaaagcauaaucaaaauacuuuaauuuagauaguuauguccagcguuuagagaaccuguaguuguuuucuaacugcaaagacuuuaaccaguuggacucuuuaagccuucauaucauuaagcuuguccuggaucacucauuuucucuaguuucucaagcucuuaacccagucuguuguuuucucacugauuauccaaguucuugccuccuguuucauaccuaugauugaagccaccagccaugaacuacaacuuucugcauuaucaccuucccugcuucccuaaacccagcauagcuacauucucauucaagucucagaaggauagcauguuucucuucuauuuaaggaaaauuccuucaucuuugcuccuaguuucauuuaucccuuuuccucugagaucuggaucccaaaauuucaucaugugcucuggcuucagucucucacuuucuauuccguuuucucccacagacugagcaugcuugaguauuuuuaucuauuaauacuaaacggaaaaguccuugacucugcaacccauucuaguuauuguccuuuuguuugccuuuuuacauacuugaagaaauucacauguuccauugacuccucagcccacucuagucugacccccuacagccuucacuccacugauuuuaaccaagaacaucagcgaccucaugcuacuacgguggacauuccuccuccacguuccuucuuguguggugcugcauuauugccaugggccuuacuaggguuccugcaucuuuuaacucccuagcuuccuucaugcccuucuacugcccucuccagcuuucccuucucugguuuaugaacuacucuugccccucccuucaacuguggcauuccccaggacucuguccucacacugcagauucucacugcaugauggcaaagcuuaguuaacacaguugagggcuccccaaagugugucagccuuccaauuucagacuugaauauuaagcagcuggcuucacaucucauucauucagugaaucguugauucaucaauauucugaucaucuaccaucaccagacugggucuuaaaagacugaguaaugaaaauacagguucugcugugucaaugggaaagacggggagaaaaaccagacaguggccacacagugaaucacauauuccaagagaagcaagcaaagggugccgugagcacaaagcaauagugacaaucacugguucuuagggcuuuucaggacguuauucuuaggaccuuaaguuaaucaaacaugcaggaagagagauccuuuuccucauuucucucacauuucuuaccccagucacucagucaccuaaauuuaaacccaguuauccuuggcuucuucgucauguuggguuuucagucagacaccaaguucuacucauuucagucccaagauaggccucaaauccagcccacuccgccaguuguacuaccuccguccugauucaaggccucgucaucuaucaccugcauuacugcaguagacucaggucagcuccaugcuuugaucucauuggaucuaccuuuccaaggccagcaaaaacgggcaccugacuuagucacugcuccgugugaaagucucccaguccugcagcagauguucuccagccucucaucagagucccagaggcagggcgccccuaaaucugucucuauauagcgggucccagcgcugcagauucuaauucuguagagcugcuggacuggaugcuuuguuuuuaaauucccuaagagauuuugacaccugaccagauugagaaacccuuggccugcaaggauaaagucggagcccuucugccugugcaugaggcccuucaugaccuggcuucagcuuagcagucggcugcauuuccugccauguccugugccacccuuuacccucacauuccagcaauauugaaccaugcauucccuuaccaucacgccguuuugugucucccuucauuuguccccucucuuucucuucaccugagugagguaucuuuccuuuguucccauggcagcgaucagugcacagugauauuugccagucauuucagacucucauccucucauuuucuguaucaguuuauuaaagauugcauuagaggguucaacauuaaugucaucuuacaauauacauaaauaagcuuuugcuuuuuucucauaaaugaccuucauuucaauuuauguaggaaaaaguauaauuuaucaacaagugcauuuuuaagugacuuguuugguuuugaaacugaagguauauuaaaauguaguuuguugauuagugauaucaaaaauagaccaaaacaacaacugcuuucagugacccagaguuugggaaucuugaacuuugcauuugaaacaagcugauuaaauuuuauaauuuuuauguuuguaaaugacaaagguuuggggcugccauuuucaagcuuuucuuugcaaguaauuugggauguggauggucuugauucucaguaagucagaaguuaaguugacaaauugucacuguauuuuugcuuuuuaauguuggcuuuugagauauuagauucaucuugauguucuguguaagaauuuugauuagguaaacacaguuuuuggaucugauggagaucacgacagaacuuugcagaaguaucauuucaaagacgucagaaucugaguucugucuugguauaacugguguaaauuacacaagggaugacugugaauuuuaaaaguuauaguggucagaaccaccaccaccuagccuugguugcaauacugauuaugccugccugagucaugagcacauucauuuguuuuucacgaaaagaaagcauguuuagauaguuacacuauuuucugauuuuucaaaaaucacaguugccucuaccaauuuaaaccccaugcuccauauuccagaaguugacgagcccugauugggacuaacguagcuugagaucugaauugcgugacuccagauaaguuacucaaccucucuaaacuucaguuugcuuugcugugaaauguagagaauauuguaccaccugccucacaggguuguuguagguauuaaguaguacuuaccauaaucacuuaguaaaugguagcugcauuauuauuacuacauuuaaaaauacucaccuguuuacuuguccacuuugccauaagacuguaaauuucuggagcccuugacuuuuucauauuugcaucuccaauaccugccuagagucuaauguaguugugauucacuguuuguugaacugaauaaaacaauguccauccaaaaggaaaacagauaugucuagcagaggaacaccagaaagggaacuaaaagggcaaaggggaaaugaaaaggcuuguuguugcagguauuacagacaagcucaaugagccuucuuuucugggccucgguccugcuccccucuaguuggucuuccaccaugucagauaggccagcugggccuagagcagagagaacauuccuucaguguuucacuaauggacucaacauugaaaaaacccaacuuuuugugauaaauuaaauuguauugggugcuaacuuuucauuagucuuugccacacuuuuuguugagcuagacauagcagugaguguccauaagugacauguaauguaaggcuacauuauauggggauuaugcuuuugguauuuauucaaauccagagucuguuauuugaagacaccauuuuuugcagcuuuauuuuccagguccugugaauaacaggacacuuauuuucuuggcuacuuuguaaaguuuuaaaaaaugugauguuuggcugggcgugguggcucacgccuauaaucccagcacuuugggaggccgagguggguggaucacuugaggucaggaauuugagaccagccugaccaacauggcgaaaccugucucuacuaaaaauacaaaaauuagcugggugugguggcgggcaucuguaaucccagcuucuugggagacugaggcaggagagucgcuugaacccaggaagcagaaugagccaagauugugccacugcacuccagccuggaugacagagacucuguuucaaaauaaauaaauaaaaauaaaauaaaauauaaaaauaaauaaaugugauguuuguuguauauccccugagucucuacuauuggaaaucauauguaccucuuuuuuuuuuaaauuuuuuuccucuuuuucuccccuucugucucucucuguuuguucauuuuuuaacacauacaggcuauuauaccuucauuaaugagagcaauggguauaugagaauauguuuaaauucacguauugcugcauuugccagcaaggaccuagacucauuauugucauaaacuaaaguuguguguguauguuaugcauauuuacauuuaagcagauugaagcugaauuuccauugaccaaucucauugugguguaccuuucuggcaaucauguuuugauuauuuucaaauguauuauucuauugcaaauagaucauaucaagugauauucaagaauagugaccacgaaguacugcuuauaaaauauuuauaugaagacuauuucuugauuuuacuucuaggacauucuucuaaguuuuuuuguuguuguuuugagacagggucucacucuguaacccaggcuguaaccuucaccucccaggcucaugugauccucccaccucagccuccugaguagcugggacuacaggcgcaugccaccaugccuggcguguguguguguguguguguguguguguguguguguguguguguguguguauuuuuuuuuuuuuugguagagaugggggucuugccauggugcccagccuggucucaaacuccuggucucaagugauccacccaccuuggccucccaaagugcugggauuacaggcaugauccacugcaccuggcugguucuuuuaagguuuuaguauuagaagaucuuuaauauaagagugcuuuuaccuuauggcuuagcaaaggcuguuaaguauauucuuuuguauuuacaguuuucuaggcuaccaggaguuuucucuauguauaguauuuuuugcuuuaauaucugauucuguuuuuagaagucuuuagaaauguauuuauugaaucuucuaguugucuagguaaaauccaauuuuaugugaaucaaguuagagauuauauuuguaaaagaacuuuugccgggcgcaguggcucacaccuguaacccagcacuuugggaggcugaggugggcagaucacgaggucaggagaucgagaucauccuggcuaaaauggugaaacccugucucuacuaaaaauacaaaaaauuagccgggcguggugguaggcgccuguagucccagcuccucgggaggcugaggcaggagaauggcuugaaccugggaggcggagguugcagucagugagcugagaucgcgccacugcacuccagccugggugacagugagacuccgucucaaaaaaaaaaauuuuuuuuuuuuuuuuugcgaauaguaacauuuuauuuaaauaucuguuacuauuugugauuuauuuccuuccuuuuuaguggaugaugcuggcaaaauagaacacgaugguucuucuggaaugaccauggacacagagucggaaauugauccuuguaaaguggauggcacuugcccugaggucaucaagguguacauuuuuaaagcugacccuggagaagaugacuuagguaagaagaaguguuuagacauuauacauccucauccaaauguuucagccugauuacuuuuggguuauuuagauugagaacauuuggagucucuucugaaguaacuuuuauguaagaauuccgguguaguaauaccaaaguuuguaaaaaguaauaagaaaauuauguaaaaagaaauagguggaaaugcaguuuucaaauaaauuauugaagcugucuucuucccugauugauagguggaacuguagacauuguggagagugagccugagaaugaucauggaguugaacugcuugaucagaacagcaguauucguguucccagggaaaagaugguuuauaugacugucaaugacucucagccagaagaugaagauuuaaguaaguagguggccuuuuugugggagaaaauuuuauguuucuggagcuuuuaaguggccaguguuugaaauaaguagcauuauuuuagagauuauuaugcuacuacauuccaagggaaacaucuuugacucuuuuauauaugcuuaugauguugcuuuaaaaccaaguuauggugaaagccaagaaguaaaugauucauucaacaaauauguauugagugcuuacuacgugaaagcuauguucuagguauguaauauuuggaccaucuuuccauuuugucuauuaacugaauucaaauaaaaacguguuuccugugaucucuguaaaccuggucacagaaguuuuuguaacuuucuacuuagauguugcugaaaucgcugacgaaguuuauauggaagugaucguaggagaggaggaugcugcagcagcagcggcagccgccgccgugcacgagcagcaaauggaugacaaugaaaucaaaaccuucaugccgauugcaugggcagcagcuuaugguaaguugcccagcagcucuuagcauugaagaaguugguucuuaaacaugaauccaugauugaaaaaugguuucuguggucuuagguuucagaagucugaaauaccaguauccuguaaggauuauuugaauugaauuagaguauaaagucuacuuuuugucuuuauuuuuaacaggaauuuccuucauguguauauuauguagaaggaaguacugcaagaaguacacaggcuuucaggcugaaaguuuucaucuugauuauguuuggcccaugacuuuuucauuuugggagacaacaagggaguccauggcgcaaaaaugcugacauguguuuuuuagcuuuggaagcuaggcguuuccuacggucucgcgauaauaaaugugcucauaaaacccaugaccuagaauggggaauuucugucauucaugaguaucauggcuuacuuuucguuguuguaguuaaugaagaauuccuaauucuuuaaaauuuauaauacuguauaauuuuguuuuuuaauacacauuguuagguaauaauucugauggaauugaaaaccggaauggcacugcaagugcccucuugcacauagaugagucugcuggccucggcagacuggcuaaacaaaaaccaaagaaaaggagaagaccugauuccaggcaguaccaaacaggugagggcgcacgaguuccauggcgcagcgugcucugcgagcucucagaggaaacucuaguauguauccacaggggugucacaauggcauuuuagcugcuagaccauauauagcuuugucuauugaacuugaaaauauaauuuucagaauucagugauauucaugaaugauuuccuuggauaaaaagaaacaggacauggcugaaacauggaugagaaaaauugaaaacuuggaugauuuuuauguguacauggaaugaaaucccucaaauauguuauaagcauuaacuuuuuaaauaaauuaauacauuuagagaaucuaugucagcauaaagcaggcauaauuuacagagcagcaggauaaguacuuuaguucauaugacauuccuauucuuguaugaugauuugcguauuaaaaauuuuauggguauauuuaaacuuugcuguaaguuaacguaaguuauguuuuuuggaauaaacaguggaaauuuuugucaccaaaguuuauuuuuaugaauaauuuuccaccaguuuauuuacuuauuuuuuuuugaggcagaaucuugcucucuugcccaggcuggagugcaguggcgugaucucaacucacacugcaaccucugcccccuggguacaggugguucuccugccucaaccuuccaagcggcuaggauuacagaugugugccacugugccccacuaauuuucauauuuuuaguagaggcggguuuucagcauguuauguuggucaggguggucucgaauuccugaguucaggugaucugccugccucggcuuccgaaagugcugggauuacaggcgugagccaccgugcccagccaauuuuccaccaauuucuaaauugcuguagguuuaaucacuaauugauaaaaguuacauauucauuaauuuuauuaaacuagagggagugaaggcgguacagucuucaugaaggaaguuuccagaccauuuucucuaugacuagguugcuauaucucuuguguugaaaaacaguaaaaggaauguuaagcagcaaauaguccaauuuaggaguccuuggccaacaguggucagaacccacacuuuauauucgcaaagaaacuggaacagaacuugguuugagcacucauacuccuuucuuuuccuuuuuuagcaauaauuauuggcccugauggacauccuuugacugucuauccuugcaugauuugugggaagaaguuuaagucgagagguuuuuugaaaaggcacaugaaaaaccaucccgaacaccuugccaagaagaaauaccgcuguacugacugugauuacacuaccaacaagaagauaaguuuacacaaccaccuggagagccacaagcugaccagcaaggcagagaaggccauugaaugcgaugagugugggaagcauuucucucaugcaggggcuuuguuuacucacaaaauggugcauaaggaaaaaggagccaacaaaaugcacaaguguaaauucugugaauacgagacagcugaacaaggguuauugaaucgccaccucuuggcaguccacagcaagaacuuuccucauauuuguguggagugugguaaggguuuucgucacccgucagagcucaaaaagcacaugagaauccauacuggggagaagccguaccaaugccaguacugcgaauauaggucugcagacucuucuaacuugaaaacgcaugucaaaacuaagcauaguaaagagaugccauucaagugugacauuugucuucugacuuucucggauaccaaagaggugcagcaacaugcucuuauccaccaagaaagcaaaacacaccaguguuugcauugcgaccacaagaguucgaacucaagugauuugaaacgacacauaauuucaguucacacgaaagacuacccccauaagugugacaugugugauaaaggcuuucacaggccuucagaacucaagaaacacguggcugcccacaagggcaaaaaaaugcaccaguguagacauugugacuuuaagauugcagauccauuuguucuaagucgccauauucucucaguucacacaaaggaucuuccauuuaggugcaagagauguagaaagggauuuaggcaacagagugagcuuaaaaagcauaugaagacacacaguggcaggaaaguguaucagugugaguacugugaguauagcacuacagaugccucaggcuuuaaacggcacguuauuuccauucacacgaaagacuauccucaccggugugaguacugcaagaaaggcuuccgaagaccuucagaaaagaaccagcacauaaugcgacaucauaaagaaguuggccugcccuaacaauacuucuacagaacguuuguagagauauuggccuugaagcagaaaauucauuuuaaagccaaucagucucauucacauacaauacuguauauugauuuaugcuguguacaaauagaauuauuacuucuaguugacuuuuuuuuaaauauacauuuugcucaguaguguguucugaauucuauucaguuuguuuaauaaauagggaaaacuggcaacaugcuaguuacuuuuaauaaaguaaucccugauucuauaccgaaguuuuauaucuuagaauuuuauauuuauuuaaauauuuaccuugcuuaccuugaugguacucuucuaagaccauuaacuuaagguaacuuuauauugguaacucugaaaguauucauguugacucauuuuuuuccccauacauuucucacaauaaaauugucagagacaucuacuaauauaaaugggagauuuuacagucaggucuaauuaucauaacauggaagucauuuacuugucuugcuuaauauuuucagaccacuugacagugaaaguuuccauuugagcuguugcgucccuggcuuugcugaguaaagagcaguggcuggguucguguuuacuuuucaaauauacuucuuuuggcuuucuuuggauuauuuacaucuuuugucagcguagcaaacuuuuagaaaaccuuauugaaaaacugugcuugcucauguuguauuuugauuauucugucugugcggcuucaucuuggaaugguugugugcuacaaaugacacuuacugaggacugcauuuuggaaucuccuagagguaacucauggcuuauaggaucuuuugcaacuuuauguauguaaauguacccugaauuauauauauacacauauauaucauguaccuguguguauugcuuauuuuacauauuuauacacacaaccccaaguaguaguuguuuaaaaucuauaaugaaaaguauuaaauuuacaauaacaugaaagauccagggaugcaugagagagcauuuuguaagucaugcucuucagagagacuacucaggugaagaauuagaaggaaaauaaggacacuaguauuuuuaaagaguaaagauauuuucuuuuaaauaucuuugguaauugaaacauagagguuaagauguuucuagguagaauguuuucauacaauuucaccuccaugucuuuauguuuuucugaaaagcaaaugaguauccagacaugacucccacaguucucuuugagaagccugagagggaacucugucuuaccuagugagggggauggaaaagaagugauggcucuguggaccagagaacgggugcuaauuaugacuucacacucggcaaguucaggcugaucuguuauuucucaguuacaguuagcaaacuuuaaaaacuuaacacucaaguuggcuuugauuaaaagguaaagauguguuuuaaguggauaaggaaagucugaggccuuauuuggaacaucacuaagucuuccacagguuuuuuguuuguuuguuuuuuuuuguuguuuuuuuuucuuaagacggagucuugcucuguugcccaggcuggacugcaguggugugaucacugcaaccucugcagcucacugcaaccucugcuuccuggguucaagcaauuaucugccucagccucucgaguagcugggauuacaggcgcccaccaccacgcccggcuaauuuuuuguauuuuuaauagagaugggguuucaccaucuuggccaggcuggucuugaacccugaccucgugauccaccugccucggccuuccauagugcuggguuuacaggcgugagccaccgugcccagacaccacauaggucugaaucagugucauacauucauaaaacaaacucgguuaauuagaacuugguuauguuaagacgaaucugggagaacagaaaacaguuuuuggggucccuucaguuggcuauugguccguaugcaucuagcacauuguaggagauuuagaaauugucuucccacccgauagcugccuugucaccucauuauggugcuccauccccugugugcuuagguuuuuaccuuucaucuuucucuuugccauugauguuuguauucaagaguuauauuuuuaggguuagaaaucaaaauauuugguguuuggcaaaccucugaagugcuagacugauuuagucuaguuuuaaaccaagugcuuuaggcaggugugaacuccagcccaaaugccagucaaagucaaggcauggguuuuccuagccuaucuuauaggaaauuccuguaccuucuuggcccccauaauguguuuuuuuuuuuuuuuuuuuuuuaaacuaacuuacaauuuugugauccgugauucauugcccugcgauucuugaaagcucugucuguuuuuuugugagaaccuuuaaaaucucccuuaauuuuuauuuucccagaaauaauguaaaaacacuuaaaugaaaguggaaauguauuaauuuuaaauccuauaaaauuaauacagaaaauauaaaugauugggucauuuaacuauauuuuuuuaaauaaacugaaagauaaagaacacaacacuucacacauuuuauauuucucuuacauacuccggaaucauacacaguucuuuuuaaagcacaacauuaaaaccuuuaaaagguauuuaaggguuuggucaagugaauaugauaaaacauacuugucuguauaaagagaaaaugaaauuguagucacuguuauguacugacauuaguuacaaccuaguuuuaauucuuaaaacaauuuugauuagcaaagcuaaaaaaaaauggauguuucaguuaaauguuuuaaagagguacagauuuuuacaaggacauaauauaaguuauuguucuguagaaauauccuauuaaauauuguaugucccucccucuguacacuuuguaaagaaaguaaaauacauaaaaagaaaaucauauagggaugugugacauuauuguaauuguguacuugagaauaacgugcaaaaauaaaaaucagaauauuuuccuguuauugaauguuuagucuauuugauaccaguacuaaguuaaugcuuuuucucaaggaaaaaaaauguacaguuuuuguaaaccuaauaaacaucaaaagcaguggauuauuuucauccccccauuucuuaauuucuuuuucacagcaguggaaugcaaagugcuugauugcuuugaauuuugugacucggaugcaaauacugguaauauuucaguucugugaauuugcaaguaauauuucagagaaguuaagaggugauuggugaguccuuugaugagcauguccuuggaauucauuuuuucuuuuaucuucauaaaggauuuguuuuauuagcaucuccaauuccccugagauaaauuacucaugcauaaagugguuuuugagagcacuuaaaguucauuucaguauuaauuuacagcauauuuaaucaguggggacuguuaccaccuccacaacagaaaucaugcccucgaguuaccccacugcgcccaguuuagaggacuaguagaugcuaacauacuagggaauggucauugccacaguuaaaaaucggcaguuaaguaaaugucaggagucaaaagagauagaguugugccaucuuugauuuuauagacaagauucugcaguucuuccaacuguaugaacaaacguuugccuaauaguugaaacaauaaauuaaaauuuuagguaaaugacgaagggaauguggugaaugucacuguccagagccauaaaucagacaaaaccauacauagcaugcugaaaaacuuuuguaauggaacacccaacaaaugacaccuaaccugucugugauccaacaaguccgauaacaugcugcuguauuuguauucucugggaaucucaguauuaauaauuucauuucccacaaauucuagcauucauguaaggaaaaacauggcuaaucaauaucuuaaaggggcaaucuuucagagcagugguuuucaaaguauggccggacagcauuggcagcaucuuaaucuccugggacuuuguuaaaaaugcaaauucucagccccacccuaguccuacugaauugggaaacuggcgugggacccagcagucuuuguuuuaacauguucuccaagugauucugaugccuguucaaacuugggaaacacuuuuagagcacuugaggaaccuaaaagaugacugguucagcauuuugugugguagauaagaaagaaauuaucacaaaaaaucagaaaugaacagugagagaaaaauaggaccccagacaguuuauaccuuccauuugcuguuuuaaaagugugagccugccaagucaacaaguaugccuuuagcgcacauguaaauagccugcacuuccuaaaucucguguggccucccaugguuacauucuucaaagguaaacugaguugagaggaagauucagcauuuaaaagagaaggguugaaaaagauuguguguguguguguguguguuuaauuggcccaggguuacuuaaauaaaucauaaccauuuugccacauucuguaacuguuuagcuaaggucaaauuaaguuuacccuauggauuuuguuucaucuuuuguuucguguauauacuguuugccuuuuucauaaaaaucuuggauuuguuauauauuguuccuguuauuuuugacaucuuugcuauuguaaauaaauuacuauuuuguuuuaaguuac

SEQ ID NO: 19076 - RNA, 1797 nt, Homo sapiens
uaaggauaguugcuguugcuuggguucugaauguaugagaaaacucccuguuuauauguaguucuaauuuagguuauuuuaaauccaugauuaacuuacauucccuuuuaaaauuaugguuuuauugcugcaagagauuuauuuuuguuauacuaaacuauggaaaaguuuuucauagcauuuuuuucaaguuuauuuuuugugugcuucauuuggaguuuuuguuuauauacauugcgcucaaaaaaguaguuuuuugaaaaauucaguaagauuugaaucuauacaguuuaacuguuaugaccuuuaugcguguuguuuucacuuuauaucucaaaugccagaguucacaaaaauagcugaucuucauuaauuacaucuuaauuagaaccauuuguucucuuccgugucuuugaccuucuaaguuuugauuuuaaagaaauuccuugcacuacagccuuuucuuaaaaugcaagauucucacuuugaagguuuuguguuggaagaaaugcuacugguuuuuaaaaagcaaagcuuaacuaauagaauuauuagcuuuucuugagacagcuuucuguguccucauuacucugcucugugugaguguuacuagaauuugugaaauacugacugagcccuucacuuaucuuuucuaaagcagcaccuuuggacaccucauucugggaagccugcucgagucauaguaaaggacacacgcuuuauguggggagaagugguaaaaauggaguuuugucuuaauuacaugaaacuaagcuuuaaaauauuuuauaacagauuauuugagcugcauaaucuaaacaugucaaacguucagugggacuauuuuuauauauguauauguggguguaggucauaacauuucaguuuauaauauaaauuguuauuucaguuuauaagcuaucucucagaggagacuagcucuuuugagaauucauaauuuaaaguuuuagacugaaguaaaaugcaacauagauaauaguguaaaucagauauaauugagggcuauauggcaguaaaacugcuagugccaguuuucuuguuugccuguuauacauuuuugauuuuuguuuuuguauucugaacauuuugagagaucauauguuuguucaauuacauuuagaguugguuugggaauaaauaucuucuaaaaagagauuuaucuuaaaaauggaaguccuaaaaauuaguuuauccagaguuuauaaagucaaauauucaguaggcauagacuggaauagauaaauucauggaaaucauauccuuucaguacaccguauaacuucaauauuacacaaguaacauugaggagaaugccaucagcuuuguucucccuuaaauucuuugguuuucuuuuuacauuuugggaacaacugcauuuaaaauguuauuagucaguauauaguaaggauuagguguuugcuuucugaaggaaugguccagugaggugauugggagagguuauuuucuaccuaacuuguauaugcccuauaccucuugggcauacuuugucuauagaaaaauauuuugaccuuuagguacauuuugggccaguagucaaauaauccuagggccgauauaaaaaucuuagaauaauuuaagguuugccuuuuauaccuguuuugaaagccuuuacauuuuugucagguaauuuuucccaagccguggauauaaucuauucaaacauguuuaugcuauccauucuguuuuuaaauugaaaaaaauguuaaaaguguuuaugaagaaaaguuuaaauaaaauauuuuuaaucuuuaaaau

SEQ ID NO: 19077 - RNA, 8857 nt, Homo sapiens
caucuaauucacuuugcaauuucaauguuuauuucugauaccaaaacuugacagcacacaaggggaaaaaaagcaguagacaaggaacagcaaauaaauuuaucuugcaugccacuuucagucaacaggauguggcucucuagauagcuguguuuagaaggaaucugaggcuucagccucacacaggggaaagacuacugcgauugauagcaauaucugugaacauaagaaagaagaaguaaaaaaaucaaugauauauaucaaauaauaaggaauauacauaccaaagagugcugccccauacuuuccucaucucccuacaaugaguuuccuaauacuucuagcucaugcacauaaauacaaccccauggacccuauaucccccagagacccuaacugcccaauccaaagugauguaccuacccaacaucucacucaacccagaagaaaccaauggcaccaaaguuggcagcgaaguuggcacuggcuguaccaccaggaccaauaaugggaccggcaaaggucugagggaaucuggagcgggcauucuggugguaucuggcccagaagguaaauggaauucuggaccagggaucuccaaaaucuccuuccucaucccaggucagcagcucaaacucaaugucaucccagcuccagggcccagacacagccucaucuccaauucccaugcggguucuugcuucagcccgggcuucggccucagcugcagcagcauccagagcauccaaggccucaucugcagccuccaugaacugugcaguccagucacgagggucucuuuucugaaccugagaugaggaauagaaaacaaaacaaaauccauuuacaauagccaagauauggaaucaaccuaccuguccaucaguggaugaauggauaaggacaaugugauacacacacacacaauggaauacuauucagccuuuaaaaagaaggaaauucugccauuugcaacaacauagaugaugcuggaugacauuaugcuaagugaaauaagccagacacagaaagacaaauacugcaugaccucacuuauacauggaaucuaaaaacgucuaacucauagaagcagagaguagaaugguaguuuccagggccuggggucaggagggauagggagauaucgguuaaaagguacaaaguuucauuuagauaggaagaauauguucuggagaucaaccguauagcaugacgacuauaguuaauaauaaugugucguuuauuuaaaauugcuaaaagaguacauuuuaaauguucucaucacaaaaaaaaugucaaguauaugaggcuauggagaguuaacuagcuugauguaaucauucugcaauguacauguauuaucaaaacaucauacuguaccccauaaauauguauauuuuuuauuagucaguuaaaaauaaaugaaugggccggguacgguggcucacgccuguaaucccaacacuuugggaggcugaggcaggcagaucacuugaggucaggaguuugagaccagccuggcuaacauggcaaaacccugucucuaauagaaaaauaaaaauuuagccaggcauggugguggcacgugccuguaaucccagauacuugggaggcugaggcacaagaaucgcuuuaaccugggaggcagagguugcagugagccaagauugcgccacugcacucuagccugggcaacacagcaaaacuccaucucgggagaaaacaaauaaauaaauaaauaaaacaaaauacuuaaaaauuacauuguacaccacaaauauauacaauuuuugucaauuauaauuuaguaaaguugggaaaaaauaaaaauacuuuaaaaaccuaaaaaaaaacccaaaacaaacucauaauuguauuagcuaauauauuaacauauguuagcaccuaauacauguuaaguuuaccuaacagcaacaacaaauaccaccagcaaugcggcaccuaccaccugccacaccuaggaucucauuccuacccugggccuuucccagccagcuauacuucaucccuugaccuaucaaugcuggaacaguuccuccauuaccucugcaaugaaucucagcacuuucaucuugcuagucucaugguaggaacggaggccccagaggaacucauacuccgggggguugcuguugggcacucgucuguaguccagguaucugaaagagcaaaacagucuuugugucuaccuacccaggcagaaugguaguccacuaaugaaaaauaaucuuacauuuuuuaacagauuucagauagcaacucccccuugggcucauuccugaacaccaucaggguauuuaccccuuaaucaucaagccuuaaauuccugcacuagaacgcuaagcacucacuagagaugcaggcgaggcuuguauagggucacagaaaggacaacauuuccuuucacuccuucugccugagcucuagcuccagauucuuguaaucuugucagugagccacagagguccauugaaaugaguacaaugcagugcaaaagugucagccuggcccagccuugggaaugucuacuguggggaugguggaugggcuucacuugcaagacaacugcuuagaaaaguagaaaaauuagaaaaauucuggccgggugugguggcucacaccuguaaucccagcacuuugggaggcagagguggguggauugcuucaggucaggaguuugagaccagccuggccaacguggugaagccccaucucuacuaaaaauacaaaaacagccgggcacgguggcacgcaccugaaguuccaguuacucgggaggcugaggcacaagaauugcuugaaccugggagguggaaguucaagcgagccaagauugcaccacugcacuccagcaugggcaacagagugagacucagucucgaaaaaaacaaacaaaagaauucgcccgguacggucgcucacgccuguaaucucagcacuucuggaggccaaggcaggcagaucaccugaagucgggaguuugagaccagccuaacauggagaaacaccgucucuacuaagaagacaaaauuaggugggcgugguggcacaugccuguaaucccagcuacucaagaggcugaggcaggagaauagcuugaacccaggaggcagagguugcggugagccgagaucacgccauugcacuccagccugggcaacaagagcgaaacuccgucucaaaaaauaaaaaaauaaaaaauaaagaauuuaaccaugaggaguauaugcaauaaauacuccugaggacauaaguguuucuguaugcacagaaacacauaugcacaaguauaguguaagaaacgagcuugagaagggcuuucuuuuauuuuuuuugagacagggucucacucuguugcccagguuggagugcaguggcaugaucacagcucacugcagccucaacuuccugggcucagaugauucuccccuaccucagccucccaaguagcugggacuacaggugcaugucaccacgccuggcuaauuuuuguauuuuuuuguagagaugggguuucguuauguugcccaggcuggucuugaacuccugggcucaagcgaucugcccaccugagccucccaaaguacugggauuacaggcaugagccauuguauccagccaggaagggcuuucuaaagcugaccagcacacaggcagaaucauaagaagcaggaaaagccccuuaggcaucacuuacuucugcuuuacaaacucauaggugagaaguuuccuuagaucuccaaggaggggaugucucacccugaagguaaaaaaaggaaacccacaaucagaggcuauuaccaugcccaaagagcuuuccagaacagaggucagagaugagaaaagaggcagagaguucagaacuguuuccccauccacccaggucacaucuuugggcucugaacauccccaaaccaaacccuccagacccccagguuaaugcaauccugggaccauccacuguugccaaaggauggcacaaacaggcaagagaugagagagcccaaucauacccaggacgcagucccaucuugcguagugccucccagaggacagcugcaaugggaggcaaggggagacaagggacggaaaauaagcauggaaaucaggcuguggccaacccccagcugcagguccagccacucacccucacuggcacgguugccauucaugaagaugacacccagaaucaccaagaggagaccgagcuugggugugucuuugguccuaagggaauauagaaagaauauauuuucaguagccauuugcaugagagaccccaaccagcuugcccaucuagccuccccaauauuccucagcuaggggagaauuauaccccagcucugcccaugaccugcuaugugacccugaacccuggacccugaucuacgugaaacuccuagaaaaaaagcaccacugagaaaggccauguuccaccuucuuucccaucuuacguucccaguaugccagccagggacucggggguacugaugagaauauacagguguucuucuuugucaauuucuuucaguugaaucccaaauuucuacaggggcaagaaaacagacuaugaaauuacaacaucuagcauaagcuacccauaggcagacacucaucucccugagacuugcccuaaacucccaguaggaaccccaugaaucuuugaaaucaagacuuuccccauuauuccuguaccccagggcugccuucucaccuucucuaggacaaagcaugcacguucaaugauuucuggauaaacaucaguguauucacggaugauaucucucagcauuucuguaggagagaggagggagccaucugagccgagcgggggccacagagcagcagucccuuugccagcccugcuggggguagcacagucaagguccucaaggguggaaagagccaaccauggaaaggaggggauagaaggggaagggucauacaagcagaagaaugccgacagagcauggagugaagggaagggcagagcuacaagcagaagaaugcugacagagcauggagugaagggaagggcagagcuuggggaggggacacuggaugcauaccugagcgcuugaugggcaccuuuguguaguccuuaagcaucaaguacuugaccaacuuauuugccugggagggaaaaaggaaaucauuaaacuuauaaaauauuuacaaaaaaacuugguugaauuacagaugagaggaugacaaagaaaagagcaagagaggggaaaagugacuggggaguuacagcucuuacucuuuccugaagaagggccacaucucggggcugugcagcaccuggguucugugaggcacgcgaguugggagaagggcgcagguuaggcgaggggcgcagguucugccagucagguggaauuggccaaucagcggggauccagucaggugguaguggccagucagugggaaguggccaaucagguggcaguggccagucgggugguagcggccagucaggaggaccuugccagucuggaggacccugccagcccgguggggucugccauccagguggagucugccauccagguggauucugccaggccaguggauucggccagacaacagggccgggccagacaaugggguuuggccagaucacuggguucugccagauuacuggguuuggccaaaucacuggguucugccaagcgacuggguucugccaggcugguggggucugccuagcuggagggcucugacgugcugguggggucugccuggcugucugguuuugccagccugagggguucugccaagccaauggcgucugccagagcacauuggggggugcgccagguggguucugaguggucacuggaacuggugcagaccuccaggucccugcagccaguggggcccgccucugauccccacugcuguucucuucaacauucaaguuauuaaucugcaucaucagagagaaguucagaaucaccaguggguucuguguccucaccuuaucuauuccaggaaugcccucuaaacccucaccuguagugacagccugacccacuagccauuggucacccugaguccuggguuugucuuucacugucuuccaggcaggaguuucaucuccgagccaggccaggagcaacccaaagauggggccugaggcuucuccucuuccuauguccaccacugguucugccuguaccacccugaacaaaucacucaagucacuucaccucucuggcacuuaauuuccuucuuuguaaaauuggcacuaugaucccuaccugguaggaggugccuuuaagguuuaaugagacaaccugugugaaugugccuagcucaaggcuuaacacauggugguuacuaacauaacaaaauguaaacugaauuacauacagguuguauauauuauuuguguccauguauuaucuccccaucaguuugugaacauccggaggacaggaauaaacauucucuucaaaugcccuauagccuagcugaauacaguuacauacauuguuuuguuuagaacaaaugaacacccucagagaagaaaggagacagccccaaagcaaaaugaaguuagcagagaucucaccuugcggguccucuugccccgaauuauuguccgggacuccagauucugagccugggaaccaucugcugaugucugugcaguugcaccgucagguucagagauaccugggucggucucuaugucagccugggaaguggccauuuuggccugauuuacauucugggucuggguaucagcuguuggggccuuagugguaucauuccaagccuugaaaggggucuuaggccugcuguuggccaggucauuggcauugagagacugagagaaauuguagguggcauuugggcccacuuuaguaguggcauucugggccuugaaggccaucucagacuuguuagcagcuaacucaccagugguugcugccugggaaaaaucauaggcagcauuuggacccuuugggguagcauuuugggacuuaaaggcugccuugggcugcguguugggcacauccuuggcauuaugagccugagagaaaucauagacaccauuugggccuuuugugguggcauucuggacuuuaaaggcugacuuaggccuagcggcagcugcugaaaccugaaugucagccaucucauuggcaguugggggcugugaacucuggggacuagcagcugcgguggccugguuaguagguggagccucugagaucuggauggccuccaucaaggucugcauaagcaaggcgcugucuucuacggaggccucagccugcaaacacaggggggaaaaaauuaaaucucugggccucugaggcaggagguggggugggaauagggagcccggguggcagcgcagcagcggagcugcaggcgggcggugggugcaaaaacaggggggcugaggcagagaucuagggggcccgcgaggggcgaugggggaccaggcggguacuaaacauguggcaggggugaaguagggcaagggcaaaaugagggguggggcgguaugcggaaagugggcacgaacaggagccggggacgcuccaagaggcgugcaguagcagcucaggacggcaggcggaucgcggaguugagaauaaggggggucgcacagaguggggaaugcagaaagagggaggguggaggcaggaggcugggggagggggugacagacugcucuacaagcgucaggauucuggaaaaaaaaaaaaaugguuccuuacccaccccgcauucucugggcagauugcccugacuacuaacagggucuccccucucucugagcagggacugauggcugaaaagagacgccccucccccccuucgauaaacgaugggaauucgaaaagcccacggagucuagucacuaaauagggucaaaccggaucccggcguuugggagaccaaagaggcccgcggggaggggugacugucggcuggggaaauggugggguggggaguggagaucucaccuggaagccgaggaggcccgcaccacaguccauuuucugagccauggcuccugucccucuggcaagagcggagccugggggcugugggagaggggcagggcguuauacuacagagggcaaauacgaaggaccuaauugggaggggggugacuguggucugacugugcgggcggauaaggugaaugugaggaggaacggaucggagcgguaaaagugaaugggcguccagauggagguucugaaccccgagaagcuacugacagggcgaagcuucaaauggggaucgggaagcagaugaguucugaauucggagcgggggugcgguuggguugggauucgcauuugggaaguugcauggagguuuugagucaggaggaaucaucuaacaguacagaucgaggucaaggaaucugaggauuucgaacgaugggagggaucggacagggguuuugaaucaggaaggaucgggaggggcauugaauugggguuugggggguggaaggggauucagaauccagggugaagggaucgggauaaaaaaaaaugggggcccgcaccagggggcagaugcccagucugggggcuaauucucaccuugccucaggccccaaccccaacccccucgcugccucccuucuucacgacucagaggaucgggauugcugggcucggcucucagcagccgcacucucuccuuguccaggagaaaaugccagcgcggcagcuugggcgaccccgccucuucgccuaauauaccacccaccgccucaggacguuacgcgcaugcgcaaacacugaagagccaaagucagucccgccugcuuucccaacaaaagcuucguccu

SEQ ID NO: 19078 - RNA, 8857 nt, Homo sapiens
aggacgaagcuuuuguugggaaagcaggcgggacugacuuuggcucuucaguguuugcgcaugcgcguaacguccugaggcggugggugguauauuaggcgaagaggcggggucgcccaagcugccgcgcuggcauuuucuccuggacaaggagagagugcggcugcugagagccgagcccagcaaucccgauccucugagucgugaagaagggaggcagcgaggggguugggguuggggccugaggcaaggugagaauuagcccccagacugggcaucugcccccuggugcgggcccccauuuuuuuuuaucccgaucccuucacccuggauucugaauccccuuccaccccccaaaccccaauucaaugccccucccgauccuuccugauucaaaaccccuguccgaucccucccaucguucgaaauccucagauuccuugaccucgaucuguacuguuagaugauuccuccugacucaaaaccuccaugcaacuucccaaaugcgaaucccaacccaaccgcacccccgcuccgaauucagaacucaucugcuucccgauccccauuugaagcuucgcccugucaguagcuucucgggguucagaaccuccaucuggacgcccauucacuuuuaccgcuccgauccguuccuccucacauucaccuuauccgcccgcacagucagaccacagucaccccccucccaauuagguccuucguauuugcccucuguaguauaacgcccugccccucucccacagcccccaggcuccgcucuugccagagggacaggagccauggcucagaaaauggacuguggugcgggccuccucggcuuccaggugagaucuccacuccccaccccaccauuuccccagccgacagucaccccuccccgcgggccucuuuggucucccaaacgccgggauccgguuugacccuauuuagugacuagacuccgugggcuuuucgaauucccaucguuuaucgaagggggggaggggcgucucuuuucagccaucagucccugcucagagagaggggagacccuguuaguagucagggcaaucugcccagagaaugcgggguggguaaggaaccauuuuuuuuuuuuuccagaauccugacgcuuguagagcagucugucacccccucccccagccuccugccuccacccucccucuuucugcauuccccacucugugcgaccccccuuauucucaacuccgcgauccgccugccguccugagcugcuacugcacgccucuuggagcguccccggcuccuguucgugcccacuuuccgcauaccgccccaccccucauuuugcccuugcccuacuucaccccugccacauguuuaguacccgccuggucccccaucgccccucgcgggcccccuagaucucugccucagccccccuguuuuugcacccaccgcccgccugcagcuccgcugcugcgcugccacccgggcucccuauucccaccccaccuccugccucagaggcccagagauuuaauuuuuuccccccuguguuugcaggcugaggccuccguagaagacagcgccuugcuuaugcagaccuugauggaggccauccagaucucagaggcuccaccuacuaaccaggccaccgcagcugcuaguccccagaguucacagcccccaacugccaaugagauggcugacauucagguuucagcagcugccgcuaggccuaagucagccuuuaaaguccagaaugccaccacaaaaggcccaaauggugucuaugauuucucucaggcucauaaugccaaggaugugcccaacacgcagcccaaggcagccuuuaagucccaaaaugcuaccccaaaggguccaaaugcugccuaugauuuuucccaggcagcaaccacuggugaguuagcugcuaacaagucugagauggccuucaaggcccagaaugccacuacuaaagugggcccaaaugccaccuacaauuucucucagucucucaaugccaaugaccuggccaacagcaggccuaagaccccuuucaaggcuuggaaugauaccacuaaggccccaacagcugauacccagacccagaauguaaaucaggccaaaauggccacuucccaggcugacauagagaccgacccagguaucucugaaccugacggugcaacugcacagacaucagcagaugguucccaggcucagaaucuggagucccggacaauaauucggggcaagaggacccgcaaggugagaucucugcuaacuucauuuugcuuuggggcugucuccuuucuucucugaggguguucauuuguucuaaacaaaacaauguauguaacuguauucagcuaggcuauagggcauuugaagagaauguuuauuccuguccuccggauguucacaaacugauggggagauaauacauggacacaaauaauauauacaaccuguauguaauucaguuuacauuuuguuauguuaguaaccaccauguguuaagccuugagcuaggcacauucacacagguugucucauuaaaccuuaaaggcaccuccuaccagguagggaucauagugccaauuuuacaaagaaggaaauuaagugccagagaggugaagugacuugagugauuuguucagggugguacaggcagaaccagugguggacauaggaagaggagaagccucaggccccaucuuuggguugcuccuggccuggcucggagaugaaacuccugccuggaagacagugaaagacaaacccaggacucagggugaccaauggcuagugggucaggcugucacuacaggugaggguuuagagggcauuccuggaauagauaaggugaggacacagaacccacuggugauucugaacuucucucugaugaugcagauuaauaacuugaauguugaagagaacagcaguggggaucagaggcgggccccacuggcugcagggaccuggaggucugcaccaguuccagugaccacucagaacccaccuggcgcaccccccaaugugcucuggcagacgccauuggcuuggcagaaccccucaggcuggcaaaaccagacagccaggcagaccccaccagcacgucagagcccuccagcuaggcagaccccaccagccuggcagaacccagucgcuuggcagaacccagugauuuggccaaacccaguaaucuggcagaacccagugaucuggccaaaccccauugucuggcccggcccuguugucuggccgaauccacuggccuggcagaauccaccuggauggcagacuccaccuggauggcagaccccaccgggcuggcaggguccuccagacuggcaagguccuccugacuggccgcuaccacccgacuggccacugccaccugauuggccacuucccacugacuggccacuaccaccugacuggauccccgcugauuggccaauuccaccugacuggcagaaccugcgccccucgccuaaccugcgcccuucucccaacucgcgugccucacagaacccaggugcugcacagccccgagauguggcccuucuucaggaaagaguaagagcuguaacuccccagucacuuuuccccucucuugcucuuuucuuugucauccucucaucuguaauucaaccaaguuuuuuuguaaauauuuuauaaguuuaaugauuuccuuuuucccucccaggcaaauaaguuggucaaguacuugaugcuuaaggacuacacaaaggugcccaucaagcgcucagguaugcauccaguguccccuccccaagcucugcccuucccuucacuccaugcucugucagcauucuucugcuuguagcucugcccuucccuucacuccaugcucugucggcauucuucugcuuguaugacccuuccccuucuauccccuccuuuccaugguuggcucuuuccacccuugaggaccuugacugugcuacccccagcagggcuggcaaagggacugcugcucuguggcccccgcucggcucagauggcucccuccucucuccuacagaaaugcugagagauaucauccgugaauacacugauguuuauccagaaaucauugaacgugcaugcuuuguccuagagaaggugagaaggcagcccugggguacaggaauaauggggaaagucuugauuucaaagauucaugggguuccuacugggaguuuagggcaagucucagggagaugagugucugccuauggguagcuuaugcuagauguuguaauuucauagucuguuuucuugccccuguagaaauuugggauucaacugaaagaaauugacaaagaagaacaccuguauauucucaucaguacccccgagucccuggcuggcauacugggaacguaagaugggaaagaagguggaacauggccuuucucaguggugcuuuuuuucuaggaguuucacguagaucaggguccaggguucagggucacauagcaggucaugggcagagcugggguauaauucuccccuagcugaggaauauuggggaggcuagaugggcaagcugguuggggucucucaugcaaauggcuacugaaaauauauucuuucuauauucccuuaggaccaaagacacacccaagcucggucuccucuuggugauucugggugucaucuucaugaauggcaaccgugccagugagggugaguggcuggaccugcagcuggggguuggccacagccugauuuccaugcuuauuuuccgucccuugucuccccuugccucccauugcagcuguccucugggaggcacuacgcaagaugggacugcguccuggguaugauugggcucucucaucucuugccuguuugugccauccuuuggcaacaguggauggucccaggauugcauuaaccugggggucuggaggguuugguuuggggauguucagagcccaaagaugugaccuggguggauggggaaacaguucugaacucucugccucuuuucucaucucugaccucuguucuggaaagcucuuugggcaugguaauagccucugauuguggguuuccuuuuuuuaccuucagggugagacauccccuccuuggagaucuaaggaaacuucucaccuaugaguuuguaaagcagaaguaagugaugccuaaggggcuuuuccugcuucuuaugauucugccugugugcuggucagcuuuagaaagcccuuccuggcuggauacaauggcucaugccuguaaucccaguacuuugggaggcucaggugggcagaucgcuugagcccaggaguucaagaccagccugggcaacauaacgaaaccccaucucuacaaaaaaauacaaaaauuagccaggcguggugacaugcaccuguagucccagcuacuugggaggcugagguaggggagaaucaucugagcccaggaaguugaggcugcagugagcugugaucaugccacugcacuccaaccugggcaacagagugagacccugucucaaaaaaaauaaaagaaagcccuucucaagcucguuucuuacacuauacuugugcauauguguuucugugcauacagaaacacuuauguccucaggaguauuuauugcauauacuccucaugguuaaauucuuuauuuuuuauuuuuuuauuuuuugagacggaguuucgcucuuguugcccaggcuggagugcaauggcgugaucucggcucaccgcaaccucugccuccuggguucaagcuauucuccugccucagccucuugaguagcugggauuacaggcaugugccaccacgcccaccuaauuuugucuucuuaguagagacgguguuucuccauguuaggcuggucucaaacucccgacuucaggugaucugccugccuuggccuccagaagugcugagauuacaggcgugagcgaccguaccgggcgaauucuuuuguuuguuuuuuucgagacugagucucacucuguugcccaugcuggagugcaguggugcaaucuuggcucgcuugaacuuccaccucccagguucaagcaauucuugugccucagccucccgaguaacuggaacuucaggugcgugccaccgugcccggcuguuuuuguauuuuuaguagagauggggcuucaccacguuggccaggcuggucucaaacuccugaccugaagcaauccacccaccucugccucccaaagugcugggauuacaggugugagccaccacacccggccagaauuuuucuaauuuuucuacuuuucuaagcaguugucuugcaagugaagcccauccaccauccccacaguagacauucccaaggcugggccaggcugacacuuuugcacugcauuguacucauuucaauggaccucuguggcucacugacaagauuacaagaaucuggagcuagagcucaggcagaaggagugaaaggaaauguuguccuuucugugacccuauacaagccucgccugcaucucuagugagugcuuagcguucuagugcaggaauuuaaggcuugaugauuaagggguaaauacccugaugguguucaggaaugagcccaagggggaguugcuaucugaaaucuguuaaaaaauguaagauuauuuuucauuaguggacuaccauucugccuggguagguagacacaaagacuguuuugcucuuucagauaccuggacuacagacgagugcccaacagcaaccccccggaguaugaguuccucuggggccuccguuccuaccaugagacuagcaagaugaaagugcugagauucauugcagagguaauggaggaacuguuccagcauugauaggucaagggaugaaguauagcuggcugggaaaggcccaggguaggaaugagauccuagguguggcaggugguaggugccgcauugcuggugguauuuguuguugcuguuagguaaacuuaacauguauuaggugcuaacauauguuaauauauuagcuaauacaauuaugaguuuguuuuggguuuuuuuuuagguuuuuaaaguauuuuuauuuuuucccaacuuuacuaaauuauaauugacaaaaauuguauauauuugugguguacaauguaauuuuuaaguauuuuguuuuauuuauuuauuuauuuguuuucucccgagauggaguuuugcuguguugcccaggcuagagugcaguggcgcaaucuuggcucacugcaaccucugccucccagguuaaagcgauucuugugccucagccucccaaguaucugggauuacaggcacgugccaccaccaugccuggcuaaauuuuuauuuuucuauuagagacaggguuuugccauguuagccaggcuggucucaaacuccugaccucaagugaucugccugccucagccucccaaaguguugggauuacaggcgugagccaccguacccggcccauucauuuauuuuuaacugacuaauaaaaaauauacauauuuaugggguacaguaugauguuuugauaauacauguacauugcagaaugauuacaucaagcuaguuaacucuccauagccucauauacuugacauuuuuuuugugaugagaacauuuaaaauguacucuuuuagcaauuuuaaauaaacgacacauuauuauuaacuauagucgucaugcuauacgguugaucuccagaacauauucuuccuaucuaaaugaaacuuuguaccuuuuaaccgauaucucccuaucccuccugaccccaggcccuggaaacuaccauucuacucucugcuucuaugaguuagacguuuuuagauuccauguauaagugaggucaugcaguauuugucuuucugugucuggcuuauuucacuuagcauaaugucauccagcaucaucuauguuguugcaaauggcagaauuuccuucuuuuuaaaggcugaauaguauuccauuguguguguguguaucacauuguccuuauccauucauccacugauggacagguagguugauuccauaucuuggcuauuguaaauggauuuuguuuuguuuucuauuccucaucucagguucagaaaagagacccucgugacuggacugcacaguucauggaggcugcagaugaggccuuggaugcucuggaugcugcugcagcugaggccgaagcccgggcugaagcaagaacccgcaugggaauuggagaugaggcugugucugggcccuggagcugggaugacauugaguuugagcugcugaccugggaugaggaaggagauuuuggagaucccugguccagaauuccauuuaccuucugggccagauaccaccagaaugcccgcuccagauucccucagaccuuugccggucccauuauugguccuggugguacagccagugccaacuucgcugccaacuuuggugccauugguuucuucuggguugagugagauguuggguagguacaucacuuuggauugggcaguuagggucucugggggauauaggguccaugggguuguauuuaugugcaugagcuagaaguauuaggaaacucauuguagggagaugaggaaaguauggggcagcacucuuugguauguauauuccuuauuauuugauauauaucauugauuuuuuuacuucuucuuucuuauguucacagauauugcuaucaaucgcaguagucuuuccccugugugaggcugaagccucagauuccuucuaaacacagcuaucuagagagccacauccuguugacugaaaguggcaugcaagauaaauuuauuugcuguuccuugucuacugcuuuuuuuccccuugugugcugucaaguuuugguaucagaaauaaacauugaaauugcaaagugaauuagaug

SEQ ID NO: 19079 - RNA, 4883 nt, Homo sapiens
agaguguugagccgccauaucugcugcugccgccgcaguugcgaaugcagcaucggcgcuuagcugccuccgcggugcagcuaagguucgugucgcuaccccuuggcccuucgcucuugcugccuuaaccccgccggcggagcccgcucuucuggccuguugagcccgcucccucacugccacacagcaaguuccgagaccauggauucgggcagcagcagcagcgacucggcgcccgauugcugggaccagguggacauggaauccccggggucggccccgagcggggauggagucuccucugcgguggccgaggcccagcgcgagccccucagcucggcuuucagccguaagcucaacgucaacgccaagcccuucgugccuaacguacacgccgcggaguucgugccguccuuccugcggggcccgacucagccgcccacccucccggccggcuccggcagcaacgaugaaaccugcaccggcgcgggauacccucaagguaaaaggaugggacggggggcaccuguggaaccuucccgagaggaaccguuagugucgcuugaagguuccaauucagccguuaccauggaacuuucagaaccuguuguagaaaauggagagguggaaauggcccuagaagaaucaugggagcacaguaaagaaguaagugaagccgagccugggggugguuccucgggagauucagggcccccagaagaaaguggccaggaaaugauggaggaaaaagaggaaauaagaaaauccaaaucugugaucguacccucaggugcaccuaagaaagaacacguaaauguaguauucauuggccauguagacgcuggcaagucaaccaucggaggacagauaauguuuuugacuggaaugguugacaaaagaacacuggagaaauaugaaagagaagcuaaggaaaaaaacagagaaaccugguauuuguccugggccuuagauacaaaucaggaggaacgagacaaggguaaaacagucgaagugggucgugccuauuuugaaacagaaaggaaacauuucacaauuuuagaugccccuggccacaagaguuuugucccaaauaugauugguggugcuucucaagcugauuuggcugugcuggucaucucugccaggaaaggagaguuugaaacuggauuugaaaaagguggacagacaagagaacaugcgauguuggcaaaaacggcagggguaaaacauuuaauagugcuuauuaauaagauggaugaucccacaguaaauuggagcaucgagagauaugaagaauguaaagaaaaacuggugcccuuuuugaaaaaaguaggcuucaguccaaaaaaggacauucacuuuaugcccugcucaggacugaccggagcaaauauuaaagagcagucagauuucugcccuugguacacuggauuaccauuuauuccguauuuggauaacuugccaaacuucaacagaucaauugauggaccaauaagacugccaauuguggauaaguacaaagauaugggcacugugguccugggaaagcuggaauccggguccauuuuuaaaggccagcagcucgugaugaugccaaacaagcacaauguagaaguucuuggaauacuuucugaugauacugaaacugauuuuguagccccaggugaaaaccucaaaaucagacugaagggaauugaagaagaagagauucuuccaggauucauacuuugugauccuaguaaccucugccauucuggacgcacguuugauguucagauagugauuauugagcacaaauccaucaucugcccagguuauaaugcggugcugcacauucauacuuguauugaggaaguugagauaacagcguuaaucuccuugguagacaaaaaaucaggagaaaaaaguaagacacgaccccgcuucgugaaacaagaucaaguaugcauugcucguuuaaggacagcaggaaccaucugccucgagacguucaaagauuuuccucagaugggucguuuuacuuuaagagaugaggguaagaccauugcaauuggaaaaguucugaaauuggucccagagaaggacuaagcaauuuucuugaugccucugcaagauacugugaggagaauugacagcaaaaguucaccaccuacucuuauuuacugcccauugauugacuuuucuucauauuuugcaaagagaaauuucacagcaaaaauucauguuuugucagcuuucucauguugagaucuguuaugucacugaugaauuuacccucaaguuuccuuccucuguaccacucugcuuccuuggacaauaucaguaauagcuuuguaagugauguggacguaauugccuacaguaaugaaaaauuaauguacuuuaauuuuucauuuucuuuuaggauauuuagaccacccuuguuccacgcaaaccagagugugucaguguuuguguguguguuaaaaugauaacuaacaugugaauaaaauacuccauuugaaacucuucgguuauuugaaaugcuuuugaauaauguuuaaaugucauuauguaaugcuauucaauuagcuuuauuacuuucucaaauaguugaauauguucuaucacuuaaaaacuuaaaaacucuucaccacuuacuguuuuaagugaggaauuuacaaacaaugcauaaguguguauuaaaggaauaauuuuaauuuugagaaaaaaacguauguuaaggcucuucccagugggcuuuguuuucucuguccaaguccagucaauaaaggagcucuucugcuuccccacuugugauuugaaaaugaaaggcucaggccgucuuuauuuguauagcaguaguucauguaacauuauccauagguucuugaagacuacaacauuaagcaaaacaauguacagcagguguacaucguacaacaaugcacaauguaugacauuguucaauguuguuaugacauuguucaauguuguuaugacauuguucaauguuguuaugaccuuguucaauguuguuuaguuaugacauuguucaauguuguuuaguuaugacauuguucaauguuguuuaguuaugacauugauaaggggaaaaauucauuuuguuagauguuauuucacuugaagucacaauuuccaagaaccaguggacuauguuaagugaggacuuacuguauuccaucaggucccaucacguuaagcauggccaaauuauaggagauuuggaccauagguuuacaagacucuuuauuuuuuuaaaagacagggucucacucugucacccaggcuggagugcaguggugcagucauggcucacugcagccucaaccucccaggcucaagcaauccucccaucucagccccccaaaguggugggauuacaggcgugagccacugugcccagccuuggcuagacucuuaacuguacuccaucaucuuaacaaacacagcucuugguuuuguucaccaugaaacuugugauaugggucacaacccaauaagggguauggcuauugagaagauaaaugcuugcaauggggccuuuggucauugaguaaaaacuaaggauuagugacuccugggcugggaaaugagaugaugucaccuuugucucuuucaugcuuggguugauaggaaaggugggaagucauuuuuaaauucagaucaugaccuacacuuggggucagaggcacuggauacuucucugaacaacuucuugaggaaaacaccaauuauggauucugagguggcuacauuuauuggcaagagaguggccuuauaaccugcaaauaacugucaacaacuaaagaaccuucugucuuauuaaguggguagugccuuaggcacagcaguauaccuggagagagagacaguuugcuuugcugucaaaccucauacucaugagcuaguugaauagguguggggacugcuggcacaacacccugggcucauucaugcucagguaaaggcaauguauccuucuacauugucccuuuguguguacauguaccuccagggugucuaaccugucagagauagccacacuggucuuguuggagcaucaguauuuuggcuguacugcccauaggucuucagggcacccaugugggaaaugaggauuuuuauuuugucauacauaagcuaaccuaauccacacggaugugccucauacgucuuggacccaguuuuuuaaucauuagaaugucaauggcaagaguuuuauuuuuaucauaagagcucuaugcacugaaccucauacaaaauacaaaccauccaguacuugguaaguuuugcccuggaagccacuuuauaagcaauuauuuuugcugcugcaucaaucucauuguuuuguaauuuuagugauuuaccaguaguauuuuguggcuguguuccacugauaggccaaaaccacaagccaggacagaacucuuugucuccauccaauuuggaugauuucccaucaaaaacuggcuccuaaaugucuuucucauuagccaauuguuuagcaauuucccuaccagacauucugaacuguuuauauauaaauacaaaaaccuucagagaaaaagacaauuuuuggaaauagauuuuagaaaccaauuauuugcauuucagugagaagcagaucauccaggugcuuggagauacuggacugucucuuuaacaaaguagauacaaauucgugguaacauuucuuucuaacuuccuggauacauuucuuuauaguuguugauaucugaugguguucuccaauacuccaaauuggggccauucacagaguacuaguuucccuagggcauccaacuauuuauaaaaaccauguucagggcaguuuccuuucagagauccccuauuuccucuaauucaggucaguuugauuu

SEQ ID NO: 19080 - RNA, 1289 nt, Homo sapiens
caguuuucuggauuuucugggugacgauuauuuucaauuccuuuuucuggugauauauacaagaaguuacagcagauauauaaagggaaggucagaaaccugcuguccaaguucaucaccacuuguuccugauccuuuuuaaguauaaguauuugauagccaguuguucuacuacauacuaguuuuccacuacuaucaaaagaagccaagcguaaucuaaaugcuaugcuccuucgaggccguaaacugacagacccgcugcguggcugauucaguguauugcguuugaaaaugauguauccauugguguaaauuacaaguaggucaaagccgaaguuaaaacccguccaacaccaguaguauucaccaucuuuggcaagcuuucuaccacaccucaugcuauuucccucuaggucuucuuuauugauuucuugaggcccuaccucacggucuuguucugcccgcagcauagcaaaccacugcuguuuauacacagaagacagccauucugaagguacuauaccaucuuguucaauaauucuugcagaagcuaggucacugauaauauauuguaaccuuaaaugucugaauacugacacaaaugguuuuccugguucaguuucaagaaaggccauaccuucaaaaucuuuucucuguuuagaaaaccagacaucuguuucugucaaaagcuguuuuaaagauccauuccaagaaggcacaaguugaaggaacauccacuuuuuuagagugguguauacauccaucuccacuugcaucacaaauaaguuagaggaaccaaugagcuguuucaugacauuuauaccgaguucuuuaaaaaguuuaacauucuggugagucaucaaauuguuuagaagccauucaaggcacuuuuucuuuacagaaucuaauccauagaucucuacugauguguaauaaccgcauacaguuuucacauuaauuguuuccuucauugucucaccacacugcuguauuaaaccauccagcugcagcauacaagcugcugccaaaauggcaacaacucgacuggguuuuaucaagacaucaucucgauacagugaaccaaacgcaaccugcagugcgucuacaucaauguucuggucaggaaucuccaguucaauaauauucaugcuggauucuuuccaagaaccacugaacauacuagaaaaguagccagauugacauaaauauauuuuguguaaucgccauucuucuccuagagcacaaaucuuaaugucacuguuuucaccauucaaaaauaauguuugaua

SEQ ID NO: 19081 - RNA, 20682 nt, Homo sapiens
cauuagugacugagggguucccucuugaacccagaaguuuauuagcauucagcaaagaaguauauguuguuacaaacaggcagugcaucaagauauccagaugucagugagagcuagaaguggagaggucagaacccgggugauucugugaugucucagggauggagaagaggaagcucagguacagccaggggccacacuccccuuucugcacugggagagaaauaacucuuacaccuggggugaugauguacugcaguuccuaauuucuucccuccuuccuccagccauuuuauuuaacaugaccuaaauauacauuccuguuuuauucccccccacccccacccccauauacagcaggaaaaauaagcaccaauaauaauaacaauaauuaaagucccaccucucaauagacccaacccucacacauauacauaccauguggauuuucuucuuuggagugacuauaggauuggaaagucagggaucaggccagcaagccaucacccugaaagucacuguuccccaaaguaccauccacgugugagcuggagcagggcaggggagggggaauggugguaggggaggagauucccccaaagcagcaagaggggugaaggaguuccccaaagccucucuucugggaaaaugucacaaucaacugagcuccuaggaaguccuaugcaaggguuuccucaacgagaugguaaauuccugauagugcaagcaucauugucaucugucucccacagcuucuuggggaaaggggacaugguugaaacccccuuccuuccccauuggguggagaauguucccaaaaugcuccuuuggagaaacucaacaagacaaauagcacaacaugggcacucugauuucaaaacuaaagcacaaaacauaacgaggaaaaaaaauaagacacaugaguacucucagagggucuagacauggggaagaaggguucaaaagaaagaaaaacauaaaauaaagccagaaaaugacaagcugucuaccaggucccacacgccugagucacuuggcguuugucuucaguaccugggcaucuucugcugucccuaucauggggggagggaacggacagugugguacagcuaagguagggagaggggaaagagggagggcccuaggcaguugagaugccagcccucugcacaagcagcagcaauuuuugugucaucuuuguuuuguuuaaaacuguaaacagcaccgcuuaaaaauaaaucagaaaagaacaauugauaaacauuguuuuccaugaauauaaaaugcaaacaauauaaaaauagauaauugacuuuugauauauauauauauauauauuaaaaacaacuugaaugcaacauacacauggguaaacuugaagucucccugcuaaaccccaugccucccucuagcaacugggccugggggcugagggcagguggggugguggcacuggcacagguaaggaaagcugcuggcagcaggaugaaggguacacacccagccuccugagugugugaagcuacuucccuucuuggcauaggacuaaggagggagagagacugguguuuacugaacccauuauccgggcagucuuguggccugguacccaagcugaggccagauagguagggcuggcuugaacugggccccaaggcagugcuuccuuggagacucuaaagcaccaagaaacuggcauccuggcccugggagaggccuacuagguggccuucucuauccacauucacugguccuccaaggaccagucucaucugggaauucucaggaucacagcugucuggcacuaggccuauuggguaauaagaugaaggcagcuacuuccacuaagucccauuuucccuuaaaaucacauccaaaagcauuauuccaggaccuugcaauggagacauguuguucaucuaguaguacucuuggagguguggacaugauaucaacaguuuuaguggucugggguguauuugcugccacccaagccagcacuagucuguguuuggaaacaggccugaagcuuggcuggcucucccaaugucacccugugcugucaacaccauggguccccagacaggucuuccuuccuccccuaggcugccauuggguuucagccacaaacugcuuagcucuagaaauucaaaggaaccugcuucugcagccacauauccuggcugccccacuucaggugguaaggauccuauuccugggcuggcuagggcagugaagggacuugcaggcagcaaggcuguccaaaccaugaacucucacucagccccaggcccuacucuguggugugugaccuuccaaagcccaacaaagugugucagggcuaugccagugccccucagagacaaugccucaugcugccuuccugauccugagggcagcucucagcccuuagccaaagguuggccaccuccuuuuucucuucccagauaggcugguggcccuucuccagcagggucuggaggcuggugauggcucuaccgccugcuguggcuggcacaguccacauguagacaggagcucaagcugcccugaaagaagaggcaagagguggguucuucccuguuguaaaggcauuuggugaguguuuacuuccugccaaauagccaggccaauuucagccccaccaucccagagcagcuuugguaagaggccagaaaguuggaauuugggcacuucucucuuggaaugcugugcuugggguaaggagggccuuccucacccucuuucauucuccagcuccacaacagauacauuucuucacaauguaucuguagccaaagucagccugaagagcuggucugggucccuugaguggugguguuagugccaugcaaauucauguggugcuuccaggggugcagcuucuaccagccaggucugcuauuugugaguaagggcacugggccaaccccaaucugagaaauggugacaaagaccagcauggacacauccccuggccaagaaacaguuugcccacaaagucaccuugacuuagggggcaaacagcaucuguucccaagcuaaauugccauaucucaggaauggcaagaacccuguugacuucuucucucaacaggcauggagauggugggaugugagggcgagggugcaauaaucauaauuugagugaacacagccaagcaaaaaauguuccauaugccauuuccaauaaagacauguaaaaggaacccucuccuacaggugauuaaugagagguugagcuuggcaagauuagccuguuccaaugucuuccugacagcaagcucuuccccaccaguauuuccaaccuaguuuaacaugaaaacugcauggaugcaggagaagggagggugccauucauuccauaaagggcugcaacugccaagaagcccugucauuugaugaugcuaaggacucggcuaauuggaagauaaaagcucuuuaaagggcccagaacagcagcugagaugccuuugguauccugucuugggagugcaaaccuggggccuuauuacagaguccaaaugaugggaugggcaaggcuuaaggaacauuuuguguugggaggcuugagaagggaguuuucccuuuuaagaaacugagauaccuuaagcucugcauggucugaaauccccuuucuugcuggcugugauaaauggacccucauuuucuaucuuuccccuacacuccacaaaaaccccagccccuauagucaagccuaauuuagguugcuucucuucccuuaucucaauuaaaagaccguguuccuugugaugagauuaugaaaauuuccuuuagaggaaaaaagaacaaaaauucaaaagcaucugcaacucagguagucacaagcuuaaaagaaggaaaaaaaauccuaucauuccggagcucaacacucuauggcaguguccacaacagaaccuuguuuugucuucuguuugcaaauggaugaauuuuaucacuccaucaaggggauuagcauuuuugucuuuaacccaagcuauggcaggacaguuaaaaggcccccaucuggucaugaugccaaaguccacagcgauaggcugugagacacacgcuacuugauccucucuaaggacagcuagcugggaugaauagcuuauagucaucugauauaaugauggcagcuaugccaggccaaaaggaauagggguggggaggaucuguaccauaauuucacauugcuaauagcaaauaagccccacuuccccaagcgggaggcaaugcagacuuggcugcuaaucagugguucaucauucauugggggaaaggggcagggggcacuaaagguuuagccugugucaaggaugcaugcuauauaugugugugcauguguguuuguguguguguguguauguauguguguguguguguguguguguguguguguauauauauauauauauauauauauauauauauauauauauauaaucacuaacuuggcaacuggaauaggcacaaaauuacagcaucccaaacccagcgugggucacaagaagaaaccucgaaagcaaaaacuggagugcaguagcagcagcagccucccugggcagaugcacuugaguugaacguggccauagauggcagaagaggcaagugggaaaaccaaggugaaaacucacaggaguuuuccuuggcccaaaggguuuucaaguuaaacaacaacccccacccccccacccuucugcccaaccccugauccccauucacaugcucaggccccgugucccuacuccagaauugauaauaacuacuuggcuagguuuccauucauggcaguggaggaguagcugguggcaagagaggcaccuugcucagcccucuccuuugacaggucaaggcuggaaggcccauagugagugggcugaggcugggggugcucaggccggacccugggcagcugaggaaugccaugggugaugcccacaggcuuggccugugguagagggcuggggcugaagccuccagaacuggaagagcaacugggcucaucaacaggcagcagcacaucucgaggccuggcccucaugcucugggaggccuguggcuggagguuauagcaagggcccaugggcagguguaggugugagggacgagcuaguugaggcccagauuccccaggugcccuugacucuggcacugauagugauauugacauggucauaggagguaugcaacagguugccugccuauauggagacuggcuggaaggccuguccaacugguuggggcuuauccaggcaggaccuggccccacuggaagaggacagggagcccaagcaggccaaucauaggccccuggggguucaguauagagggaaaggggacugucucggcuccauucuccuucuuccuccucuucguccuccucaucugaaucuuccugcugggccugcagcucaucagacucgagguagcccuggaccaagugggaauuggagagcuccaucuccagggucucugcagugucgagagagcggcuucuccuguugagggccauagcagcagguggaggucgagggugcaggccaggcagucccaaguaucgagggaggcugcucacaccccagggcaggccuugguagaaucgacuaugguaguuguugaaggcauguuugugauaguagcccagcucaaaggcuuccaaggaggcugcaagaucuucaucauuguggaacucaggauucucuucacacuugccuuccccaucccguuccacaucagcgaugucaaaggucaccaugggaggcagcucagggagguuuugagugaaagaugagucagagucagagcugcaggacaugcuggaaaagagguucccauugcuggugaacucuaccagggccugugagaaacucacaguggcauucccuuccuucucaaccuccucuuccucuggaucuucagggggugaauaaguaggguaggcccuccugggagauccuccaaaauuugcuucuugcaugucuggcucaaacauggcaucacucuggaagagcugcaucaggcagguacuuugaucuuucuuggagcagguuccuucauaacgcuucuccagaggacggaagucccuccagucuggcucgcugcuugcagugguggggaaagcugagguaauuccccggugggaaaucugagaggucccugauaccccugcugccaggcccaucacugaugggccuaagggccucaucugauacucuaagacgggcuucuccugccgggccugggucucucggacuugagucucucuacaacgaaccucucgggccugggcuucucggguucuggccucccugccaugagcuucccaagugugggccucccuggcauaggcuucccugccauaagccucucgaguauaggccucccuggcgugggccucccuggcaugagcuucucgggcacgugccuccugggccucaagcugcucccgccgaagcucccaauacaacaacuguuucuggauggucacuagccguucuuccucugucuccauugccccagguggccgggaggacaaaaagggcucaaaguuuaagaaggggucaaacaucucagagcuucgaccauggaggucauaaaggcagucaucuccagguggagaguucucaaggcugucaucuggcucauagaacucauauagggcaucuccacuguagcugucucgggguagacaaucccugcggacaagccccagggccucaccugaaucauccucaaauccaggugugguggagucauaauaaccuucaucacuauugggggcggauucuugcuggucacucugaggagucaaaaguuccccaggggcuaggccaggauaagaccuaacugggucaaggagcauguagccgugguggccuggggauguggugggaugguagcccagguucauauugggccguggauacauuugggcaguuucccacagauauucuaagucaucaucuucuuccuccuccuuaaccuccucuucuuccuccucuaauuccaccucuucuuccucuucuuccuccucgucaucaucaucuggcaaggccaucuccuccccaccuccuugguaggucaccaggcaggaacuucgcuuggucccaucucgguuugcucucuggcccccagaggccaugcugucugucauacuguccauguccuguucugcuauuaugucaccacaaccugucaaugaaucaaagcuuuucagggaugucacauccccaaacaagaggcucagugggucccccacagggccauuggguggguuuaccucuccugcuacuaccuucuccccuguuucugggcuauggggcuccucuaggcuacuggcuucaggggcaggcuuggguugcacaugugcugaggcacaggccuccauggguuuuucuggaucuuuacaggccauuuucucaguagcugguggagaagguucugguguuggagaaacuuuuggcccaggggcaucuuggggguuagcauuuuccuuucuaggggcuuggaaggucuccucaaagcagggcaccugaggggcugagcucacgugcucaugaggccuggcucugacccucucaggccccuuggccccuggcucacuuugcucagccccagugaccuugcucuuccggugacggcggauacugcuaaaaaagccuuuuaggccuuucuuuggcuugggcauagagggaaacuucucagccacagcuuucucuguggcuccagccacagaugucuuacaucuggagccugucuccaaagccccaugggcacucugagagcugggaaauuggcaggguaacucaggcaaaggcagggagaagccaguuccuucacugacaacaucuucagggccaugggcugcuucacucaggccaucgugggucuugcucuugcugagaccuuucuuggagcugccuuucccagaaccuuugcuccgucccccuccaaagaaacuaggcagaguacagauacccuucuugccaccaaagaguuucauggcaguuuucuucagccuaccugggccggaugaggauggcucugagguugguccuucugucgccucagcugccuuguucuuggcuccuuuuucugcuguuuguucacggguacucccagaggcugcagcucccuuggccugagcagcuucauccuuuugggucuccaugaugauggggacaacugagguacguccagcuggaaaugcagccucaggcuuccaggcacuguuauaacauuaucagucaggaagcaucacaguggggucuggaggagauaggagagacaaagacagagagacagauacuagugagcaagcauccaggcuggguuugcuuucaccggacgucaggcuugaguggaacaagaaagaaaaugauggaaaauguggggcaaaucuuaauccacucgauaugcuuggcuugcugggccagcucucucugggccccaaggaagcaaaacucuacacugagcaacaagaagccuucauccccuaccuucuugcuggguccacucccuucagaccauccuaagcucaggggaccacugggcagggggaccugcaguugugugaaaggccuaguggugcuauuggcugugggagguauuaucaauuaucaaaggggaugaggauagggagagacaagaaaggcaaaagggauguuggcuccaacaucacagaauuuuugaaaaccaucuggcaaaacaguccauugaguccucacagggcucuguuggauucaagcuucaguuucauauuagucugggcucucacugacauuuugucugagacugaaaaguggaccugaaguuucaccucccauccaaagcuuccuaaauugccugcagaaccaugcucaggcuucagaaucucagaauaggagccucacacauccacaaaguaggucugcaaucuagaaccugcuaagacaaugaaaugggagccucaagaaagguacucucugggcuucaauauucgccauucaagaggccuaucaauaucucucccucagagaggugauaugagggugggucuaagccagacccucuauuggcuguccugcugggaagauacuuuaaugcggucaucaauggaaccccaaauuccacuugagaaccaugagguggacuguuucuccucuacucuccuccucuuauuauuuuuguccccaucuagcucccuaucuaggaagggaacuccuugaaggcccuacaugauucauauuccuggugugugagauagguucccaauggcuuuuuaaauaaauaaaccuggugcaagccacacccuucuggucaaggcucucaauccuccaaaugcccaaauaccaacagagauggaauaaaaacaagaccuagccacuacccaccacaauauaccucugcaccucuggucauccgcuagcucagugaccagccugcuaaaacccaaugaccccucccugggaagucccucaccaauuuguccccucucuguagaguggcaccagcagaugggggaaucugggaggagaggggagaggggaaggggaaggggagggaaggaagaguaagagagggagagagaagcaagcacccuugguccaagaacagcuggacaguacaccaggccugugauugcuugccauaauaauaagacucacacauucaccuaaaguggaagacuguggaccagcacugagcauggaaagaggcuggcagcuacacucuagccuuggagccccugguucugucuugcaaacauuaauuuugugccugcugccuugcuuggcuugacacuugaaucaucagugugaugauccaagcuuccauaaagaacacucugcauaacugaauauuaaaauuggagcaagauaacagcugguuauccagaaaagaaaagagcaggugaaaaggaaaguucaucugaaccucucucugcagagaucugaauugccauuugcucagguuagagauuuuucuguaacauauuuugacaucacacuguuccaacucagcccugcaacugauagucccacaauagacagugcccccucccaccuccaaauacacacacaaucacaccuaaacacacaaucacccaguuuucugccccugggucuggugggaauaggggcccuaucaugucugaaugccccacuuuccacagcacauuuuuaccucagccuuaaaauuacugcuaagguuaucgucacgguguuggggauaggggaguuggggaggcaguacuggaguuguuugugaaauucuauuccccucuggaauucagugcuucagggcaggacaagaagggagaacucccagccuuugcuucuaaggagcuccuaggcuaacagggagaguccuauauguaacagucuguuagaaacuggaccaaacaacaggaagugaccggcaggcaggagggcaaggugaacauuaccugagcucugccuucugucagaucagcagaggcauuagauucucauaggagcgugaacccuauugcaaacugcgcaugcgaaggaucuagggugcacucuccuuaugagaaucuaacaaaugccugaugaucugagauggaacacuuuuaucccaaaaccuuccuccucuccauccauggaaaaauugucuuccaugaaacaggucccugguuccaaaaagguugggaaccgcugccuuaaagaauagccccuguuauuucuaaagcugguugguggaguaucauucuuuauaccuuguaaacauauuccaagauaaaugugaaagggagaaagacacuucuugggcaguaaggcugggccucaaggaaaaccucacagccaagugaaaaacucuaggaccuacacauccuugugaaucaaaggcugacuuguccugcuggguuuggggcuggaguuccugggaacagagugauuuggcaaauugaaucacaaagaaggcugcuuuccagagccuugacgccccaguuagaagacagucucuuugggcuuucccuugcccuugcuccuaugcucugugaggguagaggccagcccacucaccucucucuguauuguccccuuuccugucacagggagcugcaguguguuguggaaggagccauggaccacagggcugggguccaggccaugucagccucccaucugccaagggacccugaaugggccaguguagccugcugagacgcagguacuugugagcuauuuugagaucaaaacagcuccucuaccuauccuucuaccugcccacuccaacuacaguggugugaugaguugaugugauaauaggcacaaaaaaagcacuuuauaaacuguauaguacagugcaaaugagaaagacugucauuacaguuauuauuacuccuuccaggucagaucccaguuucuuaggaagcaacugaccauguguuaaaggcuguucauuugggaaagccauucacugugggaagcucagggacuugcugccuuggcccaugcugagagggagacagauaugaggggauuuuaaaaagguguguauaucuauacaaacuccucugcuaagagguuugaaaagcccucucuguguguugugggagacagaugaauuacgcagggugucccugggauggaguuucucuccguccaguucaggcccuucuccuaaccaaguccagagucaucuuugcuggcagauaccagccuuaaacugguacucuguguucucucucccagagccauguccccccacagucauucacaguaucucugccuaugucacccagaacacugggaaggaagguggcagggucacccauagcugguagcucccuagcguagccccaccuagcuaccucugccuuaggccucuucuccauacucuuugcuauccaaccaggugccaaagcuauccuuccucaauggguuaugcugccuuuacuuaggaccacaagaguucaccaagagagugagguggggcagaaagcaaaggagacagcaaaggacagacucugcagauccccuaggcugggacuggcuuucccuggggguccugucaagaaaguggcacugccaaaugcagggccccacaacccucauguuccuuaaccaguguggcugaguuucaggugggcuggggguuaagagaacccucccaagccacucuguggucccuugcagggacugccugcugcagcagcugcuaucauggcagaaagcaggcugugguagaaagcgcuggggccauuccagcucccugagccagauucaagccauucuggggccaguggaaggcuggcuacaaaggaagagcuucuuccuucuccucuccacuuaaaacauaggcaggaggccagccacauaccugcccuagagacccuucucaaggagaagggacagcugcaauaugagccuugcacauucugcuccaaaucagcuucccggggccagcauggccaacuugaagagggcugaauugggggaagaaaaagaagcaaguggauuuaugcaguagcuccagagacauggccuugaccagccauaguuccucaggccuguuccaaacagucuuccugaaagcaagcccacuucaggcccaccugcccuucuguauguuggggaggguugguuaaagaaaaaauggugaggauggcccuccagagagcuggccauuucagcgcuggaaucaacucugcccagcuaggggaaauccagcaaguuuuuucccauguuuaugccucaauuuccuuaacuguaaaaugaggucauugagagugccuaccucuuaaggcuauuguaagaaguaaaaccaaugcacauaauguaccaaaucaagugcauuacauagcagaagcuaaaaacauuauaguaaccaacuuuuauucauauuuuauucaaacugugguagaacaauuucuagaaguaaaaucaucucagucagguugaguagggugcucccuagggcucuguggguaagucaccaaaccuccuuggggcucaguuuucccaaauggcaaaugguaaaugaagauaacuguguggucaugucauaggaggcuuuacuugcucauuuagccaacuuuugauauucagggaccuaaaagagucagcuacuggcuagcagccaaggauuaucugggacuuucaacuagccagguucucuagcccaggucaaacucagcuaaaaguaccaacaucaaaggaaaugcaaaucaacagauauccuucacccucaggguauuuaccacuuuauaaagcacucccuacucccauacccccccauuugcccuccucagccacccauuacucaggccuggugggggauggcaacuccuugucacagagaaggaaacugugccuagacuugggaaaagacuuguccaaggucacauagugaaauggugacagagccacacuagcucccagaacuguugagucucaauuucaugccauucugcugcacugugcaggccaccaaucaaaggaggaagacugagcaagagaacugcaaaguuuacccucacaccagcaagaacuauaaucucccaaucccaucccaccucugucccagcccugcuaagccuucuuugccacauuuccaguccucacugguugccacuguuuggguccuaccaaacacauuccaggaagccugcugacaucagaaucuaggggccaacaacccagccuguggcugcucuccucaucagcaacccuaccaccacuccucucaaacuacaggacaugucacucuacuccccuuuuccuuaagagauagguuugaguggcccaaaaacgagaaaccugccaacguggacaaagaugcagaauuugagcuauuugaagaaaaugacuuaucagaugaucuggaacuugaaugauccauuuuuaacacccauagccaaguacugcccucaaaacuauuuggucagagccuaaaggaagggcugcuuggcuugguuggcugauggaguuguagaugcagcuggcagagccccuucagcuccuccccuaauuugcagccuuccugcugaggggcaccuccugcccagagggcaucucaccaacuccagaugcagcaagaccccaaauugggacuucucucuccugucccaauucccccaccagccccucucaacugauuuguuuacauacugagcuuuguauaauucauccugacgggcuuuggucuguucauucaucucucucaaauugacccuccuucaucuuacagucacuacaacuagcacacagcaggagcucaaacaaugcugauucaacugaauucuaauucaccugaaguuucuuggugcggaacuggaaugccagccucaccuucuauaggcugugugguuugagaaaguggccuaaccucucugacacucaaaugccuuaucuguaaaaugaagaaaaugcuaucuaccaugcaggauugugguaaggauuagagaugaucaauguaaaagcaaacugguaacuacauacuaagcagauauucaauaaagggcucuugugaugaggccacuuguaggcaccuuuuccucuccagcuccccaauugccaccccacauucuccgaagaugacacaagccucuuagcugagcucccucuagucccucccuaccgcagcacccccuggcuccccucucccaucucauucauccuguacguuguugccagauucauuuucuuacaacuccuguuucagcacuucacuccuccacuuaccaaauuauucugcauugccuacaggauaagggccaaaacccuaugucugauguuaaaggcuugcucucccugaaugcuccuuacaaguuucucagccuuguuucucugccucuuggccccagccccaaauacacagggguuugcccagucugggagauguggucacccagauaccaccucucccuagaaaugggcuuuccuggugagucuucuuagugccccagguuccuccucaggcucuugagguccccucccugcccagcuugccuugaaugacagggacuuugggagccacuuacuugccacucccaucuuaggcucccaaacuuucuuagagagaaguguaucugaaguggguaccaugcccgccugcauaggcuuccacuaagucaguacuagcccagcuagagcgagaucagacaggugccaacccuuccccaccccccguucaaaugaagaauaggagaggagcuaacuccagagaaacagaugugacagagcagccaaggaaacccuacagaggagcagcugggucaagugaacaauggauaccucugacuuuccuauguguccacuccccucuacuaaccaugcccugugugagaaaccaagugaggaaacugaagcuugggaggggacaaggagagugugauucgaggaagaacucuggaauugaauugcggaccaggagcuuuggacuucugaguuaacuugagcaaauccuuucccuguucuggaccucaguuucuucauauagaaaugggagauuggaccagggagucugcuugcuccaaguugcccugagaggcugggggaggaguggucuugugcccaguuuucuaauggcugcugagucagaaggcauagcagggggcacuggauuggcuuugaggguccuaggucuuacuguuaggccugguuaccuagcugguucgaccuaguucaccacuucaggacaaaggugcacuguggcccagccucacuccuuacaccaccccucaacauuuugcucuuucaaaaugcacugagucuggccugugaauauuuccaacauauccagaaaggaggggggccagaacuggucaugccauuccucauuccccugaaaagagccacagcccccagcaagaagggcugagcagauggagagggaggguugaggcauacucacuagggauggaggguuaguauccacuuggaagcccagcggggguaaaaacuguaggagaugaaagcaaugaaaccucuaugcugaaaaaaaaugcacaucaaagggucacaaaggccacugcagcaccaguaugccugccuaugaccacaccaagccccucaggucauuuucuccauuguucauauuuuccccuaauuccaaaaggggagguggagggagcaacauacucuuacugggcuagcaccuguaccucuguagugguucugguuccccugccugccuuugcuagaaauacacuuacacacgcacagguuugaaaaauaagacgaagcagaggagauggaagacucugagauuauuuaauucagagaacagaaguugggggugcagagagaguuuaaugccuaugaaaucuccaauagaucguuaagcagaagagcaaugguggccagcugcucgcaacuccuucccccaacacacacacacacacacacacacacacacacacacacacacaagguuuaacuauagcaugacaggcucagauuaucccugagaaagaacugggcaaugaggcaggugacccaggaaugagugacacagaaaggcuaugaaauauugccucaggggcuuaacccuuuaucacccacuguaucugcccagacaggauucagguagggaaauugaaauaacauuggacauucucucuucuagccucagauagccuaucuguuaagcaagggggcuggaaaccccuucucccucuugguucuaccugccaggcuugcuacuguuuccuaguggagcagaguuguuucuuccauacacacuaucuacgaguggagauguaacaguucuucaggaaauuucguguuucuuugagacagggucuugcucugcugcccagccuggagugcaguggcaugaucauggcucacugcagccuugaugucucaggcccaagagaggcuccugccucagccuuccaaguagcugggacuacaggugcaaaccaccacaccuggcuaaauuuuuguauuuuuuguagagaugagguuuugccauguugcccgagcuggucucgaacuccuggggucaagugauccacccggcuaggccucccaaagugcuggaauugcaggugugagccaccaggcccagcccuuaaggaauuuuuaauaccuccacuaugcuaggaggggaucauuagacugccaaauucuuccaacuaccuccucuccuuuugaaauuuucagucccagcaaagcuauaggccaagaccaagaggcaaaagagacauuaaacgagugagaggcuccccuuaugaaguucccaaguuaacucagccccccuuuccucuuagggaaugagggagguaagaugagggggaugguuaaugaaaucuacauugauuggaggcugcugguuccauggaacauaguggaaagagccacugcacgggaagcaggagccuauccuuaaauagcugugugaccuuaagcgagccccuguugcuuuccaaggcuaaggauucucaucuguaagcauagcaguucaaacuggugcuccccaaggacugcccaucugagaggaagguguucagcagaggccuggggaacacuucucagccccacuucccaccucuuccugcccuuuccccugcaaugccaaagggaggcugacauaguaaaacuuuccuuuggagguagccugcccgcagcucuacuuccagauccaaaggugaccucuuaacuggcugacuuugcagcaugcuucugaucccuuucuaagaccccauucuaaaacucauucaaaaaccuuguuuuuauuacugcuuaguuacauacaaaaauagcaacucccugucaauucccuacucuuugaugccgccuuccccuaaaaggaucagauuuccauuccacagccuggcauccgggaaaccccaucacugagccucaaucucuucucuaccucugagccacaccaucucaaccagaauagacucauucacucccuucacccugccugucaaucacuuucuccccucccauuccugggucugcuuaugcuuugccuacuaaaccccucuacuuucuggcagcuuccauggaugaucccccugcuuauacagaucuuucaucucucuccaaguaguuugucucuuggcucaugaaucagcaaccaaagauaugcauggucugggaucugagcauuccaaauccugggccuguuguugggggaagauauaucaugauuuuuuucuuguaguugcaaucaucccccuucuaauccauccucauuaggcacacucaauacauaucugagccuugaguaucauuucucuagccacuuucauaugaaucaggacaagcgcaaguuggaaagguaaaggucuucuggaaaacucuacaaagaaagcaaguccuuccggaacaaucauuaacugcucugcacugcuuggcuuugagaggguuguggcugagguccagguuuuauuuacuccuccaaaggguucugagagaacccagacauccaugauaucagacaaaacagaggcaggccaacuuaauuauagucugcauccuauuauaauuuaagccugaauaugcccaggagaaguaggcagcccuggaggaguucugagaagaaagaagucaccaugggugggcaagagccaggcagaaaggcaccaaggaaaaggaaggcccagaacugagguuugagaaggaagaagauuuggacagguguaggcugaguggguuuggguguggggaagggaguuacauagagcagauacauuaggugccugcuggccugagacaaggcagagggcagguccagcccugggcuagagaugcccagcugcaaguagagguuuguguuggggccuaaucaaggugggaggaggugacuguagugugauaucugugguccuggcuccugucauaaagguccagagcuagccuucccccaagugaggaauuuacugggucucguugccccuccucaaagugcccaagcuuugccugggcccugcagcccacagggcucuccacaccagagguuaaucaaagguccaagagcuuaccaagcccccaguggcuuccucuguccuauuccucaaaaaggccuagagagcccacugccagaggugcaccauggugcagugacugugcaguggguggugccgaaugaggggagccacacugggggagggggcucugcuggaaucccgguggggcaggcaguccaacagugcagugcccucugccuugcccaugcccacgccgcugcagcaggcaggcagagccgcagaggaagauguuuguguguggaacaaggcucgccuugaccccgcggcccuugccgaaagcagccuggccaaacggagaccagcucugcggggccaguccagcugccgccuaggcgcuugggcugugacgcauguagcgggcacagccccucaccaccgggggagccaagcaaaguccagcguucgggcggucaccagugucagaagugucuccagcagacaaugacaggggccuggcgggcuggguauguuaaguaacugcgaaguuggaggguuuggccaccucgcuagcucuccuguacacagagaugguaugauacguuccguacuacaaugagggcuccuucggccucuggcaaggaaaugccccccaaacaccgugccuauugcuauuuuuaaacgggaggcuggagaggaaaacgcggccaguauccuccaagggaaaaggaggugaggcgaggcgaggcgggagacaaagcggccuugcagcucuaacucaaggacuagcuugcgccgcugcucuaacccaaggaccagcaagagcccggcugccagccagccugcccgaccgcgggggcgggcgccagaugcgcccggaggcccaggaggaggggcgcggcuaguuggggccacaaggccaagguucugaagggaagugugcgacugagcucagcccacaggcccaacugagcuccucuggggagggggcagucuguggaugucccaauccacgccaaagccggucuccgucgggcccaagccagcacgccagcuugaguccgcagaaaggagggagaggcuggagaugcacaggggaggggaggggcggcagccaggcagccggagagaggggugagcgguacccgcguuacacagcuguuccagcaaaugugcuacaacaaagcugcagagcuccuggccuacaaaugcauggcuuggggugcuggcuggcggcgcccuucccgggacugugcggcagcacgugcgggcccauccccgcccccccgaaagccgggaggcuuggcccaggcuagccugccuuccuacccgcccuccccaaccccccuccccccagccguggucgcuugugcccaggggacucaaggccgcucugccucuccacccgacaguccgcaaagcggguuccaaaggagaggggcgagcgaccgggacuccgacccgccuaguccuuagugcccuccuccaguccguaggagcagagcacgcgggaaugcacccgaccgcgggcaggcggaggcuccuggcuguacgcaacgcuuacccagcccggucagguuccuagcccgguuauuguccgcugagccgcccugggccgggcugcagccucggcugccacggcugagagcgccgccaccgcagcugcugccgccgucgccgcggcuccagucaccuccagcacugacuccccuuccccaggcuuuggguagcucccccauacccccucccccaguacuccaaggccaccggguggggcaucugcgucc

SEQ ID NO: 19082 - RNA, 20682 nt, Homo sapiens
ggacgcagaugccccacccgguggccuuggaguacugggggaggggguaugggggagcuacccaaagccuggggaaggggagucagugcuggaggugacuggagccgcggcgacggcggcagcagcugcgguggcggcgcucucagccguggcagccgaggcugcagcccggcccagggcggcucagcggacaauaaccgggcuaggaaccugaccgggcuggguaagcguugcguacagccaggagccuccgccugcccgcggucgggugcauucccgcgugcucugcuccuacggacuggaggagggcacuaaggacuaggcgggucggagucccggucgcucgccccucuccuuuggaacccgcuuugcggacugucggguggagaggcagagcggccuugaguccccugggcacaagcgaccacggcuggggggagggggguuggggagggcggguaggaaggcaggcuagccugggccaagccucccggcuuucgggggggcggggaugggcccgcacgugcugccgcacagucccgggaagggcgccgccagccagcaccccaagccaugcauuuguaggccaggagcucugcagcuuuguuguagcacauuugcuggaacagcuguguaacgcggguaccgcucaccccucucuccggcugccuggcugccgccccuccccuccccugugcaucuccagccucucccuccuuucugcggacucaagcuggcgugcuggcuugggcccgacggagaccggcuuuggcguggauugggacauccacagacugcccccuccccagaggagcucaguugggccugugggcugagcucagucgcacacuucccuucagaaccuuggccuuguggccccaacuagccgcgccccuccuccugggccuccgggcgcaucuggcgcccgcccccgcggucgggcaggcuggcuggcagccgggcucuugcugguccuuggguuagagcagcggcgcaagcuaguccuugaguuagagcugcaaggccgcuuugucucccgccucgccucgccucaccuccuuuucccuuggaggauacuggccgcguuuuccucuccagccucccguuuaaaaauagcaauaggcacgguguuuggggggcauuuccuugccagaggccgaaggagcccucauuguaguacggaacguaucauaccaucucuguguacaggagagcuagcgagguggccaaacccuccaacuucgcaguuacuuaacauacccagcccgccaggccccugucauugucugcuggagacacuucugacacuggugaccgcccgaacgcuggacuuugcuuggcucccccgguggugaggggcugugcccgcuacaugcgucacagcccaagcgccuaggcggcagcuggacuggccccgcagagcuggucuccguuuggccaggcugcuuucggcaagggccgcggggucaaggcgagccuuguuccacacacaaacaucuuccucugcggcucugccugccugcugcagcggcgugggcaugggcaaggcagagggcacugcacuguuggacugccugccccaccgggauuccagcagagcccccucccccaguguggcuccccucauucggcaccacccacugcacagucacugcaccauggugcaccucuggcagugggcucucuaggccuuuuugaggaauaggacagaggaagccacugggggcuugguaagcucuuggaccuuugauuaaccucugguguggagagcccugugggcugcagggcccaggcaaagcuugggcacuuugaggaggggcaacgagacccaguaaauuccucacuugggggaaggcuagcucuggaccuuuaugacaggagccaggaccacagauaucacacuacagucaccuccucccaccuugauuaggccccaacacaaaccucuacuugcagcugggcaucucuagcccagggcuggaccugcccucugccuugucucaggccagcaggcaccuaauguaucugcucuauguaacucccuuccccacacccaaacccacucagccuacaccuguccaaaucuucuuccuucucaaaccucaguucugggccuuccuuuuccuuggugccuuucugccuggcucuugcccacccauggugacuucuuucuucucagaacuccuccagggcugccuacuucuccugggcauauucaggcuuaaauuauaauaggaugcagacuauaauuaaguuggccugccucuguuuugucugauaucauggaugucuggguucucucagaacccuuuggaggaguaaauaaaaccuggaccucagccacaacccucucaaagccaagcagugcagagcaguuaaugauuguuccggaaggacuugcuuucuuuguagaguuuuccagaagaccuuuaccuuuccaacuugcgcuuguccugauucauaugaaaguggcuagagaaaugauacucaaggcucagauauguauugagugugccuaaugaggauggauuagaagggggaugauugcaacuacaagaaaaaaaucaugauauaucuucccccaacaacaggcccaggauuuggaaugcucagaucccagaccaugcauaucuuugguugcugauucaugagccaagagacaaacuacuuggagagagaugaaagaucuguauaagcagggggaucauccauggaagcugccagaaaguagagggguuuaguaggcaaagcauaagcagacccaggaaugggaggggagaaagugauugacaggcagggugaagggagugaaugagucuauucugguugagaugguguggcucagagguagagaagagauugaggcucagugaugggguuucccggaugccaggcuguggaauggaaaucugauccuuuuaggggaaggcggcaucaaagaguagggaauugacagggaguugcuauuuuuguauguaacuaagcaguaauaaaaacaagguuuuugaaugaguuuuagaauggggucuuagaaagggaucagaagcaugcugcaaagucagccaguuaagaggucaccuuuggaucuggaaguagagcugcgggcaggcuaccuccaaaggaaaguuuuacuaugucagccucccuuuggcauugcaggggaaagggcaggaagaggugggaaguggggcugagaaguguuccccaggccucugcugaacaccuuccucucagaugggcaguccuuggggagcaccaguuugaacugcuaugcuuacagaugagaauccuuagccuuggaaagcaacaggggcucgcuuaaggucacacagcuauuuaaggauaggcuccugcuucccgugcaguggcucuuuccacuauguuccauggaaccagcagccuccaaucaauguagauuucauuaaccaucccccucaucuuaccucccucauucccuaagaggaaaggggggcugaguuaacuugggaacuucauaaggggagccucucacucguuuaaugucucuuuugccucuuggucuuggccuauagcuuugcugggacugaaaauuucaaaaggagaggagguaguuggaagaauuuggcagucuaaugauccccuccuagcauaguggagguauuaaaaauuccuuaagggcugggccugguggcucacaccugcaauuccagcacuuugggaggccuagccggguggaucacuugaccccaggaguucgagaccagcucgggcaacauggcaaaaccucaucucuacaaaaaauacaaaaauuuagccagguguggugguuugcaccuguagucccagcuacuuggaaggcugaggcaggagccucucuugggccugagacaucaaggcugcagugagccaugaucaugccacugcacuccaggcugggcagcagagcaagacccugucucaaagaaacacgaaauuuccugaagaacuguuacaucuccacucguagauaguguguauggaagaaacaacucugcuccacuaggaaacaguagcaagccuggcagguagaaccaagagggagaagggguuuccagcccccuugcuuaacagauaggcuaucugaggcuagaagagagaauguccaauguuauuucaauuucccuaccugaauccugucugggcagauacagugggugauaaaggguuaagccccugaggcaauauuucauagccuuucugugucacucauuccugggucaccugccucauugcccaguucuuucucagggauaaucugagccugucaugcuauaguuaaaccuuguguguguguguguguguguguguguguguguguguguguguugggggaaggaguugcgagcagcuggccaccauugcucuucugcuuaacgaucuauuggagauuucauaggcauuaaacucucucugcacccccaacuucuguucucugaauuaaauaaucucagagucuuccaucuccucugcuucgucuuauuuuucaaaccugugcguguguaaguguauuucuagcaaaggcaggcaggggaaccagaaccacuacagagguacaggugcuagcccaguaagaguauguugcucccuccaccuccccuuuuggaauuaggggaaaauaugaacaauggagaaaaugaccugaggggcuugguguggucauaggcaggcauacuggugcugcaguggccuuugugacccuuugaugugcauuuuuuuucagcauagagguuucauugcuuucaucuccuacaguuuuuacccccgcugggcuuccaaguggauacuaacccuccaucccuagugaguaugccucaacccucccucuccaucugcucagcccuucuugcugggggcuguggcucuuuucaggggaaugaggaauggcaugaccaguucuggccccccuccuuucuggauauguuggaaauauucacaggccagacucagugcauuuugaaagagcaaaauguugaggggugguguaaggagugaggcugggccacagugcaccuuuguccugaaguggugaacuaggucgaaccagcuagguaaccaggccuaacaguaagaccuaggacccucaaagccaauccagugcccccugcuaugccuucugacucagcagccauuagaaaacugggcacaagaccacuccucccccagccucucagggcaacuuggagcaagcagacucccugguccaaucucccauuucuauaugaagaaacugagguccagaacagggaaaggauuugcucaaguuaacucagaaguccaaagcuccugguccgcaauucaauuccagaguucuuccucgaaucacacucuccuuguccccucccaagcuucaguuuccucacuugguuucucacacagggcaugguuaguagaggggaguggacacauaggaaagucagagguauccauuguucacuugacccagcugcuccucuguaggguuuccuuggcugcucugucacaucuguuucucuggaguuagcuccucuccuauucuucauuugaacgggggguggggaaggguuggcaccugucugaucucgcucuagcugggcuaguacugacuuaguggaagccuaugcaggcgggcaugguacccacuucagauacacuucucucuaagaaaguuugggagccuaagaugggaguggcaaguaaguggcucccaaagucccugucauucaaggcaagcugggcagggaggggaccucaagagccugaggaggaaccuggggcacuaagaagacucaccaggaaagcccauuucuagggagaggugguaucugggugaccacaucucccagacugggcaaaccccuguguauuuggggcuggggccaagaggcagagaaacaaggcugagaaacuuguaaggagcauucagggagagcaagccuuuaacaucagacauaggguuuuggcccuuauccuguaggcaaugcagaauaauuugguaaguggaggagugaagugcugaaacaggaguuguaagaaaaugaaucuggcaacaacguacaggaugaaugagaugggagaggggagccagggggugcugcgguagggagggacuagagggagcucagcuaagaggcuugugucaucuucggagaaugugggguggcaauuggggagcuggagaggaaaaggugccuacaaguggccucaucacaagagcccuuuauugaauaucugcuuaguauguaguuaccaguuugcuuuuacauugaucaucucuaauccuuaccacaauccugcaugguagauagcauuuucuucauuuuacagauaaggcauuugagugucagagagguuaggccacuuucucaaaccacacagccuauagaaggugaggcuggcauuccaguuccgcaccaagaaacuucaggugaauuagaauucaguugaaucagcauuguuugagcuccugcugugugcuaguuguagugacuguaagaugaaggagggucaauuugagagagaugaaugaacagaccaaagcccgucaggaugaauuauacaaagcucaguauguaaacaaaucaguugagaggggcuggugggggaauugggacaggagagagaagucccaauuuggggucuugcugcaucuggaguuggugagaugcccucugggcaggaggugccccucagcaggaaggcugcaaauuaggggaggagcugaaggggcucugccagcugcaucuacaacuccaucagccaaccaagccaagcagcccuuccuuuaggcucugaccaaauaguuuugagggcaguacuuggcuauggguguuaaaaauggaucauucaaguuccagaucaucugauaagucauuuucuucaaauagcucaaauucugcaucuuuguccacguuggcagguuucucguuuuugggccacucaaaccuaucucuuaaggaaaaggggaguagagugacauguccuguaguuugagaggaguggugguaggguugcugaugaggagagcagccacaggcuggguuguuggccccuagauucugaugucagcaggcuuccuggaauguguuugguaggacccaaacaguggcaaccagugaggacuggaaauguggcaaagaaggcuuagcagggcugggacagaggugggaugggauugggagauuauaguucuugcuggugugaggguaaacuuugcaguucucuugcucagucuuccuccuuugauugguggccugcacagugcagcagaauggcaugaaauugagacucaacaguucugggagcuaguguggcucugucaccauuucacuaugugaccuuggacaagucuuuucccaagucuaggcacaguuuccuucucugugacaaggaguugccaucccccaccaggccugaguaauggguggcugaggagggcaaauggggggguaugggaguagggagugcuuuauaaagugguaaauacccugagggugaaggauaucuguugauuugcauuuccuuugauguugguacuuuuagcugaguuugaccugggcuagagaaccuggcuaguugaaagucccagauaauccuuggcugcuagccaguagcugacucuuuuaggucccugaauaucaaaaguuggcuaaaugagcaaguaaagccuccuaugacaugaccacacaguuaucuucauuuaccauuugccauuugggaaaacugagccccaaggagguuuggugacuuacccacagagcccuagggagcacccuacucaaccugacugagaugauuuuacuucuagaaauuguucuaccacaguuugaauaaaauaugaauaaaaguugguuacuauaauguuuuuagcuucugcuauguaaugcacuugauuugguacauuaugugcauugguuuuacuucuuacaauagccuuaagagguaggcacucucaaugaccucauuuuacaguuaaggaaauugaggcauaaacaugggaaaaaacuugcuggauuuccccuagcugggcagaguugauuccagcgcugaaauggccagcucucuggagggccauccucaccauuuuuucuuuaaccaacccuccccaacauacagaagggcaggugggccugaagugggcuugcuuucaggaagacuguuuggaacaggccugaggaacuauggcuggucaaggccaugucucuggagcuacugcauaaauccacuugcuucuuuuucuucccccaauucagcccucuucaaguuggccaugcuggccccgggaagcugauuuggagcagaaugugcaaggcucauauugcagcugucccuucuccuugagaagggucucuagggcagguauguggcuggccuccugccuauguuuuaaguggagaggagaaggaagaagcucuuccuuuguagccagccuuccacuggccccagaauggcuugaaucuggcucagggagcuggaauggccccagcgcuuucuaccacagccugcuuucugccaugauagcagcugcugcagcaggcagucccugcaagggaccacagaguggcuugggaggguucucuuaacccccagcccaccugaaacucagccacacugguuaaggaacaugaggguuguggggcccugcauuuggcagugccacuuucuugacaggacccccagggaaagccagucccagccuaggggaucugcagagucuguccuuugcugucuccuuugcuuucugccccaccucacucucuuggugaacucuugugguccuaaguaaaggcagcauaacccauugaggaaggauagcuuuggcaccugguuggauagcaaagaguauggagaagaggccuaaggcagagguagcuagguggggcuacgcuagggagcuaccagcuaugggugacccugccaccuuccuucccaguguucugggugacauaggcagagauacugugaaugacuguggggggacauggcucugggagagagaacacagaguaccaguuuaaggcugguaucugccagcaaagaugacucuggacuugguuaggagaagggccugaacuggacggagagaaacuccaucccagggacacccugcguaauucaucugucucccacaacacacagagagggcuuuucaaaccucuuagcagaggaguuuguauagauauacacaccuuuuuaaaauccccucauaucugucucccucucagcaugggccaaggcagcaagucccugagcuucccacagugaauggcuuucccaaaugaacagccuuuaacacauggucaguugcuuccuaagaaacugggaucugaccuggaaggaguaauaauaacuguaaugacagucuuucucauuugcacuguacuauacaguuuauaaagugcuuuuuuugugccuauuaucacaucaacucaucacaccacuguaguuggagugggcagguagaaggauagguagaggagcuguuuugaucucaaaauagcucacaaguaccugcgucucagcaggcuacacuggcccauucagggucccuuggcagaugggaggcugacauggccuggaccccagcccugugguccauggcuccuuccacaacacacugcagcucccugugacaggaaaggggacaauacagagagaggugagugggcuggccucuacccucacagagcauaggagcaagggcaagggaaagcccaaagagacugucuucuaacuggggcgucaaggcucuggaaagcagccuucuuugugauucaauuugccaaaucacucuguucccaggaacuccagccccaaacccagcaggacaagucagccuuugauucacaaggauguguagguccuagaguuuuucacuuggcugugagguuuuccuugaggcccagccuuacugcccaagaagugucuuucucccuuucacauuuaucuuggaauauguuuacaagguauaaagaaugauacuccaccaaccagcuuuagaaauaacaggggcuauucuuuaaggcagcgguucccaaccuuuuuggaaccagggaccuguuucauggaagacaauuuuuccauggauggagaggaggaagguuuugggauaaaaguguuccaucucagaucaucaggcauuuguuagauucucauaaggagagugcacccuagauccuucgcaugcgcaguuugcaauaggguucacgcuccuaugagaaucuaaugccucugcugaucugacagaaggcagagcucagguaauguucaccuugcccuccugccugccggucacuuccuguuguuugguccaguuucuaacagacuguuacauauaggacucucccuguuagccuaggagcuccuuagaagcaaaggcugggaguucucccuucuuguccugcccugaagcacugaauuccagaggggaauagaauuucacaaacaacuccaguacugccuccccaacuccccuauccccaacaccgugacgauaaccuuagcaguaauuuuaaggcugagguaaaaaugugcuguggaaaguggggcauucagacaugauagggccccuauucccaccagacccaggggcagaaaacugggugauuguguguuuaggugugauuguguguguauuuggaggugggagggggcacugucuauugugggacuaucaguugcagggcugaguuggaacagugugaugucaaaauauguuacagaaaaaucucuaaccugagcaaauggcaauucagaucucugcagagagagguucagaugaacuuuccuuuucaccugcucuuuucuuuucuggauaaccagcuguuaucuugcuccaauuuuaauauucaguuaugcagaguguucuuuauggaagcuuggaucaucacacugaugauucaagugucaagccaagcaaggcagcaggcacaaaauuaauguuugcaagacagaaccaggggcuccaaggcuagaguguagcugccagccucuuuccaugcucagugcugguccacagucuuccacuuuaggugaaugugugagucuuauuauuauggcaagcaaucacaggccugguguacuguccagcuguucuuggaccaagggugcuugcuucucucucccucucuuacucuuccuucccuccccuuccccuuccccucuccccucuccucccagauucccccaucugcuggugccacucuacagagaggggacaaauuggugagggacuucccagggaggggucauuggguuuuagcaggcuggucacugagcuagcggaugaccagaggugcagagguauauugugguggguaguggcuaggucuuguuuuuauuccaucucuguugguauuugggcauuuggaggauugagagccuugaccagaaggguguggcuugcaccagguuuauuuauuuaaaaagccauugggaaccuaucucacacaccaggaauaugaaucauguagggccuucaaggaguucccuuccuagauagggagcuagauggggacaaaaauaauaagaggaggagaguagaggagaaacaguccaccucaugguucucaaguggaauuugggguuccauugaugaccgcauuaaaguaucuucccagcaggacagccaauagagggucuggcuuagacccacccucauaucaccucucugagggagagauauugauaggccucuugaauggcgaauauugaagcccagagaguaccuuucuugaggcucccauuucauugucuuagcagguucuagauugcagaccuacuuuguggaugugugaggcuccuauucugagauucugaagccugagcaugguucugcaggcaauuuaggaagcuuuggaugggaggugaaacuucagguccacuuuucagucucagacaaaaugucagugagagcccagacuaauaugaaacugaagcuugaauccaacagagcccugugaggacucaauggacuguuuugccagaugguuuucaaaaauucugugauguuggagccaacaucccuuuugccuuucuugucucucccuauccucauccccuuugauaauugauaauaccucccacagccaauagcaccacuaggccuuucacacaacugcaggucccccugcccagugguccccugagcuuaggauggucugaagggaguggacccagcaagaagguaggggaugaaggcuucuuguugcucaguguagaguuuugcuuccuuggggcccagagagagcuggcccagcaagccaagcauaucgaguggauuaagauuugccccacauuuuccaucauuuucuuucuuguuccacucaagccugacguccggugaaagcaaacccagccuggaugcuugcucacuaguaucugucucucugucuuugucucuccuaucuccuccagaccccacugugaugcuuccugacugauaauguuauaacagugccuggaagccugaggcugcauuuccagcuggacguaccucaguuguccccaucaucauggagacccaaaaggaugaagcugcucaggccaagggagcugcagccucugggaguacccgugaacaaacagcagaaaaaggagccaagaacaaggcagcugaggcgacagaaggaccaaccucagagccauccucauccggcccagguaggcugaagaaaacugccaugaaacucuuugguggcaagaaggguaucuguacucugccuaguuucuuuggagggggacggagcaaagguucugggaaaggcagcuccaagaaaggucucagcaagagcaagacccacgauggccugagugaagcagcccauggcccugaagauguugucagugaaggaacuggcuucucccugccuuugccugaguuacccugccaauuucccagcucucagagugcccauggggcuuuggagacaggcuccagauguaagacaucuguggcuggagccacagagaaagcuguggcugagaaguuucccucuaugcccaagccaaagaaaggccuaaaaggcuuuuuuagcaguauccgccgucaccggaagagcaaggucacuggggcugagcaaagugagccaggggccaaggggccugagagggucagagccaggccucaugagcacgugagcucagccccucaggugcccugcuuugaggagaccuuccaagccccuagaaaggaaaaugcuaacccccaagaugccccugggccaaaaguuucuccaacaccagaaccuucuccaccagcuacugagaaaauggccuguaaagauccagaaaaacccauggaggccugugccucagcacaugugcaacccaagccugccccugaagccaguagccuagaggagccccauagcccagaaacaggggagaagguaguagcaggagagguaaacccacccaauggcccugugggggacccacugagccucuuguuuggggaugugacaucccugaaaagcuuugauucauugacagguuguggugacauaauagcagaacaggacauggacaguaugacagacagcauggccucugggggccagagagcaaaccgagaugggaccaagcgaaguuccugccuggugaccuaccaaggagguggggaggagauggccuugccagaugaugaugacgaggaggaagaagaggaagaagagguggaauuagaggaggaagaagaggagguuaaggaggaggaagaagaugaugacuuagaauaucugugggaaacugcccaaauguauccacggcccaauaugaaccugggcuaccaucccaccacauccccaggccaccacggcuacaugcuccuugacccaguuaggucuuauccuggccuagccccuggggaacuuuugacuccucagagugaccagcaagaauccgcccccaauagugaugaagguuauuaugacuccaccacaccuggauuugaggaugauucaggugaggcccuggggcuuguccgcagggauugucuaccccgagacagcuacaguggagaugcccuauaugaguucuaugagccagaugacagccuugagaacucuccaccuggagaugacugccuuuaugaccuccauggucgaagcucugagauguuugaccccuucuuaaacuuugagcccuuuuuguccucccggccaccuggggcaauggagacagaggaagaacggcuagugaccauccagaaacaguuguuguauugggagcuucggcgggagcagcuugaggcccaggaggcacgugcccgagaagcucaugccagggaggcccacgccagggaggccuauacucgagaggcuuauggcagggaagccuaugccagggaggcccacacuugggaagcucauggcagggaggccagaacccgagaagcccaggcccgagagguucguuguagagagacucaaguccgagagacccaggcccggcaggagaagcccgucuuagaguaucagaugaggcccuuaggcccaucagugaugggccuggcagcagggguaucagggaccucucagauuucccaccggggaauuaccucagcuuuccccaccacugcaagcagcgagccagacuggagggacuuccguccucuggagaagcguuaugaaggaaccugcuccaagaaagaucaaaguaccugccugaugcagcucuuccagagugaugccauguuugagccagacaugcaagaagcaaauuuuggaggaucucccaggagggccuacccuacuuauucacccccugaagauccagaggaagaggagguugagaaggaagggaaugccacugugaguuucucacaggcccugguagaguucaccagcaaugggaaccucuuuuccagcauguccugcagcucugacucugacucaucuuucacucaaaaccucccugagcugccucccauggugaccuuugacaucgcugauguggaacgggauggggaaggcaagugugaagagaauccugaguuccacaaugaugaagaucuugcagccuccuuggaagccuuugagcugggcuacuaucacaaacaugccuucaacaacuaccauagucgauucuaccaaggccugcccuggggugugagcagccucccucgauacuugggacugccuggccugcacccucgaccuccaccugcugcuauggcccucaacaggagaagccgcucucucgacacugcagagacccuggagauggagcucuccaauucccacuugguccagggcuaccucgagucugaugagcugcaggcccagcaggaagauucagaugaggaggacgaagaggaggaagaaggagaauggagccgagacaguccccuuucccucuauacugaacccccaggggccuaugauuggccugcuugggcucccuguccucuuccaguggggccagguccugccuggauaagccccaaccaguuggacaggccuuccagccagucuccauauaggcaggcaaccuguugcauaccuccuaugaccaugucaauaucacuaucagugccagagucaagggcaccuggggaaucugggccucaacuagcucgucccucacaccuacaccugcccaugggcccuugcuauaaccuccagccacaggccucccagagcaugagggccaggccucgagaugugcugcugccuguugaugagcccaguugcucuuccaguucuggaggcuucagccccagcccucuaccacaggccaagccugugggcaucacccauggcauuccucagcugcccaggguccggccugagcacccccagccucagcccacucacuaugggccuuccagccuugaccugucaaaggagagggcugagcaaggugccucucuugccaccagcuacuccuccacugccaugaauggaaaccuagccaaguaguuauuaucaauucuggaguagggacacggggccugagcaugugaauggggaucagggguugggcagaaggguggggggguggggguuguuguuuaacuugaaaacccuuugggccaaggaaaacuccugugaguuuucaccuugguuuucccacuugccucuucugccaucuauggccacguucaacucaagugcaucugcccagggaggcugcugcugcuacugcacuccaguuuuugcuuucgagguuucuucuugugacccacgcuggguuugggaugcuguaauuuugugccuauuccaguugccaaguuagugauuauauauauauauauauauauauauauauauauauauauauauacacacacacacacacacacacacacacacauacauacacacacacacacaaacacacaugcacacacauauauagcaugcauccuugacacaggcuaaaccuuuagugcccccugccccuuucccccaaugaaugaugaaccacugauuagcagccaagucugcauugccucccgcuuggggaaguggggcuuauuugcuauuagcaaugugaaauuaugguacagauccuccccaccccuauuccuuuuggccuggcauagcugccaucauuauaucagaugacuauaagcuauucaucccagcuagcuguccuuagagaggaucaaguagcgugugucucacagccuaucgcuguggacuuuggcaucaugaccagaugggggccuuuuaacuguccugccauagcuuggguuaaagacaaaaaugcuaauccccuugauggagugauaaaauucauccauuugcaaacagaagacaaaacaagguucuguuguggacacugccauagaguguugagcuccggaaugauaggauuuuuuuuccuucuuuuaagcuugugacuaccugaguugcagaugcuuuugaauuuuuguucuuuuuuccucuaaaggaaauuuucauaaucucaucacaaggaacacggucuuuuaauugagauaagggaagagaagcaaccuaaauuaggcuugacuauaggggcugggguuuuuguggaguguaggggaaagauagaaaaugaggguccauuuaucacagccagcaagaaaggggauuucagaccaugcagagcuuaagguaucucaguuucuuaaaagggaaaacucccuucucaagccucccaacacaaaauguuccuuaagccuugcccaucccaucauuuggacucuguaauaaggccccagguuugcacucccaagacaggauaccaaaggcaucucagcugcuguucugggcccuuuaaagagcuuuuaucuuccaauuagccgaguccuuagcaucaucaaaugacagggcuucuuggcaguugcagcccuuuauggaaugaauggcacccucccuucuccugcauccaugcaguuuucauguuaaacuagguuggaaauacugguggggaagagcuugcugucaggaagacauuggaacaggcuaaucuugccaagcucaaccucucauuaaucaccuguaggagaggguuccuuuuacaugucuuuauuggaaauggcauauggaacauuuuuugcuuggcuguguucacucaaauuaugauuauugcacccucgcccucacaucccaccaucuccaugccuguugagagaagaagucaacaggguucuugccauuccugagauauggcaauuuagcuugggaacagaugcuguuugcccccuaagucaaggugacuuugugggcaaacuguuucuuggccaggggauguguccaugcuggucuuugucaccauuucucagauugggguuggcccagugcccuuacucacaaauagcagaccuggcugguagaagcugcaccccuggaagcaccacaugaauuugcauggcacuaacaccaccacucaagggacccagaccagcucuucaggcugacuuuggcuacagauacauugugaagaaauguaucuguuguggagcuggagaaugaaagagggugaggaaggcccuccuuaccccaagcacagcauuccaagagagaagugcccaaauuccaacuuucuggccucuuaccaaagcugcucugggaugguggggcugaaauuggccuggcuauuuggcaggaaguaaacacucaccaaaugccuuuacaacagggaagaacccaccucuugccucuucuuucagggcagcuugagcuccugucuacauguggacugugccagccacagcaggcgguagagccaucaccagccuccagacccugcuggagaagggccaccagccuaucugggaagagaaaaaggagguggccaaccuuuggcuaagggcugagagcugcccucaggaucaggaaggcagcaugaggcauugucucugaggggcacuggcauagcccugacacacuuuguugggcuuuggaaggucacacaccacagaguagggccuggggcugagugagaguucaugguuuggacagccuugcugccugcaagucccuucacugcccuagccagcccaggaauaggauccuuaccaccugaaguggggcagccaggauauguggcugcagaagcagguuccuuugaauuucuagagcuaagcaguuuguggcugaaacccaauggcagccuaggggaggaaggaagaccugucuggggacccaugguguugacagcacagggugacauugggagagccagccaagcuucaggccuguuuccaaacacagacuagugcuggcuuggguggcagcaaauacaccccagaccacuaaaacuguugauaucauguccacaccuccaagaguacuacuagaugaacaacaugucuccauugcaagguccuggaauaaugcuuuuggaugugauuuuaagggaaaaugggacuuaguggaaguagcugccuucaucuuauuacccaauaggccuagugccagacagcugugauccugagaauucccagaugagacugguccuuggaggaccagugaauguggauagagaaggccaccuaguaggccucucccagggccaggaugccaguuucuuggugcuuuagagucuccaaggaagcacugccuuggggcccaguucaagccagcccuaccuaucuggccucagcuuggguaccaggccacaagacugcccggauaauggguucaguaaacaccagucucucucccuccuuaguccuaugccaagaagggaaguagcuucacacacucaggaggcuggguguguacccuucauccugcugccagcagcuuuccuuaccugugccagugccaccaccccaccugcccucagcccccaggcccaguugcuagagggaggcaugggguuuagcagggagacuucaaguuuacccauguguauguugcauucaaguuguuuuuaauauauauauauauauauaucaaaagucaauuaucuauuuuuauauuguuugcauuuuauauucauggaaaacaauguuuaucaauuguucuuuucugauuuauuuuuaagcggugcuguuuacaguuuuaaacaaaacaaagaugacacaaaaauugcugcugcuugugcagagggcuggcaucucaacugccuagggcccucccucuuuccccucucccuaccuuagcuguaccacacuguccguucccuccccccaugauagggacagcagaagaugcccagguacugaagacaaacgccaagugacucaggcgugugggaccugguagacagcuugucauuuucuggcuuuauuuuauguuuuucuuucuuuugaacccuucuuccccaugucuagacccucugagaguacucaugugucuuauuuuuuuuccucguuauguuuugugcuuuaguuuugaaaucagagugcccauguugugcuauuugucuuguugaguuucuccaaaggagcauuuugggaacauucuccacccaauggggaaggaaggggguuucaaccauguccccuuuccccaagaagcugugggagacagaugacaaugaugcuugcacuaucaggaauuuaccaucucguugaggaaacccuugcauaggacuuccuaggagcucaguugauugugacauuuucccagaagagaggcuuuggggaacuccuucaccccucuugcugcuuugggggaaucuccuccccuaccaccauucccccuccccugcccugcuccagcucacacguggaugguacuuuggggaacagugacuuucagggugauggcuugcuggccugaucccugacuuuccaauccuauagucacuccaaagaagaaaauccacaugguauguauaugugugaggguugggucuauugagaggugggacuuuaauuauuguuauuauuauuggugcuuauuuuuccugcuguauaugggggugggggugggggggaauaaaacaggaauguauauuuaggucauguuaaauaaaauggcuggaggaaggagggaagaaauuaggaacugcaguacaucaucaccccagguguaagaguuauuucucucccagugcagaaaggggaguguggccccuggcuguaccugagcuuccucuucuccaucccugagacaucacagaaucacccggguucugaccucuccacuucuagcucucacugacaucuggauaucuugaugcacugccuguuuguaacaacauauacuucuuugcugaaugcuaauaaacuucuggguucaagagggaaccccucagucacuaaug

SEQ ID NO: 19083 - RNA, 4380 nt, Homo sapiens
guugaauuaaccuuuuagguuuuuucuaauagaaauauuuaaagcuauuuaaaaguaaaugcauacuuuauugcauggauaucugaucacucaaucuauauuaaugaaacuauagggucacauugaagcuucuagaacuauauuuuaaagcuauuauuagcaauuauauugcauguaugaauauauauauuugguuugagauguguguguaucucuguauaaccuuuuauauagugauaaugagaggguaggcucuacacaguccuucgucuauagcuguauaggucacuaaucugacuugaugauuuuaagucacauuucauaguuuuaacuaguuaugagagagaaauuauauggcaauauuugaacauugcuuucuuaggcaccagagcaaagcaacucuguuuccuuugcacauuuuaccugccaacauuuauuaacaguucuuaccuuccaagucucuucaccuuagcaaauuagggaucagguugcagucuucugcagagaaacugaugguuaagcucaaguuccaagcauaguaugugugugcuacacaagcucagaagaguuugacaaggaccaggggacuuacuaccacaauccacuucccuuaucccaggagagauggccaaacccauguggcauuaaauggugaauaaaaaagcuucacucaaggagggacuauuggaugcucuuuggacuucugaccuaugcaguauucaacaucauuggaugaaauguaauggaggacagugcacagccauguauccacuuucucuuccuguccacccuuuggguaauaaggucaaucauugguggaacagaauuucucuaggaaacaaaaccaggggauuuuauuuguggaaaaaggaaguuuccaaaaggggauacugcaucuuuacuaauagcuggcucaguuacucacuuuaaauccaugcaaagagugcacuugcuguuaaauaauuguuaaaugaguuauuagaaggcaggacuuuugguuugggcgacaccauuugcgcaacuuguaucuugcucaggguggaaaacuucauagcuaaaugccucuagaagagguguuuauuguuuuuuuuaagcugcacuaaaugaauucccuuuuugaauccauuguauauuucaauauuucgaaccaugaucagcucacuauuuccugagcuggaacuugcuaacuucuaugaucguuuuuucaugaaaguugagaaggccgggccuuggccuuuuguuucuucaugagaaggugugacacugccuauaaauguuucuuacugugaaacacucugaaugugaggcuguagucaggguuguuucuggugguuugacaauggcuugcaugcugcuuucuggcuuucugucucuguccaaguugaucaauacugcaucuuaaccaauguuucacuugaguuaaccacagcuuuacauucuaucuccuaucuucugaucuucguauaccccagcauauugaaaaagaguaaaaguauuuucuaucaaucagguagauccacagagugacaguugccacugcagugcuugcuauuucacacaaacaccauuucauaccuucaacuucuuggacuuucuaaaucggacucgugucuaaaucaggguauuugacaaucucagaugaugcuacugccuaugugccaguuaguucaucuuccuaccaagaucaugaauggcaccacacuauccacuagcuguacaauuuacagagaagcacaagauucaucuugucaccuacaauucgucuugaacauguucauauuuaguacucagaaacuguguaagcuccucccaauacagaaaauauuuuuuaaggcagcauauguauuucugauuuacuaaaaacgauugucauucuccucucauucuucuuuuugguaugaaccaaaagcggcuaggagcaaugccucaaauaaccagaaaugaccuuuuguugauacaaauuguaucucuuuuuuuccugauuguauagaaacaaauguacaaaacucaucugaagcuagguuuggcacugaauuuucaccaugagguuuguggcacugugugucacagggaaguagcucagggguugugagggagcuuuuauuucuaaagggcaguaguaauuuauagacaaaaacaauuuuucaaggccucuuuauuaccacugcacagcuaucauguguaaaauuucaagcauuauauugcauaaguucucuuuagccuauuaaauuuaauauguccuugcaaaagggauuuuguguaaaaagugucaguguuagugacucaucugcaagaaucuacaaauggagcuauacaacuaugaauacauaaauacagcaugguuccuaguuauuagagaaacauuuucuuuauauugaggucuacgcacuucuugacuuuccauuuugucuguaauuauaaaacagcaaauaacaaagaagcauugggacccccucggcugccuugauaauaaaaucaagcuuccuucaugggacuaagcauguguccuucaggauacuuaccucuaagcacucagcagggguuacuacaaagcguuuugugugguuuucaaaaaacaguguauuuugcaagaggugcuuuguaauuuuaauuauuucacugauuuucugaccucauaggaagucugugccuguugaggccuucaauuuuguagcuuuucugauuuuuuuucuucuuuuugugauuuuguuguuguuuucauuuugaucuaaaggagaagugugaccccggaguggcauggucaauccagggcacccuuucuguaagacaacucaaaggaaaagaagccuuuucaaagguaauaucgagccauugcacucucucuuaaggugccagguaugggagaaugacagaugccuuauggaaauggucuacaaaacuuuucuucuucuaaguaauaaaacacauagcaugauucucucucccucucucucucucucucugcccacccccugcuaguuuccaggagaauacuucucuaaaauucauuuuuuucuauuuuggaauaaauuaucuuuauacaguaauucaaacacugauuuccauuaaccuuuggcccugaguuuucuucuaacauagaagaguucauuuugagaggcacucaguuaccauucaaucugugcuguaaguaugggacuuuguacaaaugcccuuuuugagggccaaaaauuucaauacacuuuguucuacuuugugaaccaggucuggaucugcacagagaaaguaaugcugagcuguccaaagaguccgcucaggucucccuccuaacccuccucugccuuccccuaguuugcuuauccucacgucugacacugaggagugcauagucuucaacugaaauggcacuacaguuaguucucauuggaaacaaacaaguguauuucuggaaccugcucgucuaaaauagucaaugccuuuguaaagacucagcauauucaauaucuauuguaugguagcuagcuauauacauagauugacuauuuuuaguccugguuuguguauuguugagcuauaguaguuugcuuuauccauuugugggauuaaacaauacuguuuaaugguuguaaacuuuuauaaaaucucuuuggguuuuuuguuugacccaaacauaauguaagucuuaaugacaaaauacacaaaguuaaccagaggugagugaaaauauagcccuuccccaguuuugucugccccuauaaugcacgugcauugcuuuguaauaugcucucgcuagcaugaaugugcuaugacuacuucaugagguuuuguuucaccuauaauugugauggaaaaugcuguauugcugacaacaaugaacuguaaccacaguuauuuacugcauaaacuauuuguguacuaaccacucauggcucuguuucuuuaagaauaccaacaacaaugggccgggcaugguggcucaugccuguaaucccagcacuuugggaggcgaagcaggcggaucaccugaggucaggaguuggagaccagccuggccaacuggcgaaacccugucucuacuaaaaauacaaaaauuagccuggugucauggcacgcaccuguaaucccagcuccucgggaggcugaggcaggagaauugcuugaauccaagacuuggagguugcagugagccgagaucaugcuacugcacuccagccuggacgacagagugagauuccaucucaaaaaacaaaacaaagaaacaaaaaacaacaacaacaaaagccaugccacacauacauauacauauacuacauauacucuaguuugcuccuaaaguauuagauuuauguccuugcgacuuauauuuugagauuaaaaacuauaaaggcagggauuuccccaaauguguucaucugaauuuua

SEQ ID NO: 19084 - RNA, 22266 nt, Homo sapiens
cucacaaacaccaaaacuacaguugccuguuuauuauuuuucaaaacaaaacaaaaacaaaagacauucaaaauuccccugugguggacaacugaguugauguggcugauccaggcugucucccagguugucucagggagcaucaguuguacuagggggugggcuguugcccuggcacggcuggaugaacacuugcaccagggauggccaucagaagagcugcaggccaguuuugagcccaugcagcugccccuggcuccagagaaggcccucgaaguugcugcugcugcuguugcugcaguugccacugccgacaccacagcucaggcccaaggugcugaggagagagugggaggucagucagggaaggaggcagcuuuaggcucuggaggggccaagagugcuugacauguguguaucugugggaugggcccacucuccugccuggcuuuacaaagagacuggagcaaauccgagaaacgacuucgugugggccccaggguugacuuggcccucuccucaguugaggaagggagggaaggaggcaagaacuuuucaaaugaaguuuuaugcagagcccuaguagauaaaccagauuaaagcagagcuguuuggguugagguaggggagggggccccacauaaccugacucccaagacauugaaaguagcugccuuaacaggacauccuuucaaggccuuagagcuugggggccuggaucccucccacacccaacaccugguuaaggggcccaaggccaggcuugggcuauaagacuaggcccacgauugcaagauugcuuuagggaggguggcucugcccuccuucucccuggcccugcucauaacacucuugcuuccccugcuucccgcaagucaagguccuuccagcugggugagggugacagcugagagcaaagccaucacccuacccucaggcagauccaugguuacacuacugcagcugaaagaacccuuacggauaaucuaguuccaccaccucccaucacccacaaucuuacagacaaguuaacugaggcccagagaugggaauggacuuucccaaggccacauagccaagucagggguggagcugagacaagaagcaggggugggcaugccccuccacagcaaaggaaacgucccuacuacagugggugugggagcugggcugaaucagcuuccuucuugacugaacagcuccagcugcccacacuucacccuugcuauccaugguacucaauaagccauccuuacccagggccaggcugguugggaaggagggguaagggcaccucucucagacaugugaaucccacucccaacuacagaucuccuggcuuccccagcugccaccucucuucuccaagaggccugcuggcccauggccuuggacagaguccauggcauugccuugggucuggccugcuucuggggccccuggauucuauagcccuuucccagaaugcccagaugaagagggguucaucucccagggagugggcaggcagcaaagggaaagacuuaguuucaggggcccgcagggguuccucucuaguacucacaggauuaucuggucagaauggcccagcauucuggaauguacaggcccuuuggaugggcuccuuuguguuacuagcauagccccucagcaagggcugcuugguuccuggcucccuggugacccaagggcucccacgccugugauccagaggcgaguuuugagggagagcaugaagccccgugcaggccuugcuaccaaggugccuggacaguguggggaggccuacugauuacucuaugcaccauuagacaaaucccuuccccuuucugggccucaguuuucuccucaguaacgugaaaaagcuggaugagagcaucuauuuuugacuuuuuaggagugguggaccaguuagagaaucugcugaaagcuauggacccuucuccucccaaaaugugugugugugccugcacacacacacacacacacacacacacacacacguccauccauaagcacaaacugaaugcaaucugagagggaugccaagcccagcuguguguggcuacuucacuggcuccccacacuagggacagggagagcuggcaagggcccagccagggacuggggcuuacacuucacucauuuaggcccugacuggggacagcuaccucccccacccaccucaccuugucuucucucccucccacagguggcagagaaagggggugagaaauccuguugccaugggcacucacucagucuugcauguugaggguuccagccgcugcucuagcacaggcugguccaaaagauacauggugucauaauucuccagcaugagcucugcuggguccucggucugaccuggcauucggccuaggggaaaugugucccaucgcacgucuucuguggagcaaagggaaguggcaagacugggcugaugagcugguucuccgacuggugcacaggccugcucacccuguccauccacccaccccacuuagcacaggugggcucucucaggaucuccagcuucacugcucucgguaucacuucucaugagccccucuccaccagagugcuucaccacacauucuuuaugguccuucucccccucuaugugcuuacauauacaaguauacaacuacagacauuuuugucccucuuugcucuuuuccuacuuccccaggcauguuccacacggacacaaacaacaacuucugaccaggcuguaucacugcuucaacuuuucaucuucaccccuauuucccugucuguagacacacacacagggacacaucauggagggucuggaugucccagaauucccaaagcaccucccccucaaaccccaaacccaccaguaccucagaguagcugaaugaccuagauuuccuacaaaucuacacacacacuccccugccuguuugaauaccacauauuuucuuaaugcagagauacacacacacccccaugcccaacucaggguggacucccugagauaguauguuccccugcccccugcaguucuugccccaagaugcacaagguacaccccuuuucuagggaacggcugucucaccacacaucccaccccucacagccacccaaauauguauacagaagcacacauacacaaguccuucacucagugacuguccuguucacucccugccucccacaccccucauucacuggcauacaaccagcaaucuuccugucccuaccuccccacacauguguacacacauaaggagcaauggcaaaggagaaagggaaagaguuaauguucuagacuuuccacauucacaacucacauccccccauauacagaugcuccacuuuagaauggggaugccggacaucccccaucccucucugucguaucacugagacgccuaccacacaguauuauauuaaaugucccuccccauccuuccacaagugcauucaguguuuucaaaugaagccuucacuggugcauuccauguagauuccauuucuggccuucugcaucucccugguacucaaagaauucucccugucauaaugccccuggcauucuauaaugugucaacccuggaccagcuuuuuauguaacccagagcuccucaggaaggacuguuccucuacuuguccaucccccuccccuggcucucuuacuggaaguugugccugucuuaauguccugcauuacuccaugauacagagacaccuucgugcacaggggccacuaccuacauaggcucugucacugacccgaucaucucucugucaucacuaauaucgccaaugcugucuacaucacuaccccugccucuuuagccugauacccuuguacauguccccagugacggcgugaacauacaggccaucucuggauggcuauaucucacugccuguucccacuaccccuccauagccaccaaccucaaugcuaucacuucucucucacacagauuaccuauuagcccucauggauuucagcaacccugccuccucuucacaaagcuguacgacagccugcuuggccaugacuuaacugccccuacuuuucccuuuuuccuauacacacacacacacacacacacacacacacacacacacacacaaauucugcuuaugucaaugccccucccuuucaauauuuacaaagaacccccaacacagcccuccuugcccuaaguuauuugucacugggcuaugguuugaccagcagguacaggaacaugcccauacacacacacacagagagacagacuuuauguuuuauguuccagcccuuccacccuguccauacaaggacaaacaaaggccauaguaucuuucucuauaaacucauucacugccuccccucucacucucugccacugcacaccccacaucacgcaggcccagcuguucucccucccuccccaggcuucagcacacagacaccacacuguucugucaucccuucuguguguuccggccuccgagguuccuguucauuaaccuaagcaaggguacucaaaaggaagagcagaucccuaucacuaacccucccugcagccucuuccuagcuuuggccucacuaauuugugugcucaccuaaaaaucacagcauuccuuauucugucuugugaucucacuuccuguuucucugacuuaaugcccuagguuccuucuuucuuucuuucuuucuuuuuuuuuuuuuuugagacggagucucgcucugucacccaggcugaagugcaguggcgcgaucucggcucacugcaagcuccaccucccagguucacgccauucuccugccucagccucccgaguagcugggacuacaggcgcccgccaccacgcccagcuaauuuuuuuuuuguauuuuuaguagagacacgguuucaccauguuagccaggauggucucgaucuccugaccucgugauccgcccgccucggccucccaaagugcugggauuacaggcaugagccaccacgcccggucuccuagguuccuucuuucuaauacacacaucaaaaucuugucucaccaccagccagccucaaggcacacacacacauacacagaaagcacugucucacugcaagugaaaaacacgugcagaaccauauauguacacacucccuacuucuugcuaucuucugccucuauguuacugcccagggcucacacccaugucauccucucagaaugugcucuuaugugagguagccagcagccugacaguggucccuggcacucacaggcuccauccuaagaggugggagaagccagcugucaucuaugcaccaggcugccuuccaggcuugccucacauuggcuaccuccugcuacuuuccaucucuuccuaggguagaaggaagccucaagagccagccaaagagaaaagaaguccauguggggacaaaguaguucuuaccugagcuaaccugccaugcagagcccugcaaagcuccucuuuucugggccagaagccuagcauucucggcagugggggacucuugcccuguagagaaaggccccaccuccauucugucuuccucuucaucaucuucaucaucuucauccuccucuuccuccucuuggucaucauuuucuuccuccuccucuaccuggucuggcaagaccucuuucuccuccuucuccucuuccuugacaucauuaacacugcccugcuccuccuguugcugggccuuugcuucagacccgaagcuggagcuggcuggcuugacgcuccaauacaggcugucuaguguauauggagacuucccaaugggggaggccucagagcccuccugcaccaggcuguuuucuccacucuggguauaaauggaacagaugcgcagcagcuucuccugcuccucgucuggcaggcccugccccauggcuuugaagaugcugagcaaagggagggaugggguaggaaagauucaaaaucucaagccacuucauaccccaacacuccaggguuugaacuuggucucugaacuuccagaccugccucugaaaggcaguguaguagagcagacagaacauagaaacaacaggaccauggacccagaacaaacucugugguucaucucugugccucacuuccauucucagguaaaaugaggacaauaaugauaccuaauguauaggauuguugggaggaguaaauaagaaagcucacauagaaugccuggcacagugccuggcacauagugggcaugcaauaaaugauagcuauuagucugcacuuaaaagcuacauaaaugcacaaaacagccaacaggccugcagggcuggaaaugaacagaucccucucuucucuggccuagcugagcaaccugucuugagcuccaaggauaugccuggaaguguucugugcuccuucugcguggaacacaaacugugaucccuuuaugggagcagcuacagcccagccuggaauggaggaaaagaaaaaaaaagcagcggcugacaagacaaagcaggaugugggagggaggccagaugagcacugcgaaccuacugcaggcacugcggggcugagggagacagagagcacgaggagggcaggaaagaccaagggagggcuuugugcaggagguagggcccgggaagcccagagacaagagcaagcacacggugcugcugcgugcagugaguagcccagcuagagggcacggccugugcugaggagccgugggaggaagagagggcugggaagguaagugugugcauuggugugugugugaggguucaccugccaauucugaguacacaugaaggcuauguuucugaagaucaccaagugaccauguggaggcuggccuggacaggcagccuggaggcagggagaccagggaggagccuguuccgacaguugaggccagagucggggagggcugaccuggggcacuggcaguggagaugggagggagugaagcugugaaggacacacagacagacagagagcagggcuuggugacugauggcaggggucaggcagaguuaaagaugaugacacugugcacacaaaagacggcgccaacagcaaaaccaccaacagauacagagcugcugggaaggggagcucgaggggagaggagggugagcaccccucacagagccucucauagagccuggcaccuaacaggcacccagucacagauggaugcggaugguucacagacgggccaugagcucagcaggcuguuuucucucugggcacaugcagacuggucacauaugcagggugacuggucagugggggcagggcuggggggcugaugacuucacuggagauccugucuauggaggcaauuucauauuccaagacgauaguggcucaaauuaaauugauauuggcuggcuggagaaagugcuugaaaagcuuccagcucuaaucagaugaaaagccagagagaaacuuuguccucucauggugguccauuagugugauuaauaauaaauauucccagacacuugauacuggcaaaaugccuuaucagcccuguuuaugauuacccaccugcuaucucgaaccauuagucugaccacuaaggugcgggggugaugcgaaucuuaaaauacacccccuuccucgaguaugucuggucauagcucaggacugagaaggucacagauucaggcugaugggaugaagguagacuuugggcucacaccaccugggccaagaucccugucccaccaucaacaaauguguagcuauuagauaagucccaucacuccuuagagccucaaugucuuaucugucaaauaggguauaauauauaauacuuccaccucccaagacugcugugucaaaguaaaugaaguuaaccucuacaaaaaaacacagcaccaugccugacacuuaauuuccaauaguaucuuuuauuuuuucucuggggaaaacaaaagccaaguucuguguuuaacagaugcuuucugcaauaauacaaucuaguggaguauuacagaagagcaugggacuaaggacaggcuaucuggauucuggccccagcucugacuugcagcauaauaccugggcaaacccccucuguucuccacucuguguaacggggugauuaggacuagauucacugcuuaucugggaaaggcaggaucugugcacaagaaaucguacccaagugagccgcuguuacugccggcaugugucgcaucccucugguaugcuuggguugggagaagaucucugugguccagacuucuccgagaccagcagcuuccacucugcaggcacuuaggauuggaaaguaccuugaaggccaccuauccaaaccucuccaugcugcucuugucacucccucccucccauuauauacacaugccauguuccuucuggacuuugaaacuugcuuuauucuuucuccugcuugaauuguucaaaugccuccucuugaaacucugacucauccaggcccuuuugguucuccucccaauugcccacccauccacaucacuucuagucuggagcacacaucuggcaauguggcuguucaguuccaacuccuggaagucuugccuugacugacuuugucuacaaagccacuuuuaaaaccuuacaaauaccucugugucccaaaugccaucaggguuaaagaaagacuuuuggacucaauagggggaucagggacuaagagggucuuggcauccagacucccacuucauucauuccccaggcacugggucagcucccaccaaggacagcacugcugggaaugagagagcagagcacgguucaauucaacgacauuuacugaggccuguuuggugccuagacuuguguggugugcuagggcacggacagcugauguagaguccuugcccuugaaaagcuuagucugauagagggaaggagacacuaagggaaguagacacggcaacacaaaaccucagauuugggaaguauucgagagucaacaggacaggguagauggugccgccaccaagugagauagggaacagaggaggaagaucacuuuagaguugagauggggacugagacgaccaauucucuuuuggucacaguaaggugccugugggccauccaaggggagaugucugacauguagucgaguacaggaggcugaaucuugggggaggggccagggcuagacagauuuggguuucagcacuuuauaggaacuaguaauaagcacaggcauuuuuugaggagggggugguaaacagcaucaaugcagcagacacagagacugacaagggcccacugauuugguaauuaggaggucaaagcaacucugggggugaaugucaaauugcagcagguugaggaguaagaggguagugaggaaauggagaguguugaguguagacuacucuuuugagauguuuugaugggaagggugggaaugauaagcugaugauaacccaacagagggaugcagggucaaaggagauuuugcuuguguugcuguuauuguuguuuuguuuaagaugagaaaagcucaggcacguuccuagguugaagagcaagagccagcagagcaagguagaggcuggggugaggccccagcgaugcuggcagagguggcuccagagcacagguggaggagcaggcuuugagguggggcaaggccaccucauccugagacuggcgagaagguugagugcagccgcagaucaguucacgagggcuggaccucaggucgagggggcccugccggaugccuccaugugcucgaggaagcuagggugaaaugggagagggggaggggcuugaggugagcgguaaggguuuagaauagugaggaaaugggagagaaaguggucagaaaacaaguaaaaguucagacaagcagaacugaggccucgcccgagauuaaaaaucauaccucugcaguggcagcaauccgcagggcuaugugguuuucuccagcagagcucagcuacccgggcugaggagcaggggaagcagaauggggaggaucaauuccagcucagggguuugcaagucagauauggccaaaggaugggcaaagcugaaggugcugaugaugaguggccgaacugagcaaccacagacaggauagagaggaagcaaggucaagggaugcaggaaauggagggauggagaucuggaugcaggcaaagagcagaugucaugggaugcaagggugagaacuagaaggacgagaagugguggucaccgagugggaugcugggaugugagcuuucagagguggaauagcuccgaaugauggaaauggguugcugaguguaguggagaaugaaagucacuggaguugaggagcuguagagugucagaugagucauccaaaugaaacagauauugcucaagaaagcaagaagggaaucaggcgcuaaaggcuuccaugauuaugagggaaguggcucagggucaggaaaugacagagaaaaggaaagggagacaaccacagguauuuaccagugcaauauucaguuugaccauagaacccaggguggauaggguaaaggagacucacaggagguauggcuaccaugguaaguugggccagaaucagaaagaucuuugaaugucaggcuaagaagccuagacuuaacaggaaggcaauagggagcaacugaagguugcuaagcaacuaucagagguauacuuuggaaagauaauagaggaaacagcacugggcuuggagucagaagaccuggguucaauaauaaacagcagcuaccauuuauugugcacuuacucugugcaggccacugugcuaagcacucuagggggauugucuuauccauucccacacuggacucaguucagucaggucuuaagcuguaugaucuuagguaagaaaacccuaccccuccccucucuggacucaguugucccaucugucagugggagugagacugggcuagacuguccccaaagggcccuucuaacucagucauucuagggcaguguggcccugaggcuugaagggccucacccucuuaccggauggaauucaagagacuuacauccgaaggaguugggggcuggcccagcaaggugagcccaagcaggacucaaccauccggggccagucaagggaggcggagcaguugaacagccuccagccccuucuugcuucccacuggccugcagaaaaucggcgagcauuccguccugagagagaagagaggaucuaaggagaaggaagcagugagccccccacccaacauuucaccucagaaaguuuggcucugucccuccccauccccccagacuccccaccuauaccucccaacugcucaaagaauucagggcacuuugccccagcccaguuuaguuggcucugagaagaaaaggaaaagggagauuuguccacugcugccguggggcccucuugggcaaaccuaaaccuuuaacacgggagguguuugccuggugcuucuuagcagagagcugaggacaguggcagaggcuccugccugggcugccuuaggcccuagggcuagggcuagucucccucaccagucuugguguuggccacgaucaguucaacgguccaucugaggauguagguaggccggaucccgcugauccccaaggcuggcaguucagagagcauccucuccaauagggccugcgugaaguucugggagugcaggccccugagcaggggcugccagaacugagagaacggcuuuggcaccaggacgucauucaaguccacguuuucugguuuguaagggacacccauuugggggggcaauaggagagagagagcaggagagcacgaaagagagagcaagagacagcaagagaaaggaagugagagugagagcaagagaaugugugcgcgcgcaugagccaagccccccaccaacaacagaguugccaccgcagaacaaaggaaagaggagagcagaacaguggggagagagaaaccaguuaguaucuggcaaccaacaacugacucaaaauaaaguauaaacaaaacagagaucugguucuagcuucagcuuugucaauaacucacugugugacuuugggucaguaccuuccccucucuggaccucagucugaccaucuguaacaugaggauguuggacuagaugaccucacaaggccccuccaauucugcuguucuagcucucuagcuagcagcuaaaucacaacgaacauggcacaauaaugucauuaagacuccccgaccccaccccaucccaccccaccccauuccagagcacuuaagggcagccccacaacugucaguggggcuaccuguucugcucagccaggaaggcugagggacuuucagaggccauggaauggcaggaaacagccuucacaccccaacccagggccccccagcccaccccagcuguuuccacccaggaaucagaacccuaagggugcagugagcccccagaacccuaccuucauauucuaucugcaaagcugccaacuguucaaauguggggacaaggaagccaucauccagaaaagcauccagcacagccucccuggaacaagaggacacuaguuuagcaaagugaugcuggcagaagacccucuccuacuccuccacccaccuccaaagcagcuaaugccucuggcucaaguggcugaagcagcauagggaggaggggugguggguggguaggaguggggaggaagggaguugacaauuggaucuuaggcuucagccuccucaggcaggggcugguuagaggcugggaucaguggguuuugaacaagugcuuaccaagcacuaaugcugaucuauggcccauaacgagagcaguagugucugaauacacuucaacacacagacaggaaaaaguuccacauccacagaaggaaauaaaugccugggaucauggggucaagggcuuuuagacucaguucuugcagucuguuuaucuugaccauucuucaguacccuaccccuucucuucucccuggcuaccuucuuuuagauccuagaaguagaaaccuuggggacccaacugcuagaccaaauaugguccauaggccuuauuacuagggguucuaaaaacccagaacaaaguuagagggguugcaggaguaggcuauagggguaaucucucaucccuaucuauuaacccauuuaugccgaguguuccauuauuggaacgcuaagcuugugggaguuauuuauauccuacugcucaaggucuucaccaaggucugauuuuucaaaaaaaaaaaaaaaaaaaagaaagaaauugcaaccuccggcauaaauggguuaauagcucaaaccuacaccagcaacagcaagcugauuccuccagaguuaguggcuucccaagaggcuuucugcuacaguuuggauguuuguccccuccaaaucuuauguugaaauuugauccccaauguugaccuuggugccuguagaagggguuugggucauugggucggaucccucaugaaugacuuggugcuguucccacaguauuaaguucuuguucuauuaguuuccgcaagagcugguuguuaaaaaagagccugacaucucccccuccaccuugccauuugauaucuguacauguggacuccccuuugccuucugccaugaggggaagaagcagccugaagcucuaaccagaagcagaugcuggcaccaugcuucucauacaggauacagaagcaugagacaaacaaaccucuuuucuucaaaauuacccagccucagguauuccuuuauagcaacacuaaacagauauagacauucuccuaacugaccaagccuagacguggaaaaaagagcucccaaguuguccuaaugccuggaaaauugacauacuuagaucccucucuccagcauuaccaggcagacacuacuguguuaggggcauaguuuucccagcugcuaaugaagccaccaccaacccuuuugcugaaggguagagccaagaaaccuaggcugggcaaacacugauaaaauacuuuuggaacgaguauccuggacaugaagagaagacuccaggggcaaucccagccuacacugcaguucucacccaggguuacucugcuaccuacaccaccuaccuaaacucuccaacuucucucuagcugagguuuagcauugccuccacacguucuuagcggaaagucccccaaagcccuuccagcugaauuuagguagaaagcccccaagagcuagggaggaaagaagaauggguagacauacuaugcgccugcucuggacugagcugagcacuuuguuuuggaaacaaaggcucacagccauacuugagagacaaggaacuuagucucuaggagccagacccugagaaggucccgccucuauuccccuaaccaugacuauccaagggaugcuaauacucuccaauggcaguucaaaagaaaacaccaggacgggcgugguggcucacaucuguaaucccagcacuuugggaggccaaggcagguggaucaccugaggucaagaguuccagaccagccuggccaacauggcaaaaccccgucucuacuaaaaauacaaaaauuagccagguguggugguacgugccuguagucccagcuucucggggaggcugaggcaggagaaucccuugaacucgggaggcagagguugcagugagccaagaucgugccacugcacugcagcgugggcaauagcgaaacucugucucaaaaaaaaaaaaaaaaaaaaaaaaaaaaaaaaaaaaaagaccaggccggcugcaguggcuuauaccugugaucccagcacuuugggaggccaaggcaggacaaucucuugaaucccaaaacuugaaaccagccugggcaacauggugagaccccaucucuacaaaaaauuauaaaauuagccagacaugguagugcaugccuguugguccuagcuacuuaggaggcugaggugggaggauuucuugagugugcgagguugaggcuguaguuaacuauguucgcaccacugcacuccagccugggugacagagcaagacccuaucguaaaaaaagagaaaaggccaggcacaguggcucaugccuauaaucccagcacuuucggagguccagaagggcaggucauuugaggccaggaguuugagaccagccucgccaacauggugaaacucugucuccacugaaaauacaaaaacuagccaggugugguggcucacgucuguagucccagcuacucugguggcugaggcaugagaaucacuugaacccgggagguggagguugcagugagccgagacugcgccacugcacuccagccuggguaacagagcaagacacuuucucaaaaaaaauaaauaaaaaauaaaaaaaaaacaagacaagacuagcagugcccaccauacauauaucuuuuaccucaaacuuagacaagggcuaggcagugagugaggugguaauuaucaagggauuuuccuaguugucaagagcuccacaugccacccgacagacaggaaagcagcuggccagcagauggaugauagugggcauuccugccucuggccauucuaguauaggcaacccccaccuggaaguuggcaggguugagggcagacaguucugccaaauguagggucacuguggaggggaucaggauuaucccugggauuuuguacagcagagguuggcaagcuaggauagggaaaccgauuucaaugaggcugcuacccucuauccuagagaauacgcagcucccgguuaccuaguuacacaccuguucucgcauguaacgcccuugagcucugccaggacacauucuacacguggggacggguuauuccacgccuuaauggccuuagguaaauaccuaaauuucuccagcaccugccagcaaagagggucccaucagaaggcugguucagccaagcaacccaccuccaccccuccaggaucccuucccauaggaccucucagcacugcccugcaggggacagggcagggcaugcaggggggggcccacaacuccccuacuggccuugcaacuaaaaauagccugacucucaaaugugagacuuccuccuccuucucccucccuuccuccuccaacugaauuuccuguggguaaauacugagauguucaaugggggaauuuggcuggagauagagacucuuaggccaaagggccagagaugaggagaggcaaugaguuacagaagaaagauaacugggagauccagguacuaauccugguucuaucauuaacuguauaugugacuuugggccugucccuucacucauccauggcuucaauuucuuaaucugugaaaaggaagggcugagcuaaaugguuucugagugaccucccuaaaaacagcaccccuccagcucaccugauuuagggaagcucuugggccccaucuacuggucagcugcggaauugcagggcugcgcaacuacccauucccaguuguucccuaccacccaguggggcagauuauccgcaaacuucaucaucuguucccuuccaucgguguggaggaucagccaauuggacucugcuccucuugucuccuuccuaguuccccccucucucuuuccgagaaguucccucacgcuuugucacuuuucuuucaaauuccuucucaagacuucucucagguagcuggcaagagggaagaaauggcuggggcagaugagagcacaccaaguccagggcacuuucuuaccguaaacugcuccucuucguaugauaccagcaguucucgggcucuuucugaaaacagaauggggagacagauaggacugccagcccagaccccuucuccugaugggauucugagccucucucaccucauuucuugaguuguaauugaggaacuagaauuccuuccccaacuacuucacagggcucaagaugguuugugaggcaaaugugacagccauuauacuauggaaacuagccaggaggaugguuugugacaguaauuuuuuaagcuaagauucaccacagccccagaggaaaugcugagccagggaaauaaacagcguuaacccuaagccugagccuucugggcucaugggccgcuuucugcccuccaaaacaccuaccauauagcucuuuaugacucagggccuuuuugcaaugagaauccaccucuucgcugccuuugcugucuccaucggccuuuacaucugacuccguacuuuucccaucauccugaggcucugguuucuguucugugaugucaucaacaacaauguucuuaucuuccucuugauccucuuccucuaucccuucccugaacuccuccaacucccaggucucucucaggcuguucuccaguuggcggcaccaauaggucuucuggagccaauccaggacaaaguagcagccuagaggggggaaggcaggcagugccacaggaucaggcaggcagcuagcaggccuccagccucaucuuguggguauuauaggaaggccccaggaaaaggcuuggcuccaagguucaaaucucaaauauccagaagcagccucuuucacucuggguuaucccccuguucuuugcuuuauccugcuuaccagcacuuuuucuagaaaaaaaaaccuauuauuggacuuagagacgagaugccaaaaacaguuaaggggcuaguaaguggcagaaguaggaaucagccccauuagcuaguuacauggccuuggccaagucuccccuuuucuagaucuguuuucccaucacaaagagugaggcuaaauccaggauucuuaaucgggaugggguggauguccaaggaacccuuggguucaugacacugcugauggcucaugccuggcaaccuccccaccucaacuauggagagguaugugagacuaaugaggcacuaccugagaaacaacauuuaaggggaguggccgggcacugugguucacgccuauaaucccagcacuuugggaggccaaggugagcgggucacuugaggucaggaguuugagaccagccugugcaacaugaugaagccccagcucuacuaaaaaaauacagccaggugcaguggcucaugccuguaauccuagcacuuugggaggcugaggcgggcagaucaugaggucaggaguucgagacuagccugaccaacaugaugaaaccccaucgcuacuaaaaauacaaaaaaaaaaaauuagccaggcauggaggcgcgugccuguaaucccagcuacucaggagguggagacaggagaaucacuugaacccaggagguggagguugcagugaacugagauugcgccacugcacuccagccugggugacagagugagacucugucucaaaaaaaaaaaaaaaaaaaguuaaucagacauaguagcaugugccuauagacccagcuacucaagaggcugaggcaggaaaaucacuugaacucgagagguggagguugcagugagccaaggucgugccacugcacuccagccugggcaacagggugagacucgucucaaaacaaacaaacaaacaaaaaacaacuuaagggcaggcaaaaaaaccucuguagucaagguaucaaaauaugccaagccauguuggaagcugaaacaaaaggagaaaucaguaauacuaaucccguuuuacuuaaaguuuugauauuauguuuaucaugaauuuuuccacauuaauauguuauuuaucuugauuauggaacuuuugacuucuccccacuuuaaauguugugcccaaggcgaggccucacuucuuucacccuagucccagccuugacuccagguggagacccuccugccuaucccucuacccucagcgccaccaagcccaggccccugggcuuaacugugauagguauaaccucugaggacucaccucugcggcagucauuuauauggggcauuuucuugugggucaacucauggcgaaggucaacaauccaauccggaauauuuaccugauuacaggggagggugugaguacagaaauuggaaaauaauuauuaaagcuggaagggagccagagauuaauuauccugaccaccuccugccccauuuuacaacuagagaaacugagguccugaaagaagauuccaaucacagugacagagccaagaaaaaaaaacagcucuucuuauucuuuuuuuacugcucuauggaggagguauugaaaaucagaaaagugggucaggcacaguggcucaugccuguaaucccagcacuuugggagcccagggcagguggaucacuugaggccaggaguuggagaccagccuggccaagauggugaaaccccaucucuaccaaaaauacaaauguaaucccagcuacuuggguggcugaggcacgagaauugcuugaaccugggaggcggagauuguggugagccaagaucacgccacugcacuccagcuugggcaacagagcaaaacucugucucaaaaaaagaaaagaaaaucagaaacauaaaaggcacacaccuccccuaaccaccaaccacccuucuacaacaaagaaauaccugugaaugagcauuaacaaucacguucuccagccucccucuagccuguccuucucccugaguauccuuuaccccugcuucccuccuacaccuccuccgggaagcgcuaaugacugagagcaugccugcccucugggccucuacacaguucacauacuccucaggguaggaaugucugaguuacagaaguagagacaugggaugggaauuccugauuuacaaagugacucauaguggcugagcugucuccucucucagacugucagcuccaugagggcaggugcugugacugucaccucuuuccuguccccacccagugcuacauuugggcuccucccagcaagcugggcaggccaagcccucugagauaccagucauaugagagcaagggagcaacugugccuccuucaggcuggaagcugaggcucugggauucuugcugggcuuggcugguagugaugggaugagcuagucugacugugugcccacaauaccccaugccccauuuggugagcccucuuggagacagaauugagcaaguucacugaaucauacgcaccucuugagccagacacuugagggggaccuuggcaaacuuugucuuccucucugagauaagauucacaaaccuggaguugagggagaaauaaguggcacagcccaaggaaccauuuuauuccaaacacuuugcugaguuacugaaacccugcauuuccacuuuuccaccgacuguccuguccuauuccuacagcuggugugucagccagagcagggacaguuccauccauuccaacauuuaaugagagucugcccuauaaugaagccauacagaugaauaagacacugcucuagccuugaacaguucggucuaggauaaauaauaaugauacaauguaacauauuaggcuagaacauaauauguuauaaaugcugcaaaggacuacaucagauaauggggagcacagcuaaccaauggagaaaauaagaagagaaagggaggaucucaaggcagacaaggggaaauagauaagcaaagacuuugacagauaugaaaacucaguagcaaccuuuuuuuccgacguguauacagcuagaaccauuaugagucacuuuguaagucaggaauucccagcccaugucuccacuuccauaacucagcaaucuuucaguguucaugagggagagaaggggaaaaggguagugcuaggaauagacagggacaggguuggaaaguccacauuaaaucacaggcgaggacccugagccauucagacaaguuccucugggugaggaauucaaagguaagaaaaaauaucagaccaccaagagacccacagagaucaccuggucugaaucccuuccuccacauuccaagauagaaagaaaaauggaagagaaggcuuucaggaaaaaggaagaaaaagaggaaugcguugacgaggguaccaaaagcugauaagucaagcaauaaucacaggcugauccacagugagguacacgcaggguuuugcuucagguaacaccugaagccaaguuuugcuuaucacaugccuccccugccuccaguccccaaagccaaccuccaccccuaccccaugcaggucuuaccugaccaaugccaugccauagagcagucuaaguucaucagugcccaagccaccaguuacauccaagagcuuacagcguaucaggucagcaguagaagccacugccagagggaguucguugccugaccuaaagggucacaguccagcaccaucauaaagagcccuuacacugguccacccuccaccucagaaccuagguuguugcaggcuacacccaucauauucugguucaagagagcaugaacagacacaaaacaagaaggugggaggagacacgguaaugucugugggauccaacaguauacagggcaugaggagcugacuaggccguauacaggacaccuaacugguagacuguccaucaacaguuguguggacacaccccuuucuuucacccccaaaucaacucauugagcuagaggagccccuuaucccuuguaagucggcucccaacucaaucuuaccaacuggacugaggcgccccacucaaacacugucuugcaggcaagacuuccuccccauuggaaucggaaaucuacccuaggguacuaaucuacuccuuaagcccuggcucaggccucacuagucccuccggcauccucuccaaguugggagaaagucacuuuuuggagguaauggguaaaccucacagauauaacaagagaauuguugaggcacaaccccuuacuuuccauuccgcuaacgggauuagcgcaagagauggcugccgcguucccccaggcauuugggagagggacaacuuuaggcgacuuaggggaagacuggagaacagggccuuauagaaacucgacaaaggaagaggugcagcgccaccagcacgcaggcaaaagggccgaacccgccaccuuaccugcuccuccacaccgugaugcgguuaagcgcguaccgcugcaacuuauggucgucacagaacagauaaaccgucaccuggucccacucggcccugcugagccaggcgaccacgaugccgugggccgagaguggcaacgacccuuucccuuuaacgcacuuuccguaccacgcacuccacacgagauccauccccugggaaccuagaccuggcccggccccggauucccacgacauacugagcucaacaacaggcucugugccgcgccgcuccgcacagccuucagcucagcgugcuacccucacuccgaaccgccaccgcaccagcagccaauaggagagcgugacccca

SEQ ID NO: 19085 - RNA, 74328 nt, Homo sapiens
gucacugugaagucuuccuaaauuuuauuggcacugaaauagaacauggauugagcauaaaccccuccaaaaacaauuuuuaaaaaacccaaaaaguacacaaaaaaccccugaauacaaaaucuaaccuuuucccccagccucccuaaggguaaguuacugacuuuaaggcagcuauuaauagauugccccacaauuccagguuucaauuuagccaauauaggacauaucaccaagugagcuaauucacagcaaugcacacaagacuccucaaggucaggcacagaguggggggugguggccagggggaauugagggaggcucuaagcuaggggcacugcauggugggacaggauggccccuugaggacugaacccuggggagaagacaaacaguaauaauaaaaacaaauaacaaguacuuuaagaauggauuguaugaccuauagugacagaugacaucacuaauacugaaagcuucuuauauuaauaauuuuggcaaaaugucauuuuguaauauaguauaugcuuuccaggugugggggugguaaaguaaugaggccaaaaucauccugccccaagacuaauaucuucuaauggugcauuagcaaggaaggcagaaaucaauauuuagauaucaguagaguacauaauacuguagaaagaagaagagcacacaugagacagagaaggagguggaugcuccuggguugagagcaagggguggggguguggaagggacuaggccagaauccccagcagcucucugguuuacagcuccaagggacagaacagcuggugucaagaccuggguuagagguuugucaaacagaggcagggcccagucaccucuuuggaggggagugaugagaaggggauuuuggucaccugagaggguugaguaaacuuggaucagggcacaggcuucucucaccauacucagcuuuuugcacucacucccuaguugagccuacuggcaucaagcucuagaugccaaggcugggauggcuguggagcaggagcuauggcccaaguagcucugagaggggaagagaccuaaaaccccuagcagggaaaauacugacgcuaggugugaacauauccucucuuuucacaagaguccugauggggcuggcugagcuuuuggguacucaucccuacuguuauagcuggagaggauuuggguauugaagcagggaggggcagaucccacgaagugacugcagaucuggaauaauaaguaagggguagaucugcccauagagcucacuuuagaccggccuauacuccuacaaggaauugggguaggaucuucuacucagccuugccacaauagaauggccaaugcccuucuaguauguuuggugaaggucuugaaggcaccauuucccccauccacccuggggagaaauugagucccuaaagucaacgacaaggcuuauugaggcugaguuugcaacagauccgaucugggagguagaaacaaaaaugacugaacaucuuuuuaucccccaaucguuacaaagccuaaauaacucuaaacgggaugggagggcaaauuuuaggucaguugacauccuggagaagauauccuagguccugucucauucccuagaccgcauaacacuccaaccguguaaaucucaggacccugaagaagacagugguaggggagaggaggggagcuagcuuccaaccuacuccacacuugacucccauaggacaacaguaaguguaagggcauuugcaaaaucaaguggaaaguaccucuaggcuggagaaguaggauauucuagccauacagauucaauggaacagagaagagaaaggagguuccauuggcaccauagugagccauucauuugcccagggaagugggugggggcuaaggggcuagguuuggucccauggcuacauuaaaugcuuggcaugacuccagggcugcucuaguuaguggcuccagcacaguaugaguuaggugaguuagguguaggaguguggggacaaggaaaaagggaggaggggucccuagaggcugggugcccauuacauagacucaaauucgucaaugcgcugcuugguguugcccugccggaucuggcgcagggucuuguauuugucucggcccagucgcauguucucagcauggaucaugucauuggcagucuucuuggacucaucucuggcauuggccagcuccgaagugagggccugugaggauguaugggaacacagaggucaauggcuuucucucauuuuaccuccuguuauuugaccagacuucccuucucuucuguuuccuucuuucuuccucacccuuucucucuauauauaaauauugagagucauuuccaacucuguuagaacugcaguggggcaagaauauuaaaaaaaaauaaauaaacuuaggggaccaguugauaauggguauccuuuaagaguagaacaacauacaaaagauucaggugggaauuuugucagcuagauauuuucuuaauguaagaggugaauggagugagugggagguggggcagagagaaaaucucaaaaagggaagagauagcccaaggucugauuaauaagugagaggugccuauccuuaaagcugucacuuaagaacggcuugggcucccauacaacacugggacaggaucuuauaccuaucccccaugauggucuagggaaugccaugggcuacuaaaucaaugcauauaguuuccuugccccuuggcccuacuuguauaccuucaggugcuucugcacacgcucauucuucucugccucagugguacguuccuccucacugcgguccuuggccauagcaucagcccguaggucagcacuagccucugccccauucucauccugcucauccugcucauucucagcaggcucugccacaugagguguacucauggcagucuucagcucagcacgggucuucuccaagucuuccuguaccaucugggccuguccagugacagaaggagagaaagacugucagugagaccaguuaaacuguggcauccuguauaugccuagaacggucuggcaagaggcaggcaccagguaggacaaggcacuucaucugccugauccuuaguuucuucauccauaaaacaagagcaauuguaccaacuuccuagagguauuagagaacuccaguaaguauuugacgaaaccaugagugccuucucccaugcugccugcugugggaaguaugaaagagggagggagccaaaacauaaggaaucuaaggagcuguuaccuaugcauauggcacccauuccuucaaugcuuugcuuuaggcccugugucuuaccuucugcugccacuccacagccucacucuccuucuucugucgggccaucuccagcugggagauucgagcugucagcucugccauuuccaaggccuacggauaaauuggaagccugugagagcugggccuucugguccucaggacccaggugucuucaacccaaguccccugggggacuaguaagggaccuacugcuccacuugcuugcugccucagagacucuuuuaccagacuacuucauuccagucccaucuucccugaccaccacuuccuuuuaagucagagcucccccaccuagacuguaggccucuugaagacaaacaauaugccaucucugucccuuccucauuaucucucccccugccccucuuggcaaguaugcagcugggggccucaguaaagcuuuggccaucauugggucacuuccugaaguggcagauccuuuccugauauccuagaaugcucaggauucgacuaagagucuucccaggacaaguacaggaaagacacucaagugucacaaagcuaucugaacaaggaaaaaagcuuaugcacaccuuggguaaaucucccaugacagcuuccucaugagagacaggucuugguucccucuauucccaccuccaacaguacaaaggaagaguauaugucaaggaguuuggaccacagguucuuaacuucugagucacagaacccuuggaaacugugaugaaaguauggaugccaaaugccccaaaaaugcauagacacauaguuuugcaugugauuucagggagcaaagcuuucaaacagaggcagaaauggguggguucuaauccuuauuuagcuacaauugugugaucuuuggugaaucucuucccugagcucuaauuuccuuaucugggauauuaucucauaugagguuaaucccauaggguuacugggaagaagaaauaaguaaggaaaagggaaauauucccaacacagcaacauacagcaggagcucaaauaugagucccuuuuguucuuuucuccuucccuuuccuuugccaggucaaucagcucagauacccaagaguuaagaaagugaacagaaacuaaggguuagggaagacugcaaaaauuucugggccacacuagugacuucucagcuugcuucugaacuaguuauuugcuggaggcccauggagugguagccugcucuaaaaagccagcauguaagcaaaaguagcuauaaguaaguaggcagacaaggaagaaaguucaguucccauaaucccagcccacccuacagcuuuaccagcuguuccugagucuuuuucuggucccgggaggccugcagcaaggccuccuuggccucuucagcuucuugacgcuccuuggccagcuuuucagccucgcucugggcacgcuuccguuccugcucaaguuccagagcccuacgggucuguucuuccaguucugagcagaaaaggaggggagaaggcagugaagagcacagagauaaagacgacacaauagcuucguuccuggaaaugauccaccccaagacaaagcuggcagaaaguucugagcucucuucuugcccauucuucuucuagucuguagccacaccugaacuacauugucugagucuacagcucaggcagaagguucuccagcucagaguuaggccuggaaaaauccaaucuccaaggugacuccaagccucaccuugcugagccuucuuagucuguuccucgaucugcuucagccucuccaucagcuccuccuucucccguucaaucuucucuuucuccuucucugccauuucacgcuucuucuucucauuuuccagcauagcacuagggaaggagauaaaauggauagaacaggauaacaacgcuccacaaaagccuggggaggccaggcgcgguggcucacaccuguaaucccagcacuuugggaggccgaggugggcagaucacgaggucaggagaucgagaccauccuggcuaacacagugaaaccccgucucuacuaaaaauacaaaaaaaauuggcugggcauaguggcaugcgccuguaguccuagcuacucaggaggcugaggcaggagaauugcuugaagacaggaggcggagguugcagugagcugagauugcgccacugcacuccagcgugggcaaaagagcaagacuccaucuaaaaaaaaaaaaaaaagccuggggaauuccaaggcuugcugccucugggucucucaacccaaccuucccaacacacuuagggauugugaguuugggccacccucccuuaccucuauacccuuguccucauaucauagccccacauaggccaguguacacggggcccugucaauguaccccugagucaggaauccuagcucucccaccaacccacugggugaccuuagcuaugucacugcuuugcucuuguuccccuaucuugaaaaugguccaauaagaccugcccuauccaccuuguuagggagacaaguuuuggcucugugcugggaugaagugcuucaagucuaguaaucucuacggcuagugcaucaguccucaggucuaacacugccugcccuaaagcccagcucuaggcuucuuuuucccagagucuguuacaaaucuggaauaaguauuugcuuuugcuuuuucuugcccuagcaccucuuccaggaaccuucuuaucucccuuggcuagguauucuccaucugggcccucagaauacuuggcuuacccuucuccccaucccucuucuauguuuuugucuccauagcacuucuuaaccaucuuauguaccacauaauuugcuuauuuauuauguucgucuccuccccacuagaaugcuagcuucacaaaagcagagauuuuuggucuuuucuuauucauugcucaauaaauauuuauuaagugaaugaaugacauggccuuuguaccuugaguuauguauauauuguuuucccucucucugcuacuagacugaguagacugugagguccuacagggcaguuuccugcuagauccagcucuguaaaaacugccccucaaacuugguagauuuuuucugaauaaaugugaauauuggugucuaaccucucaucuaugaaguccuagguuggccucauguccugacuuagcaugcagggcaccuuugagaagcuuccuugccccagcccuggccccccacaucagugugcagcaccuaccgcuccaucugcuucuggugcuucuccucccgggccugugccuucaucugcugcaccucaaugguaucaggcuugcgacggcgcauguauaguucaugguuccccaugcacaaggccaagauccgcuuguuaauccgcagccggggagcauagaagacgaaguccuggugggaaaucagcaaucagaaagaauuuggagggacaggugaaggugaucuucugccuucugaaaagcuaaauccaaaagcacuggaaagaauauuuaaucugaccuccugcacuacagaugggaagacuaauuaucagagugguaaagugacuugcccaggguuagacaguagacagacccaagacuagaaacccagguuucuugacucugaaacccauguucuucccauaauuucuuucaaucuuugcuuaugaaaccacaauuucuuucaaucuuugcuugugaaagcauccuaaauuacucuuaaucaaguugaaggauucaaacuuucucugcuaauuagggaacaugcuaggucucaggugaccucuuuuggaagccaaaugaccccugaauaauacccuggugggugcaguauggguggcuggacuguuucuacaaucuccuaaaagcaaauccuagacccagccccuuaaauccuuuuuggaacaaggcaggcuguaaauacauacaugaauacauaaaucuccugaucacugcuuguccugguuguuguuuuuaaaaugagcccuugaucucagcuggcuuuguuacuuaacuuuuucugauaauaguugagcacagcagcaauaaaagaaaacacacaagaaaauccagugaguuugaguuuguuacuacaaauaccacuggaccgaagucaccagcugaugggcaccaccaucuccucugccacugaccacacacugcuacugucucauauagcuuggggugcagguauaaaucccagcucuaccauuuuuagcugugugaucuugggcaaaucacuccaucucucuaaccucaguuuugucagccauaaaauuaguaugcuacuuaguaccuaccugaccauguugcugaggguuuaaggagacaacauguguaaagucccuagcaggggaaguucaggcaccucauggcuggagaagaaucacugagccuucaugaaaagggucaggcucagcauugucacugggccuuguuggacaugcaguaucccagaaaaggggacacucagcucaguuuccuaaccuacccacaaucaccagcugucuggucuugucagcugcaggcuacugaguggguaagaagcauggcgaguguguuagagaaaugaaugaacuuaaagcacuuuuuuggucuuggauugcucuggagaaaagucugagagggcagcaguaaaguucuaccaagaagucuguaggaucaucuucagauuuggacuuuggccacagcccuuucuccacaauaaaaaaaaaagaagucaagggcugggcaugguggcucacgccuauaaucccagcacuuugggaggccaaggcaggcaaaucaccugaggucaggaguucaagaccagcccggccaacauguugaagcccugucucuacuaaaacuacaaaaauuagccaggcaugguggcaugcgccuguaaucccagcuacucgggaggcugagguuguagugagccaagauugcaccacugcacuccagccugggcaacagagcgagacuccaucaaaaaaaagaaagagagagagagagagaggaaggaaggaaggaaucaaauaugugaacaguguccacuuucugggacccaggggcuuggaaauaugagaugcauucgguuuccaccccagaaccucagggcagcagaggcaauggcuaagaagcaguucuuaacacugccuguggcucucccacauccacagugagagagacagguagcagaguagaaccagguacaggaugucugcuggccauuucuuggcaucaacaucccccuccauucccaaucucuauuugugcuuccuguucgugcacaugcgcgcacacacguacacacaaacacaucagaaaaggaagagaaaaauagaauagcaugauugcucauuaugcaggccuuggcaaguaccugucuuggucagagggaggaaucacucaccggggcuuuuuugucaaugggcuugaugacaaauuucuuaucauugaaagagauguuccugauuucacuccaggggaagccuaucuugggaguuagucuguagaaauagaaaccaauaacaucaggacaagggcaagacaagaaggguguagagaacugggggcuugcccucacugucaccuccaagcuucuaugucucucucucucuuuuuuuuuuuuuaaaauaaauagagacgaggucucacuauguuacccagguuggucuugaacucuugggcuugagcaaucuucccuccucagccucccaaagugcugggauuacaggcgugagccacugagccuggccaaacaaacacuucucucuggaggagguagacucagugacagcucagccagugucaucacacgccaccaggucagcugccagcauugagaguucacuaaagaucuccugauaguacaacuaacauaugauuccuugucucaaguuuguuuuguuauguauuuguuugaggcauggaacuuguaacaguuccucaagggaauccccagcccuauuuaacugagucucuucuauccaagcuuacaaaaguuugagagaaaguaaauaaugaacuccaagauucaggaguuauauggaacaauaauuuauugcucuccauccucaccaagagcacaccaagugaaaaauauaagcaagugggauaaggcuacagugagaggauuauaggccaaaagccacuuaaccaucacaggagacuaauuacaaaugcugauaagauagucuaggccugcacgauccaauaaaaacauaaugacugucacauauauaauuuuaaguuuucuaguagccacaugaaaauaaguaaaaagaaauggauguaauaaaauuauaguaaguuuaguuaacccaauauaucuaaaauauuaucauuuaaacauguaaauaaauauuuuuuaaaauauuaagacauuuuacguucuguuuuucacacuaagucuucaaaguccaguguguaguuuacacuuacagcagcacaucucaauucaaaguagccacauuucaaguguucaauagccccauguggcugguggcuaccauaguugacagugugagucuagucaauacaggauuuaguauugacuaagggaaguugugaaaucaucugggcuggacuaaauuagguagaaaaagaacugagaugggacccaagagauauggcccugcuccuuggugaaaagugagcccuagauguuaacgugaccuaaauaaacuaaaagagaucugagauauaccugucauucugcucauagauguugagacccagggcauccacccccagccacagcucugagccuuucuuguucuugaugcugaaguaguucacaccauacaucuccagaucuugagcaaucuucagauauuccaggacagcauccucccuaaaugacacagaguugggggucacaaaguggggcuugugagucagacccaaggagauagaaagccugcuuacucuguacuucugacaaggaucuugcuaucaggagugggaaaggggacaaaaggcaagcagaugauggagaacagagcacagcaugacuuuugcaaagcaaaaucuccuaacaaaaaccuagggucuaagcucccaaggggaauaaagaugggcugacccuugcuggccucuggcauguuggcugccauagaagcaauuuucuuucucucauucauugugacagccucuuauaaaggcacauucuuagcagggcucagaauguggugauggcaaaaugaugauauuuguccuucaacuacacaacccucaaaaaugcuuugccauguguaagagcucccuccauuucuugauagucaaaacuguuugggcuaccaguuaccagcauucagcaaaacaaacaaacaagcaaacaaaaaacagccuuauaaugguccuaguuugccuucuaucgucccuguucccucuuucuccaacauccaccaaugucccuugucaucagucucuucucccuagaacgcauucucauucacccuguaagggaaguggggcccaccacugcuugggcaagcuuaccugagcaugccacgguguuccucaugccacaccuggauccgcuccucccacugguccuuguugaguuugugcuguuccaggacucuggaaagacaaugggugaugaguaguuuaaagcacaaagucccugugcaggagagaagggaagcccauuuagcuuucuaaggggcugaugcaaagaggauguagagucagccaauugaggucacacuggaagcagaccgaaauuauagcaagaagguguuaaacuagacacaaggaauugccugaaagguaagagagcuacaagaauggaugaucaaaaacaacaaggggaacaccuuccuuuguaccuucauccacaaaucaaaugaugugcuguggucccuaagcauagcaguaaugugucaggaguuugugcugacuuuaggggcuaacaguagggauggaccucauggagucagguacacucucuccuagauccucuuaggaccaacacucuauguuuauaagaauacugcucagaaaugaaaggauggccuuuggcuacagagcaaugaacugaguccuaauggcuuucagaaaaaccaacaggcccaaccuccaagaccuacuagauuauaaacaagguuugcuuuaaacaugccaucucagauaucauggcaaugacucagguagaguccccaggguacaagcacuaucccuaauaucuuauggguguguuguacauauaugccauaacuccaaugggacugaggcucccagaaugaagcaaagcuuuuccuucuaauccaaaagacuauggaaauggccauuggguauaguaggaaaaaacuuaguguuaaaauauuaaggugcuaagcuuccaggucuggcucuggcucugccucagaugagcugcaccagauggggaaagucagugugaguaccucugcaccucuauuuccuucgccaggaaauaaggauauugccugcuuuguucauuuuguguguuauugugauacaaaaacaaaaauaaugaguguuuuagagcuuuugacuuugaaguuuacaaaaggggaaagcucuguacacuagcugucaauauuaaaagacuauuugagcuccccauguccucgguuugcuuauuucucucucuccccugugaacuucugauauaagagaucuaaaucaguaaaaagaacugagaaaauggaaccagggaugggugaaagaaauuacucaaucucugguucuauauaagcaccugccuccaggguaauaaaguucuguaaccagguagacagagggaaaacaaaaaggcuuuuuauuuggaaagccagaaaaacaacaacagagucugacacuauaugcaaaugucucuugagcagcauaacacagucuucagacagaccccaauggagaagaacagaucuggcaucccugugaggcagggauuggucagcugugggcugcagccccuuauggccaaggcaaaggagggcagggaaccaccucaccucugcgggagcaacuugucuccggccagguagccagacuuaugcacuuccuuauugaagucgccauacuuagacuggacagcauacgaggccagcagcacagcggucucaggcgggcaguaaauaucaucauugagaaugcccucuuucacuugcagaaagaacaggcgcugagugauguccugaaucaauuccucggacacauccucaggguagaacuuggcacggaacuuaaagagcagggggcuuuccuuccgcacauccugggcagucaccugggaagaguaaggguuauggacucucaaaaaauagguuuuaaggguaauggaguggcuguaggguggggagaaaacacugaaagaucaucaauuugcauaaucuuagacagcuggguggcaacuccccugguaauuaagaaaaauaauacauuacuuucacuggggacugaaucccaugucuguaaucacuuucuguugggaauuucuuccugaaauuaccuuaauaccgacugaugaucagaaaucuucaaaccacuuuuaucugacuauauccaacuauccccaaauucugauaguaggcauaagcucuucuuuuaagcucgucuuauaagucuccuccaacuucauaaauuagcaaaguaaggacuaggauauaugucugaggacugagaacuggcuaaacaagagcacaaauuagaccauuuuuuaaagccugaaauggaauacuaguggcuccacacuuguccagcaaaagacucaacucuuuaggaaaacaagacucuaccagcagaaggugggguaccuacucccuagacacaaucagagaagcaaacugcaggacaguauggagacuucuaaggacaaggccagccaguuugaggauacgaagauggaaggcugccagguucccgugaagaugcugcuugggguggagagcuugcauggacucaaaccaucccauuugggguccaacugagguaaaagaucaagaaagagggaaacaucuauaugggguucagacauuaguugacugcuggagaaggugcagcauaagacuguaagaucuuucagauuuuuuuuuuucuaguucaagaaucuguggcucuuuuuaacaaauccccagccaagcucaguagcucaugccuguaaucccagcacuuugggaggccgaggcgggcggaucacaaggucaggagaucgagaccauccuggcuaaaacggugaaaccccgucucuacuaaaaauacaaaaaauuagccgggcgugguggcaggcaccuguaaucccagcuacucgagaggcugaagcaggagaauggcgugaacccaggaggcggagcuugcagugagccgagauggcaccacugcacuccagccugggcgagagugcgagacuccgucaaaaacaaaacaaaacaaaaacaaacaaacaaaaaaaacacaaauccccuaaagccauugaguuuggagagaugaaggggauaccaauccucucuugaaaagccacuaauggauuugauccaaaacaagucaaaguucaagcuaguguucccauuagaaagaaaagagucucuucuucuuugaaugcuggccauugucgcuguuagaagucaaaguagagacagagcaagagcuuugccuugcuuguguccucgguccuuauucugauccaaguggucaacagaccacccagucacaaacacagcccuagguauccaggauuugccaacuagcacaugguacccucccaggaauguucuggaaaagaaaagaauucuaaauccaacagaggaauaagcaguuaccuucuuauugaguuucagccagguggagaaaccuuuaguguccugguacugcagaccaaagaaccaaacuucccucaagccaauaguuuucaccaccuagaagagaaaaccaaaacaaccaaccauugauugaauacuuccucugugugaggcacagaggacacaaaguuugaagucaauauuauaucugcccuuaaaggguuuaaggugcucagcaucuggcaagaaaauauacuugagcagcaaucaagaacugaugucggcaucucucugcacaaaguacugcugaggcaggaaagggaucuauuacuuaugagcacugacacauaccaagaaccuuacauccaucaucuccuuuaauuuucauaauaccccuaugcuagacuuacaauuaggcccauuuuauagauaucaaaaaugagguucaaauaaaugaaauaacuugcccaaguuucagguugugagugacagaauuaggguucaaaccaggucuguuugacuccaaauccaugcauauccagugauuucugccaccuccuccuucccucuacaaugucacaccacuucccacuuccaugauggauuaaaggcugaagguggagauuguuggauuaacuccuguaucuuguucucuugggccacucccauauauuguccuucauccuuagcaacuggggguaauacccacacccuuaagacugaguuccauuuacaauaccccaaauaaagaauguuugagaagauaaaacggggauugugaaggacucugaagccaugcugugccuggguucugagaggauuuuuuccaacccugaucagagccaagucaugauuccucuuacacagguuuaggguggaaaugaggguagaaauaggguaaguaccucaguguagcagcugaggugcccccuguuguccugagccuccuggcugaacagugggcaggaaaaggaggcuugccaagagaacacagaugagcucuguucucuagucccugacauuagcauguuaauagucuggcccucagcucaaccccagcauacccaccacugucgauggcagcagugaagcugagccacauccuaaugaggucaggcuggccuuaggcagucuuuuuuauuuuguuuuuugggagaaggaugcaaguggaggguaaggguaaggugagaaagaaucauagaaauauaccuggagauggaagcagggaacaaggacccaguuuugcugauguccuucccuuaugaacaaauuaauaucucccuucaaaauacacacacacacaugcacacacacacucacucacaaagacacacauacacacacuaacacuguauccacaaaguuucuauuaugcauccaaagucaggccccacagucacacccagaguuuacaaucuagagcuucagagaccccaaagaaaaaaguagcucauauuuauuaagcaccaaucaugugucaggcgcugaacaguaaacaacccugugagauagcaauuauacccauauuauagaugaggaacuaaggcuuagagagguaaugcaucuaaaauuacagagccauauagaaccaugaugugucugacuauagagcuuguaccuuuucuucucuagcaugcuauguccuaaugccaaguacucauaugagcuuacgacuccugagcuucucaagugauuaauugccuugucucuccuuuggcccaaauuucccauccagguaauaaacuuugaucacuucugcaucgagauaugcuuccuggcauucccacuagacccaagcgacaaccacuuuggggagaagccaugucccccaagucaucgaccuucauugcucaccaggucacccuuccccuucauagcuuggaucaaguaucaggaaaccugagcaaaauguucaugucugucuccaacuagcuguaugauaucaagguagcauauuuccucucugggccucgccuuccuuaucuauccaaauuggggaguauggcuucaaugaucucuuuuuucucuuaaguucuaucauuguacuaauuacauuacaagguuauuuugcaaaugguuaauaaaaacaaucccauuucccagcuaccucuugcugauguggauaauuagaaacauguuuagaaaagaucagugggggugggagguaaugaggaaaguucaaaaggcuuccagaauucaauggccaguugauucccugacucuaagucaauaggcagcuggaacugccagaaaguuucagauggagaaaugugaaugcuuauguugaaauguaauauuggcuuuuugcagaggaugaagguagugggugggcgugaacagaaaagauuuuuuuaaagcaccuuguauaucauccuagaucuaaacagggcccaaggcccaauuaacaguucuaaucauuuuccacaggguugcagaagaauaguguguccagaugcaauuggugggaaaaggcaagauccaagaaacaauccagcugagagagagagaaaaaaaaagagagagagagagaagacccacugaagaugcugaagagaagaagauggaccaugagggccaggauauuaggucauggggggagaacagacuuggaacagaaguaguagagcagugcuaugguuuggaugugguuuguccccaccaaaacucauguugaugcuucauugccgguguggcagugcugggagguagaaucauuaagagguaguauguaaugagagguguuucagucauggggaccccugucccugugaauuacuugaccuuuugucacauuaugaaacagcacaaaggcccucaccagaggcugagcaggugcuggugccaugcucuuggacuuuacagccacuacaauuaggagacaaauaagccucuuuucuguauaaaguaacuagcuccagguauuuuauuauaagaacauaaaaugggcugggcguguuggcucacgcuuauaaucccagcacuuugggaggcugagaugggcagaucaugaggucaggagaucgagaccauccugacuaacauggugaaaccuggucucuacuaaaaauacaaaaaaauuagccgggcaugguggugcgugccuauagucccagcuacucgggaggcugaggcagaagaauagcuugaaccugggagguggaggaugcagugagcugagauugcaccacugcacuccaguaugggugacagaacaagacacugucaaaaacaaacaaacaaacaaacaaacaaaaacaaaacaaaacaaacauaaaauggacucagacaagcagcaacuggucuuugccuguacuaacagacuaauuguagaggcuaagagacuccaagacugaaaggaagugagguaggcacagacuaugcagccagucccagaaaucccaggagugagaccguuagccucuuuuugcaccacguugucuguuucacuauugggugggaguaggggugugauaagagaaggaggauuagccaggugugguggcucaugccuauaaugccagcacuuugggaggccaagacagguggaucaccugaggucaggaguucaagaccagccugaccaacauggugaaaccccgucucuacuaaaaauagaaaauuagcugggugugguggcacaugccuguaaucccagcuacuugggagacugaggcaggagaaucgcuugaacccaggaagcagagguugcagugagccgagaucgcgccauugcacuccagccugggcaacaagagugaaacucugucucaaaaaaaaaaaaaagagagagagagagagaaggaucauggugacuaaaguaguucugagauccagaguaacucaggagaaguugggcaaaguaauaccuaaagugaugucaaaaaaaaaaaaagagagaauucaggcucagugcuggggggagggagggugaucucucugagcacugucucuuccuuugugaacauaaagaaaucagaaacauaaauguuccacuuccuuaggcucuagggcuuaaagagaugaguaauaucucucagccugcacugaagucucaaagugagaaauugaggacguggcgggaaggaaauauggucugaaaucagaauugaaacugaaaaagaacaaagaacaaaaauggaugacuccugaccccaggcuacaaggaaaucucuaaggcccaugggggugcugugaaccauuuuaucaggcaacucuaaaccccuuuuccaagccaaguuuuucuugcuuccagcuuugcuuccaguugagaccuccauuccagaggaaagagaaaccuuauuuucaagugagagcuuagcaucuagcuuccaguuccaggaauaaccucuguggcuccagugacuaggguccuuaucauuccacucugagaaaugguccuaucccugaggaaaaagaaaauucuuuauuggcucccuuugacccgacagccagcuuaucggaucugagccaguauuucucaaagcucccauggaaaaaauccuuaagcagcagaaaauaaugaaugcauauacccaagggacauagggggugugguaggaugggguagggggagauaauagguagauggcuguaacccagcuauaauuucuuugaagccucagguuuaauuauuugugcaaauuuuauauucuacuccauaaauaaugaauuuuuaaaauuauugcaaguaaaauuaaugcucuagaauacuaaaccacauucaucucacagcuuuguaucccuccuggaaccugccccauacaccuaaagaaaguaggacuucaguuuuuaagacacuagcuuaagaaacuggagguuguguauucuacucagcuccaugacuguggagaguuacaggguucaagcaacauaaaauggaaaacugaggugcagugaaaagaaaagaucugccuuggaguacauccucguuaauuaucaggagcuucuggaagcaagaaaaaaaaacccuuuaccuccuuuugacauguggaggcaaccuacaucugaggucuguagaggggagcggagaucaggucagcuuaggagcccagagauucucuucuugaaucccccaugcauuuaucugaguaaacaaacuagugaugucaucagccacuucaaaagcccagaaauucucuucuugaaucccccaugcauuuaucugaguaaacaaacuagugaugucaucagccacuucaaaagcccagagcauggccgggcgcaguggcucauccuguaaucccagcauuuugggaggcuggggcggggcagaucuuuugagcucaggaguucgagaccagcccaggcaacauggugagaccccaucucuacuaaaaauacaaaaagauagcuggugugggcaccuguggucccagcuacuuggaaggcugaagugggaggaucacuugagacuguggggugcgaagguugcagugagaucacaccacugcacuccagccugggugacggagcgagaccuugucuccaaacacacacacacacacacacacacacacacacacacacgagcgugcacgccuagaggagaaugagggaguaaugcuggagccacaagagaagaacugugugagaaacaaugugcaaaacugcaucaaugcccaaacaccugagacccccaagauaccauuacagauuuggcagcaucugcaucagccacccaccugaaagcaaauuauugcaccacuggaaagcaccaagaugggcuaccacuauugcuguuucuguuauuacacauugccuguggucaaguggucaccugcucuauaacagagaacauacucagcugagguucuaaguuucuuucuuuuaucguuuuuuguuuguuuguuuagagauagggucuugcuguuaaccaagcuggagugcaguggugcaaucauagcucacuguaaccuugaacuccuggacucaagugauucuccagccccagccacccaaguagcuaggacuacaggcaugcaccaccaugcccagcuaauuuuuaaguuuuuguagagauggggucucgcuauguugcccaggcuggucugaagcuccuagccucaagugauccucucaccuuggacucccaaagcacuaggauuacaggcaugagccaccaugcccaaccuagcuaggguucuaaguuuuggaagcagguaaaguggaagaagguuccagaggacaguugaucaaaagcauuagaaaaacuggaaaugcuaugugcccugguuuaagccccagcuauaccacuuccuagcuauaugaccuuaaacagauaauuucaccucuguaagccucaguuccucaucuguaagauggagauccuccuacuauaauauauguuaguuauuuuauaaaaugaaaaaaaaaaagguuuacuguccuuauugcagaguauucaaguccuaaguacuuuacugagccagaagaacuuccugauuucauagcucccucaucugaacucucagggcaaugccaccuacuuuaguccuuaauaagaaccaccaauauuagaaugcuugguaugcaccaggcauuuuacuuauuugaggauuaaaucacaaaaucugagauuagcaugauuaucauuuuacaaaggaaaggaaaguacugagaggcuaaaugagccauccaaggucacacagcgaaguaacaggacagaauuugaacucagggcugguucuaaauccuaugcuuuauauaucaccccauggaaccugaccucaagggcguuuauuucuuucuuuguggguagagaguugcaugugccuuucuaugcuuuuauagguaaggaacuccaaguuccugaagaacagagaugguguucgacaguguagaccuucagucaauauuaaaugaaucaguaaauagaugaaugaaucgaugcuuugagauuucaccucuguccuugagcacagcccuuuaguggcaccuagguaauccaagaucaaaagcuuuagaaguugaagcaagugacaaaaucacuauagcaaaacauguucucucuccccucuagcuguagcacacucacaagaagagagguaaaugagacaaacuaugaguccuacuucccuuucccaccaggcccuagacuuccucaagcuauggcaucccauuguugccuauuauuuauugcuggugccaaggaguacuuccucucugguuggcuuccucucuggucauuggccagaugacugcugcguuccaggauggccauaaagcuuuugccaauuccugccaaggagucuagcuccuuccucccaggcccaggcucuaccaggagggccuccuugaaugaugggucccaagagccagacagaacggacuuccucccuuaugccucaucaaguuagagagagaagagcucacaucccccaaaugccuaugaacacauaacucuacugauuccugaccugaccugccuuggccucaagagggccaaaugcucaauuccuugaguucaaaucuuuuucccuguauuuucucaccugugggguccaccucugucccucugacucacagaaugugacugccccccuccuucuuaugauaguccuucagaggucugaagacagaaagcauaucuuccuugagucuucucuaaguugaauacucccaaucaccccaaacagaguagugcagugcaggaaaaguauaguuuugugaucagaguuguauucaaaauuccauaucacaacuuacuaacuacaugaccuagaguauguucuuucaccucacagaggcaggagcauugugaggauuaaagcgccuagccaggaauaggccauaguaugugcucaauaaaugauacuucucaagauaacaaugaugagaagucauggacuucuugguuuccaagucucccaaaggcuuuguuuuggaagcaguagcauucagaacuagcauaccaaucugcccaggguucccuacuaucugggguucccuacuaucuggacuucccucaaauccacacccacagcacacaaaccaaaccaacacuaacaaaaaacuaccaggcauugagguuuuuugaaguuaauaaaccucuuuguucaagaauuuuucugcccccacuaggcuccaaaucaugccuuccucauccuccacagccaucccccugcaaugcacauauacaaagcccccaguguugaggguagaggauggcgucaucugguuugggauggggaauuaguagaaucagggcucuuggaaggaguauagguaaaugucaaaggagccucuggcucccagcuggucuguaaaaucugcacugacuaaccgcuucccucucuaauagcugcuacccagaaugauacugcugucuaaagcaaagggcccaaaagccuauguguucuauggacacuuccucccuuuugucuuagagacaguaaaaagccugucaaggaagagaugaucccccugccagcuagcccuaccuccucacauaugccagcagcugaucauacucaggugaggcauuucucuccuuuuuacagaaaaggauugucugaaaucccaauacuaggaacagaaaugggagagaaagagagauggaaugcacaaauaaaugccagagauaaauuuucugagagauaaccagauuugagaaacaaguuaggcauuguacagaugagaaacugaggcccaaauaagggaaacguuuguaucacagcgaauuagugauagagccaacccuacagcccaagauucaugacuuucuauccaggcccuuuugacuucacuaggcugucccuuuaaaaguucuccaauauaaccuccaugugaagagagaaugcaaagcacaauuauaauuagaaugcauuuagucauuccagacuagcaccauaaucacuugugagcuaugugaauguaagcacaucacuuuaauuguaguaaacuuguauuuaaauauuccucagacuaauuuguauuuucaccaauuaaguaucaaugauuacacuuugccauucaaaguaaaacaaacacaaaacaaacuccagagaaguaaguuccaccuaaaucugaaguuagauauucugaggaucauuaagcccaucucccaauucucccaauucuagauuauuuuucuuuacuuuuuuuuuuuuuuuuuagagacagagucuugcucugucaccuaggcuggaguacaguggcgugaucauagcucacuguaaccuugaacuccugggcuugagcaacccuccuggcacaaucuccugaguagcugggacuauaggugugcaccaccaugccaugcuaauuuuuaaauuuuuuguagagacagggucucgcuguguuacccaggcuggucucgagccccugggcucaagcaauccucccaucucaguguuaggauuacagacaugagccaccacaucacgucaacuccagcucaauuaauaauacaagaagcacaaugguauuggaaagggagcuaucauuuauuacuucucuaccauaugcuggaugcuuucuuccagcuaacacuuucuuuccuauuuguguuuucuuaucuuucucaccuauuucgaauuuaucuuuuuggauuggacauccuuauaugccacuauaaucagauuuuugaguaacagguaagauacaaaacauaacacacucacaaaaauccugugagguaaguauuagauauuucucggggggaggggaugaagauaccaacccagagaguucaauaauuuucccagggucuaacuaggaaaaugaggauuuuguguccucaucuguaaaacaugcccauacuaauucaugcacucacagagcuuugugauagucaaaugcuuaucauaauacuuagcauacacugaguccuggauaaauguuaacucucaucuguauuagccacagacaauaauuuucccacucuauguaauaagaacucagaagguguacccaagcuguccucaaauuucuagcccucuccuaccccugucuccauucuacucuugucuuuucucucaccagucagaaguauucacaggaauagaauuagcuuauuugaacacuaccuccuucuuuuuuucuuccucucuccaacccuggggaaguucucauaugguagaaggacacagagagcaaggaagaaagggaagcaagagggccuggagaauccaucagggugauaugcagccuaacauccuggacaauaacucagaccuccacuucaucggagucugguggagaaauaggauaauggccugucuggugaggucccagccucuggaaaugggagccucauuuuugcuccuagaagucuggccacagacggcacauucccuugaaugcuaaaaaugucuguagcugccaucuguuuauuauaguauacaguacauccuuucugacaauaaugauucacaaugaagggacaccccuuggguuggagaugggaaugaccucuucacuauggcgaguaagcaauuaucuucauggcaugccuguaggagaugaagcagccuccuacugcauccaucaacucccauguuguccuaagucccaacauucuuuugagagaaaugugcauagagcuuacuaccucagggagaguaaguuaguuuccuucuacuaggaagcaaaaacaugggacagaggcaguguggugcaguggcaacaauguggagugcaaaucccagccaaauaucauuugggugcaauuaaguuauuuaacuucugagccucaucauuaaaauggagaagacaucacuuacauguuucagaguuaaaaggaaggcuccauaugcuaagauuuuuaaagcaucuagcauagaauauacaccauuuucuuuucucccuuauucaggaccaaagauaaaauuaaucaggaccauagggugcaggcugccaaaguuuaacuuugccuccuuucauauuaagucuggaaucagccuucauuuugaucuaucuuggagugaacaggaagagagauucuuugacaagaggcaaaagucauggauuguuggcauugugguggaagcuauucagagaaggagaggaggcuaaggagucuccgccuuaccuggucaaauagcugcuucccggugguguugggcuggauggcaaacuccagcucugcauccaugguggucacacgcacacugaucuaggaugagaucaaaggaagcagguuagucaucuggcucuguguucaacagagccugagacaagugucucugcucaaccacagaggaaggaguuaggaugcuaagagccugggcaacuuagauacugauggggaugaagggagaauauugacccaaacacaaccccugcucccaagcagcuuauugaagacaaacaacacagccacagagcaauacuuaccaaagaacagacaagcaugaaggccgggugcaaugccucaugccuguaaucccagcacuuugggaggccgagguggguggauugcuugaggccaggaguucgagaccagccuggguaacauggcaaaaccccaucucuacuaaaaauacaaaaauuauccgggcaugguggugcacaccuguaguucaagcuacuugggaggcugggguaugagaaucacuggaacccagaagguagagguugcagugagccgagaucacaccacugcacuccaaccugggcaacagagcgagacuuugucucaaaaaaauuuuuaaaaaagaaugcagaucagccuacaacuaagagcaggcaaaugauaacuguacuucuuccaggaaggccuuuccaucuauacuagacagcuucaucucacaggguucucuucucaccucugaucuaccuggauuaucuauagcacugguaaacaauugcagaggcaaauuaauaucaggacaaagagcacuggguuccacaugauaaucuaaagggcagaaaaagcuuucaauaaaaucuaacaccccuucauguuaaaaguucucaauaaacuagguauugaaggagcauaccucaaaauaauaagagccaucugauaaagccacaaccaacaucauacugaaugcgccaaagcuggaagcauucccuuuuaaaaccgacacaagacaagaaugcccucucucaccacucauauucaacauaguauuagaaguccuggccagagcaaucagaccagagaaagaaauagagggcaaccaagcaagaggagaggaagucaaacuauccuuguuugcagaugacaugauccuauaucuagaaaauccaauagucucggcccaaaagcuccuuaaucugauaaauaacuucagcaaagucucaguguacaaaaaucaacauacaaaagucacuagcauucguauacaccaacaacagucaagccaagagccaaaucaggaaggcaaucccauucagaacugccacaaaagaauaaauaucuaggaauacuguuaacuagggaagcgaaagaucucuacaagaagaacuacaaaucacugcucaaagaaaucagauaugacacaaacaaauggagaaacaguccaugcucaugaauaggaagaaucaauauuguuaaaauggugauacugcccaaagcaauucauagaauagacucaaugcuauuccuaucaaacuaccaaugacauucuucacagaacuaggaaaaacuauuuuaaaauucauauggaaacaaaaaaacagccugaauaaccauggcaauccuaagcaaaaagaacaaagcuggaggcaucaugcuacccaacuucaaaugauacuagagggcuccaguaaccaaaacagcauuguacugguacaaaaacagacacagagaccaauggagcagaauagagagcccagaaauaaggccacacaccuacaaccaucugaucuuugacaaagucgacaaaaacaagcaauggaaaaaggacucccaauucaauaaacagugcugggauaacugguuagccauauguagaagauugaaacuggaccccauccuuaucucacauauaaaaaucaacucuauauguauuaaagacuuaaauguaaaaguaauguaaaacucaaaauuauaaaaacccucaaagaaaaccuacguaauaccauucugaacauaggaauggacaaagauuucauaacaaagacgccaaaagcaauugcaacaaaagcaaaaauugacaaaugagaucuaacuaaacuaaagagcuucugcacagcaaaagaaacuaucgaguuaacaggcaaccuacggaaccagagaaaauauuugcaaacuaugcaacuuacaaaggucuaauauccagcaucuauaaggaacuuuaacaaauuuacaagaaaaaaaacaaccccauuaaaaugugagcaaaggauaugaagagacacuuuucaaaagaagacauacauguggccaagaagcauauauaaaaaauuuacaucauuagagaaaugcaaaucaaaaccacaaugagauaccaucucacacaagucagaauagcuauuauuaaaaaaucaaaaaaaaauaauaacagaugcuagugagauugcaaagaaaagggaaccuuuauacacuguuggugggaguguaaauuaguucaaccaugguagaaaacaguguggcaauuucucaaagaccugaaaacaaaacuaccauucaacccagcaauaucauuaugggguauauauccaaaggaauauaaaucauucuaucauaaaaauacauaaacgcgcaugugcauugaagcacuauucacaauagcaaugacauggaaucaaccuaaaugccagucaaugguagacuggauaaagaaaauguauguuaguaugcagccauaaaaaacaacaagaucauguccuuugcaggaacaugaauggaguggaggucauuauccuuagcaaacuaaugcaggaacagaaaaucaaaugccagacugggcaugguagcucacaccuguaaucccagcacuuugggaggccaagauggacgcaucccuugaggccaggaguucaagaccagccuggacaauauagcgaaaccccaucucuacuaaaaacacaaaaauuagccaggcaagguggugcacaccuguaaucccagcuacuuugguggcugaggcacgagaaucgcuuuaacccgggaggcagagguuguagaauaccacauguucucacuuauaagugggaauuaaaugaugagaacacacagacacauagaagguggagggugggaggagggagaugaucaggaaaaaauauuuuaauaacuaauggguacuaggcuuaauaccugggugauaaaaugaucuguacaaugaacccccaugacaugaguuuaccuuaugacaaaccugcacauguaccccugaacuuaaaauaaaaauuaaaaacaaagaagaacacuggauuccaagccuagcauguagcuggucaaaucuacaaccuuggauaacuccuguccuuuuccugggccuuaguuucccuuaccugugcaaaggcaggaaugggauggagggcagccaauuaaacuagauaaaugguccaaagaccauuucagugcugaugucggugguucuauauacugccuugcauugcuaaugcuuccuauauuuaugucucauuggcuuccuuaggcucaagaggggaagggggccucaguagagguggguauggguggcauagaggggcuaccaaagccaacucagugggaggacaaaggugcagaaacaggcccagaccaaaauaagagacagccacacacaugauuucacgggcacuagaaaaaauaccaccuuuacaaauagauccucgaagcuaggucaaugauagcugaaauuucauaauuagagauuuaguccuuuggcugaaaacucaguaguaaugguagcaguaguaauaguaacaggcagcagcuuuccuguaucaagacuugcuacucaccaggcacuucauauguacuaccucauuuaauaucaauaaucacccugugaaguagaguauuaucuccacauuggagauaaagaaauagguauuugucuaaagucacauugcuauuaagcaggggagacaggguuugaauccaggucuaaauccaaaccucacaauguaaaccaauaugcuaaauuccucuuacagaguacaaaagucucccauuaaaagaaaaaaaagauugauuuuuaguuguuagauauuuugcuuaaauaauguauauaguacagccacaaaauggcuucuuauauggucauacaaaaucuuuaugaagacuauuucaugcucacggaagacacuuuaguaauauugaggaaauguaaacaguauuucauagaguccgugagcucaacuuuguaaaauguauacauagaaggaugauuggaaucuuguccaaguauuagucaggcuugguuuugggguggugaucuuaugggugcuuucuccuuucuuuaaacuaaaaaaaaaaaaaaaaaaucuaaucuacauuuucuaaguuggucacauacugcuuauaguauugagggaaagcacuagauauaguauugccaaagaugcaaauuuccauggagugaguaagacauuaaaccuuaucagucuuugaaccucuaggacuuuccugaacacacgggucaggagcagggaagagggggccaggcagcuauuuugccagauaaacaauuacgaugaggaucaggcccagaaaacaacuuuguaaauaaaucucgcuagggagccaaggaggaaaucuauuuuaggauugacaaugggacaggaaaggcccugaaggcaggaacaaguaaggcaaguaccccagugggaguaaggcaagguuagccacuuugauuugguccuacccuaggcuuccugccaagucagugaccccuacagaaugggccgucauaaaguaggauggggccauuggacuggaauuugaggggcaccauacuauauccagccucaaaucacccuugagcugggucaagggugaccucaaaacaccaaugacugaagggacaggagagaauagaaagggggcagugggcuuuuuagaauaauagacuucauucucaacucaaaguuuacgucuuacuuagaauuaccuuuccaguacucaagauucaauggguacucaugcaagauguuggcuaaaugaauggguaccaaacaagggauauuggagauagauacagcauaauauacacauacaaagauggggaaauuugacaucuugacuuuuuugugccacgaaucauucuugccugucuagugaagccuauggaccccuucuuagaauauuuguaaaugcaugaaauaaaguagauacaauauaacaaaauuauaucgaaauauuugaaauauaaaucaaaauuuaauaauaugugcuuauuaucauauuaaguaauuaccgagcacuaggucuuauuaguuaguuauugccacuguaauuucaaacguguauugagcauaaauaauauuuugagaaauauacaauaacuaauugugauauaaaaauauguauguuaggggccggguauggugucucacgccuguaaucccagcacuuugggaggccaaggcgggcgaauuacuugaggucaggaguucgagaccagccuggccaacauggugaaaccccaucucuacuaaaaauacaaaaauuaggccaggcgcgguggcucacgccuguaaucccagcacuuugggaggccgaggcagguggaucaccugaugucuggaguucaagaccagcugaccaacauggugaaaccccaccucuacuaaaaauacaaaaaaauuagcugggcgugguggagcaugccuauaaucccagcuacuugggaggcugaggucggagaaucccuugaaccugggaggcggagguugcagcaaguugacaucgcgucauugcacuccagccugggcaaaaagagcaaaacuccaucucaaaaaaauaauaauaauacaaaaauuagccgggcaugguggugcacgccuguagucccagcuacucuggaggcugaggcaggagaaucgcuugaacccaggaggcagaggcugcagugagccaagaucacgucacugcacuccagccugggcaaaaagagcaaaacuccaucucaaaaaaauaauaauaauacaaaaauuagccaggcaugguggugcacgccuguagucccagcuacucuggaggcugaggcaggagaaucgcuugaacccaggaggcagaggcugcagugagccgagaucacgucacugcacuccagccugggugacagagcaagacuucaucuaaaaaaaaaaguacauuagauaguuucuguauaaacuucuauuauuaagaaaccuuaaaaaaaggguagaauccaggaaaacacuccacagccuaagaguugguaacaaggucauggguacugcuauuauugcugccuuuauuuuauuuuuauuuuuauuuuuauuugccuacauuauaauugaacaaauggcuaaauuacaaaggagagguugguaaaaaacaaauaaguaauuuuccuccauccaaguucauauauccuucccacuucaaauucuguccauggaccccauagaggucugaggaccccagguuaaggagcuuccuauaaauucauuucaauucacccaauauuaauggaacacaauguuuaaggaacuaugguuggaacagaccaguagaaccggucccugaucucaaggcacuuacugaaaaacacaaaaacuaaaauguacaagggagacccugaaaagugccauaauagaagaacagagaaaaccuuucguggaaauuaggaaccacaguucaaaguaguguuugcacugauuuccaaagaauaagcuggauuguggaaaagaaagacugugaggguaggcacaagagcacucaaaugucccagguagagaaaacaacauguaugauggcccagaaggaggcaaggaugcagauggucccuuuagaagucaguccuacuccagggugaaugaggccugcaaagugaagagagggcagagucuaggaagauaaguggagggcauugaaggcuaugcuagaagguugggccuuaauccuguuggcaguggccagccagucuagagguucugggcaggguggggcacaaucagaaccaggcuuuuuggaagaaaacacccaggaaggaaacuaagggggggugggauuccagggacauauccuaaagccuaggaguucccuuuaauucacaauauuggaaauaauuuucaaaggaagcaagccagugucucgaacagaucaugucaauuguaggucaugccaauccagcgucuucagggcacugaucaagggugaagcccagugcuggcccaaaguacguaaucaaauauucguuaaacaaauauuuauuaaauaaaucaauugguaaagaagggcccauccugagugaugaauaagcaugucagagaggcuaggguuggccaugcuuccucccucguagaggaucacccugguaaaagggcucuacuaaaaucagaaggugugagcugaaacccaaccagaaccuguuuuuucugaaucucuacucaggguuucugccauuccacuauggcuucuuccccagggauagcagccugagguuuccugaacuucaauguggagauaaauaauuuuggguuuuuaaaaaguuggaaagaaaaacaaacacaaaagaauucccauuccugucuccacuuaacucagaagcaaaugugaguccuguuagcagcacuguaaaccaguacaaccacuguggacaacaguauggagguuucucagaaaacuaaaaauaggacuaccauaugauccagcaaucccacuacuagccauuuauuuauccaaaggaaaaaaaaucaguauauccaagagauaucugcacccucguguuuacugcaucacuacaucacaauagccaagauauggaaucaacccaaguguccaaaaccagaugaauggauaaggaaaauguggcauauauacauaauggaauauuauucagccauaaaaaaugaaauccuggccaggcacaguggcucaugccuguaaucccaacacuuuggguggcugagaugggcagaucaccugaagucaggaguucaagaccagccuggccaacacagcaaaaccccgucucuacuaaaacuacaaaaauuagccaggugugauggcgugugccuguaaucccagcuacucaggaggcugaggcaggagaaucucuugaacccgagaggcggagguugcagugagccaagaucaugccacugcacuccagccugggcaacagagcaagacuccgucucaaaauaaauaaauaaauaaauaaaaauccugucauuugcagcaacauggaugagccugaaggacauuauguuaagugaaauaagccaggcacagaaaguuaaacaccccgccaagcacgguggcucacaccuguaauccccgcacuuugagaggccaaugugggcggaucaccugaggucaggaguucaagaccagcuuggccaacauggcaaaaccccaucucuacuaaaaauacaaaaauuagcugggcaugguggcacacaccuguaaucccagcuacucgggaggcugaagcaggagaaucgcuuaaaccugggaggcagagguugcagugagccaagaucaugccacugcacuccagccugggcaacauagugagacccugucucacaaaaagaaaugauaaauguuugagauggugaguaugcuaauuacucugaucugaucacuauauauuguauauaucaaaacacugcuauguaccccauaaauauguacaauuuauguaugcauuuauuaugaugugucagguuaaaaaaaucaaaauuaggcuggguacagcagcucacaccuguaaaucccaacacuuugggagaccaaggugggaggacagcuugaagccagaagcuagagaucauccugggcaauauagcaagaccaucucuauuuaaaaaaaaaaaucaaguuaaaaaauaauaaaaauuuuaaaauuaaaaauuagaaaaaaacuaagucaugaggacaaggccauuggucuaugcucuccuguuuucuguguacgugucagagguagcagggaguaaggguaguaacagcuggggccugaaagugauagauaggauagaaguccugaucaaagaaggucccuuuguucucucuuagauuaaucagggauucaagagugcaagaugggcugcaggcccagacccacugccacagagggcccacuggaugcucacccuuaguaggcacccauggucuucuuuucgggccuagacgcugcucucucccuaaagagaagacaguggucuuguuugggaggaaagaaccuaaaaaugaaguuuccaaaguuggcagaaaauucccagccaguccuucaguuugacaggaauacaggagcugacccggaugggguagcauuucaagauguaguccccagaagagaacuguuuauaugccuagaucccugccuaagccaggcccugaggaucuaggcacagcaugagguuaaagacugugucucagaagaacauuaagguuugaaggaacaauaacaaaaugucugcauguguguuuggggaaggaggagugucauccucucacaugcacuggcccucccaccuguugcccaagaacaauaagcccacuguuauuuacugagcaauucaacauagacgcuucccacaccaagcacuucacuaagcacaaacaaacucaucucggugguacacuguccaaagccuucaacaaacuggguucucucucaugucuccaguuagcugggcugagacacaaaaguaaccaggccagaugcuaccucugucuuggcaccagcagcugagagguacuuuggugucugggccugccaguuucaaauaagcaacccucucuuugccuaucaucagaagcacccaggugagcuguagcccagcuacagcaaaagggauuagcaaugguuuccccucaccuaccccaugucacugaacuauaagauggcucuuuccuggagagaaguuuggaagagucagagagaaaagcagagaguaagucaaauaauuacaaguaacuugccuggagcauggaccuccgagcugaggggaugaacauuaccauccccacuucauagaugagaaaacugaagugcauagaggcaggugacagaaggauggaaaugaacacuuacugaaugccaacaaugugucggccucaucacacacagucucacuuaacaucacugaggucacauuuacucagccaacaaguaguggaggcgggucuucuggacauuccuggagcuccuuccacaacuccacccaccucuccugucauguugucuucagacacuggcuuggcaacuauuuuggcuaagacucaaacauucuggcauaggaagccugggcacaucugggaagcacugcuugggaagguccccuugucucacuggggcagagguugugagucagcccaguugggucugagcucaaugaccucauuuccaccugccaccuccccagggggccaccccugcugggcuuucaguggggcugcugguguagagaagaaggcaaguauaaguggggcaggggagccagaagaaggaugugcccuaccaacgcaaucccagaguucuaguaucuuccuuggccagagaauagucaucacagcgucacucacacugccuucaucaggucggaagcuaaacuccauuguuuaggcuccaguucccaccauuuccugcuacuaagaguggggccaaggcagggcagggcagguccuggucuguuuugccucucuggaugacagcacugucucaacuagcuuuuuuccauaagagggaaaacaagguuugcuuugaaucuuuagccuaggggccauucugcuccuccuccucuuccuucacugacuaacucacuucucagcaagucagccucuucccuguugacuuggaagugguaacugguacaguuaucugcuaggaccucuuccagacucucaauacagcccauaaaaccugacugggguuaaccuuuccuaugccugugccuuuucccaguagcuucuagaaaggagaacaacacccaaccucacucacaccuuaauggguuagcaguauuucuucaaccacuccaacugcuccagagggcgucagagacaaggguccccuuucauuuguuuugacccagcccugucauccgaagcuccucaagaagcauuucaacuggaagacaagggcacacuggaaacugagaguuacuccuccaauuaccauaugugugaggguuagcaauggaaauauaaccaccuugucccugugggagcagaguucaggucagaggugaaaauugaaagaaaaaaaucagaaacagugaugucacuuuagcaaguuaguuucuucguuaauccagccguaauugcauggccuuuuguucaaccucaggcccagguaaaccccucuuguuuuucucuccacacgugaaagucaggaagaaaaccaucugcuuagugucugaaccuaacuucaguucuuacuuucaaaaucaccuuagccaaaccauacccccagggcaaauacucuccagccccaacucaucucuccuucuuaggcacaugggcugacacaccagcuccuuagcauggccauuccucuuuuuacauuuucucauuauuucaacccaugcauccuagaaucucauauggcuucucccuucugaacuucaacuuguccucuaagaaaauaaacaguccagaaucccaaacugucagaccugaaaaagacgucagagaucacucgauucgaaccuugcaacauacagcuggggaaacugagguccaaagaaagguaggcacuggcccagagccacacagcugcuaggcagugugggaggaggggcuaaaaaccuggcuuuugaggcugggcgcgguggcucacacuuguaaucccagcacuuugggaggccaaggugggaggaucaccugaggucaggaguucgagaccagccugaccaauauggugacauccuguuucuccuaaaaauacaaaaaauuagccaggcaugguguugugugccuguugucccagcuacuagggcggcugagacaggaaaauugcuugaacccgggaagcggagauugcagugagccaagauugcgccacugcacuccagccugggugacggagcaagacuccaucucaaaaaaaaaaaaaaaaccuggcuuuugauccacuagccuauuuaguaagccauagugccagccugacauuuagaaaacaguagauacuucaagcauacuauuauugaucuaaaaaaaaaacuauguggaggaggcuggaucaauuuguuuccgugaaaaacuccaagcuggcacugcuuggaaguuuagcuuucaacagagggcaggccuaacuuucaggaucugagacaaucaccaccacccauucuagggagacuaaauauuuuauaacaccauggaaggagaacucagagagcccuguuuccagaacuguuuucuuuggaaaaacuugaauagcaacugguugggaaggcccccaguaauaggcauagccaagacucaagcuggggauugaggagggcacagagcagagaaagaggaagggaauuugaguaauggguucauauccaggcagccaagaacaacagauuccuucaacucccauaaaacuucaaagcugcugaaauaaaagaagugcagacccaucauuaauaaaguaagucuccagaugggcaaagccccuauccggggccacaccuagcugggcuucacucuuuagcgucacuuuccugcuugacccagcuuccugccagcaaguuuuacaggaaguauuuguagacuggaaacugaccauuuuuggcugccugaauaugccagcucugcccagggugccagaagagggcucuauucccucugcuuaggaacagacuccagcaaccuccagcaucauacuucugaagcacacuggagcugauccaaacccaaacuuggguuccaucuauugcucaugggaauguuaaaacugcugaagccaggauuagucaaauaugcaguugcagggggacgcuucuggcccuaaucaaaaagcucuguuuccagcugagcgugguggcucaugccuguaaucccagcacuuugggagggugaggcaagcagaccgcuugagcccaguuaaagaccagccugggcaaaauggcgaaauucugucucuacaaaaaguacaaaaauuagcugggcaugguggcgcacgccuguagucccagcuacuaauacuuacuuaggaggcugaggcaugagaaucgcuugcuucaacacaggaggcagagguugcagugagccaaaaucuugccacugcacucuauccugugcaacagagagagauccugucaaaaaaaaacaaaaaacaaaaaaccucuguuuucaaccccagggguaggcuaagguuggcuuccuaccuaccuugcugguaagcuaagaaccaaaucuaguaucugggaaacccacagaaaacccaggagcccuuguccuggaaauaauggucucagcauuuugagcuuuggagccuuuuugaccuuccucuuucuaaaauucaguuuccuaaucuauaaaacgggucuaauaauaucgaccucaguacaggguuauugggagauuuaaguuaacauaacagacauguuugacacuggaggaagaaaauaauugaacaguaauaaaaauaaaaauaauaauaauaauagacaugaaaguacuugacacaucauaaguagaaugugaugauuacuaaucccuccccuuuuagccauauuaugacgaauauccuaccugucaggaauaauuuaaaacaaaaaccuguuucacuacagagggcuaggggcugcccaagaagaccucuaaagagcccuucuagcauaaaggacucucacuuucagggaaaacuaaaaggugauuacauuucuaguuggcaagacaaugugaaaccaugcacaacaguuaaauacacauguauuccagcauuauuuuaaauauuuuaucucuugagagagauggggauuuccuccccaagaagcagaauccuauggaaaggcagagcacaacacagcaccuaugcugccuuauuauuuucaaaggcugccugaucuuccuuccuuauucuggacucugccuugccauuuucuccaguuaugucccauuaacacacacaagucugcaacccucaacacaacccacugggaccuccaaacucccucagaugguauccagaagaucacaaacuguuuuuguuuuguuuuguuuuguuuuguuuuagacagagucucacucugucacccaggcuggagugcaauggcgugaucuuggcucacugcaacccccgucucccggguucaagcaauuccccugcuucagccucccaaguagcugcaauuacaggcacccaccacuaugucuggcuaauuuuuguauuuuuaguagagaagggguuucacccuguuguccaggcuggucuugaacuccuggccuuaagugauucgaccgccuuugccucccaaagugcugcgauuacaggcgugagccaccacgccuggccugggaugguguuaauaugacuagagggaugucugauagaagggaaacacagcaaguaaagagcaacugaaaggccgggugcgguggcucacgccuguaaucccaacacuuugggaggccaaggcgggcagaucacuugaggccaggaguucaagaccagccuggccaacauggugaaaccccgucucuacuaaaaauacaaaaauuagccagguguagcggugcauucuuguagucccagcuacuugggaggcugaggaaggagaaucgcuugaacccgggaggcagagguugcagugagccgagauugcaccacuguccugcagcaugggcgacaggcgacagaggaagacuccgucucaaaaaaaaaaaaaaaagccaauugaauacgguccacauccacaaaagaucaaggaugcaaggaugcagucaguucugcuacugcccucaaaucccucugcaccuuggccucccuauuuguaaaguagugcagggauuaucccugcuccucccuaccuaaaaucaucacuacacaccaucacauacaccacugugcacuaaaguaaugucucuguaguaagaggaacauagcuuuguauucugaaaaccugaucucaagauccaggucuaccaauaauaaaccaugaacucuuaaauuucaacuuguaacgugggcauaaugaugccaccauggcaggaguguugugcagugcuuaaugagguauaucccaaacuuagcuuaccauaagaauuuggcacuggucaaaaaguccagacuucuggacaccaccccaagcuuacugaaauggacucuccagagaagacgcuggggaauuagcauuuuaacaaaugccucaggugauucuuuccaucugaaaaguucaaagaaacaacacauggccuugaugcuguugaaaugagagaacaggaccagggaucucuggucauccaaaaugcuuucuggcccagagauccccaugacaggaaccuugagguuagcacccagcaaaguaaggucugcaggcaggaagaggaggagacuuugaaauuacaaucagaacgcuaagugcaccagacccucagaccauuguccaggaucuucaaccauccucccaucuagcuaagaaucaaacagugggagaaaacagacaguucagauacuucagcagccaaagcaugaugaucacaaugcuauaauuagggccccacucaaagcccucuugaguucucugcgucuuaaacacuccacauucacucuuuccuggaagaacuuucaggcaaggagcagaccuuaaaugaagcucucucuuuccuugaugcucuuggaacuugaggaaaagaagaggcaugguugagaggaugcugcauuugcauacagaugugaguauguuggagggugaggguaggagucuaaaauaggugugacuagcaauggugcacuagaaccagcuugcacuagagcugaucaugcacaucucuucccaacuccuccaucaaggacugcauauugguaaccugaaaucagccauggugggaguauuuauaccaugggaauuggcaaacaguaaaaaucauggauuugccgaagaguugauuguuaaacauuuaccagcacacuggacaagagacacaugcaaguuaagcauuauuaaacccauuuuaugaaugaggaaacugagucucaaagaaaggaaccaacugcuauuuucuagcugcaugaccuugaccaagagccaagucugucuggcuagcuauaaaucccuggcucuccuuaccagcaccccaggguagcaggacauccuuacuaucagccaaaagguggcugacccaaagggcuccccaucagcuaaaggccaaacaagggcaccuaauugugcccagugcacuccaaggaaaucugaggauaaagaguucaggacugagacaugaagccaacaagagacagucucauccccaccagaggagagaggcuggagugaggcagggagugggcuagaaaaccccaauagaaaccauaggacauucuuaagaucucuucacaaauaccugacagaaacccugggcucuagagguagucucuggaacauuacaagucccuagaccucuuaaagccucaguuuuccuacagguaaaaugggaguaauaaugccuaccucaccggaguguugcaaggcugacauuuuauccuuuacaaacagaaaagcaccuggcuugguaccuggcauguaguagauguuucauaaauuuuaguuccuuucuccugcaaugccauuauccaacccagauucuuccagggucucuggcucacuuguauacaacaauaauccuagccccaugcgcacagugcucuacaauuuaaaagauacuugcccauaugcauucucucacugaauuaaacccuguaagaaaaagacaagcccgagacaaguaccauuuuaaagaagggagaaauggagguucaguaagguaaaaagcaacaugcucaagugugaaagaaauagaacuagaacccugaucuccccaacuacuaguauucuguucuuuaccuuuccaaguuuaucuuauuuaaggcuacacaaagguccuuccaaaggcuugccuauuaucauuugucuuuuuuuuuuuuuuuuuuuuuuugaaacagauucucgcucuguugcccaggcuggagugcaguggcaccaucucggcucacugcaagcuccgccuccuggguucacgccauucuccugccucagccuuccgaguagcugggacuacaggcgcccaccaccacacccagcuauuuuuuuuuauuuuuaguagagacgguguuucacuguguuagccaggauggucucgaucucccgaccucgugauccacccgccucggccucccaaagugcugggauuacaggcgugagccaccgcuccuggcuuaucauuuguuucauccaagaaauugagcagccucuggacuucaggucugucuuaggaugcuacaaaagaggcugucuuugggaaaggagaauagcauugguaacacagggugggaacagcccuugugguagaaggagccacaucuuuagcucggagcaaccagccaugaauggugguucagagauugggucucugaguccaaucccaguaaacuucggauauuuacuucccccuguaggucugaguguucccaacuguaauggcuggguuuugcucagugguuuugacuuuauuacauuucuaacagcuuccugccuccucaaucucccaaacagaaaaucacacaaaacuucaaaauaugaaguacguaaaaguagagcuguucugguugaagggaggcuguagcucaccagguagcccagccaaacaguuuguaacccacuggauuagcagcuugacgggagggagagagcccuaggucugaccuucuagaauucuacucauccuagcuuugccacugauuccuuauaggacuuauaugacuuucugggcuucaguuuccccaucuguaaugugaagugguuggucuaguuggccucuaaagguccuuucagcauugcgauuucaggaaaaaaguguccagcuauucccacaguagaaaacuguggagagagaccagcaugagcaaaggucaaucucuacucugaagaaagcccuucaggcucuggugacucugaacugaacucuucaggcaauuccucaagcacugggugggugggcagacaggcaggaaggccggcgccccacccucuuuugcacaggaagcuagcuacauccucuuuuccccaccccaggcagaacaucaccacagguccccagcagaagcaguggggggcagggagaagagaaggauggggccugaaaggaaguugaacaugcaaaucaccucagcuaaggagccauuuguggggagggaaacaacuggggcccugagaaagagcagcaaagcugcccauuaucuacuggggcccagcuccccaauaaagcuuagcaaaaguggccugaagccacaggcugucauaaagaaucacaaggcauggguugguacagugagcagccugggcccacucacuccaccucacugaguuucugcaagccaaacagcuggggcucuuacacaagguguuucucagguacagucuuucuuaggguaagaacacagacaugccaugugcgagggugggguguacacaugagugaacaaucaagaauacaggagcucuucaugccucucaaagccaagaaggcaagcacuaauccucauggccuuaccaccagcccauuuuccggugcccacccccauacccugugacuggggcccagcccuccccacauccuguucucagagaacacgcggcugccuaaggaaagauaaugucauuaccauaccuccccuccauagaggaggcuuugguugacuggggagggagcugcaguuuucugucugaccagacugaauaaucuacaguaaaucucccaguuucacagaauggaacaggaaggguaacuagguaacacuaggagcaacuucuaaauuggaggauccaugccuacagauagaugaucaugauucaaagcacuucuggaaaaagaaauuuucuggaaaaacacaaauugacaauuuaacuuacauuuggagacuggaagaugacaugccaauguucuuccuugauuaacaaaccaggaaaugcaaaaauacaauaaaauuacaguuuuaaaaaggucccaaaugucaaucaagucucacuacacauggguuuuagaugccagcauugguauuucugcuaaagcacccugauuuaaaugugccuacaguggcuuuggccacuuugaaaaagaaaaugaucucaggccauaggaagguccccugacaaacucaaagaggaaggggcagugaggaggaaccacagccugaaccuacccauuguugaaacuuccuucucuccucucuaaacagcucggacucccuggcucccccuugucuucccuccccacccuauaaauauagcaaagaauguggcugaacauccaucugaauauucagggagagccuccuuacucacguaagaaguuggaaggcagaugucauuccacagcacugccucacuacugugcagaccuucaauguggcaugauccuugguugggcuuguaugggggacuuuggcuggcuaccccuaagcaggauguccccaaccccccacccagccugcuguuccccuaggcuaaucuuacagccuaauccaauucucauccccauuagggaacaagguuuaucacguaggccuuaagaaaaaauuuuuugagaguagucucaaaaauaccuaccuccaguggaugugcugaagguugaaagguggccucauaaccugcugcaaguguauuuguuuacagccauuagcucacagccuucauuuuuguaugaccgccuuccuggaagcagagguucagagagcccaaagaaugcucuugggcuguauggaucuaugauuguuuuggaagagucucuugguggcaaggauaagauaagagaccacauggcauccagcuuauuaguuuuggucccuauguagcuugagguaacuucucuaaaagcuggcuuuguuuuuucgaguugauaaagccacaucuuucccuccaaaccacaagcucagcuaacaauuuacugagacuaguaaaaacuauuuaaccuauccugcaauaauacaaggguuuuuagcaccccuaccaccacaaacauauaaccuucacaccccucaaugcugaggugagcgagcaugaaccuaucuagccccccacacacauauucauaucaguucuuuggagagaauaagaauccuacccccagccccgaauguuuggucuaguuuuuucagacaacaguaaagaggccaaccagaaucucuauggaaauuacccagaagccucccuaauggucaaggcaacauacauuguuccauaauccaaagcaaacccuaaaaaucuacuauucuagcaagaucuggaaaaacaaguaaggcuaccucuuaccuaccucagguguuucagaaagaacccacaucauugacacagacauauguauacacauacagguucuacauaccaccacuuuaucagacacccaauauggaucggaucaggcuuugaaauaauucgugugugugugugugugugugugugugaaugagcaagcacgugagggcauuuuuuugucagauggaggaaauaugcagauaaauggaugagaaauuaccauucuauacagcaagggcagagauagagguaauuaaaguggacuguggaaacacaagcaagaggcauccaggccauaauggggaaggugaggagacaaggggaggugagaaggcagaagguugcuugagauagagcugaccucuccugaaggacaaaggagacugucacaagaaaaagauuaaagggaaaaggaaccucaugguauucuggguagagagacagcauguacagggauacagagguaagaaacacaaaguaugccuuucucucaaaggcaugaaguuaaauaucagugucuccuuucccagcuuccugacccucuucccagaauuuaucagaagaaaaugaauuaaagaucuucccaccacuuuggcauuaggugccagcucauagauuugggggagaugggccacaaucagagacagaaaucccugaagacaaagccaggcaagauagacuaauguauaaaauaaagauaagaagcugauuauguucccacagccccacugaggcaccagcuuagcuuaaugagcacuccccacccuagcucacacagaccucagaggaaucacucuucaggacuugagggagcccaugacaacauacuuucuuucuuuguuuuuuuuuuuuuuuuuuuuuuuuuuugagacagaguuuugucuuguagcccagccuggagugcaauggcacgaucucaugaucucggcuaacugcaacuuccaccucccagguucaagcuauucucaugccucagcaacccaaguagcugggaucacaggcaugugccaccacgcauggcuaauuuuguauuuuuaguagagacgggguuucaccauguugaucaggcuggucucgaacuccugaccucagguuauccacccaccucagccucccaaagugcugggauuacaggcgugagccaacacgcccggcccgacaacauacuuucaauacacauggauaaccugccuaccuacagauagaccuggaaaggcaaccaaacuaagaucccucugcaucuauacuccaccaccaccaccaccacacacacacacacacacacacacacacgcagacacacacacacacaaagaagaagugaaagcuaccagcauaacaagggccugaggugggccccagccaaggcugccuggcuucugcaaagggguggagauccauugauuucacaaacuguuuugccuucuuaaguaaggauuccucuaaucauuuucuccuuccuacauccuccauucuucacaccccauaaccauccuuucuacccugggucucaugucccucuucuccuuuucuacuacucccucauccugggacuuuuaaggcuucccagagcuggaguuccucuuuacaaagugauagauacacccacauggauucucagacaaccguucccuccaacagauugcagcagaaggcacgauggguuucaccacaaacuaggccagucauuggcaucacuguuugaaguaucaguuuccucaucuauuaaaacaaaaccguaaagagugccgggcgugguggcucacgccuguaaucccagcacuuuuggaggcugaggcggguggauuacuugaggccaggaguuccagaacuagccuggacaacauggugaaaccccaucucuacuaaaauacaaaaauuagccgggcgugguggugcaugccucuagucccagcuccucgggaggcugagacagggaaucgcuggaaccugggaggcaaaggcugcagugagcggagaucgugccacugcauuccagccugggcgacagacagagacuccgucucaaaaaaaaaaaaaaaucuuaaagagauaauguaguauaggaggcacacucacaaauuaaaagcagacuucaggguucuaaaauuauuugaucucaaauccuuaaagagggcaaaguaugauggaaaagacuuagggaacucagccauuuaucaagcacuuucaauaugccagguacucuccuagauauacucauacucuugagcucuuuuaacucucauaaaucucagugaaguagguaucaguacuauccuccguuuuguuuuuuuuuuuuguuuuuuguuuguguguuuguuugagauggagucuugcucugucacccaggcuguagugcaguggugcgaucuuggcucacugcaaccuccgccuccuggguucaagcgauucuccugccucagccucccgaauagcugggaauacaggcacaugccaccaugcccggcuaauuuuuuguauuuuuaguagagacgggguuucaccguguuagccaggauggucuggaucuccugaccucgugaucugcccgccucggccucccaaagugcugggauuacaggcgugagccacugcgcccggcccacuauccuccauuuuaaagauggggaaacuaagguugagagacauuaaauacauuacccaaagucaugcagcaauaaauaaugguuaaaaugauucuaauauuuggucugucauuuaucuuauaacuaccacccuccuuucucuugaaucaacuugagcaauguugaugagacucuaggccccccaaaaaaaucgcaggaagaccugaggcaacucuacuuaggaugcucaccauuaauuaucaccugaaaaccauuuaagccaaccucacucauugacuacucauaaauauucuuuagucccuaaagggaaauuuauagcacuaaaugcccacaagagaaagcaggaaagaucuaaaauugacacccuaacaucacaauuaaaagaacuagagaagcaagagcaaacacaucaaaagcuagcagaaggcaagaaauaacuaagaucagugcagaacugaaggagauagagacacaaaaaacccuucaaaaaaucaaugaacccaggagcugauuuuuugaaaaguacaauuuuaauucuaacccuaggugaccacagaccccauguauacauggaaggagacacaaugguuugguuaguuaguaaccaacauggaagguauuuaugauuggcuacaagaagcaggauucaaaggccugcagugugucuggaucaggaaagaggugacuauaaagaagccaugaguauauaagaaauagguauacaauaaauuggcagucuaaagcacagacuagcagagauuggcaaacugucucuguaagccacuuauagucuugguuacauauucuuuuuucuuuuuuaaaaaaacaacgcuggccgaggugggaggaucaccugaggccaggaguucgagaccagccuagccaauauggcgaaaccucguaucuacuaaaaauacaaaaauuagcuaggagugguggugggcgccuguaaucccagcuauucaggaggcugaggcaggagaaucgcuugaaccugggaggcagaaguugcagugagccgagaucaugccacugcacuccagccugggcaacaagagcaaaacuccgucugaaaacaaaacaaaacaaacaaaaaccaacaaacaaacaaaaaauguuuuuaaaaugguaaaacuuauuuuuaugauacauacaaaaacugguccaacaggcaaguucaccaauuccuagacuuaaccaaauacugauaacuccacugacuaucugcaaggccucaaaccuggauaaauaucucuuuucacauucuacuuuccaaaaaagauggacagcaaagguuuuaucugaaaguuagccaaagauaacuggcccacauaccaauugaucauacauagcagccuacucccuuccuaugcaaaggcacuggcagaaaaaauagauaauaagcuuagaccacuaaccaucuuccacaaaagcucauuccauucucauacuaggaaggcccugggccaagcugauccccacaauaggaggccccaggccaggggcugagccauaaaguaccugacucccaggccucuggcucaaaucccugaccuuagagagcaacaggcaugcaugaagaagaaagaagcaagaaggggaucccucccagcuggccaauuaagggcucaagaagcaaaggaacaugugugccuugcuucucucccuauucccucagaaaagguuuggagaauaaaaggaaaucaagcuaaggaugccaaacucaaugggagugagaggcuaagaaugaaagaaggccaccacagagcuccacggcuaaugaccuccauuaguggccaacacuacacuaaggccuuucuccucuggacuaagucuaggauguucaugaucugcuuggcccuucucucaaaaguggugggaagaaacaaccauucaggagugccuaccuucuaaccucccacccuggcucuucacaauuguuccuccucuagaaaaagaaaagagccgggaacaguggcucacgccuguaaucccaacacuuugggaggcugagguggguggauuaccuaaggccagguguucaagaccagccuggccaacauggugaaaccccaucucuacuaaaaauacaaaaaauuaaccaggcguggaggcgggcaccuggaaucccagcuacucgggaggcugaggcagcauaaucacuugaacccaggaggcgaaaguugcaguaagucgagauugcaccauugcacuccagccugggcaacaagagcaaaacuccaucucaaaaaaaaaggaaaagaaacaaaaagaaauaaaaaacaucuacaugugaaaguauauacaccugaaaaguuaacuacugcuaagaauuauagguggauuucuggauccaagaggugccagacagccaacuguggaugcagcccuuccuuuccuccccuguuagcuuccauagucuucagccaggagauagggggcuucuggggaaucuaaucugacucaagggagaggauaagacaaaaaaugcccuuaaaccaauucagcagcuauugaaccccugcaaagugugggguauuuuacucugcacugggaauacagagacuaugccaaguacuacuucaagggguuccccaccuaguaggaaaaagacauaauucuuggaccccagagaaugaaguguguacuauauccacccuaaagcucccaguuaccuuucucuccuaagaaaaguuccuuuugauacuggcgagagaaaagaaacccaaaguguccuacucaugcugcuugcuucucuccauuaagcaccuucccaugccccuaggaaggacuuggaacaaagcccccuuuccuaccauagaaggagcuuauucucuacucgggauacuacauguaaaacaguggaaaaauaaucaaagaccacacugugauacagugugccccaauaugcgcgagagcuugauccacucugaaaggauaguagcaguaggggcuggggccaaggagaggcugcucuauggcugggcucacucccuaaucaagcguaaaggccauccagcugaagcaggaagcagagaacaagcaguccucaguucccaggcacaagacacacgucuuggacacugagacagggcuccagcccugcaaguccacauggaucugaggagugaagucaccagguccuugagcucaccagcucccuauaauguucccacuaacugaaugucuugaugcccacagcauuacucaccuccuauccuguucuauccuuccccuuucccccaaccacuggucugcucacgcccagacggugaacucacucucuaaaaagggcugcucaccucccuugggugcaauuaguuaaccccaccccuuccuccagcacuuuuggguugggggccauaacuacuaucuccuucuggaccucugaccaaguuuagaggauguccaauugaacuguuagaagaguccaaagagcccuggaaaaagcauuagcucagugcucagaucagcuguauccaugccauauugacaugggcacaggccucccuccccuuucucugguucaguuuugucacauguagcaaggagaggcuucuauuagagaugcaguaaucaaccuuugcccaauguuagaauucccugugggagugcucagaaaauauugauucccaaagccuuaacccaaaccaauuaaucagagucuacacgugcuccuacaaacuggucaagaucaauuacacaggcaagcuggacuuccccagguacacccuggccaagguagaucagaaggcagggagccuagauggcuccaugcaaaacucagcccccuacuauaagaagggcagcucuaacagucaacauuaagcuucauucugguuuccaaaggucaugaguucaaauuucccccuuuuuccaaaccuugcuucaaguccacaagaaaaaaaauuaaaauguauuggaacuagcaaauccaaccccacaugcuuugacaucaggcaagcauuacaacuuuuccuuucucuaaaggaccaguccuaucugccauugugaauuguuuuuuucauuugccacauauggucucuauggcccaauuuuaagaaucucccacccuucacagagggaauggugacaagagagagcugcucuuccugcauccacagccuuuuggcugcucuagugacacauucccaugugaugguaucacauuccugagggcguaccaacugcuugugaccaggaacuaccuggccacagacugggauaaaccaucuaccucaugaugucagcuuaucaccuguuucugguggguucucuaugaacuaccucuccagggcacuucuucccuccucauccacauccggccucuaaugaugccuguucaccccuccacccaguuaugcucccuuacaaaauucagacacagcugaccacuuccaacuuuuuggagcugguagaguuguccauuuggcucaguuccgcacagaacaaaaccauuucugagaugugugccaccauucccguacccaugggagggcagaccagccuccauuguuaggggaguauaacauuucugaauaaaucagaguuucagagcaggaaauagcccucagagguuagccaaaccaaccucuuguggaacaggcuauggcccaaaaacgagcaaggacuuggucaagauugcucuggaaagcuaacagcaaggcccagcauaaacaacagcucuucaacuaaaaaagagugccuuuuccaugauucuccaauaccucuuccucucaacaaaaaguuggauugaugcucuugcucccaccaagguacaaacaagacucuacauuagcuaggucuaagcagcccccaaacaauucucaccuacuaauaagcaacucccauauguccaggagcauggcaaaacaaaauaaguuauuggcucaaccagguggaaagcacaauuagccuugaaggcaguggucugacacuaccaagaauggguuacacaggaagccaguugcaaaaccagagucaggccaggccccaaguaggcaggacacaaauauaacagguggccauccccacacagcccccaagugcucucucucuaaacauuagucuugacuuacaauauuuagaagagagacugaaaagagguugggcaaccacuggaacgggggaagggccaaauguuuaaagcugaaacuuccuuucuagcuucagaacucugaccuaaccaugaccagagcuuaaguccaggccuuuaugaaacaacacugccuucccuucccacacuccaccccgugcauagucgaaaaccaaagucuucugucucccaaucaagccuugucuccauuacucauuagcugaguaauuuuugcagccacuuaaagucuaugagccccaguuuucccuuauguaaaaguaaagauaauaauuccuggcuggguguguuggcucacaccuguaaucccagcacuuugagaggccgaagugggcggaucucuugagcccaggaguucgcgacuaggcuggccaacacagugaaacccugucucuauuuuaaaaaauaauuuuaaaaaagauaauaauuccuaaccugccaacuguagagaguugaugaauaucaaaugacauaguaauaacaauaaaaaagaguuuuacaacuaugaaacuuguuacaaauauagagaauuaucauuacuuggacacuggaaaaaaauuacagggcaaugccagccaaccugucaagagauuccuucaauucgcaucugacuuggcuauuuuaaacagaaaacuauuuggaaaaugggcagcuauccccuaaaauuauaaauccuuuccagcuuccuaacccuagaauuucuuuuucugggauguuaagcagcuagagguuccagaagaacuugccccaagagguuccuaauggcucuuuuaagauuuucuuuaagcuugguucuucuugccaaaggacaaucucaguagagugugaugaagggagaacuacucgacucucccuggaauaaaaguccaugcagggcacacucaaacaugucuucucaaccuccgaucuuugaaggauugccuccuuucuaauccgauucucauaaauaugcugccucuaccugaguucacagcuggagggauggucagugaaggcacaaaugaccugagaaguagaagccuaucacuuuccuugcuccagagugcaaaguucaccauuuuccuuauaguuaaggucaguuacccacaucaacauaagaguaauacucuauggauuacucagcaacagcaaccuaaccacuucacccuggaaacuuuuaggacacguuugcauaacuaauuauguguuauuuggauuaucagaagagccuguauucccugagcucacauuauuuagaacaggcaguccacagguagcugagaagagaggggauuuuuuuguuuguuuguuuguguguuuguuuguuuuuugagagagucucgcucugucacccaggcuggagugcaguggcucaaucucagcucacugcaaccucugccucccagauucaagcgauucuccugccucagccuccugaguagcugggauuauaagcacucgccaccacacccagcuaauuuuuuuaguauuuuuaguagagacgggguuucaccauguuggucaggcuggucucaaacuccugaccucgugauccacccgccucagccucccaaagugcugggauuauaggcaugagccaccacgccuggccgagaagagaguuuuauuauggaugguugagagaugauuauauggcaaugccucauugguccuaaauggucuauaaaugagcuguaucacagaagugaacauuuucugauaacugaggcucacccguuuaaggaucauaacuauucuuaguggugagcugaaagucuuucaucuacugauauacucuacugcuuuugucaacagagacuauuaaaacaugauuuaaacuucucugagcaccugaauccugaacacuugauuuucuacgagcuaacauuucagagccuuccacugcuaacuuauccaaguuucccaccaauucugagguuaacacauaaucauucccacuuuaccaacgggagaaguggaggcucagggagguuaagggauuucuccaaggucaaacagcaaguaaguauggaaacacagauauuccugcaagccuggccuacaauaaaugccuggagauacuuuggauccacaccuucucaaguagcccaaaaaauuauuuaaaaugucauuuccuuuuccuuuuggaaccugaucucaaacucccugccucacaaagcuccugaaagugccaaucacuaagagugugcaggcagcuuccuguuugucugaaggggaagggaauaaugccugcaguggccugugggccuagcccagucagggucaaccucugguagcagagguuccaggauuaaaggcugggcaagcagaacucugccccaccaacuguggaagucugggaauaaaaaggcaagagaaagguggggccugccaugagugggcagaauagagccagcauuucugguaauucugcuucuccucuaguggccugguuccuucaacauaaucaauacucucaaguuagaaagcuucuaagaccaggaccagugaccacuaggcuagaauuuuucuuucaaaauauuuguauuucacaaaucacuaucuuccucaauuauucaacugguggcucaccuacagcugagugcucugcaaaauuccacuuuccuaccaccuggacaagauuccugauguguauguuguuaggaaggggauucuaaucuagcuucucugauaauugacaggcccuuccacagcucuucuuuguuuguuuguuuguuuguuuuuaagccagucaaauuuagcagugggggguuguacacccacuucaguggcugaggcgugguggcucacgccugcaaucccaacacuuugggaggucaaggcaggaagauugcuugaagccaacaguucaagaccagccuggccaacacggcaaaaaccugucucuacuaaaaauauuaaaauuggccaggcacaguggugcacgccuauacuugggaggcugaggcaugagaacugcuugaaccuggaagguggaggcuaccgugagccaagaucauaccacugcacuccaaccugggugacagagcaagacucugucucaaaaaaacaaaaacaaaaacaaaaacuucagugaugcuaauguuaacaaguucugacaacccaguaccaucgguaacccacuaccaucggaccagccuccacugcucuucuguggagaacauuggaaaagcaugugccuaucacaaacacacacauauguacacucacaaaguuucuuuccuucaccucagacagcuccaacagccagaggucuucugaggugcaggauucucagucagguacugucuggaaucaaaccaccccaagcuggcaaaaccacaaaacaggaaggggaccaugcuaagcauagaaaauaaguuuauccuaccacuaaucacuccacugagcucauuuagacacaggaucuaaagcaaucucuauagguggggccuacugagcauagaaaggggagcagcuaccaucaucuuucaucgcaacagaaggguucacauaucacaucuucagaaaaccuucccucucagacagacaaauccucauuacaacuucuuuauuuuccacuuaaugaagaguauggccccuuuauuuguguagauuuuaaguguuccaccaauucauccaggcauugguggcucacgccuuuaaucccaacacuuugggaggcugaggugauaggauugcuugagcccaggagcucaagacuagccugggcaacauagcuaguacccuguccauacaaaaaauagaaaaauaacugggcaugguagaaugcaccuguagucuuagccacucagggggcugagacaggaggacugcuuaagcccaagaguuggagguuacagugugcuaugaucacaccacugcacuccggccuggguaacagagugagacgcugucucuauauaaaaaagcuuuuuuggccaggcacaguggcuuacgcuuauaaucccagcacuuugggaggccgaggcggguggauuacuggaggucaggaguucgagaccagccugaccaacaugaugaaaccccaucucuacuaaaaauacaaaauuagucuggcgugguggcaugugccuguaaucccaguuacucgggaggccgaggcaggagaauagcuugaacccgggaggcagagguugcagugagccgagaucgcgccauugcacuccagccugggcaaaaagagcaaaacucugccucaaaaaaaaaaaagaaaaaaaagauuuuaauguuuaaaaaguguucuaccuauuugcugauuugcuuauuaaugagccccuguagacuuuaaaaucggauuugacauuaaaagauggccagcacauacuaaguuaaaaaagcagaacaauacggauuuguacuaucugugcauuuaaaggcauauauauacaaaugcaugaaaaaagagucuaugggcugggcgcaguggcucaugccuguaauccccgcacuuugggaggccgaggcagguggaucaccugaggucaggaguucaagaccaggcuggccaacauggcaagaccacauuucuacuaaaaauagaaaaaauuagcuggacaugguggcaggcaccuauaaccccagcuacucgggagacugaggcaugagaaucacuugaaccugggaggcggagguugcagugagccaagaucgcaucacugcacuccagccugggcaacagagcaagacuccaucucaaaaaaaaaaaaaaaagaaaaagaaagaaagaaaaaaaagaguuuauguucacauaacuaacugguuaaugaugguugucucuggagaauacagucaggggcagaagacaggaggcuuuauauuuuucaaugcuguuucauuucuuacaacaaacauguuuaguuucauaaugaaaaauuaauccaaaauuguaaaacaaagucuguauuuauuuaaaucuguuccaccacacagcagagauugugucuguuaacuuuccuuauauggcucaggacuaaaaaaacagaugggaaaaguccuuuaaagacuaggugaacuucagaagcucucucuauuuuaggacagucaaccuuaccuaguaagcauaaaccuacaccucucaaaugcuggcccuacccuuuucucaggaguggaugggaggaaaauaucuccuacugcccccaaaauuagucuaccuuggccaaaaaauaccaagucugcaaagauaagcagcucugggcccuaaagcagccugggugguggugguggugguggugguggugguggugguggugguggugguggcggcggcggcaacaguagcaauagcaagaguggauauccacuggaugccccaacauuaugaucgccaggacuuccuugcuauccucccuggucuaugccugucucuuccuaggccucagcacaggggccaaccaaaucccuaaaccucaggugcacaaaccucucaggauuaaauuaugcaaugcagcccugccugcuggccaugccauaaugagcagcacaaacacaaaaaaauuaaaaauugaguaaugucucaaauauguacuguacagccaaacuuugggcuacuucacaaagguggacagaaauguuugcauggcugccuguuagaauccacaaaaaguuuugauuugaauauucccacuugacacgaacacuacuguauuaugugaagauaugggaaaagggagcagaaauggcuaugaacaugcuggccacucacagauaaacagucucuccaaggugcacaagagagacaaugccuucccauuccccggugcuacccuguuccauucugccagggcccagcuggguccacauuagguaguuuccaguggaucaauggaauuguuguuuggcuaucugguagaucuagcuaaaggaaucuaaagaagacaguuccaacaugaaaauaguagcuauuaacauaucuauucaauaaauauuuguugagaaucuacuuuaugccaggcaucauuguguuggguaccggggauauaauggguggugagaaaccaucucuguucucaugaagcuuacacacuagugggcuagacugacauaauggaaagaacacacuccugagagucuugccuucaauaccaguuucugcuucugccucaauacaugaccuugagcaagucccuucuucguguugauuuauaggugaccaguagaucuuccacuggcucagguaauuugcuuccuuacaaaacauaaaguccugggguggaauggggguaugcaaauggccaaggcagcagcaagaagccaagggucccaacaacaacaauaaaaacaacaaaagaagccauggguaguauguggugaaaacaaaaagcaauuaauugagauucuccacucaaagaccuugaauuuggcuuagaugguucuucaugaacuguuuuccuaagacagaugagaugggcaggccucuaaagaguauacaguuagugacagacaugaagaucuguccuucccacaguacauggcaggcuucagaccagaagaccugaaaggugcucaguuucacugcagcuucuacacuucuaccuauagcuaaagggauguuaagaaacccucuacucuaaaccacuuauuuuauacuaaagagcuaaggugaugguggccccucccuccccaggcacuuguggucauucuugaguagggcugugcuagggccaguuggagucaggcugcucaaaugagugaggagaugguacuucccugcauacuuccuacuuaaaaaaaaaauaaaaaacuggcuguaggggcaccuaugugggguucagagaaacuguagcaucuggcauucuggguucagaggcuugauuggaaucacauauagcacagaacuuuaaaaggccaacuggaacaaacauacuggaguguccugggccuaccuuccuuccuuugugccucacaccucacagaccacuugcagaugcauuagugcacugaaugaauccucagcauaacccuaaaaaguagguugcuauuacucuuuccauuccacagauggggaacuaaaaucuggaaugguuucagaauuugcacuggugacucaaggccagcuaggcuuucucuguacuuacacucaggccucucuuccccauaggugcuaauacaccugucccuucuccaagguguauuuucucuauuacuagugguuaguaugcccuaccaggugcucauccaacacuguuggauccccugcauucauugcuacugcuucucccucaccauguauauuacugaccaaaugcuccucaaagguuuguccauuccuaaccaccuccaccuggagaauggccccuucuugagacaggaagagcuagaagcuuccaaaugcacacguuuaaugaaagagcaagccuaggagcccagauggcugcaauucugcaugguaaauaacauaacagaaguucuuacaaaguacagugggcacauagaagauaguacaauacuaucugggaguaauaaagaaaguuuccaauggaagugacauggagugggggggagaugaagaagaggcaccugaaauuucaagcugaaggaaagaacauaggcuaaagcagaaagaagagguauggcauugcuuuccacaguuaaaaaaaaaaucauggccaggugcaguggcucauaccuguaaucccagcacuuugggaggcugagguggguggaucacuuuaggccaggaguucaagaccagccuggccaacaugguaaaacccugucucuacuaaaaaaauacaaaaauuagccagguuugguggcacaucccuguaaucccagcugcuagggaggcugaggcacaagaaucgcuugaacccaggagguggagguugcagugagccaagauuggaccacugcacuccagccugggcaacagagugagacucugucucaaaaaaacaaaacaaaacaaaacaaauucaaccugaaaaagcuggaugaaaaaaagaaaaaggacggguauagcuuacuuggacuugggaaaccuugggcccacaaagcuaccacauagcauacaugugggaauaaaugggagcugaguugggagaggaagcuagaauggggugagguaccaaagggaccucccuauaugcuaugcuaagagguuucaauuuucucuuuucacauucaugggaauguaucuauacuagcaaaugcugggaguaaucuaaaugcucccccaaaggagaaugguuuuaaauuauggcauagccuuugaauagaauuuuacauggccauuagaauguucauuucuuaaaauuaaauagcauuuaucuaaguuuuuagugauguguuaaguagggggaaagaaggagaacuuuuuuauguacacuaugauugcaccaccaaaaacuaagguacauauaugagauacgacaagaaauacaaauaauuauugccauguuaaaaugaugaauuuauacacaauuucucucucuauuugcuaaacuuugucauaugccaugcugaguuuuaaaaaaaggggaaauauaaaaaaagaaccacucuucuuccauuugacucuacauuccuucuuccuccaccugcuugccuaccuucccaaaccaacagccauuuugauccaccaccuacaacuggcaucgcuaacaacccaugugagguaccuaggaagaaugagaagcuuccagcaaggcagcugcuuccagcagcaagcuccugcauagcccacaggccauuccagcucaaugcuggagaagaaucuucccccuaacagcacugcccagcacuacccaacuaaggcuucucugguuaaacugcccaaggaugcccaaggaacuuguuucuaaaggaaggaaaacagaugccaagacuucuugugcuuucuccagggggcucagagcagguaagguuuauguucauggccaacucuuagguggcugagauccaaugugggauccuuguuucacaagcaagcacuggauaaagugucagugagaaggacgaaaaggaggaagaaguagaggauggguaaaaacagauccagugaaggguacaccuuucccauaaacuugcuuauucccuaucagccuuguaggcccucacagaaaauucagaagucccucuccuuugaucuccaggacuaauaccaaaggaaaccauauuuacaaaauacaggaucaguugaaagcccaacacuagguguguggcaaucuuccugacuagaaauucucccuuuugcuccacccaagcccauaucaccuagcucuccccguccaagggcaacauagucaacaaugauucagauagaggaaggggaaagggagcuuagcaauuuaagacucagucaaaagcaauuucauagcccuacaaaaagggauguugugggggagggaguaaaggaagugaaaucucauauguccucaguuuuagcuuguuucuuugucuucccuuucccugauggaacaaugaccaauccaagggucuucuauucuuccugagucacagaugaccaaaaauagccagcaacuguagucugcaggcuggacuccaagaccccacccaaggcauguagucaacaguugucucuccaagccagaaucuccacagugagcucucugguagguagauucaguauaucccagagcagagcucacugaaauagagggggcugcuuacauguugauagccagaggagaaaaugacacacucaaugccauucuaaaugggaaaaggaagcuucuccgaaaagucaccacucugcucugcuacacgcuuuccaagaccccuuuccuagccucuuaaagacugggcacaaauaaucagaaugucagaaaaagccaaugucucuauuuuguagauaagaaaauuaagccucauaaaagugacuugcccaaggucacacaggcagagauuaaaaaccaaauaucucacucuucuuuccauuguaccauuuuuuacuaaaagguauuuuuaaagacacccagacaagugccccaagcuguaagugucaaaagcucagcucuucuaaccuaaaguuagacagcucaggacugggaaggggagguagagggaacuuagacucagcccacccaggaaagccaagugagaaggcuaggcauacaacaggcauacuuaaagaacuagacuuaccaacuggaaggcuuuaccugcuccaaagaaauaguuucaaaugcugaaagcccuagccccaucccacccccacacucugaaccucuuuaggccaaucgagaccacuccuaggcugucagagaucuagguaagaagcuguagaggagugaccaggcagugccaagaggauaaagggagauaagaaagcaggguggagaaaucacagucauuccagagcucucccaucuuccucucuccuuccccacuccuccccuauauuaggacucuaaacaagaagaaaagaaguuugcaggugguauuguauaaacuugaagaaggcauucccuguacuaaaggagaacagaggacuaguugaggugggguggcaaggagagggaguaacuugaggggggagaaaauagccaaauaaggcagacuugacugguaggaaucaucaggaaagguuccagaaguugacguugcagggaggaagccuuuagucaucgguuuccucuggcaacuggccuaagaccagaaggaaaaaaacucccaaccuuaggaaaaugcccaggcuauggcagacagaaaggcaacuaggcuagauuuucaccaggcccacaucaggcccugcuggagcaacucuucaagcacucaaaguagaaagauguaguguaacccuaaagcaaauggcagauguccccaccaagcauaugcuagaucuacaauggcccaggcaccaaggggaauaaggaaccugggagggggguuuguucuuuuccauuuacauauuucuuuuuuuuuuucuuuuuuuuuagacagagucuugcuuugucacccaggcuggagugcaauggcgugaucucagcucacuguaaccuccaccucccagguucaagugauucuccugccucagccucccaaguagcugggauuacaggcucccgccaacacgcccggcuauuuuuucuauuuuuaguagagacaagguuucaccauauuggccaggcuggucucaaauuccugaccucaaaugauccaccugccucagccucucaaagugcugggauuacaggcaugagccaccacacgcaaacuccaugugccucuuucuaauauugcugauauuuucauguuggagaaaaagaaaauuaaaaggcaaagaaguuaugugacuuuucuucuuuguaaaggaauuagucagucucccacaaguaucuacaaggauguuuggagaggaguuuagcucacuuaaaacccuugaaaauagcaaagauuuguacgacuuaacuaaugaugcccagauugacuguuaccuugacccucacccuccaacucuauaccauagauuagucaaccucaguuaaaaauuacaacagauaaaagaggcucuuggugagcuucaucaaacauccaggcugagaaucugaaaaaauaaauggaucagccaggcgcagugccucacgcuuguaaucccagcacuuugggaggcugaagcaggcagaucacccgaggucaggaguucaagaccagccuggccaacauggugaaaccucaucucuacuaaaaaaaauauaaaaauuagccgggcguggcggcgcacaccuguagucccagcuacuuggguggcugaggcaggagaaucucuugaacccaggagauggagguugcagugagccaaagucaugccacugcacuccagccugggcaacagagcaagacuccgucucaaaaaaaaaagaaaagaaaaaaaaggaaauggaucauggguuggagggaaggcagauuagaucacgaaaguaagaucaggaaccuuaucuaaacacacaacuugagaaaaauaagacuugauccuucucagguauuuaauggaggccaaggcuaaagagagggaaagaaauacugaucaagccugacagguaugccuuguucccccuccuaggccuuggccccagucacuucccaaauauauacccaggaaaaaaauuuucaggauuauaucuuguuuuguacaaccaaauugucauaucucaacucuucucucauuaggcccugaucacuacccuggaugcacaaaguaucuaucaaauucccacaagguagaaggguugccaggaaugggaagaaacuucaauauucgaagucaccaaucacagaagauaacuggcaaaacaguucuacuaagcaagcacagagccauuugccauauuaguggccuaagagcuaugucaacacuuaccuuaugccacaacaagccgauugaaaggagcaucagaucugguaucugugucauuaggcacagacaaagggcugugcuuugaaagucgcccaaaaggccuuuucuccaaauucaagacccagaugcugcagcugugcccuggccagaaaacgucauacuccuccaccucuaacaaccacacacugagaaauccucccugccaucuccacccuuucccaaauaccugauuuuauagcaaagucaaugagagaauuaaaagcuguuucuaggcugcugacauaaaguuauugccaagcucuauucuuugguuuaguucauguguaagcaugaagaaaagacccucucacauaccuacuuaggcaacaaaagcaacauuuuuaaaaauuaauuugcccaggcugggcgugguggcucacaccuguaaucccaccacuuugggaggcugaggcggguggaucaccugaggucagaaguucaagaccagccuggccaacauggugaaaccccaucucuacuaaaaauacaaaaauuggcugggcgugguggcgcaugccuguaaucccagcuauuugggaggcugaggaacgagaaucgcuugaacccaggaggcggagguugcagugagccaagauugcaccauugcacuccagccugggcaacagagcuagacuccaucucaaaaaaaaaaaaauuaauuugcccaauucuggaaaaccaaagguauggucucccccacaggcccuuguuugccaauuaagaaaggauuguuggauccaaauuacccuagaaagaguagcuucaucuaugcuuauaucuguggcuccccuugaaucagucagcagcucaagccucccuucacuucagauaaaguaacuuucaagagagcauuggucuagggccauugguuuacacccacauaccaaaaacacaucacuuucccacccagaacggccacugcucccaaguguacacacccuuuaaggcccuguucaugucccaguaaacccuuucuccucaaaaaguuguagaaaaugcaaugcaaaguauauauuuuucucaagccguuuuuaagugaauuagcccuaaauccccaauuaaauaggagauaggagaucuuugaaggcagcaguuguaucaucccuucauuuauuucuaucccuuaugguaaauaguacauaguaaccacucauuaaaugguaagaauucaacuaccugucuucuuucuuauccaucccaucuagcacaaaguuaggcauauaguaaaauucaguaaauaaucauaacauuuguauaucacuuguuagauucuaggcacaguucuaagcccuuuacauaaauuaccucauguaauccucacagcaacucuguaaguacuauuauuauuuaugguuaaggaaaaugaggugcagaaguuaaauaacuuguccaaggcuauauaacuaguuggucgcagagcuagauuugaguccaggcagucuaguuccagagucuguuuuucaacacuacucuaugcuuccuuuccacggaggcuugaaaggucuuuuuuuagcuuccugccccaggcuuggccuauaagcaccuagaggugaguggugaacuuugaggccaggagauucuagucugcauucaaacaauuugcuacagcagcaaauacugucacuaaauugaaaaagugccauacuguucuccuaacucaagggacagaucaagcuggagcgcugagucagaauucagaauucaaaaaggucagagcucaaaauuaaacagggcaaagagaaagcagggaacuggggugagggguagacaggaagagaagacagucaucggagaucccagaaaaacuugcuauagcaaaaccauuuuaggggaacuccauuguacccaucuuguuaauguaaucaccacagagccaguucucuggaagucugugcucucuggguggagucauccuucuaagacagccaaguccagugggagaccacuaacuugggaauuaggaaauccaaguucuccuuucaauacuguuaccaacuauaugugaccucgaacaagcugccuaaccccucuggcuaugaauacgaugaagaaauuacucucuaaaguuucuuaggacagcaaggccuagucucaagcaggaaaaugugacuaguguccucucucuaccucccuucagccuacacauaugccuuccaccacccgucacaagccaaagcaaaacacuuaccuuccugggaagugcuacaaagaguuccugagacaaggucagagccugagccauuuccaaauaaagaaacccaugagaucagcucuacacacucagaggaacuugcucuucccauggccauaacuccacggucaugucaccaccagcacagagggagaagacacugagcaccucacagugagugccauuuagaagguaggcauucaccaucccuccccuacacuggagccaagcaaguuagguuuuaguccuggcacuaucaccaguucacucaaauccuuucccuuuucuggacuuuagugcccccaucaagaagauaaaggcugaggcagaagauuuaaggccagcucaguuguuccaugguucaaaacacuccugugagaaacccugcccauccagaacaaccagcuaaaggaaagcuuaaggcuagggaagcucuggguugcccuagaugcaaaugccuuuaaaaugcuguaccccauacaaaauuagcugggcaugguggcgcaugccuguaaucccagcuacucgggagccugaggcaggagaaucgcuugaacccgggagguggagguugcagugagcugagaucgugccauugcacuccagccugaacaacagcaaaacuccguaucaaaaaaaaaaaaaaagcuguaccccacaauagccaguccucagcucacuggugguagauacuuuaugagguuuguuuaggagcccuuaggaaggccucaauaucuaccaauauaucuaacuaccacacucaccauguuagaagaaaaucugaaacauaaucuaguagcuuccgggccuuccuuucagcagaaauaaaaaggacuauucuacuaucaggcaggcggucacugaaaaaugugggaagaauggcaggaaaaucuaugaggcuuuuaguguuuguccaaagcuuuucagucaacccacagucuucauaauauacucucacuugguuuauuucuuuccacaguaaggaaagacacagcccuuucucucccaugacucgggaagaaauggccaagaguacucaagccaguauucuucuuggaucuacuaaugaaacaaaccaacucccaugugagaaacaguccauucugaacucagcacuuaagaagaaacagcacucaagaaguauaaugggacaagaggauacauuuuaauaagcgcuguucaauuuuguauuuccaauacugccuggcacauagaagguacccaaauguugaagaaagaaugucugaaggaaugaacauacauauaagagacucaaugcucuuauaccaucaagauucucaaaaacaucaguacuggagggauuccuagaguuuacccaucacugguacagcucccucaugacaagcuggagagacagagggccugaagaaaggacuugccuaaagucccacuucauuuggcucacuuuacugaggacaggagagaaguucuucuuauauggaaagagaagaaaaauucucaguucagugaugcuuuccauuucccagcacccaccuuccaaauucauggaauccugagcuaauccuccaaagugacaacuucuauaccacagauuagaaccuggaauugaaaaguuuuucagcucucucaagcaugaaauggaaggagggauggacagcaaagccagucagucaugaaaagaccacccccuucacuugaaccaacagacuaucccaaaggagaccacaucuguacccuguuuuuuccuuuuugcaagcaaaguaauagagcagguggcagggaaagaagauucugaguuaggaaagaggcacaugauaaauucaauucuaucuuugaaagauuagagacagacuauuagcaaucuguaacaaugccaaauuuccagcagcuaugguuaugaaaggccuaacucugguaguguugguagccagauauucuccccucuggggacccugagucuagaaauuccagugggggaaacucccagaaagauacaaagggaccuaagacaggcuguugccaugcaacacuagaacagaguucagaauaauuguagcugucauauuaucucauccagagagaauuagauuuggaggcaggggaaauagacuagaugacuuccaaauguccuuuccagcuccaucauucgguaaaguaguuucaugggaggaggagguaagagaaaaguaagaacaacacccuaaaacaagcuacuguugcaggcagcuagagaauggaaaguuagaagauuagugaucaauacuacuucuaucacugacucacagagcaaccuuucccucuccaagccuaacacgagagagcauagauuaguuggugugggucccacaaaggccuuccugccccaccagcccccucccuacccagagggcuguuaaaagaaaagcguaaaggaaauucccaagaugguuccugcucugucucuaucaucuacacuuucacaaagggccaagugaacugaagaacccaaguggagagaugcaggauccucucucauaugaccucucuuccugauccuuuuccccccacuuaagucuguaggcagggcugguucaaggguuaaaagacuaagaaucuggcuccuauuuaccaaguaccacuuuagugccacucgaguggcucaaguaaugcuaggaauggcaggagaauaaacaguccacauagucccuguuaaaguuuagcugaaugccgacccaaacaccuucaaauacuucaaggaucuaggcucuaugucugcucacauugauggucccaucaaaugaccacucgauugccuuuccccugaucuguugaucuauggcuaaaaccccagcagaucaaagagguguuucaccaagacugacccucuaacuaagaccuagauucaaguccuaguuuugcaacuggcauacugcaucacucuagguuagucucccccuaacaugaguuucaguuucaucaucuauacaaugagaggaauuggacuuuauaguuguggagagccuuuucaauacuaacaucuaauaaaucccaaggaaggaaaccagaaacucaagaacaucucgaaaauucaaaacacucuuuuuuuaggaaauccaagaaagccucaaagccuuugugauccuaaaagaaaaaaauuaaagaagguagggagggggaaaggccuuuuuaaauauauauauauauauauauauauauauauauauauauauauauauauauauaacugucaucaucaccaaaaaauguagauggcaauuaauaagcuuuuccauucuggcuacuaaagcagacucaggaaacuggcaaccagaagcagaguccaaggaauggcaagaaggcaaggguggcgguggguagugaggcauguuuuuuuguuuuuuugcuuuuuuuguuuuugagauggagucucacucugucacccaggcuggagugcaguggcgugaucucggcucacugcaaccuccgccucccagguucaagcgauucuccugccucagcuucccgaguagcugggauuacaggcgcacaccaccacgcccagcuaauuuuuguaauuuuaguagagacaggguuucaccauguuggucaggcuggucucgaacuccugacuucaugaucugccugccucggccucccaaagugcugggauuacuggcuggagccaccacgcccggcuggcguguuuuaacaaauguaggggagguugggcugacuaggagggacaauuagcuauaaaagugaaaccgacccuagauagguuguagacaugcugcaauaugaaugaacgaguuugauuuuccacuaccuuucuccaucugucacacgcuagaaauagccuaaagcacauaaaugaaaauggagcagagaaagggaaauuuuuuccccuuuuaauuaaaauuacugguugguauucagugaacuagggugugccccugaacaccuuggccuugguaugaggaauaagaaaaguaacagaaggcaccuggugacacuaccgaaccuuaccaggagaccacacaaaugucaaccuuggccacuuugcucaaauuacucauuuccuuuuaucugaggaccauaaaggucugagaacagugggcaauuuguuuggagcaagaaagggaacucaaaugucaagaacucaaucauugggucagaauaaagggucaaugagaugagcaucagaaagccuggaccccaaucuuggcucagucaccaugugcccuuagguaggucuuucccuguaggucucaauagccucauuagauuuuuguuuuaguuuuaguuuuuuuuuuuaagagaguuguacuaaauagucuccaaggucccuuucagguuaagauucuaugaucuuaacagacauaauauaguugcuuuuccuaaaaguugaccauuccuugagucaaaguauagaaaauucucuaauacuuccagucuaucaaaauucagcccucuccuuccaauuugauucagguuucagucaaucugcauaaaaaugccuucaguauuuagguacccucauuacuccaggccugacuacaaacagcuuauacuccauucucucuccauucccaggaaaacaauaaacacgcugucuugucuucuuugccacuuugacucagaugagacgguuaaugcaaguuugaagcaacuuccaggcccaugaagcuguguuucaaagugggcuaucucagaacugaggaugagauaugccacuacagaagaaagaccguggagcaaugucuauucccagagauccacccaacuguucaggcaaagccgcaccuuaagaggagucaggagucaaccacagagagagacccaaagagccgcuccugacaggaucuuuauaaucuuguuuuggcagacaaugggauauuuuccccucucuccaaaaccauuacucucucucuuugggggcggggacuagggaacaaaguguguaaaagccucauguccuaaaaccacaagcaauuuaaaggagauagacagugaaagcacauacuuuuugaaaacuugguguuucugaaggacaagguucuggaaaggcaagaacgacuuggcagugaggcugguauacaguaacguggcaaccaaagcucaucacaaacccaaaaggcugggcccccaacucuccuccucucaucccaggggaccuucagcccuuuucaaggcuacuagucacuaucucaccucuacaaggcucaagcaguccuggggagacauguuugggagcacugcauugccuaggccagcucaacaagcuguuuggccuaagggacucaagccaggguggucaccaggccuuucugagcaagggaagggccucagcagccauuuggcaugacuugcacaaaagcaagcagagcucauuagucaggcacaccccuccuccccucucccuccugggcauccggccccccuauccccacucccaggaggcuucuguuccucucguaacagccagugggguggagacgcauccccaaaucaaccaccacucuagaaagguguggccccacgagaaaacccacaccacacaaaauaguccggaggggauaggaggagauagagaggcauuaagcaauaggaggggcagggauuuggagguggagaggagggagaaaccgguccucucucccaggagaugggguaggccucuccucagacuggugccuaaauaaguguuggugcucucgggugcagccucgaugacgauuuccucacaucucucuccucaccuccuaguggaaaacagcuggagccacccggugaggcugugggaaagaugagugggggugccggauccgccccgagcggcucccuccuuucucccugcuucucuguucccauguccccucuuggacauuggcagccuugccccagaaaggugccaauuccuggguuggggaaaguguugucuucuggaccagaauccucuccucugugcccauggcccaucagggaaaaggggaaaccccaggccccaacgaagccguccugacuguugcaucucagacacagggaacuggaaccugagaaagaggcaggccucgccccguccaaacuuccagccuggacacccccucaaccccugagggcgcaccagaccaggaucccacuccgguccccucccuacccuuggcuauggcggagggcgcggcgucccaggcgggccgguggcuggccaagcccucagccaucagcaaagggcuaugaggcucagccagagccauuggggucgacagcgcccaccuccggcacucaccguuuugggcaugguggcggcaaaggcagcggaguuggcgaaguuuagcuaggacugucgggcagugcugagcacgcaguacacacggcuuggauucggcuggccggggacucagauugggucccucacuagcgucggggcgacuguuaggcuuccugcuaacgggccacgacuucacaaaccccacccaggaaagagccgccccugucgcgccgcccgcuccuuuauguggcccggcuuccgcgccg

SEQ ID NO: 19086 - RNA, 742 nt, Homo sapiens
ggcuuuuuuguuuuuguuuguuuuguuuuuuggcuacugaagaccugacugccuuuucaucuuuugaucucuggcuccgcacucgggguggggaaggcaggaggagguggagagagagugggggaaaacagaggguucucuccgcgugcagccuaaccaggcgggucguggcugcagugcugaagccgcuccccagucgccuggcuccuaagagccuucuuugcaaugugcagcuagcucgcccgcucgcagccaaagggaguuaccucucugcaaacucgggcuggcagcgcugggccgacgggggcgggggggcggguggggagaaggguggugagggggguuggcugagaguagccgacugaggcagcugcgggagagaagacgggggagggggggaaggcaggguggggggaggcgggguggagaggaggaggacaaaggcagccgucaguccuaccaggcacuuuccuugcuuccuccgagucuuuagcagcuuuuaaaaacuucaccgaagaggaaagggcagcuccgggcggcggcuucgaagccgccgcgcugcaagaggcguuggcugucgcuggagccgggcuggggcuggcguggugcgucccuucggcuccuguacagcacuggagcggcuagcucggcccuuuuucccucugucgccuccucugccucugggcuugcuccggaccgucccgcucucccagcaagcuggcuccccgggaucucggagggg

SEQ ID NO: 19087 - RNA, 39023 nt, Homo sapiens
cagaaauaccuugaaagcccaaaaggaugagauaaggaaaacagguugggacaugaagauuaucuuuuaaguuauugucacaauaguuacucucuuuuagacccugaacauuuucaguacuugcuccaaaugguuuagcaacuuuugaagugggauuaacaaguuuggccaaugaagcuucuucccugcccaccgccagaggugcuggagaaaaguaauccuggagggucggcguggaggcaguagagagguuuauaaaagucaaggaagugggaagaggcuugcgagcagcaggagaggcgcagagucagaggggcaggggcggcggcggagggagcaggagguuggggcuugagcccgucauuccggcgcacgaaaacuugaagucgcucgguagccggggaagggaaggaagagaggcaggcucuuuccuagaggugccgugaucgagggucuggcacuccaagccaacuccugagaacgggaaaugggcgggagucggugggguggagagggcagccguggucgcgagagcgaaggagcggucugagaauccggcuugaguguuaaaggcuaagcgugucuagcuggacccguggccccgaagaagcgagacaaggcgacgcggagcugucccugacaccccgaggaccgagggacagcgaagggccggggccgccggccauugccaggcgccauuaggugacgcggccgucacgcgaugacgcgcugaccggcaguggccuccacgucgcagguuccgcaaagaccugugggagcgacccgggagaaggagggccaagauggcggaagcggaggagucuccaggagacccggggacagcaucgcccaggccccuggugagcuugggaucugcgacaaaagggaccgagggugaggcagagugcccccuaaagaagucgggggacgggcucguggccugagagccggagcuccuuccgcccggcaggcccuucuuguacccgaugccagaaccagucccaacacugcaccuguucuuugcgcuaaccgcuuugcccccugcccucgugguuccuuccaggucuuuuugugaaacuccgaucuuuccuuucccauccucccaggucucgucaucguccccuacauuguguuaaauggcgaacuuuaggugauuucuuaaguuaucuuuucuucugcuguccccucauuuuaucaaaaccugucaccagccuuuguugaaggaauaaugagagauugcuucccgugggacauuaacguuuuguugcuuauaacuuuaguauugacuuguucagugaccccaguaggccagguuuaaccccugucgcagcuccuugccauucucuucaccauacuuguucuccuuucuuauuuuuuacuuuuuuaaaaaucgagacaaggucucacucugucacccaggcuggagggcaguggcgcggucucugcucacugcaaccucugccucccaggcucacgugauccucccaccucagccucccuaguagcuaggaccacaggugcgugucaccacaccaggcuaauuuuuaguauuuuuuuguagagacgggguuuuaccauguugcccaggcuggucucgaauuccugggcucaagcuauccuccugccucggccuuccaaaguguugggauuacaggcgugagccacugugcccggccaucuucacuauacucucuugcuccugucucugcaagggauagaauuuccacugcaagcccaaaguguggacaaguauuuuaagaacacaggcuuuggaguuaaacuuuacuugggauggaauccacccacuuugugaguuucggcaagucauuuuagggaggguguuucuucaucuguaaaauggagauaaaaauaccugccucaaaacaguuuuuagaaagaucaaauggcauaauuuauguaacgugucuaauacuaucaguaccaugaacugaggaguauaaugaggucaauauucugcuccugucccucuucucaauguguuuaguuauauaguaguugcucaguaaaugguucuucccuuuccucuuuuuuuuucuuuuucuuuuuuugagacggaguuuugcucuugucacccagguuggagcacaauggcacaaucucagcucacugcaaccuccaccucugggguuuaagugauucuccugccucagccuccugaguagcugggauuacaggcgccugccacuacguccagcuaauuuuuguauuuuuguagagacgggcuuucaccacguuggccaggcuagucucgaacuccugacgucaggugaucugcccgccucggccucccaaagugcugggacacaggugugagccaccgugccuggcccccuuuccucuguuuugaauuagcaacuuaacauagugaacugagcugggagaucagugaacuuaauucuaguccuagcucugcugcuuacuagcuccauuuguucaccucuucacucacucaacaaauauuuauugagcauccgcuacuauguuccaggcacuccuuuaggcacuggggauauggcaauaagagugaguuguguuaaguucuaucgugaccuugaguaaaaucaggcugaaccccaguuuccuccuuuggaaaauggugauaggaacacaucacugaauuagugagaguacuaaaugagauaauauauacauugugccuacugugacauugucauaggugcuuaguaguuuuuaguuucuuucauuuaaacuucuccaccccucuucugugaagcuuuccccaguuaacuucagugguucugaucacucauuacucaauaugcaauccgcuuccauucaacaaauguuuagugaacucccacaaugaguaaugcacugugcuaguugcuguagggaaugcaaagggccugccucuauggugcuaccagucuuaaguuuuagggauaagacaaguauacaaugcuaaaauaaggcaguauguaagagaaaguuacacaaagaauauuacagaaauuuaaaggaaaaugcuaucauguccaguuggggugaccaagcuacaugguggaaguuauauuugaaaggacuucaaaggauggguaggauuugaaauugcaagugaguauaagagcuaucaauaacugagcaccugcuacaugccagguauugugcuagacauccucugcguauuugcuacuaaacuuuacagcaaucauuucaguuagguggcuuuuaacuacauuuuaugugcagaugaggauaugacaugcagggagguuugaugauuucccuagggucuacauccaguuagugccaugcaugaaauuugaaccuagaucugacucugaagcccagacuuauauauccauuuauauauaaguggauauauccauucauauauauauagaagcgcagacuuauauauauccauuugugcuacacagccucuugugaacaaaggcacagaaguuggaaggugcuaguauauuuauagaacaacacuuuggcugaagcacagagaauuauuaggagauaagccuucagagguaagccuacugaguuagggaggcaguauggaacaguggugguuuggaauguguacucuggagucagcuugcuuagguuugauucuaagcacugucacuuaacuagugggauauuggggaaauuaccaaaccccuccuugccucaguuuccccaucuguaaaauagagauauaacaauacuuaguucauaggguuauuagguggaaugaguuaacacauuggauaaauuaacacacuuaauagaaugccuggcauauaauaaugcaauguguuauuucuuauuauuggcuacuaaccugggaggcuuaaugggcuacaaagagccaguggaaauuuuugaggagggaagaauuugaaaucaugaauuggacaacauaauagaggguaaguuacagugggggaauaucuggaaucuagagggccagugaagcuguuacaguaguucugagaagaaaugauaaggaucuggacaacagcaguggcaggagacaagaggauuugagacaaggcagaauccacgaggguuuguagcgugugaaggaggauuugucuuagaucaguauuuuccaaacuuuagugugcuagcagucaucuggggaaucuuguuaauuugcagguucugauucaguuggucugggauagggcccgagauuuugcauuucuuacagacucccuggagaugcugcugcugcugcucccaguaccacauuuugaagagcauggcuauagacacccaagaguauagugacacucugaacaaaaauagauaauauauaaggaggguuagcuggaugagggccuuaaaaguugacuaauucaguuugggacauguuuaguuugagauacuggcaggccauucaauagauauccaacaggcaguuggacuuuaaaacaugcacuucagggcgcagaagaggucuugccuagaguuguugauuuaggagucaucugcacaggguuaaaaagacagaaucuuggguaaugccuguauuuagggggcaggaagaagagauaggcuguaauaauggcugcagucuggggucuuuuuuuuuuuuuugagccggaguuuugcucuuguugcccaggguuggagugcaauggugccaccucggcucacugcaaccucugccucccagguucaagugauucuccugccucagccuccccaaguagcugggaucacaggcaugcaccaccaugugcagcaaauuuuuguauuuuuaguagagacaggguuucacaguguuggccaggcuggucuugaacuauagucugggaucuuuggaagaucucaggcuaugaggaagcuggccccaggugaaggggcuggcuggagaccaugccacuggcuaccccgucauccacuccugggagccaggccucuuugagcugauuccugcuucaugcuuccccguguugauuccuuuuuccaggauuuuggucaauaguauaacccauuugcucccagcuauuuuuuuuaggguugcagucccugcuuuuauuguguguuuuuuggcccugccucuaccuguuccccuuacuggcccaagccaggcagagcaauguucauguguguuucugugagcacaucuauauaugugcaagagccugccugcugaugggaaaggggagggacauggauccaagucgccuuucccgcugagggcuagacagagagcaggguccauuagcugagguccuggaaguccugucuuuuauacauggagcuggagggccauaguuccugacucagcucauggaacacuguugcugauucuugaagagacaaaggggagagaguaggggaucacaugggacuucagugacuacagagacuucugauaccaacuaccuggaguuaggccaaacugcacagguuaaaagcacaguccucuacaagacugcucuucagacaccagccacaauuuuggggguucccaggaccauccucacuucagagcaaguagcaacaaauucacggguucccacguuccgcucagguuuauuucuuuuuuggcacaaucucagcucacugcagccucugccuuagccuccugaguaucugggacuacagguacaugccaccaugcccggcuaacuuuuguauuuuggguagagacgggguuucacccuguuggccaggcuggucucgaacuccugaccucaaguuauccgcccaucuuggccucccaaauugcugggauuacaggcgugagccacggcaccuggcccuccccucagguuucauaauucacuagaaugacucauaggacucagaacagcacucuacuuaaaauuacaguuuuauuauagcaaagggauacaaauccaaaugugcaaaagagagagauacacagggcgaggucugacagggucccaaacacaaagauuccuugucuugucccuguggauucaagacauguuacccuccugguuugcugguaugugacaauaugcagaguauugccaaucagggaaguucacucaugugucuauaguuuuuauugggguuucauuaugauuaauuggaccauugcucacauaauggaacucaaucuccagggucccaccacucccgaaaguuugggcuuauauguugugacuuaaagccccaaaccucuagucauaugugcgguguuucugacgugguuagcccccauccugagucaucaccagaguacaaacuacguaagggccuacugugacucaccuguaagcauaaacuaccagagccccugugaauaucaaaaauacuccucugucauucaggaaauucuaaguuuagaggcuaacucucaaguacaggggacaaaggccagcuaaauucuuuauuauacaguagugacagaacuggaauugacuccaugggaaucuugaacuugagcuaacauuuauccagccccuauuguguuccuguauuaauacauuucuuccucacaauaacccugugaugaugguaccauuaucucaauuuuacagaggaggaaacugaagcacagagaggcuaaguaaccugcucagugucacauggauaguacaagauggaacugggauuugaacucaggcuauuuggccugcacucuuaaccaguauucuccaaauaccauguugagcauugaguaugugcuaggugcugugcaguguuauuuaucuuuauagcaguauuguuuccaugugagaucccuguuugacuuuaaagccuguuuuuuuccuacuguacuacaaugcuucuccuagcaguagcaggcaacagggaaacugaaaacaagcaauccuggcacuugaaagggcaguguuauaguagugaggagaaaauauggcuucaaaaaguguugguuuuggcugggcauggugccucacgccuguaaucccagcauuuugugaggccaaggcgggcggaucacuugaggucaggaguuugagaccagccuggccaacauggcaaaacccugucucuacuaaaaauacaaaaauuacccgggcaugguggugggugccuguaaucccaacuacuaggggggcugagacaggagacucgcuugaauccaggaaacagagguugcagugagccgagaucacgccacugcacuccagccugggugacagagcaagacugucucaaaacaaaccaaauggguugguuuacgcauuacaugcugcagaguauucaaagagagugaggcuugaaugcagauccuuguauuucuugauuaugugaggcuacuuuuggagagcacaaugucaguaaaguggugagaaggccaaugccagauuacagaggauuaagugcgaaaguaaaguuugaucaagcaagagaaggagaguaguuugagagaauggcagaaacaagggagugauguauuuuuaaauuuuauuacagaagcuuucaaauguguaaauaaaaugaagaguagcauaaugaaccucauauaccuaucaacauucuauuauuuuauuggucucaccacauuuuuuuuggccuuuuuauuuaaaacuaauuuuaggcauauagaaaagugcaaaaauaguagagagagugccuguauucccuucgcccagauuccucuaaugcuaacguuguacauaagcauaguacacugauaagaaccaagaaauuaacauuaguaaaacacuauuaccuauagaccauauuugaauuuuagcagguuuuccacuuauggccuuuuuuguuccaagaucuuaucuaggaucccacauugcauuuaguuguuauuuuuccuucauuucuuccagucuguaaugguucuucagucuuuucuuaucuuucauaaucuuuucugaguauuuuaaagcaaagcccagacauaucaucuucauuuguaaauacuucccuacguuucucuaacagguaaggacuuuuucuuuguuaucauacauaacaaaacuaauaauaacugcacuccagccugggcaacagagugagacuccauuucaaaaaaaaaaagaaaagguaaauuggauccccauauacaccuucaacaauuaucuacuuacgaugaaucuucuuucuucuacagcccuaccuacuuucuuuauuauuuugaagcaaaucccaggcaucauuacauuaguaaauauuugguauguaucucuaaaagauaaggauucuggcugggcacgguggcucauaccuguaaucccagcacuuugggaggccgagaugggcagauugcuugagcccagagguucgagaucagccugggcaacaugacaaaacccugucucuacuaaaaauuuaaagaguagccuggugugguggcacaugcuuacagucccagcuacuugaaaggcugagaugggaggauugcuugagccugggagauugaggcugcugugagcuaugaucauguuauugcaauccugccuauaugacagagcaagaccuugucucuaaaaaaaaacaauaaauaaauaaauaagaaauuuuuuuuugauuuuguauuauuuuagaguugccuucuugcuauguugcccaggcuggagugcaguggcuguucacagucgugaucauagcacccgcagccuucaacuucuggccugaagggacacucucaccucagucucccaacuagcuggaacuauaggugugugccacaguucccaaauuagaauucugcuuuuaaagagaacauaaccacaauaacauuaaugcauguaaaaaauuaauaacuucuuaauauaucucaggguucaaauuuccaauuaucuccuaaauuauauuuuuauaauuuaaaaauuggcccacugccuguuuuucuaaguauaguuuucugggaacagagcuacacuuauuuauuuauguguuaucuuuagcugcuuucaugcuacaauggcagaguucagcaguugcaacagaaaccauauggcucucaaaaccugaaauauuuacuguuugacccuuuacagaaaguuuggugaccccugcuuuaggcaauuaucuuuuagaauaauuaaaaauaggaagaaaugucauauuuacuuucauuuuaacuaauuugggagaucauuuauuuauguaaauccaaguuuccuucugauaucauauuccuucuuccagaggaacuuccuuuagcauuucuuguagaauauauuuuagcuuuugcuugucugaaaaacguuuuuacuuugacuuuauuuuuaauaguuauugcuggguuuagaauucaguguugauaguuuuauucuuuuagcacucuaaaagugucccuccauuuucuuuugguuugcauaguuucuggugagaugucuuucuuuguuuauuuguuuguuuauauuuuguuagagaugucuauuauaauuuuuuuuuuuuuuugagauggagucucgcccugucacuuaggcuggaaugcuguggcauggucuuggcucacugcaaccuccgccuccugaguucaagcuauucuccugucucagccucccaaguagcugggauuacaggcaccugccaccaugcccagcuaauuuuuuguauuuuuaguagagaugggguuucaccauguuggccaggcuggucuugaacuccugaucucaggugauccaccugccucggccucccaaagugcucagauuacaggcgugagccaccaugccggccuuuuauugugauucuuaucuuuguuccuguaaaugcaaugccuuucucuuuggcuacuuucaagauuuucucuuuaucuuugguuuucaauaguuugugucuagguuuguggauuuuuucauuuuguccuuugguauucaucuugauugggguucucuuggcuuguaucugucauuugaugucucauuauuuuuggaaaauucucagcuauucuuuuuuuuuuuuuuugagacagagucucacucuggaguucaguggcgugaucuugggcucugcaagccucgaccuccugggcucaggugauccucccaccauagccuucugaguagcugggacuagaggugugugccaccacuccuggcuaauuuuuaaauauuuuuuuguagagaugggguuucgccauguugcccaggcuggucuggaacucccuggcucaagcaaucugucugccuuggccucccaaagugcuaggauuacaggcaucagccacugcgguuagccuauaucucuucagagccauuaucuuucuauucuucugggauuccaauuauuuacauaauaagaccauuuaauguuuucccauaguuccuagauacucuauucuuuuuucuuuucuucuuuuacucuucuccuuuuguuuuaguuugcauaauuuugacugaccuagcucugaauucuuucuuugguauugagguaacugauaaggcuggcaaaggcauucuuuaucuguuacuauguucauguauuucuagcauugccaucugauucuuacaguuuccaucucuuugcagaaauucaucaucauucaugcauguaccuuuucuacuagagccuuuugcauauuaaacauaguaaucuuaaauuucuuuucugauaauucuaacaucuuggucaucucagagccugguuuuguuaauugcuuugucucauaguggguuguuuuuucaugugaguaugggggagauaauuuguuauugauauugaacgcuggacaucauguacacacugcuagaaguggcacaucucugcugcugaguugucagucaguagggguuaagucagucuagucaggguugagcuuuguuuguuuuguuguuguuguuguugcuaugguuaccuucagugcaucaccagcuucagauuccucuguuguuaccuugaguuuaggggugggggugcuauguugucccaguguuuuguuuuuuguuguuguuuuuuuuuuuuugagacagcaucucacucuguugcccaggcuggauugcaauggcgugaucauaucuuacugcagccuugaccuccugggcucaagugauccucccacuuuagccuccucaguagcugggaccacaguuaguugcaugccaccaugcccaacuaauuuuuuaaaaacauuuuuuguagagaugggggucucacuguguuacccagacuagucucaaacuccuagcaucaagcgauucuccuaccucagcuacccagaguugggguuacaggcaugagccacugcacccagccccaauguuuuuauuaauguucauguucuguacucagcuucugucuuugcccuugcaucucauggugagucucuuucuaagcucuagcacuuccuccagcaguagacugcuguuguuuauuacuccauacuugcuagccuggugauaggggccagggaaaggggauucuuuguuuucauagucuagucucugccuuaggcagaccaugugucccugggucuccuggguagcacuuucuuagugauccugucccccuccuagcugaaggaaacucuuaauggucugggcccaggaugguuuucuguccaucccuuaguaguagagagcuuuuccuuuucccuuucuccagcuucagugaguugucaccuguguucugaaggcaacuuguuuuugucuaaguggcuuuaaggcucuuuccucuaggggcuuuuuucuagagaagagccuguaagugggugugaacuccccuugcgucuauugcuuccagggauucuguacucuugugcugauccauacuuggacuuuagcaauuuauuuaaaauuuuauuugaauucuuacccaucugugugguguggugugcagcauugucuuccccucaugcuuugcuacuguugagccagugcugaugucucuucguggaagcaccuggcuuucuuuagauuucauccaggcuacuuggucucccuacaacucaguucucagaugaauucagggaaaguuaugauucaguaaaguaucuagccuuuucucauuauucuacuuggggaauggucuuuccagcuuccuauaucuuaaucagaagucaaauuacaguguuauauagucacuugaaauaggugcuaucuuugugguuguguguuuauuucaauacaugguaguuucauugguuuaauuuuuucucucaguuucagggauugcuuccuucaaauuuuaauuuuguuuaauaauugugugaaguguuuauaugauugcaagucauuuauauggacaacauauauugaaaaaagccuaguuucucucccugucugcucuauccuauuccuuucuuuccucuauaagaaaccuuuaaaaaaaaauucuauggcauguuucuuauauuuaagaaauaugagugugguuaagaaauuguuuuuguuuuauuuuauuuuauuuuauuuuauauuuuauauuuuauuuauuuuauuuauuuauuuauuuguuuauuuuuuguauuuuuuuguauuuuauuuuauuauaacggaguuuuguucuuguugcccaggcuggagugcaauggcgugaucucggcucaccgcaaccuucaccucccggguucaagcgauucuccugccucagccucccgaguagcugggauuacaggcaugcgccaccacgcgcagcuaauuuuguauuuuuaguagagaugggauuucuccauguuggucaggcuggucucaaacucccgaccucaggugaucugcccgccucggccucccaaagugcugggauuacgggcaugagccaccaugcccagccuuuuacaaauucuuugaacauccucauuccuucuaaaauuucaguauacugucugcauuucauuuaucugcaacuguugcccauuaaaaauugugccuacugggccaaaaacuguaugagaagucauugccucuauuuucuuaggaauuuguagauuugaguuuugguuguaauaaaauuugacggaugugaacauccucauucuuucuaaaauuucaguauacugucuuguguuuccuuuaucugcaacuguugcccacuaaaaauugugccuacuggcccaaaaacuguaugagaaggcauugccucuauuuucuuaggaauuuguagauuugaguuucgguuguaauaacauuuggcagaugacuaugaauuuaaaaguucacauucuuuauucacuuugaaaauuuuauuugcucugugauugccagguaaccuguaaagacuguaaucaagguauauuuugcuauuucccuguuucccgcacuugccuuuaugguucauguaaugcucauuuuuagccagcagaggccacuagagccuguuagggagcagaagugcaacagaaacguggccauucuaagacagugauugcuaaaaggucacuuuuuaauaacuuuacaauuauuaucucagucuugcuagcuugugccaugugaagauuuuaugcuaaauguuggugggcaagaaggugucuaugacauuuacuuuaguuuuuucauuauguuuaaucuuuaaagaaauaaauuugaggauuauuguuaacugcauuguguaaugucuguugagcuaacaccuacuuuccuauguaaaacccuacaaaauacauggucccaacucucuaggaaaugaugauauauaugaggaaugcuacaguuuauuacaggcuuacuuuuuuuccccugacucuucucaguuugcaggccuuucagauauauccaucucacaagacauccccguagaaggagaaaucaccauuccuaugagaucucgcauccgggaguuugacagcuccacauuaaaugaaucuguucgcaauaccaucguaaguuagacuaguugagagaacuucuguucaguaucaugggacuaaguaacuaauaguacuuugcaauauuuucauuugguucacugauuuugaauauauuuuauauacugaaguuuaauauuuuauccuagagauuaauuugguacagccuuuuuggagagcaguuugguuauaaugcauauuaauaaucuuaaaacagcaaggugcgguggcucgcgccuguaaucucagcccuuugggaggccaaggcaggcggaucaccugagcucaggaguucgagaccaaccuggcccagauggugaaacccccaucucuacuaaaaauacaaagauuagccagacaugguggcauaugccugaaaucccagcugcuugggagacugaaucgcuugucuccgggaggcugagguugcagugagccgagaucgcaccacugcacucuggccugggcgacagagcaagacuccaucucaaaaaacaaaaaaaaggucuuaaaauguccaaaucuuuuuaaaccaauauauuaucauacuucuccaaauguaguauaaggaaaguuuuaaaauguaaaacaaaaauuuucaacauuaaaguaucaauauacaaagauguuuauuauagcauucuuuguaauaggggaaagcuagaaauaaaugaaccacagaugagguauugguuagguaaauuauguuauaucuuuguggugggaugcuaagcaacuauuauaaauuauguuuacaaaguguuuaauaacggguaaaauucuaggugaaaaaauuaaaacagaauuagcucaguggugcuuugagagguuguauuuguauuacugaacccuucuuccaguuucuugauuuuuuuuuuuuuuuuguaucuggcaucuaggauucauuuaccaauuaaauugggaauguuaaaaauuuauuucauauauugcaaagaauguaguagcuagagagcaggcuaauugguccuuggaaccucaucuucuaugaacugaaugucacauacuguguuuuguagagcagcuuuuuauaguacaauuguuuuaguuucuuuaagcagccuauugggagggcuguguuucuuuuuuauggauuuuuucaacaucaaaacagaacagaucaaaacagauguggaaagguguuaaaaguuggcuuaagaaguuaauagaaaaagcauacccuaccucucugguuuguuuguguagugaaggaguugaacuggaauuaucugcaaaauucagugaagaguucacaggagauugaaaugaaagaaauuuuagcaaauuaaguaaggcugcuggcaaccuuggucaucacaauacaacaaguuguuucugucuuucagaugcgugaucuaaaagcuguugggaaaaaauucaugcauguuuuguacccaaggaaaaguaauacucuuuugagagauuguaaguauaugagguuuuuaaggguuugcuuaaucuaucucacuguaccuuaucguaaguacuuuauaaggcaaagucucugugguaauaaaacugacaucauuuuguaggauaaaaaaauauguaaacgaauauguaaaucaaacuucuggcagaaauuaaaaauugauuuuauuuuauuuuuauuuucauuuuuuuuugagacagagucucacucugacuuccaggcuggagugcaaugguaugaucuuggcucacugcaaccuccgccuccuguguucaaguaauuuucaugccucagccuccugaguagcugggauuaaaggcgcccaccaccaugcccagcuaauuuuuuuguauuuuuaguagagacggauuucaccagguuggccaggcugguuuccaacucccgaucucaggugauccacccaccucggccucccaaagugcuaggauuacaggcagacauuaaaaauuuagauuggaaucucagagauugaaacauuuugcuuauuauauuguccucaucaguaaauguacacuggccaggcaugguggcucauacauguaauaccagcacuuugggaggccgaggcaggagaauuguuugaacucaggaguuugagaccagccugggcaacauggcgagaccucauuucuacuaaaaauaaaaaaacuagccaggccugguagcacaagccuguaguccuagcuacuugggaggcugaggugggaggauugcuugaguccaggagaucaaggcuguagugccgugacugugccacugcacccuagccugggugacagagugagaccugucucaaaaaaaaaaaaauauauauauauauauauauauauuuuaaaaaaugcucuagugguuacuacaaaauacauuucuggaggcugcuaauuuacaauauuuacauuuauuacauaauauuccuggaagcugcugacacauaaagaguuaaugaucuccaagggaaaggcaaauguuuaaauuuuuguuuguuaguuuuuugagauggagucucgcucuguugcccaggcuggagugcaauggcacaaucucagcuuacugcaaccucugccuccaggguucaggagauucuucugccucagccucuggaacagcugggauuacaggugccccaccaccacauccagcuaauuuuuguguuguuaguagagacggguuuugccauguuggccaggcuggucucgaacugcugaccugaagugauccaccugccuuggccucccagagugcugggauuacaggcaagagccaccaccccggccuaaauguuaaauuaauaugauaguaaauacccguaaacauuuaacaaauuaauaguaccuuuauugacaguuugauuuucaagccuaucauuuagucugaugacugcuuucuuuauuagaguucugucaaaacagacagcgucucauucuguuacccaggcucaaaugcaauggcguaaucauagcucacugcagucucaaacuccugggcucaagcaguccuucugccagucuccugaguagcugggacuguaggcacacauggcuaguuuuuaaauauuuuguagagaugggggucucccuauguugcccaggcuugucuaaaacuccuggccuuggccgggcgcgguggcucacgccuguaaucccagcacuuugggaggccgaggcgggcggaucacgaggucaggagaucgagaccauccuggcuaacacggugaaaccccgucucuacuaaaaauacaaaaaauuagccgggcgugguggugggcgccuguaaucccagcuacucgggaggcugaggcaggagaauggcaugaacccaagaggcggagcuugcagugagccgggauagcgccacugcaguccagcuugggcgaaagagugagacuccgucucaaaaaaaaaaaaaauaaaaaaaauaaaaaaauaaaacuccuggccucaagcagucugcccaccucagccuccuaaagugcugggauuacaggcaagagccacugcccagccaauguuuuauuuuuucaacuuuuuguuaaaaacuaagacaaaagcacacacuuuggucuaggccuucacagggucagaauuggaucauuaguacaauugucuuccaccucuguaucuguccuauuggaaggucuucuggggcauuaacacgcaugaaacugccaucuuugaugauaacaaugccuucuucuggaauaucuacugaaggaccugccugagacuguguuaugguugacuuuuuuuuuuuuuagagacaugaucuuguucugucacucaggcuggaaugcaguggugugauuauagcucacuguggccucaaacuucuaggcucaagccauucucccaccucaggcucccaugcccggagccugugccaccaugcccagcuaauuuuuaaauuuuuuugucugggcacgauggcucaugcuucuaaucccagcgcuuuggcaggccgagguggguggaacaccugaggucaggaguuccaggcuagccuggccaacauggugaaacccugucucauuacaaauacaaaaauuagcuaagcgugguggcaggcgccuguagucccagcuacuccggaggcugaggcggaagaaucgcuugaacccgggagguggagguugcagugagccaagauugcaccauugcacuccagccugggugaaaagagggaaacucugucucaaaaaaacaaaaaacaaaaaacaaaccacauuuuuuuagagacagggucuugcuauguuacccaggcugaacuuuuuaaguagaaguauacuccaacauaacaaugaaaaguauaauauaguaaacacguaaaccacaguaacauagucauuuuuugucauuaucaaguagaguauuauguaguguacauaauuguucuauauuuuuauaugacugucaacauacuagguuuguuuauaccagcaucaccacagacacgugaguaauguguuguacuagaugucacuaggugauaggaauuuuucagcuccauuauaauuuuaugggaccacuaucauugaccgaaauaucauuauguggcacaugacaguacacuugaauucaguuuuuaaguugagcaguuaaaaaaaaauuaaugaaauuagcagcaguuuuauuagaagugguaggauuaugguuuuuuaugucuuuuccaaacuuuccacaauggugucaaaauuacuuauacaauuaaaaaauaaacaauauuaaguauauaaauuugcguaccucucuuggguaagguuauauacaugugagguuaaaguucgauguggaauauuugccuuuuuggaaugaauugaggaagguaauugugcucuaagcuaugugcuacugaacuguuggcaugcaaaucacucagcagcuuuuuuuguuuguuuuuuugagacagagucuugcucugucacccaggcuggaguguagugaguggagguugcgaucuuggcucacugcaaccucugccuccuggguuuaagggauucuccugccucagccucccuaguaggugagauuacagguaugugccaccacaccuggcuaauuuuuuuguauuuuuaguuagagacgggauuucaccauguuggccaggcucaucucaaacuccugaccuuaagugaucuucccgccucagcuucccaaagugcugggauuacaggcaugagcuaccgaacccgaccaaaucacucagcagcuguuuuuguuuguuuguuuguuuguuuuugagacggagucuugcacugucacccaggcuggagugcaguggcacaaucuuggcucacugcaaccucugccacccggguucaagcaauucccaugccucagccucccaaguagcugggauuacaggcacgugccaccaugcccagcgaauauuuuguauuuaauagagaugggauuucaucauguugcccaggcaggucucaaacuccugagcucaggccauccgcccgccucggccucccaaagugcuaggauuacaggcgugagccacagcauccagccugcagcuuuugauugaggaccauguuugcuagaccugauguuggcagagccugcagagccuuuugcaguuuucagaaagcuuucauauguuauuaaaguuuaaccuugugaaauuaccaauacugggcuguuuuuucaccuagaagaauagcaacucuauauuaauucaauauacuaauuauaaaagggaagcaguaugacagaguggcaagaacuuuggucuaagaaucaaaagaccaggcugggugugguggcuuaugccuguaaucccagcacuuugcgaggcugaggcagguggaucgcuugaggccaggaguuugagaccagccugggcaacauggugaaacuccaucuguacaaaaaauaaaaguuagcugggugugguggcgugugccuguagucccaauuauucaggaggcugagguaggaggaucaccugagccugggagguugaggcugcagugagccaugaucgcaccacugcacucuagccugggcaacagagugagacccuguuucaaaaaaaaaaaaaaaagaaaagaaucaggccaggugcgguggcucacgccuguaaccccagcacuuugggaggccaagguaggcagaucaccugaggucaguucgaaaucaugcuggccaacauggugaaaccccgucucuacuaaaaacacaaaaauuagccaaguaugauagcgggugccuguaaucccagcuacucgggaggcugaggcaggagaauugcuugaacccaggaggcagaggaugcuaugagcugagauugcgccauugcacuccagccugggcaacaaaagccaaacuccaucucaaaaaaaaaaaaaaaaaucaauagcccuagguucuggucccaccuccacauauaaagcuaggcaagucauuuccuucucagcuucauuuuuuguauuugugaacugagcaugauuauacuugccuugucuaaugcagucucugacugguaaagugccuuggcuauagucuuuuuuucuuagaauaugggguagggaaccuaggucugcugauuguuuguccauuggucuuuaauuauagcgugccagcaugugucuuaguagauggggagaaggaaagggugauuugugggauaugaaauaagcgaaacuggaagucuauguaaagaagugcauucaggauuaggggacagggagggcagguggugggagaggagagguaggaaggcuuggccagccaaagagagccuugaugucugaauucuaggagggagagagguagauauuagaauaaagacagaaaauauuaccuucgcuucugucuuuucuugucuuguaggggauuuguggggcccuuugauccuuugugugacacucgcauuguaaguacuugcauuuucuuucuuugucauuugagcuagacuagacuuuuuuguggauuuccaaaauugugggggauuuugauugaauauuucauuuaggacuuauaugacauguuguacauguuauacuccuuagguauuuaagccucuaaagucacuuuccaaaucaauuaaaauaugaugaaauuaggcucaccuuccuuaaccaaugacauuuuagucuguuuuagccaugucuauucaacaaacauuuauuuacuuauuuacucuccuguuccucccuauuauuaaacuaagugaauuaagguuuaagcacccuuuguuugcaaacauaauucucuguaaucuuacuaaaaauaugaaugagaaugagaauaaauuaggagaguuaaaagcaagaucauguuucagaguguuguacuuuuccauacacauuguagguaaaggaagaggacggggaaggagaagaagguuacacuagagagaugaauauaaccauugauagagcgggaaaaaauacugcccuggaauucaguucugaguucgcauucugacucugcugucagcuagcuaugugacuuugggcuacuaauaaccaauguuuguauaauuuuucccaguuugcagaaaacuuuaaaauacuuucucuuauuuuaaccucauugcaauaauuaaaauuauuuuauuuuucuuuuuuuuuuugacaaacaagcucagguucaaaaagguugaggauuuaaccaagaucacauaaucagugguagaccugagauucaaccucagguuuccucacuaccuauuuuguaccucuaggguucauuacacaucucuucccaccuggucacucugggucgccucuuccauaucuguaaagggagugguugaggguccuuuccaggcuuaacccuuuaugggucuaaauucacuaaguuucuugcugaccucucuaauuuuuuaaauuuaaauugagcauauauuaauuuagguaauaauguagaguacuauuucuuaugcuuuuaguaaccauguuaagggaugcagccuaaugccuugauggagggguuuauauuagaugucccgagcauauauauuuuuuuuacuuuugaaaguuuaaccuuauagauuauguaguuuaaccccacuuaguugcagagaaaacuggagucccaggacaucaagugacauaucuagugacagaauuaggaucaguaucugggucucuugccuuccaggcuaguuaauauucuuuccaucauaccaugcugaagcaacagggauuccagacaacaagugaugagugcuggccauucuuugcaucugguugucacgacuuggaauggaauaugcauaucauagaauacaaaagccugugcauacugccaaguagcauagcagggcaagaaagacuuacagugugacuucucuauacuguuuaauaagaagagguugugagcuuacaguuauuauuuuucuugguaauaacaccaaguccaaauauucaaaacaguuuauaucuguaaaauucuuagacaaagaaaggauauuuaagugguuguucaacuacucaauuccaaagcaaaacccuuuaguaauaaucuguauguuuugauuuuuuaaaaaucaacaacuaaaaagguuuauagacuguuuccauuuuuauuuauuauuuuuauuuuguuuugaggcagucucacucaguuacccaggcugaguugguggugugauuacagcucacugcagccucaaccucccaggcucaagcgauucucccaacucagccuuucuaguagcuaggacuauaggcguguaccaccauggccaacuaauuuuuuauuuuuuguagagacggggguuucgucauguugcccaggcugguaucgaacuccuggccucaagcgaucugccugucguggccucccaaagugcugagauuacaggcuaagccaccauaccuggccuauuuccauuuuuaaauaucucaacugaaaucuuaacccaagaacuacaaauucugaugugucuaaaggcuagaauaguaaccuaaaugcauguaguagugauauggugacuguaagccccuuguacuuaugucaguuacacuugauuguugcaguguuggaaugcaggcucaauguuagaaagucuaacaguuuuuucaagaaaaucuagaaauucauauucuuaugugaaauaaaauagugucaacuuaaauucaaaaucaucuuaaauauuauauaagcccaaggccucauuauauaugagccacauuugacccuucaguuuauaaccucugcuuaaaaaaaaggucuucaauaauucauuuaaacauuucaacaaggucaaauggagcaccccuuguaguccugaggcauuuggaauuugcaguaagggagccuugccaaaugcuugugucauuuuccuuuuagcacaaccuacauauuacagaucuucaggugagguauggcacagcaaucugauucaaaguuugagaacccaugccuuaacuuuguugcccuaaguaaaagauuaagcaauucuuacgcuguuuccuuuucucagaaugcugcaaagagacucugcagauagugaaaaagauggagggccccaauuugcagagguguuugucauugucugguuuggugcaguuaccaucacccucaacucaaaacuucuuggagggaacaugugaguauuauuaaaaugcauucuuuuuuuccucuugccagguaguauaucuuagauuaaggaauacaggcuagcuagauuuuuuuuuuuuuuugagacagggugucacucugucacccaggcucgagugcauuggugugaucauggcuuacugcagccucuaucucccaggcucagcgucccaaguagcugggauccuccugccccagcaucccgaguagcugggacuacaggcaugugcuacuaugccuggcuaauuaaaaaaauuuuuuuuuuuguagagauggggucccacuguauugccuaggcugguuuugaacuccuggguucaagugauccucccaccuuggccucccaaaaugcugggauuacaggcaugagccaccauaccuggccucauauuuuguuuuaaagaaaaaucaaacuaaauaagggccaaagagaaguguucuuaaaaccacuaccacuguacagagauaaccuuguuaaguuaaauuaucuuaaauuaucagagguccuuugauaagcuucagaugcccuuuccaggcccugaaaucauaggcagacuuuuuuguguaagaagaguauguacguuuuggggggcaaguggucccuagcuuuuaacaaauucucaaguauaauaggucuauaaacuagaaaggauuaagaaccacuaccuuagagguucagagaaagauaucuguaggaacuagagcagaucaucugguguuagaugauugacuuuuaaggaauuugagaggagaggaggaagaguauggggaaagaaaauuaaagcauguacuuaauuuuuuuuuuuuuugagauggagucucgcucuguccaggcuggagugcaguggcacaagcucagcucacugcaaccuccaccucccagguucaagcgauuuuccugccucagccuccugaguagcugggauuacaggugccugccacaaugcccggcuaauuuuuuuuuguauuuuuaguagagacgggguuucaccauguuggccaggcuggucuugaacuucugaccucaggugauccacccccccacccuuggccucccaaaguguugguauuacaggcgugagccaucgcgcccagccaaaagcauguacuuaauaauuaauguuaggauguagauguuauguaccaagaaggaggcaacauuccguuacauagagaaaucuauguaauaagcugugucauaacacccaucaguuguauuuaugaucuuuauuaauguauuuuguuuuuaagaucuuuuuuucagagccucugugugcuggguuacuguauacuucccuugacaguagcaaugcugauuugccggcugguacuuuuggcugauccaggaccuguaaacuucaugguucggcuuuuuguggugauugugauguuugccuggucuauaguugguaaguauguacuuauuuccacaauaacagaacagacaaaaacaugauuuaaugaugaagaccagaugaggagcaguauaaguccaaaguuagaugugagugauaugauucuugauaguauuauccauagaacccucuucccugaguaggcaaugauggggcuuaucugaguuggauaucuggacuuauaagauguggagagucacaucuuuuuucuuucuuuaaaaaaaaaaaaagguugggaaaguggauuacacuacauuuagccuaguccugguauauacaaggcauuaggugacuuguggaaugacugggaucuuuuccugauaaacuaauuaaaauaaaaauaauaacauuuacagauugcuuaucaaaggccaggcacuguuuaagugcuuuauauauauuaucccauuuaagccucacagcaacucuaauagagaaauacuguuauuagucccaucuuacagaugaagaacaguuacagagaaguugagcagcuugcccuagguugcauuacuugugaguaagagagucaaauugcaaaccaggcagucaugaaccuuuaagaacuauacuauaccaccuuccaguguagauuguaaguaucauuauauagcacuuuucugcuucaguagaacauuuugcuaaagacuaggaagggccuauagcaaugauaaugaaugcuaugugcucauuguuuuuauauuccuaaaguucucuuaagauuccagcuuaaauuuagaaguguucacuagcuucugcuuuaauggauaggcagacugcuuaauauuuuuaaguguaguaacaucucauugcucuggaacaugguugaaagcuaagaaguaauccaacaaaggucugagagagccagaacugauauuccaaagacuguauauuaagcuugggugcuuuucccauggggagagccccucauucucucacugagaaucucauaauuaccauaaauguaauuauacuuacuuaguuauccaguguccaggcucacaggugaucacgaaguagaaucauaggagagagaaacuuuaauucagcaaacauuaaucacaaacuaugcgucaggcauaauuuuaggcauggucuuuguccuuggaguucacaaucuaacagagcagcccgacgugaaaacauuuaaaggcaauagguguucuaagugggaaauggagauuuauacacaguacagugggacagacaugauuauucaggaaagauuucccagagaugugaugaugaugaugauuaguauuugagacagagucucacucugucacccaggcuggagugcaguggcacuaucucggcucacuguaaccuccaccuccuggauucaagcaguucuccugccucagccucccgaguagcugggauuacagcuaugugccaccacauccgauuaauguuuguguuuuuaguagagaugggguuucaccauguuggccaggcuggucucgaacuccugaccucaggugauccacccgccuuggccucucaaagugcugggauuacagacaugagccaccgcaccuggcugauuauuuucauuuauuuauuuauuuggcuaaaaauauauauauauauauauguuuuuauauuauuauuauacuuuaaguucugggauacaugugcagaacaugcagguuuguuacauagguauacacaugccauggugguuugcugcacccaucaacccaucaucuacauuagguauuucuccuaaugcuauuccuccccuagcccccccagccucugacaggccccagugugugauguaccccucccuguguccauguguucucauuguucaacccccacuuaugagugagaacaugugguguuugguuuucuguuccugugguaguuugcugagaaugaugguuuucagcuucauacaaaggauaugaacucaaccuuuuacguggcugcauaguauuccaugguguauaugugccacauuuucuuuauccagucuaucauugaugggcauuuggguugguuccaagucuuugcuauugugaacagugcagcaguaaacauaggugugcaugugucuuuauaguauuacccaguaaugggauugaugggucaaaugguauuucugguucuagauccuugaagaaucgccacacugucuuccacaaugcuugaacuaauuuacacucccaccaacaguguaaaaauauuucuauuucuucacauccucuccagcaucuguuguuuccugacuuuuuaaugauagccauucuaacuggcgugagaugguaucucauugugguuuugauuugcauuucucucaugagcagugaugaugagcuuuuauucauauguuuguuggccgcauaaaugucuucucuugagaagugucuguucauauccuucgcccacuuuuugaugggguugucuuuuucuuguaaauuuguuuagguucuuuguagauucuggauauuagcccuuugucagauggauagauugcaaaaauuuuuucccauucuguagguugccuauucacucugaugauaguuucuuuugcugugcagaagcucuuuaguuuaauuagaucccauuugucaguuuuggcuuuuguugcuauugcuuuugguguuuuagucaugaagucuuugccuaugccuauguccuaaaugguacuaucuagguuuucuuguaggguuuuuaugguuuuagguguuacauuuaagucuuuaauccaucuugaguuaauuuuuguauaagguauaaggaaaggguccaguuucaguuuucugcauauggcuagccaguuuucccaacaccauuuauuaacuagggaauccuuuccccauugcugguuuuuaucaggcuugucaaagaucagaugauuuuggaugggaggcauuauuucugaggccucuguucuguuccaucggucuauauaucuguuuugguaccaguacugugcuguuuugguuaccauagccuuguaguauaguuggaggucagauagagugauaacuccagcuuuguucuuuuuguuuaggauugucuuggcuauaugggcucuuuuuugguuccauaugaaauuuaaaguaguuuuuucuacuucugugaagaaagucaaugguagcuugacggggauagcauugaaucuguaaauuacuuugggcaguauggccauuuucaugauauugauucuuccuauccaucagcauggaauguuuuuccauuuguuuguguucucucuuauguccuugagcagugguuuguaguucuccuugaagagguccuucauaucccuuguaaguuggauuccuagguauuuuauucucuuuguagcaauugugaaugggaguucacucaugauuuggcucucugucuguuauugguauauaggaaggcuugugauuuuugcacauugauuuuguauccugagacuuugcugaaguugcuuaucagcuuaaggagauuaugggcugagacgaugggguuuucuaaauauacaaucaugucaucugcaaacagagacaauuugacuuccugucuuucuauuugaauacccuuuauuucuuucucuugccugauuucccuggccagacuuuauguugaauaggagugguaagagaggguauccuugucuugugcugguuuucaaggggaaugcuuccagcuuuugcccauuaaguaugauauuggcuauggguuugucauaaauagcucuuauuauuuugagauacguuccaucaauaccuaguuuauugagaguuuuuagcaugaagcgguguugaauuuuaucaaaggccuuuucugcaucuguugagauaaucaugugguuuuugucauugguucuguuuaugugaugaauuacguuuauugauuugcauauguugaaccaaccuugcaucccagggaugaagcugacuugaucaugguggguaagcuuuuugauaugcugcuggauucaguuugcaaguauuuuauugaggauuuucacagugauguucaucaaggauauuggccugaaauuuucuuuuuuuguugugucuuugccagguuuugguuucaggaugaugcuggccucacgaaaugaguuagggaggaaucccucuucuucuauuguuuggaauaguuucagacggaaugguaccagcuccucuuguaccucugguagaauuuagcugugaaucuggcuggucaugggcuuuuuuugauugguaggcuauuaauuacugcuucaauuucagaacuuauuauuggucuauucagggauucgacgucuuccugguuuagucuugggagggauuauguguccaggaauuuaucaauuucuucuagauguucugguuuauuugcauagagguauuuauaguauucucugaugguaguuuguauuucugugggaucaguguugaucuucaauuuaucaguuuuuauugugucuaucugauucuucucucuuuucuucuuuauuagucuggcuagcggucuauuuuguuaaucuuuccaaaaaaaacaguuccuguauucauugauuuuuugaaggguuuuucuugucucuaucuccuucaguucugcucugaucuuaguuauuucuuaucuucugccaguuuuugaauuuguuugcucuugcuucucuaguucuuuuaauugugauguuagggugucaguuuuagaucuuucccgcuuuguccugugggcauuuagugcuauaaauuucccucuaaacacugcuuuagcucuguugcagagauucugguauguuccgucuuuguucuuauugguuucaaaaaacuuguuuauuucugccuuaauuucguuguuuaccuaguagucauucaagagcaggucguucaguuucuguguagcugugcgguuuugagugaguuucuuaauccugaguucuaauuugauugcacugugaucugagagacuaugauuuccauucuuuugcauucuguuguuaugauuuccauucuuuugccuuuguugaggaguauuuuacuuccaauuauguggucaauuuuagaauaagugugauguggugcugagaaaaauguauauucaguugauuugggguagauaucuuuuagguccauuugguccagagcugaguucaaguccugaauauccuuguuaauuuucugucucgucuaucugucuaauauugacagugggguguuaaagucucccacuauuauugugugggaguauaagucucuuuguaggucuuuaagaauuuguuuuaugaaccugggugcuccuguauugggugcauauauauuuaggauaguuagcucuucuuguugcauugaucccuuuaccauuauguaaugcccuucuuugucuuuuuugaucuuuguugguuuaaagucuguuuuaucagagacuaggauugcaaccccuacuuuuuuugcuuuccauuugcuugguaaauauucuuccaucccuuuauuuugagcuuauaugugucuuugcacgugauaugggucuccugaauacagcacacugaugggucuugacucuuuauccaauuugccagucugugucuuuuaauuggggcauuuagcccauuuguauuuuagguuaauauuguuauguguaaauuugauacugucauuaugaugcuagcucguuauuuugcccauuaguugaugccauuucuucauagugucgauagucuuuacaauuaguuacguuuuugcaguggcugguacugguuuuuccuuuccauguuuagugcuuccuucaggagcuauuguaaggcaguccugguggugacaaaaucucucagaauuugcuugucuauaaaggauuuuauuucuccuucacuuaugaagauuaguuugucuggauaugaaauucuggguugagaauucuuuucuuuaagaauguugaauauuggcccccacucucuucuuguaggguuucugccgagagaucagcuguuagucugaugggcuucccuuuguggguaacccgaccuuucucucuggcugccuuuaacauuuuuuccuucauuucagauuggugaaucugacaauuaugugucuugggguuguucuucucaaggaauaucuuugugguguucucuguauuuccugaauuugaguauuggccugccuuccuagguuggggaaguucucuuggauaauauccugaagaguguuuuccaacuugguuccauucucccugucacuuucugguacaccaaucaaagguagguuuggucuuuucacauagucccauauuucuuggaggcuuuguucauuccucuucauucuuuuuucucuaaucuugucuuccuacuuuauuucauuaaguugaucuucaaucucugauaucuuuucuucugcuugaucgauucagcuauugacacuuguguaugcuucaugaaguucucaugcuguguuuuugagcuccgucaggucauuuauguucucuaaacugguuauucuaguuagcaauuucucuaaccuuucuucaaggugguuagcuuccuugcauugcauuagaacaugcuccuuuagcucagaggaguuuguuauuacccaccuucugaagucuacugucaguucgucaaacucauucuucauccaguuuuguucccuugcuggcaaggaguugugauccuuuggaggagaagagacauucugguuuuuggaauuuucggccuuuuugugcugguuuuuccucaucuucauggauuuaucuaccuuuggucuuugauguuggugaccuucagaugggguuucuguguggauguccuuuuuuugauguugaugcuauuccuuucuguuuguuaguuuuccuucuaacagucaggccccucugcugcaggucugcuuaaguuugcuggagguccacuccagacccuguuugccuggguaucaccagcagaggcugcagaacagccaagauugcugccugcuccuuccucuggaaucuucaucccagaggggcaccugccagaugccagccagagcucuccuguaugagguguccgucaaccccugcugggaggugucucccagucaggaggcaugggggucagggauccacuugaggaagcagucugucccuuagcagaguugaagcacugugcgcugcucucuucagagcuggcaggcaggaauguuuaaguugcugaagcugugcuuacagcugcuccaucccccaggugcucugucccaugaagaugggaguuuuaucuauaagccccugacuggggcugcugacuuucuuucagugaugcccugcccagagaggagaaaucuagagagguagucuggcuacagcagcuuugcugagcuguggugggcucuggccaguuucaacuucccuguggcuuucuuuacacugugaggggaaaacugccuacucaagccucaauaauggugguugcccuucccuccaccaagcucaagcauccuagguccacuucagacugcugugcuggcagugagaauuucaagccaguggaucuuagcuugcugggcuccaugggggugggauccguugagcuagaccacuuggcucccuggcuucagcucccuuuccaggggagugaacacuucugucucgcugguguuccagacaccacuaggguauaaaaaaaaacuccugcagcuagcuuggugucugcccaaauggccgcccaguuuugugcuugaaauccagggcccugguggcauaggcauccgagggaguguccuggugugcggguugugaagaccauggggaaaguguaguaucugggcuggaaugcaccguuccucauggcacagucccucauggcuucccuuggcuaggguagggaguuccccgaccccuugugcuuccuaggugaggcgauuccccacccugcuucagcucaccccccgugggcugcacccacugucuaaccagucccaaugagaugaacuggguaccucaguuggaaaugcacaaaucaccugccuucuguauugaucuugcugggagcugcagaccggagcuguuccuauucggccaucuugccagccaccuccuguuauuuuucuuuaaagagaugggguuucacucugucauucagucuggaguggaauggugcaaccguaacauauugcagccuugaacucuuggcuucaagcaguucucccaccucagccucccgaguagccgagauuacaggcauaagcuguagcacccagcgagaggaaugauucuuuuuuguuuguuuguuuguuuguuuguuuuuugagacugggucuuucucugucacccaggcuggagugcaguggcgccaucuuggcucacugcaaccucugccucuugaguucaaacaauuauccugccucagccacccgaguagcugggauuacaggugcccgccaccacaccuggcuaauuuuuguauuuuuauuagagaugggguuucaccauguuggccaagcuggucucgaacuccugaccucuggugauccgccugccuuugccucccaaagugcuggaauuacaggcaugagccacugugccuggucagaagggugauucuugaugaguaaaacgaugauuagguuuuucuuagauggacaagggagggauggcguuuaaaagagcugacaauuucagaagcacaguuagcucaaaaagcagagcagcacgaggccguuuaccauaggaacaaauaaccuuacacaucuuuguaagccuuuucaguacaguucaauaacuuuuccagaaaaggguaaaaaacuccuuuuagaaagauuuccauccaaaaugguuuaguacuugaaauaaguccucggccucggcucucugaaaaacuauguugcagaaugccuuuaucucugaggaucaccaguauaacuaaacuuuuaguguaauucuguguucuagaugaugccaagcucaugaauguuuaguaaauguuaauaguugugacaauauuacuguauuaaacauuccuuuuuguuuugucuuguuuuguuuagccuccacagcuuuccuugcugauagccagccuccaaaccgcagagcccuagcuguuuauccuguuuuccuguuuuacuuugucaucaguuggaugauucucaccuuuacuccucaguaaaucaggaaugggaaauuaaaaaccagugaauugaaagcacaucugaaagaugcaauucaccauggagcuuugucucuggcccuuauuugucuaauuuuggagguauuugauaacugaguaggugaggagauuaaaagggagccauauagcacugucaccccuuauuugaggaacugauguuugaaaggcuguucuuuucucucuuaaugucauuucuuuaaaaauacaugugcauacuacacacaguauauaaugccuccuuaaggcaugauggagucaccgugguccauuugggugacaaccagugacuugggaagcacauagauacaucuuacaaguugaauagaguugauaacuauuuucaguuuugagaauaccaguucaggugcagcucuuaaacacauugccuuaugacuauuagaauaugccucucuuuucauaaauaaaaauacauggucuauauccauuuucuuuuauuucucucucuuaagcuuaaaaaggcaaugagagagguuaggaguggguucauacacggagaaugagaaaacaugcauuaaccaauauucagauuuugaucaggggaaauucuacacuuguugcaaaaaaaaaaaaaaaaaaagcaaagggccucuaaagaaucagccucuuuggucccuuugugcugucaccuuuuugccauguuuaacagcaucuugguuggcacucuagucuuaaucuugcuccuuaacuuugaauaugcagucuaaaaugucaguagucaacauguaauuuuccuuugaaauucugaauauuccagugcuggaacuuauccaaaaagaagaccucagaaacuuagauugguagaucucuagugcauauuaucaugugggcaccuucucuuaggguggaaugaggcagucuggaugcagcauaguuaaaaggagcuguuuaauauucucuguagucuggccucuuaacuagaaaguaaagcuaaaucagaagccuguauuuaaccaugugaacagggagggauuuaguguucugauggcugauuaauagaacagcuagauacuuagagcaugacgugggaugggaugaguuuacagcugcugccuuuucauggugagcuuagcaguuuucucauuagauguguuuuuuuggguuggggaauagcaauuuauuuuauugauuuuagacuuuaucaagcuaauuagcuccccuuuagauaaguacauguugcacaugugcaccuacuuguaaucucagauauuuaugcacacaagugugaagguuuuucagggagcagagcaucugggacaggcugauucugagcuaaacagggcuccuuuaaggcaauaugaacuguugccuucuauaaauugcacauugaggaacucuaauagacaaagauuaggugucaggcagaaaacacucauuguaaauauacuauuaguugauaaacauaggacuuucuuauuccccaguuuuucuuuaucauauaauuuaaauauuuauucauuuuguauuuaaagacuaccuacacauagauauaugauuccaaagucauacuuucuccauccccacauuagccaagugaauacagggccaaauggguucuuggaaugauaauaacaaagcauuacaaaguggguccccuugguuccagccuuguccagaguuuuugguuauauauuucuauuuauuacaauuuaccuuuuaaauuguaaaauaaaccuuuguguggacagagccaauguuucaaucuugaaugaguaaagaaaauacuuuggaacugauccucauuuugaaauugguucuaaauuauuauccauuuccaaugucugaaauucucuuacuuccugcuaaaacucucuuucugccaaaguuguuucguaaucugucucaaugacuauaauguaaaauuaaagaaguaaccaugcuucucaagggggaauuaaaaguguuuauugaauuuuacucaggcuaauuguuuggucagaaauuccuaaggccacagcuuugggggguucguguagauguacaugguggguggguuauaaauauugggacuuaaggcagcuuguucuauguauuuaucuuugcucuugggugacuuagggaaugauuuuauuugauuuaaccuucuuucuguuugccccgagaauacucgccaguggcgcuugcaguuguagcauuuaccccaagauaacuuugccuacgaaauauuucgcuuuuauuauuuucacaucauucuaguauauggacuuuggaaacaaaagacauuguucuauuuauagcauucuuuuuuuuuuuuaguagcgguauuuccauuuacaaaauauaguaacucuugauuacugaaaaugucaaauccuagaaaacguagcaugccuauacaugauguuaacaucauucucgaacaguuguuggccgaagauucauuugaugaauccaauuuuuuugaaauagacaauucugauguucucuuuagaaauaacucaguuuuuaucuuuuuucacauugaaaaucaguuagauuugcuuaagccucaaagagaauguuuauguaaauuagcgcuggcaauuuuuuuuuuucuaaacaggaaaaggguuaaaugaagguugauaaaauggauguucaauugucuuucugaaagugaguggcuugaagggaugaauaaauauuuucuuaauauauucaaaaaagugcauugcuuucugugauggaaguuaagaccuaaaugucuggaaguuguaacccucaacacagcuuuuccugauuugcugcaaaggcacauagcugauuauagaagugaagacggcaaggacggggacuccaacaaaggaaacccuguugcaggauuugggaacuuucaugcuucagaugaaauucaggcaugugagcaucacugcagaauguggugcaucauugccaucaugaguaaucacuugcugcuccuacuucugagaccaagacucuuuugucauauucuuuagcaauaggacggguaaagacuggauuuaauugcuguucagaguauaaaaacucaauugauuccaacauaucugaaugugcaguaaagucuuaaaagucaaccguuaaucauuaagucuuuugccucuaaagucuuuugccucugaagagguuuauuacaugaguugauuuucauauuuucauuuuggugggguuuuccuguuguugggcaagguggggucacaggacaugggacuaguaagcauuuuacuguuuacuauauuugucuuuuuauaaacaguaucucccaaaaugugauuagaaggcuaccaagccuguauuuggacauuuaauugugugcuuuauauaauguaacuacuaacaguauuuggacugccuguucauuccuggagacaaaaaugaaaaucugucaguucaaguucuuggguaacaucaagucauuagaauuuaucuaaagcuuaucaugauuugauaagacauccauugcaugcagcuguuuuagcucagugcaaaacacugaaauugugauucuuagacuguuucugagacauuuggauggaaauaaauguauaaauguuaauucauguauauaaauuagaaacacuuuucuagauucuguaggcuuuuguuaaaaauagagaauuucuugggguuuacuuaggccacagaauggccaaauaauaauaaugacaaugauauuacuaauaauaauagcuaaccuuuauuuggcacuuacugugugccaggcacuauucuauuuuuuuaagaauuuuuaaaauaacagcuuuauugaaauacacuuuaccauaaacuucaccuuuuuauuuuuuauuuuuaugagacagggacucacccaggcuggagugcaguggagcagucauggcacacuguagccucgaccucccugggcucaagcaauccucccacuucagugucccgaguaguugggacuacaggcaugcgucacuacaccuaauuggcuaauuuuuguaguuuuuguagagauaggguuucgccauguugccuaggcuggucuugaauuccugggcucaagcgauccaccugcuuuggccucccaaaacagugggauugcaggcgugagccaccaugccuggcugaaauucaccuuuuaagauguacaauucagugguuuuuaguauauucacacacaaaauugcacaacuaucacuaacaucuaauuuuagaucauuuuguaacuucaccaagaaaccccaggucugucagcagucaguuccauucccccuucaucccagccucuggcaaccacuaaucugcuuucugucacuauugauuuggccagacacuauucuucugugcuucucaugcaucuccuguaauaccagugcuacaauucucauuuuauguggaaaauugaggcacugagagguuaaguaaauugcccacggucacacaguaauuugauuuacaacaguaauaacacauuagaugagaacacaguaggacacaauuuugaauuccauuuuuauguaccugaaaugaauacaccccucccccaagguauuuucccuauuguuagccuuuguacccuagguacaaauauagguauuuucccuauuguguuauguaccugaaaugaauacacccuucccccaagguauuuucccuauuguuagccuuuguacccuagaacugacuggauguagauaacauuuguuuucagaguaauggaacacuguaucagcagcaucugagaacauaagaacaguuggacauuggaaagagguuuguugcccucaucccuccuugaaccucuuuucucucccgcuuccaccaccaccacacauauauaccccuuuuucucagucuuaagcaucaaacaauuucugccucuuucuuuuuaauucucccagagggaugguuaaugcaucacaauuuaacuugucuauucagguauuaauagucaagggaugcaucuguuugcuuauaguaccaguuauauuccuaggaccuuagagagcaguagugugagaauagaaugccuuucuauuuggguuaaacuaugugggaggaaaaaguaacagaguaaaggcuuugccuuaaugaagucaaguguucugccuggugggaaguggccacacgcugcacugcgcugcucuuguuuacucuguucuuucagagccuuuguacuuugccaucacugcuaguaauuucuugguccuuuucaauacuccauuuuaaucuugauuuuuuucuauaaauaauaaaucugugaaaaaucuguaaaaagauuugugacuauuaaaugugcaacuaaaaacacuggaaaaagaau

SEQ ID NO: 19088 - RNA, 432 nt, Homo sapiens
aagcuuccaagaugccgcccaaaggaaaaagugguucuggaaaagcggggaaagggggugcagccucugggagugacagugcugacaagaaggcucaaggucccaaaggugguggcaaugcaguaaaggucagacacauucuaugggaaaaacauggcaaaaucauggaagccauggaaaaguuaaagucugggaugagauucaaugaaguggccacacaauauagugaagauaaagccaggcaagggggcgucuuggguuggaugaccagaggguccauggugggaccauuucaagaagcagcauuugccuugccuauaagugugauggauaagccuguguuuacagacccagcaguuaagacaaaauuuggauaucauauuauuaugguugaaggaagaaaauaaaaucauaugaaagacugaaagaaaa

SEQ ID NO: 19089 - RNA, 13211 nt, Homo sapiens
agagagcaggguuggccuugcguucgccugagcaagggaguagacagcacagcggcagcggagggagucuaugcgagcuggacagcagugggagguuugugaggcucgcacuggccgcagacccucgggcucgaucgcccgggagccaggacucggcgacgcgaggcugccgggcuacccggccgaggcuucgggggcgcaaacuaaugggacuggcucgcucggcagcaucuccccgcucuucuaaguacacugagcagggcccgcgcugaaguagaagcuguccgggggcgcguagcccggagucccaguguggcccggaggaacggagcccgugccagggcggcccagucgggagcccggggaccgagcuugugcuguggggaaacccccacuucuuccaagggacagcgaucccgggacggucgaggcgucggggcggucaccgagaccucugcgggaagaccccgucggggagagggcgcgcagccccgaagcgucucgggaagucgagcggaaucgggcgggaucacccgggggcgcagagcccccgucgcgccucgugcggcagcggagagcccaggagaacgagcccucgggggccgaagcccaugcccggguugggggcggcugcccagugaguccuccuggccggccgggcggagaagagcgacaccgaagccggcgggaggggagcacuucaaggccggcggcugcggaggaugggcgccugagcggcuccgagcgcagcgcggcagaggaaggcgaggcgagcuuuggugaggaggcgccaagggaucccgaagugcagucugcccccgggaagauggcucggccugggcagcguuggcucggcaaguggcuuguggcgauggucgugugggcgcugugccggcucgccacaccgcuggccaagaaccuggagcccguauccuggagcucccucaaccccaagugaguaacuuaucuccucuggacgcuggggugggaggcacuccuucagggugaggccgcacgccccggagugcauguggggaggucuucggaggaggagcggcgccucauuuugucuccggcuuuuucgaguguuuuccugcgggcgggcggauggagcagggugcggcggggugggguaggggcacuuggcuggguugugaccccccgggcuucccacccccugccucugcacgucuuggaugaagucgagguggucgcacaggcggagcuggggaguccgggcgcccgagagcgcaccggagaacugaguggaggcgagaacgcagcucccuccggggccccugggaacguggugauuuucgccgagagccgcuccaggagcgagcuugacucgggcgagggacgaggccagaacacggguuccucguuugcguagcuguggagggaacacagagcgggacccggcgcuugggguggguggcagcgccaacauccccacucgggcuucucccauuuucauuucucuuucuucccuguuuuccucccuggcuuuuugcuuugcugucucuuuuugccccccgccccuccuuucucccugccggagcgguagaaaggcgggcgcugcucccaggcucacaaaggcagcggguggagaggggcggagugggagaguggucguuggguaguggggguucgaaccagugcccgucagggguccaauggagccgguaacagagcuucaagggcccgccagggcggagaguggcggccgagcuguugagggagguggguggagaaggagcgauuccugcccaggcagguccccuuggcccccgagucugucccccagauugggaagcugugcuuaguuuuccccaagggguuggggcggggagugggcagcuauauaaaggacauccuuucuuuucuuucuucuccuuccucugcacaacuaccccaccaccaccacacacacaaccccuccaaacaacacgcacaccuuucagggcgguggcucagugguuucugggcuuuuagugggaagucgcuggggcuguuguagugaccucuggaccuucucuuuuggcauccaggacucagguuggaaccaagggucaaaauugcccuuccucucaauuuucuggaggucccagcaaugugcgaacaaccccacuuagcaggaaacuggggagcuuugaccugcuccauccgugaucacugauuccuguaucucaaauuucuuccuguccacucuugcugccccacgccgccucccccccagccccgcccugccccggguaacuucccaggcuccugccuaccuuggccucuugggucccagggacguuugaucucucagcccuggaguaggagaaggcagcuuuaguuuucuucuccucgauuaagguagaguccuauuacugguuggugggauggcuaaaccaggguugggguggagggcucucccuggguacaaggaaagggauuggcaagaauuucuuuccuacccagaagccaaacgggguacaacacucuccuaacagcaggggcucaaaaugcucugggagcucugggcugcuugagcccaggggggaacguugugaagugcucagugguugugaagugcucagugguugugaagugcucaguuacccugguaaggguggaggcuggaaauguucugucuugagccaggagaguugaaauccgccugggguagcccaucauaggggcucaugggagugaccuaauugcucucucgggucucuaaccagagauagcaugcagcuccacagcuggaaaggagcccuccugcagaguugggggugcuggaagaaacacgaucugucugugcuucccccuuuuugugcucagagacuuuagugcucuggacuggcuuacagguuuuggggggugguauccucucugaccccccuccucaucuaccucaagcugagggcaggcauuguggggugaggaugggggguggcugaagacucucuagaaacuguccgaauuccauucuguaauuggguagauccugggaaggaucagagacugauccuggugcacccuccuuccauccaggcucaggggucuggaaugcagccacugucuacauguguuggcucgggguggugggggcaaauggacaggaaggaggcacugcccucagcucuccuugagcuuugggggcugcuucugccaccgcgcccaacccucaggcugccacagccuuucaaauaaacagucccucucugucucccucccucucugccuccugcccgaguucuccucucaggcccgugucaguucgcccucucauacccuccgcgagcagcgcucacuuccccucuccagcuaggcucgccugcucugccuugcucucacacucccucucacucuuagucacucucugccucuuuuucucaaguccuuuuguuucucgcacaugcccgugcucucccucucaggcucauuuucucucuuccuuccccucuuccucuccuggcuuuuggucucucuccucagcccugucagaagcuggcaaccccccucccaaaaaagaaaaucucccagugccuauaaacccugcuuaauugcuuccuucuugggaaaaaaaaaaucaaaauaaaagaagugguggggcuggggguccgcuuccagguuccaaggugcgugcggcccggccccagcccugacugagaggggaagcgggaauggcuggcccaagacucccaagccucuuucccaaauuggugcuggggccuucugggaugcuagucccugaguggcaggagcuucugccuccuuggccccuccugucagauuugccccaugagcgcaagguggggggauggguuugguccugcuagaguuuuuuuuaggaaccucugugugugcgugugugugugugugugugugugugugugucugaguuggggggcuguuaucuaaaugguccuaggcgaccccucccgcagccucuuccccugggaacuuggggcagccggcaggccucacacuugaguccucagccaaguccagcugcugcaguucagucucucagucccguccugaccccuuccugccccccacucagguucccccaccuccagggagucagaaugugccugagaucacauuacaaacauucccuacaaggggguggggguggggggguucagcuuggcauccaggacccuugacuccagcaugggugggggcagcugcagaccccaacccaugcuugccugcuccaagccaaaguguuggccccagccccacacagcuguucuagcucacaguccuggggaggccagcucagggggcccuuuuccggggugguuagggaccugaccucuucuacuuuguggcugauuggccacaggugggagccugagagugaugggaauccagcagcuccuaaaguccccuguuccccugccuccccucucccacauagggcagccaggcaagggcaagaaggaccugugaggcugggguggggacugaaucaaggguucccuuucuucccuugggcucucuguugucucauccgcucaggugaauggggaugcgugggcccuggauacuauggugcaucacuguuuucugggguuagggacuaaaggagauagagugggccagccaggaggcugcuaguugccaugggaacaccagguuugggggagaguccacucugugacuauuagaggagcugagauacgggggugcucaccagccacauucuggguuccuuaccccgcagaccauagcagccccucuugggcguguuucacgaucauuguuuugggucagggugcuagcagccaggaauguaagcuccuucagcuuuuuacuucuaaauaaugcuguguuuggcaugcuaacuaauaggcaggcggcaccuugcuacuuacaaugcauucucauauaugaucucaucgaaugcucccaacaacccugggaaguagguauuggucccauuuuccagauaagaaggcauaugcccggacaagggaagugacuugucuaaggccagucaaugacuugccuaugggggcagagcuguguugugugccauucauuccugcugccuugaaauguaggagagacaggaauucaaggugggguuugggaagaggcccuggcucccugccccugaguuccccucuuaccucgcaggugugcaagcaucugucccugugacucaggcccugucuguguggggugagcagugcuccaacuuccucauuugacuuuucuaggccuaccuuccagggcugacugcuugggugaccugaacuaaaggcagccaacucacugccuggcacacucccugcggagcucugaguggcaccuuugguuccucucugagcuaagaaucucucuucucagggaccccacagaaagcagacaucgacaucgaggaggggggguauuaaauucauaauggacacgagccuuagccagguggggcagagggaagggcauaguucaguguagauggggagggugacuuccuccaggacucuccuggcuucccugccucugacagagcugugugugccaggacccagcugcuguuccugcccacccacgccugggcgggcacugcugggacaugccaggccugcuccugccagccucgggggcuggguggagcugggggaguuaaagaggagccuuuaauuugggggcuccccacccuagcugggaugagaacagacuugagcucuggcuuggggucuguccuccauuggucuugccacccugggaggugcaggugcaguggucguggggucacugaaucgagguugaggcuagaggcuucuaccagacuugggcuugcauggccuagaaccaggcucccccuuuggucauucucugaccacaaguugcuagagccugagagcagggugacagggaaagaaguauagaccuggugggaugugggcagcuuucugggcaagacccuccuagcugcaagcucucccugcccccuguaaauuguauucacauggguggagaagggcuuauccggagaaaacaaggagggggcuguugguuaguugguuucuggccaguccagggccuuggaggcuacuguccccaaccccuucaggcuuuucauaucccaggauucuuuguggcagugauggcaucguggugcuucuaagcuagguagaaaggcugaagguagaacuuggguuaggguagagggggaagagcuggaauagcuuaggccgccucccccaaguccuuuuacucccugggguggcgcccuggggucccagggcuaucugaggcuggagagggaaggccucagggguuaccauggugaccugcuucaggcuuccugcugagccaugucaaucccuuuauuuuucagaaaagggcuuugucuggggguggccccagacagaaaagcuuggcuugguccuaggguggggggaaguaagguggaggauaaagaguuucacuucgggauaucucuuccuccucuucccuuacuccuacuccuaaucugguaagaggggagaacuguagggucccccuuuaaaguaugacuaguguucuaccuagcuuuggccuucacucucacuggcuauacacccaucccuuauggcccguuaccacucucuugagcuucugacaggucaagacgagguuugcccaguggucgggaagaugcuaagguuaccaguaugggggaucagggucagggaaggcgggucucaucaggcuccgcucccuucugcacuucaggggaaggugaguuucccucugccagcugccaugcaaaugaacuaaugaauauuuaugaagucuguucacugagguugaagagacucugagggguuuugggggcaauaguucucucuucuccccccuccuccaucauguagacaucuguuuccucaaugccucuggcuucaagguagaaccccaauuagcuagaagcccuguuccaauuccagggcucuggaaccuggguggcaaugggagacugcacuugggguagacaggacucccuggugaguaagccagaaccgagugguuagaaagcugagcuggccugucucccuuuccgugcccucuauguagcugcauauauauguguuguuaagaugcaacaguacaaggauucagguaauguuuuagggccucuuagacccaucggguuauuguccuggguagguuuagaccccucuuuucaaugggaacauucaucugaucauucauucccucacaugaagggccuggacucuaagguuccugcuggcucuaagaugugagcaguugucuaauccugccaucuggauggaaccguugugagcacuggaaagggaaaaaaugccuggagaauucuagaggcuuuggggaaacuuguuggcuuuguauggugcaugggacagggguauuccaucugaaauguuuauccaggcuuccaucccaugccuacuuccuuucugggcccucuauaguuagguaccaguggggaggccaucucauucuggcuuuuacccuccugcacaucaagauggcagcucccaauuugguggagccucacucgacauggaggaaaggcugcuuuucuucguccacuucauccauguggucaguuucccucuucgccuacuuggguaucauuucccucccucagaugaggacacagguuuggcauugcaaaggcauuugcccagaguucccaguaggccgguauugcuuguaguaccuuugguguaaugggcccucaggaaauggaaccacucuuuucucagaugauugugguagccugugaacuggugcaugacacugucagcuucauucucuuuaagcacugccugaagccuuccauuguccuuccugcucugagagccugucuccaaugggaugaaacccacccugcuugcugugacccuugaagccuuucagucuggccccaggugaacuuuucaccucuucuucuguuucucucuucucacucccagccaagcuggaccaaucacuggccugggcuuuguguuguagccacugcugucuacugucucaguguguugacuucuuauuccucaccuaagacccacuuucauccugccuuuccuguggauacaucucugaccauccuggucagaugagcuaucucuuucuucucccugccuccagcccuugcugcuugaaucaucauccucacacauaccuacagauagccugguguugucuaucacucgaguauggguuauuuacuuuucugacccaaacuggacaguaaaguccuugacgauggagccauaucuucucuuccuguuuccccuccaaaauaugagagugagcucauagguacuuaguguuaguaucugaccuccugccucuugggagacugcuucuaagaggcagucaaacauguugaacgccuauugugugcuagguguucuccaugugcugccuugucuccccaccacaauauuggaagguaggggcucuugccacccccacuuuacaagagaagaaacugaagcucagaacaggcagcucauccaaggucacagaguuaguaagggccuagcuuuggaaucugauucuaaagucuguguucuuucuccuacaugguucugccuugcucucagcaccagcccauccagucucagaaauggccaauggagcaccauuuucuuucugugugcuuaggcaaggacagaguccuauggauaggugguccugggcugcugacccucccugcugucccccagugccuggccuucuggauuagaauaugaaccuggcucaaaaggcauuuguccaucuccucucaggagcuggaguaggagcaacauagaggugacagguuaggauacagaugaggcccuaucuucuaugaucuguugucucugguugagccccuucucuucuccucuguucuuuuuaagaaugagaugaaucaaguuuaggaauucaggcucuugcauuuugagggugggaugaauugccaguaggacaauaggcagugggagugagcagagcugcaccuggccagagacuguggccaucaucccuuugcuccaggcgaugccuguuccuaucuuuccaucaugaccaagauuaguaaggaugggggagaagacaugggucccagacagauugagcucccccagccuuuggcugggagcugcggggaguggugacuaagacaugugugggcuugcuguguguguguguaugugugugugugugugugugugugugugugugugugugugugcgcgcgcgcgcgcgcacguguguauggguauaggagagguaguagcagcggucaugaaggaaucuuuguuggggguggggguauauaagacugccaccuccagguagcaugggccugacaccuugguacccagcccauuggccacgucagcccccugcggaaaugccacauuaggacaaagggcucccccagccaggcagugcuccacccugccgagcagucagagccuggcagccuugcccaugggccaccccuuccacacucuccugguagugugguucucucuccccacccccagccugaggauggaggaagggcagaaggcuugcucuugccaucuccacccaguaggcccagcccggcucuuguccgcuucccugguucuggaauggccuggggccacccccaacccugaggcugaccaucuucuuccuucugggcagguuccugagugggaagggcuuggugaucuauccgaaaauuggagacaagcuggacaucaucugcccccgagcagaagcagggcggcccuaugaguacuacaagcuguaccuggugcggccugagcaggcagcugccuguagcacaguucucgaccccaacguguuggucaccugcaauaggccagagcaggaaauacgcuuuaccaucaaguuccaggaguucagccccaacuacaugggccuggaguucaagaagcaccaugauuacuacauuaccugugagucccgcccaucccauccucuggcucucucccugggcuuaacucuuuccucuccuguaguagugggagcuucuaaguggugcaaugcuauugcauguaguuaagacccugcuggaucugauccccuuugaagacuggcauguucuccucuuagccuggccuuggaauucucgccccaacauuuaccaagcucaccuuggcuccagggguugggcaggagaggucuccaauucguguugcuucucucuuauuuucuuugcccaccuaaguucuaauauugggaaugguaacauaugccaggcccuuugggaucagccagcuauucagccuuuuucuucaggggaaaccaaggccccaaaaggugaagggacuucuugccuuagaucacacagugaguuagagauagggucaggacuccaacccaguucuccugauuccuacuccagaauuccuuucagucuauguagaagcccccauuaugaucccagugaggaggcagaccuuaccgaggggccauggccugcucgugacagaggagcagugccccuggggguggggcuuguucuuggccugggcuggacuaggccauuuuguuccuagugggagggaagaaaaugaaaagguucacugguagaugggagcugcuugcuucucccgacugcaguuucucucccuguuggcugaagcagaaugggaguuucuggguaaugcuaguagaccuuucucuccuccugacuucucugacuucucuggccucuuccugcagcaacauccaauggaagccuggaggggcuggaaaaccgggagggcggugugugccgcacacgcaccaugaagaucaucaugaagguugggcaaggugagugccuagucugaggguccccucaccccacccuguuugaccuuuggaacagauguuccuggcugggugcauguguauuaggagugggggagcaggcguaggguuacaguauccaggccauucuuggcccacccuugaugacugagggcaccuaugcuggccgggucccugccucucaccuguucugucuccauucuuagaucccaaugcugugacgccugagcagcugacuaccagcaggcccagcaaggaggcagacaacacugucaagauggccacacaggccccugguagucggggcucccugggugacucugauggcaagcaugguaaguguauguguuucccagaggucaggagccauugcucugucaccuuguuaggcccugucccugaagaaaugcaagcugggccuggccugaaaucugcugugugucccugggaccccuggcugacuguuccuuccccuuucccuuccucagagacugugaaccaggaagagaagaguggcccaggugcaagugggggcagcagcggggacccugauggcuucuucaacuccaagguggcauuguucgcggcugucggugccgguugcgucaucuuccugcucaucaucaucuuccugacgguccuacuacugaagcuacgcaagcggcaccgcaagcacacacagcagcgggcggcugcccucucgcucaguacccuggccagucccaaggggggcaguggcacagcgggcaccgagcccagcgacaucaucauucccuuacggacuacagagaacaacuacugcccccacuaugagaaggugaguggggacuacgggcacccugucuacaucguccaagagaugccgccccagagcccggcgaacaucuacuacaaggucugagugcccggcacggccucaggcccccgagggacagucggccuggaccggaccucuccuuucgcccccacacccccuccccuugccagcugugcccaccuuuguauuuaguuuuguaguuucuuggcuuuuauaaucccccuuuuucccugcccccugggcuucggaggggggugcuugugccccuaacccccaugcucuugugccuucccccucuggccaggccucugggcuccgugggggcgccccuucuuggaaggcagggcuggacacugauggacagcaggcagggagacaguccccuggcccugccccucccucgccccccuugccaccuucccaggacugcuuguccgcuaucaucacuguuuuuaaugcuuuuguguucauuuuuuagcugucaacucauuuucaucuguuuuuugaagaaaaauggaaaaauguaaaaggcagccccuccccaggcuuugugagccuggcccaagccaguacaagagggccuggggcacgauguggucagccaggaagcauaggaugccauuucuuuuauagauuccuugguauuucuggugggguaaggggcaggccagggcuguucacgcccaugagggaagaggaaagugccacugggcaaggugucccacccuccccuccugacccuccuacgaggcuuauccuggcaaugggguagucacugccacccuuccacacacacacacacacacacacacacaaaaaaaaaucccuuccuugugggauucuugggcaucuccugccucccucacucucacgguaauuaaugucuuaauuggcuguugccuggggaacaggagagcugcugcaggcagaugaccucaugggggguggagggaggugaggugcccagguggcuauuugcccugcagagcugggaguuucacccccaccccccacccuguucucuccuuaccuuuggcauccuuuggccugguggggaaacagaggcccaggguggagaccuaagcggguauaagaccagguggccugcuccuuuucugggcccuagcacagguggguaacccccacccaacccagcuccugcugcugucccagucuugggcuggggccuggaaagaggaagaggcugccuggggcugggccagcccgcugugcacuuugaccccaguuccuugccagcacggcugcuaacagacugccacuugagugcgccuugcaggcacucccagagcagccauggaaggagcuggcccucacaccauccaccuccacacugccuccuggccagcugcccaccccagugccaggugggagagggagcagaacagccagccccuuccagguggcagucggaaggguuuuuguuuuuguuucuguugccauuuguguaaauacuagucuuuuuggaaaaaaaauaauguaaagauguuuuguauaaacucugaauuauuuucuuguugcuuuuuucuuagaaaaaaaugagaacuaaaaaaaaaaaauuaaccacauggag

SEQ ID NO: 19090 - RNA, 5516 nt, Homo sapiens
aauaugaaccuguguuguguccuaugaucucuuggacagagaagcuugguuuugugauuagcagcaacaaauucaacauaaacagcuucaauuugcuuuaaccaucagguuaaaaaaaauuuaagcuuacugcaacccuaaauaugguuucacaguuuuaauacuuucgguacaaccauaacacguaacauaggaugugauguaguaacguaauuacucucacauuggacuuaaucagaaagaauuugcagauuuuauuuuauuuauuaaaaaaccagaaggcaauauagcuaaauguuuaacauuaguuaaagcuggguguuugugacauuuuucgcuguccuuuucuguauccuugacgauuucaucauuuaagaugaaauaaugcuuucgggcccacccugauuuguggagagcagcugccgcccccgccacaucaaggaggcgggcuccagcugacuucacaaucacuuccgccgccgcagucgccgcccgccccgcugcugucuggcgggggaggagcucgggaccgggagcagcggcucuggcggucguggcggucggagauccgagagcucugcuucucugaaaagcguguggcuuucuggacuuggugagugaaaggcugauuguuuccucgauucauccgggcgcuggcgguggcgcgaguggccgggcgcggggcgaguggccgggcacgggggcgaggauuuugggggguuccugggaacugcuuuucagguucgccccucgggaagggguggggcggacgcgggaccugacugcagagugaggcccauguccuccaucggccuguucuggggccacaucuuccgcugccggaaccccuuugguguggcgcgguccccacucgaguggcuuucaucgcuauugggagggcagugguggucgcggcccucucccacuucucccugccucuccuccccucuccuuccuucuucccuccucggccccuuugcggagcacuccguggccuuucuucccauauuuugcuguuguuuugccaaaugguaaaugguuaagauuuuuagguaaaaauacuguucccagggaaaaaauuggaaggaaaaaauaauuauucucagggaaaacuagacccacgcacgcccuuuucuuucauuuucccucuccccugccacaucgguuggggucucccguuugagcugauggccuuuucccaccucuuuuuaugacauugcguccccccuaccccccaccccccgugugucgcgagcacgcgcccccgcacagaagccuuccauugcagcccccuccuugccccuccauccucaagguuccagugcuuccccucccccgcgcaugcgcaggcacacgcagcacacacccucucacacacccucacacccucacacccucccaugccuucccccuccucuauccgccuaccacauacacaccucuagcaccggcccccucccugcucggccucugcgugcucucgcgaacacaugccuauucacacacccccuccggcugcccuccuucuuccuuccugucauauacacacauaaggacauccuucuaucgcuggccagugacauacauauguagccacaugugcucauucauacccccuucucaaaugcucuccucuauugcucugucugccacgugugucagacacagcucucuuuugcuggucccugaggugcacacacucgcacucacauaaauccuucuacggggacacaaccugccucccugcuugccauauccacacaggcaggcaucauucuuugauugccugccucuguuccauccaccucaagcacaucccucuccagugcugcgcaccccccacccccgcuuccauuugugccugcugcauuugcucacacugacauuucuccauuguugccucccauuuugacuaacauacacacacacaaacucucagacacuccucuccauugccaaccauacacuccucugccugugacauacgcauaaacaugggcauccuucuguaguuucagcugccucacauacagcuacacacacaaacaccuucccuuuccucauacauacacgcaccccucuccuccaaagccaccccacccaugccugucauuuucauacccacauccagaaugggucucauucuaacacucauacccuuucccccuacaaacguaaacaucccucuguugcaggauuacugguccccuuccaccugucccucuccucuugauagacagacacauaggcacucgugcacacacggcgaucuguauuuuccacucuauuccaauuugcauuucuccuguaugucugcagcacucagaaaaaugcagacaccccauaaaaaaaacuauagcagucuuuccuuuccccacguugcacaauuccacaguacuucacccaccuuccaagcguccagucaccccccaaccuuccgucagauucuccucuaagucuggcuuuccugcaaacccagucuuguaaucauuuugccaacauuaaaaauguguuccaggucuacaccugacagucacuggaaugcuacuccaggccuuagaagaaagugaaacuaauuuuaaaggccccuuauucuuucuguuaccugccugcugaagugaaaauaaaucucccugcuccuuuauucuaaacugauuuuacuuucccaucucaaaaacgugugcagggagcaggagcccuccuacccgagccccagcuguauuggaaacccuccuaagucagagugaugggucaggaaucuagcaagccuguauggcccaauccaacaggaggguaucaguccaauacagguaggagguauggaagaaggcaugcuuaugucaguuucaggccacccacgagccagcgggaaaggauugccagccagagaaagacgaacuccgaagucccaaugcacagaucagcccccagucaaaccaccaagaggagccgaucgccauuuuccacuacucgucguaguugggacgacagcgagaguucgggaaccaaccugaauauugauaaugaggacuauuccagguauccgccaagagaguacagagcuucggguagcagaagaggaauggccuauggacauauugacucuuauggggcagaugauagugaggaggagggggcugggccuguugagcgaccgccagugagagggaaaacuggcaaguuuaaagaugauaagcuguaugacccagagaaaggggcaaggucuuuggcugggccaccuccacauuucucuaguuuuagccgugaugugagagaggagcgagacaaguuagacccagucccugcagcaagaugcucagcuagcagagcugacuuccugccacaaaguaguguggccucacagucgucuucugaaggcaagcuggcuacaaaaggugacagcucggagagggagagaagggagcaaaauuuaccugcacgucccagcagggcuccugugaguauuuguggugguggggaaaacaccucaaagagugcagaggaaccuguggucaggcccaaaaucagaaaccuggcaaguccaaacugcgugaaaccaaaaauuuuuuuugauacugaugaugaugacgauaugccacacaguacuuccagguggagggauaccgccaaugacaaugagggccacucggauggccuggcaagaagagggagaggcgagaguucaaguggcuaucccgagccaaaguacccugaagacaaacgggaagcgaggagugaccaagugaaaccagaaaaggugccgagacgacgacgcaccauggccgacccugacuucuggacgcacagugaugauuacuacaaauacugcgacgaagacucugacagugacaaagaguggauugcugcucugcgucggaaauaucgaagccgagagcaaacccuguccuccaguggcgaaagcugggagacucugccggggaaagaagagcgggaaccuccacaggcuaaggugagugccagcacuggcaccagcccuggccccggugcuagugccagugccggggcuggcgccggggccagugcuggcagcaauggcagcaauuaccuugaagaaguucgagaaccaucucuucaggaagagcaggcaucccuggaagaaggagaaauuccuuggcuccaguaccaugagaaugacaguagcagugagggggauaaugauucuggucacgaguugaugcaaccugggguauucaugcuggauggaaacaacaaccuugaagaugacuccagugugagcgaagaccuagaaguggauuggagccucuuugauggauuugcagauggguuaggaguggcugaagccauuuccuauguggacccucaguuccucaccuacauggcacuugaagaacgccuggcccaggcaauggaaacugcccuugcgcacuuggagucucucgcaguggauguagagguggccaauccaccagcaagcaaggagagcauugacgcucuucccgagauccuggucacugaagaucauggcgcaguuggucaggagaugugcugccccaucugcuguagcgaauaugugaagggggagguggcaacugagcugccgugccaccacuauuuccacaagccguguguguccaucuggcuucagaagucaggcaccugccccgugugccgcugcauguucccucccccacucuaaagaccaaggccguuuacuccuggucugauuauuuuccccaucugaaauccacaauacugcaggagcccucuugaaauuaacaauggaaauaaaaccaaucagucaguuagccuaaaccuauugauuccucgugauuauuuccaaugugaaaacaguuguguaugauugcauuaaaaaucauaucaucuuuuagagguuagaaaagggaaaacuaaacuuucuaaaugcuacuugagauugcaguaagaagauacguuuucuaaccugaaaguuaaaucgcauuuguuuucuucaguagaaugggaauguguugcuguuacuuguaaugucaaguuuaucuguuaaauauguccaaaaggcaaaaucauuuuuguugcauguuaugggucgauguuccuguaauugcagugccguaaaagcuuauuaaaguuguucuuuugguuuuacaugguauaauggaauuuuuugguuuugucugaagcagugguacugaaugacuuuauaauugaucccuugcauuugcaucaaaagcuuuaguuucacuggaaaugcugacuucaacaauugcaaaaaaaaaaaaaaaaaaugaagguagugacuuuaaaaguaggaauaaaguguaugguuguccaacuacugcaggggaaaaggucaaauagaugaagaaggaagaaaagaaagaaggaaagaaagaaacaauaagaaagcaugguaaagaaacaaaacaaugguaggauuaaguccaaacugaauguagggaugaaugaguuaaaaucaccuuugagaaaauaguaacucuuagagggaauggguccaaaaaaauaaagcuauaugccaa

SEQ ID NO: 19091 - RNA, 24676 nt, Homo sapiens
uauguucaggggcgcuuggauguggcccgggaaagacgccgccgcgcugacuaucugcugcugcugcugcugcugggcucccaggccgagcgacaaaccuugcgccgacuccgagcgggcgcagcgauggcgacugucccuggcgucccugcucuucuucaccgugcugcucgcugaccaucuguggcugugcgcgggggcccggccccgggccagggagcugagcagcgccaugcggcccccauggggggccggccgggagcggcagccggugccuccucgcgcggugcugccgcugccgccgccgccgcccggcgagcccagcgcgcccccaggcaccugcggccccagauacagcaaccugaccaaagccgcccccgccgccggcucucggccggucugcggcggcgucccagagcccacggggcuggacgcagcuugcaccaaauugcaaucuuugcagagacuuuucgaaccgacuacuccggcccccccucugcggcccccugacucccuuucccgugccccggccgaguuccccuccgccaaaaaaaacuugcucaaaggccacuuucggaacuucacucucuccuuuugcgacaccuacacggucugggacuugcugcugggcauggaccgccccgacagccuggacuguagccuggacacccugaugggggaccugcuggccgugguggccagcccgggcuccggggccugggaggcguguagcaacuguaucgaggcguaccagcggcuggaccgacacgcucaggaaaaauaugacgaguucgaccucgugcugcauaaauacuuacaggcggaagaguacucaauccgguccugcacgaaaggcuguaagguaaggacuggcuuccgcagccacagcagccgcccugggcagcggcagcggccgcagugggaccgggagaaaaaaggaagucucccuuucuacccaccccaccacucccaccgugcccagugcagcacuaccagugccacccugggaccuucccuagugaagaggccucagggauucaggucagguaaccaccuggcuaacuucuauuaauuccggguuugggcaccuuaggccuggggcuuccuggcgcccugcucccucaugaguggggaggggccgcagggcccugggcugacaaugagguggcaggagggauugugcuccccccagccuccauccucagccagccaugccccucuccuuucagaggcuggaacugaacguccugggacuggcuggugcagggggaaggccaaagaugggaggaagaauauuuggcaaccaaacccucacccuuuggcuucugccagugggugagaggacgagcacuccuggugguggggcacaccacacacuugaccuuaugugaccugaggugacuggccagagccgaggcaggucgagcccaggggcugccugucuucucccaaggaagucaccugcaggcucuucuccccugacaaaggaaggagcugggaacagggaacagcgacuggugggaaggccacugaagguuagugcauucucauacaaaacucccagugccuucccagcaccccauggugacaguggggggaacacuggcuuucuagcugcuggggauagguauccagaggagaggugaggcagcugcagaccggcccgccuagggaagagcugaguguuaagaaacuucuugacccucggcgggguugcucuggacaguuaggugggugagggcugcaaacauuugggacuugaugguacugcccugcucgcccagccuggccaggugaccugccuuugggaggaaagagaacagcaaggucaaagggucagaugacaaggagaccaggaggggugguggccucacacauccucgagcuggggccaagagcuggagagugagacaguugcuuucuagccuagcucgugucccuccaagacuuuggggaggggcagaaagugccauuuuccauccagcauggcccuuguggacuucugcagggcuuccaugcuuuuagcggguucccuagggauuggggcagaggguugggaaggaaaaggguaguuccucgcuccugacuucacuuucuccuucuccuuuuuccugcucucguaaccuagcagucucccucccgccucccucagccucagcugacucacugccucacucacacuaccaaaugagauauuccacuucuuaaagguauacagacagauagacacacacacugccauacaccaucaccaccaccccgggcaaagucacauaggcaugcagagaggucgucacacccacaaacagugucauuagaagcagaugccgugucacacacacgcacaucuccccaugguaucagagacacgcaggcagaaguacugucacaugaagaagggcacauuuugucuuacagagacacauacccucgaugucagccacggacacauacacucagugggagcagagagacaggguccacaagcagauggaaucaaggaugucuguuuuuuguggcccucccuucaaccccauggcccuguuuuuuguuuguuuguuuuguuuuuuuccucaaucaccaguaugaaugagaggcaugccacaacuuccccaugggguuuucuccguguuguaguugacuccgauuucugucuggaccugaacuaaauacaaaucucucauguugauuguuuuuaccaagcagugugacguaggagaaauacaucugaucucuccaguucaggaggccuuaucaccucuacuucuuguuagugguaugaccuugggcaagucacuucacuucuguaagcuuucauuuccucauuuguaaaacagggaucaucauccuugcucugcccacauccugggucuuuugugggaagaaggugcagauguauuuuguaauaagaauauaacaucugacauuaauguaaugcuuaagguuuuuccgccccucucguguguguuaugagaucaaggaggcuggugauacuagcaccacuacucccauuuuacagaugaggaaacucaggugcaaggggaucaaaugguuugcccuaaggucacucagcuaaugagcaggagugccaggacuccagcccacguguuuuggugccaaccucgugcuuuugccauggccucacaucaaguuccugauggcccucccuccucuccuuugucuucuugucugucucucuccagcaaaccagcgaacuccuccugugcucucgcugccugcugugccggcagaagggcagugccagcuccauagcucucuuccggccuuucccacccuuguccaaugcucucucccucaacugaggccagacccaccuggcucucgaauccagcuguaugaugggcacgaagggaaaagacagcccugcuacccuacuuggacuguaggcuccucucuccucagucccucaccccaccucccuggcaggccuuacuugccauucccaaaccccguuccugggcuccaagcccuccugucugguccccaccccaaaugggaucccugcgagaugacgccccacccucagagcuucuccugaguggagagaccacagccccaggccaagaugaagaggcuuucuuacuucuagaaaccaagcugggaaccucuguuucagagccaggugacccccuguccccaggacccuguacugagugcaucaguuagcucuucccuggguggccccagaaacccuguucucugccuuugcaauaucugcccccguuucaggccacacagggccccacgaaucauaccuguccucgcugcugccugugacaccucccaauuuaguaccagcugcaacauuuccuuaaugugcaacugacuuccucucacacagcagggcaauguaacuuagguaggccgaugcccuuccccgcccuggccucucccaacucccagggucaugccucaccucucucuuagcuuccugugcauccccacaagcccuauuuccuccaacccccaccccacucucuuggccauagcuaggguuacuggacaaccaccacacucccccauggcucuccauccucccaguucugccacacuccugccuuucugauugccucuucccccaccucugucucuuuccuacucucucuucagaacauucagacuagggggagugauggagaugggggcaaaauccuggcuucuucucucauagcuguugaucugaggggaaauagaggcccaagggaggggcaguucuuagcucucucaccagccauaggguugcauuaguaaagaugagugccagggaaggaugugauaguucugcucuauuccagacugacccaaacccaccuggcagacaguguguuugauuuugggucucacacugacugggcugagaaggaggcaggaacccauguucuucuggagagaguugaaggagguguuucaccuggagaagaggugacucgggcagauaugcugucugacuucacaccucagaauaguugacaugguauaaaugaaaaagcaugaccugcguggccccaaagggcuuuuauaguuagaaaguucuagguuaaaaccuaguucuuuuauuuauuaccuguguaaccuugagcuaaggacgucaacucucugagccucacuuuucucaccuguaaaauggggcuaauucaucguaacaguccugugaggucauuauuaaugagaagagucuuuacaguacccagaccugccauaucagaguugcucaguuucuuccuuucaaaaaaggaacagacugccuuaggaggaagugagcuccugcucccaggaagugucuggcccgauacagguggacccuuggggaaaaugccguggaggcaauucuaacaccagauuaugagcagaguuggaccaggugaccuuugagguauauuucagccuggauuuuaggccugugagcaaagcuugcucauugaacagcagcacuggauggggagggcuggggaaggagguugguccuaacgcccacacaaagagaggggguggggggcugccagagccagcgccuugccuucugcccguacccgcuggggcccugcucuuccuccacuccggcuggcagcuguuucugccucacugccuuccucucuccucccaccugccacagcuuuccugccaagcaggacuccuugcuaacacuggguaugaggggugcugagagcagggagcucagggcacuggguaaaggacaggagccccaaguuggccaguggugucuguuuucaucacacagcuugcagucaggaagcagugccccacaggcagccucccugacccagggcucuuagagccagagagguacccuggucccuguuuggggguagaggaaggggcaggcugucuauaaacagccucccgggagccauggcaaagccugcccuuggggaggggccuccagauccacagaagcucaucucuucaccaaggaaugugagcaugggguucugggaaggagcaggagccaggaauccuggagcaggcagagagaggaggcaauguuuauagugaggacaagugaggacccaccaacauccuuuguucagugucccagucucuuguccuuggacccagugacaaucacuguuaccuuccuggaauagcacacagugaauuaagacugggagugggaaaguggucacucccacccugaccugcccccacuccaaccuccauguucuucccacguuagcucacacccaacaugccuauccacuuuccaaugacccuacaaccuucccaaucuucuacuuaucacccuacgcucuuccuaagccacacccacaccuuacucccucuaccuacaguccuccaaccccugccccuccugacaguuaucuccacccccuuccaccucaacucuggaccucacuccccaccucuuuccucucaacagucagccccucacauuccacauuacucccccuauucccaucucccaccugacaccccucccaaaccuuuacuccaagaucccacacccucuucuggccugcaugccccuugggccuugcaucacucacaccccacucacacuuuaccucccuucuccccauccuuuuucuugcucucuuucaucuucugguccucucuuccacccucuuuccuccugccucccccucucccucucugcucucuuucucccacuucccuucucucguuaccauucaggguagacauguacaugugugcaugcacacacagacacacauucauacagacacacaucccccggucuucuucauggcuacuucccauccuucccgcaggcuggugccugacuacuacagucaccauagcaacgggaaccuccaggaaggauacacugguaucuccugaagguggggguugggggaguuagguggagaaagggagccuaacagccucccacccaauaccauggucuggcaggaagagucugcugaacauggugaaggugggagugaggaaagggaagacaguggguggaaccaagaucaaaggagggucaagaaucucccaacacaucguaagcaugcgagggugcuucuaagccaugcggaugcauguugguccccucuggaugugucaguacccuaaggaaaggguauacucacuuuuuuacauguggguagggacauaggcugaaccucagacucaggggcgggagugugccuuagaaaaacuccuuuggggcaguuauucugugcccccacccucugaggcaguuuaccuucugugugcccauacagacugggcaucaaaccugcccuccccagcucauuucucagccacauguggauuccagcugccaguguuagcugaaagccagggguggccccugcuucuggggaucuggacaaaucuggaccccuacaagcaccauucuccgaugcuggccugguaggucucuggggaauggguauguuugcguuuugugugauuacaggcacacagaccagagugugugcaagaggccagggaugcuggaccagccuuuucucccugggcauaaaagugggcucaguaacgccugaauuuuugauacuguuagccagauaggugcuuagaggggagggcaagggcaccaggcgagcugcagcuggcucuggagagggaaggaguuacuauggagugacagggacugccagggccaaagcuccugcucgaaugcauucuggagaaaggagcuggaaccugagccacaagucugugcaccagaagaugaggccaacuggcugcaaagacgaaagggcuaagaaaggggaaggaaagaagaaaauugcgagucuuugagugccuaggagaugccaggggcuuuauauauguucaugaacucauuuaauccuggcagucauccuagcaggcaggcacuaucaugauucccauuuuacacaugagacaacugaggcucagugaggugaaaugaccuacccaggccacauagcaaaaggacuggcauacaaaccuaggucugucuguucuuucuccagugcacagaugcaugaagaaaaugcuaauaaucuccuccaacugucagagguagugcccagcuggcuacugagaggcugggcugagaagcugggccgacuggaagggaggcccaacagagccuauugguagcuuagagguccucuggaguggcccagauccaaaacgaggacccaccaacauccucuuuguucaacgucccagucucuuguccuuggacccagugacaaucacuguuaccuuccuggaauagcaacaagagaaugggcacagggaaggaacugcaaaggagaugggaggaccugggcuccucucgccuggagggaagguaucucuguuauauucucagccccaaucugcuggagggaucaagcagagcacgaggggagaaggugcagaacauuaaccuaaguuagucccuaagcaggccuaaugcagaccugagacccuggccuccacauccacuacaccucaacaugugcaguuucuccauauccuugcacaugcugguagagcuggaagggaaaacgacugcaguaagacuuuguugccccagaguccgcugaggccuggccugggcuuuggaugcccaguucccaugcaaggguuuuggugagccccuaaacuugaacaccuaggcuuuucuuggggauugaaggaagugccaguccaccaaguucugccagaagaggggcauuugguggugauggguguuaccaauguucccugucuuauuugguuuuaagaagauagcauggcuaccuggcugaucugugaaaggugagcuugucuguuuaguguugaacucauuaaaacuuccaacuaaguuaaucucuuagaauuauuauagucucagaaucuuauaauaucuuuuuuuccaguuaaccaaaaaggccuuugagaaauuuuggaaaguagaaguauaaaaggaaaaaagucccagagcacuuagucuuuuuuuuuucccgugguaaaauguacauaacauaaaauauaccauuucaacuauuuuuaaguguacaauucaguggaauuaagcacauuugcaguauuguacaauuaucaccacuauccauuucuaaaacguuuucauccucccaaacagaaacucugugcccauuaaacaagaacucccagccgggcgcgguggcucacaccuguaaucccagcacuuuuggaggucgagcugagcagaucaccugaggucaggaguucaagaccagccuggccaacauggcgaaaccccagcucuacuaaaaauacaaaacuuagccgggcauggcggugcacaccuguaaucccagcuacucggggugagacaggagaaucacuugaaccugggagguggagguugccgugagcugagaucgcgucacugcacuccagccugggugacagaguaagacucugucucaaaaaauuaaaaaaaaaaaaaacuccccauucuucccuccuuccagccccugguaagcauuauucuacuuucugucucuaggaauuugaguagguacuucauauaaguggagucauacacuauuuguccuuuuguguccagcuuauuucauuuagcaugaacauuuaguguucaagguucauccauguugcaguauacaucaguacuucauuccuuuuuauggcugaguaauaguccauuguauaucuaugccacauuuuguuuauccauuaauuuguuggugggcguuuggauuaucuccacuuuuuggcuauuauaaauaaugcugcuaugaacauugguguacagguauccuuugagucccugcuuucauuucuuuuggguuuauauuaauaccuaggaguagaauugccagaucauauggcaauucuauguuuaacuuuuuguggaacugccauccuguuuuccacaauggcugaaccauuuuacauuauauuacauuuuauguuauacauucugcaccauuuuacauacauaacagcaguaugcaagaauuccaguuucuccacauccuugucaacacuuguuauuuucugaaguguuuucgauaauagccaucuugauaugugugacuauauauuuuuacauaguugaaaucauacuguuuuuuacccugcucuuuuaaacuuguuacacuaucucuucauguaauuaaauauucauaaacaucauucuugaugaguguacaauauuccaucacaugaauguaauguaauuuauuuaacuaguccccuauugacauuuauguuacuuccaacauuuugcuauuauaaauaauacugugaugauauucuuuguucauaagucuguuucagaacgauucuuuuuuacgaauaaaugcuaucucagucauuuuuucuuauuuaucuacuuugcugaguuuuuaaaaucacaaaauaaugcaugcuguuuguaccaaaucuaacaauacagcgguuuauaaagaaaacauuaauguuccuccuauuagcuccccucccaaucccacugccugaggucccugauguuaacaauauguaguguguucuccugccccucugugcaggcuuacauaaacgucuacacacaaaaugacuuuuucuuuccuuuugcauacaaaugggagcauagacauuaauucugcaaggugaaguuucagagcuagauguacagaaucaaagaguauuaaccuuuuugaggcucuugacauacauuaccaacuuucuuucaaauuacuggguuauucuaguuuauacccucaccaaaagugugagacuaauaugcagcacacuuuuccaguauuggcuaucacaucuuuaaagcuuuacuaauuugguaguugaaaaaugguacaacauuggcuuuucauuuucauuccuuaggucagacauuuguuuuucuuguuuauaggccauuugucuugccugcuuugugaauuaucuuuucauguuuuguguuuuccuuacugacucguacaugcuuuuuuguauguauuaaugauauuaaccuuuuucuaaucacauuuguggcagauuuuuuucauuuguuauuugcaccauagagcugaaaggagggaauggaaaggaagagaacuauuccacacacuuuguguccuuuaucuuacuuaauucuugcaucuuccuuaugaaguacaugauauuauucccauuuuacagaggagaagacuggcucagagagguuaaauggcuagcuuaagcucauccagcuaguaagaguuggagcugggauuugaauggcagcagacaaugguaccacccagucuuugcugguguaauuauacuaucgguaaagcuuugugugguaaagcuuugugcuaguugcuuaacaggcauaauuuacugaaaaguaaggguagguacuuuuauuaucuccauuuuacagaugaggaaaguguggaucagggaaguccaguaacuugccugggguuuuauaaccaguaugagcaaaccuaggguuuggacugcaugacugaguuuaaagauguuugacccugucuucccacuguauuugauuacucccuaggcaucaacuucuuggauccaaauugaggcccaggaaggaaaagugccuuucucacagucaccagaaaguuaguggcugagucccugucucccuacagguggugacuuguccaaauucacacaguugguggcagagccagaaucugaagccagcucuaacucucuaucuaacuggagcaggggcuucucgaugaagagaauuuguggaauaugcuggggagaaggaguuggggagaaaguggagugcauagauacccugagacuuuucugaaggaauggacucuggcauuggagucuuccagggcaaggcuacucuagaagcccccagaugguaggaccugggacaggagaacucauguucugaggcaagaaaaucuuucuucuggagacauuugccuucccuucaccaacugcuaaagauuaaaacaggaauagugagccuuuggcccuggguaggaagcugaugggcgcagaagaagcaaagcaguguuugccucuuuuuaacaccuccaucucucagggugugugugugugcguuuguguguguguugaggagagagagaaaggaauacuuugauuguggaauggaaaugaucauuuguagcaccuaauauccaaaugcuauucccccacaucuacuuacaaagaaaacuuuacucauguggagaauggacuacguagacugauuuuagagucacgccucccauccagacauacaaaucucucccuaauuugaugugaaauuaugucagaaugagauuugaguccacuggcuucagugguuguagugaauugaagggaccaucccaagggcaauaugaguauaagaguuuagacaccgaaguccagauuaaccugacuucaaauuucaguucgaaaucugucuucucuguggaauagcuguugagaacuugaacauauucuuuaaucucuauuggcaucucauuuuccucaccuuuggaacuaaaaaauagggucauuaugaggcuuaaauaacaugaagcaugcuaaucucuuaagagcacagugccugcgagauggaaagugcucaagacaugcuagcccccauuguuauuauuauuauuggcuguggaccuuggacaaguuauuuaaacucuuugguccucccuguccucaucuguaaagaucugucucuaccucaagggauaguugugaggucucagugaguuaauaaaugucugggucaggugauuagaacagagccuggcauauaguaagcacuuaauaaaugguagcuauuauuauucucuccuuaauuagguguguuuaauccaaaugacugcuuaauaucuaauugauguugacaacacuggggugggauacuuaggaguagggaaagguaauuugugaacaggaggugaaguaucuaugguaggggaugaggagccagaaggcaaguggagggauucuagugagggaaggcacaaggauauacuuagaugggggaggaaagaggcagagagggagauggaaagacuccaaagcccuugauuuaccucaucacuaaagaccaagcacagcugacagucaucuuugaucacaucucuguucucuccagccucucaucuuucuggcaaggcacagcauuuggaggaggagguaaggaucugucuuuggugaucccuggagaaggcuggagauugcuuccugggccugggcccagguauagcuguauguggcaaacaagugugccugggaaggggaagugugugcagcugaagggaaccuguggcugucacugucacacuggcaccauuccugugguacucugcacaaccauugugcacagaagcucccgaagcucccaaagcuccccucgucucaucuuaguccucuguguggcuaugggaccccucauuagcucuguuguccugauaaauuuaccaugguccagacagugaugauggaguagaugauccagggcagggcagugcagggccuggggcucugcagcagggcagugugggcugagucuagcgagguuggucaggucaggucuuggagauuuuguuuuguuguuuucgagguucguggcugcaaagcaguuuguuuuuauuuaaaauucacuuuaucaaaguacuguauuuucauaauuuuaaaaggcauguacaagcuauauauauauauacacacacauauauauguguauacacacacacacaccccaagccucacucuucagagucaaacacuugagacacucuugacuguuucuucugauauuuaccucaauauuucuaaaugguaugcuaauauugcuauuucuuguuuuuuucuguuuuaaauauuuguguauacacacauguauagauagauauucacacauauacauauauacaccuguguguauauaucucauuuauauguauccuuguagcuuauaaagcuuuuaaauucuaaauauaaaauaucuguuaaaugacauauauagaucucaaugcuuaucauuaaaacaguagcccucuacuccaccccugagccucacucuucagaauuaaauacuuccaacucucuuagcuguuuucuucugauauuuaccuccacauuucuaaaugccaugucaauauucuauuucccaauuuuucucuuuuaaauaucuguugacuuuuaaaaugugauuaaaggaagauuuagcucuuuuacucccagcagcacuuaagauacacacaugcuuccccuccccucauacauucaauauuggcaaaucaaaauuccugauuuuaacaauauuccauguuuauauuacuagaauuauaaauauuguucacagcugaguuauguagaauacugugauuauauuuccuuccuuggucaucuuguuugcauggaguuaauaauugccucuuguuuucuguuugcuuaguuuucucauuuuuugcugauaacauucccaauuucuuuaucagaacuauaaaaucucacacaaacacuuucauaacccauuauuuucacuuuuuuccuuggagcucuccaccuugcucuaguugcuagagguuugguuuucaaguacuugucaaguaccucuguguguauaccuccuccacuuguauacccagcuccaugugaggcccugaggacaguggacagaugaguaagauacaaucuguccuuggugaaucuacagucucaugaguguauaauuuauagaaaugucuuaccagaaggcuguguguuaagacuuugaucuaagcugucccuuuggucccacacucaggcaggccuccucuucuucguuucccaugaguuaccagaaugugauacaguccuccaaagagcaaaugugaucuuaggcugcauuaacaaaaaguuucuaggacaggagggcugaugccucuacuucacuuuguguugauaaauccuauccggggauuguguguaguugcaaaggacauggaaauacagggacucaucugaaugugaacaaccaggcuaacagaggacuggaaaccacaucuuuugaaauaguugaaaaaaaauuggggauguuuggcuucuugaaagaguagucuacacauagcuaucuucaauuuuauucccucacauuuccuuuucaauuuucuacaggcugguuucugcccccacugcuccacugaaacugcucucaccauaaugagacugccucuuaauuccccaaaccaguguguucccaucuaaauccuuaucugcuggccacucccuauucuuugaaauucucuccucccuuaauuggcagaaugccucucuucuguuucuccuccaaucucuugagccacuccuccaucuucaucugauucuuuuccuccaucugccccuuaaguguuaguuuuucuagggaucuacuguugauccuaggcaaugccauccacuuucuaggcuuccacaauugcugaagcagccagggugagcuagguuaugcucugguaacaaacaacccccaaauaucugagguuuagcacaacaaaugguuacuucuuucucaugauacgugucugaaacaggucaucagggaacaucugcucaugauagucaccaaagacccaggaugguagaggauccaacauaacacugcuuccacagucagcaucagagggaggagaauguggcaaaucauacauuugcucuuaaagcuucugcccagaagugacucaugucaccucaacucacacuucauuguccaaagcaagucauauggccgugccuaacuucagagggugugggaaaguguaguccuacuaugucccugaugacuaagucccuaaccccugauggcuuccaagccuuuaugcagacccuccuucugagcugacugcuguguccaacugccuccucaacauuuccaccuggcugacucacauauaccucaaagucaacaugaccccaaacugaauuuaucgucuucacccccaacucuaugccuccuauuuucccugacuuaauaaaugaaacuauucauccagcuacccaacccagaagcuuggucaucauccuggaucucucccucucucucauuccccacauccuuaaauaauccuggugauucuaccucuuuaacaucucacauccaccccuuccucccuauuucucaauucugccacuguugccuuagucggggcccucacaaccucucacucagacuguuggaauugucuuguaacugaucucugugccuccggucuugaugccuauacuccaucaaccacacuuucagacagaaguccgaaaaguuagucaugggaguggcaagccaucuuuaaguaggcaauuauuugaaaccuauuaaaggcucuccauugccuauaggaugaagcccagcuccuugucagcuuccagagcauaucauaaccauggccauggccuuccucugcaaccucaucucccauuguaucccacuuugcgcccucuaacuaugcugaacuaccuacagucucuaaacucagcacuauuucacacuuccaggccuuuaugccugcucauuucuuugcuugaagugcacuuauucuuuccauauuccaccuaguuaccuucuacucauuuuuuuuucaaucccuaacucaacccucucccacauggagauguuuuccuguccuucagcccucaaaacacaguugaucacuccucucuuaaugcuacuacuguaccaaggagauacagugcuucuugacuuacaaugggguuacaccuugauaaacccauuguaaguugagaguaucuuaaguugaaaaugcauuuaauacaccuaaccuaccaaacaucagagcuuagccuagccuaccucaaacgugcucagaacacuuacauuagccuacaauuaggcaaaaucauccaacacaaaguguauuuuauaauaaaguguugaauaugucauguaauucauugaauacuguacuaaaagugaaaaacagaacgguuguauggguacuugaaguaucauuuccacugaauauauauugcuuucucacuuugguaaaguugaaaaaguguaaguugagccaucauaaguuggggacugucugugcuaccuaucacagugacuuaaaaugauugauucauauaguugucuccccugcucccugaagacaggaaucuugucuuacucaucucuauuaucuguaguucccaguacagugccaggcacucagaagauguucaagaaauguuugcauggacaaauaaugagaaaaacagacucagagaagucuaaaaauaccugcaggguuggcacaggggacaggaagguagcuguuccauauggcaccaguagagcuaguaagagcugcgagugaagccacaaggaggaauuaguucaaaauaaggaagaacuucuguaacugcuagaguuaucugaagauaugggcugcccuaggacagcaugacccccugugacaaggcuuacaaucagaaacuggauaagcacuuggcagugauguuggaguggaaauuccaacagcagauagggcaguguugugaugguucucauggucccuucuauucuggaacagucaugacccugacuccucugcucaccugauugacagggauuaucuaggccccuucagagcugcuccuacauuaggaacacuguuucuccacuggaccaacccuguccaggcugggcccauccagccacuggccuuugagcagauggcccaagaggcuugguggugggagagcuuucuggaacugcacuggcucuagguucucacccuccucucuggccaucuccccugccuuuccuucaggccaugccacuuugacucaugacugcucaguuugagaagcaggacagcuguugcuuauuuuuacagccacuuaaguagaacccuauuauccaccuggauuugcccuuuaaugcaucuaaucccagucugauucuaccaaucccagugaacuacuguccccagaguuauguccaugaucuccuuccucugguugaggagacugauuuugaccuaacccuguucugauccaacuuuugaaagcccagagucgggacuaggagcacuuggcucuuuucagacccugcccgaggggguuccucacacacuucucugugugcugauggaugcaguacaaagaggcaucagguuagcagucagguugccucccuucuaaucauggcuuauaguugauuucuugcaugccucugacuuggcuaagccaacccucuucuuugggucucaguuucccuauggguaaaaucugggagcggaguguaccguggugucuguggacaguggauuucauccccauguguagcucacauugcugcuuugccuccacaggcucugcggcugcagcuccagcugcuggccaagggccccaaggguacauuaggaagacaagcagcccuggagagaaggccuauagggaggauuuggauggggaaacaggccccagggauggaagcaaguuagaauccaugaaggaaacugcuuacuuccugguuggcaagaacuaaagcucuccucccuggagggcuuuucagccccagaaccaaggagcucgguauggccuccgcuuucuaaacuuucuggcccugaguccuggcuuugggauguaaaagucuucuuucuagaggagaguggggaugaugaugcccuggccagggcugcaagcgccagagccagaggguaaggcucucuggguccucccuagauuggcaacugcagagcccaggagggguggugacaccucucaucuugccccucccauuucuggagugcucugcagcccagcugggaggagggaugggacagccuucgcagcuuccuuuuuggguuaauugguguucccucuaguuauuuccugcucccuuccccucccaguucccauagcaacugggcuguagcagccagaacuugauugagcccagcaguggcccgacugagguggggaaaggagggcacugccaggucaaugcuucccaccccacccaucccccgcugccaucucaaggguucaggaugguuaagcccagaggacagggcauaauuggaaagccuuuuaugccagggcuagaguuugaagagucuaacaugccagagcaggccugguucuccucagcucuccuccccuccccaugcccuguguccugccucuuaaauuuugaauucacuguugcugguaggauuguucaguaggaagaacccuggaguuggaggugggaaaccagguuuccaguuccucccaaaccgaugguucucaaccguggcugcauacuaaaauugccugagguauuuugaaaaacuacagauguguaggcuccacccacaaggauucugacuuaguuggucuggaugugaugugagccagacaggaguauuuuuuuucuuuuuuuuuuuuuuuuagacagggucucacuguguugcccagguuggagugcaauggugugaucucagcucacugcaaccuccucccccugggcaaaggugacccucccaccucagcauccuaaauaagugggauccaaggugugcaccaccacacccagcuauguuuuuauguagagacaggguuucaccauguuguccaggcuggucuaggacuccuggacucaagcaauccaccagcuucagccucccaaagugcugggauuaccaucaugagccaccgcauccagcccaagacaggaguauuuuuuggaagcucuuugagugauugugauaugcagccagaguugagauccuggagaacaaaagagcuccguaguucacccagaacugacuguuaucuuguucugagacauuucuucccuuucccugcaucccuugccuccagcaagccccacaacucuccuaagccgggcccuccuggcuuuccuccauccuuguagacaagugcccaggaaccugugaaugcccaaacaaccucccccgucaaccccuggcucaguccuaacacuagugaaacagggcaagcuaccuagguccaucuaagaaacagggcugcagagucuaaggcaggcuuguugcccaagcuguaacaaacacugagagccagaucuuucaccugagaaggaccccaggcuaccucugaggcaugagggauagcaauggccuccgcuggccggcuguggggcugaggaauuggauuaccucugagccccacaucacucuucuuccuccauuccccucauuagcuccuugccuguuccugccucgccacccacaggccugguguccuccccaagcaaucugcucacccacuuguugucauggugacucuggcuggggguguggggacugaguggggaggucgucuaauuaaggagaaaggccacacucccaaugucaggccaccccucccccuuccccaaccuacccuggcuggcucccuccauuccucccuccaggagcagaugacgggagcgcccagccaccauagccuguuacugggcuaauugcaguugccugggaggagggcaggaacuccacuggggccuccucaccuaggagcuggaacacugaacuagaagagcccagagagaauuccacagggaccucugagucacacugauggaugcaggguugggagggggccgauugcacacauuuuggggugagggugaggcaggcucuggguccaggcuacagacauugaggcagagccuauggacagagacucaucuuggcacucuggggcucaaaagauggagggaagucucuaagguacugggacccuuaguucuuguaauuucauguucuuuccugccuuacuucuguuucuuucuccuccccuucuugcgcucucuuauuccucuuucuuagcuuugcuuucuuacagccccaucucucuuagccacucuuauuccaucuuauucacccccgcuuguucuuacccaucuuucuuacucccucuuucuuaccgcuuccucuuaacagcuccgcuuaccccuaucucacccucuguuaugucccuaccuuucaacuucuuucacccucaccccacucuuaacccuucaccucccuuacacccuccaccucuaauucccuggcucuuucuccccaaccccguuguuuccuacccccacuauuccuaccauuccuuacccucucuuugcuauacaccuccugucuuccaccccuuaccccaacugccacucucucauaccccucaaaccccucucuuccugcccuccuuuaacccuccagcucucuuacccugccuccuauuuucaccuguuuuuucacccuccuuucacucuuuucccguuccuuuucacauacucuuuuagcccaguaauuucauauuuaggaauuuauauaaauaaaauuuaacacaagugugugagagauguguguauaaagacagucacuggagcguuguucauaauagugaaaauguggaaauaaguguccaugagcaagagaucaccaaugcccuuuucauuccauucauacaaaaccauucucuguucucuuaacacaccauggauuuguuugccgacauaccuuugcuuaagcuauugucucagccuggaaugcccauuuaccucaucucuacccaucccaucuaacauccugauuugaguccaagcucaacuguucucccaccacugaaaucuuucccugcuucucuacuugcuucccuccagugguccaugguuugaacucuccuuucuauagaucauaugccauagauucaaauuagaugugucuacccaugaaacuggaauuuucaugagcguagggacauguccucauuuacuuguccuguucauucauucaacagauuuuuuaaaguguauauugugccgaguauacaacaguuaauaaagcaaacccaugucugcuuacgugcaacucacauuuuaguggggcugacaggaacaaaacaagagugcagagaaaguaauacuuguggugaagaaacaaggaaaagagaauaaugagggcagcauccuuuggugagagggguaagggagauccucucugaggagaggacauuuaaacugagaccugaaaagugagaaugacccagacaugucaagaguagggggaagagcauucugggccaaaagaauagcaugugccaaggcccugaggugggaacaaguagggcauguucaaggaaaagaaagaaaaugaaguuggagagaaagacaggagcaaaguuauacgagggcuagaagucuguggucagaagcuuaauucuaaaugcaucaaaggguuuggagcaaaggaguaacaugagucaauugcguuuugagaccacucuuccuccuguguggacaguggauuggaaagagcaagggugcagguggagaggccagaugggagacugucauccaggugagagaugaugauggcuugcccaaaggcauagauguggagcuacaauuggcaugccuugcugauggacuagauguggggauacagagaaacggaaaugaaggcugacaucuagguuucauggcacucacugaaauggucaagacuugaggaggacaguggauuggggauuaaaaaaauaagaucuacauuuuaaaauuuauaacauguuaaauuugagaugccugugagauaccgaagucccaagcaaugcuuugcucuuugggggacugguuagcaacacaaccuaccccaucacccacuaguaccucccugcuuuggaaaaggccagugugggauugcauugccaaaguccauguucacagcaguuauuuguaguuuagugaaaauguuugaaguaaguauaagaaacugacagugcuucugaaaccauguugcucagaauaugguagaagagccuccuguggcacagugaccuggaccuggcucagaaaugcagauucugagcccaccuccguccucuugaagcugaaacagagggagacaucugcauauuuuaacaaaugcuucaggggguucugaggcacucugaagucugagaaccauugcugugaggaacaacaaugaaccuagaaagcaccccuaaagauacaggacuggauguggguggcaagacaggaacaggcaaggugcaugagagccaucugggcaucuguuaaaaugcagaugcugacuuggcaggucggggguggagccugagauucugcaucucucacaagcuccuaggugauggugaugcugcugguccagguccacacuuugaagagcaaggaccuagaucaguggaucagugguugacaacuggagacaauaccccuaccccaggggaacauuugacaauggcuggagacauuuuuuuugguuuuuuuuuguuguuguuuuuuuuuuugguuuucacaagaggugaggggagagaaugcuacuacuguguaauggguagaggccagagauguugugcaguauccugcaguguacaggacagcccccacaacaaagaauuaucugacccauaaugucaguaguaucacuguuaagaaacccugggcuugaugauaaccaaagaguauggagcagggaaucuuccuuagcuaggacccagugccugguaggaguggacuagaugagggacaggaagcauacccaugaagugaaacugcaaagcagagguuccaaaugaaacguagcaguguguuugaugucugcuccaugccagagcggaagccaauagggcagagcauggaucaaguagagcucaaaggcacauguguugccugguaaggcagguuccugguuuuuuuuuuauuauuaaaaauaaccccucacauuuacauuacacuucagaguuuacaaaacauuuucauauaugccauauuauuucauccauacaacacccuaaugagguaaagcaaggauuauucuuucucuuucuugaauuuagaaacucaauaccaucagccaaagaaauguuugcugaauugaacagaacugacauuugccucauuauauauagguagucucagacaagucagauacuuccuuggaccaaguguaaaaugacaggguugcauggaaugauuggcaaggcuccuuccaguucugaccuuccaguaauuuugugaucuuugccaacacacaaauuuugagucuuggaugacugcagacuggggugcuugggaguacuggcuaugaaaucggagaucuuagguaagaugcaguggccuugauccaagcccuucuuccucucuacccccuggaucuugggguuagguuggugaggcccccuugagagaccacaaguaaguccucccaucccucuccucugaggugggaaggggcuggcacaugggcugaugcucuuuccucuccccacaggcugucuacaaggccuggcugugcucagaauacuucagcgugacccagcaggaaugccagcgcugggugcccugcaagcaauacugccuggaggugcagacccggugccccuuuauacuccccgacaaugaggaaaugguguacggagggcucccuggcuuuaucuguacagguaaaggcagggcacuggggaagagggaggaggccgggggcccagggcaggcaucaggucagaggaguugggagcagggauaacaacaggggagucaggugagaagaaggccaguggcuggacgaaugggcagugacguccccagguugggauagggccaaguggaauagggaaaaagaccagaguguccuucucugcccaaaacauguccagggagucaucccaaagaaacuggcugggguccccaggaaagaagggcucagaaagggcaagugucgagggcuguggggagggagccuuagaugaggcuacuugagcagccccagcucuggaaacuugcucccuagguaaggcauagcuaucagcuccccgagcaccccaccacaccuuccuuauccauuggcaggguugcuggauacuucaccaaagcgucuggaaaccaagugcugugacgugcagugggucuccugugaggcgaagaagaagaaguucaaggagucugaggcccccaaaacccaccagcagcaauuccaccacuccuauuuccaccacuaccaccaacaguaccaucacuaccacccccaucaugaucccccaggccgugucagcaacaagcccgcccugcugccggucucugggggcucccgccucagcccuagcaggauccggcucugcguccuuguucucaugcuccuccauaccgugguguccuucuccagcaaccaggguggugggggauuggggcuggagacacugccugcccuagaggagggccugacacgggaagagugac

SEQ ID NO: 19092 - RNA, 869 nt, Homo sapiens
cauggaugauccgaagagugaacagcagcgcauacugcgccgccaccaacgcgagaggcaggagcugcaggcccagauccggagcuuaaaaaacucgguccccaagaccgacaagacgaaaagaaagcaguugcuccaagacguggcccgcauggaggccgagauggcucagaagcaccggcaggagcuggagaaguuccaagacgacaguagcauugaaucugucgucgaagaccuggccaagaugaaucuggaaaaccggccuccccgcuccuccaaagcccacagaaagagagaaagaauggaguccgaggagagggagcgccaggagagcaucuuccaggcugagaugucggagcaccuggccggcuucaagcgcgaggaggaggagaagcucgccgccauccugggagccaggggucuggagaugaaagcgaucccggccgacggccacugcauguaccgcgccauccaagaccagcugguguucagcgugucuguggagaugcugcgcugccgcaccgccagcuacaugaagaagcacgucgacgaguuccugcccuucuucagcaaccccgagaccagcgacuccuucggcuacgacgacuucaugaucuacugcgacaacaucgugcgcaccacggcauggggaggccagcuggagcugagggcccugucgcacguccugaagacccccaucgaggugauccaggccgacucgcccaccuugaucaucggggaggaguacgucaagaagccgaucauccuggucuaccugcgcuaugccuacagccucggcgagcacuacaacuccgugacaccgcucgaggccggcgccgccgggggcgugcucccgcgucuccuguagg

SEQ ID NO: 19093 - RNA, 13556 nt, Homo sapiens
acaucugaacaaacugauuuauuagaguguuacagugggggcucccacacagacgggcaccagagcgaggugcucagcuccccucaucucccucagccuccacagccuucuggcucuccuccucgccuuuccgcguaaacuccucgaugacuauguccucagagcuugcagaagcagcagaagagaauggaagguuaggaaccccuuucuggguguccuccguguccacucuuuuuuccugaucccagaaaagugauccccucccugcuucccagguaggcuccucggcccccucuugguguccccacuuuuccaucagccacucuggcuuguuuccuuucauucccgcccaaauuucccagcacaaaagucccccaggagcacugaaagggacauaaggaugagggaugggaaggagggaagguaucaaagaaugaaagacgaaagaaguaagggcgagcgggugggggaaaaggaaaaagaaaaaugggaaggggaugagggggaaggaugauuccaacaagagcagaagguggagggcggggggaugcagaaagggaaaggagggcauaugaaaagcaccgaacugugacacgaagcuaagccauauguuuccacugcacauguauugaaagcaccccaaggaagcauuuucacauuucuaucgucauaacauggaggguggaaaugggaagaggggaauggggcuucccaaucuuguauuccauuaccuagcggccucuguagcaagcauggagacggagggaaaaaauggagcugaagcugauuagaggcucuucgguucccugaagaaguaucuuuacuucccccccccccaacuucccaauccuuugcuccagcacacacgacacacacacuuccccugaauaccuagacacccagccuaccuauugcuauuccauccccaggcaaacugcuagucuccaauucaugagaucagaaugguuuggaccccagcccucaggacagccgucccugugaguuccaccuggucacucaccaugagauggcuucggauggaucaggaccaaggguagcuccacaccaacaucgcugcaaggaucccaagguggaguuacaucuccucucucuacaagcccaaucccugaaccucccucccuuaguuuuccagucuuuggaugcccucagacccuccagaaucaaucauuauuuugcucuccuuauccccuuguccuccucuucuugcccaaguucccccaccccacagucucucaccuggcugucaggucuccuaggaugcuguggguagaaugacacccaaaauuagcagcgggaaauagagaaggggcaaccuaguuucacaaggggaugagggaucauaagaccuaaugagccagccacagaauggguuucuggaagggaaagugacuugcucacugagcucacagguuugggaaccuggucugggagaaaggguggggaaugguuugauugggucaaucuaacugggagaaaaacagaggcgaaaagcccuugacucuucagccccugcccagacagacccagaacccucacuuacccaccacaggacaccaucagguugacucugacuuuguaggacaccaggauccccagcagcucuuuguccauucccggucuaauacuggagguuguaguauucguuuuaggguguuuggggcaugaagaguaauucauucuguccccaguuucuucucaugcauuccuaucaccacacccuauuauguuuagucuuaucccagaauaucucccaggcucuaaccuuuccuacccguugagaccacauuucucuuccugacauucacuuuuaccaugucacucucugcucaagagccuaccuuuugaauauaacaacuacucugccugacuuucaagaccccuaacaaccuugcccuaucuagccucucuaaccuuuucuccccuaacuccugggauacaaccuaagcagacccaucuucucuccgugaucagaacaugccauguggauucccaccuucuagccuuugcccaugcugugucccuagucuacagugcuccuuuuuuuccucuguugguauccagauccuucacauucuucaagaucuagcucauucuaccuccuccaggaagcccucaccagcucuccuggcuucuuuuaacuuuguugcgauuuacucugaaccacguguacuaacauuuaacuguuggguuguauuugcaucucucuucguuccucaucuaggccauaaauugacugaaggcagagacugucuuaaacuucuuuauauucuccacauugcuuagcauaggaaagagcauguaauagggguucaguaaaaaacccacugauugaaaaauaagacagcgaaagcugcaugagcuugagaaaaucucuucauugcucugggcugcugaucucuuacauauaaaauaaugcaguuuggaugauuucuaaggguauuucuagcaauaacagucuauagcuacuugauugaaaagacguauggagagauggagggauuacacuugacagaugguggcaggugguuuuugguggaagacacaucuaacacuagggccuccgaaggcacaggaccaagugaaugacuuccuagaauucuauuaauuccuguugcaucauuuuccuuuuuuguccuccuuuuccuccauuucucaucuccuagucuucuacuccaucuuuauuuuuucuagagaguagcuucuguagagaucacaguauucagagccagaugacaugugauauaauccugucuacaucuaccacuuaucagcuaugccacuuuaagugaguuccuucuucucucugagccucaggguccuuaaguguaaaagggaauaagaacaccuguccaggcuacuuuagugggauucucacaaagauagcauaguacauaugucggaccuuugugaacugugaaaucuuauacaacauaaggauuguuuuccucuccauguuuuccuuuuuuucugccgcugaccuaagccugccguuggucccacaggcauuauugagcuugcugcaggccuuuaggccuggaggagucucugaacacugcccuagagacacuuuaaaaaacagguaggcuuuacugaacaugaaaccucagagcuguaaauguagcauguggaaugguugagggguaggaaauggaggcugagaguuauauuugagcuuacauugugcuagaggccagguugguaucuucaugcuuaaguuugccauccagugccaggccccguuucuggcagcuggcagccaggauugggguuacugcaaagcucugggagaagcuggaauuagcagcuacagucucccuacaaaagaagaacaagagaagaauuuaggcugggcuugcugacuaagcauacuuuuacucccaagaguaucuuguacaagauuauacaagaaccuacuggaguauccaagagagguaacauguuuaacugaagacugggagaaauuaguucuggugggaaauccuuaugccccugcccucgcucagcaucgugaugggacuccuggggguaaguugcauccccuccaucuaguucuccugggaaucccucccuggaaucuuccaccacucuucucccccacucuacccccucaacugccuccuggaccucuucccaccaccccaccccuuggcucucugguccuagccccagcaccagcucacgugaauuccugaaugaacacagucuugguguacuugucuagugaauacaggacaacaucugugaucuggucaacugaacaagccaggaaaagcacaugauuauaaucagucagucauccuugagaccccagcucaguguccuuagaugugaccuuauacauaggcacacuauacaugaugcagugagacaugcucauugacaaaacaagauaugcauuuugacaagcccauguuagagggaaagccuagaugaaugcagacagguaagugagauagaauuuugggaaaagaccuguggcuuugggaccaggugcacagggaugggaaaagaaacucaccugaaaucuugauuuuuuugaugaccuuguuggugcaguuguugauagaaacauugacagagauggguucuccgugguagugaaccuaaagcaggagcggggacccaugucaaggcuggaggacgaauacgcagauggagaccuagaaccccugcuuccuuagcgcuauugccacccuggcucccaucucugccugcccaaguaggaaaucagugaagaaagggcaucagagggguucuggggugggaggcaaaaagugggggucacaaaccucccuguccauccaggccuggaguuguaggggcugagcugacagaaggaagcggcggauggucugggcugaggggccagggccugccuccgguggugcaaauuguacuuuccggacaaccagccgcacauagucucugagcagagaccaagagauuagccagagcguccuccuuucagacccacagaccucucccaugccacccccauaguccaauuguugcuuaagaaugggagcaggggaaggccucccucagagaacuccucuagucccuuaauguaagcauguagaccaaagguuauuaaacuauggcccacuggccaaaucuggccugaugccuguuuuccuauggcccacaagcugagaaugguuauauuacauuuguaaaugguugaaauaaaucaaagaacaaugcuauuuugugacauguggacauuacaugaaauucaaauuucaguguccauaaguaaaguucuauuggacacacagccacacucauucauuucuauacuaucuguggcugcgauugcacuacaacggcagaguugaguaguugcaacggagacuauagggcucaaaaagccaaauauuucuuuuuuuggcccauuacagaaaaguuugcugaccccugcccuagaucaaagaagguaagucagaggggacucagaaccgggugucacugguggcgaugaggcuguggagguuagaaguggggcuauuucugucaugagagcaggaucuguuuccuggcagaggcuggaggcagggauuuuuggggacaaccaaagaauaccucuuggagacugucuccucuggguuuucagcacagaaacucuucacuucaaagucaaucccacagggcuguaaagggacaagggcaaagagagcucauuuccagugcuguccucccuuccucaugggccuauaagaaaaugccugaccucuuuccuuagcuguccauuucuccagucuugacugucccacuguuccucuucccuggcacuaccuaucccucuuucuuagaacccaguccucaccuuuccugcaucuucaggaccuggcugcagugucacagaacagggcagguuggucaccaucuaggggacaaaaaggagaucagaaaagaaguagaaaagaauacaaacaaauacaaaagaaauggggaacccucucccuuguuguccuucuugagcuuccucucuuaaucuucccuggagaccuugccugcccagggcuuggggucaguaccugcaggguaaagggguaggcauuguccccuagcuugugcaguagucgcuccuguaggacugugaggggccccugagggcugcuggauucagcugggaccacuugcagggucugcacauacagaucuuuucggaacgucagaccaaucacuuccaagucaucacggccauagcgaaaggcacaugucaacaugacaaacacugcaggcauaggaggaagagaguggucugucaggccugagugggaaggggaaucuuaacugggucaagaagacacagagaggugauguaauaugaucgaaggcuggcugggcgcgguggcucacgccuguaaucccagcacuuugggaggccgagguggguggaucacgaggucaggagauagaaaccacccuggcuaacacagugaaaccccaucucuacuaaaaaaaaaauacaaaguauuagccuggcuuggugguagugggcgccuguagucccagcuacuugggaggcugaggcaggagaauggcgugaacccaggaggcagagcuugcagugagccgagaucgugucacugcccuccagccugggcaacagagcaagacucugucucaaaaaaaaaaaaaaaaaaaaaaaaaaaagauugaaggcuaugggcacaaaugaaaagauucuuaauacauuugacugcaguaaaauuuauguuaaaagucuuuauaaagucuucuuuauauucaaagucuuuauaaacaaagaaaaaaauggaaagccugggagaaaaucuuugcaacacauauaacacacugaaguuuagaguccaaaauauauaaggacucccacacaucaacaauaaugccaguauaaaacugugcaaagaaugugaauaggcccuugcagaagugugcaaagugugugaaggaauggccaauaacauaugaaaacauguuuagucucgugaguaaucagauaaaugcaaauuaaaaccacaacgagauaagauuucacacccaugagauugucaaaaaauuuuaaaugugacaacacuacguguugaugaagauguggagcaaaaggaguucuuacauacugcuggugggaguauuaaugcaaccaauuuggaagacuauuugggauuauccaguaaaauuaaaucugcucguagaguaugagcuaauaaguugacuuuaaaggagcuuuuguucaggagagauacauaugauaauggccgucgcaucaacguuugucagaacauaaaacuggagauaaucuaaaaaucuaucaacaggagaauggauaaaaaauuugugguauauucacauaauggaauacuaaaccaagguuaaaauaaaugagcuagaacuucaaagaaugcccuaugguuuguauguggccucuccauaacucaggaguugaaacuugauggucauugugaugguauuaagauggccauuaagaggugauuagaucauggggcuucuuuguucaugaauuccuuuaugaaugggauuaagacccuuauaaaggagaccuuuugcccuuccaccuuccaccaugugaggacacaauguuucuccccucuggaggaugcagcaauaaggcaccaucuuggaagcagagagcagccgucaucagacaacagaaccugcuagagccuugaucuuagacuucccagcuuucagaauugugagaaaauaaauaucuguucuuuauaaauuaccuagucucagguauuuugcuguggcagcacaaacagacuaagaccugugccaacaagguuaaaucucaaaagcuauugaacaaggcugggcgugguagcucacgccuguaaucccagcucuuugggaggccuagguggacagaucgcuugaggacaggaguucgagaccagccuggccaacauggugauaacccgucucuacuaaaauacaaaaauuagcugggcaugguggcauacaccuguaauuccagcuacucaggaggcugaggcaggagaaucgcuugaacucgggaggcggagguugcagugagcugagauugcaccacugcccuccagugggggugacagagugagucucugucucagaaaaaaaaaaaaaaaaaagcuacugaacaaaaaaucuagcugcagaaugauagguacaguauguuaccgguuauauaaaguuuaaaagcauguaggacaauaucaaaguugaucauagacacauaaauauggaguagaaguauggagccaucaagagaauaauaaacaccaaauucaggguagucguuaucuggggagggaggagagaaagaggagaaggguuaaguagggagggagggaggcaaacuggaucagggaaggacacacaggaggcuuuaguuuguuucuguaauucuuuuuaaagcuuggugaugaguacaggguauucauuauauaauucuguaugccuugauaaauauuuuaucaugaaaaagagaaacaauaauauuuagggucagaauaccuggacuugaauaggacuugcacaaaucccuugauuucucugggucucaguuauuacaccugucaauaauaggacugcucuaguaacccuacauaugccauuuagaccucaaaacaacccucugaaguauuauuaucuccacuuuagaggcaaagaaagugagcucagagcuauuaagcaaugguucaggauuucaacccaggccugucugacuccaaagcucaggcucauaggugcucaacuuaacucauaggacaguugugaggagcugauguauucgaaaucccuuuggaggccgggcacaguggcucacgccuguaaucccagcacuuugggaggcccaggcggguggauaggcugaggucaggaguucgaguccagccuggcccacauggugaaacccugucuuuacuaaaaacacaaaaauuaaccgggcgugguggugggcaccuguaauccuagcuacucaggaggcugaggcaggagaaucgcuugaacccaggagguggagguugcugugagcugacaucgcaccacugcacuccagccugggcgacagagcaagucuccaucucaaaaaaaaaaaaaaaaaaaaaaaaaggaauccuuucggaaacuucaaaauaauuauagauguggaugaugauggugaugaugaugauauugacagaaauggaagaguuauaauugaacucauacuuuguaacagguaucuaagauuugaaagaaaucaagugagaggcggauagaaaucaucugaaaugcgcuaauggaauauagaauggaguagagagggauaccuguccaaguacagggugacagagguugaggcaaggaaagauguagaacaggaauggauaaccuuauuucuaucaggggcucugacccaaagaaaaaauaaaaacuaccaacagcagcacuugaguagaaagcaacuuauuuuaguauuuuuaagaacucaaaacaucaaacaccagauuauuugcuuuuaaaauugagaaugagaaaaaugaaccuauauucaaaagauauagcaaagccugaaaguauugauaauaucaguguuuauaaggacuggggcaauaugagaagacucaugcacugcaggagugagauuuaauugguauaagcauuuuagagggcaauuugacaauagguauagaaagcuuuaaaaaugugugaaugccuuuuggccauuaauuccucuucuaggcacuuagaaagaaauaauugaacaaguaugaaaaggaugugcauuacagggcguugugguauccccauaugauauaguacuaggcaacuuaaaaaguuauagauuuguguauauugacauagguuuaaaaaauguaaaauauuauuuuuaguauagcauuuuuagugaaaauauagauauguuugcacagaaaauaugaauaaauaagaucaaaagauuagugauuaaagaugguaagguuacacagucucuccuucaucuauguuuucuaauuuuucuacaauggagacaaaccuaauaauuuucaaagauacagcaaauagauucaccuugguucucaauuauggccaauuauagugagagaaaggagagagaaagaaaggaaaauaaggcacaaaggaaaggaaaaagacagaaaguaaaaaggagaggaaaagagguggcugguaggaggcagggugagagaagaaaugaaaaagaugaggaaugagacagaaaaaaaggucaggaugggcgaggcagaaggggaucuaguagcaccugagguaaggacguuaaucagaugacuuguucuuggaaucgcuuucuguuccuguguugggaaggcagcagacuaagacaucaacugcaucacgcaacuccuacccccaacugaagcucuaauuggcucucuagcaguuuagaaucguccuuuuuuuugcaugcuaggaaauagcuuguuuuuauuuucuuuuaaagucaguaucuauuuuaaaguuauuaauguauaguuguguuuauucuacaaaauauauguuaauugucugaacaucagaaaauacaaacaaaaagacaaaucaaagcuccaccauaauauaucauguuccacagauaacuacuguuaauaccuguuaugugugcuucucaacuuugucuguugcuauaauugaacacaaggccaccuuagguauuuuuuacuuuucucucauugccuuuuugaaguuaaacuuuguauuuugagaucauuguagagucacaugcaguuguaagaaauaauacagagagagauuccagauagauuuuuguuaaacaacaauucguucacaccaccacauauacugcccuaucacuggccuuuaucacuccacaguauaggguaagcauauuuuacauccacaaauguaccuugauagaaaaacacauuagaaaauaugaugcaaacaagacaaucuucacagagguaacaaaccauauugaaaaacuaagaauaaacaagaaauaugcacaacuuaaaugaaaaguaauauaaaacucuacuaaggggacauaaaagaagauuagaauaaaaggaaaaaugcaucucuuccuggaacaacauauauuuuuaacuaaagauuucuuuccauagcuugugaagauuuuguagaaaugugaaaaaaugauuuagguuuuagaaauauagaauacuugggaaccuuaaauaaguugguuaauuuaugagucuaucccaaaguuccucugauacuuaaaaccgauuugauugcuuauuuacacugcuuaaucugagagauuuaggcuacuuuauucuccaauaucuaacaguuacaucugaacuaguauucaucaacccauucagagccuuuuucaaaucaaacccaauuuucagucuaguuggaucacagugggguuaauccauagugagaauuaaaaggaaaaaaagcagcaaaaaaaaaaaaucagcauaaucuugaucuguaauacugcugccagaguaauguuucuuaguguuacuuccuaugguuguuguuuuguuucuuuguuugggauuuuuuuuucuugaauaaaaggucagccaguuucccuacacaaaaaaaggagauggaaagacguauaccagagguuacaaaaugacagccugaaagucacaucuagccaacagaaaaaaaaaaaaaguuuauaaucuauccaggcuucuaaagucuuuuagugaguugcugacauuugaaaaucaggaaauuugccuuaaaauauggauuucugacuuacuggaucauucuauaggcagucuaagauccagaucaauagccaagcaggggcaccaccaguaauaauagagaaaaucugaaauucugaaagaagcuauuuuaauuucagcacaaguguaaguuuuguguaauuuugaaaaauaaaauuuaauuuaugcuuuagauauuuacuuugaauauuauuuggguaagggggcaccauaaucuuuucacacuuugggccucuaaaagucuuauuuugagcuucguuuacagcuccucauuaacaauuagaaaauuuggccacacugggcuggaauucccaguugucagccuccaccagagaaggcauucgcaguuccugccacuuucugguuuuguuguacucuggugcaauccacucaucggguuaccugucugaaacauacaaagaccaacaaggauuuccacuuacacuuucgacauuuuaaguacucaggaucaaccaggacaacaccgucuguggagagaaggacagacagcacuuuggucaggaaaaacucucagacuaugaaacagaggaugaucccugaaaugguucuuccuauucuucccuuuaauuugccuccuuuucugcacggucuuuccuggacuuucuuuuacucccuaguuuccauuccucuuuccccaggcuucccuuuuuuggacucacugaccaauggguuccaccguguccacaugguccacgaagucccguuuccccagguagauggagagcuguuguggaacaacuucccauguuauucucacaaucauuuuugaauggauuccccugaaacccccaacccagaccccugagaccuugaaggauguacccaccuaucccuuuugcccucucauuugcccagcugggccagguucucucaccuucccauuggagcuggucuucuuaaacacccuaugaggagaaaaccagaaagaggauggagagggggauuggaagugcagggaagaggaaauaagggaauuggggagaaaaagaaauauucuuaggauuaggagaagaggcuccaggagcauaggauggggcaaagguagggauaauugggguagaauccaaggacacaaguuagggagaaauuggaaaucccccuaccccaaagggaaauacuuggauugggguagggagcaauucacagguucagaggauuagaaggaauucuuacuuggacauguuggcuauauaguugauguugagccuuuucugggaaaagggaaagaagaaaggcucaaucauuucauuucuauucuucucaccccacuccagcauaccauccauauacaccuagugugauguaaccuuuccuccuuagacagacaccucacccacaucaaguaccuccuauucucccuucugccaaggguacuucuucagccauauucuugcccaucuugggcaagaggggaaaaaaaccuuccuauuuuguacaaaucauugacuaaccauacuauguauucuccagaaagggccaaacuuccuagaauggcuggggaacucuugagaacccugagagagaaggaacuucucuggaaagaggcuggacagaggcuuccauccagaaaagugugagaaaaauguguuucuuggucuguaugaggcuagacauccccuggcacacacuaggugccaagacauguuuguuggauacaugaaugaaugaaugaaugaaugaaugaauggacaaaucaauggauucugucuccuucugcuccugcaauggauccugaaccugaguucaccucaugaugcccuugacucucaacaaagaagggagaaaagugugagagagaagggguuggugccuucaugcucucaguuuuuggugacagaagucucuauggagguugaaaguccuccuugaaccaacucaucccucucauugccuuuccuagauuuucccauccuuauccccauccagguccccaggggcuaggccuuuggaugggaauccuuagagagagggagaugucucucuagugcuuuccuuugaugcuuacugagccuggcccagggggugagcuuaggggagcuuccagaggucuuuggagggucucuaggccugaaugucuauaggcuaugucaggaagggugucccucaacugcugccugauauauuaagagggaugcuaagagcaagggauauagggcuuaguaugggcuagaaguagagggcuuuggaauauuaccuggggagagagaugaaguucacaucagucuccagcucugguugcuaugccugccuccccagccucuuauacccacaguccucugagug

SEQ ID NO: 19094 - RNA, 5405 nt, Homo sapiens
aaggaaaggcacaucuggcagcccucgcuaaucucuuuggggaccagagggcgacaacgcagcgccacucuuacgggaauucccuucaccucuuccuucaugauccuaucucagcaccgucucugcgagggggaaaaagaaggcucgcugaugaauguuaguaggucagcaggggugggagggcguccuccccgguuccgacccuccucagcgggaacacugacuugggagauucacgcuccaugacuuggccagggcuggaccgcccgucagcccugcacucuaaagagagugcacgggcuucugaaaggcaaagaaaaaacuccaacggggacggcgacaaagaaccaaagcccuaggguacuggguaaaaacagguucugagcuaaggugugcccccguaacucaccaaacuaaaugucccuuccccguucucccugggccucccgccgcccugucccagccggagcuuuaaccgccaaguuucaaauccgucccggagacgccaaccaauugcagugcggacugcccgagggcggagcgcgcacgucggcgcgcgcaggccggcgcggugggaaggggagggucagcucguugcacccuggcccggccucuuuucgacccugcggagcauccgcuuccgguucccagacugaauugucagugagcggagucugaggucgcuguggacugcccacuggugagguggugcggcguuuaugcggcugagagugcgggucucaggcagaauguggggcggggacgugggagguggcuggucaggugaaggaagggucgaucuaaggacccuaccauuacuaaucacaucuaggaaauguggggcggugccuugccccgagucccugcggauaguuaacacucccuugggcuucgaaaguagaucuuuuuagacucgacccugauuuccucuucuccagguuugagacgguaacaucuguuuugcaggauugugaaaaaugagguccucuuucuagaguaccugacagguugcuuggcauccagaagauguuuagcuaaguuaagaguuuucuucugucuuccuucucuccuccaaccuuaacaccuagauaugggcugggccuguagacugacugccuuggaauggguuggagcugcugucugaaacuugcugggcugcucucccuuuugaaccacuuuuugucuguucugauucacucuuccagggccuugcccgagauggacagccggauuccuuaugaugacuacccggugguuuucuugccugccuaugagaauccuccagcauggauuccuccucaugaggugggaaccaucuguauuccugaguaggagauuuuuuuccccgugggcaugagaugaugcaugaaagguaggauagcaggguuagaaggcgaaacggagagugaaucuuagcacuuguagccagaggacccagaagcuggauucugagcaacaggacccauugggaacuucuuuauggaagccuccugcuagggucuguucacaccgguuaauucuggaaauuuggagccuucauuuccauacuguuaagagguucagcgcgguggcucaugccuguaaucccagcacuuugggaggccgaaacaggcggaucaccugagguugggaguucgagaccagccugaccaacauggagaaaccgcgucucuacuaaaaauacaaaauuagccgggcgugguggcacaugccuguaaucccagcuacuagggaggcugaggcgggagaauugcuugaaccugggaggcagagguugcggugagcugagauugagccauugcacuccagccugggcaacaagagcaaaacuccaucucaaaaaaaaaaaaaaaaggugaagaaauggggagcuacugggcugccccagugcuauccaucuacucauuuagucuguguuaucuguucuacuuaaauuaagucuaugaccuuuccuuuuccugacuucaggguaauucauuaguguuucagaugaagguaggugugaaguaagacugguaaaauuucugggguugcugugucuugcagaggguacaccacccggacuacaacaaugaguugacccaguuucugccccgaaccaucacacugaagaagccuccuggagcucaggugaacuuaugaaaccuuauuucaggcuagauucauccauaccacaaauuggcaguguuggggggauggauuggaaagcaggugcagaugugaggaaacuuuccuucuuguggacagaaaagcugagauaacacuucugcaacuucugacuuuccucucagggacacacaagcugagcuauuguacgaugaugcuacuaguuguucuuguguuuguggucuccauugagcccccauucugugcucuugucuuacaguugggauuuaacauccgaggaggaaaggccucccagcuaggcaucuucaucuccaagguauuuaugcccaguaggcaauauggaucguuacuucccuuuguuaaauuaacagauugcagaacccuaaugucccaagggcugagaggaugacucuggauucauagaagggguauaauggagacacccccuuucccacuuaaaacuuuucauuuggcaggccaucugucugcauacauugucacagaaaaacaauagcaccauacauuugaauagcaccgaauuucacugacagucuucugaaauuaucgcaucccaaucacauguauucucucuuuaccaacaggugauuccugacucugaugcacauagagcaggacugcaggaaggggaccaaguucuagcugugaaugauguggauuuccaagauauugagcacagcaaggugagcacaguacuugggcuguggugcugcaagaagccaucucaaauaggacagauuggacaggaguagccuaaucuguaacuuaauaagaaagcauuuugcugggcacugugguacacgccuguaaucccagcuacuuaggaggcugaggcgggaggaucacuugagcccaggaauuuaagaccagcccaggcaacgcagcaagacccugucucaaaacaaacaaacaaacaaacaaaaagagagagagaaaguaagcaccucuccugggaaaguacaggagggaagcagcuauuagugacacacagguuggaguggcaaaucccuuucccccuauuaugauucugucuugggucauaucucuucauuuguacaagcugcuguguuccuuccaggcuguugagauccugaagacagcucgugaaaucagcaugcgugugcgcuucuuucccuacaguaagugccacuuucuuuuuucacuuuccugacagggcccuaaguaagaacucuuuaaauacugaugacuagaggcccuacaaguuggggauagggaaucaggagcucaagcgugaagauaaccugcucuguuccuccuuuucuucuucuuuccuucagauuaucaucgccaaaaagagaggacugugcacuagaaaguugcagcccacagcccuucauguggacucugucaugacaugcuaacuagacuucaggggagccacuucuguuuucagccccucccuggaauagugaguugggaggauggggagacagcuaaccaacugcauuacccaaaccauauugcacuuuuaguucccuaguuuucuaggugagcuucauucccugaaaggaggaugaugauaucuaggcauaaccuagccugugaggaaccuaguuaggaaagacaacugacauuuauugaauaucaugcacuagucccuuacauaugucauauuuuaauuauagaaaucaguagcaaaaagaaucuuggggauuuuccaucugacuucccuggccaucuuaucccauccuugcacuaccagaagauucauacacuuuugagacuccagugagacgcuguuuucaccccuuccuccuccuagccucucucccaaaaaguaaaacacaaugcugaagaaauauuggugugacuuuugaauguuaccgauuggauguaaaaugcuaucgagggaagaaaaagcucuuccaaagagaggagccacuggaaggaacagagcaauacuauaccuuccucgcaacuaccugugaugucugaccagaacauuagcaaggccaaggaacuuuaaccacaguauaacuaagaaauggcauagagugaggggcacugaaagaaacugcccguuccccuaggagcuuugagcauuucucugcaggggacaguaguaauauaauucucucuucuccuuucccacauucuuugaucuggaacauaaacuaaggaaggggcuuagaugcauuucuuuucugaggcagcaguaagaaauugguucacaguuuccaacuuguaaguugaguagugcuaacugcugacuucucccuuuucuucaccccagccccaaauaacauucugccauguuccuagaucuuuaguuaccaauccaccauuacaagauuccuagucaugccuaugccaucgccacuggcauguuuaaaauacccauuuggaauugaaaguuuucuagugugaggcugggcgcgguggcucaugccuguaaucucaccacuuugggaggccaaggcagauggauagcuugaggccaggaguucgagagcagccuggccaaaaaggugcaaccccaucucuacuaaaaauacaaaaaugagacagguguggugggacacuaccuguagucccagcuacucgggaggcugaggcaggaggaucauuugaacccuggagguggagguugcaguaagccaagauggcgccgcugcacuccaggcugggugacagagugagacugucucaaagaaaaaaaagaguuuucuagugugguguggggugauguaccccuaugaugaagucccaaaauuugccuugaaagaauccuggggagcuuaaauauguauuuauaggcccuucuacuggacaaugauucuguuagucugagguggaaucuggaaaucuggauuuuuaaagaagcaaaggaaauaaguaaauaagucuucaaauguaggaaacauuguucuaaauaguaguacuauacuguaugaggaaggucugguucuuccuauauaucccacccuagcucuacugacauaccucuucuagagccucacugcuauuguuagguggcaacaucccuugagagcagagcuggagguagaauuaauguagcugucccuaugcuuccugggaaauccuguucuauccuccuauuugcugaccccaugccccgcauuggccacgaaagaaagaaaauaguagcuugguuacuuccauaaaggcauguugggugacuuggcugaauguugagguccaagacucuuccugugguuaacaggucuuaaaacauuguaucuaagaaguaugaaaaacaugguaaaaagucccagcca

SEQ ID NO: 19095 - RNA, 5670 nt, Homo sapiens
aaguguguguguuguguguguguguguguguguguguguguguguguguguguauuguguguagcgaggaggauugggggugggaucccaugacguuaccggcuccgccuccugguguauauaaggggcgcuuggcgcgcaacgaccccaagccgcagcuuugaagccugagcggccgaacucggcagcuccaacccaacucggcuuaacuccgccucaccgagcccaguccaagacucugugcucccuagguuugcaacagcucucugguaagcguuggggacccacacgugugucggaggggggacggcgaggguccgggcguaccuaggauucucuggcaaccauggcaugcaguugcaucaacggggccgugaccuguugcuggcgagacccccgccccgggaguuagggcucccgucuccaccccagcuccaaaccauuucuagaugggggcaggaaaaucugggaccugagucggggggcaucggguggaacccuuccucucugcugagaggagagugcgagcaaucucgggcugcccuggggccccucugggggcgcaucuccaaaucuuuagaugucgaagccccgccucgcuguugaugcuugcaggucagccuagcagggcuugggaggaaguaggggaacauuugcuuacuccccugggcgacagcugcgcuaguugagcagugugggcuuggugaggagggauggaauugagucggugcucacuuuuaaucugcagcgagguugguccccucucccucuggggggucugggggcugugucuguuugaagccccgggggaagccccuggguggagcucuguuuaauucccaaauagccacaggccaaggaacugacacauuagguuucaagauuccuggguugagauuaggauaaacccuaucaguuucuggcaagagaaagagaccuaauauugauugagcacuuacuaggcgccagccacucuacuucagggggcuuucacgugccauuucugaaauuagcccuuccaaaaaccuuguaagguauuguaauuccuacuuguuuaugaagaaacugagguuagagguaaagugacuugccuuugucccuuccauauccccguccucauuucccaauagcuccuuugcuugguggagggggucuuguaauucgcuuucagaguuuagggauaaugagcccugucgagggguuuuugucuuguuuuucaccagaucaucuucuucaauuccugcuaggaugccguggcaagcauuucgcagauuuggucaaaagcugguacgcagacguacacuggagucaggcauggcugagacucgccuugccagaugccuaagcacccuggauuuaguggcccugggugugggcagcacauugggugcaggcguguauguccuagcuggcgagguggccaaagauaaagcagggccauccauugugaucugcuuuuugguggcugcccugucuucuguguuggcugggcugugcuaugcggaguuuggugcccggguuccccguucugguucggcauaucucuacagcuaugucacugugggugaacucugggccuucaccacuggcuggaaccucauccucuccuaugucauuggugagauauggugggggagggagggaacugcacagccagcaaagggguuuuuggucaggaaaucuggguggaaguauucuuuauauuauucacaggaccucaaucucccuaaaugugcggguuugcugggggucuggggggggguguugaagguguggagaaauugcucauucuauccaucuccguccugguuuccuuaauuaagugaaugguuuugguucuuaaaaaguaauaauaggccaggugcaguggcucacgccuauaaucccaacacuuugggaagccgaggcagacagaucaccugaggucaggaguucaagaccagccuggccaaccuggugaaacccugucucuacuaaaaauacaaaaguuagccgcgcaggguggcuuacaccuguagucccaacuacucaggagguugaggcaggagaaucucuugaaccuaggaggcagagguugcagggagaggagauugugccacugcacuccauccugggugacagagugagacuuggucucaaaacaaaacaaaaguaagaauaggugaaaaaggcagggacuugugugagccuggggucugggaagaagggaacuuggccacauguuucucucucugcuacaccagguacagccaguguggcccgggccuggagcucugcuuuugacaaccugauugggaaccacaucucuaagacucugcagggguccauugcacugcacgugccccauguccuugcagaauauccagauuucuuugcuuugggccucguguugcugcucacuggugaggcaaagagcaggguauaaugguggggguugggccaggaggggcuaguccuuggggccagggauaaggaugggggaugggccugagaaaggcuuaagggaggugauaaugguggggaagaagaaaagcugggaaggaaccuagaggcagggaaacaaagcuuggacugaagacuuucugggaguccugaaugcauuucucccacaggauuguuggcucucggggcuagugagucggcccugguuaccaaaguguucacaggcgugaaccuuuugguucuuggguucgucaugaucucuggcuucguuaagggggacgugcacaacuggaagcucacagaagaggacuacgaauuggccauggcugaacucaaugacaccuauagguuagauggucacucuuaggagcugcagagcugggaaaaugaaggggaagaaggggaucugcugaaggauucuggauggggaugggaaaaaaugggaggcugggcuuugaagaccuagcuaacugguuuggcauuagagaaaagauacagaguuggcugaacacacccuuaccuucuccaacccuucuuccacucuagcuuggguccucugggcucuggaggauuugugccuuucggcuucgagggaauucuccguggagcagcgaccuguuucuaugcauuuguugguuucgacuguauugcuaccacugguaacacagucauuccauucuguuuggggcuugggcacagugugugcccaggcuguaugcagacugggggugguagaggagugggccugcuucccuaauuuagaaccuuacgcccuuccuucaggagaagaagcccagaauccccagcguuccaucccgaugggcauugugaucucacugucugucugcuuuuuggcguauuuugcugucucuucugcacucacccugaugaugccuuacuaccagcuucagccugagagcccuuugccugaggcauuucucuacauuggaugggcuccugcccgcuauguuguggcuguuggcucccucugugcucuuucuaccaggucaguaucaaauguuuguuuucuucugcugucagagucucagguuauagcauucaguaccagagaauaccccuuaaaagggcugugaggggaaaguggagacucuuuaaacauacagucuugggaagagagaucccagucaacucaugccacccugggcauucuccucuccagccuccugggcuccauguuccccaugccucgggugaucuacgcgauggcagaggauggccuccuguuccguguacuugcucggauccacaccggcacacgcaccccaaucauagccaccguggucucuggcauuauugcagguaacagacccucuuuccccuucccuuaguuguuucgccaacuucuuuaacuuugccacucccuucucucauuucuuguuuccugccuauuaauuuuagcauucauggcauuccucuucaaacucacugaucuuguggaccucaugucaauugggacccugcuugcuuacucccuggugucgauuuguguucucauccucaggugagacucuuccucugcauacugugauuuggauuuuuauucuuggaugaggaaugauggagaucugcuccucuuuccuccuucgccuucauuauuccaacuuucuuugaggaaucuggguaucucacccugccaaaaagaacuucccuuaauggugaugaggaagguuaagcugccugggagaagaugauaaagugaguaaagguuguucuuaauacugccaucuuacuuuugccucagguaucaaccugaucaggagacaaagacuggggaagaaguggaguugcaggaggaggcaauaacuacugaaucagagaaguugacccuauggggacuauuuuucccacucaacuccauccccacuccacucucuggccaaauugucuauguuuguuccucauugcuuggugagcaguggaauuuuucugggguggcucugagaucagcgugauugggucgaaguguguggcauuugguggcugaggaagaacuagagagagagcgacucuccuuggaacaggguuucuaaugucuuagcauguuggucuuaagaguugguuuugaugucucucaacuugaccuuugaagcuguccugcugacugcucuuugccuggugcuggcccaguggucaguuccauugcuuucuggagaccugcuguggacugcagugguugugcugcuccugcugcucauuauugggaucauuguggucaucuggagacagccacagaguuccacuccccuucacuuuaagguaaaugaacucugucuuuuuuccuugccagcccaucuugggagaauaggcuccagauaucuugaggucuaauaaaguucauagauauucuuuaauugaacaugaaagggaagauauaggagguaccuaggccaaagacuucuucucugacccucuuuaguuccuuuccaguuccauuuacccaaacugcauauucuuggagucucaugagguaugcuaaaugagcagcuacugaaaugcagaggacaaguaagaguuggacucacccuuuucuggccugcauaggauagggaucucuuucuaggucaaccugugguauguacaaagaagauuuuacuuuguuuucaggugccugcuuugccucuccucccacuaaugagcaucuuugugaauauuuaccuuaugaugcagaugacagcugguaccugggcccgauuuggggucuggaugcugauugguagguauccacuugggaagaguaggcuucuuugguguccuagcccagcuccuuucccucuuggucucaaguaggaaaccuaugaagccuuuacacccccaccucacagcuaccuuuccccacuaggcuuugcuaucuacuucggcuaugggauccagcacagccuggaagagauuaagaguaaccaacccucacgcaagucuagagccaaaacuguagaccuugaucccggcacucucuauguccacucaguuugacaucgucacaccuaaaugcugucugguccccugcacaauaauggagaguacuccugaccccagugacagcuagcccuccccugugaugguggugguggauacuaauacaguucuguacgaugugaaggaugugucuuugcuauuucuugucuauuuuaacccgucugcuucuaaaugaugucuagcugcuuaccaacuuuaaaaaaugauauuaaaagaaaguagaaaaauaaacug

SEQ ID NO: 19096 - RNA, 4222 nt, Homo sapiens
aggaaacguguggguggggagggguagugggugagggacccagguuccugacacagacagacuacacccagggaaugaagagcaagcgccauguugaagccaucauuaccauucacaucccucuuauuccugcagcugccccugcugggaguggggcugaacacgacaauucugacgcccaaugggaaugaagacaccacagcuggugggaaaucugggacuggagggggcuggugagaaggguggcugugggaaggggccguacagagaucuggugccugccacuggccauuacaaucaugugggcagaauugaaaaguggagugggaagggcaagggggaggguucccugccucacgcuacuucuucuuucuuucuuguuuguuuguuucuuucuuucuuuugaggcagggucucacuauguugccuaggcuggucucaaacuccuggccucuagugauccuccugccucagccuuucaaagcaccaggauuacagacaugagccaccgugcuuggccuccuccuucugaccaucauuucucuuucccucccugccuucauuuucuccccaaucuagauuucuuccugaccacuaugcccacugacucccucaguguuuccacucugccccucccagagguucaguguuuuguguucaaugucgaguacaugaauugcacuuggaacagcagcucugagccccagccuaccaaccucacucugcauuauugguaugagaagggacgagggggaggggaugaagaagagguggguuggaucagagaccaagagagaggguagcaagucucccagguaccccacuguuuucuccugggguaagucauaagucgguugaggggagaugaggcuaggcucuggauaucugcaguacccagauuggccccacuguuccucuuccuuccaaccuuucuccucuagguacaagaacucggauaaugauaaaguccagaagugcagccacuaucuauucucugaagaaaucacuucuggcugucaguugcaaaaaaaggagauccaccucuaccaaacauuuguuguucagcuccaggacccacgggaacccaggagacaggccacacagaugcuaaaacugcagaaucuggguaauuuggaaagaaagggucaagagaccagggauacugugggacauuggagucuacagaguaguguucuuuuaucauaaggguacaugggcagaaaagaggagguaggggaucaugaugggaagggaggagguauuaggggcacuaccuucaggauccugacuugucuaggccaggggaaugaccacauaugcacacauaucuccagugauccccugggcuccagagaaccuaacacuucacaaacugagugaaucccagcuagaacugaacuggaacaacagauucuugaaccacuguuuggagcacuuggugcaguaccggacugacugggaccacagcuggacugugagugacuagggacgugaauguagcagcuaaggccaagaaaguagggcuaaaggauucaaccagacagauagaaggaccuaauaucaagcuccuguucucugccucccagcuucucugcucacccccuacccucccuccuccaacuccuuuccccccuauuuucuccagugaguuuucuuuuuuucuuuucuuuucuuucuuucuuucuuuuuuuuuuuuuuuugagacagagccucacucuguugcccaggcuugagugcaguggggcgaucuugggcucacugcgaccucugucucccugguucaagugauucuccugcuucagccucccaaguagcugggagcaugcacaaccaugccuggcuaauuuuuguauuuuuaguaaagacaggguuuugccauguuggucaggcuggucuugaacuccugaccucaggugaucugcccaccucggccucccaaagugcugggauuacaggcgugagccaccauuccugacaccagugaguuuucauuagggauucccuacccauacucuuccugauaccagauagacaaguaaacaaaaggaagccauuaaggggauccagaggggaggcauuagauucaagucagugaagggagcaguguggcuugaguagucaagagaugagagagaaacugggcaguagcagagaugacacugguggguguucaggaguauguuuuaauucucccuucucucauagacacccacuuucccucauccucuuucuccucaaggaacaaucaguggauuauagacauaaguucuccuugccuaguguggaugggcagaaacgcuacacguuucguguucggagccgcuuuaacccacucuguggaagugcucagcauuggagugaauggagccacccaauccacugggggagcaauacuucaaaagguaaaaugggcccacaugacccaauccaugagcccaacaccccagccuuucuaacaccacugucuuuugcuccacuucccugucacuaaagccccuaaacuuggugccccaucucuccacacugucuaaccccaaccucuagaaaucaagguuuuucuguguaggguuggguuagcguguuguuagaguaggggaguggauugagaaggaggcugagggguacucaagggggcuauagaauguauaggauuucccugaagcauuccuagagagccugcaaggugaagauggcuuuggaaccagcuggaucuaggcugugccacauacuaccucuuuggccuuggccacaucccuaaacucuuggauucuguuuccuaagauguaagauggagguaauuguuccugccucacaggagcuguugugaggauuaaacagagaguaugucuuuagcgcggugccuggcaccagugccuggcauguaguaggggcacaacaaauauaagguccacuuugcuuuucuuuuuucuauagagaauccuuuccuguuugcauuggaagccgugguuaucucuguuggcuccaugggauugauuaucagccuucucuguguguauuucuggcuggaacggugagauuuggagaagcccagaaaaaugaggggaacgguagcugacaauagcagaggaggguuuugcagggucuuuaggaguaaaggaugagacaguaaguaaugagagauuacccaagaggguuuggugauggaaggaagccacaggcacagagaacacagaaucacuuuauuucauaugggacaacugggagaagggugauaaaaaagcuuuaaccuaugugcuccugcucccucuuucuccccugucaggacgaugccccgaauucccacccugaagaaccuagaggaucuuguuacugaauaccacgggaacuuuucggugagaacgcugucauaagcaugcugcagucuaucaacugccaacugccugccagcaagacagacagagugugggggugggggcagagaggagagggaaggaggcccugcacuaacugucaggauguggccgaccaaauggggcauggacuauacagagagagacacacacagaagugcagauuauagauugaaugaggcagauggcaacugguauugggggcccaggagccuguguaucccuucuguaaucaauuacagugguugcagacaucaugaguacuccuuuggcacagagcucggucuuuuacuuccugccccuaauugaccccugaccuggacauaucugucuuuaggccuggaguggugugucuaagggacuggcugagagucugcagccagacuacagugaacgacucugccucgucagugagauucccccaaaaggaggggcccuuggggaggggccuggggccuccccaugcaaccagcauagccccuacugggcccccccauguuacacccuaaagccugaaaccugaaccccaauccucugacagaagaaccccaggguccuguagcccuaagugguacuaacuuuccuucauucaacccaccugcgucucauacucaccucaccccacuguggcugauuuggaauuuugugcccccauguaagcaccccuucauuuggcauuccccacuugagaauuacccuuuugccccgaacauguuuuucuucucccucagucuggcccuuccuuuucgcaggauucuuccucccucccucuuucccucccuuccucuuuccaucuacccuccgauuguuccugaaccgaugagaaauaaaguuucuguugauaaucauca

SEQ ID NO: 19097 - RNA, 1852 nt, Homo sapiens
cauggaggcaguguaccugguagugaauggguugggccuggugcuggacgugcugaccuugguguuggaccucaacuuccugcugguguccucccuccuggcuucccuggccuggcuccuggccuucgucuacaaccugccgcacacgguacugacuagucuucugcacuugggccgcggagucuugcuuucauugcuggccuugaucgaagccgugguccgguucacaugugggggcuugcaggccuuguguacucugcuguauagcugcugcucuggccuagagagccuaaagcuccuggggcaccuggccucucauggggcacugcggagcagggagauacugcaccggggcguccucaauguggucuccaguggccaugcuuugcugcgccaggccugugacaucugugccauugccaugagccugguggcuuaugugaucaacagccuggucaacaucugccucaucggcacucagaaccucuuuucccuggugcuggcccugugggaugcagugaccgggccucuguggaggaugacggacguaguggcugccuuccuagcccacauuuccagcagugcuguggccauggccauccuccuuuggacacccugccaacuagcccuggagcugcuggccucagcugcccgccuccuggccagcuuugugcuugucaaucucacuggcuugguguugcuagcuugugugcuggcagugacggugacuguguugcauccggacuucacccugaggcuggcuacccaggcacucagccagcuccaugcccggccauccuaccaccgucuucgagaggaugucaugcggcucucucgccuagcacugggcucagaggccuggcgccgagucuggagccgcagucugcagcuggcgaguuggccaaaccggggaggggcaccuggagcuccccagggugacccuaugaggguauucucaguuaggacccggagacaggacacucuuccugaagcggggcgcagaucagaggcagaagaggaggaggccaggaccaucagagugacaccugucaggggccgagagaggcucaaugaggaggagccuccaggugggcaagacccuuggaaauugcugaaggagcaagaggagcggaagaagugugucaucugccaggaccagagcaagacaguguugcuccugcccugccggcaucugugccugugccaggccugcacugaaauccugaugcgccaccccgucuaccaccgcaauugcccgcucugccgccggggcauccugcagacccucaaugucuaccucugaagccuccuucccugccugcccaccccuccaugcuccacgcaggcacucacgcuaggacagcauuaacaccucaucuccggguccuggucugaauccccuccuaccccuguggccauccugccauacauccaggacauugaguuggaagacuaugaucugggugggggcaggauaacauggcuucucuuuacccagugggucccuucgaugcugaggguggugaguaugucacuaugcaagggcccugagacuauuugcugugggcucuccuccagccugcccagggcccacccagaugccucugggguuaccccugucugcuucugguuuuucuguuggagaucuauagguccuuuuccugccuccuucacauuuccuccccagcuuuugcggccacaacacaucagugucauuuggguguuuuggcaacucaggggccuucggaugaucuuaaaccuuuguguucagccagagccccugugcccugguaggcguugggguuaguaucucucgggugcccucagagccaccucugccugugaucgucug

SEQ ID NO: 19098 - RNA, 2727 nt, Homo sapiens
guccugacgaucuuguuuauugaaaaguuuuaagcaggauuuuagacauaaaaauaaaagagcaaauauagaggucuuggggaccauggccacagucacugcugagcuggaggccugggcuguggcuucauggggcagcacccucuacgccaugccuuguacuccccgcacuuggggaagaugaaguuuuaguuuccaaaugagaagggcaguggggcuccaggcagccaccucgggcggcaggauggggcuuggcagcuaaggagcagcaauggugcaguccucagagcugggaggguggcuucccgggagaccugguggugcuggggcugccagugagucccgggagcgaggauauuggggagagccagagccggcagagggagggaggagccuggaaugcggggaagucagacugugggcgaaaggggagcccggauuccggccucacaagcccgaguaggaggccucugaggucucagaccaggaugaaucccggcgggaagacgauggcugccucuggagcccucucugguuggggcagcccaggcgcaagagcagcauccacauccgcucccggaacuugaccccuacaaaggcauagagcagcggguugaggcagcagugcauguagcccaggccugaggugaccgacuuggccacgucuacccugcuuucucggccacaguugcgggccaaagcgcccagguccaugaggauguccaccagcaccaccaggugauaggggguccagcagagggcaaaggccaccacgaccaccaccaccagccgcauggcccgcaggcgccgcuggccccuggaaaccagcagcacggccaggaugugggcauagcaguaggccaugaccagcaggggcagcagaaagccagccaccagcugcagcacccgcagagccgugcggcccaccugugggaaguuguauuggcaguggguggcguugaggcgcucgucguggugggccgacaggaagaugaagucugggagggcgaaaagcaggcagagcccccagacagccaggcaggugagggucacgcgggccgggggcccccggcgguagagcuggguggcaugaacuauguucagguagcggucaaagcugaugcaggccagcaggagggcuccugcguagaaguugauguugaagagggcaccugccacuuugcagaggccagagccaaagacccacuggacggcagcguccacugcccagagcggcagugucagcaccagcagcgugucugcuacagcuagguggagcaggaaggugucggugcugcucagggcuguccgccggcucagcagcacggcugccaccgcgccguugcccagcagccccagcagaaagaggaggcuguagagggcuggcaggaaggcccggucgaaguucaggcugaaguccugugggcagggcggggagguacagcacgagucacucucguuuucuccauagucauaggaagagcugaaguucuccaggagggcggcaaccucggcgucauuuagcacuugguggucacucaccugugagggcgggaacggggaggaaggggcuguguaaaggccuggcaggaacucuuuugugauugagucugauuuagucugugauuuacucugagcagcuccuccuauaacuguccccgccagucuuccagggccguacuuccucaacuccauccgcucagccugggcucugggauagugacuucccuucucaaaggcugcuucucucgcauucuucugcgugaucccaucggcccagggaccccugggcaggaagaagagcgucccuccagugcccagagcccucucugcccacuguccucucucucccugcucucccuucaggcuugccuugcguccucagugccccacccccaacacauaguucaaccaccuuccuccccagcgccucuccacaauccccuuuuccagucacuaacccuccucuucccuccuuggcccuuguccggggaccccaacuuccugcgcccccccccaccguguggccucucuacaagucaccacgccccccaaaugcaugcagucugcccaguccuucccccucccuacacugaggcuugcacggccauuuagcugcccacaaggggaucccccacuuagcuugagaaggaaucuucuuuauccccucacccccagcacuauggaccugcaggucuccccaguaccaauuuaguccagcacgccaagagucaaaguuccaagucuccugaagggagccuucgagucuacuugccccccgccccccccauuuugcagacgagacaccgaagccagagaggagaggagaggcacccagggucaguggccaagcuggguucccaauuccccagugcuguuucugccacaacccaugcggccuccagcuacucacccaacccuguggugacccugggcugugggccagcccuggcauuccccugaugccccggguuuuccacuucgaauucuggccuggccuggcugggcagcagcacuuaccucaaggaccauggcugggcuggugcucuggcugcuggguggugugcugccugccccucugcuuuggugcuugugguuggaaaccugcagucacagaggaagugggaguuucaggcaguucucagcagcagccucuuccagggaguuaccucuaccagaccucccuaaaccucaggccacagaguuuccgugacugggugaaaccuc

SEQ ID NO: 19099 - RNA, 890 nt, Homo sapiens
aaugucuggagcgcuugauguccugcaaaugaaggaggaggauguccuuaaguuccuuguagcaggaacccacuuagguggcaccaaucuugacuuccagauggaacaguacaucuauaaaaggaaaagugauggcaucuauaucauaaaucugaagaggaccugggagaagcuucugcuggcagcucgugcuauuauugcuauugaaaacccugcugaugucaguguuauauccuccaggaauacuggccagagggcugugcugaaguuugcugcugccacugaagccacuccaauugcuggucacuucacuccuggaaccuucacuaaccagauccaggcagacuucugggagccaaggcuucuugugguuacugaccccagggcugaccaccagccucucacggaggcaucuuauguuaaccuaccuaccauugcucuguguaacacagauucuccucugcgcuauguggacauugccauuccaugcaacaaccagggagcucgcucaguggguuugaugugguggacgcuggcucgggaaguucugcgcaugcguggcaccauuucucgugaacaccuaugggaggucaugccugaucucuacuucuacagagauccugaagagauugaaaaagaagagcaggcugcuacugaaaaggcagugaccaaggaggaauuucagggugaauggacugcuccagcuccugaguucacugcuacuaagccugagguugcagacuggucugaagguguacaggugcccucugugccuauucaguaguucccuacugaagacaggagugcucagccugccauggaagacuggucugcagcucccacugcucaggccacugaauggguaggagcaaccacugacuggucuuaag

SEQ ID NO: 19100 - RNA, 3763 nt, Homo sapiens
cugccgugagggccacgguguccugaaggccuuguuguuccugucccguggccugcuuggcugggcuugguugggcucgaccaucuccccauaggccagggugccugaacuggcgccaugagcucccccgaugagguguccguuuggagggcugguuucgaccugggggguggcgagcaggcuggcaccugcacagucagccccggagccccacagggccacagccgaggccucgaucugggggcaccacacagcagcaagggcgagagcagguucacagaucccgagggcuucagcuucgagucugagagcgaauugauagagcagggaaggguggugcucuggggccaggaaggccggccuagcaccccggucgacgaccaaggggacgguguggacuacucguccuaccugguugaugagacagccgccaucgugccaccguccagcauccagggacacccguucccugaagacgccacuacugaaggguccgcugaaaacuggguggaccuggaggucggucccagugggagaggcaugcugagccccagcccuggagaauggcagcaggccucugccggcccucuccaccucaguguuccugaaccaggccgggccuggaagaacccagaaaggggcucgaagagcagauggagcguccgcguggacccccagcagcccucuguaauaggccccaccaggaugucuacccacgacucugauuccuccgaugagaccagugacuuaccacugaugaggaugggcauucgccacaaagaaggaagccaagccaaguucggcagccacaggaagccagcagacacauccagacacucaagcuuccacugcaaggagaguuacuugcccgugccaggccguuuccugaccucugcuccccgcggacucacuccagucguggagaggccggcugugggagagcuggaggacucucccgggaagaaaaugcugagcagggccuugggaaagguggaggccaggcccagcugcucaggagcugccacugcaggggcccugcccuggggcccuucuaagaggaagauggcccaggagaagucucuagggggugccucucaacuggcccuauggagacccuuuccugccugcggagagagacucucagccacucccccagggccggccaccucccagccauugccuggugugcggccgcaggggauguccaagaaaccccaaaagccuaagcacagcagcccugggaagaaaccagcaggaaggaagaccagggagucccaggcuguggcgagagaagauaaugacccaaauagagaugaggucccaagggcccaaguaaguaggcccuucucacccuccucucccucuucauccuccuccuccucuggucuccccccagccuccucucuuccagcacacaccuguuuacccaugcccccuaugucccuugcucaaggguuguuaucggaaggccagggacacuagaaugcccaaucagggucuucguuguaggggcacacguuaaagggaguacuuggugugugacgggcaaaccuccggacacucugcagggguccuaccuccucccccagagaggagcugggauggaaggcagggcuggcagcugguuagguuggggugaucccuuaaagugugggccgcaaaccuggggcaucuaggcucaucaacuucccgacuccuccuuacuuagcuguugcccgagccaccuggaaaggggcccaggcuaucucacuauccccaguguuuucccuggcugggcucugccuccuggccuggggcugacugggggagaaagugcuaaugagauuaggcucuggagucuccaucuuaccacaaccccucccauauguacucacugcccgcccccaccgccagcccgacucagaaauuucuguuuuagcuucccacacaccggccaggacugccucgccuauccacgcaucguggagaauucagcaguagcgacuccaacaucagagcuccccaaguucuggggacuucagagcccucugccuacagccugggaggccucgugcccagacgccaugcacccucuggugagucuugcggguuugauaggaguggaggggagaggggucgggagggaaaccucuggcucugucgcuucugggggcucagccuuguucccaggcuucccugcccacccaggcagguaucccaugggaaauggggugucgacagggcuggcuuuaagccacaucauccucucugagugggguuugugugguggggggcgauuuggagcagcgcuccaaacuccaacucuggaagacuuucggcaguacugagcccuuuucuguuaaguccugcucagccacacuggcccuccgagggccuggcuguggcugccccacugcugguguccaacccggagucacaacgcuagggggccacaggugcagaugggcucauacuggggaacagggaagacagucacagagggaggguuggagaugcugggcagagcaggggcaacauguugccagcagagggugauggugccucacuuuagacccugcuaggccuuuuccaccucacugggcggcuuggaagcuggauuuuguguucucuuucaggugacuggcagccaccuguccaucccccaagaccggaaaggcagcaauagcccccgggagcccagggcuguccucggguaauguuuuguguggcuccuagaaauccagguccacacuagauggugggaucugugucuagguuaaacugauagcugcauaccccccgacccccgccgccuccaccuucugcaccccagggagagagggugccuccuuuccauugaggauucugugccaacccaccucgccacugggcugcaggcuaugggggcuacuaaggguugggggagacagggaggacagggagagaggaggccagaauugacuaaccauuuaucuuccucuggugucuccuggacuagugcauccggcugcagagggaaauugaggaccuuagagaccaacuagguaugagggagcccuggcuggggcagggauggacagcagugucuuucugcaggugccgggggcaggguggacuguagguacaggcggcaucacugggacugacuuuccuuuggggaagagaaccaagcaggccuggcccuggagccuucugugccuuuccagcuaggggugugcacagacagcaauguguugucugaacuccauguacacuuaguccacgagucccagaacucuccucuuacgacgguuagagauaccucauguguuuucccuacaagccugguagggcuuguaugguguuugcuugcuggcuggcuuaucugucuuugaaacacguucugaaagguucugggaugccccagcaccugagaaccacuuuccugcuuagaaggcauuucuacauuuaauucaggugacgcguggaugagucagucccagggcuggugggguuucugguugcagggcuaggugguuccccaccggggcagggcguggguuucuguuucccugggucuggagugcccauuucugccucucucuuucagcggccaugcaguuccucacugacaaguuccaggaccuuugaagugaguguugcacacaccaugccccuuuccacaaucaugguaccuuaggagggcugugggcuggcccuggcugagggcccgucccugagccuacucuguuucacagguuggagccagcaucuuccuacaagaugaacagcugccaccuuugga

SEQ ID NO: 19101 - RNA, 4379 nt, Homo sapiens
cacaggcucuugguuugucccgcugcccgucauuugacuggguggaugcacucuggucgggucuuggggccagggugcacuggagcucucgauccacuucuuucuuucugucuugcucccucuggccgggcaccuacuuuuuaaugauagcuccucugugugccaggugcuucucgugcaucaggacauuuauucucccaagcugaugagcugggggcagcucuccccuugacuuccgccuuacaaugggacacuggggcucagagacguggcugucauuggaaaguaggugccuggccagaggcagcaggacaggaagaaagagguggauggagagcuccagugggcccuggccccaagaccugacccaaguacaaccacccagccaaaccacgggcguccgggcaauccaagagucugccucccaauuggguaaagcccagaagccgcgcccaacaaggggcacgcugauuggcgaugggcagaccaaugagaaggcguggaacaaugagaaggcaggacgcaggcauugagggagcccggaagccacgcgcugucagugacaucucgugagcagacuguggugaggguggcggugucccaaaggccuugcuguuccuguggccccagagcaccacccuucccugcuguaucaauucgcucucaggcucaaagcugagaguggcccccucggcugggcuuggcugggcucggcucuccucucccacuguuaccaggacgacugucuccccacagccuggcugucuagacuggcgggcgccaugagcuccacggaugaaguguccguuugcagggcugguuuaggcccagaggguggcgagcaggccggcgcccacaccgccagcccgggagccccacggggugacggccacggccgagaccucaauuuuggggggcagcgcaguggcaaggguaagggcaagggcgagagcggguucacagaucccgagagcuucagcuucgagucugagagcgaauugauagagcagggaaggguggugcucuggggccaggaaggccggccuggcaccccggucgacgaccaagcgggugguggggacuacucuuucuaccuggcugaugagccagccaccaucaugccgccguccagcguccagggacacccguccccagaaggcgccacugccaaaggguccacugacaucugggcggaccuggaggucggucccaguuggagaggugcgcugagccccagcccuggagaauggcagcaggccucugccggcccucuccaccucaguguuccugggccaggaccggccugggagaacccagaaaggggcucgaagagcagauugagcuuccaaguggauccccagcagcccuccgcggaaggccccgccgggcugaauacugacgacucugauuccgcagaugagagcagcgacuuaccggugauuagggugaucauuagcaccaaagaaggaagccaggccaagcccggaagccccaagaagccaggagacacuugcggacgccgcaguuuccaccgcagggagaguuaccuucagguucagggaccucuccugaucucuccuccccgcagacucaccccagucguggagaggccggcugugggagagcuggacgugccuuccuugaagaaaaugcagagcaugguguggggaaagaggggggucaggcccagcugcucaggagcugccguuagagggccccuaccccggggcacucugggaaggaagguggcccaggagaagaaaucccuagagggugcaccagaacuggcccugcggggagccuuuccugccugggggcagagacuuucagcaguuccaccugauccggcuagcuucccgccagugucuggcguggggcuccuggggaaguccgugagacccaaggagcccaagcacagcagcccugggaagaaaccugcaggaaggaagaccagggagucccaggcugcggccagagaagauaaugacccaaauagagaugaggucccaagggcccaagugaguagguucucuucgcgcacuccuccuucuccuccuugcucuccucuuccucuuucuccucugucuccccccacccaccucucuuccagcacacgccucuuugcccaugcccucucuaucccuugcucacagguugucaucgggagcccagggacacuaggaugcccgauugggguccuccucuuaggagcacacauuaaagggagcacuuggugugugccaggccuggcucuggacacucugcaguuguccugccuccucccugagagaggagcugggauggaagacagggcuggcagcugguuuggaucagggcgcaaagcuugggcaucuagacucaucaacuucccaauuccuccuucccuagcuguuaagcaagcccuccugucuugggguggacugagggagaaaguguuaauaagauuagucuggggucuccaccuuaacacaaccccuccccauguguacucaccgcccguccccacugccagccugacucagaaauuucuguuuuagcuucccacacagaagccagagcugauuucucuguccgugcgucguggagaauacagcaguggugaucccaacaucagagcuccccaaguacuaggaaccucacagcccucggccuuuaccuugagacgccuggugcccagaugccaugcauccuccggugagucuugcggguuugauagggguggaggggagagggguccggagggaaaccucuggcucugucgcuucugggggcuuagcugugcucccaggcuucccugcccacccaggcagcugucccacaggaaauggggugucgacagggcuggcuuuaagccacaucguccucucugagugggguuuguguggugggggcgauuuggagcagugccccacauuccaacucuggaaggagacuuucggcaguacugagcccuuuucuguuaaguccugcucagccauaccggcccucccagggccuggcuguggcugccgcacugcuggaguccaaccuggagucacaaugcuagggggccacaggugcagaugggcucacgagggagaacagggaagaccgucccagagggaggguuggagaugcuaggcagagcaggggcaacauguugccagcagagggugauggugccucacuuuagacccugcuacgcccuuuccaccucacugggcggcuuggaagcuggauuuuguguucucuuucaggugacuggcagccaccuguccaucccccaagaccggaaaggcagcagcagcccccgggagcccagggcuguccucggguaaugcuuuguguggcuccuagaaauagagguccacacuagauggugggauccauguccagguuaaacuaauuucggugucuccccaauccccucugccuaccauaccccaugcagagugagugccuccuuuccauugaggguuuugugccaauccaccucaccacugggcugcaggcuaugggggcuauaagggcugggggagacagggagaacggggagaaaggaagccagaauugacuaaccauuucuuuuccacuggugucuccugggcuagugcaucuugcugcagagggaaauugaagaccuuagagaccaacuagguaugauggagcacuggcuggggcagggauggacagcggugucguucugcaggugcuggugguggggguggacugcagguauagguggugucacugggacugacuuccucuggggaagagaaccaagcaggccuggcccuggagccuucugugccuuuucagcuaggggugugcacagacagcaaugugucgucugaacuccguguacacuuugucuacaagucccagagaucuucucuuagaacgguuagagauaccuuauguguuuuccuuuaacugcugccugguacugcuuguaugguguuugcuugcuggcuggcuuaucugucuuugaaacauguucugaacgguucugggauggcccaacaccugagaaccacuuuccugcuuagaaggcauuuccacauuuaauucaggugacggguggaugagucagucccagggcuggugggguuucugguugcagggcuagguuuuuccccacgggggcagggcguggguuucuguuucccugggucuggaguacccaguucugucucucuguuucagcugccaugcaguuccucacugacaaguuccaggaccugugaagugaguguugcacacgucaugucccuuuccacagucccaguagcuuagaagggcugugggcucacccuggcugggggcccaucccugagcugcucuguuucacagguuggagccagcaucuuccuacaagaugagcagcugcuaccuuugga

SEQ ID NO: 19102 - RNA, 4379 nt, Homo sapiens
uccaaagguagcagcugcucaucuuguaggaagaugcuggcuccaaccugugaaacagagcagcucagggaugggcccccagccagggugagcccacagcccuucuaagcuacugggacuguggaaagggacaugacgugugcaacacucacuucacagguccuggaacuugucagugaggaacugcauggcagcugaaacagagagacagaacuggguacuccagacccagggaaacagaaacccacgcccugcccccguggggaaaaaccuagcccugcaaccagaaaccccaccagcccugggacugacucauccacccgucaccugaauuaaauguggaaaugccuucuaagcaggaaagugguucucagguguugggccaucccagaaccguucagaacauguuucaaagacagauaagccagccagcaagcaaacaccauacaagcaguaccaggcagcaguuaaaggaaaacacauaagguaucucuaaccguucuaagagaagaucucugggacuuguagacaaaguguacacggaguucagacgacacauugcugucugugcacaccccuagcugaaaaggcacagaaggcuccagggccaggccugcuugguucucuuccccagaggaagucagucccagugacaccaccuauaccugcaguccacccccaccaccagcaccugcagaacgacaccgcuguccaucccugccccagccagugcuccaucauaccuaguuggucucuaaggucuucaauuucccucugcagcaagaugcacuagcccaggagacaccaguggaaaagaaaugguuagucaauucuggcuuccuuucuccccguucucccugucucccccagcccuuauagcccccauagccugcagcccaguggugagguggauuggcacaaaacccucaauggaaaggaggcacucacucugcaugggguaugguaggcagaggggauuggggagacaccgaaauuaguuuaaccuggacauggaucccaccaucuaguguggaccucuauuucuaggagccacacaaagcauuacccgaggacagcccugggcucccgggggcugcugcugccuuuccggucuugggggauggacagguggcugccagucaccugaaagagaacacaaaauccagcuuccaagccgcccagugagguggaaagggcguagcagggucuaaagugaggcaccaucacccucugcuggcaacauguugccccugcucugccuagcaucuccaacccucccucugggacggucuucccuguucucccucgugagcccaucugcaccuguggcccccuagcauugugacuccagguuggacuccagcagugcggcagccacagccaggcccugggagggccgguauggcugagcaggacuuaacagaaaagggcucaguacugccgaaagucuccuuccagaguuggaauguggggcacugcuccaaaucgcccccaccacacaaaccccacucagagaggacgauguggcuuaaagccagcccugucgacaccccauuuccugugggacagcugccugggugggcagggaagccugggagcacagcuaagcccccagaagcgacagagccagagguuucccuccggaccccucuccccuccaccccuaucaaacccgcaagacucaccggaggaugcauggcaucugggcaccaggcgucucaagguaaaggccgagggcugugagguuccuaguacuuggggagcucugauguugggaucaccacugcuguauucuccacgacgcacggacagagaaaucagcucuggcuucugugugggaagcuaaaacagaaauuucugagucaggcuggcaguggggacgggcggugaguacacauggggagggguuguguuaagguggagaccccagacuaaucuuauuaacacuuucucccucaguccaccccaagacaggagggcuugcuuaacagcuagggaaggaggaauugggaaguugaugagucuagaugcccaagcuuugcgcccugauccaaaccagcugccagcccugucuuccaucccagcuccucucucagggaggaggcaggacaacugcagaguguccagagccaggccuggcacacaccaagugcucccuuuaaugugugcuccuaagaggaggaccccaaucgggcauccuagugucccugggcucccgaugacaaccugugagcaagggauagagagggcaugggcaaagaggcgugugcuggaagagagguggguggggggagacagaggagaaagaggaagaggagagcaaggaggagaaggaggagugcgcgaagagaaccuacucacuugggcccuugggaccucaucucuauuugggucauuaucuucucuggccgcagccugggacucccuggucuuccuuccugcagguuucuucccagggcugcugugcuugggcuccuugggucucacggacuuccccaggagccccacgccagacacuggcgggaagcuagccggaucagguggaacugcugaaagucucugcccccaggcaggaaaggcuccccgcagggccaguucuggugcacccucuagggauuucuucuccugggccaccuuccuucccagagugccccgggguaggggcccucuaacggcagcuccugagcagcugggccugaccccccucuuuccccacaccaugcucugcauuuucuucaaggaaggcacguccagcucucccacagccggccucuccacgacuggggugagucugcggggaggagagaucaggagaggucccugaaccugaagguaacucucccugcgguggaaacugcggcguccgcaagugucuccuggcuucuuggggcuuccgggcuuggccuggcuuccuucuuuggugcuaaugaucacccuaaucaccgguaagucgcugcucucaucugcggaaucagagucgucaguauucagcccggcggggccuuccgcggagggcugcuggggauccacuuggaagcucaaucugcucuucgagccccuuucuggguucucccaggccgguccuggcccaggaacacugagguggagagggccggcagaggccugcugccauucuccagggcuggggcucagcgcaccucuccaacugggaccgaccuccagguccgcccagaugucaguggacccuuuggcaguggcgccuucuggggacgggugucccuggacgcuggacggcggcaugaugguggcuggcucaucagccagguagaaagaguaguccccaccacccgcuuggucgucgaccggggugccaggccggccuuccuggccccagagcaccacccuucccugcucuaucaauucgcucucagacucgaagcugaagcucucgggaucugugaacccgcucucgcccuugcccuuacccuugccacugcgcugccccccaaaauugaggucucggccguggccgucaccccguggggcucccgggcuggcggugugggcgccggccugcucgccacccucugggccuaaaccagcccugcaaacggacacuucauccguggagcucauggcgcccgccagucuagacagccaggcuguggggagacagucguccugguaacagugggagaggagagccgagcccagccaagcccagccgagggggccacucucagcuuugagccugagagcgaauugauacagcagggaaggguggugcucuggggccacaggaacagcaaggccuuugggacaccgccacccucaccacagucugcucacgagaugucacugacagcgcguggcuuccgggcucccucaaugccugcguccugccuucucauuguuccacgccuucucauuggucugcccaucgccaaucagcgugccccuuguugggcgcggcuucugggcuuuacccaauugggaggcagacucuuggauugcccggacgcccgugguuuggcugggugguuguacuugggucaggucuuggggccagggcccacuggagcucuccauccaccucuuucuuccuguccugcugccucuggccaggcaccuacuuuccaaugacagccacgucucugagccccagugucccauuguaaggcggaagucaaggggagagcugcccccagcucaucagcuugggagaauaaauguccugaugcacgagaagcaccuggcacacagaggagcuaucauuaaaaaguaggugcccggccagagggagcaagacagaaagaaagaaguggaucgagagcuccagugcacccuggccccaagacccgaccagagugcauccacccagucaaaugacgggcagcgggacaaaccaagagccugug

SEQ ID NO: 19103 - RNA, 4960 nt, Homo sapiens
gucagugagaggcgcaggcgagcuggaggggagcggcgcgcggcggccagugggcgcccgcgguuccccaaggcccgccccugcgugggguggggggagugcgaggcugcgcuuaaaaggcggggaaucgccggccgcaagauuuuuccucgacagauccugccgcaguccgcucccucccgcuccgcucgccccugcccgcccgcccgcccggucgcgcggucgccgccgccaccgugucgcccgcauccuccgccuggcgccuccgggccccgugccuccgcccgcccucuccggccccggcgacgagguaacgcgcccugggccgagccgccgggcccuccgcccagagcgccgcccuccgagcucgccccgguggguguggcccggccuggcccgugccccgcugccgcacuucggucccucccgagccccgccgccgcauuucggccuccuccggccgcccguaguuccaguuccccuuuccccaccacggagccccagggccccugggcuugucgagaugucugaggcgucaggaaaucucaacagccuccgcauggcgaauguggcccugcgcgaagaauuaaaugcccuucgcggggagaaugccaauuugggccuccagcucgggagagcccuggccgagguuaauuccuugcggggcaaugucuccagcuacauccgcuggccaguacccauagugcccguccuugcggaggagaacuuggaguucgcgcucagugagaucgaagucauucccgggggagaacugcccuucuugugccggccucccccacgcgcggagcccgacuguaucucggaugaucuuuugauuaacgugauccaggaucgcagcacccccgacgggcccgcugaccccccucugcugcccaucccgcccccgccggcgcugccuccgcccgcgucaaaggaaccgcccccgcaacccccucuggcaccgcuggagcggccugagauagagcccuuuucaggagacccagucuaccuggcugaauuccugaugcagcuagagaccuucauagccgaccaugagguucauuuccccgggggcgccgagcggguggccuuucugaucuccuuuuucacuggcgaagccaaggacugggccaucucggucacccaggaaggaagccccuugcaugccaacuucccgcgcuuccuggaugaaauccguaaggaauucuguggccccauccccccacguguggcuaaaaaggccauucgcaagcucaagcagggccacuguacccucggcagcuaugcagaugcuuuucaguuccuggcccaauucuugucuugggaugacugccgccuccaaaaccaauuccucaaaggccugucggaauucuuccgcaaagagcucuuauggucaacagaaauggccgaccuggaugagcugauucucgaauguguggagauagaaagaaaagugcgcguucccaagccuaucccgcucccuggaguucgaaauaucaucuucccuuuugcuccgagucccaaugaggaagaaagugaagaugaagaguacuacagugaagaugaagaccaagaggcacgcaggcacaggcuucacuccaaggaccagaggaagcgcaugagggcuuuucagcaagagaugaaggagaaggaggaggaggagaugaagaaggaggaagaaaugaagaagaaggaagagaaggaggaggaggaggaagaggaaaugaaacagaaagaggaggaggaggagauaaggaacaagaaugaggaggaaggagagaguaaggaugaagaagaugaagaugaggaugggggccagaaaccagaaggagagccacagcaggauccagggacugaggagaccuauggugagguggaggaggagccacuggaugaggcccaagaugaugaccuagaugagcugauggagauggagccgaccuuuguucacgcgucaucccagacuucuggccccacaagugguuaccacgccgaaaacuuccugggugcaucaccucccauaauacagccuagcagacggaggaaccagaaucgagucccacuucuggaaggccuuccaggcaccaauucaccauucuacagcuccccccaacugauucgccgcacaggucguuuaggacaacgccaaguucgaagacgccccccugugcuuuuccgccucacuccgagacaggggggccaccgagcugcucguggccgaauucgaguuugagugcuggggccagauggccacccagaacacacccuucuuuugcaucccccgccccugcuauugcugccauaccugccccauuugcugaccaggacuucagggaguuucagaccugcagaaccugaagaagaccugcagaauuccagaccaucuugcaaccgugaccagagagcgacgugugcccaaccagggccaccugggaaaggagggaucagcaauagcugcccucuuggcauguacucugcucaguccggccacgagcuggagagcaaguuucugggccuguucccauaaaugaacuggucacccucuuguauuuccccucugguuguuccuaacccucaccucuccugcguuucuucacccuauguucuacaguuuuauucucugacugacccaccaggacuucacccaaugccucacugaucugccccaaugagcaagaggacaggcuacccugaacuccuaaagccacugaggccaguugcuagauauaaucgauggugagcaggaugguauccagaaaugucccuagaauccuacacucauuucaugccacaccuccagcagagggccuggaagaggacccgacaucuagcccagugagagugugcaaagccacaugucaaauggacaacuugacggagauuugcccuugacugacugugcaggcugguuccacuuacagcacuugaguuuaccuuugcacagauuccuguaucagggcucuuggacugacuugccacacaucuggagcccuuuccucucaccacauugcccuccugggcacccccgguggacagcgcccaacauugcaggcuccacaacuuuccuugauguugccuaaaggguagccaguuaggguuccggagaggagaaggaggaagaagaggaggaggagaaagaagcagcaacgaucauucugccauuguaaagagugacucuuuccuuagggaugguggucuucuccccuugccaggccuuggacugcagcccccagucaaaggucuuugcaggacacuuucuauccuuggaguugcagaggaggccugauuggccauuccuucugggacagacagagagagggcccauggccugcucugagcucccuucaauuucaaggaacccuuaguucugagaggagagaggaaggcugcaccuaccguggccucacagcugggaccccucaugggggccaaccccuggccugcugcugugcuucagugacacaguaaagcuuaagaggguggcugccuccuaggaacuccugggacuucuagguacaaacucaggugcccuuauaaagagacccacugcuugccuugaguccagaaagcacugcuucugcagugaaaaacacacacuuacuaugucaguuuuggccauaaaaugccagccaaauccacugcuggccugaacugccccuggacacuggacuuucugcacagugacuggcagcagagcaagugcagccaggguuuguggccaaagggaagaaagcauaguaaauucaaccucuguuccucaugggagucugaccgauaaucucaggcggaccuuaggaucuugggccuggaggcaagagaaaaaagcuggaggaagaggagucgcagagaaacccaguccucugacugguuucuggugaggucucuauucaucagugggagguaagaugcccuuuucauuagcgcuuuuguuucucagccuggggaucaguggauuuggauuccuauaaccuguugcuaccuuuuaaaaagauccccucucuccaaagagaaaaguaauacauaaucauuaaagaaaguuuggaaaauagagaaaacuaugaggacaaaaaccccccagccauucagagucccaccacacagaggcaagcacuauuaacacuuugcugcuuuccuuucuaguguguucuugcuaugucuugucaaagcugagaucacccugccaguucuugaucagcaggauuuaaaauggcugccaccugugcagucaugcauacugaauaauucauuuaagcauucuccuaauuuguuggaccuuucaauugucugguuuuccccauccccaccagggcaggaguaaacaacuuuguaaagaaaauuuugucuguuuuucagcugauuuuaucugauuuccucaagagugcauuccagaaggggaccugcuauucuucgaggggaccugcuauucuucgaggcaguggacccuguuugcugauggucaacacucuggcccugcugccccaugucccuguggagaagugugaaggacgggugccuuaaacccacacuuccagggacccuucagcacagguccugccuguucccauggugcuucucacccugaacccucagagcuacagccagggauagagcagaugagcagugagcugguuuccacccucuggggcaggaggggcuugggcuucccuuugacccucuuccuuccuuucccagaucuucaauauuuguugugauguaacagccauaagagcuguaagaggaacugugggcuuugggagcuuucuuggguugaaagagggguggggggaggggaugcaugcagggguaugaaggcagcccaaggucucccagaggcucgggaggaaacccuuuuggaauacauguguuauuguugcauuacuguguugugaagauaagaagcugcucuguaugcuaaagcuuucucuccucaauaaaaauauaaaggguguguaaagauugu

SEQ ID NO: 19104 - RNA, 3089 nt, Homo sapiens
ccugcgcucacaagagguuugcagggugcacuuauuucggcaugagguugauuggauggcuuuuguggugcaaaauaugacugugacucuguccugaaacuuaaugccuuuuucaguuugauugucuacauggagaucagggugauaaguuucaauaaacauauagacgcccccccacccacccccauuagcuagaaaagaccaggacuggguugcuuuaaaugaaccaagcuugaccaacaaacaagacagccauuuguucacucagaucuagccgagguaacucacaagugcaccuugagauccuccaugugucugucaacagcgauaggcaggaucugcgcccagcucaugcugcauucuaagaacucucauuucauuugcauauaaaauucauuacaggaaguaauuaacugaaggaacagcaucaucaaaggcucaaggauaauggaaaguaagugcaucuugccccccaccagucaauucagaucgugguuugugguugguuugguuuuguuuaaaggaaguccgacucuguuccaaaaaccaagaacauauaaacuaaaaggaucuauccaaaaucuaaaaggcagucuugccaguugcuauggcccauaaugcacacacacacacacacacacacacacacacacacacacacaaaagggcuacuuuuugccauuuagguucuguguuugaccagcuuucaauuaaccuugcugggggagagcauaagaaccuggguaaauggcauacugaaagagcuucagaauaaucauugcgaccccucccugcccccaccccccacgaagcuuauaggcacuaacuauucuugucagcucaauuuucuaagcagagcaagagcagugauucauuugauuuuuguaugccugauuucugggagguuggggaggaagacaaagcacugagcaaagaaaaccugcugaccaaugauggaaaguuaauugucuacugucuucaagaggcaaaaagaacaguugaaugaaauuguagccugcuucacaaagagaguuccccagccccuuccuacuucaccccucacccaauagauucaauggucaaccuccuggaggaugcaguaagguuccagagacaagcagaucucaacuuugauaggucguauugcccaaugagaagccaccuuuuagcucaacugcccacacuccagcuggacagagcagcugaaaaaccacacuaaguacugagaaaacuugggccucucacaagagaagcccuaggccuaggcccuuuguuguuauaguucugaaucugagacuucuggaaacaggccaggcccaccaacucccuugcaaccagcacuucgacacuuaaaauaauaaaacagcuaggcucaguugcuuuugaaaguacuagaacuacuuggugugaaguucuuaaccaaauuccaaauuccagggauuuugcccaaaauaaaaucaauucaucccuggccucaguuuauauaugaaugccacauuugucugcuccagacuuagaauuccaaaaaacagacauuuuccucuguaguaaaugaaggagcguuugugcuuuugcuuagcaaaaaugaaaggacaccagggucuccuugggaaccauuaugacugguugaacguuaaagcugaguaugggacucacauaguauaggccuuguuacuucuguggacuuuucuggaaguuucuuguuuacuacuucuaauggguuuugccucuccccucaccuugcuaccucuggagguuuucccaaaagauucugaaccugaauucucagacaccuugauguuugucaguuaccuuuagucuuguuuuccucuacaauacucuauaugccuggaauuuuuagaauaucuucuacaucaucacuguggcccacgcagugguguucccauuagcacaagaggauuuggggcagaaaucauauggucagagagaacauuuaagaccggaaguauucauuuaauuuuuuaaauuaauuuuuuguaaagauggggguuuugcuauguugcccacgcuggucuugaacuccugagcucaagcgauccucucgccuuggccucccaaagugcugggauuaaaggaguaagccacugcaccuggccucauuuaauauuuugcaacagguagacgucccaaauaaacaaccaaacuguaaaauuucuacuaaucacuaauuaacagaacacaaagcaucuuccccacuccuaacacucaaccucucuccuaccuuugauuaucauaacuccacucucucucccacccaggcacuuaccacaauguuugcugccuucugcaccuacgcugcugagacuggagaagagaggcugaaagccccucucagaaaggcuugcagagaacccaccacuacuacaauuacuaguauaaauaauaaugauaauaauuuuugaagguggaauagagaagagauuugagugaaaugaaguuggcccuaggagcucagcuuccauuucaagucgucccuauccucuuuuuuccuccccauuccaguuaguagcaacagauggcucugcuagccugacuuugaucuagucaccauccccaggagcggagguuaauuguuaaccaaggaugcuuugcauuugguggguagucaguacauguuuuugaggguaguuauucuugguacaauagcaagcuuugcuggugucuccucuccuuauccuguacuacuuggccugccucagcuccugacugggccucccccaccagccccaacuuauuccucagccccaacuuaucccucagccccaaaucccaugaacugcaucccuagcacaacaacucacccauaaaggaagugagacaacaggaagcaaaauaauuaauguuagcuuaaugaccacaaacugaccaguugaucuggauaaauuaccuugaacgugcaaagacagaggagauccuaccaggcucuccuaacaagcacugcaccugacauccaguguaacuaucuggacaacacagacccgauugcagucucucuguaccugucagucugagcagaucuguccacgcaccugcccucuuccucaucaaugaacaaguugggaaaaaga

SEQ ID NO: 19105 - RNA, 15871 nt, Homo sapiens
ugagaugcggcuuucaggcauuuguuuaggacaugcccauggcggggcuucuaaaggggcuuguacggcaacuggagcgguucagcguucaacaacaagcuuccaagaugccgcccaaaggaaaaagugguucuggaaaagcggggaaagguagagcggccagagcgaucaaggagaaugggggcgggugaggagcgaagggagggaacagacaguccaucuccggaguccgggacggacgcagcagguagccaguggccccacagugcugccaucgauuacaucuguaggaauacauugggcuacgguucagggaccguccuaguggguaauggaaucugauggggauaguuccucggaggcgaugacuuagggcugcuauuucaagggguuauuagagcucuaaaauugggucuuaucaaaagccagcaauaggaaguacacauugguuaugguccuuaaaguucacuuuaaugcuuacagaaugacaugcccaccaucggggaaggaaucauucauccauugaacagaaaugugucaggcagagugcuaagcgcugaggauacacaaauaagacagaaggcugggcgcgguggcucacgccuauaaucccagcacuuugggaggccgagggaggauggaucacgaggucaggaguucgagaccagcuuggccaacauggcgaaaccccgucucuacuaaaaauacaaaaauucgccaggcguggugguggugcgcgcccguaaucccagcuacucgggaggcugaggcaggagaaucgcuugaacucgggaggcagagguugcaaugaaccgagaucgcgccacugcacuccagccugggcgacagagcgagccucugucucaaaaaaaaaaaagagauuuuggccuuaaggagcucccgaaguagugaggaagauaaaggcuuagugaucauaaagcacuguacuaaauguaguguugagggauguguaugggauauaauagaaauugagggaaguccuucauuuagcuggggaacagggaacggaagacuuccuggagaugaauuaggcaggucaagaugugcauugaggguagguuaaagcauuccuuacuugggguccagcagcaaaagcacugaggugagaaacagcaugaugugugcagcguaguguugcuggagcaaaaacucaaggcagaauggcaaguggugagaaugaaaacagaaacaaagacgagaucauggagagugcuauauauucugcuaagaaggacaguuaaggaucagaaagaccuguaaggagauuguugugguagucuuggugagagaugaugguggacugaccuaagggaguggcugugggaacugagaaaagagaaaagauucuguaaauauuaggaugugaaauagucaagacuuggugauuuauuggguuggggagggguggugagggaggaucaacgaucauucuguuuucuggauuggauuucuaaccuguugcugguccugcaggguaacaucaaggauacaugaggagcggggaugagauugaugaauucacuuucagauagauuggcuuugaggugucugugggacaucucaguggagauguagucaggaagugguuggauauuugagucuaaaguuugagggagaggucuagacuguacauguaaguuuuaggagucgcuaacuuauagaugguaguugagcccauuagaguguaugcaauuauccauggagaguuuauagaaugaaaagagcagagagcagaggaugugauccuaggacaggcagagaaagaggcagacagauagagggagugcagaaugguggccagaggcuggagagaccagaauguuuuaaagagagaggguauagucuaucaagaacagcagauuuggaaauuagagguggccuuggguaaaagugguuucagugaaacagaagccagauuaccgugacuagagaacugacugggaagugguaauuuggacuucuuggaaaguuuuaauugaaaagcauggaaaugggaugguagauagagaaggacagaggauuaagagaaaguuuuauuuucuuugcuucuuuggaauggggaaaacuugggagugaagcugaaggauccaguaaaguaaaagagguaaagguacagaagagugagauuuaggagaaaauggaauccaggaccuagggggagcagggacaccuuaugcuugaggucauaggaaaggagauggaggggcagggacucaguaggcaucuugaggagagugguaaaggucuggaauaucguaauggaagagggaaugaaacacaaaagaagugccuucagggcuaggagccugacuaagaucaaaggccaugaauuuguagacuacauaaucuucacagucugauuuaccuaguacuaugcaauuggcacaauauaggauugaaaagagcuaggugcagccuuaagccaugguugagguuuuguuaggcaguuaugauaggaggauagcaacaccagggaauuacaagggccagugggaaugcaguucagaugaaggaacaugggguccagagugggaagggaaaaagaagucugguggccuaggugaauguagcaggacgaagggacuggggucaagggagagguucugugaaguuaaagagcaaguauugugggaaugagacaugaggaagcuggaagaacaggagguuauagccagagacugaacuaguucugaguggcacaguuccaucgugugcccccggggcagguagcuuggaguagagagcaugacauucgggaaagagaccuagaacugagauuccccaagauagauggugaggucacucaagguaauggcaggagugaggguggagaggaagcccaaagcugaugccagagucgucaggaaaucaaaggcagugagguggcagucagaagaugacagcauccagcagggaagaggaugggauaacuggaaggcaucaucauucaagaauggaucuauagcaaacccaguuaggaguuugauuuaauaacacuccuuuggcaguaacauuuuuuuaggguuuugguagucaguauuugggguuuucaguuuaaucaaacauuuauuaaaacaccuuuugugugccaggcauugugcuaggcuuggagauacuaagacaagcaagauggagacucuugcuuaaaacuuuucaauggcggccaggcgcgguggcucacgccuguaaucccagcacuuugggaggccgaggcucgcagaucacgaggucaggagaucgagaccauccuggcuaacagggugaaacccugucucuacuaaaaauacaaaaaaaauuagcggggcgugguggcaggcgccuguagucccagcuacucgggaggcugaggcaggagaauggcaugaacccgggaggcggagcuugcagugagccgaaaucgcgccacugcacuccagccugggcgacagacagagcgagacuccgucucaaaaaaaaaaaaaaaaaaacaacuuuucaauggcucccuauuacgucuaggauaagucccaagcuccuuaauggggccaaaaggccucaaugcccugacccucagcuaccucccucaggcaggcucaucugagugcacucccaccucagauuuggcuucauccauacaauuucuuacacauaccaugucguuucccccauucuggagugucuccucauccuuucuuuggcuaaccagcuccuacucauccaggaaaccuucccuggcuggcuccagugucccucugugcuuccacagcccccuguccauaaccaucucugcaucuccugcauucuccugaaaugauccgucuuccucacuagaauaugaguuuucugaaggaagguacauggcuuguucaucuuuguacucccagugccuggaacucaguaguuguauaggaaauguuuauugaacugagcccuuaauucaacuguaauucuuaggaacaucagccucuagcaguauguaggcugccauugacacagaaguuaccauaguaguaaaaugacauacuaguaaaauguaagaugcugcuaaugguucuaggaagacaucaauaggcaauguaguagacucuagaaauuuggacaugaauguauucuuuagccaaaaauggguagugggaaauuugaucuuuuuaaaaaauguauucuuagagauuuuacuuacuggaauugugaugcuugaacacauaguugugguacaugauagaacucuuacaagaacuuaggagucugcccucagaaggcaggguguuaaauuggaugcaaagaaucugggccaggcuuccggagcuuucauucaccuauuagcacacucauuuguguauccauuuucugugaaggguuuauauagggcacagauuuccuguuugaagaaagaugggucagauuaauuuagcuugauguuguaaagcaagcuuguccaacccacggcccacgggcugcauacggcccaggauggcuuugaaugcagcccaacacaaauuugcaaacuuucuuaaaacauuaugagauuuuuauuugugauuuuuuuuuuuuuuagcuugucaacuaucauuaguguuagcguauuuuguguggcccaagauaauucuuccauuguggcccagggaagcugaaagguuggauacccuuguuguaaagugucuggccgaguucccuuuugaaguguggcguuaugauggaaauauccacuccgguuguguguuggaccuuucuguaaacauggaggugcaguuuaaaugaguaccugucaucucuucucuaaagggggagcagccucugggagugacagugcugacaagaaggcucaaggucccaaaggugguggcaaugcaguaaaggugaguuacugguuccuuuuuuuccauguuaaauauaaauucuguuuauguguuaguacacauaaaagacagaaugcuuaacucauucuaacaggcuagccuaacacugguauaaaaucaaaauaacacaaaauuguagcugggcgcaccuguaaucccagcacuuugggaggccaaggcaggcagaucagccuggccaaaauggugaaacccugucucuacuaaaaauacaaaaauuugccugguguggugguguacacuuguaauccuagcuacuugggaggcugaggcacgagaaucaagaaucgcuugaaccaggaggcugagguugcaaugagcugagauugcaccacugcacuccagccugggcaacagaguaagauuccaucucaaaaaaauaaauaaauaaaaauaaauuuuaaaaaaauggaaaauauagaccagucuugcuuaugaaaaguaauucccuuuaaauauuuugucauguacuuucucagauacccagaauuucuuuauaguuuuuuaguauuguuccuuaaaaugcauuaaguuagaucuucccaguaauugaguuauuucuuaggacaaaauaauauuuuauaaaaccaagagauuagauaaguguuaaaaguccucugcugaauaaacaggcaagggugcaggucucuuuagaaagcuuccccacuggugagccacaaaccagggucuugaccaugaaaaugggggcaggagaaaaucagcaaauaauuacuugaaauacuuaaccuagccccagaggaguaucugcugggagaaaauuuaaucugcaaacuaguaagugcuauguaacaaggcaauuuccauguuuuagucaggauaugggaggcuguacuuugauucauucauucaguaaggacuuagugacaucugcccugugccaagcaauguauuaggcucuggggauuuuuuaucauguauuuauuuaauaaaaaaguaagagaugggccaggcacaaugguucauuccuguaaucccagcacuuugggaggccaaggcacgaggaucacuugagcccaggaguuugagaccagccugggcaauauagcaagacccugucacuaaaaaaguaaaaauaaaaaaucagccagacgugguggugcacaacuguggcccuagcuacucaggaggcugaggugggaggaucgcuugagcccgagaauuugaggcuacagugagccaugauugugccacuacacucauccuaugcaacagagcgagacccugucucaaaaaaauaaauaaaaaguaagagaugguccuuguuaucacaggcuacuugggagcaguuagguaaagauauguauuucauugcuguaugauaagcauagcaguggaacugcaucauauaaauucagccauacauguguagccuaaaaaagagagaucauguaaaugguguggacuguucugcccacucuucuauucaaugaaccuaugccccacagagagagagagagaugagagacaugcaccugcuuuucuauaguugcccugaauucuugugugagcauccaaucaugugaagugggguucugguauccaaagauaaguuuucauaaaacauagccccuaaauacaacccaguuacuucauguuacaaacggaguacagcguuccuggcuaugucugggcuuaaaugagagcugacaugcuggucucccauaugacaucuucauaaagggauauucuaggguaauuuuggcuauaugcaguuuucaccuaauauguuuucacaagcaucuaaccuaagagacuguugcacugcauauggcuuuagcuacuuuuuuuuauuuuuuuuuuugagacggaguuucacucuuguuguccaggcuggagugcaauggcacgaucucggcucacugcgaccuccgccucccagguucaagcgauuguccugccucagccucccaaguaucugggaucacaggugcccgccaccgcgcccagcuaguuuuuuguauuuuuaguagagaugagguuucaccauguuggccaggcuggucuugaacuccugaccucaggugauccaucugccucggccucccaaagugcugggauuacaggcaugagccaccgugccuggcggcuuuagcuaauuuuuuaaaaacuuuguuuuguuguuuuuaucuuuguagagauggagucucgcuauguugcccaggcuggucuugaacuccuggccucaagcgauccucccgccucagccuccaacaguguuaagauuauaggggcaugagccaccacaccuggugcauguggcuuuaaagaggcaccuuacccucucuggaaaaaaaauaaguucaauguggccacucaugagauauauggaaaggaguggcacguuauucacuaggaaaguagauuaggguuaaauuuguuuuuauaaagccuuuuauuuugagauaauuauagauucacaugcaguuuuaagaaauaauacaucuagcugggcauggucgugugugccuguagucccagcuacuugggaggcugagguaggaggauuguuugagcccaggaguuugaggcggcagugagucaggaucacgccacugcacuccaaccugggcaacagaaugagaccuugucucuaaaaaagaaaaaaagaaaaaggaaaagaaauaauacguauuccuuuguuucucccaaugguaacaccuaacaaaacuauaguacaauagcacaaacaggauauugacauugauguagucaagauacagacaauccuaccacuacaaggaucccuccucuuggccuuuuauaacuauacccgcuucccuccugccccaccucugcccucuuaacccauggcagcaacuuaucuguucuccauuuguguaacuuuauaaugucaagaauguuauaugaauggaauaauacaguauguaaccuuuugggauugguuuuauucacccaguauaauucgcuggagauuucauucaggugguuuuguuuaucaauaguuuauuccucuguauugcuaaauaguaccaguugaguaucccuaauccaaaaauacaaaauacaaaaugcuguaagaucugaaacuuuuugagcgcugacaugacacucaaaguaaaugcucauuauagcauuucagauuuugaauuuucagauuagggaugcucaacugguaaguuuaaugcaaauauucccaaauccgaaacacucuggucccaagcauuuuggauaaaugauauucaaccuguaucccaugauguggaagugcuguaguaugucgaaccauucaccuguugaaggacagcuggguuguuucaaguguuuuuugaaggcaccagucggugagggacccugggacccucuggccuuuuaggguucagcuccuuucacauucugucauucugcuucagaccccaccccugugcccacacccugcccuuuugucgcuauaagcucugcagauucugagacccauccacugaccacagcuucccuccuuccccuucccuuccugccuccgccaauccuguuccucuguucuucuccucacagacccccaagcccucaagcccacccuaaucuccccacuuucuccuaggcuucauguuuguuuuccuauccccugcacacucaaaauuaggccuaagggcuugaucauuggauugaggagguccaguuuuucuuuuggccaccucccugcauccaccucccugcuacucaggaucaauccaauggucuacuuucuaugcacuuaaaauuagaucuauaguuagaagagaagaauucgagugguucuaguauaaagaaaagacaaauauuuaaggugauggauauuccaaguauacugauuugaucuuuaccaauuauaugaauguauuagauuauugcauuaccuugaaacuguacaucuacuaugcaucaauaaaaaagaaaggaaggaaaagaaaagaaaagaaaagauuuccuugaaaacgucuagcugggggcaacuuaaauauuaauacuugauuuuuaauaaguauguaaauaaaguauuuacuaauaauuccaauaugaguauuauauuugcuuauagaugaacuuauuucaguagcuuggcucaaauuugaaacaguuacuuaagaaagaaaaauucagccgggcgccgguggcucaugccuguacuccuggcacuuugggaggccaaggcuugcggaucaccugaggucaagaguccaagaucagccuggccaacaugguaaaaccccgucucugcuaaaaauacaaaaauuagucgggugugguggcgggugccuauaaucccagcuacucgggaggcugaggcaggagaaucacuugaaccugggagacagagguagcagugagccgugaucacaccacugcacuccagccugggcaacagagcgagacuccaucucaaaaaaaaaaaaaaaagcuccccagaacugcugggcccuacuggaaagucacacagccuuggggauugggacuacuaauacuuggucucugacuuuaccuaggcccucagugcugcucagcaauccuuuaccgcccaccuguagccauccaccaccccacucccaucagucaacagagaacuucauuccaugguucucaacccuagacguacaucagauucgccuaaaaaaauacgagugccuagggucucaucccagaccaacugcaucagaaucucuuggaggggggccuggacuuugauaacuuuuuuagaagggcugggcucuguggcucaugcuuguaauccuagcacuuugggagcccgagguggguguaucacuugaggucaggaauucgagaccagccuggccaacauggugacaccuugucucuacugaaaauacaaaaauuaguugggcaugguggcaugcgccuggaaucucagcuacucgggaggcugaggcaggagaaucacuuggacccgagaggcggagguugcagugagcugagauugcgccacugcacuccagccugggcgacagagugagacuccaucucaaaaaacaaaaacgaaaaacuuuucuagaauuucuggaggugauucuaauaugcugccaggguuaagaaacacucaucuagucucacagcguuagugugaggauuuaaugagauaaguacucaucaacuuuuaaauguuuuuauuauuuuaacaagaaaguggaaaccagacccauugucaggaacucauuggcuuucagcccccuagcaacaaaguuaccuccucaccuuuuuuccuuuaaggcuaauuuuucaaaccguguucugaauaccaaaccuugcuccuucauuuaucucuacccucuuuuuuguucugucuucaaccgguuuuuuuuuuccuaggucuuucccuucauuccgaaaauaugcccagggaccuuuaaaauucguggguuuuuuuguuuuuguuuuuguuuuugagauggagucucacucuuguugcccaggcuggagugcaguggcgcgaucuuggcucacugcaaccuccaucucccaguuucaagcgauucuccugcuucagccucccgaguagcugggauuacaggcauccaccaccacucccggcuaauuguuuguaguuuuaguagagaugggauuucuccauguuggccaggcuggucuccaauuccucaccucaggugauccgcccaccucugccucccaaagugcugggauuacaggccugagccaccucgcccaguguaaauuucguauuuacaugucuuccacuuuuugccucuagccagagcccuuucuccuuuucaaacaaaguuaguuuguuugaauuacccucccacuugacauuguuuccucagucagccugcuguauucuggcuucugcacuuaaacucuucugaaacuccuuuuucugagaucauuguuccaucauugcacaauguauuauacuucuuaccugaugucucugcaacccuuaacccuuguugaccauuuccuccuugaaacucucuccugccuugguuuguuagcacacgcuucucuccuaccuauauggccuuuccuuuuuauuaugcuuuuuucuuuuuucuuuuuaagagacagguucuugcucugucacacaggccggggugcaugacaugcaguggcaugaucauagcucacugcagccuucaauuccugggcucaagugauccuccugccucagccuccugaguagcuaagacuacagaugugcaccaccaugcccggcuaauuuuuuuuaaaguuuuuguagagaugggggucuuacuauguugcccagacuggucucaaacucccauccucaagggauccucccaccuuggccucccaaagugcugggguuauaggugugagccacugcgccucgccccuuuuuauuacacuuuuugaguucuuuacuuguugcuugaacauugauagucuccaagguuacuuuagcuuucuuuccuccucuucucauuuucaucuccuuccugguaaccucaugaauuccacacuucagcugccaccuccauagucaucacucccaaacucuuucuguagcuuggcucuccaagacacagcugcacuguugccaguucguuggucacacuugcagaccccacaggaaugaaaaacucuuugucgcacugucuaaacuagaauacucguuuauucauuuauaaaaugguggacgguauccccuaucugugaccacgaaugcaguguacauuuucccaggaauuguaucagacaaucacuuugugaguauggaagcagaaacaaggaggcaaucuagaagcugucucuuaaaaaaaaaaaauuaacuguaaaacagccucaggcagguccuucaggagguauuccagaagaaggcauuaucauaggagaugacagucccaugcauguuauugucccugaagaccuuuccaugggacaggacauggagguagaaaacagugauauugaugauccugacccugugugggccuaagcuaguguguguauuugugucuuagucuuuaauaaaaaaguuuaaaaauuaaaaaaaaaaauuuuaaauagaaaaaagcuuauaguggcugggcgugguggcucacaccuauaaucccaacauuuuugggagguugagguaggcagaucacuugaggucaggaguucaagaccagccuggcuaacacugugaaacccugucucuacaaaaaauacaaaaauuagcuuggcguggugacacgcgccuguaaucccagcuacucaggaggcugagagacacaagaaucgcuugaaccugggaggcggagguugcagugagcugagauugugcuacugcacuccgacuuggaugacagaaugagacuucaucucaaaaaaaaaaaaaagaaaaaagcuuauagaauaaggauaugaagaaagaaaauaguuuuguacaguugcacaauguguuuguuuuuuaagccaaguguuauuaaauagaguccaaaaguuuaaaauuuuuuaaauguauaaaguuaaaaagauauaauaaccuaaggcuaauuuaauauugaauaaagaaaaguguuuuauaaauuguagcuuacauguauaguguguauaaagucuacaguaggggacgggugcgguggcucaugccuguaaugccagcacuuugggaggucaaggcggguggaucacuugaggucaggaguucgagaccagccugaucaacauggugaaaccccgucucuacaaaaaauacaaaauuaggccggguaugguggcucaugucuguaaucccagcacuuugggaggccaagacaagcggaucaccugaggucaggaguucgagaccagccugaccaacauggcgaaaccaucucuacuaaaaauacaaaacuuauccaggugugguggcgcgugccuguaaucccagcuauuagggaggcugaggcaggagaaucacuugaacccgggagagggagguugcagugagcugagaucgcacugcugcacuccagccugggcgacagagcaagacuccgucucagaaaaaaaaaaauuagccgcuagccaggcgugguggugcaugccuguaaucccagcuacucaggaggcugaggcaggagacucacuugaacuaaggagggggagguuucggugagccaagaucgcaucauugcacuccagccugggcaaaagagcgaaacuccaucucaaaaaaaaaaaaaaaaaaaaaaaaagucuacaguaguguacaguaauguccuaggccuucauauucacucaccacucacugacucacccagagcaacuuccaguccugcaagcuccauucauguaaaguguccuauauaaguguaccauuuuuuaucuuuuauacuauauuuuuacuguaccuuuucuauguuuagauacccaaauacuuaaaccauuguguuacaguugcuuaugguauucaguacagucacauacuguacagguuuguagccuaggagcaauaggcuaugccauauagccuagauauguagcuggccauaccaucuagguuuguguaaguacaguguuauguuugcacaaaaacaaaauugccuaauaacucauuucucauguuucccuguaguuaagugacgcgugacuauaagugauucuauuugaaugugaaaugagaaauccugcgaaacagcuaucuugacaaaaucauuuucaaggauaauaguguuuuuuuaaauccauggcuuuauguaaacauaggucaaauuugaauacuucaguaggguugggcguucuuaauauucaaccuaugauaccuuuucaaaguguggaauuguggggaggcuuauacauugggucucuuuuaguaagaaauacuuccuggccaggcacggugugcugacaccuguaaucccagcacuuugggagcugaggugggcagaucacuuuaggccaggaauuugagaccagccuggccaacacagugaaacccaucucuacuaaaaauacaaaaaguuagcugggcgugguggugcgcaccuauagucccagcuacuugggaggcugaggcaggagaauugcuugaacccguggguggagguugcagugagccaagaucgggccacugcacuccagccugggcaacagacggagacucugucucaaaaaaaaagauagaaauacuuucuagcagguuuuuucuuauccucacucugaugaaauaauagcuagccguuggucaaugguagcugcauuaucucaaucuucacaauccuaugagaacacauaggucccguuaucauugcaucuugauguacaaauggagaaacacuuggagguuuaaaaacaugcguaaguucagccaggcaugguggcugacgccuguaauccuagcacuuugggaggccgaggcgggcagaucacuugaggucagggguucaagaccggccuggccaacguggugaaacaccaucucuacuaaaaauacaaaaauuagcugggcgugguaaugggugccuguaaucccagcuacucgggaggcuaaggcaagagaauugcuugaacccgggaggcagagguugcagugagcugagagcacaccacugcacuccagccugggagacagagugagacuccgucucuaaauaaauaaauaaauaaagccuaaguucauacagcagaguugggauuugauucuaggaccacagcucucaacccguaucguguuuccuccuccuguuagcaugaagguauaugguaaaagaugggagcuucccggccgugagcggcggcucacgccuguaaucccagcacuuugggaggccaaggcggguggaucacgaggucaggaguucaagaccagccuggccaacauggagaaaccccaucucuacuaaaaauacaaaaauuagccaggugugauggcacauagcuguaaacccagcuauucaggaggcugagacaggagaauugcuugaacccgggaggcagagguugcagugagccgagaucacaccacugcacuucagccuaggugacagagcaagacuccuucucaaaaaaaaaaaaaaggcggagcuucccacagccaggugccuauuuuccaucuaaaucaggacucugagacauugucuuaauauggggaaugggauugugguuguuguccugggcaaacuuccaggauuuuuacuugcuaugaacuaauguguuuuuuuuuuaacugguggggguaauccaaauguaaccacuguacuuuaaggagucauuugggucuccaaguauuacaugaauguacuuuuuccuugcaggucagacacauucuaugugaaaaacauggcaaaaucauggaagccauggaaaaguuaaagucugggaugagauucaaugaaguggccgcacaguauagugaagauaaagccaggcaagggguauguugcucuuauuauuuauaauuuucucucaagguaagaaagcaaaguaaaaaugacaaauaauaaaauaagauaaaaauucuccauccuccacagaagaaacacagaaguagggaucauuccuuuguucaaccauugguuguagcgauauuuugguuuaaagaucucaaaagcagaaauguccaacuuguaaauaguagaauaagggucaucuaugucaaaaccuaugcaugaccaaacuugcacggcuaacuucaaaguccagcaguguugagaguacuuauguguucagucuaguuagacuucuucuaccuauuuguccuuauugagccuauuccuguauugcucuuaggaauauaccucguaaccuuagcaaaauguugggaaauucucucaagcuacaguagaacuguucccucuucugggccacuugauaucacuuaucuuuuggguuuuucagggugacuuggguuggaugaccagaggguccauggugggaccauuucaagaagcagcauuugccuugccuguaagugggauggauaagccuguguuuacagacccaccgguuaagacaaaauuuggauaucauauuauuauggucgaaggaagaaaauaaaaucauaugaaagacugaauaag

SEQ ID NO: 19106 - RNA, 2042 nt, Homo sapiens
cucuucuucuuuuuuuuucuauagauaugugaaagaggccaaagaagcaacuaagaauggagaccuggaagaagcauuuaaacuuuucaauuuggcaaaggacauuuuucccaaugaaaaagugcugagcagaauccaaaaaauacaggaagccuuggaggaguuggcagaacagggagaugaugaauuuacagaugugugcaacucuggcuugcuacuuuaucgagaacugcacaaccaacucuuugagcaccagaaggaaggcauagcuuuccucuauagccuguauagggauggaagaaaaggugguauauuggcugaugauaugggauuagggaagacuguucaaaucauugcuuuccuuuccgguauguuugaugcaucacuugugaaucaugugcugcugaucaugccaaccaaucuuauuaacacauggguaaaagaauucaucaaguggacuccaggaaugagagucaaaaccuuucaugguccuagcaaggaugaacggaccagaaaccucaaucggauucagcaaaggaaugguguuauuaucacuacauaccaaauguuaaucaauaacuggcagcaacuuucaagcuuuaggggccaagaguuugugugggacuaugucauccucgaugaagcacauaaaauaaaaaccucaucuacuaagucagcaauaugugcucgugcuauuccugcaaguaaucgccuccuccucacaggaaccccaauccagaauaauuuacaagaacuauggucccuauuugauuuugcuugucaagggucccugcugggaacauuaaaaacuuuuaagauggaguaugaaaauccuauuacuagagcaagagagaaggaugcuaccccaggagaaaaagccuugggauuuaaaauaucugaaaacuuaauggcaaucauaaaacccuauuuucucaggaggacuaaagaagacguacagaagaaaaagucaagcaacccagaggccagacuuaaugaaaagaauccagauguugaugccauuugugaaaugccuucccuuuccaggaaaaaugauuuaauuauuuggauacgacuugugccuuuacaagaagaaauauacaggaaauuugugucuuuagaucauaucaaggaguugcuaauggagacgcgcucaccuuuggcugagcuaggugucuuaaagaagcugugugaucauccuaggcugcugucugcacgggcuuguuguuugcuaaaucuugggacauucucugcucaagauggaaaugagggggaagauuccccagauguggaccauauugaucaaguaacugaugacacauugauggaagaaucuggaaaaaugauauuccuaauggaccuacuuaagaggcugcgagaugagggacaucaaacucugguguuuucucaaucgaggcaaauucuaaacaucauugaacgccucuuaaagaauaggcacuuuaagacauugcgaaucgaugggacaguuacucaucuuuuggaacgagaaaaaagaauuaacuuauuccagcaaaauaaagauuacucuguuuuucugcuuaccacucaaguagguggugucgguuuaacauuaacugcagcaacuagaguggucauuuuugacccuagcuggaauccugcaacugaugcucaagcuguggauagaguuuaccgaauuggacaaaaagagaauguugugguuuauaggcuaaucacuugugggacuguagaggaaaaaauauacagaagacagguuuucaaggacucauuaauaagacaaacuacuggugaaaaaaagaacccuuuccgauauuuuaguaaacaagaauuaagagagcucuuuacaaucgaggaucuucagaacucuguaacccagcugcagcuucagucuuugcaugcugcucagaggaaaucugauauaaaacuagaugaacauauugccuaccugcagucuuuggggauagcuggaaucucagaccaugauuugauguacacaugugaucugucuguuaaagaagagcuugaugugguagaagaaucucacu

SEQ ID NO: 19107 - RNA, 396 nt, Homo sapiens
cugucuacaggcacucagaaugguccagcguuugacauacauuguaggcuuuccuacaauacagccucuaacaaaacuaggcugucccgaaccaaaacuaggcugucccgaaccccugguaauagaauuguuuaucuuuauaccaagaaguuugggaaagcaccaaaaucugcauguggcaugugcccaggcagacuucaagugguuccugcuguaagaccuaaaguucuuaugagauuguccaaaacaaaggaacaugucagcagggccuguggugguuccaugugugcuaaauguguucgugacaggaucaagcaugcuuuccuuacugaggagcagaaaaucguugugaaaguguugaaggcacaagcacaaagucagaaaacgaaauuaaaa

SEQ ID NO: 19108 - RNA, 396 nt, Homo sapiens
uuuuaauuucguuuucugacuuugugcuugugccuucaacacuuucacaacgauuuucugcuccucaguaaggaaagcaugcuugauccugucacgaacacauuuagcacacauggaaccaccacaggcccugcugacauguuccuuuguuuuggacaaucucauaagaacuuuaggucuuacagcaggaaccacuugaagucugccugggcacaugccacaugcagauuuuggugcuuucccaaacuucuugguauaaagauaaacaauucuauuaccagggguucgggacagccuaguuuugguucgggacagccuaguuuuguuagaggcuguauuguaggaaagccuacaauguaugucaaacgcuggaccauucugagugccuguagacag

SEQ ID NO: 19109 - RNA, 704 nt, Homo sapiens
ccuggugacugggacacugcggcgagcaggggcauggagcagcagaaggggcuuggucaccguucauggcucugugucuguggcuccgguggucucagauuccgagugcccgguauccuccccuagggaggaaagcagagugacaaguggacccucgggagcccuggggauuucuggcuuggccugagguucucuugguggaacaggaaggggaggcggaugggcuugguggcgagcagugagagaggcagaggcgugcuccgaaggagcucucaccugaaacacuuggugaaacaugccagggcucucuggaaccggcuccuccaagacccucgcagaagagcagguucccugggcaagccugugccaccggauggguccuccguggcgucagacacagccacccauuccucagggucguuuugcagcccuuucacauucugaaagacagacuaaauagccagauccuaaugcucccucccaucccuggcuuccuucaccccacccagcaacuguugugugugucucuggcccucuugcaggggcuggggaugcagcagugaccugcacagaccaaagcccaaccuccuaggggacauuccaggacaauggagggaagccagacucaccaggucagcagguggaaggaagggagugaagaucaugcuuccaggagugugugaugugccgguagggaccgacag

SEQ ID NO: 19110 - RNA, 6134 nt, Homo sapiens
cgagguucauuggucgccagccacagcggcgggaggucgaaggcagcgcaagagcucauuggccuuuguggcaagagcgggaagggaagcagaagcuggaucuucccucagaccgucugacugguucugacuugccggaggcugaggcaaccacaggcugacaucagaauuagguccucguucuccacgccucuuauuuccucccacccuccugagccagauucccaaccccuuccccucucugcuaccucagcagggaacccccaacugcuccugaugucccaucgcgcccucagcucucccggaaucccuuucgggaggacuccuugcuccagcccccugagcccuggccuuuggccaaugaggcagggcucaugggauugcuuuugauucggagguccgggagggaguggaugauugggcuuccugaggaaguggugcgcuccaggguggugggacugcguguguggggugggguggggguggggggaaauggugugcucaagcacaauuguugaaguguggagaggauuauggaagauuuuggggaggcuguggagggaauguguggguuuucaugaaagcagaaaaggugugugaguccaagagaaacacuacugcacugaggaguucccuacuggcuagaucagaaccugacacuucauaggaggcucaacagguaccugcugaaugaagaaucaagggaaucggccgggcccgguggcucacgccuguaaucccagcaccuugggaggccgaggcagguggaucagccuggccaacaugugaaaccccgucucuauuaaaaaauacaaaaaauggcggggcgcgguggcucacgccuguaaucccagcacuuugggaggccgaggcgggcggaucacgaggucaggagaucgagaccauccuggcuaacacggcgaaaccccgucucuacuaaaaguacaaaaaaauuagccgggcgugauggcgggcgccuguagucccagcuacgcgggaggcugaggcaggagaauggcgugaacccgggaggcggagcuugcagugagccgagauugcgccacugcacucccgccugggcgacagagcgagacuccgucuaaaaaaaaaaaaaauacaaaaaauuagccaggcgugguggcaggcaccuguaaucccagcuacucgugaggaugaggcaggagaaucacuugaacccgggaggcagagguugcagugagccgagaucacaccauugcccuccagccuggguaacgagugaaacuccgucucaaaaaaaaaaaaaaaaaaaaaggccgggggggaugcaugaagggaugaaugaaauuaguaacugaaagagggccagggauccaggagaacaauaugauuucaugggauacaagagggaaaucagcucaaagggggagcaagggaauaauuaaguguaagguggaguacaagaaaaaaaucagcaugaaccagcaugaaaugugaggggaaaauugaauauagggcauagaagagacugacaauggaauugagugcugguggcacaaaauccugugcggggagugaaugaaugcaggagguucugaagagaauuggugaaguggaugccaggaauaauacuuggguuuggcagagugcaggaugauacacaagaagggcguguaguaaugguggaagagggcaggggagugcaugugcaugccugaaaguggggucuauggugaagugacgguaagcaaggagaauaaugacugcauugaauggguaugggauccauuccaagaguuucuugggagggggcuaugugugaguggggcuucugggaaggaggcaacaucagcaaggggguugcagugaagguuggcgaaaaccaugggagaagaaggggagggaaggcaaucugauuccagcggugagaaggauggagaaggagcauugagccaccucagauaggguuuuccaagggcagaggaaguacguuggggguaggggaucacguggccauucugaccuccgcuccugacccuagaagcauggaucccgugugucugaaccuccauuucccuauggauguacugaggacaaauaaauacccgcugcacccugcugccccucugacucugaaugcaccacagggcgucagacuggagccccaugggggacugaacuuggccccagaagagcuauagguugcugugaccgcugccacaaccauuuggguaucacugcccaaaucaggggccacaagcauuucugccucuuccaggccugcgagugucacaauugugcccucuucucaugaguauggugucugagaugcggaggggccagaccuccucuaaaugggacuaaucuuagcccugcuauccuuugcuucagagaacgccucagggucuugccugcugugagugccuugaagagggagcagcgggcacgaucaaagagacaccuggcucaaggaccaauaaggaguauggcugccccucccaaagcucccauccgugucaggaauuugaccaucagagcaggagcccucagugaguguuucuggcaagggagggagccagaguuuggguggaggaagcaugagugguucugucaccaguccugucacagaauugcagugcgaccuggggcaaauugcucccuggaccuuagugugcccaggugcaaaaugucaccaauguugucuaccaaguguuuguaggaaggagagagcugggggacagggcaaucgaagagcuccauggugagaugagaccugcgacuggagguggggugaaguggggugggguugggggaaagacucaccaaagcuguuccuggucuuucacagcugggaaggagaacaacaugcugcagcccgagacccacaucuucacagcccccgaggagguaaggagagucggugaccagucgggcaggcucccacccagccacuguccagacaucuuucaccgugucccaaggacauggguuucaucuccaauccuaucaccagcucaccaugugaccuugggaaauaucacuucuccucccugggccucaauuuccccaguugcaaaaugaaaggcaagacuggcuggucuucaaggucuucggagcucugacauucuaggcuccuauccucauccuaaaacauguccacaccuccucucuccauggcuggccugguaccugacugcaaccugugcucucugccccugcaggggagcucccaaggggcucugcugcuuggccaggccccagaaccuuugucucugcccuguacuccagugaccuuggagcagcaacugguuucuccuucuggggauccccacagggccccugcccugcccagcaugugaguagcgugaggaccauggagcagguugugucuugugugccuaaccuuguccuugaugccgugggagauggaggaggaagagggggaggaggaggaggaggugguggagggggaggaggagcaggaggaggaggaggaggaggagggagaggaggaggaggagaagaaggaggagggcaaggcagcaucuaauacuaacgggcgaggacagggcucuccuagcuuugcuauuuucuauuugugagacuuuggacaagugacuuuaugugucugaaccuccauuucccuauggauguacugaggacaauauucuauacccauagcauugaaaagggaacgggcacaaggccugccacauaguagggcuucaacaaauggggguuguuaugccacaugaaacagguggaugggauagaagguccugcugaaaggugggguccgugcuggcgagggccacagaggcccagggcaaagcccagaggccauuagagaaagcuuccuggagacccuucaagacccauggggacugggcaauauggaagugagaaccagucccugaagagggacaguaaucacaucucuccagguguuuugcaaauuaaagcacggacaccuguaauuucccaugauuuucaccauugcccugggaggaaagagcugguaggaauaagcgucccugucaggaaaaagagguauggaaaagaaaccuggccaagcaggagaagggacuugccccagccacaaugacuaaugguccagcaggcauugggauucucacauccagauacugcaaaauccugccccucuuucugucuacugguaguauguguccgccagcggauuuaauccccuggccucuccuuuccuuguuucuagaugcucaacucugauccuccagcccugugccacccuugacccucuucuacugcagccacagguccugggaaaguagugggguccagaacccugggaggggcggaguuuaguggaugggaagagcagaaggccuuggugggggugggggaggagguugagggaacagggggcugaaggggcacuugucguauugggaagagguguaguuucccagugccuauucucucaugcacuuuccuuuccagguccccaaagucucugaccaggcuuugguuucugcccacucagaguggcagcggaagcuggaggccgcugaggcucugcugacucugagaaacucugcccaggccccuccugacuccaucucccugcaccagccuugcaacccaccagguagccugcucccugaaaggagaauacagggugggaauagcuggggaaugggggucguugugguaagcagguucuaacugaaaaaucagagucaguaaguugaaucuccuuggggccaggcacccaagcuccucaguaugacucccgagaugguaguugagggcuguuuauugaaucuucgguuuauugagcuuugugugcaacagcaagcguucagugcccugaugucaagaaagaaggaagcugaggcccugagaguggcagggacuugcccucucugauaugcaugcagcauaucaaguggaagaaccggcccucuugacuuucagcccagggucuaugcucagccgccuguggccuacuguggucuggggaggacauacagaggugauaaagggcuuggucuggaaggaggucuggucucugccuuccgggagcuuccagucuagauguggagccuggaugcccuugcaagcuguguuuuguggccaaauuuuaacgaugugcccagagaggaggggcuggaggagcuccgaggggggauaaacaacuggggaggcugggagggaaggcuaggcauucccagauccaaauggugaauggagcauggugugucagugaagaaacaccccuggagggacugcuggaacagaaagggaugaggcuggagaggauaccaaucacagaggucugacaggucaggcuuaggaggcuggaccagcaacuguggguagugaggagccagggaacguuuucugagcuagggagaacaauuucagagacccugagcuugacaaaaagaguugugguggcuuugauggaaggauugggggaggcaagaugggagauggggaaaucagagaggaagaggucuaugcaacaguccaggugacaaaucuuugguugggugggacgcauaaaaacaguagaucuggaaggggauguggaugugaccuggcucuggccccuuccuuucuguccacagcuccugcuggagauaaaggauuccagccucccagccccucucuccgccccaggccagccagcuccaucucgcugccuauuggacaucugggaugcaucucccucuugagcuaggaacccagaggaggaggccucaauagagcacugccuauuugguauccaguuucugaaugugcaaaaugguuaacguccaaaacgcuuaacgucuuuuuuuaaagccuucagguguuuuauaagcuuuuuauuauauggggcaacuccuuggcugaggguggauauucuuguaccucugucccuuacucuuuuggaugcuggggccuuuuucugucucauaaagacaggauugugcaaucuaaguugaucagucucucagugggguucugugugaguucauaugccagaguuuuuauucgucuugugauugcugacauaccugugcacucauguguauaccccugcauguggaaacaugaagauguuuucacuuugugucuagguuuauguacgugaacaaauaauaaaccguuguuguuauaaggcacug

SEQ ID NO: 19111 - RNA, 5979 nt, Homo sapiens
aauaaagaauaaaaaggagauggaaacucgacuccauggaagccccugagaaaggacuuggggagcagucccugcuguguccuugucacuuugguagcccugcuccuguugcuagagguucaggauccuaggaauuguuuucagguuuggggauuugcuagccauagcaugacuucccugaacuuccuucuccugcuguuucacugauuucuguuggcccuguguacuggaaggcaacgccagagacagagaucuugcugaguccugguccucgacuuggucuuccuugucauuucuguuuccuaacaaugggccgaggagcucuucucauccucgccacauccccuaccccucugcgagcauggcuucccccuuggccucugccuucucaggucccucuuggacaccaaccuggaaauggugaggcacagcuucaucuucucccugccugcaagcaaccuagacccccaggagauggcucuuaacagcggugacagugaucaccuuggucaggcaugcgcuguacagcaggcuuuuccuaggucucugucccuugccuuugccggcacuagcccugccuagaggcagagagcuggacuuugcaagcuggagagguacaugucuguguaucugcuucucagccaccuugggaugcuuuccagccagcgacgaagaguucucacugccucgcaccccacagugacucagucacuuccucagguucacgguuguucuaucauguaugacugccaagauccagccaucacugcaaccacagaaaacagcuuuacuuacccaaagaaggcagaggaggagaggaugagagaauacgugcugggcaggugaaauucuauggccaccgucguccaaucacauagcacuuacaguccucugcugacacuucuguucucugugggggcagacugagcuuuagcagagugaaggcauccugagggaaggcacuaugguuuucucuuuuuaaacaucuggccccacuggcucacgguaaacgugagaccccuauuuauggaaugaaaaggaauagagggaaggauuguucagacucuuuuugaauuggucacaucugacuuucuuccuuguguucugucagcccugucuugguuuuguacaugcguguacauguaaaugugcacuuauacaugcacauugauguuuaauuuguacucauucuaaaguucucaucauacugcuucccuccuugaacaugcugagugguccccgugaccuuggguauacagucgaagcaccuuagcuugauucucagggccccacaccuuccagcccugucugcuaccaugugcucuuggagaccaugagcucugucccugccagauuauuaggcauggccagaagcgaccaagcaugugcucucaugacaaagggccuugggcacagacugaucccucugccuggagugccuuccuuccugccuugacaugguggacugcuccucauguuucagagcccaccucggugguucugucuuuggugcagccucaccuaauugcuacuaagaagaguuaguggcugguccuccucucuggaggaagugggacuguagcuucuguuacacucaacucucaugguugcucccuugucuauacccccagcauuuggcucuguguggccucucugcucucacuacacacacacugcucaccucuucucacccugcuccacaccuccaacacaucaacagucccugcucacuuaccacauugcgggccccuuagcccccagcaccaaguaccugauaagcuuuccauaaauauuagauggugaacugggaccaggcacuucauucuagagagagagcucagguuuuguuuugguuuauccuuugaaccugaauauguacuucuugguccagguugggaaccucagcgccuugagagcagagucaagaauaaacaagcgccuggcucuggaccaggcccuguucccaguccuggguuuggcuuuccucaccuuaucauugaggacaguacuagagacagggugcucuugauucccccacuuccagacugcauguacugaggccuugaguguauucucaaggccaccccacccucuccugcaagguacuugauuuaaccauuuaaacguuccauuauguggagaggggauaaaaauaacgcucccuucugaaucgaacccuuaucccuucggucuacagcggagcccuuucccuggcguccuuuucauaaauauccaggcgacccgagagacugagcacucccacucccgcucccgcucccgccccugcucccgcuccugcucccacccccgucaucucccaccgcccgcagcccggcagccccgcagccccgcagccccgcagccccgcagccccgcagccccgcagccccgcagccccgcagccccgcagccccgcagcagccacagggggaaccaaagagacagaagccuucccagcugcccggacgacagacgccaacaccccccgccccccaccacacgccgccugcccgcccgcaccccgcacccugcgcgcuagcccacgaccgagcggcggcggcaacagcagcuggcugcaggcugcggcgacucgcaccggcgcgcuccuggcagcacuugccaucccaggugacuugaacucgccaguucggauccccugcgccagcucccgcucgcgcaucgggucuguguucccgcacccacccgcccuccugcccucccgcccucccccgccucuccgucccccagcucgcgggaagggaggucgcggcagcggcccggcggcagcggcgaccguggcgacagcagcgacaguggcggcggcgguggcggcagcggcugcggcggcggcggaggcugcggcggcgaccguggcagaggcgguggcggaggccuccguggcggaggcggaagcagagguagaggcugagguggaggccgaggccucaauagaggaggcagcaucggaggccaccccgggggaggcggaggccgcccggguggcaacggugguggcgguggcggagggcagcgcggccgaagccgccgccgcagcggaggcugcggggccccccuugggggaggcggaggcggaugcggaugcggaugcggaugcgaaugcgaagguggcggccgagguggcggccgagguggcggcugcggcggccgccgcggaugcagaugcggaugagacccucggugacugugaggggaacccagauuuucagauggccucccuguacgugggcgaccugcacccugaggugaccgaggcaaugcuguacgagaaguucaguccagcugggcccauccucuccauccgcaucugcagggacaagaucacccgccgcucauugggcuacgcguaugucaacuaccagcaaccgguggacgccaagcgggcccuggagacccugaacuuugaugucauaaagggcaggccagugcgcaucauguggucccagagggacccgucgcuccgcaagagcggggugggcaacgucuucaucaagaaccugggcaagaccaucgacaacaaggcgcuguacaacaucuucucggcguucggcaacauccucuccugcaaaguggccugugacgaaaaggggcccaagggcuacggguucgugcacuuccaaaagcaggaaucugcggagcgggccaucgaugugaugaauggcauguuccugaacuaccgcaaaauuuucgucgggagauucaagucgcauaaagaacgagaggccgaaaggggagccugggccaggcaguccacuagugcugacgucaaggauuucgaggaagacaccgacgaggaggccaccuugcgaugaagacaucccaggagcuagccagccagcagagccaaaccuuggcucacacccgguuuacaaccccccacccccagcccucccccgccaacccaccagcaguguauuuauuguauugagagugcaggucucucucucucucucucuccccuucucucuccccgcuuccuauuuucucccuccaccucuccucuccuucccuuccucucccccgcccacccccaccaagggcguugugaauaaucuuacuaaucugugccauuuguagguuaaaggcugccucuucucccugugguuugguuuaaaaagcauuuucauucucucuuuguuuacugcacaggugguacaauuucaugguagaaucaucagaaaggagaaggauaucagaugagggaagaaacaagagaguaauugcuccccugguccuacuccccagagagaaccacuuuuaccuuuuuggugugcugcuuuuccaggcucucuucucucccucucucuccuuugcucacccccaccccgccuucccuuuuaacacaccguuauagaaugguucauguaugugguguuucuuaaccugcuuuuucagcaacuaaaaccaaacaaaaaucaacccauugaacuucuuuccauguuaucaacaggcuuaugaaaugucaucuucagugccugcagagugcuccaguguauccguggaccuuaacauuucuguaaucauucccgcauuguuggacauucagguggugccuaguucuuucccuguguuuaagaccaacauugcgugcucugugcuuugaugagugaauccuuccuugucaagccaaaucuuugcuagcaucccgguggucuccuuaacugcggacuugcaagauccacauauagacauuuuaaagacuuuuccuguguguugccaaaaggcccccuucauaagcauuguaccgauuugcacucgugccggccagcgcagcuaguaaagaguaugcccguuuccccugcauagccuccuggucacuguaauugaucgugugugugcgugcgugcgugugugcaugcgugugugugucuuugugugugugucuuggccagcuuggcgggcugcaaaggguguuucccuguccucagugguuuugcugcaaucaaacacuguuuauuacccccuuccccugugcccacuuccuguccuuuucccuguugucagaaaaauaauucagcgucauugcaggaaaaaaauaaucacgaagcagacaaguuaacagaagaaaauuaaugucaccaguaaucauuucugaugauuacuuauacauuccugaaacauuuucaucuguaucugcccuguauuuuucaugugauauauaugugaaauuauuguauauacuguuucaauaucugcuuuuucacacagaaauauauauuauagacauagauuuauagauauucuugaacuuucaugucauuaaauauucuucuaaaauaguuuucauggauguuuagugcucuaauaugugauugggcuucauagagugauagauauauauacauauuagauauagauauagggauauauuuguuuuaaguaguuauuggacgucuggguuguuucauuuuguuuucuuaugcaagccaaagcugccaacaagaucacagugcacaaacauuacauucauguuuauuuccugaacaaaaguuaauaguauaauugaaggaugaaaagauaugggagguuuaaaaucuucuuuuucccuucuuuaguaagugaccauugauaaagauaguaccaauuuacccucauaaaauaugcagauauugugaguguaccuggauaccuguacaguuuuugagacuugguauuaaauuauuuauaauuugagauuuuuuguuucuauuuguuguaaacauucaucuuuaugcagacaauaauuaucauacuaaaagcauuuuuuaaaauauugguaaggaaaaacugaaaaucauucuuaauucuaccacuugacaaaaauagaaaaaacuuuugaagcauuugagacauauauguaaauaacuaaugccuccaaaaauguaauauaggauguauguuucauugugguauauuuucagugugagaagucuuacuuaccaucuuuccaaauuacuuaguguuucauuuuacagaugaauu

SEQ ID NO: 19112 - RNA, 5979 nt, Homo sapiens
aauucaucuguaaaaugaaacacuaaguaauuuggaaagaugguaaguaagacuucucacacugaaaauauaccacaaugaaacauacauccuauauuacauuuuuggaggcauuaguuauuuacauauaugucucaaaugcuucaaaaguuuuuucuauuuuugucaagugguagaauuaagaaugauuuucaguuuuuccuuaccaauauuuuaaaaaaugcuuuuaguaugauaauuauugucugcauaaagaugaauguuuacaacaaauagaaacaaaaaaucucaaauuauaaauaauuuaauaccaagucucaaaaacuguacagguauccagguacacucacaauaucugcauauuuuaugaggguaaauugguacuaucuuuaucaauggucacuuacuaaagaagggaaaaagaagauuuuaaaccucccauaucuuuucauccuucaauuauacuauuaacuuuuguucaggaaauaaacaugaauguaauguuugugcacugugaucuuguuggcagcuuuggcuugcauaagaaaacaaaaugaaacaacccagacguccaauaacuacuuaaaacaaauauaucccuauaucuauaucuaauauguauauauaucuaucacucuaugaagcccaaucacauauuagagcacuaaacauccaugaaaacuauuuuagaagaauauuuaaugacaugaaaguucaagaauaucuauaaaucuaugucuauaauauauauuucugugugaaaaagcagauauugaaacaguauauacaauaauuucacauauauaucacaugaaaaauacagggcagauacagaugaaaauguuucaggaauguauaaguaaucaucagaaaugauuacuggugacauuaauuuucuucuguuaacuugucugcuucgugauuauuuuuuuccugcaaugacgcugaauuauuuuucugacaacagggaaaaggacaggaagugggcacaggggaaggggguaauaaacaguguuugauugcagcaaaaccacugaggacagggaaacacccuuugcagcccgccaagcuggccaagacacacacacaaagacacacacacgcaugcacacacgcacgcacgcacacacacgaucaauuacagugaccaggaggcuaugcaggggaaacgggcauacucuuuacuagcugcgcuggccggcacgagugcaaaucgguacaaugcuuaugaagggggccuuuuggcaacacacaggaaaagucuuuaaaaugucuauauguggaucuugcaaguccgcaguuaaggagaccaccgggaugcuagcaaagauuuggcuugacaaggaaggauucacucaucaaagcacagagcacgcaauguuggucuuaaacacagggaaagaacuaggcaccaccugaauguccaacaaugcgggaaugauuacagaaauguuaagguccacggauacacuggagcacucugcaggcacugaagaugacauuucauaagccuguugauaacauggaaagaaguucaauggguugauuuuuguuugguuuuaguugcugaaaaagcagguuaagaaacaccacauacaugaaccauucuauaacgguguguuaaaagggaaggcggggugggggugagcaaaggagagagagggagagaagagagccuggaaaagcagcacaccaaaaagguaaaagugguucucucuggggaguaggaccaggggagcaauuacucucuuguuucuucccucaucugauauccuucuccuuucugaugauucuaccaugaaauuguaccaccugugcaguaaacaaagagagaaugaaaaugcuuuuuaaaccaaaccacagggagaagaggcagccuuuaaccuacaaauggcacagauuaguaagauuauucacaacgcccuuggugggggugggcgggggagaggaagggaaggagaggagagguggagggagaaaauaggaagcggggagagagaaggggagagagagagagagagagaccugcacucucaauacaauaaauacacugcugguggguuggcgggggagggcugggggugggggguuguaaaccgggugugagccaagguuuggcucugcuggcuggcuagcuccugggaugucuucaucgcaagguggccuccucgucggugucuuccucgaaauccuugacgucagcacuaguggacugccuggcccaggcuccccuuucggccucucguucuuuaugcgacuugaaucucccgacgaaaauuuugcgguaguucaggaacaugccauucaucacaucgauggcccgcuccgcagauuccugcuuuuggaagugcacgaacccguagcccuugggccccuuuucgucacaggccacuuugcaggagaggauguugccgaacgccgagaagauguuguacagcgccuuguugucgauggucuugcccagguucuugaugaagacguugcccaccccgcucuugcggagcgacgggucccucugggaccacaugaugcgcacuggccugcccuuuaugacaucaaaguucagggucuccagggcccgcuuggcguccaccgguugcugguaguugacauacgcguagcccaaugagcggcgggugaucuugucccugcagaugcggauggagaggaugggcccagcuggacugaacuucucguacagcauugccucggucaccucagggugcaggucgcccacguacagggaggccaucugaaaaucuggguuccccucacagucaccgagggucucauccgcaucugcauccgcggcggccgccgcagccgccaccucggccgccaccucggccgccaccuucgcauucgcauccgcauccgcauccgcauccgccuccgccucccccaaggggggccccgcagccuccgcugcggcggcggcuucggccgcgcugcccuccgccaccgccaccaccguugccacccgggcggccuccgccucccccgggguggccuccgaugcugccuccucuauugaggccucggccuccaccucagccucuaccucugcuuccgccuccgccacggaggccuccgccaccgccucugccacggucgccgccgcagccuccgccgccgccgcagccgcugccgccaccgccgccgccacugucgcugcugucgccacggucgccgcugccgccgggccgcugccgcgaccucccuucccgcgagcugggggacggagaggcgggggagggcgggagggcaggagggcgggugggugcgggaacacagacccgaugcgcgagcgggagcuggcgcaggggauccgaacuggcgaguucaagucaccugggauggcaagugcugccaggagcgcgccggugcgagucgccgcagccugcagccagcugcuguugccgccgccgcucggucgugggcuagcgcgcagggugcggggugcgggcgggcaggcggcgugugguggggggcgggggguguuggcgucugucguccgggcagcugggaaggcuucugucucuuugguucccccuguggcugcugcggggcugcggggcugcggggcugcggggcugcggggcugcggggcugcggggcugcggggcugcggggcugcggggcugccgggcugcgggcggugggagaugacgggggugggagcaggagcgggagcaggggcgggagcgggagcgggagugggagugcucagucucucgggucgccuggauauuuaugaaaaggacgccagggaaagggcuccgcuguagaccgaagggauaaggguucgauucagaagggagcguuauuuuuauccccucuccacauaauggaacguuuaaaugguuaaaucaaguaccuugcaggagagggugggguggccuugagaauacacucaaggccucaguacaugcagucuggaagugggggaaucaagagcacccugucucuaguacuguccucaaugauaaggugaggaaagccaaacccaggacugggaacagggccugguccagagccaggcgcuuguuuauucuugacucugcucucaaggcgcugagguucccaaccuggaccaagaaguacauauucagguucaaaggauaaaccaaaacaaaaccugagcucucucucuagaaugaagugccuggucccaguucaccaucuaauauuuauggaaagcuuaucagguacuuggugcugggggcuaaggggcccgcaaugugguaagugagcagggacuguugauguguuggagguguggagcagggugagaagaggugagcaguguguguguagugagagcagagaggccacacagagccaaaugcuggggguauagacaagggagcaaccaugagaguugaguguaacagaagcuacagucccacuuccuccagagaggaggaccagccacuaacucuucuuaguagcaauuaggugaggcugcaccaaagacagaaccaccgaggugggcucugaaacaugaggagcaguccaccaugucaaggcaggaaggaaggcacuccaggcagagggaucagucugugcccaaggcccuuugucaugagagcacaugcuuggucgcuucuggccaugccuaauaaucuggcagggacagagcucauggucuccaagagcacaugguagcagacagggcuggaagguguggggcccugagaaucaagcuaaggugcuucgacuguauacccaaggucacggggaccacucagcauguucaaggagggaagcaguaugaugagaacuuuagaaugaguacaaauuaaacaucaaugugcauguauaagugcacauuuacauguacacgcauguacaaaaccaagacagggcugacagaacacaaggaagaaagucagaugugaccaauucaaaaagagucugaacaauccuucccucuauuccuuuucauuccauaaauaggggucucacguuuaccgugagccaguggggccagauguuuaaaaagagaaaaccauagugccuucccucaggaugccuucacucugcuaaagcucagucugcccccacagagaacagaagugucagcagaggacuguaagugcuaugugauuggacgacgguggccauagaauuucaccugcccagcacguauucucucauccucuccuccucugccuucuuuggguaaguaaagcuguuuucugugguugcagugauggcuggaucuuggcagucauacaugauagaacaaccgugaaccugaggaagugacugagucacuguggggugcgaggcagugagaacucuucgucgcuggcuggaaagcaucccaagguggcugagaagcagauacacagacauguaccucuccagcuugcaaaguccagcucucugccucuaggcagggcuagugccggcaaaggcaagggacagagaccuaggaaaagccugcuguacagcgcaugccugaccaaggugaucacugucaccgcuguuaagagccaucuccugggggucuagguugcuugcaggcagggagaagaugaagcugugccucaccauuuccagguugguguccaagagggaccugagaaggcagaggccaagggggaagccaugcucgcagagggguaggggauguggcgaggaugagaagagcuccucggcccauuguuaggaaacagaaaugacaaggaagaccaagucgaggaccaggacucagcaagaucucugucucuggcguugccuuccaguacacagggccaacagaaaucagugaaacagcaggagaaggaaguucagggaagucaugcuauggcuagcaaauccccaaaccugaaaacaauuccuaggauccugaaccucuagcaacaggagcagggcuaccaaagugacaaggacacagcagggacugcuccccaaguccuuucucaggggcuuccauggagucgaguuuccaucuccuuuuuauucuuuauu

SEQ ID NO: 19113 - RNA, 765 nt, Homo sapiens
ugcuucaagaugaagcugaacaucuccuucccggucacuggcugccagaaacucauugaaguggaugaugaaugcaaacuucguacuuuuuaugagaagcuuauggccacagaaguugcugcugacacucugggugaagaauggaaagguuaugugguccgaaucaguggugggaacaacaaacaagguuuucccaugaagcagggugucuugacccauggccguguccaccugcuacugaguaaggggcauuccuguuacagaccaaggagaacuggagaaagaaagagaaaaucaguucgugguugcauaguggaugccaaucugagcauucucaacuugauuauuguuaaaaaaaaaaaaaaaguaaagaaggauauuccuggacugacugauacuauggugccuugucgccuggggcccaaaaaagcuagcagaaucugcaaacuuuccaaucucucugaagaagaugauguccgccaguauguuguaagaaagcccucaaacaaaggagguaagaaaccuaggaccaaagcacccaagauucagcaucuuguuacuccacauuuccugcagcacaaagggcagcauauugcucugaagaagccguguacuaagaaaaauaaggaagaggcugcagaauaugcuaaacuuuuaggcaagggaaugaaggaggcuaaagagaagcgccaggaacaaauugcgaagagacacagacuuuccucucugugagcuucuacaucuaagucugaguccagucagaaa

SEQ ID NO: 19114 - RNA, 2930 nt, Homo sapiens
aauaaagaauaaaaaggagauggaaacucgacuccauggaagccccugagaaaggacuuggggagcagucccugcuguguccuugucacuuugguagcccugcuccuguugcuagagguucaggauccuaggaauuguuuucagguuuggggauuugcuagccauagcaugacuucccugaacuuccuucuccugcuguuucacugauuucuguuggcccuguguacuggaaggcaacgccagagacagagaucuugcugaguccugguccucgacuuggucuuccuugucauuucuguuuccuaacaaugggccgaggagcucuucucauccucgccacauccccuaccccucugcgagcauggcuucccccuuggccucugccuucucaggucccucuuggacaccaaccuggaaauggugaggcacagcuucaucuucucccugccugcaagcaaccuagacccccaggagauggcucuuaacagcggugacagugaucaccuuggucaggcaugcgcuguacagcaggcuuuuccuaggucucugucccuugccuuugccggcacuagcccugccuagaggcagagagcuggacuuugcaagcuggagagguacaugucuguguaucugcuucucagccaccuugggaugcuuuccagccagcgacgaagaguucucacugccucgcaccccacagugacucagucacuuccucagguucacgguuguucuaucauguaugacugccaagauccagccaucacugcaaccacagaaaacagcuuuacuuacccaaagaaggcagaggaggagaggaugagagaauacgugcugggcaggugaaauucuauggccaccgucguccaaucacauagcacuuacaguccucugcugacacuucuguucucugugggggcagacugagcuuuagcagagugaaggcauccugagggaaggcacuaugguuuucucuuuuuaaacaucuggccccacuggcucacgguaaacgugagaccccuauuuauggaaugaaaaggaauagagggaaggauuguucagacucuuuuugaauuggucacaucugacuuucuuccuuguguucugucagcccugucuugguuuuguacaugcguguacauguaaaugugcacuuauacaugcacauugauguuuaauuuguacucauucuaaaguucucaucauacugcuucccuccuugaacaugcugagugguccccgugaccuuggguauacagucgaagcaccuuagcuugauucucagggccccacaccuuccagcccugucugcuaccaugugcucuuggagaccaugagcucugucccugccagauuauuaggcauggccagaagcgaccaagcaugugcucucaugacaaagggccuugggcacagacugaucccucugccuggagugccuuccuuccugccuugacaugguggacugcuccucauguuucagagcccaccucggugguucugucuuuggugcagccucaccuaauugcuacuaagaagaguuaguggcugguccuccucucuggaggaagugggacuguagcuucuguuacacucaacucucaugguugcucccuugucuauacccccagcauuuggcucuguguggccucucugcucucacuacacacacacugcucaccucuucucacccugcuccacaccuccaacacaucaacagucccugcucacuuaccacauugcgggccccuuagcccccagcaccaaguaccugauaagcuuuccauaaauauuagauggugaacugggaccaggcacuucauucuagagagagagcucagguuuuguuuugguuuauccuuugaaccugaauauguacuucuugguccagguugggaaccucagcgccuugagagcagagucaagaauaaacaagcgccuggcucuggaccaggcccuguucccaguccuggguuuggcuuuccucaccuuaucauugaggacaguacuagagacagggugcucuugauucccccacuuccagacugcauguacugaggccuugaguguauucucaaggccaccccacccucuccugcaagguacuugauuuaaccauuuaaacguuccauuauguggagaggggauaaaaauaacgcucccuucugaaucgaacccuuaucccuucggucuacagcggagcccuuucccuggcguccuuuucauaaauauccaggcgacccgagagacugagcacucccacucccgcucccgcucccgccccugcucccgcuccugcucccacccccgucaucucccaccgcccgcagcccggcagccccgcagccccgcagccccgcagccccgcagccccgcagccccgcagccccgcagccccgcagccccgcagccccgcagcagccacagggggaaccaaagagacagaagccuucccagcugcccggacgacagacgccaacaccccccgccccccaccacacgccgccugcccgcccgcaccccgcacccugcgcgcuagcccacgaccgagcggcggcggcaacagcagcuggcugcaggcugcggcgacucgcaccggcgcgcuccuggcagcacuugccaucccaggugacuugaacucgccaguucggauccccugcgccagcucccgcucgcgcaucgggucuguguucccgcacccacccgcccuccugcccucccgcccucccccgccucuccgucccccagcucgcgggaagggaggucgcggcagcggcccggcggcagcggcgaccguggcgacagcagcgacaguggcggcggcgguggcggcagcggcugcggcggcggcggaggcugcggcggcgaccguggcagaggcgguggcggaggccuccguggcggaggcggaagcagagguagaggcugag

SEQ ID NO: 19115 - RNA, 560 nt, Homo sapiens
cauggcaguugggcuguuaaguuugagcgcucccagucuuuuggcggcaguggugaugcaaaggcucuuggccacccaccuccgcugggaauccagcuucuccaggacuguggucgcccugucugcuguggugggaaaacagcccccggaacugaccguacauuggcaggaggacccagauccugaggacaaaaacuucuaugagaagaacccagacucccauugcuaugacaaggaccccauuuuggacaucuggaacaugugaguugucuucuucuuuggcgucuccauugucccgguccuuggcagcaccuuuguggccuaucugccugauuacaggaugcgagagugggcccacugcagagcugagaugcuugugaaauaccgagaggccaaagaccuucccaucauggaauccaacugcuucaaccccagcacgauccaguugccagaggaugagaacugaccaguugcugaguggagcucaagaagcaccaccuuccccaccccuugccugccauucugaccuaauuaaaggggcugaaagucugaaaaaaaaa

SEQ ID NO: 19116 - RNA, 560 nt, Homo sapiens
uuuuuuuuucagacuuucagccccuuuaauuaggucagaauggcaggcaagggguggggaagguggugcuucuugagcuccacucagcaacuggucaguucucauccucuggcaacuggaucgugcugggguugaagcaguuggauuccaugaugggaaggucuuuggccucucgguauuucacaagcaucucagcucugcagugggcccacucucgcauccuguaaucaggcagauaggccacaaaggugcugccaaggaccgggacaauggagacgccaaagaagaagacaacucacauguuccagauguccaaaaugggguccuugucauagcaaugggagucuggguucuucucauagaaguuuuuguccucaggaucuggguccuccugccaauguacggucaguuccgggggcuguuuucccaccacagcagacagggcgaccacaguccuggagaagcuggauucccagcggagguggguggccaagagccuuugcaucaccacugccgccaaaagacugggagcgcucaaacuuaacagcccaacugccaug

SEQ ID NO: 19117 - RNA, 3396 nt, Homo sapiens
aaaauuaauguuccaauguuucucauuuggcccaagauucuggcuucauaaauuuguccaacuggcuauuuuuaagcuuguccuaaaagccaauaacauguuuauuccuaauaacuaauaugggcaaguguuauuuacagauuuauuaacuccaucccagauaugucuccacucuuuguucccuccuaaugcuaauuuaggaaagagaccacuguaguaaaacuuuagaagaagauggagaagugccuugucuuuuuagaacaaagauaacacauuacguguaaggaagcauaauaaaugaauugguagaugauuagauuagaaaucauccuuuucaacuaggucuaagaauacuuuacuaguguauuaucuuuuauuuauuauguaaagcuucuuuccuuccuuuuccccaaucaugauauauuagugacaaaauauuacagaaccggacuaucagucacuuaaaaaaacaguauaauucuaaugcuaguaaacauguaauuuaauuuaguucuggaaggacaguugucuuugauuaaagccccaccaaaacccauuuaaguauuuaauguacauacuauucauauuauuauggccuguaaacacuaauaucugagcaaucaaacuguuuuaucuaccauuuuugaugaaauuugaauaaaguuuaaaaacguguaagccuuugaacaaauguaugaaagcuuuaaaagaucauuagcacuuuuauuuuguuuacaaauaagcugccauuuaaaaaaauaaaaccucacuacuugaacauaaagcucccaaacaauauuguauuaaaauguacuauauugaccuaggaggauauagaaauuauauucaccugauuaacuggagcaguuucacauaguagaaauacuuuuugcuaauuugauuauaagugcucaaauuuauugaaauuagauucucaugccuauaaaaguauacuuuaaaaauauuuugcaacaacugucaaauuauuuggguuccuuuaaauagcaaacaauugggaaauuuuccauaaaaaugaauagguuuuauuaauaccuguucauguaguauguggacuaaaacaauugauauauaucuguauguaaaaaugaaugaucuuaucuugccccaaauuuuucuuaccugauucugagccagccuuuuuguuuugauggcacccugugaguauguuccauuuucugugaacuuugucaaauucauacuauaugaggaaaugaucuaauauugugggcuccaggcaggucaucuuaauugcaugucugucucuucuguaaaaugaugagguggaaccuagagcuggacaaaaaauuagagaucacuuaacauucugugauucaaggaauucuuaggacauuuuuacucuauagaaucucagaaugauuauucucagaucuacuguccuugguggaaacucucacagugccuugcaugcaguaaaaguuugauuugccgacuggcugacguguuaauuaucacacagacuccaagaaccugaugcuugcuagaccuuaguuccuuggugaugcuaagaguaaauguaguuuuccuaggaacugagcacugaggucuguguccuuugccuguguagaaucugucuaugcaguugguauucaggcaagaauuuuagcuguaacaacaauggaaauauuggaggacccacuuuggcauuuauguaaagauuucauauccuauccaacauuuacuuuagugucuaaucaaauuccauacccucaaaaagaucuguuggaacaaauugauaaaauuagguggaaaggaaagugguaugggacucaaauacaagucacuucugguuuaauuauuggcucugcugcuuaauuccucuguaccucacguccucauugucgaaguggggacaauaaucuggaccuaccucacaggggaauugaggauauuuucauauauuagugugcuuugaaguugacugaaagauauacuggauaucauaauuauauaauuucuaaauagauuucuuuaaauccaugcuauguuuucuuuuucagucagguccuacagaaugacuauugcacuuggucuauuguuuuaauaguaaauuuuguuauuaaucuccuauguguuaaacguggguaauuguauuauguuaauacauacuuagggaggaaaagcagguggauguaaaucagugauucccaacuucagcagaugauagcaguggaggguauccuugagcuuuuuguaauauuucaaaaaguauauuagaaauuauacauuuacccauaauauuccugcuucacaagucaauuaagacauugaauuuccauucauuuugccuauauucucucaaaagcugugaauggcaguauguuuuugauuaauaauaaaauaagaaauccuauuaugugcaacuuauuaaauacuugggaacaugggaaaagaauaaugaagggauucuuauggugaaaauguugggaaccacuuuuauaaaggaacuaagauuauuugacccccuccacagauugcuuaccuagucucuaaauaaugaaauguguguguuuguguguuuuggcuauauuaggcuauauaacuucagguuagaauuugccuucaguuuuuuuucuguuuuagaauaucacuggccuaauuuauuuagguguguacauguugcucauacauacacacacauauaggauuacaaauguggaaaauguuauaaugucauauucuagcauuggacuaaauaucaauuucugacucuuaaaguaguucuguguauaaauucaacaugaugaaucaaggcaauaauuucucaaauguucuuuuauuucuuuguuuuuaucucgacuuuuuauuuuccauuuuuucuaguacgcaaauaguguaaaauuguuuuaaugccuggacuuugaaacaaguaacaaguguuugaaaguauauaaucuacgagcgaauuugcccuccuuggacuaaccacauacaaauaugaaucuggcugcaagaacaggauauccagguaacuagagagugggcauugauaaaaauaucugguggagaagccuaggauuucaacuuuuugucagaggauuccuguugggacagcuuuaccagaaaagaauaauagcggauauguucauccaaacuaagaacuuucaugcaucuugcauuguuacauagccuguggaaugaauucauuuuuucucccuugaguccaggaaugacuucccuggaaaaacucaaucuauauacagcugugccaaaaugaaggauaccugccucuccgaaacuuucacugcugcuucugucauuguucacuugucagauaaaauuuuauuaucucaggaugcaaauuuaaaauaaaguguaaaucuauguuaaugaauugaauucuguguuuuuuuuaug

SEQ ID NO: 19118 - RNA, 32093 nt, Homo sapiens
uuucaaaacaguauauuuuauuuuacaauagcaaccaacuccccaguuuguuucaauugugacaucuagauggcuuaagauuacuuucugguggucacccaugcugaacaauauuuuucaaucuuccaaacagcaaagacucaaaagagauucugcauuucacaucaguucacaaguucaagagucuuccauuuaucuuagcuuuuggaauaaauuaucuuugagguagaaggacaaugacgaagccacuuaauuccuugugucugcauaaaagcagauuuauucaucacaacuucauuuaugugaauaaagcagaugaugauaaaauguucucuuauucuuguuuaaucaguagugguagugaugccagaaacugugaaaggaaggcuuuuaguuacuuucuucuuuccauuuuccaauaauccauuccccauccccagcugaagaaagggguguuacugaguccagcugauaccacacauugaaagguaaacauuaauauuucaaaucugaugucuaacuaaaaauguacagaaugaaaacuagaaaauuucaaccccagauuaucuucaaccuugcucccuccaccaaucauacuuugacauuuaucuauuuccuucuccacuuauggauguaauuggcuugcuauagaaacuacaguucagaugcuuugaauguaugaacuacaaugaacaauaaaguccucuucuuuugaagcauauuuuggcuucagcuuuaagauaaucuuaugacaagaagggucacacugauucacuuaauaaauuccauucuuaccuaacacaagguuuaguugauaagcacuuggacaaaaauaauacuuuucaaaaauguaaagcaaacuagugaggacaaaggauuuuguccucaucucaacaaugaucagcuauuggaacugcaugaaacugaacaauuuaaaccuggagcugguaauguucuuaagaccaauucagaacaaaggcagguugcccuuaaaacagguuugaccuuuuccuucacucuuccuccugucccacccucugugagugauuuaaaaacggaaaaggucaaagcccagccaggccuacauuuagagaaauuuuaaaaaaauuuuuccuuucaauuuuggccaauuauuuccaauuuuuauuuuauucuuaaaacuuaagcaugguaaaauguuaagcuguuuucauccacugauauuauucuacuauaaaaagcccuucuugagcagauuugaugauaaaaaggagaacauuucuaagguauaauuagagaagcuguugcaugagaaaucaugucuccaucuccauuuugcuaugcguuaucugaggauuguuucugaaagagaucuauuuaggcaguguauguaugugucagcauguaaaaaguaaagaacugaaaauagacaaaccuuguaaaugcacuucaaaaccaauuguggcucaaguguaggugguuccccaaggcugguaccaaugagacugggguuugggaauuaguuggucaucaucccuccugcugcccagcaguggucagucauuuuucaugagggauggacuaggaaaaugaagugucuauuauaaggagaguuccuguaacuuaaggagcaagcucacuacaaaacccagcuaccugcuuaucguaguggccagagugguagaagagauacggaguaggaauuaaaccacacaauguuauuuagggacuaagccaugccccuaacaagaaaacaagccaaaaggaaaguauuaggcauucucugggaaggcaugcauuuuuuucccaugucucuggggccaaaaaccuuauaccaaguaccuauuggcacccgaauauauuuguagaaugaaugaauacaugaaaaaaaauaaacaguaaccuuucuccuauauucuacuuuccaagccaauuaauaagcaagugucuuuucgucaugauuuuuuuuguuuucuguuuaggauuuaacaaaaugguugagauaacagucacuucuguuugaugaagaguaucacuucauuccauuuuuguguuuuuguugcaucuccaagucagaauaaaugccuuuuggagcagauauauuucauuuagcauuuaguaucaucuucaucaauacucguaugaacgaaaaaauaaaaagcccucucuuauucccacucuacaacgcaugucaaaggugaucuguuuaguuuuuccuuaguaucgaacauaucacagcuacucaaugaaguuucuucucaacuaaagaaacacagucucuuagagaauuuguuccuguguuuccaccauaagauaaaugagauaaagugcacuuugguuuacgucuuucaagcacuuaagaacagcacuuuauucaguuuuaauaaauuuuuacuaaauugguaaaugcaaaagaaucuuuuuuuuauugcucauaugucuuccugucucuaagccagaccaaugagcaaauaccuuuaaaacuaguuguuacaucuugaaccauuuaacuguaauaaaagcagaauguuuaguuaaugaauuaaagaacaaacccugagcccuuuuaucagucuccuggcuuuaaacuaagccaaugaggaagugauuugggggauuccugaaacuaggaaaaaugucucuuuauuuugaaagaaacuugcauuuuucuuucuuuuuuuuuuuuuuuuuaaucucaaaggcaauugagugggucuucugggccagaccuauuuaauuuacgaaacauaguaccuugcagagaauaggcauugaaauauuauuuaaacaaucaaaccaaagauguucuucuaucuucagcugucagugaucuaaugcccucaucucucuuauccucaggacccagaaugguauauuccacauaaaagaugcuuuguuuaucaaaugaaucaaaaagcacgccugaggcauuuauuuuuacuccuuuacuucuguaggccaggucaaggugggucuaauucacuuuuaucaucagcacuuaagaaacuggauggaagaccacaacaccuuguuuuuugcaaaaauuuuccaucuccucaaucaggccaggaagcauguaucuucuggacaggacuuuaucucucuacucagcuuaguacacugccuuauauuaguccauuugucccauguuuucaucacugaauaaacuuguuaaaugacuuuuggucuggaucucacaccuauauuacuucauuuccuucugugagcacucuauaaugauaacaucauuuuuauauccuagggcauguaguuccgagccccacagaaaguaaucaccauucaguaagccaauaguucauuccuaucuguauagaacuguaggcuuuguaaaucuacacauagaucucuguuguagguucaauaaugauaauaaauguuugugcccccaguuguuaucucuaaggauaagaguaaucaaugaucauucagcagauauagcuuauauauggguggcaguuuacaaauuauaaauugauuuuacacauauuuucuucugcuacccaagacacaauaaagaugguuuaucuuugcauccccaaugccuagcaaugagauuggcacacaauagauaacuacuauaguggcauucuucagacaaccaaucccuugcguaugcguauucaaaagauaaucauuguuauucaaauuuuccuacuuuauuugcacaauauaauaacuaucauacaauuuuauaaaccuaguacccagcaccaagugagaaaaucaacaguuacauuuauauggugccuuagaguucacaaaaugcuaacauagguauugccuuauuuuuggcuguggcuaaaugaaauaugauaaauuuucagugccuuuaacagugaguucacauaguaggcaaucaaaauugaucuauuuaacagguauuuaaacccuugguuuguauaacuacuuauagaacccuucucacugugguuuaacuauacaaugagaauuuuguagagacaauaccuagcuuacagaaaguuuuauucauacagaaagcaucaaauuuuucauuuacaagugcuuuauaauuuagaaagcacauucgcaagcugaauuaagugacuuucggucuggaucucacaucuauuacuucauuuccucauacuagcucuuuccugguuaccuggaaaaauguaucaguaauaauuuaacuuaaccucaccaguaaagucuugauuguuuaaaauuaagcaauauaucauuccuuacaucugaauaguauagaggauaaacuuuccucuuauuacauaggagaauuaaucuuguauuuuacaguacccaaaauagcugguauguaagaggcacuuaauauucauucauccauucauucauucauaaauauguagcccauugacauuuguaucaugcuuuaguuuacaaagcacuuuaauaugcaccuuucugaaauuuuuuguucuaugagaauacuuuucccccuuugguagcucuagcacccagcaugguaucuggcacauuauaggugaccacaacaagcuuagucccuuauguuuucaguauauuuuaaaguuuaaaagcaguuuccauguguuuucguuucugauaccuggaauacugcauuuuuacucaaaauuaccagagcagcaaacacaaauuggccucaaauauacauauaauuuauucauuuaucaaacaauuccuugugucugcauaguacuauauccuuuugaaagagcacuuuuuuaugcuugcuccuuucuuuguauccacaacgcuuaucacaguagaauacaagugcuuuacaguuuacaaagcacauucacuauuuuuuuucaggucaccuagauaucaauaaucauugcauuuuuagugccuagcacagggacaggcacagaaaaggaaacuaguaguauucagaaauuuucucugaauaacaaauaauacaucagggggugguaagcuaugaacagcaggccaaauccaauuggcucaaaaacuaagaaugauuuugaccuuauaaaaacguuguuuaaaaaacaaauauguaacagaaaccauauggcccacagucuaaaguauuuaugauuugaccccuuacagaaaaacuguggaccccugauuuacauaaugcuucacaauuuacacugcacuuucaaauguuaacugcaugauugccaauacacuaauugguuuuucucuuauguuuuacagugcuuucauacacauuaucagucauuuaaaucaacuucccacauaaacaggaagaaaaaaaucaaggaaaguauuaaacaugcucaacagucccagguucucucaucuuuaagccuagagauggguauuaaacccaggaguagcguuggcacaguccaccaaauuauuuggccacuacuaugagcagggaguucaggcuguccccuugggaccucgcuuugucccaggcacagucacccuuuccauaaccaucacuagaaaucccaaaccccagaauccugcucaccuaagcucaaagaaggaagcuguugcuggcaggugcuucucagaagucuggcacaucuguguauuucuugucuaauucuucucauuggccuggagcaucucuucacauuuuucucuagagagccuggcacuuuuuuuuccccaacaaccugaccauuuuaucuucucagucuagggcuucuggggucaaaagaaaggacugaaauacaguaucaccuauaugaaugucugcuccugagggaaguuaacaaaagccagauuagauacugacuggauuuuggugucucucucaaguggagaagaugugaauagaaacagaaguuuacaaaacacuauagccuaacaaauagguaaaagcugugauuuaaagcuggcucaagacuggcccaggcauaauacugucaaucuaaagguaaccggcaacaucaaaaaguacaucucaaaagaaucaggcuuaaagauaaacaggagaacuggaaauaucuaagaguaagaaguguaaacaauagaaaagagguaggguuuaggguucucaucuugggauuuccccaggucuucaagcuucuauccuuccuggguucugggucaugggccuccagauuccggccguuagucuugagauaccuuuuucgcuuggguccucuauccaucuagguaggcuuugugacaggggccuuccauccuuggguuguaggucuuccagcuacaacccugggcuaaucuuaggucguuggccuugugucacaagucucaguucuuaggccuuccauguguccugucccaggucuuaagacuucuaacucaagccuugagacuuccauccaacucaggccuucgguccaauucaggccacccucuguuuucuuggcucuugaggcuuuuguugguuucaggccugaggcuucuaucuaucuuggaacaugggcuuuccaucuuaguccucgggucucaagucucaaaccaucugucuuauacuuugggccuucuauccauaugagccuuccaccuucugcccuacuugaguucuggguuuuacugcagucuagggccuuguuuuggucuuggaucaucucacauggcagccuggcauaaggaaccgcuccacaaugcuugcucugauagccgacguucugcaccuaucaggcagggguuaggaagccccucugccacacaugacacacacacacguacacuugcccacauaugcaaagaaauauuuaaggagagauuacaugaaaucaaagagagggagauagauucaugaagaggcugaaauacucaaaggugaguagaaagggaagaagcagagaacaaauacaagccaacagagauuaauacugaaauagaaaaucacaaacagcaagagaugcugaggcacgcaggggaggagagagagaauagcccaagagaggcagaaaggaaaugcagaaaugagaaaugugagauaaaaaguagaaacagcagaaaggaggccagacucagaaaaaaggugaaauuuaaaacgaacgagaaggggaagggguaacaaauaaucacaguucacaaagagaaaagagagguaggcagagaaaggagagguagacagaacaagaaaaggacaaaaagcacacagcaugugacccaaaaaggagacaugaaauaaagcgugaaagaagagccacaucuaggagagcaaagagaaauagcaacaaaaugaaaaaugagagauaugucuaagacaagacacagaccacucuugugaacaaaaagagaaaaugaggcaaaggcacacacgaaagaaauuagcaagagaaacauggaaauggguaagacacacuuuagauagagaacaaagagcaaagacaagaaagaaagagacaaagaaauacacacuugagugcaagagauaagcaaaggcagacauucagaggaaguaaguaguagaagaggcaagauacagugaggggcacaagaggcaugaaaagcaucacagaaagauaaaaaaaaucaaaaagugucauuaguaauuauaauaaacuauuguuacuacgaauacuacuuauaguacuacaauaauaacaaccaccaauaccaacacagaugcucuucuauuuauaaacuuuuaccuuagggauuucuuacauagaaccaaagcaugccaacucugccugcuaccugauagugcuaguggucacuuauauugugggaaaugaacuuaugagucuucuuggguuaccuuuuacuugacaugugccaggcacugcaauaggugagcacuuuacauacaugauuucauuuaacccucacaaacagagaagucuagagacuuuaaguugucaaaggucauauaccuaaugaguagcagaggauuuaaaacacacaauguaugccucuuaacauccuguuacaacuauuuacuaggauuucuggaagagccaaaugggaugucacagaugacuaaguauuuucauaaaaggcucuuugauaggacuugcucaauccccuccuuuagcaucaccuuuccccaacucuuuagaaaacugacuucauucucacacuuuuauaauggcuacuucagaguuuaguuuucuuuuuacacuaaucuuaacugacgacagagucucucacaaacggagaugagaaaggguuacccuuucagcagaaagcagaaaugguguuuuaagcuucucaacguuuaaggcucuaagaaugacagagggccuauacagugaagacauagaacacacaagcaaaggcuaaauucuucugugauacaacugguaagaagaccauaaugucuuugaguugcuucagugaacccagucaguaauauggaagacuggucaucuuuccaucucacauuuagccccacuucacauuagaccaacacaccccauccaacaccagcucccaaaaaacagcuguuauaacaguucugaagugauccucacaggacugcaacaucaacaacuuacuucauucagcuauccucaagugcuagagugccaggcauguugaucuucaggugggaaggcugacuuccuucaguguguucaaauuucuuggaccugcugaagacucagcucucugcacugcuuguaggaaguauaaugauuuggcagauaggaacaaugaagagcuauaaaaaaacaugagauaaaccauguaaaugccauaaauauugaguacugugcuagaguuacauaagauucaaauuaauaagcaauagaaaauguuuccacagaacuuugaaaccuauaaagucaaaacuuuuaggucuuuagagagaaaauuuccucauucaacagaauaggaaacuggcauaaaugggaaaaugucuugccaaauaucacuugaugagucacuagagacaccacuaccagucauagccuuauaccuuaguuaaagaccagaacugccgggcgcgguggcucacgcccauaaucccagcacuuugggagguugaggugggcggaucaccugaggucaggaguuugagaccagccugaccaacauggagaaacaccgucucuauuaaaaauacaaaauuagccgggcgugguggugcaugacuguaaucccagcuacuugggaggcugaggcaggagaaucgcuugaacccgggaggcagagguugcagugagcugagauugcaccauugcacuccagccugggcaacaagagcaaaacuccaucucaaaaaaaaaaaaaaaaaaaaagacuuccauccuguuuuaagugccaaucagcuaggaaagagucccuuuaaaugauuaauaacugagaucacaaaaauaauagauaugagagggaaaaacauaaggucuucccaauguuuaaggcucacuucgauguuuuaagaccccucaaguuugcuuuaagucuccuggcucaggacuaacaaaacacagccuuagagcagcauuuucaaaacucacaauauugcucuuugagauaaaggugagucacucuggaaggcaaauauucucacaauaagaaaauucacauagguuguuuaacauugcagcuaaaauacaaaaaaaaagaagaagaagaagaagaaaaagaaaauucacauagacuacuggcccuaggagaauuuaucuaaagauuaugaguacaauagauagaucuuccuagauaacucucaacuuagcuuucuaguuccuagacuuucuaacaauuuguuaguaacucucuauuucuaaaucuacagagauuucuagucaauuauaacauuucaagaguucuuacccaugaaaauauuucaugaaauuuauagcuacccacuauuuacgaagaaugcugggcaaagccuauacguucaggauuuauugcaccgaauggucaccuuuaucugccaauucucacucgcuaaucagccucucccaacacugaccuagagaauguaggguccugguucuuuagcuccugccugaugacagauaacuuugugccauuuuuagucagguuuccauuuguauuuaugcggcuuccaucaaucagcaaccauagcauaaaaagacacaccucucacuuguuguauuauacaccauggcaucccaagccauccugaaguauguaaaugauuggcaaaguucuucuguaaggcuuuaagagagacuuuggggaccacauggaacagaaugauuugcccaugugaucaaugucacugaugugacaguuguccauguucuccuaaaagaacaacuuagcuguaagccucugccacgugcuauagucccacuccaaacacccgaacacaugcaacccgcuacccucuuuacaucaucacuuuaaccaguuaaucucacacccaguugcuucccagguuaguuaggaagcuguuuuuaccaaaucauaugcagaauaaugaugaauacgaccucagugaaacacuaagugcaauguauacuggaaaacaaaaucaaaauuaagacuacuuauuaugcuuuuagggacagcuuacgcaccuugacguguggugguuguuuuugagacuuuaucuuccuaucugggaccaggaaaguaucuugacagaaccuccugaccuaggguuguugcccagugguagugagcuuuuccccuggaggauccucaugccccaucuccaccuagggaucgucaaagggaauggaucacuaacacuguaaaacaacaagccuauucuucugaggaagaucugaaaagagauaaaagaaaaaguauugaaaugcaguacacugggaaagucuguucuaaugggcaacuagugguugaguucaaccauauuuuuacccuuuucuucauguggauugaagaguggacauuuacaguugugcggagcuguuauauucuggcuaccaacuuagcaaaaaaaaaaaaaauuauccuauucauuccagcucuauucuguaugcuuucccucauuuccaagagaaauuuagaacugaguaauugccaauauucccaugcugcauuuuauucuccagucuuuauuacugagcgauccucuacaauguggguuguuaauacccuuguguucucagcacaaaauauaguaggggggucaagaaaucaagagguugaaacuaauggaaggagaaacuaaugcuuucucaaccaagagagccaugaagccacacagaaaaggucggauguggucuaacccuaugaguuauguaagaauucuccuccacaaugccucuggcuuccuuuauaaagagcuauuuuaagaacugagaaauccaccucuaucaaagugccugucagcuaguucuguagcaucccccucuuuuaauuuguacuuuaaguagugccaugccauaauauugccaagauaaagagaauuguuuccuacucaauccacaugguaacauuucuucaacaaccuguauaauagggcgccaccaaaguucuaggauauucggagaaaccaagaauggucacaagcacauagaacuccaguuauaacaacagcuggccaggcgugguggcucacgccuguaaucccagcaguuugggaggucgaggcgggugaaucaccugaggucaggaguuugagaccagccugaccaacauggagaaaccccgucucuacuaaaaauacaaaauuagccuggcguggucgcgcaugccuguaaucucagcuacucgagaggcugaggcaggagaauaacuugaacccaggagacagagguugcagugagcugagauugcgccauugcacuccagccugggcaacaagagcgaaacugcgaaaaaaaaaaaauacacgccacaaaaacaguuaagcaaaucuaugcagaaggaaaaacaagguacagaaaaccagggauucaguaaauuccuuauacaggcccccggggcucuccuauuccacuuuuuaacaauuucaauuguuuuucaagcuaagaaauuuugauuucuuaaaacaaggaaauggcagugauaauggaauuaggccuaccaaaacugagcuaauacagaugaaguuagucuuauuuguaaacaaauccugagaacuuaauacccaucugccaaaggaaagugggaauaauuuaaaaggccacuaaucaaaagguguuaaguucauuaaaucuaucuugcuguguggugagaaaagaaauaauuuagugcuuugcaucucucauucuucauuggggaucaaguaugcuugcccuuacagaccucacuggagcccagcucugagggauaaaugaaacaggccgaacucauuauguaaaguuaaaauguauguguacaugcaaaagaaaaaguauaggaauugaugaaaacuggcucacguucugcuuuucuuucuuuuuaagagacugggucccgcucugccaccuaggcuggagugcaguggcuaaugauggcucacugcagccuugaacuccugggcucaagcaauccugcugccucagccuccagaguagguaggacuacaggcacguaccaccaugcccaacuaauuuuauuuuauuguagagacaugggucuucaacuccuggccucaagugauccccccaccucaaccucccaaagcccuggaauuacaagcaggagccaccaugcccagcuguguucugcuuuaaaaaggagaguugugggaaguucaauccaaagacagaagcacuacaacaauaaauuccccaaacuaccuuuuucuccagauagcuggcaacccauccaaguagauuagcuggagcuuggccagauucucaaagggaaagauaugauuaauuuggagccucuuauagcuguuugcaguccucaggucucacaugcucagaauguccuuaagaagaaagacaggguucaguaggcuaccaaagcaccgguaggauaccaaaagaguuacaaaaaccccaaugaaaaaaaccuaggaaguauaaacugaagcauuagacauagguaucuccugucucuacuuucuagccugcuuggucucccuaaaguccucuaaugacaagcccuggcaguacacgggaagauuagacaagugaagaaaaagaacuacaugaaaauaugggucaaaccaauaccgaccuuaagggcugacacuaaauuuguggcuaauggucauccuguugcugaaaauacuucaagauucaaggugguguggcaacugcuacuacugcuuagaggugcaauugucuugacuguuuuuaauaauuggcuaucuaccuuuacuauagcauaggagcucacuaaaggggaucuaagccaaauuugcagucuugaaagcacuuugcaugguacuguauaguauggugugaaaagcacccaguauguuaaaccugaguaccuuaaaugaauacaggcuuccagaucccugaucagggauuacuguaucaugaggaaaccuuuaugucaaugucaaacaggaauauauggaacaucacuuauucaacacuauucucuagcuuuaaaaaggccaaacuguucuaugauguucucaauauaagcagaacaagcuucaaaaucucuugccaacauccuuccccauccuaauuuaaucuaagauuagauacuugacuuccaaaugcaggcuuccaguuaaacauggcgguucauacauguuuaugcauuuacucuacugcuuccuaaaacuccauuaaugagaguaaaugugcacuccauaugcaagcaaauacaccuaaagaaauuuuaaauaaacggauccuagcucaaauucauuuauacacuggcaucuaaaagggaacaacuauuccagucuccccaagucuucuuaagcauauuuauggaguaucuugcuuuagcaucaaagcccucuaguuuugccuguuacuauggugaugacauacucaaagagcauucccuuucccuuaacgggaaucuaaggcuagagaaaaugguuacauuuuggaacugggaaucuaaggcuagagaaagugguuacauuuuggaacugauacagaaccauacauuucacuaggguucaauauucacugacaagaauuuugagaauccgucaucuugcagaccaacaaaauaucaaagucuuauggagagaauaacugaguggcacagccagccaucugguucaaauacuccagcaucagacagaauugucacagcuagacgugauauuaauaaucacauaggccaggcgcaguggcucaugccuguaauccuagcacuuugggaggccaaggcgaguggaucaccugaggucagaaguucgagaccagccuggccaacacggcaaaacuccaucuguacuaaaaauacaaacauuagcugggggcgggggguggggggcgggugccuguaaucccagcuacuugggaggcugaggcaggagaauugcuugaucaugggggaaggagguugcagugagucgagaucgugcuacuucacuccagccugggcgaaagagcaaaacuccgucucaaaaaaaaaaaaaaaucacauaauucaacauuuucauucucuaaggaaacugggaacccagaagaugaaacuaccucaauguuacacaaauagaagguaaccaagugauacuuaaacccaugucuucccacaauucaaaggucuuuuaacuguggggucugugcauagauucucaggacauauggggagcuuucuacaaaacuuucacaauacucucauuucacuguaaggauaguuuagaucagcuauaugacuacuucauaauauaggaccacguugccagauuaguggcaaauguucuaguuuuguugccuggggauuacagaaaagaagagaagcaaacaauauauaaauguguuuugugccaaaugaaagugaaauagcauugcuaugugcuauaauggcaggauuuaaagcaguuugaaaacagcaguuuggugaagugcaucaacacagcaugugauauuacagacacgccacucaaaagaaacuauaauacuauaauaguagugccauauuugcauuuuaguuaucuauuaacuacuaauuuguacaucugcuauguuuuauaguuguauuauagauguaggcaaacagauuucauuccagguuuguucauacacuuuaacuuaacaauuauucccauaaaccuaaauaguacauaauaauauuuuucuuuuacagaaaacguuuaaucaaauauagcaaaauauuaauuguagaaucuaagcagugauuauguaggugcacacugaauaauucuuuucuugagagaaaaccucccuacuaucaaacuuauuauacagacuugagaaacacugucucaaacuaauaucuaauauaaaauauuaaaauuauacucaacauaauuucauguuauuuuaaauugcugauuaauaugcaaugcacaugacaaugcuguuaaucagggcacuuuuuguaacagcacaccaacuuucuugacuaaaauugaaagguuaaaaauuauauuuggguuacaauugccaaggaagacaucuacuccuugggucuuaaauaggcacuuuggaaggcuagcuggaggucaguaaaugaaccuuuccuaucccacgugugaacaugccuuucccuuccuuucccaccuccaguguucucaggguccuuuagcucuuagaaaaaaacggaaagaagaaaugcauacccaaggaacagcuuaccuggcgauaucagaauaauuuaaucugaaaaucaaugucaaaauguggauugaaguaaauucugguucuuaagauaaaguuuguuucugcaaccuauuuuacguuucaaaacuggcagaaacauuuagggcagaagggucauuucuaguuucaagaauacccuacagcuaaacucucccuaaacuuaaccauagaagcaaaugucaaacacucacuaccguaauauuaacagaaaaauuucccaaccaagccagguuucucacuguagaaaugggagguaacagauaagcaaggaggugagacuauaaugauccauguggcaaugauuagaguuggagacguagguauaaacacauuuaguuuaauauagauacagaugguuauauauauuuauagcuaugugcauauacacacguuagaaugcaaauauauaucuccuugcucuugucaacugaaaaggucuugaaggaaugacacuccaguaguaaugagcgcaccuagcauucacuucuugauuucuaauauuacucuccaauaaaaaguaucaaggcuccuugcagaaauacaucauuuuagguccaggcaggagauaugcaaaugagucugaagcauguuguaguuccaaaaauaagaaagugcucaaacaaaaaacccacauucaugggguuauaucaaagccaaaugaaagaccucccaauggccaaagcuggaacaauuugaacaacagaauaaaguaauacuguauuauaacccagaguauaaaauaucccugagaucauacugauauaaaugacugaauaaacacaauacauuguggagaaaagacauccugugcaaaagaauuccaaauaauuuauguaaauacucugcccucaaugagguggaagguaauuucccauuccuuaagugcuggcugcacauagugacuuccuaugugaacaguauaguagggaaauggagaaauaaagacuaauuuuacgcuggagaaaccugacaaauaguaccucagacaggugauuaaggauaacauaaacagugauaagucauguugauaguauguacucuugauaagugauaagaauggcacucuaccuuuguggucuuccuccuaaacacucauaaacccaaucuagucaugagaagaacaucagacaaauuccaauagagagacauucuauagaauacuggaccauuaguccucaaaacugugaaguucaucaaaaacaaagagucugagaaacugucauuaccaagaggagccuaaggagacaugacuacuaaggacacaugcagcgugguaucuucaaugggauccuggaacacaaaaagaacauuaaggaaaaacuaaggaaaucugaauaaaauauggacucuaguuaauaauaauguaucaauauugguuuguugugacaaauguaccaaacuaauguaaaauguuaacacugggaaaaacugggugugaaguacacagaaacucuaucuucagaaucauucuguaaaucucuacacuguucuaacauuaaaagguuauuuuuucuaaaaaucucccaaccaguugcugaagacuuauaagacacaguuuuuaaaaagcaagcaaaauggaaccuaagaacugguaagucuauguuccagauuuuucuacaguacguaccaucauuguuugcagaucugaucuaaagacuuacucucuuucuuuucuguuuauauggauuuauaauagguaauuuugauguuaaaauauacaaggcccaaauaaccagguauccguaauaucaaaaaguuauuuuuuaaaaaaacauuagcaauuaaacuuuguuuuuguacaucaacagauuuccuggaaagaccuagucaaucugcuguaaaaaauaagucguaaguuaguagcuaauuuucagucaagggagaucuauaaggcuggaaaacuuuaauaacauauagauuguagagugauuauaucccaucacuguucaaugccaaucacacuaacagcauacuauaaaauauacuaugccacuaguuuucaaagcuauggguaaaguaacauagauaauuuuauaaugggaccugguaaaguacagugauguuccagucauaucccuauuuuuaaauucuuauacgcacuugauuauguaauaagaggguauugcuugggucuacugcauaaccucucauguuuccgggaacacuagaagacuagcauucuaauugguuaaggaaaauaauacuuuaagucuacccauaauuuaagaagucuagcaccggucaaauuuacauuuuguuucaguuucucauccuaacaugaaaaaaaauaaucaaaaguuauuucuaauauaaacaucaaaacaguaaaggagaggcuucuuuaccaaacucauuuguauaagaugcagaagaagcccaagcuccauguaucaguacucaauuuggaaaggucaaggaagagcuaucaaguaaagccuaagucaccaacaaaaacaugaccaacucgacagccuaauacacauauauauagugauauauaacuguacauggccacugaaguuuaacuuguuaaauucagcaggccagcuaugucuuaaauacaugagcuccaacuugaguuggauuuuugaaggaaaccuguguaaaaugcuacuugccuacagcccaaaauaugguagugagaauaucaauuuucucccaauccagucuuuaagacaaggcagaggaaggcauuagcucuguuuaacugacacaucauuacucuuugccauccaaacugauaagguuugggggaagagaagaggcauuagcucaguucagauauaaucauuaguuucuuucucuuuaagcugguaacguauuuuuccaggaugcuuucacauauaagaauauuuuagcagucaacaaaggucaacucuuaauucauuacuuuaagacaugaacucccuucaagcuguacauuugauaaucagggcacaaacacccugaaaagaaauuaugaaugccuaaucacagcagcccugggucucacagucuucuguaauuuagggagguggcuagagaaauggaaguuacagaaagauaaagcugaaagaggauaugagaaaauggucagaaaacuuccuccaauccuacauguuaagguuuuauaaagggaaaagucagaaaagaaaugacaauaaucauuuaaagaaaugccaaaaaaguuuccuucauuagacuuuugaaaauuuuccaaaucacaaaaugucauuuucagggauuuagguauuugauauaagccccuaucuuauuucacuagcagucucgagauggucagauugauggugaucugaaccaaacucagagccaggacuaaagucuaagcauuucugcccaaaaccauaaugauuuccuucugcauccuccauaagaaagcaaauuccuugauauaaauccugucuuugguuuugcuauuuauuccagcaccugguacaauaauauuuguugaacuaacacaagaauuaucucuauuuugaagaugcccacauuuccagagcaucccuuuuuacaauugcuagagauuuuucuuaaggguggaaauuauuucaagcaaugaauuuaaauacagcuucaagauucaccuuuggaugcuaucuaguauaaucaauccaccuaaaaucaagccauccuuccucuugacuuaagguacagaaucaccuccaaauucauucauuuaaaacaaauuccaauaauaauuauaauuguauguugacaaugaaugacaauuuaauuaccaauagaagauuucauaagcauagaccaggguuucucaaauuggggugauaacccuggggauuugugaauauauucuaauggauccccaaguucuacauaaguuauauaaaacacaucuuugacaaagacaacgugaaauuggaaaacauauuuacauuucaaauaucuuuguuaagucaguguuccucaaaacacauuuuuuuaggaucucagaaaauuuuguuccuuuagaagguguuucaucaugaagcauuacuuggguuugagaaacaauggcacagaccauguuuccaagaagguucaagaccaugauguauauaacccucagucagccagacaauguuguuaagcauauggaguggggcugggaggcauggaaacaagcccugaggaaauauggauaugaauuaaaacgggcuauaagugaagccaguucacuuauaugguucuuguugcuccugcugugaugcaugaaugugcaccagaaaaaaaguuucgaauguuauguuaaacaauauuuugucagcuggaaaacauuaaggaggcuaagcuucuuuuagcuuuacgaaaggugggaggaaagaagguauauaaacuacagcauaaaguaggcaaggaaggucaagguuuugacuucacuucuccacuacccucuuggcaaaaagguuccaaacuuaaaaaguaucuacgauaugcauuauccauggucaucuguucuugggcagaaauguaguaaaauuguggaaggagccgaaguauuagauuuaugcccucaaucucugaacuuuaaaauacucaagcuuaugagauuuagcaaucacuaauuugccaaccuucgcaaauagccaaacacaauggcuaugcucuaucccuuucaucucuuuccauggcuccaaaagagguaaaaaacaaaugaaauuaaaauaaaccaacuggacuauccagauggcugcaauauuaauccuaucuuggcuuaaagagaaaaagcaaacccacuuccuuaaguuuauucuaucaacuucaaauccuuguggguucccuuccuaaaacuacuacuuaugauucacacaaaacagcacuuauuauuuucuaaaguuauuucaaaugugcucacauuagcuccucaacgauaaaaucaucucaggaaugaaauuauauaggaugauaucauuccuacccagguuaucaguguaaccuagcauagagcuggguccacaauauuaauucuacaguucugcugguuaacucacauauguguauuuaugcauguauguauguaucuauuucucucucuauauauauauauugcagaugaggugggaagaaggaaagaaacuuacuggacccucugacuuuucuauagguggcaucuaagagaaagaaaauagaauaggaaaaagauuacuuaauagcuacgaaguaguacuuacaguauucuaaagagccagagacucuucuuuacagcuguccgaggagcuaguagggcaaacugcucccugagcugggccgaucuuuugacauccuucuccgagaaacaauauucuuuuucaguuauuacaaagaacugcuguugugaugacuaguuauuugcuugagcaguuccauauuacauaauccugugccacaaaacacccuguacacuaguggcugggauauuauucauuuccacuaggcagcuaucucacuguugaaauuuauauccaaaagaauauuuaauuuuggcuuauuuuucuuauaaaauagggaacucgucuuaucauuuuuaaguccucaccucagugugguacuucaaacuacuucaaauuauuacuauaauuaaaugcuucauuuuauauaauaauuaauaaaaaagguggcauaugcuuuuuaaaagcaccucugcauauguucccucauuuaaucguuuuacugcaaucuucuugaaauaaguaggggcaggugcuccagaugaagaaauuaaaggauuauaaaauuuagguaguuuuucuaaaagugaaugcugguaaagcccacacaaagauacuggucuuaagaguuccacucuagaauaucuuugauauuaaaauagcaagagucaguguucuauccacagacccaccacccucaguuaaaaugagagacacuggucaccagguacauaguauaaauggauauuuuggcuucaaaaaaauaaugaccagguuaucgaguccacccuacaauccagaugucuuucuuaaaaaaauuuuuuuaauaauaauaagcaauuuuucuggcuguauccuggcauuuggcacuuuacaauaacaauauacaaaggggacaacaagagauucuuaaccaggcaaucugcucuggaaagaagaaugcagagaaagugccaaccuuccuuccuggggagacaauuuuauaguguacacuggaaacacaaaauaaaggauggcaauccagcucccugggucugacuugccuucaguauuuugcacaguaaagcaguaacacaggugggcaagaaugguucuuguccccagaaucugacaauaauugaaacuaggaucauuaauaaaugaaagaaaaugagugaaggcuuauccaccuaguucaggccugcuuuucauagucaacacugcaccaacacaccaaagugguagggagaucuuggacugaugggcugaaaaaugggacaaucaguacuguguuuauuaauaacacagaaggggcuuuggguagucagcauacucagaagcaaugcgaaaggaaguagagggguucauguauaaugggugggaccaaggaaagugcaacugagaauuguuuaaguccaagagaaagggccuugucuggucaacauuacccagcaaagaggcaaaaggggcagggcagagggaagggaagagggagacagcacaaucuuaccuaauagcugcaaauauggacaccugagauugugagcaauagucuguaaaaaggggccaagggcacacaaggggcagagagagggaagacuucguauauaaagcaugacaccauggcuaccugugauuuuacacacuggcgcaaugcaaaaggguugggaguauggaccacuguuugauagacaagugcauggaauacuccaaugcuuauacuuuauuaugccaugggaaacuaagggugggguggggcgcuugcuuaacaaggucagggagggagaaaaccauugauaacugccauugugccuauuaacagucccaggagaaguuuugaguagucagcagccccugcaguaaugcaaaggggauacuagggcauaauaucccacucuaccagaaggagacauauauaauugcaaauauucacauuaacaguacaaggggccuuagugggucaguacccccgauguaagcaacgaggaagcaggagucuuaucuaaugaucagugcccuugauaauuguuauuaaugcuauuaauuguccaagagcugagauuaugaguaguuaacacuucucagcagcaauccaaaggguaaugggaggaacauagggucuuuuucuccuacacagguccacaaauacaauuaugacauuaauauuaaaagaaaaggguucauucauaauuaacaugccccugaugcaaggggaauauguggagaucaacucuuagucuaaaagaagagguggacaauugcauuaaugcauauuaaguccaaaagaaggggcacuuagugaauaucaucccccugcucuaaagcaaaggugguacaggaacaugcuuagagaauugaguuugugcacaugaacauuccaagugacagucuugaguagugggcacuaccugcuaaaaacacuaagaaaguagguaggauccuuaucuagugcacagaucaggagcaaauguaauugcacauauuaacaguccaaaacaacaggacuuugguugaucaggacacccuguuguacuacaaaggaaaggugaugggguaugaccuuaaucuacugacaaagacaaaagaaaauuucaauuauauguugauaguccaccagaaggggccuuggagggaaacaguauaccccacaguaaugcaaaagagguauaaugguccuagaagugauaggguuguggacaacugcaauuauucacauuaacuguucaaauguaaagaucauaaggagugggcacccacuauugaaaagagguggggcauccuugucuagggcacaagaaccaacauaaaugcaauuaugcaugucaacaagccaagaaaaggggacuuagggggucagcaacccugguauacugcaaauggagggugagaagguagaacuuuguuuaauuaggaugaaccauguggugauuacauacauuaauguccaagggacauuguuguggucaauuaaaaccauguacuuuggacaaauauaagaaucuuaaaaaguaguggguacuccuuguugaaaagcaaagggaguccaugagaaggugcccuuaucuaguacacaagaauauagacaagccaagcaaagaggccucagugaucagcaccccagcuauacugcaaagggggucugagaguaggacuuuauucaaauaggauaagccaugugcaguuaugcacauaaauuuccaagaugcaugguuguggucacuuacaauugugcaccuugauuguccaaauguaagggucuuauggagugagcacucccugcugggaggaaaagaaagauuaugcguagaugggauggggcagaggaggcuuccuugucuaguacacagaaaccuggacaaauauaaucacacacauaacaggccaggaaaaugggccuugguuaucagcaccccugcuguacugcaaaaggggucugagaguaaggccuuauucagaugagauaggccgugugcaguuacacacauuauugaccaaggugcauggcugcggucacuuagaauugugcaccuugacuguccaaauguaagguucuuauggagcuggcacucccugccagaagggaaaggaagauugagggugggguggggcaggggaggcuuccaugucuuauacacuggaacccagacaaauauaaucacauacguuaacaggccaggaagaggggccuugguuaucagcacaccuacuguacugcaaaaggggucugagaguaggaccuuauucagaugggaugggccaugugcaguuacacacauuuauguccaaggugcaugguuguggucacauacaauugugcaccuugacuguccaaauguaagggucuuauggagcggguacuuccugccagaagggaaaggaagauuggggguggaguguggcaggggaggcuuccaugucuauuacacaggaacuggaacaaauauaaucacacacauaacaggccaggaaaaggggccuuggugaucagcaccccugcuguacugcaaaaagggucugagaguaggaccuuauucagaugggaugggccaugugcaguuaugcacauucauguccaaggugagugccuaugcucacuuacaauugugcaccuugauuguccaaauguaaggguauauggaguggacacucccugguggaagggaaaggaagauuggaggugggguguggcaggggaggcuuucaugucuauuacacagaaacugggauaaauauaaucacacacauaacaggccaagaaaaagggccuuggugauucaguaccccugcuguacugcaaagggcaucugagaguaggaccuuauucagaugggaugggccaugugcaguuacgcacauuaauguccaauaauguccaaggugcauggcuguggucacuuauaauugugcaccuugauuguccaaauguaaugaucuuauggagggggcacucccugcuggaagggaaaggaagacugggagugggggugggggcggggggaaggcuuccuugucuaauacacaggaacccagacaaauauaaucacgcacauaacaggccaagaaaaggggccuuggugaucagcaccccugcuguacugcaaaaggggucugagaguaggaccuuauucagauggaaugggcaaagugguuaugcacauuaauguccaagguguaugccuguggucacuuacaacugugcaccuugauuguccaaacguaagcgucuuauggagagggcacucccugccggaagggaaaggaagauuggggguggaguguggcaggggaggcuuccaugucuaauacacaggaaccgggacaaacauaaucacacgcauaccaggccaggaaaaagggccuuggugaucagcaccccugcuguacugcaaaaggggucugagaguaggauuuuauucagauagguugagcuguguguaguuaugcaaauccaugucuaaggugcaugguuguguucacuuaacaauuacgcaccuugacuguccaaaugugagagucuuauggagugggcacucccugcuggaagggaaaggugagacugagguauguggagaggacccuccuuuucuagugcauaggaucccagacgauuauaaucacacacaacaugccaagaaaaggggacugcguuaucagcaacccuucuguauugcaaaaggggucggagaguaggaccuuauucacauggaaugagcagugugcgauuacgcacauaaauguccaagaugcaugcuuguggucacuuacaauugugcaccuagacucuccaaauaaaagggucuuauggggugggcacuuccugcuggaagggaaaaguggggaugaggggagcacuuuccuucucuagugcauagcaaccucgacaaauacaaucacacauauugggaggccaagaaauggggccuuaggugucaccaaccaugcuguccuucaaaaggaaggauacugauguaauugucauuaggcacauuaacaguuugagaaaggggccuuaagugaauaguaccccaugcaauaaagcaaagagggugugauaggucagaaacccaagucuaauugaaggaccauugacaacugcaauuacaugccaucuacaguucgaagagaagggcuuaauauugauuagcacucucugcuuugauaaguacaggaguccugauaaaaggcacaacuguaugcaacugaaaauguguauauaacaccuaagauuaugcacgcuaacuuuacuagucuaagggucuuaaguaguagguacuuccagcugggauguaaauacagugggugggguccuuacaugguaaaaaaguacagcagcaaauauaaguaugcacauuaacaguccaagagagugaauucaggcuaguuagaagcuccugcaguaaugcaaauggagcaaggaagcgggauucuacucuaacauaggggcacaucaacuacugcuaauuaugcgcauuuaagcaguauaagagaagaagcacuagcuaguuagcacuccugcugcuuugccaaggaggugugagggggaugggauuccagggcaauugucuuacuuuuuuuuuuuuuuaauguuggccaggcuggucucaaacuccuggcaguaagggaucuucccaccucagccucccaaagugcugggauuacaggugugagccaccacacccggccucagggcaauuuugcauaauagaaauucaagaaagacuuuaggaaaucaguacccccuucuaugaugcugagaagucaagauauuagcuugauauaaaagcuagauauuagcuugauauaaaagacucaguucuaaucaauuagacauuugaaaugucuuagacaauugaaaucaauuaggcaauugaaaauaugcacauuaagagucauggauaauuagaaauacacauuaagagucccaagagaaggacucuggguuuccagcaucccuuucuauaauguaaaagggguagaauauagguuuaaagggagagaccaugaacauuggaauuuugcacauucauagucccagggaaagguaacauagguaauuaauaucccuugcuguaaaacaaggaggauaaaauggaucugaucugaaagacauuguugugaucaguugccaugguucacauuaacuauccuagugcaaaggucuugacuagaggucauccacugcugaacacuagggaagugaguggggucuuuagugcacaggaagagggacaaaugcaaguagcacauuaacaguacaaaagaaauguccuugugauuagcacccucuacuguaaugcuaagagggugugagcaguugggaucuuaauuuaauggaaaagaccauaauugcaauuaugcgcauuaacagucccaaguacccccugcuguaagacaaaaggaauaugaggggaugagaccccagacuaacagcagauagggaaauugcauuuugcacaucaauaauuucuggaggaggggcauuagguaaccagcacccucuugauguaaagcaaagaugaugcagggaccuugauauaaaagacucaguucuaaucaauuaggauugugcacauaaacuguccuaguacagaggucuugaguaguaaggguccccugcuggaauacaaagggaguggaaggguuagugcacaagaucguggacaaauacaauuaugaacaucaaugcacaagaagaguccuugggugaucagcccacauuguagcgugcaaauaggauacagagucccuuucuaauggacaggacucuggacaauugcaacugugcaaauuaacuguucaagagcuguuauugaauaaucugcacucguuagcaacaucccacagaaggugggauggggugagaauccauuuuuauugcacagaaccaugaauauaugcaauuaugcauaucaacuguuuaagagaaggaaacuuggguagucagaacucagcagcaauggcaaagaggacauccuagacuaaugagugggacuaugggcaauuaguguuuuacauauuaaugcaaggugguagguaguucacacuaucuaggagcaaugauaaaggcauacacauaagugggucuucucuguuacgcagaaccaugaauaauuacuauuguauccauuaauauuccaagggaaggggcucuaagaaugagucagucccacugcuguuaugcaaagauguuugcaaaggccauaguguaacuaacagaacuauggauaauugggauuuuacucaauaauuuaagaaacucuuaaaucucagguagucagcgcugccucaaggcaaaugcaagggcgacugguagucuucaugauuaaugggugagacaauuagcaauuacuacuuuguucuuuaauuguccaagaacagcaggauucuccagaagcacagcaaaaagcgcaguagggugccuuuguuuaauaggcaaagcuaugacaauugggacugagcauuuuaacuguccaacaaaagacggguugucugcgacccccugcugaaugcaaaugggguucagagugcugucuaauccaauggguaggauuauuggcaauuagaauuuuacucaaugcaaagaguuuuagguggccaacacaguacacaagaaaagaucacuacucaaaauugggacugugacuacagaagcaaugacagagaaaugguuucuccuuuaagggcaggggaucgagaaaaugauaaguaacucaaauugugggcaauaaugcucugauagaaagcucucaauugacauucccuaacuucaacguaccgaguaaggaaauucuuuguccugagaucacagacaaaugggauuguaugcauuaacugaaaauggucaaggagucaguacugaagaucagcaaugccaaggguaaacggaauaucccaguauaauaggauaagcaauggacaacuuauuuugagcacugaaucaaugaaaauuagagugacuuucgagagaagcugggcgggacugaggaacuaggacugggacuggggcuagggcugggggguuaggggacuggggcuggggcagggcuggggcggggugggaguagggcuggggcuagacuagggguuugcugggagcagggcuggggaggaacuggaugcuaggcaggcaggauacaacgaaaaauugaaauacuccaauauaauaagucugaauagaggacaccagaccacagcaauucaaguuuccugucugauaaguaggugauuagucaauuagugcagcaucaaggaugggaacaaagcaaggccuggaccuguguaaaccuucaaacacucuuuuuuacauuaggucaugaaguuaaauuuuuuacuguuucugugcuacagacucuucaaaggaaaauaguuaagucaauuucaaagaaaaugaccagcacauuuuuaaaacauuagaaaugauuugacuuugacuaucuacugccaaaaaaagguuaaggaauuuguaaugagaagcuaaaaacuuuaaggaauuuuaaggaacucaaaacaaaaacucauuaaauguaauuaaagugaauucuacaaauaaagccucuuaauacauuucuauaauagucacuuaagacuuaaauucaaacacuagcaaaccacaaaaucagacuguaugacugacauccaaaagauaaauauaaaucaaaauccgaccccagcauuagccaagggguagguguuccucuugaggaaggcaggaauuccucuucugccaccuguuggccaacgaucaucugugauccauucugguccuugccacggcucaccaccauguccacaccaagcaggccuggagcacugcccauggcaacagugcagugcagggcagaccagagggggguagggggguagggggguagggggguggggagguggggggugggggguggggguggggaguuggggggguugggggguggggggggagguauacuuagccuuaggugaggcaccaauacagaggaauggagggagguucagaccacacagccagauauccagcacugcaagaggcagcacuggacaggaggggacaaauaagaggggacagagguggaaaggcuaaauguccuugaaaagaccuugaaaacaccugguguaccgcccacugggagacauacacguggccccuccacuucuuucuccugacuggcuaaagacagcugcgaagugccaugcuaauucacccaggucuucgcugaguagcuggacagugugucaucagucuaauuccaucuucugcucuaauuggcugugaucaauuccacccccauuucuaauugguuggguuaugcagcaauccagcacuguccaucccaccuuuucucccgcucugcguggcacuaggcggcaaaacccgccaucuuuaacaaugcggcaagcccgccaugauguccacgugacaaaagccaugauauacauaugacaacgccugccauauugucccugcggcaaaacccaacacgaaaagcacacagcaaagacaaagaggcccgccauguuuuacacugcggcaagaccuucagccgccaucuuuuccugugugaccgcacauguccaccaccaugcuaaccacuuaacaaagccucgcccaucaugauguggccuucccgccacuugaacacugcgacagaacuggauccgccauuuuggacaaccuaacaaagcacagcccgccaugcugagcaaugccgcaaugucaaaaucgccauuuuaagcccugcaccuuagucuuuccuaaccuuccauuuuuaacuagucccuuguacugauaaaagaugauucuuacugccucccgauacaacaaucacgcaaagcuccuaacaagccccaaaucaauucauucagauagguuuagcucaugcaaugcacaugacuuccucugccugaccugcuaucauccaucuugccucccuaguuuaacuuagcacaaacgacuagcccuaagccgaguuaugcggcaagucuaaaauggcggccacuuuuccuccacaaucugaacacgcccuuagcuuaacugcagagucauucucugccaaagcgguagguacacucacacaccaccaaaugaucagcagcaaaaaaaaguguagauauuccagagagugcaacaacccacaaaaccaacauuuuuucauccauaaaaagcaccgaugggcgaugaaaaaaaaaaaucaaagcagguauccgcggccccgaugggccagaaaaacaaaaauuaaagcagguauccgaggccccgaugggcaaggaaaaauaaaaaaaaaaaaagcagguauccgaagccccgaugggccaaaaaaagaaaauuuuuaaaaagcagauauccgucaccccgaugggccagaguguuggggguucagaggggaagggaaucagcagguauccgauaccccgaugggcuaaggaaaaaaaaauaaaaagcagguauccgcggccccgaugggcgaauaaaaaagaauuaaaaggcagguauccacggccccguugggcaaagaaaaaauaauaaaaccagguauccgcagccccgaugggcaaaauauagaaaagagaguggaagaguaaaaaacugauccacaaaaaacagagaugucaaccaaaaaugauuccaaagaaaaauuccuuaaauauuaaaaauugccucaaaauauuccaaauacuuucuuuaaaaaaauauggaggacgugucaagaagacacuaggagaaaguauagaauuuaaaaaaauauuuuauggaauuuaggugauuuuuuuaaagaaauacgccauaaaggguguugggggacuagaaaauguucuagaaagaaccccaagugcagagagaucuucagucaggaagcuuccagccccgagagaguaagaaauauggcugcagcagcgaauugcagcgcuuuaagaacug

SEQ ID NO: 19119 - RNA, 32093 nt, Homo sapiens
caguucuuaaagcgcugcaauucgcugcugcagccauauuucuuacucucucggggcuggaagcuuccugacugaagaucucucugcacuugggguucuuucuagaacauuuucuagucccccaacacccuuuauggcguauuucuuuaaaaaaaucaccuaaauuccauaaaauauuuuuuuaaauucuauacuuucuccuagugucuucuugacacguccuccauauuuuuuuaaagaaaguauuuggaauauuuugaggcaauuuuuaauauuuaaggaauuuuucuuuggaaucauuuuugguugacaucucuguuuuuuguggaucaguuuuuuacucuuccacucucuuuucuauauuuugcccaucggggcugcggauaccugguuuuauuauuuuuucuuugcccaacggggccguggauaccugccuuuuaauucuuuuuuauucgcccaucggggccgcggauaccugcuuuuuauuuuuuuuuccuuagcccaucgggguaucggauaccugcugauucccuuccccucugaacccccaacacucuggcccaucggggugacggauaucugcuuuuuaaaaauuuucuuuuuuuggcccaucggggcuucggauaccugcuuuuuuuuuuuuuauuuuuccuugcccaucggggccucggauaccugcuuuaauuuuuguuuuucuggcccaucggggccgcggauaccugcuuugauuuuuuuuuuucaucgcccaucggugcuuuuuauggaugaaaaaauguugguuuuguggguuguugcacucucuggaauaucuacacuuuuuuuugcugcugaucauuugguggugugugaguguaccuaccgcuuuggcagagaaugacucugcaguuaagcuaagggcguguucagauuguggaggaaaaguggccgccauuuuagacuugccgcauaacucggcuuagggcuagucguuugugcuaaguuaaacuagggaggcaagauggaugauagcaggucaggcagaggaagucaugugcauugcaugagcuaaaccuaucugaaugaauugauuuggggcuuguuaggagcuuugcgugauuguuguaucgggaggcaguaagaaucaucuuuuaucaguacaagggacuaguuaaaaauggaagguuaggaaagacuaaggugcagggcuuaaaauggcgauuuugacauugcggcauugcucagcauggcgggcugugcuuuguuagguuguccaaaauggcggauccaguucugucgcaguguucaaguggcgggaaggccacaucaugaugggcgaggcuuuguuaagugguuagcauggugguggacaugugcggucacacaggaaaagauggcggcugaaggucuugccgcaguguaaaacauggcgggccucuuugucuuugcugugugcuuuucguguuggguuuugccgcagggacaauauggcaggcguugucauauguauaucauggcuuuugucacguggacaucauggcgggcuugccgcauuguuaaagauggcggguuuugccgccuagugccacgcagagcgggagaaaaggugggauggacagugcuggauugcugcauaacccaaccaauuagaaauggggguggaauugaucacagccaauuagagcagaagauggaauuagacugaugacacacuguccagcuacucagcgaagaccugggugaauuagcauggcacuucgcagcugucuuuagccagucaggagaaagaaguggaggggccacguguaugucucccagugggcgguacaccagguguuuucaaggucuuuucaaggacauuuagccuuuccaccucuguccccucuuauuuguccccuccuguccagugcugccucuugcagugcuggauaucuggcuguguggucugaaccucccuccauuccucuguauuggugccucaccuaaggcuaaguauaccuccccccccaccccccaacccccccaacuccccacccccaccccccaccccccaccuccccaccccccuaccccccuaccccccuaccccccucuggucugcccugcacugcacuguugccaugggcagugcuccaggccugcuugguguggacaugguggugagccguggcaaggaccagaauggaucacagaugaucguuggccaacagguggcagaagaggaauuccugccuuccucaagaggaacaccuaccccuuggcuaaugcuggggucggauuuugauuuauauuuaucuuuuggaugucagucauacagucugauuuugugguuugcuaguguuugaauuuaagucuuaagugacuauuauagaaauguauuaagaggcuuuauuuguagaauucacuuuaauuacauuuaaugaguuuuuguuuugaguuccuuaaaauuccuuaaaguuuuuagcuucucauuacaaauuccuuaaccuuuuuuuggcaguagauagucaaagucaaaucauuucuaauguuuuaaaaaugugcuggucauuuucuuugaaauugacuuaacuauuuuccuuugaagagucuguagcacagaaacaguaaaaaauuuaacuucaugaccuaauguaaaaaagaguguuugaagguuuacacagguccaggccuugcuuuguucccauccuugaugcugcacuaauugacuaaucaccuacuuaucagacaggaaacuugaauugcuguggucugguguccucuauucagacuuauuauauuggaguauuucaauuuuucguuguauccugccugccuagcauccaguuccuccccagcccugcucccagcaaaccccuagucuagccccagcccuacucccaccccgccccagcccugccccagccccaguccccuaaccccccagcccuagccccagucccaguccuaguuccucagucccgcccagcuucucucgaaagucacucuaauuuucauugauucagugcucaaaauaaguuguccauugcuuauccuauuauacugggauauuccguuuacccuuggcauugcugaucuucaguacugacuccuugaccauuuucaguuaaugcauacaaucccauuugucugugaucucaggacaaagaauuuccuuacucgguacguugaaguuagggaaugucaauugagagcuuucuaucagagcauuauugcccacaauuugaguuacuuaucauuuucucgauccccugcccuuaaaggagaaaccauuucucugucauugcuucuguagucacagucccaauuuugaguagugaucuuuucuuguguacuguguuggccaccuaaaacucuuugcauugaguaaaauucuaauugccaauaauccuacccauuggauuagacagcacucugaaccccauuugcauucagcagggggucgcagacaacccgucuuuuguuggacaguuaaaaugcucagucccaauugucauagcuuugccuauuaaacaaaggcacccuacugcgcuuuuugcugugcuucuggagaauccugcuguucuuggacaauuaaagaacaaaguaguaauugcuaauugucucacccauuaaucaugaagacuaccagucgcccuugcauuugccuugaggcagcgcugacuaccugagauuuaagaguuucuuaaauuauugaguaaaaucccaauuauccauaguucuguuaguuacacuauggccuuugcaaacaucuuugcauaacagcagugggacugacucauucuuagagccccuucccuuggaauauuaauggauacaauaguaauuauucaugguucugcguaacagagaagacccacuuauguguaugccuuuaucauugcuccuagauagugugaacuaccuaccaccuugcauuaauauguaaaacacuaauugcccauagucccacucauuagucuaggauguccucuuugccauugcugcugaguucugacuacccaaguuuccuucucuuaaacaguugauaugcauaauugcauauauucaugguucugugcaauaaaaauggauucucaccccaucccaccuucugugggauguugcuaacgagugcagauuauucaauaacagcucuugaacaguuaauuugcacaguugcaauuguccagaguccuguccauuagaaagggacucuguauccuauuugcacgcuacaaugugggcugaucacccaaggacucuucuugugcauugauguucauaauuguauuuguccacgaucuugugcacuaacccuuccacucccuuuguauuccagcaggggacccuuacuacucaagaccucuguacuaggacaguuuaugugcacaauccuaauugauuagaacugagucuuuuauaucaaggucccugcaucaucuuugcuuuacaucaagagggugcugguuaccuaaugccccuccuccagaaauuauugaugugcaaaaugcaauuucccuaucugcuguuagucuggggucucauccccucauauuccuuuugucuuacagcaggggguacuugggacuguuaaugcgcauaauugcaauuauggucuuuuccauuaaauuaagaucccaacugcucacacccucuuagcauuacaguagagggugcuaaucacaaggacauuucuuuuguacuguuaaugugcuacuugcauuugucccucuuccugugcacuaaagaccccacucacuucccuaguguucagcaguggaugaccucuagucaagaccuuugcacuaggauaguuaaugugaaccauggcaacugaucacaacaaugucuuucagaucagauccauuuuauccuccuuguuuuacagcaagggauauuaauuaccuauguuaccuuucccugggacuaugaaugugcaaaauuccaauguucauggucucucccuuuaaaccuauauucuaccccuuuuacauuauagaaagggaugcuggaaacccagaguccuucucuugggacucuuaauguguauuucuaauuauccaugacucuuaaugugcauauuuucaauugccuaauugauuucaauugucuaagacauuucaaaugucuaauugauuagaacugagucuuuuauaucaagcuaauaucuagcuuuuauaucaagcuaauaucuugacuucucagcaucauagaaggggguacugauuuccuaaagucuuucuugaauuucuauuaugcaaaauugcccugaggccgggugugguggcucacaccuguaaucccagcacuuugggaggcugaggugggaagaucccuuacugccaggaguuugagaccagccuggccaacauuaaaaaaaaaaaaaaguaagacaauugcccuggaaucccaucccccucacaccuccuuggcaaagcagcaggagugcuaacuagcuagugcuucuucucuuauacugcuuaaaugcgcauaauuagcaguaguugaugugccccuauguuagaguagaaucccgcuuccuugcuccauuugcauuacugcaggagcuucuaacuagccugaauucacucucuuggacuguuaaugugcauacuuauauuugcugcuguacuuuuuuaccauguaaggaccccacccacuguauuuacaucccagcuggaaguaccuacuacuuaagacccuuagacuaguaaaguuagcgugcauaaucuuagguguuauauacacauuuucaguugcauacaguugugccuuuuaucaggacuccuguacuuaucaaagcagagagugcuaaucaauauuaagcccuucucuucgaacuguagauggcauguaauugcaguugucaaugguccuucaauuagacuuggguuucugaccuaucacacccucuuugcuuuauugcaugggguacuauucacuuaaggccccuuucucaaacuguuaaugugccuaaugacaauuacaucaguauccuuccuuuugaaggacagcaugguuggugacaccuaaggccccauuucuuggccucccaauaugugugauuguauuugucgagguugcuaugcacuagagaaggaaagugcuccccucauccccacuuuucccuuccagcaggaagugcccaccccauaagacccuuuuauuuggagagucuaggugcacaauuguaagugaccacaagcaugcaucuuggacauuuaugugcguaaucgcacacugcucauuccaugugaauaagguccuacucuccgaccccuuuugcaauacagaaggguugcugauaacgcaguccccuuuucuuggcauguugugugugauuauaaucgucugggauccuaugcacuagaaaaggaggguccucuccacauaccucagucucaccuuucccuuccagcagggagugcccacuccauaagacucucacauuuggacagucaaggugcguaauuguuaagugaacacaaccaugcaccuuagacauggauuugcauaacuacacacagcucaaccuaucugaauaaaauccuacucucagaccccuuuugcaguacagcaggggugcugaucaccaaggcccuuuuuccuggccugguaugcgugugauuauguuugucccgguuccuguguauuagacauggaagccuccccugccacacuccacccccaaucuuccuuucccuuccggcagggagugcccucuccauaagacgcuuacguuuggacaaucaaggugcacaguuguaagugaccacaggcauacaccuuggacauuaaugugcauaaccacuuugcccauuccaucugaauaagguccuacucucagaccccuuuugcaguacagcaggggugcugaucaccaaggccccuuuucuuggccuguuaugugcgugauuauauuugucuggguuccuguguauuagacaaggaagccuuccccccgcccccacccccacucccagucuuccuuucccuuccagcagggagugcccccuccauaagaucauuacauuuggacaaucaaggugcacaauuauaagugaccacagccaugcaccuuggacauuauuggacauuaaugugcguaacugcacauggcccaucccaucugaauaagguccuacucucagaugcccuuugcaguacagcagggguacugaaucaccaaggcccuuuuucuuggccuguuaugugugugauuauauuuaucccaguuucuguguaauagacaugaaagccuccccugccacaccccaccuccaaucuuccuuucccuuccaccagggaguguccacuccauauacccuuacauuuggacaaucaaggugcacaauuguaagugagcauaggcacucaccuuggacaugaaugugcauaacugcacauggcccaucccaucugaauaagguccuacucucagacccuuuuugcaguacagcaggggugcugaucaccaaggccccuuuuccuggccuguuaugugugugauuauauuuguuccaguuccuguguaauagacauggaagccuccccugccacacuccacccccaaucuuccuuucccuucuggcaggaaguacccgcuccauaagacccuuacauuuggacagucaaggugcacaauuguaugugaccacaaccaugcaccuuggacauaaauguguguaacugcacauggcccaucccaucugaauaagguccuacucucagaccccuuuugcaguacaguaggugugcugauaaccaaggccccucuuccuggccuguuaacguaugugauuauauuugucuggguuccaguguauaagacauggaagccuccccugccccaccccacccucaaucuuccuuucccuucuggcagggagugccagcuccauaagaaccuuacauuuggacagucaaggugcacaauucuaagugaccgcagccaugcaccuuggucaauaauguguguaacugcacacggccuaucucaucugaauaaggccuuacucucagaccccuuuugcaguacagcaggggugcugauaaccaaggcccauuuuccuggccuguuaugugugugauuauauuuguccagguuucuguguacuagacaaggaagccuccucugccccaucccaucuacgcauaaucuuucuuuuccucccagcagggagugcucacuccauaagacccuuacauuuggacaaucaaggugcacaauuguaagugaccacaaccaugcaucuuggaaauuuaugugcauaacugcacauggcuuauccuauuugaauaaaguccuacucucagacccccuuugcaguauagcuggggugcugaucacugaggccucuuugcuuggcuugucuauauucuuguguacuagauaagggcaccuucucauggacucccuuugcuuuucaacaaggaguacccacuacuuuuuaagauucuuauauuuguccaaaguacaugguuuuaauugaccacaacaaugucccuuggacauuaauguauguaaucaccacaugguucauccuaauuaaacaaaguucuaccuucucacccuccauuugcaguauaccaggguugcugacccccuaaguccccuuuucuuggcuuguugacaugcauaauugcauuuauguugguucuugugcccuagacaaggaugccccaccucuuuucaauagugggugcccacuccuuaugaucuuuacauuugaacaguuaaugugaauaauugcaguuguccacaacccuaucacuucuaggaccauuauaccucuuuugcauuacugugggguauacuguuucccuccaaggccccuucugguggacuaucaacauauaauugaaauuuucuuuugucuuugucaguagauuaaggucauaccccaucaccuuuccuuuguaguacaacaggguguccugaucaaccaaaguccuguuguuuuggacuguuaauaugugcaauuacauuugcuccugaucugugcacuagauaaggauccuaccuacuuucuuaguguuuuuagcagguagugcccacuacucaagacugucacuuggaauguucaugugcacaaacucaauucucuaagcauguuccuguaccaccuuugcuuuagagcagggggaugauauucacuaagugccccuucuuuuggacuuaauaugcauuaaugcaauuguccaccucuucuuuuagacuaagaguugaucuccacauauuccccuugcaucaggggcauguuaauuaugaaugaacccuuuucuuuuaauauuaaugucauaauuguauuuguggaccuguguaggagaaaaagacccuauguuccucccauuacccuuuggauugcugcugagaaguguuaacuacucauaaucucagcucuuggacaauuaauagcauuaauaacaauuaucaagggcacugaucauuagauaagacuccugcuuccucguugcuuacaucggggguacugacccacuaaggccccuuguacuguuaaugugaauauuugcaauuauauaugucuccuucugguagagugggauauuaugcccuaguauccccuuugcauuacugcaggggcugcugacuacucaaaacuucuccugggacuguuaauaggcacaauggcaguuaucaaugguuuucucccucccugaccuuguuaagcaagcgccccaccccacccuuaguuucccauggcauaauaaaguauaagcauuggaguauuccaugcacuugucuaucaaacagugguccauacucccaacccuuuugcauugcgccaguguguaaaaucacagguagccauggugucaugcuuuauauacgaagucuucccucucucugccccuugugugcccuuggccccuuuuuacagacuauugcucacaaucucagguguccauauuugcagcuauuagguaagauugugcugucucccucuucccuucccucugcccugccccuuuugccucuuugcuggguaauguugaccagacaaggcccuuucucuuggacuuaaacaauucucaguugcacuuuccuuggucccacccauuauacaugaaccccucuacuuccuuucgcauugcuucugaguaugcugacuacccaaagccccuucuguguuauuaauaaacacaguacugauugucccauuuuucagcccaucaguccaagaucucccuaccacuuugguguguuggugcaguguugacuaugaaaagcaggccugaacuagguggauaagccuucacucauuuucuuucauuuauuaaugauccuaguuucaauuauugucagauucuggggacaagaaccauucuugcccaccuguguuacugcuuuacugugcaaaauacugaaggcaagucagacccagggagcuggauugccauccuuuauuuuguguuuccaguguacacuauaaaauugucuccccaggaaggaagguuggcacuuucucugcauucuucuuuccagagcagauugccugguuaagaaucucuuguuguccccuuuguauauuguuauuguaaagugccaaaugccaggauacagccagaaaaauugcuuauuauuauuaaaaaaauuuuuuuaagaaagacaucuggauuguaggguggacucgauaaccuggucauuauuuuuuugaagccaaaauauccauuuauacuauguaccuggugaccagugucucucauuuuaacugaggguggugggucuguggauagaacacugacucuugcuauuuuaauaucaaagauauucuagaguggaacucuuaagaccaguaucuuugugugggcuuuaccagcauucacuuuuagaaaaacuaccuaaauuuuauaauccuuuaauuucuucaucuggagcaccugccccuacuuauuucaagaagauugcaguaaaacgauuaaaugagggaacauaugcagaggugcuuuuaaaaagcauaugccaccuuuuuuauuaauuauuauauaaaaugaagcauuuaauuauaguaauaauuugaaguaguuugaaguaccacacugaggugaggacuuaaaaaugauaagacgaguucccuauuuuauaagaaaaauaagccaaaauuaaauauucuuuuggauauaaauuucaacagugagauagcugccuaguggaaaugaauaauaucccagccacuaguguacaggguguuuuguggcacaggauuauguaauauggaacugcucaagcaaauaacuagucaucacaacagcaguucuuuguaauaacugaaaaagaauauuguuucucggagaaggaugucaaaagaucggcccagcucagggagcaguuugcccuacuagcuccucggacagcuguaaagaagagucucuggcucuuuagaauacuguaaguacuacuucguagcuauuaaguaaucuuuuuccuauucuauuuucuuucucuuagaugccaccuauagaaaagucagaggguccaguaaguuucuuuccuucuucccaccucaucugcaauauauauauauagagagagaaauagauacauacauacaugcauaaauacacauaugugaguuaaccagcagaacuguagaauuaauauuguggacccagcucuaugcuagguuacacugauaaccuggguaggaaugauaucauccuauauaauuucauuccugagaugauuuuaucguugaggagcuaaugugagcacauuugaaauaacuuuagaaaauaauaagugcuguuuugugugaaucauaaguaguaguuuuaggaagggaacccacaaggauuugaaguugauagaauaaacuuaaggaaguggguuugcuuuuucucuuuaagccaagauaggauuaauauugcagccaucuggauaguccaguugguuuauuuuaauuucauuuguuuuuuaccucuuuuggagccauggaaagagaugaaagggauagagcauagccauuguguuuggcuauuugcgaagguuggcaaauuagugauugcuaaaucucauaagcuugaguauuuuaaaguucagagauugagggcauaaaucuaauacuucggcuccuuccacaauuuuacuacauuucugcccaagaacagaugaccauggauaaugcauaucguagauacuuuuuaaguuuggaaccuuuuugccaagaggguaguggagaagugaagucaaaaccuugaccuuccuugccuacuuuaugcuguaguuuauauaccuucuuuccucccaccuuucguaaagcuaaaagaagcuuagccuccuuaauguuuuccagcugacaaaauauuguuuaacauaacauucgaaacuuuuuuucuggugcacauucaugcaucacagcaggagcaacaagaaccauauaagugaacuggcuucacuuauagcccguuuuaauucauauccauauuuccucagggcuuguuuccaugccucccagccccacuccauaugcuuaacaacauugucuggcugacugaggguuauauacaucauggucuugaaccuucuuggaaacauggucugugccauuguuucucaaacccaaguaaugcuucaugaugaaacaccuucuaaaggaacaaaauuuucugagauccuaaaaaaauguguuuugaggaacacugacuuaacaaagauauuugaaauguaaauauguuuuccaauuucacguugucuuugucaaagauguguuuuauauaacuuauguagaacuuggggauccauuagaauauauucacaaauccccaggguuaucaccccaauuugagaaacccuggucuaugcuuaugaaaucuucuauugguaauuaaauugucauucauugucaacauacaauuauaauuauuauuggaauuuguuuuaaaugaaugaauuuggaggugauucuguaccuuaagucaagaggaaggauggcuugauuuuagguggauugauuauacuagauagcauccaaaggugaaucuugaagcuguauuuaaauucauugcuugaaauaauuuccacccuuaagaaaaaucucuagcaauuguaaaaagggaugcucuggaaaugugggcaucuucaaaauagagauaauucuuguguuaguucaacaaauauuauuguaccaggugcuggaauaaauagcaaaaccaaagacaggauuuauaucaaggaauuugcuuucuuauggaggaugcagaaggaaaucauuaugguuuugggcagaaaugcuuagacuuuaguccuggcucugaguuugguucagaucaccaucaaucugaccaucucgagacugcuagugaaauaagauaggggcuuauaucaaauaccuaaaucccugaaaaugacauuuugugauuuggaaaauuuucaaaagucuaaugaaggaaacuuuuuuggcauuucuuuaaaugauuauugucauuucuuuucugacuuuucccuuuauaaaaccuuaacauguaggauuggaggaaguuuucugaccauuuucucauauccucuuucagcuuuaucuuucuguaacuuccauuucucuagccaccucccuaaauuacagaagacugugagacccagggcugcugugauuaggcauucauaauuucuuuucaggguguuugugcccugauuaucaaauguacagcuugaagggaguucaugucuuaaaguaaugaauuaagaguugaccuuuguugacugcuaaaauauucuuauaugugaaagcauccuggaaaaauacguuaccagcuuaaagagaaagaaacuaaugauuauaucugaacugagcuaaugccucuucucuucccccaaaccuuaucaguuuggauggcaaagaguaaugaugugucaguuaaacagagcuaaugccuuccucugccuugucuuaaagacuggauugggagaaaauugauauucucacuaccauauuuugggcuguaggcaaguagcauuuuacacagguuuccuucaaaaauccaacucaaguuggagcucauguauuuaagacauagcuggccugcugaauuuaacaaguuaaacuucaguggccauguacaguuauauaucacuauauauauguguauuaggcugucgaguuggucauguuuuuguuggugacuuaggcuuuacuugauagcucuuccuugaccuuuccaaauugaguacugauacauggagcuugggcuucuucugcaucuuauacaaaugaguuugguaaagaagccucuccuuuacuguuuugauguuuauauuagaaauaacuuuugauuauuuuuuuucauguuaggaugagaaacugaaacaaaauguaaauuugaccggugcuagacuucuuaaauuauggguagacuuaaaguauuauuuuccuuaaccaauuagaaugcuagucuucuaguguucccggaaacaugagagguuaugcaguagacccaagcaauacccucuuauuacauaaucaagugcguauaagaauuuaaaaauagggauaugacuggaacaucacuguacuuuaccaggucccauuauaaaauuaucuauguuacuuuacccauagcuuugaaaacuaguggcauaguauauuuuauaguaugcuguuagugugauuggcauugaacagugaugggauauaaucacucuacaaucuauauguuauuaaaguuuuccagccuuauagaucucccuugacugaaaauuagcuacuaacuuacgacuuauuuuuuacagcagauugacuaggucuuuccaggaaaucuguugauguacaaaaacaaaguuuaauugcuaauguuuuuuuaaaaaauaacuuuuugauauuacggauaccugguuauuugggccuuguauauuuuaacaucaaaauuaccuauuauaaauccauauaaacagaaaagaaagagaguaagucuuuagaucagaucugcaaacaaugaugguacguacuguagaaaaaucuggaacauagacuuaccaguucuuagguuccauuuugcuugcuuuuuaaaaacugugucuuauaagucuucagcaacugguugggagauuuuuagaaaaaauaaccuuuuaauguuagaacaguguagagauuuacagaaugauucugaagauagaguuucuguguacuucacacccaguuuuucccaguguuaacauuuuacauuaguuugguacauuugucacaacaaaccaauauugauacauuauuauuaacuagaguccauauuuuauucagauuuccuuaguuuuuccuuaauguucuuuuuguguuccaggaucccauugaagauaccacgcugcauguguccuuaguagucaugucuccuuaggcuccucuugguaaugacaguuucucagacucuuuguuuuugaugaacuucacaguuuugaggacuaaugguccaguauucuauagaaugucucucuauuggaauuugucugauguucuucucaugacuagauuggguuuaugaguguuuaggaggaagaccacaaagguagagugccauucuuaucacuuaucaagaguacauacuaucaacaugacuuaucacuguuuauguuauccuuaaucaccugucugagguacuauuugucagguuucuccagcguaaaauuagucuuuauuucuccauuucccuacuauacuguucacauaggaagucacuaugugcagccagcacuuaaggaaugggaaauuaccuuccaccucauugagggcagaguauuuacauaaauuauuuggaauucuuuugcacaggaugucuuuucuccacaauguauuguguuuauucagucauuuauaucaguaugaucucagggauauuuuauacucuggguuauaauacaguauuacuuuauucuguuguucaaauuguuccagcuuuggccauugggaggucuuucauuuggcuuugauauaaccccaugaauguggguuuuuuguuugagcacuuucuuauuuuuggaacuacaacaugcuucagacucauuugcauaucuccugccuggaccuaaaaugauguauuucugcaaggagccuugauacuuuuuauuggagaguaauauuagaaaucaagaagugaaugcuaggugcgcucauuacuacuggagugucauuccuucaagaccuuuucaguugacaagagcaaggagauauauauuugcauucuaacguguguauaugcacauagcuauaaauauauauaaccaucuguaucuauauuaaacuaaauguguuuauaccuacgucuccaacucuaaucauugccacauggaucauuauagucucaccuccuugcuuaucuguuaccucccauuucuacagugagaaaccuggcuugguugggaaauuuuucuguuaauauuacgguagugaguguuugacauuugcuucuaugguuaaguuuagggagaguuuagcuguaggguauucuugaaacuagaaaugacccuucugcccuaaauguuucugccaguuuugaaacguaaaauagguugcagaaacaaacuuuaucuuaagaaccagaauuuacuucaauccacauuuugacauugauuuucagauuaaauuauucugauaucgccagguaagcuguuccuuggguaugcauuucuucuuuccguuuuuuucuaagagcuaaaggacccugagaacacuggaggugggaaaggaagggaaaggcauguucacacgugggauaggaaagguucauuuacugaccuccagcuagccuuccaaagugccuauuuaagacccaaggaguagaugucuuccuuggcaauuguaacccaaauauaauuuuuaaccuuucaauuuuagucaagaaaguuggugugcuguuacaaaaagugcccugauuaacagcauugucaugugcauugcauauuaaucagcaauuuaaaauaacaugaaauuauguugaguauaauuuuaauauuuuauauuagauauuaguuugagacaguguuucucaagucuguauaauaaguuugauaguagggagguuuucucucaagaaaagaauuauucagugugcaccuacauaaucacugcuuagauucuacaauuaauauuuugcuauauuugauuaaacguuuucuguaaaagaaaaauauuauuauguacuauuuagguuuaugggaauaauuguuaaguuaaaguguaugaacaaaccuggaaugaaaucuguuugccuacaucuauaauacaacuauaaaacauagcagauguacaaauuaguaguuaauagauaacuaaaaugcaaauauggcacuacuauuauaguauuauaguuucuuuugaguggcgugucuguaauaucacaugcuguguugaugcacuucaccaaacugcuguuuucaaacugcuuuaaauccugccauuauagcacauagcaaugcuauuucacuuucauuuggcacaaaacacauuuauauauuguuugcuucucuucuuuucuguaauccccaggcaacaaaacuagaacauuugccacuaaucuggcaacgugguccuauauuaugaaguagucauauagcugaucuaaacuauccuuacagugaaaugagaguauugugaaaguuuuguagaaagcuccccauauguccugagaaucuaugcacagaccccacaguuaaaagaccuuugaauugugggaagacauggguuuaaguaucacuugguuaccuucuauuuguguaacauugagguaguuucaucuucuggguucccaguuuccuuagagaaugaaaauguugaauuaugugauuuuuuuuuuuuuuugagacggaguuuugcucuuucgcccaggcuggagugaaguagcacgaucucgacucacugcaaccuccuucccccaugaucaagcaauucuccugccucagccucccaaguagcugggauuacaggcacccgccccccaccccccgcccccagcuaauguuuguauuuuuaguacagauggaguuuugccguguuggccaggcuggucucgaacuucugaccucaggugauccacucgccuuggccucccaaagugcuaggauuacaggcaugagccacugcgccuggccuaugugauuauuaauaucacgucuagcugugacaauucugucugaugcuggaguauuugaaccagauggcuggcugugccacucaguuauucucuccauaagacuuugauauuuuguuggucugcaagaugacggauucucaaaauucuugucagugaauauugaacccuagugaaauguaugguucuguaucaguuccaaaauguaaccacuuucucuagccuuagauucccaguuccaaaauguaaccauuuucucuagccuuagauucccguuaagggaaagggaaugcucuuugaguaugucaucaccauaguaacaggcaaaacuagagggcuuugaugcuaaagcaagauacuccauaaauaugcuuaagaagacuuggggagacuggaauaguuguucccuuuuagaugccaguguauaaaugaauuugagcuaggauccguuuauuuaaaauuucuuuagguguauuugcuugcauauggagugcacauuuacucucauuaauggaguuuuaggaagcaguagaguaaaugcauaaacauguaugaaccgccauguuuaacuggaagccugcauuuggaagucaaguaucuaaucuuagauuaaauuaggauggggaaggauguuggcaagagauuuugaagcuuguucugcuuauauugagaacaucauagaacaguuuggccuuuuuaaagcuagagaauaguguugaauaagugauguuccauauauuccuguuugacauugacauaaagguuuccucaugauacaguaaucccugaucagggaucuggaagccuguauucauuuaagguacucagguuuaacauacugggugcuuuucacaccauacuauacaguaccaugcaaagugcuuucaagacugcaaauuuggcuuagauccccuuuagugagcuccuaugcuauaguaaagguagauagccaauuauuaaaaacagucaagacaauugcaccucuaagcaguaguagcaguugccacaccaccuugaaucuugaaguauuuucagcaacaggaugaccauuagccacaaauuuagugucagcccuuaaggucgguauugguuugacccauauuuucauguaguucuuuuucuucacuugucuaaucuucccguguacugccagggcuugucauuagaggacuuuagggagaccaagcaggcuagaaaguagagacaggagauaccuaugucuaaugcuucaguuuauacuuccuagguuuuuuucauugggguuuuuguaacucuuuugguauccuaccggugcuuugguagccuacugaacccugucuuucuucuuaaggacauucugagcaugugagaccugaggacugcaaacagcuauaagaggcuccaaauuaaucauaucuuucccuuugagaaucuggccaagcuccagcuaaucuacuuggauggguugccagcuaucuggagaaaaagguaguuuggggaauuuauuguuguagugcuucugucuuuggauugaacuucccacaacucuccuuuuuaaagcagaacacagcugggcaugguggcuccugcuuguaauuccagggcuuugggagguugagguggggggaucacuugaggccaggaguugaagacccaugucucuacaauaaaauaaaauuaguugggcauggugguacgugccuguaguccuaccuacucuggaggcugaggcagcaggauugcuugagcccaggaguucaaggcugcagugagccaucauuagccacugcacuccagccuagguggcagagcgggacccagucucuuaaaaagaaagaaaagcagaacgugagccaguuuucaucaauuccuauacuuuuucuuuugcauguacacauacauuuuaacuuuacauaaugaguucggccuguuucauuuaucccucagagcugggcuccagugaggucuguaagggcaagcauacuugauccccaaugaagaaugagagaugcaaagcacuaaauuauuucuuuucucaccacacagcaagauagauuuaaugaacuuaacaccuuuugauuaguggccuuuuaaauuauucccacuuuccuuuggcagauggguauuaaguucucaggauuuguuuacaaauaagacuaacuucaucuguauuagcucaguuuugguaggccuaauuccauuaucacugccauuuccuuguuuuaagaaaucaaaauuucuuagcuugaaaaacaauugaaauuguuaaaaaguggaauaggagagccccgggggccuguauaaggaauuuacugaaucccugguuuucuguaccuuguuuuuccuucugcauagauuugcuuaacuguuuuuguggcguguauuuuuuuuuuuucgcaguuucgcucuuguugcccaggcuggagugcaauggcgcaaucucagcucacugcaaccucugucuccuggguucaaguuauucuccugccucagccucucgaguagcugagauuacaggcaugcgcgaccacgccaggcuaauuuuguauuuuuaguagagacgggguuucuccauguuggucaggcuggucucaaacuccugaccucaggugauucacccgccucgaccucccaaacugcugggauuacaggcgugagccaccacgccuggccagcuguuguuauaacuggaguucuaugugcuugugaccauucuugguuucuccgaauauccuagaacuuugguggcgcccuauuauacagguuguugaagaaauguuaccauguggauugaguaggaaacaauucucuuuaucuuggcaauauuauggcauggcacuacuuaaaguacaaauuaaaagagggggaugcuacagaacuagcugacaggcacuuugauagagguggauuucucaguucuuaaaauagcucuuuauaaaggaagccagaggcauuguggaggagaauucuuacauaacucauaggguuagaccacauccgaccuuuucuguguggcuucauggcucucuugguugagaaagcauuaguuucuccuuccauuaguuucaaccucuugauuucuugaccccccuacuauauuuugugcugagaacacaaggguauuaacaacccacauuguagaggaucgcucaguaauaaagacuggagaauaaaaugcagcaugggaauauuggcaauuacucaguucuaaauuucucuuggaaaugagggaaagcauacagaauagagcuggaaugaauaggauaauuuuuuuuuuuuuugcuaaguugguagccagaauauaacagcuccgcacaacuguaaauguccacucuucaauccacaugaagaaaaggguaaaaauaugguugaacucaaccacuaguugcccauuagaacagacuuucccaguguacugcauuucaauacuuuuucuuuuaucucuuuucagaucuuccucagaagaauaggcuuguuguuuuacaguguuagugauccauucccuuugacgaucccuagguggagauggggcaugaggauccuccaggggaaaagcucacuaccacugggcaacaacccuaggucaggagguucugucaagauacuuuccuggucccagauaggaagauaaagucucaaaaacaaccaccacacgucaaggugcguaagcugucccuaaaagcauaauaaguagucuuaauuuugauuuuguuuuccaguauacauugcacuuaguguuucacugaggucguauucaucauuauucugcauaugauuugguaaaaacagcuuccuaacuaaccugggaagcaacugggugugagauuaacugguuaaagugaugauguaaagaggguagcggguugcauguguucggguguuuggagugggacuauagcacguggcagaggcuuacagcuaaguuguucuuuuaggagaacauggacaacugucacaucagugacauugaucacaugggcaaaucauucuguuccaugugguccccaaagucucucuuaaagccuuacagaagaacuuugccaaucauuuacauacuucaggauggcuugggaugccaugguguauaauacaacaagugagaggugugucuuuuuaugcuaugguugcugauugauggaagccgcauaaauacaaauggaaaccugacuaaaaauggcacaaaguuaucugucaucaggcaggagcuaaagaaccaggacccuacauucucuaggucaguguugggagaggcugauuagcgagugagaauuggcagauaaaggugaccauucggugcaauaaauccugaacguauaggcuuugcccagcauucuucguaaauaguggguagcuauaaauuucaugaaauauuuucauggguaagaacucuugaaauguuauaauugacuagaaaucucuguagauuuagaaauagagaguuacuaacaaauuguuagaaagucuaggaacuagaaagcuaaguugagaguuaucuaggaagaucuaucuauuguacucauaaucuuuagauaaauucuccuagggccaguagucuaugugaauuuucuuuuucuucuucuucuucuucuuuuuuuuuguauuuuagcugcaauguuaaacaaccuaugugaauuuucuuauugugagaauauuugccuuccagagugacucaccuuuaucucaaagagcaauauugugaguuuugaaaaugcugcucuaaggcuguguuuuguuaguccugagccaggagacuuaaagcaaacuugaggggucuuaaaacaucgaagugagccuuaaacauugggaagaccuuauguuuuucccucucauaucuauuauuuuugugaucucaguuauuaaucauuuaaagggacucuuuccuagcugauuggcacuuaaaacaggauggaagucuuuuuuuuuuuuuuuuuuuuugagauggaguuuugcucuuguugcccaggcuggagugcaauggugcaaucucagcucacugcaaccucugccucccggguucaagcgauucuccugccucagccucccaaguagcugggauuacagucaugcaccaccacgcccggcuaauuuuguauuuuuaauagagacgguguuucuccauguuggucaggcuggucucaaacuccugaccucaggugauccgcccaccucaaccucccaaagugcugggauuaugggcgugagccaccgcgcccggcaguucuggucuuuaacuaagguauaaggcuaugacugguaguggugucucuagugacucaucaagugauauuuggcaagacauuuucccauuuaugccaguuuccuauucuguugaaugaggaaauuuucucucuaaagaccuaaaaguuuugacuuuauagguuucaaaguucuguggaaacauuuucuauugcuuauuaauuugaaucuuauguaacucuagcacaguacucaauauuuauggcauuuacaugguuuaucucauguuuuuuuauagcucuucauuguuccuaucugccaaaucauuauacuuccuacaagcagugcagagagcugagucuucagcagguccaagaaauuugaacacacugaaggaagucagccuucccaccugaagaucaacaugccuggcacucuagcacuugaggauagcugaaugaaguaaguuguugauguugcaguccugugaggaucacuucagaacuguuauaacagcuguuuuuugggagcugguguuggaugggguguguuggucuaaugugaaguggggcuaaaugugagauggaaagaugaccagucuuccauauuacugacuggguucacugaagcaacucaaagacauuauggucuucuuaccaguuguaucacagaagaauuuagccuuugcuuguguguucuaugucuucacuguauaggcccucugucauucuuagagccuuaaacguugagaagcuuaaaacaccauuucugcuuucugcugaaaggguaacccuuucucaucuccguuugugagagacucugucgucaguuaagauuaguguaaaaagaaaacuaaacucugaaguagccauuauaaaagugugagaaugaagucaguuuucuaaagaguuggggaaaggugaugcuaaaggaggggauugagcaaguccuaucaaagagccuuuuaugaaaauacuuagucaucugugacaucccauuuggcucuuccagaaauccuaguaaauaguuguaacaggauguuaagaggcauacauuguguguuuuaaauccucugcuacucauuagguauaugaccuuugacaacuuaaagucucuagacuucucuguuugugaggguuaaaugaaaucauguauguaaagugcucaccuauugcagugccuggcacaugucaaguaaaagguaacccaagaagacucauaaguucauuucccacaauauaagugaccacuagcacuaucagguagcaggcagaguuggcaugcuuugguucuauguaagaaaucccuaagguaaaaguuuauaaauagaagagcaucuguguugguauuggugguuguuauuauuguaguacuauaaguaguauucguaguaacaauaguuuauuauaauuacuaaugacacuuuuugauuuuuuuuaucuuucugugaugcuuuucaugccucuugugccccucacuguaucuugccucuucuacuacuuacuuccucugaaugucugccuuugcuuaucucuugcacucaaguguguauuucuuugucucuuucuuucuugucuuugcucuuuguucucuaucuaaagugugucuuacccauuuccauguuucucuugcuaauuucuuucgugugugccuuugccucauuuucucuuuuuguucacaagaguggucugugucuugucuuagacauaucucucauuuuucauuuuguugcuauuucucuuugcucuccuagauguggcucuucuuucacgcuuuauuucaugucuccuuuuugggucacaugcugugugcuuuuuguccuuuucuuguucugucuaccucuccuuucucugccuaccucucuuuucucuuugugaacugugauuauuuguuaccccuuccccuucucguucguuuuaaauuucaccuuuuuucugagucuggccuccuuucugcuguuucuacuuuuuaucucacauuucucauuucugcauuuccuuucugccucucuugggcuauucucucucuccuccccugcgugccucagcaucucuugcuguuugugauuuucuauuucaguauuaaucucuguuggcuuguauuuguucucugcuucuucccuuucuacucaccuuugaguauuucagccucuucaugaaucuaucucccucucuuugauuucauguaaucucuccuuaaauauuucuuugcauaugugggcaaguguacgugugugugugucauguguggcagaggggcuuccuaaccccugccugauaggugcagaacgucggcuaucagagcaagcauuguggagcgguuccuuaugccaggcugccaugugagaugauccaagaccaaaacaaggcccuagacugcaguaaaacccagaacucaaguagggcagaagguggaaggcucauauggauagaaggcccaaaguauaagacagaugguuugagacuugagacccgaggacuaagauggaaagcccauguuccaagauagauagaagccucaggccugaaaccaacaaaagccucaagagccaagaaaacagaggguggccugaauuggaccgaaggccugaguuggauggaagucucaaggcuugaguuagaagucuuaagaccugggacaggacacauggaaggccuaagaacugagacuugugacacaaggccaacgaccuaagauuagcccaggguuguagcuggaagaccuacaacccaaggauggaaggccccugucacaaagccuaccuagauggauagaggacccaagcgaaaaagguaucucaagacuaacggccggaaucuggaggcccaugacccagaacccaggaaggauagaagcuugaagaccuggggaaaucccaagaugagaacccuaaacccuaccucuuuucuauuguuuacacuucuuacucuuagauauuuccaguucuccuguuuaucuuuaagccugauucuuuugagauguacuuuuugauguugccgguuaccuuuagauugacaguauuaugccugggccagucuugagccagcuuuaaaucacagcuuuuaccuauuuguuaggcuauaguguuuuguaaacuucuguuucuauucacaucuucuccacuugagagagacaccaaaauccagucaguaucuaaucuggcuuuuguuaacuucccucaggagcagacauucauauaggugauacuguauuucaguccuuucuuuugaccccagaagcccuagacugagaagauaaaauggucagguuguuggggaaaaaaaagugccaggcucucuagagaaaaaugugaagagaugcuccaggccaaugagaagaauuagacaagaaauacacagaugugccagacuucugagaagcaccugccagcaacagcuuccuucuuugagcuuaggugagcaggauucugggguuugggauuucuagugaugguuauggaaagggugacugugccugggacaaagcgaggucccaaggggacagccugaacucccugcucauaguaguggccaaauaauuugguggacugugccaacgcuacuccuggguuuaauacccaucucuaggcuuaaagaugagagaaccugggacuguugagcauguuuaauacuuuccuugauuuuuuucuuccuguuuaugugggaaguugauuuaaaugacugauaauguguaugaaagcacuguaaaacauaagagaaaaaccaauuaguguauuggcaaucaugcaguuaacauuugaaagugcaguguaaauugugaagcauuauguaaaucagggguccacaguuuuucuguaaggggucaaaucauaaauacuuuagacugugggccauaugguuucuguuacauauuuguuuuuuaaacaacguuuuuauaaggucaaaaucauucuuaguuuuugagccaauuggauuuggccugcuguucauagcuuaccacccccugauguauuauuuguuauucagagaaaauuucugaauacuacuaguuuccuuuucugugccugucccugugcuaggcacuaaaaaugcaaugauuauugauaucuaggugaccugaaaaaaaauagugaaugugcuuuguaaacuguaaagcacuuguauucuacugugauaagcguuguggauacaaagaaaggagcaagcauaaaaaagugcucuuucaaaaggauauaguacuaugcagacacaaggaauuguuugauaaaugaauaaauuauauguauauuugaggccaauuuguguuugcugcucugguaauuuugaguaaaaaugcaguauuccagguaucagaaacgaaaacacauggaaacugcuuuuaaacuuuaaaauauacugaaaacauaagggacuaagcuuguuguggucaccuauaaugugccagauaccaugcugggugcuagagcuaccaaagggggaaaaguauucucauagaacaaaaaauuucagaaaggugcauauuaaagugcuuuguaaacuaaagcaugauacaaaugucaaugggcuacauauuuaugaaugaaugaauggaugaaugaauauuaagugccucuuacauaccagcuauuuuggguacuguaaaauacaagauuaauucuccuauguaauaagaggaaaguuuauccucuauacuauucagauguaaggaaugauauauugcuuaauuuuaaacaaucaagacuuuacuggugagguuaaguuaaauuauuacugauacauuuuuccagguaaccaggaaagagcuaguaugaggaaaugaaguaauagaugugagauccagaccgaaagucacuuaauucagcuugcgaaugugcuuucuaaauuauaaagcacuuguaaaugaaaaauuugaugcuuucuguaugaauaaaacuuucuguaagcuagguauugucucuacaaaauucucauuguauaguuaaaccacagugagaaggguucuauaaguaguuauacaaaccaaggguuuaaauaccuguuaaauagaucaauuuugauugccuacuaugugaacucacuguuaaaggcacugaaaauuuaucauauuucauuuagccacagccaaaaauaaggcaauaccuauguuagcauuuugugaacucuaaggcaccauauaaauguaacuguugauuuucucacuuggugcuggguacuagguuuauaaaauuguaugauaguuauuauauugugcaaauaaaguaggaaaauuugaauaacaaugauuaucuuuugaauacgcauacgcaagggauugguugucugaagaaugccacuauaguaguuaucuauugugugccaaucucauugcuaggcauuggggaugcaaagauaaaccaucuuuauugugucuuggguagcagaagaaaauauguguaaaaucaauuuauaauuuguaaacugccacccauauauaagcuauaucugcugaaugaucauugauuacucuuauccuuagagauaacaacugggggcacaaacauuuauuaucauuauugaaccuacaacagagaucuauguguagauuuacaaagccuacaguucuauacagauaggaaugaacuauuggcuuacugaauggugauuacuuucuguggggcucggaacuacaugcccuaggauauaaaaaugauguuaucauuauagagugcucacagaaggaaaugaaguaauauaggugugagauccagaccaaaagucauuuaacaaguuuauucagugaugaaaacaugggacaaauggacuaauauaaggcaguguacuaagcugaguagagagauaaaguccuguccagaagauacaugcuuccuggccugauugaggagauggaaaauuuuugcaaaaaacaagguguuguggucuuccauccaguuucuuaagugcugaugauaaaagugaauuagacccaccuugaccuggccuacagaaguaaaggaguaaaaauaaaugccucaggcgugcuuuuugauucauuugauaaacaaagcaucuuuuauguggaauauaccauucuggguccugaggauaagagagaugagggcauuagaucacugacagcugaagauagaagaacaucuuugguuugauuguuuaaauaauauuucaaugccuauucucugcaagguacuauguuucguaaauuaaauaggucuggcccagaagacccacucaauugccuuugagauuaaaaaaaaaaaaaaaaagaaagaaaaaugcaaguuucuuucaaaauaaagagacauuuuuccuaguuucaggaaucccccaaaucacuuccucauuggcuuaguuuaaagccaggagacugauaaaagggcucaggguuuguucuuuaauucauuaacuaaacauucugcuuuuauuacaguuaaaugguucaagauguaacaacuaguuuuaaagguauuugcucauuggucuggcuuagagacaggaagacauaugagcaauaaaaaaaagauucuuuugcauuuaccaauuuaguaaaaauuuauuaaaacugaauaaagugcuguucuuaagugcuugaaagacguaaaccaaagugcacuuuaucucauuuaucuuaugguggaaacacaggaacaaauucucuaagagacuguguuucuuuaguugagaagaaacuucauugaguagcugugauauguucgauacuaaggaaaaacuaaacagaucaccuuugacaugcguuguagagugggaauaagagagggcuuuuuauuuuuucguucauacgaguauugaugaagaugauacuaaaugcuaaaugaaauauaucugcuccaaaaggcauuuauucugacuuggagaugcaacaaaaacacaaaaauggaaugaagugauacucuucaucaaacagaagugacuguuaucucaaccauuuuguuaaauccuaaacagaaaacaaaaaaaaucaugacgaaaagacacuugcuuauuaauuggcuuggaaaguagaauauaggagaaagguuacuguuuauuuuuuuucauguauucauucauucuacaaauauauucgggugccaauagguacuugguauaagguuuuuggccccagagacaugggaaaaaaaugcaugccuucccagagaaugccuaauacuuuccuuuuggcuuguuuucuuguuaggggcauggcuuagucccuaaauaacauugugugguuuaauuccuacuccguaucucuucuaccacucuggccacuacgauaagcagguagcuggguuuuguagugagcuugcuccuuaaguuacaggaacucuccuuauaauagacacuucauuuuccuaguccaucccucaugaaaaaugacugaccacugcugggcagcaggagggaugaugaccaacuaauucccaaaccccagucucauugguaccagccuuggggaaccaccuacacuugagccacaauugguuuugaagugcauuuacaagguuugucuauuuucaguucuuuacuuuuuacaugcugacacauacauacacugccuaaauagaucucuuucagaaacaauccucagauaacgcauagcaaaauggagauggagacaugauuucucaugcaacagcuucucuaauuauaccuuagaaauguucuccuuuuuaucaucaaaucugcucaagaagggcuuuuuauaguagaauaauaucaguggaugaaaacagcuuaacauuuuaccaugcuuaaguuuuaagaauaaaauaaaaauuggaaauaauuggccaaaauugaaaggaaaaauuuuuuuaaaauuucucuaaauguaggccuggcugggcuuugaccuuuuccguuuuuaaaucacucacagagggugggacaggaggaagagugaaggaaaaggucaaaccuguuuuaagggcaaccugccuuuguucugaauuggucuuaagaacauuaccagcuccagguuuaaauuguucaguuucaugcaguuccaauagcugaucauuguugagaugaggacaaaauccuuuguccucacuaguuugcuuuacauuuuugaaaaguauuauuuuuguccaagugcuuaucaacuaaaccuuguguuagguaagaauggaauuuauuaagugaaucagugugacccuucuugucauaagauuaucuuaaagcugaagccaaaauaugcuucaaaagaagaggacuuuauuguucauuguaguucauacauucaaagcaucugaacuguaguuucuauagcaagccaauuacauccauaaguggagaaggaaauagauaaaugucaaaguaugauugguggagggagcaagguugaagauaaucugggguugaaauuuucuaguuuucauucuguacauuuuuaguuagacaucagauuugaaauauuaauguuuaccuuucaaugugugguaucagcuggacucaguaacaccccuuucuucagcuggggauggggaauggauuauuggaaaauggaaagaagaaaguaacuaaaagccuuccuuucacaguuucuggcaucacuaccacuacugauuaaacaagaauaagagaacauuuuaucaucaucugcuuuauucacauaaaugaaguugugaugaauaaaucugcuuuuaugcagacacaaggaauuaaguggcuucgucauuguccuucuaccucaaagauaauuuauuccaaaagcuaagauaaauggaagacucuugaacuugugaacugaugugaaaugcagaaucucuuuugagucuuugcuguuuggaagauugaaaaauauuguucagcaugggugaccaccagaaaguaaucuuaagccaucuagaugucacaauugaaacaaacuggggaguugguugcuauuguaaaauaaaauauacuguuuugaaa

SEQ ID NO: 19120 - RNA, 730 nt, Homo sapiens
acugauucucggauuuuuuuagaucuuccuuugcuugaagggacuggcuguggaacagcagguuuagguacuucuagaccucuuucuugauagaaaucaugcauuugcuuuuuuucucuuuccucuagauugaucacuaauuuguacacuaugucuuguaacugucgguccaaccuuauaaagagguugugucugauguacugcuauauugcauuuuggacaucuguugcuguaguaaaaaugucuuacgacgcagcuuuuacaaaagguauaaagauauucugugaugguaguugcaucuauuaaguaaccuuugcaaauggaacacaagauauauggggucagcucagagagauuaaucaggcgcuccuccucguccuccgagucuugccggccucccuccagccucaacgagaagugacucauguccuccuccuccuccuccucuucuuccuccucuagcuccucuucuucuuccaacugcucguccuuauccucgaagcggccucugaagcggcccaggcugcgcucuggcuccagcucagggggccgggagccggagcagccgggagccccagucucagacagaggcgccggucccuccucacccgcugcgggugcgagggugagggcgggcggggagacaggaggcggaggcggcaaggcugcagcucccucggcuuuggcagcgcuuacgcugcccgccgucaccaccgcgacccccuccaug

SEQ ID NO: 19121 - RNA, 29428 nt, Homo sapiens
gucauucacauaaaucuuuccaggauucuuguauuggaauauaaucuuuuauuuuaccacucaacgauuaagccauucaacuacacaacacagauaaaacggaaguuauaacauauaaaccaguaccugcccacacucauagcagugaggggaauaaaaaucaagguugcacuguaauuccaugacucuaaaaaucaagucuauuugacauugguuugaagcaacagaaccuuuauagcagauuccccuuuuuaaagaaaaacccaaggagagaugaucaagcacaaaugaucacuucaugcauuuuauugauagucuauauuuuaaaucugcaguaugacaucuuacauagggaaaaaagcuucuuccuaaaagauaacuauuaauaaucaaaccagcuuuaauaugauugaccuuucaaggucuuguuuugcuuuaaacaaguuaacuuuuagcaguuguaaagcacuguacaaaagaaaacuguguacauucucaaaauuuaauacagggcuucccaaccaggagucugcuggauagguaucggagaaggguguuauguucagguuuaaauugaaagaaaaugagaaaccagauaaagcaagccaaccaaauuaacuucacuuugugcuccucucugcuuuuuugagucucucccgaaggucaggaagcccugguauaacaaucacuuuagucuuuacagaacauacaucuaugugcuuugugaccaaagacauaaaggcagccuuuguuacuguucccccuccaaaccccuucagguucuuauaagcuucagaaagcuuuccaagauugcugcccuguucuuuguaugaauccaaguaaacaacuauaccaaagcagcucuuccugggagaagauaaaacaggcacagauacaucaccaggccaacugcguaccuacucaacuugauaccugaucacauggcccuacauccuuaaaagcagcaccagggacaaauggagcuaucaagagguaaaauccaaacacuggacaguuaaaacacauacaaaccaguuaaaagaacauuaguaauggggcacuaaauagaguuaaggcuggacagcugguucaaccauaccuugguauugaaauaauucugcaagaugaggaacuuacagaggaaccuugaaagaggcaccaugauaugacaggguucacuuucacugcaugucuuuaagauaucuacuacucagcccaacugaccauaaagcagcucguggaacuuuaauaaacaaauccuaauaaaaauaaauaauuuuuagaauguuggaggguaugccuauuuccuucagaucugaucaagacaugagaauuauaaaaccgauacaaacuguucugugauuaucacuugacaguucuaacacuguuauacagcucaauucuaugcugcagccuuuaagauacaaacugggguuacaugagaucacucacuuguuagagaaguaucagauaaauuuuagaacuguuccaguuaaggaaaauaauucuuaauuucauaauccuaaaacuuuuucuaaaaauuuuugcagggcagguacuuaacucauagcuguuuuaguugauuaaaaaaucugauuuaaaaauaaguaaggcugggcgcaguggcucacgccuauaaucccagcacuuugggagaaugaggcaggcaaauugccugagcccaggaguucaagaacagccuggacaacauggcgaaaccccaucuccacaaaaaauuagccaggcaauguggugcaugccuguagucccagcuacuuggaaggcugaggugggagaaucaccugagcccaggaagucaaggcugcagugagcugugaccaugccacugcacuccagccugggugacagagcaagacccugucucaaaaaguaaaaaauaaaauaaaauaaaaauaaauaagugacauacuaguuccucggaucuuuuacuuuuuuccaaaugaaguaugcugucaauuuacauuuuucauguuuuuucaaaagcacacaauuuacuaguuaacucaaugaauuacaauacuguuauugaauauaaacauacugaagaauuaaagggaaaaaaacacaccugacacuuuaacaugugccuuaacaaucuugcauacuaagguacagaauacuucagaaaguaacaauuagcauagucuuauaagacuaggagaauaaaagugcccugcaaacauggcuucuauguacuuaauaugguaaaacaugugacagggaagccuguaagguaaaacuuaaaaaaaaaaucaaauaaggcagauuauaauuuuuuuuguucgcaaaagaacaaaggagaaaaggggaagaauaaaaacauucuccaucuuuaaaagaaaaaauauuaacaaccauaaggugccacuguauuuuagcaagcuguaaaaauggccuuuuaagaggaauuuugcaaucuuuaccucccuaucauuuggguauuuugggaacugaccgaaagucauggcugaugcuucacccauuucaugucauggacgccugggaagcagguaguuaaauacaaagcauauuaugugauaacccuucauaaauauaauuugagacacugacacuaggagaggauacuuggcacagaaaagacauguuauggggcgggggacacauuacuugaggcaacacuuacagccaaucaguuuccuaaucuuaagguuuggaugaauuccaaucguuuuuaaaaacuguguguguacacacacauauuuuauuuccuggugcuaaaggucuuauaaacuguacaauuaccuacauuccaacacuaaugugaacacuuuucucaauccccaccuccauuaacaccauuaagguguaacuaacauguucuuuucagagcaaauauuccaaauuaacaagguggcucaucuucuauaguguugauacaaagucagcaaacuuuuaacuuaacuugcucaauuuuguuucuaauaguacuaauaaaccucaacuuuggcuggacaugguggcucacgccuguaaucccagcauuuucggaggccgaggcaggcacaucacuugaggucaggaguucaagaccagccuggccaacacggugaaguccccaucucuacuaaaaauauaaaaacuagccaggugugguggcaugcgccuguaaucccagcuacucgagaggcugagacaggagaauugcuugaacccaggaggcagagguugcagugagccgagaucgcuccauugcacuucauccugggcaaccaaguaagacucugucucaaaaaaacaaaacaaaacaaaacaaaacaaaaaaaccucaacuuugucagcugcucagaguuaaaacaauucaaauguuucagacuagaagugaguuuuuaaaaacaucugaaauauucaagaaaauuuggguuuugguacuuuuccuuaugcucugaacaaugugaacucccaacauuguuuauccuuguuccucuuacugcaugaaguucaaacuaggucuuaaagacaacuuuucuguacuuaagaaaaagugcaaagauagaaaaugaaauguaagguguuuugcaagaaaugcucccucgagaaugguguuuggauguggguggggggaaaacgauuuuuguucuccauuguaaucugacaccuacgaaugaccuugucuucaauguccacaacacuaguaagcauguaauaaucacggacaucgcaagauuaaaaauuaaguagcaaauuccacuaaaacacuuguauucauucuauacaaucgaauggaaauccgugagugcuacugaaaaagguguucacaugcacauguccaauaugugcauuccacugaaggcuaaaagcuuaaaauucuauuuccaguguuuaugaauagcuucaauaucuacauucauagccagcauucugcuugaguuaccucuuacuuuaauacuucacaaaugaguaaguacgucuugggagauuaggaagguaccuguugucaauaacuuucucuuaugcuuagaaugugcugcaauuguuuuuaaacuauuuaaaaugaacaccccuauaauaaugaaacacuuuaugccaagaagaaaauugauuuguuuuuagccaaucaagacuacccugcagaucugaaaacuguagauuacauccuuaggaaaggagaaaaggaggcucacaaauauaaaggaauccugacuuuuacacggacaaauuuuuaaaaagauaaaauguauuacauaagcgccauaaacagugaaaucugcuuauauuaaaaaaaauaagugaagcuuuguuuggacauuauuuccuugcaagagcaguacauauccuuaguaaacaacuaccauauuuacaaguuaauuuccuugauacuuagauaggauugaaagccagaagaaaucauggaagagugagcuuugaaauaaucuuuacagcuaaguugguaacagugaagguacccagacaauuccuaaagcagacuuguuuauuuuguagaguauuugacuacgucuggguagcuagcuugcuuugauaaaggccaaggacaaguucaaucccuauuuuggccuguuaaagcuuuucccagaagaacaaauaucugcuccauagucauucuaauccuaaccccagcuagucucaaaaaagaaauuaggcaagaagacugggguuaucaugaaguuacucuuacuacuaagaaaccaacauaaagugcauguccauagauagcgagucagcagucucauuuucauauaugggcagcacaauuaaaauuugaauuucaaauaacccaacaugacuuucaacaaaggauaaaaaucccuuaaucuucaacuggucuuuaaauuugagauguuaggacuguguuagagauaguaaugaaauaugaucaagugugcacugguaccuuaaaugacaaaucucaaaaacaacacaaauucgagacuuuccuauuaacacacacauguguaccaacugcaauucauaugcuaaaagugguuuuauagucucuuuccuccauuuuuucauuuuugaggagcagacuuguaaauuuaacuugugcuagguaguagugguuuguuuuucuuaaaccaaaacucugccaaacuugcugaucuucugcuucaucuacucagguagaauaccaggucaagcugcugcuguggcugcucucaccauaugaaaccaguuugugucugcauuauuacugucuucaggaaaacuuuaaauucuucaguuuucuuuacuccucccauauuucacuuccugccuaaauccaaguuaaauuauacaauuuccacuggucuucaacacgguuuaauucugcacuguccuuuccuuugcaugucacaguagcuguucacacauuaaauauuauagauauguucugcucuugacaucuacacacuuacaaaagcagcuuuguacuuuguuugguguguuuguuacuauguuggcucacaaaaagcaguuuucucaguucuaagcaugguacuuuacaauuuuuaaugcauucauacaacagugcauuggaaaaguacugagccucuacaaaauagcuuuacauuuuuaaacaaaugaaugugauuuuuuuucacuuacacaagcauaggcuuuuuaauauuuccacaagauaaauaucucaauuaaacuauaagcucacucuacagugugccacagugaugggcuuaggagacaguuauacacuuagaagauccuaaccuuaguguuauuuacacugacauguccaguaucaccaagucugaaaggugaacaaacaauacucagaauguggcugaauuuguguuaacuaauaacugggaaugauauagcuuuaaucacuuaugaaacacauacuguaacuuagucuaaacugguaauuuccuuugcuccucucuuauggugugggaaaauuuaaagaucaacaugaaaaaggagccauugcuaaggcagaucuuuuaagauaacaaaggaaaaauugacaaguguauaugauaaauuaucaguaacagugaugcuaccaauuuaacugguacggaaaucagauuuuuagguccuauaacguggcuuuuaaaauauuuccuuuuauucuggaacaaaaacuggagaaaggacaaugauuccuucagaaagcaaugacucaauucagguuguuacuuuacauuuaaguaccacucaaaaaguggacauaaaagcaagugauuccuguuugcccaucacuauaucagcuacauagcugagaguucagaucuuaauuacacaacacuuucucuguuaccagaagcuaagacugcucugcgacaaauaggacagguagaauucucagauaaccagcgaucgaugcaguggacaugguacucaugggaacaagguaguuuacgaaguuuguugccuucuguauauucuguaaugcaaacacuacagguuuuuaaugcaucauuuucaccaaaacuucucauugccaaguugucaaucuguucuuuggugaguccucuagguuggucaucaucauccucauuuaagaggaaaaacugagccaggcuaaggaagggcaaagagccacuuucaucaaaugugacuggggcccuaugucgacccucucgccuggcaccugaugagccugaugaugagcuuccuucauuacugccuucaaauaaaucugagcuaguuucugaacuuucaccaccggaacuggaacuaggacuggaacuggaacuugaacuggaacuggaacucgaacuggaacuggaacucgaacuggaaccagaacuacuaccaccaccagaaccuccucuuccacuccgugacucugcccuuuccauauuucgauuugagacugagccaguaggcucugagucgcuaucacuguacauaaaauagcuuaacucaccaaaaccugucauuaucugccuuaacauggucugaauugcaacagauguagucucacuuaaaccaguauuuaagauucuacgaaugggaauucugaugguacugacauagguucucacaccugcccgcucagaacgugaaaauguacgccuaaaaccuccucguucacuuucauaggugacaguguuguuuggugucugagaccuagaccgaguucugcuggcuaugcuaucucucugccgauauucuccaggacgaacucuucuuacuugaagaucaaggacuaugguuggaggucucuguccugauccuguagauucaccacuggcagcugugucugaagaaccugcuccuugagaagcauuucuuguuccagaagcugcaaaaagaccucuacuuagcaacucaggcccagauauuugcugccucaaugucacauggugccggguucuagaacuucccuccgucucauuuaccaaaggauguucaaaagucugagaugagauacuaugaugagaucuucguggaauuucacucauuggaugcagaggugaccuacuucuuucagcucuugcucugguucuccgauggucugggcuccugcuucuugcccuccucugaccucugguaggugggaccucuguuaacgcuucaguugaauuucguucugaucuagauggccuugcagauguugauucagaucguggguuuuccacuugccuuuggcuguuguuuuccacauuuucuccacuagaacgucuugcagauggcucauuuucauucucugaauuuuggcucccauuauuacgguuaacauuuaucucuaaacugaaucugaaaucaccacuguuuggauuaguccgacucacugcucuccaagauugguuuccucuuugcccacuucuuguuguauuuccaguuugucugacagaguuaagccagucuauuauagagucaccauuagacacaucaucugaagagucuccuccuguucaaaacaaaggagggggagagggagaaaaaggaacuacuaaaaugaggacaaucauauaagugcucugaaacucugcauuaaauaacuuaaaaauucggaacacauuucauaauuacagauuuuuacaaacuauacugcauaaauuuauaagguaagaaaauucuaauuccauuugaaaagagcaagcuacacuagagaaauuuagagaauuauuugauuuuuaaagggaaucuggaggaagucuauuuucaguauuuuaucauauacagagccaagcauaccacugugggauggucagaagacguuuuuucaguccucugccaaaauacuaauguaaucaaacuagguaaggaaacaguguuuaacgaacagucacauuuaguucaagcuacauuucugucaaauuuuuauuagucuacauacugugccuuugauaacauuugagguuguuuuaaaauacaggacuauuuauuguagccauaagaaaaauacaaacaagauuuauagguuuaaaagcauuugaauauuucuuaauguuaccaagguuuucaauggacaugaaguuaaagaucagaucaaauaaguagucugaaccuugcauagcacauauaauggcauguucaagaaccaaauuauuaucguagccucucagguugcacaaucaaaaucccuacuugacacugggagggaaacaccagaccugagguuagagcaggauuucucaacagugguacuacugacauuuuaagccaguuaauucugugucaugggggcuguguugugcauuauggcaugucaggauguuuggcagcauuccugcccucuacacaaaugucuccagacguugcuaaugucccacauggggcaaaauuauaucucauuaggaaccacuggguuuagacauuucuuuuugcuggugaagaagucacauguuuauaaagaaggaauuaaguaggaauaaauuucaauggaggugaaaaacaaacaaacaaacaaaaucacauuuaaaugggccauuucucacuguguuccaauuaacauaaacaucucaaaggugagguagaaaaaaaaugcugacauucuaaguaucaagaaaaugucaguuuucuuuuuaugagcaguuacuuagcaccaaauuaauuugugccaaaucuggauaaucuuuggcugacauuuacuauuacaaaguuccuaucaucccaucgucuauccaccuccccaccaaaaccaaaacauaccucuauuuucaucugaguuuugcgguggugggccuucuuuaauuugcuguagucgucucagcaacucuuccucaguacuuucaccugaaauuuaacaccacagggcaaagaugacauuagggguaugacaaucaaauacuuuaucagugacucacaguaaucugacacaagaugauuagaaaaaaaaucauauuuuuaaaagagaaaacuuuuucaaaccaaaaagaaaaaccaaggaguagguagguccugggaaaaauucacuucuuuggaaacauauuaaaagcaauuuacaaaguucuuuugcauauaacaucuaacuuuggcucacgccuguacucccagcacuuugggaggccgaggcggguggaucaccggaggucaggaguucgagaccagccuggccaacaugaugaaaccccaucucuacuaaaaauacaaaaauuagccagacaugguggcaggugccuguaaucccagcugcuuaggagacugaggcaggagaaucgcuugagcccaggaggcagagguugcagugagcagagacugcaccacugcacuccagccugggcgaaagugcaagacucugcuuaaaaaaaaaaaaaaaaaaaaaaaggcaaaggcaauucuaagcugggcgcacagugguaccacaucuguagugccagcucguugggagacucaggcggaagaaucccuugaguccagccugggcaacaugagacccugucucaaaaauaaauaaguaaguaauuuuuaagaauugcagcuuugagaggaggauauuguuaucugcauuuuaaaauuaagaaacagacugagcgacagacuggcuugccaggagccacaccaaacagcagggccagaacuccaccuaaagcauucugauucaagccugguauuguuggcuaaaaacacacucccucucuuaaaagucaugcuaaaaccuuaccuuuuaaaaucuaagcaauuacucaaagguaaguagaauuaaacagaaaugaagaggaagacagauacugacuuuuaacuaggaucaaaugggacuuagugggguaaaagauaauuaagcacaaacuucuaauugcuauguuacccaaggcuagcucuggaggauuacaacugggacauauucagaaaaucagagauaacagaauaagucuuuccuaaaaacuaaguucccauuagcuauuccacacucggauucuuaucuaguaaguuagauaaagcuaacuaagaaaaaaaagauuuagcuccauucuuuucaauucaguucgcuaaaaauucauaauucauaaguuaaaaaucucucugauauaguguaauuccaaacaucaguaaauauaaucagguaauaaauacagcaauaaaugucauuccauauccccuauguuaaauaauauuucauaagggcuaaagaaauggauuuuuaaaacagguucaagcauuuuuuuuuaaaccagcaacuuacacuuauaaauccuuaaauauauguaagcauaccuggggugccuagcaaauuguuaucucucauaagccuauaaucuucuucacucagguuauuuacaaauugauagaaagcuucuucucgauccaaucgguccaucugacuucugcgcugugcugcagacugaucaccacuuccuuugucauuggaaucugaguuuuccauauugaugaacaaguggaaaauaccugaaaagagaaaagagacuaaucuugaaaauaaaggucacuauguauucuauacaaguuuuaauuaugugaaaauccagaauguaggucuagagauggauuuucagaccucaaaugaaauuuccuaacaaaaacuccugaaaagcacuguuauauuaagaguaggucaaggguuggcaaacuacagcccuugaaccagacaggguuggcgaacuaaagcccuugggccaaauccagccauacugugguauuuuuuguuuuuugagauggagucucgcucucucaaccaggcuagaguguaguggugcgaucucagcucacugcaaccuccaccuccuggguucaagugauucucugccucagccucccgaaguagcugggacgacaggcaccugccaccacgcccagcuaauuuuuguauuuuuaguagagacaggguuucaccauguuggcccaaucuggucucaaccuccugagcucaagugaccugcccuccucagccucccaaagugcugggauuacaggcaugagccaccgcacccagccucgugcugcauauuuuuauucuccuugcaaccuaagaaugguuuuuagagacuaucuugugacauaugaaaaugcaaugaaauucacauuuuaguguucauaaaguuuuauuggaacgcagccauacacauucauuuacauguuaucuauggcugcuucugugcuauaauggcagaguugagcaguugugacagacuguauguggcacucccauugcuuuggacugcugcucugugcacucuuaaguugcagugauguagcuauaaugacagcauuucaagugccuucacacuggacauuaaaaaaaacugaguauacacucaucaucucaaacaaagagaaaaguggacucugaaugucacgcuuaaaggugcagcagaggauggguuuuucaaaaaucagauuagauggcaaagaaugcaugauuaugcaaaaaauacuauauacuaaauacaauauauacugacacuauuaaacacuagugacaauauucccaauucacaggaaaacuacaguucaaaaaguuagaaaauuuaaagugaaaucucaucacaaaauauuucuucacaaaaauaaaaaugaggcuucaaucaaaguaaauuucccaggggcucauuuauuggcuaaacgaggaaagcuguuuauugauggugaguuagugaaauuauguuugagugcagaagcugaagaaauguguccagagaaaauaaacauaauauuggacuuuugguaaguauagugguccaaaaagcugggaauauugaaaagcaaugucacuaaucaacugaaaaauaagguaaaugauggagugguuuucucuuuggcucuugauuuguugacaaauguaacugauacuacuuaaguuauuguuuauucaaagagccaaguguugauuauucaaggaguuugaacugcagaaguagccccuauguguagucuacaugaaauaaucauaggugagaauauuuucaaaguugagaaaacuaauucagcaaaaccugaagcagaaucucauaauaagauauguuacuacuggaaugguaaaaauauauauggaauggaaaaagaccuaguuggacaaauuuacaaaguuuaugaaaauguaagguauuuaacguuuaugguuauauauuuuauuacucaucaucaagugaucugaagaaaauuucaaucuaucauauuacugaaccaguagcacuaaugauaaacuucucucuuaugaacucugguuuaagcucaaguuccaugaauuuuugucagaaauuuugucuugcucuacaacacaacauuugaugggcuaauauugguaaaguuuuauugugauuuguugugcucaaggcaaagauggauuuauuuucugugagaaccgcucucaauuacuauuaucaaacaauaaauagcuuggaaaauuaguguuuccugcagacuugauaauguuucuuaaugaauccauccuaaaacaacaaagcaaaaaauacuuauauaugaaacuuauacugugguaaagccauuucagcaacaacauugguaucacauguaaugucaagcuguuuuauauacuucauguccugacaaaguaaugagagcuccauucccacacaaauuuguagcacauacauuuucugagcucaaacuacaguuccagaacuguuuugcagaccccaauguaagcacaaaauaaauuuccuuauuucaaaauccauuuaacugugcaacugaggagcuuccaucuaacccucaacuagaagugacaucucugcagugguaauaugccaaaagguaaauauuaaagucaucuggcuggggugugguggcucacaccuguaaucucagcacuuugggaggccgaggugggaggaucacuugagcccagaaguucaagacgagcuugggcaacauagugagaccccaucuucauaaaaaauuaaauuaaauuaaaagauaaaaaauugccaggcgcgguggcucacgccuguaaucccagcacuuugggaggcugaggugggcggaucacgaggucaggagauagagaccauccuggcuaacacagugaaaccccaccuguacucaaaacacaaaaaaauuagcugggugugguggcgggcgccuguagucccagcuacucgggaggcugaggcaggagaauggcaugaaccugggaggcggagcuugcagugagcagagaucgcgccacugcacuccugccugugcgacacagugagacucuguuucaaaaaaaaaaaaaaaaagauaaaaaucuaacaaaauucuauauaugcuucacuaaaaucauacacuuguggauugcuuaagauagcaauaccuauauguaugaaaagauauuuucaaagauuaaauauuuaagucagcaauaaauggacauuugcaaaugacuaauaaggaauacuagcuaugaaucccaauuaagcaaaauguuacccucaaaagaguaucauucuucucauuaguaaaccuaucucacgaaacacuguacucaauuauuguuauuacauuuugaguuuuaucaggaaaaacugugagaauuugguuucucucuuuugugugacaauaugcucaauuuugcuuuuugaucugcaaagccuaaaauauuauacuaucuggccuuuuaaagaaaaaggaugccaacuccuguucuagguaauacauaaacuuagccaaaaauucuugucauucacuauuuguacgaguuuaaggaaaccagaauauuggcagacauuccacacauacucaucaaugaacugcacacuaauaaaaaacaaugguagucaacaaucuaaaauacagggagacuacaaacaaaaauguucauccucuaauucuuuaccuuacaaccccagauuccccuuauguuccccacgaacacaacuaaauuccaugaacauaugugcuacugaccaaauguuugucccccucaaauucacauguugaaauccuaaaucccaaggugaauauauuaggagguagggccuuuggucauaaggguggggcccucaugaaugagauuaacgcuuuuauaaaauaguccccagagaguuccuuuguccuuuugccaugugagguuaaagugagaagacagcugucuaugaggaauugggcccucaacauauaucaaaccugcuggcacccugaucuuggauuuucuagucuccagaacugugaaagauauguuuuuguuguuuauaagccacccaguuuaugauauucuauuacagcagccugaacagacuaggacaauacgaaaaaauuuauggaaaaaggguagucuauauugguacuaugacuuaaucccacauacacccacacacaacaccugaagugccggaauguucacaauucaauccuagagagaaaaauaagucaagucuuacuccagauauaaaaacacaaagaagccugucuugucaaaccuugccugcuugcuaagccuaaauaaauuuuagucuagacagaggcauaccuagaucuccacuguuuuccuuagaucauuauuuuuagaacuauccuaucuuguuuaauuaagaugaguaugucaagaaaugugguggugggggggagaucauaauauuuuuggaguuucuuaaucucauaacugagauugcuuaacuguaauaagauuauacuacauaaacuucugacaaaugguuacuuuauaauacuugaaacuuugacacuagaaaucaccagcuuaaauaaaacacgcacaaaaaacaggcacuaaaaaaauacaaaacaaaacaaaacaaaaaaaaacccugaaaaggaagccaaguuuucccacaugaaucucaaguaauacaacuugguauuagaagugguaaaggcagccgauuuuuaaaaauauagaaaagcacaaaggaaaaaaaaagucagccauaauuucucaaauuugcuaagaacauuuaacuaauguucuuaauaaagcgguuaguaguuugaacgcuaaugcaugaaaguuaagacaaaauucacuuguguaggauagguaaauuguucugaaaacaacugcaggguuaaaaggcuugaaaaauauaaaucuuccaaagaaggcaaagauaucugguuaaguucugacauuugaaggacaugaaccaaauaaaagagaaaacucacaugccaaagacauuuacagcaguggcacaaacucuuuaacaauaguaucgggggcugggugcaguggcucacaccuguaaucccagcacucugggaggcggaggcagguggaucaccuaaggucaggaguuugagaccagccuggucaacauggugaaaccccaucucuacuuaaaaaaaaaaaaaaaaaaaaagagcuuggcgugguggcccaugcguguaaucccagcuacuugggagggaggcugaggcaggagaaucacuugaaccugggagauggggguugcagugagccgagaucgugccacugcaccccagccugggugacaagaaugaaacuccgucucaaaggaaaaaaaaaaguuaucagggagguaaaagcccagaaggaacagaaacuuacaaaaauaugggaaagauuuaaaacacugaaugugaagcaagaaaggggucuuguacugaguauggagggggguguaucagguauauuaacagaagacggaagagucacucaacuuccauuuuguuucuauuuuauucaacaaugagaaucaucuucuaacuggaaagaguggaaaaaacaacuuuucaaagaaaaucaaaagccaagaaugcguaauuucuaaugacaaucuuuugagaugucauagagaacaggagagaugcuaaaugauccaaucuucaaaaaaagugagaucuacaaacuacagagcaguaaaaugugacaauacaucuaggggaaaauucugcaaauacauuaucagauaaacugcaaacauguagaagacaguauguucacaagaaguggaguucacugcuggucaacuuaaaaaaauacaaacccccccccaaaaagauuaaccuuauuuaaccuuauuugcuucacauagggaugguucuaaaccuuggcuugcacauuagaauuacuuggggagcuuucucugggguuggucagacauggauauuuuuuaaauuccacagguaauucuauuuugaaagucaggguugagaaccucuuugauagggacaucaggauaacacugcugacuuacugacuugauuucugcacaggaucugagguuuuucuuccuauuaagaagaaauauagaccaguguaauaggaauuaucuggaaaucuuguuaaaauacagauucugauucaguagauugggguagggccugagauucugcauuuuuauuaagccuccaggugauguugaugcugaaccuagaaucauacucugaguaguaaggagcuugaugacaauacaguuaaacagauucacaguuguugaacaccacccucaaagauuacaaagcaauguuaacuugcaaacagcccuguaaacuuuagcauuuuuaaaugaaccaguuggaugaauccacccaagacaugguaaacaaauccauaaacaacucgaagcugugaguuagcacagaagauguauauaauaaauauuauucugaauuaucaguggauuccuaggaugggcugaaauaaaaacaaugguaaauauccuaccucggacacuuuaugaagggcuaucaagcuaaaauaacccauaguaaaaguacacagucggggaagaaccugucuuggcaauucacaugaaagauaccucaaguuuuuggcuaacacaagcucaauaaaaagccuguuugaccuggcuaugaaaccuacgagaaucacaaguugcuuucauagaccacgguguucaaauaaaagcagguaacagccccacugaaaccugcuguucauaguacauguagaaggccggacacgguggcucacaccuguaaucccagcacuuugggaugccgaguugggcggaucauuugaggucagaaguuugagacuagccugacuaacauggcaaaaccccgucucuacuaaaaaaaauacaaaaaaauuaucugggcgugguggcgcaugccuguagucccagcuacucgggagguugaggcaggagaauggcaugaaccugggaggcagaggcugcugugagccaagacugcaucacugcacuccagccugggagaucccgucucaaaaacaaaagcagacuacauguagaguaagugaaacacgagugagaagccugggagcaucauaaaagaaauggaugaauuaccuggagguaguuagccuggagaaagacuaaaaauggacacaauuaccaucuucaaauauuuagagaggaauaacaugaaggagagcacaaccauaggguuaaauuaaggucaauaguuaaagacaugcagaagcaaauaauucuuccuuuuaguaaaacaaucuaacaaaauugucaaaaaaauagagaugcuaccagucucuugaagcaagcaaacuuccugucuccugagauaaucaagcagaagcuggauauuaaaaagaggauuccuuauuaggugagagccagaagagacugauuccaaaagaccauuuggacuaaaaugcuauuaaggguagugaagucucuuggucuucuauucugggcuuagggucauaguaagcuacauacuccagugacacaaaauuacaacauuuucuuggcaacaccaauccacuuagguuaccucuaccccauacuccccucccccaacauaccuugugcuuuaccaccgucacaauguacugcuauuccccucaguccccucuuagcuucucccuauuucaccaacccuuaaagauccaacgagaucuucccuccuaaggagcuauuacuaucucagcuagcaauuuuuccauccaucucugcauauagcacuugucuaugcuacuagaguggcacuuccugccuuccauaauguuuuauauuuuugaaguguaugugucuucucuucccaaauagauuucuuuuagggaacaaaccagaauuacagucccuuuaaaacuucugccaaaugccacuagcacaaugccuugcacauuguggauauuuaaaugacugaaagaaauccaaugugaacacugaguucauuucccuuaguaaucucucugaaacagcacaguccaaaagagauacaauuugaaccauauauguaauuuuucaaaaugccaagcagcugcacuaagaguaaaaacaugugaaauuaaucuuaguaauguaucuuauugacucaacauaaucaaaaaaaaucauuucagcugacugaccacgguggcucaugccuguaaucccagcacuuugggaggccgaggugggcggaucacaaggucaggaguucugagaccagacuggccaacauagugaaaccccgucucuacuaaaaauacaaaaauuagccggacgugguagcaggcacccauagucccagcuacuccuagucaggagguugaggcaggagaauugcuugaacccaggaggcggagguugcaguaagcugagaucaagccacugcacuccagccugggcgacagaguagacucugucucaaaaaaaaaaaaaaucauuucaacauaaaaaaaaauuuagauguuuuacauuaaaaaauacuguuuuugaaaccugguguguguuuuacacuuacagccuaucacaaguuggaugcuaaauuuucgacagauaaaauggaauguaguucagcaaaacaauacaguuguguuuaguggaaaaacauuuuacacuacuucaguuuuuuaagcuuaaaauaaaaaaaaaacuuaaaauuucaguuucacuagucuuauuucaagugucuaacagucacauagugguuaauggcuaccauauugggcagcacagcuuuaaaguauuucuuuguaagauagagaaaucccaaauagggagaguuucaaauguccccaauauauuuuucaugcucuacaaacccacuauuugcauccccuuuauguuuuccaaaaauaaaacaauaagguucaauacucuacaauguucaauacucaugggauagauaagucuuuccuaugcucaugaaucuucaagauucauucuugaccuuuuagaauuucuaccauuuccuacauagaaacuagagacaaaacauuuuaccuccauucaaaauuuuccugacacugauuucagagauuuuugaauccuaaacagcuccugcuugaugagcuuggauuccguuccaugaaagagggaauucuaaauuuuauuuaauucaaaauuuuaaugagacacacucauaaagcaacaugugaacaaauccaaaucacuaccucuucaauaauaauaauaugcugcugucuccuuuccugcuacccuuccauauauaugccagagacaaucaaggaaaauauuuuccccaugauacuccugcaacacacuuauuucaaagccuccauccuuucugccuuaacuuagcauuuccccugggcuggaauugggggucaagagauuucagcacuggcaaggcacucccucccuuauaagggaauucaaagaguaagcuauggcuacaauaccugcagagguccccuggacuagacauaauuacauuugcaaagaaaauggaaaucaaggcaaugcucucaaaugccuuguaaacuaauuuuacucucacacacccaaugagccuggucuuauuuuaagcagaccuucacuaucuaagcggcauaaaagaaagaaauggaauaaaucuaaaaaccacaaguucugccccagguagauauaaucugccacuauuguuuacuaagugcaaacaaacauuuuaaaguuuaggcaugccaaaaauaccagaaaaccauacuccaaaugaucaaauacagcucuaucuccauuuugggugugaaaauauuagugaagaauaacauuaacaaaacaggucuccagauucuacuuugcagugaguaacauugugguacauuucuagcuuaaguagcaagaggaaaaagagaauccuuauacaccgcugggaucuuucaacaucaucguaaaagagaaggucauaaauccauuucuuuaguuaucucagauaagucagaaauucugacuucagcauaugauuagcaucagcuguuuuucuaugaaaagauuacccgugaaacauacaguaauuuaaacaaugaaauauaacuguuuugaagucacuuaggucucucucuggcuauaagcaauacucaucacccuguauuuacauagcccuuacaccuguauuucauuuaaucuucacaauaaucccaugaauuaggaaucaccaccucuacaggugacaaacagaagcacagagaaagaaagugauuuaccaaaaaccaugugacuaguaagugggaaagggccaguaauuaaauccaggucucugcauuccaaauccagucaacuuuucacuaagacaacugccucccaacauaucccaagacucuauacuuuaaaacacauuccuuccuucaaucccaauagguaugacuaaacuauucaaucuaugagcuuuuuauaccauguucacucccuguaugaaaaauuccaaaaugacaaaacaccuuuuguaagcagcacaaaccuagauggacuuauuuuuaaauaagucaacuuuuaguaauuuuuaaaaauacaguugcuccuuagauaaacagcauauuuuauuaaccuuauuucuuuuagaguacugugugccaauauauccaaauccauuccuggaaacaagaaaccaaaugagaaauuuugcccaaucguuucaaagagcuacucaucuggucaaugaaugggacuguauccaguaaguuuaauucuggggaggaaaggccagcaagaacaccaacccugagauuuauuuaaaacagauuuuauucacuuugagaauuuuaaaguauuguuaauaaucucaacuucuucuagucauuauuauauauuaauauaaauuaugcaaaugacuguuucugauuacugcuaaauguaguaucucauuuaauucuucuaauccaugcacaccaaacuuuuaaaaaauuuaauuguuauaauguuaaggcaaaaaguuauuuaaaacauauuguucaguacuaacaggucaggagaccuggugcuaaguauaaacacaggcauguuauauuugauggacacacuacauuauaguacccaauuaaggagacuuaaggcauccaaaaauacuguuaauaaaacagaccuuacaaaacuaaauucugaaacaccaagugaaaugccuguguaaaaaccaauuuuaaaaagugagucaucuuggcugggcauggugcuggccgagugugguggccgacaucuguaauccuagcacuuugggaggucgaggucggcggaucgcuugagcccgggaguucaaaaccagccugggcaacauggugaaaccguuucuaccaaagacacaaaaacuuagcugggcaugguaacgcgcaucugugguccuagcuacuugggagcugauguggcugaggugggaggaucacuugaguuugggggcagagguugcagugaacucagaucacgucacagcagucuagucugggugacagagacuccauaucaaaauuuaaaaagucauauggaagaaauuaccucguuuuuuaaaaaaaguggggugggugggagggaggaauuaagguaacguaacaucaacuaacuacuaaaucauguugaauauuucaccuugugcauauguguucauucaagcuccaaauucuauaauaaaguucuaaagcaggacaugccaauuuuuaaaaaauuauggguaugaacacaaaaaugugucacacugacaagagaagggcaauccauuuuguuugcaacagagcuucaucaagaaucucauaaaggaggcugaguacaguggcucaugccuguaaucccaacacuucgggaggccgacgcgggcggaucaccugaggucaggaguucaagagcagucuggccaacauggugaaacccugucucuacaaaaauacaaaaauuugccaggcaugauggcaggugccuguaaucccagcuacucaggaggcugaggugggagaauugcuugaaccugggagguggagguugcagugagcagagaucgugccauugcacuccagccugggugacagagcgagacuccgucucaaaacaaacaaacaaaaaaccacacaccaaaaacacacacacacaaaaaaaacaaaaaagaacuucauaaaggaguccuuuaagaacuagugacaugugaucugugucaaugaagaaaauguuaaauaccaucaccaaaaugaaaaauacuuuauucaguuuuuuaaaaguuaaaucacaaagaacugcugaauuuaaggccagaaaacaaaaaguaccaucauaucauuacguauguaggcaccaaaaguguuggggauucuucauauauagaauguuuaauuaaaauguuaugguauuuguaacagaaaaauauuugcuaacaaccagguaucuuuuuuuauucuacacauggguagcagggugaaacucagcucugugaaaggaaaaaagagauacugaaauccagucuugguuguaacuugguuauguggauuuggccaauucauuuaaccucuugugccagagaagucuccaucaauauuagaguauuggauuaaaccaucugcaagguacuuuccaguucuaugaaucuguaacuguaaauaagauauaaccuacaccacauuacgauauuaagaaauauuaaguuuaggaaacagcacaaauaacuaggacauaagcuuauaagcucugcuuuucucacuaccauuucacucaauguacuucuaucuccacucacgcaguuaucuuuuugaaaagaaauauaaagcauuccuaaaaaaaaaaaaaaaaaagaacaggcaggguuaaugucucacugacuuuccuuauugcaugauaccucucaccaacuaaaaaauuuguugauaauuuccaagaguggccuaucagaaaaugcuaccaagguaucccccacugcucaugcuaccauaacaauaagagauuauaaaauaucugaauggcaguuagcuuagccuccacuuacauucuucuaucuuuaccaguugaaaaggacagcagagaaaaacuaaaaggacucaggaauguuccucauguacgcaccgacuugcagcucaaacaacuuuuacuaaaacgcucuaaaacaguuaaaacugaaagaguguuaagaacuucaguaaaucaaaggacugaagaccaugccaaaugcgguugaucuacaggaucaaguuaguuaaaaaaggaaaccauuaugacauuucaucucagucaaauacuuuaaucuagacagugaauuuaaucuucaauuacccguuuuauguucuuuuauuaucaagcuaugccacuaaauuauaauuuggucuuauccauaaacucguuuugacuugcuucucucauuauuccuaagaagucaaaaagaaaaugacucaaaaacccaaggagugcauguguuuaaguuacuaagguaaaaaucacugauaacugacaauguugguguucaucaguaacuaaggcacuauuuuaaggaccuaagauuuuuccaucaaaaaucagguuuuuaaagauugaagccaauuuuuaaaauuaaaaucacuuagccgggugcgguggcucacgccuguaaucccagcacuuugggaggccgagacgggcagaucacaaggucaagagaucaagaccauccuggcuaacacagugaaaccccgucucuacuaaaaauagaaaaaaauuagccaggcguaguggugggcgccuguagucccagcuacucgggaggcugaagcaggagaauggcgugaacccgggaggcagagcuugcagugagccgagaucgcgccacugcacuccagccugggcgacagagcgagacuccguuucaaaaaaaaaaaaaaaaaaaaaaaaaaaaaauuaaaaucacuuaacuaaaaaagaaaguauuaucuauaccaaucaguuauuugaggaaguaauuuuguauuuaagaccaaccaugcugacaauuguccuuccugaacuaguauaccuacauaaaaauaacaugaagagggugacaauauaucuuugguuuguccagaagaguaaggguuuacacuuguacugaaguaaucaguaauauggcucucccuuucacucucaaaagugucccaguuuagauaauucauauggucuccuuaguuauaaucagcacuaaagggaucauuggucaauaaaaaacaaaaguuguaguuaacacuuuuccuccuauagucaaggggagaucagaagggaccuuuugucauuccagaaaaaaauuuuaaacaucaaacacaaauacuuccuuucucccaggaaguaacauguucaucaucauggaaacgccauuagacucucaaauguuauaaaagcaaaccaaccuguaguugcaaaauuauugcaagaaauccaccaaucuauguaaugcaccaagugcucucugccuacagauuauuugucucacagauauguaggugcuacugugacuaaugaaauuaaacucuuggauugguggccaggcgcgguggcucaggccuguaaucccuguacuuugggaggccaaggcgggcggaucaccugaggucagggguucaagaccagcuuggccaacauggugaaacuccaucucuaguaaaaauacaaaaguuagccaggcgugguggcacgugccuguaaucccagcuacucgggaggcugaggcaggagaaccgcuugaacccaggaggcggagguugcagugagccaagaucgugccaccgcacuccagccugggcgacagagcaaaacucguccugcccuccuaaccaaaaaacaaacaaacaaacaaacaaacaaacaaaaaaaaccaaaaaaaaaaaacccuuguguuggaacauuaaaauauaagaaaaucuagagcaaaaauaccaacuauauaugucaggagaaaaaccacaaguucauaaauauauucccccaauugagguauauuuaaaaaauaccucaauuggccagucgcgguggcucacgucuguaaucccagcacuuugggaggccaaggugggcagaucacaaggucaggaguucgagaccagccuggccaauauggugaaaccccaucuuuacuaaaaauacaaaaauuagccaggcgugguggagagcgccuguacucccagcuacuugggaggcugagguaagagaauugcuugaaaccaggagguggagguugcagugagccgagagugcaccacugcauuccagccugggcgacagagugagacuccgucucaaaaaaauaaaaaaauaaaaaauaaauaaauaaaaauaccucaauugauaaaaagagaaaugaauugcuggauuaucugggaaacuuucauguuugaggcugagaaaaaaaaaugaaagaaaaauagauacagaaguguuauuacuuucuuauauuggacaucagaacuucaauuuauuauguaaacuagauacuuucugaaaucaaugggccauagguuuuagaaaucuuuguguuaaagaaaaaccuguccaguucuaggcaguggcacaaaauucuaggcccucauugguuuggguuugacagaagacuuuuuauucucuaauuugucauccacucuaugguaaaugaagagaacaggaggcuggcuggugauuugcucuauuucuaauccaccauggccauggaaaaauuaauguacauauaauauaauuccauaaaugcagaugccucauuugaccuacuacuauauuaaggcucacuacauguucacuaaccucaaagauauccaaccagccuaguauuuccagaucauuuaauuauuaagcuauuucuuaaaaucauuucugauuuuaaauuaaguuuaucaaaugauauacaaggagcuauccauuuaacaucuaucaaugagcccauccaauuacagggccugugaaauagaacaauaaauauguguaaacaugcauaauagcugaaacaggaacguaacagacgaaaaggggggauugcuggauaaccuuuaaguauuaacaaaaguuucugaugcaacauaaccuacagacuuuuuacuacaaccuuucauuuucauugcauuuccuaucuaauuagacagcaaucaaacccagaaguauaacgucagacaggccugggauaaaaugagggcuccaccacuuaaagcuauuuaacugaggacaaauuauacuuaaccucuuuggguuuuugguuuccucuauaaaaguuaacauucucaugaggcucuguugugagaauuauaaaauaaugcauauaaagcacauggccuagcaccacaggccuucagcagaaguugguuaugaauuuaggcuaaguauccaucccaguuugucggggacaaucaagguuugcaccugcuguccaggaauuauuaauguuccuuuuguucuuaaaagugucuugguuaggcaauaaauuaugugguuacccuaaugaugaugauaauaauaaugaaaggagucaauaucaauuaaaaguaucauguaucaauuaugaauuuuugaaucuuaaaggaaaaaaaucaaccaccacacacaaaguaacguaaaauuauacucucguaagcuauucugauauuucauuuaguuauccaaugaacauuuaaauguuauuuuacuuauacucaugccauuccaacaaugauauaagacaacaaauuuuuuguuguuguuguucuauacagguauugguaaacuucagacauuauuuuaaagagucaaauucacagauaaagcacuggugaguuccagguauccagaaacauuacccuuuuaauucccagugaaaaguacccauucuuaucaugaagaauacccaacaccaucuaacaucuaucaaugagcccauccaauuacagggccugcaaaauagaacaauaaauauuuguaaacaugcauucuacacauaaaucaucaggagacgcaacaaaaaauaaauuaccugacuguuaugacauaguauugaaauacaauaaacuggauuuuaguuuucuucacucugcucuagaaaaaaaaagaauccauuauucuuccucuuuaaaaagauacacauuuucuuugaauuagacacaaccuaaaaaaaaaaauacagacacaccauaacccaaccuaauucaauauuaguauuagggcauuuggggagagcaagaaggucagaggggaccaggaguuagauaaaagaugucuucuaagacugagagacaauuuacguuuuauuauaagcuugcuuaaaauaagccuuuccuuaucagaccaguaauuauuuucagauucugauagucacuuucaaggacuuaucuggcacauuacacuagccuaagguaggaacuaaaguauuaaaauucaucagaacaucauggacuaaaaaaaucuuuguaacauuuuucaguaaguggaguguguccuaaaaucaaguuuuaaaaaguggauuggucuuucuagcuaccuaagcuauauuucuacaguuuagaaaagucauggggggggagggguuauaauugugccaguccuccagggaagauacaauguacuuaauggggugauaaguaguuacucugucuauaaucacgaagaaugaaagaaaugauuaguagcaguagguuuauuauuucuucccccuuucaaucaguccaaaacacugcgguuaauucugauucaggaaaugcgggcuccuuacuucuggcaaaaaaucauuguggggucuugcaaauggaagaugacaaucugauacaacugcuuccucuugccccaaaaugaaaaaaaaaaugaccucaauaacaagacugcuaggccucagauucccagacuaaccuguggaauaaguauggugaaacugucuagggaaggaacguggcugucuccuccaucuugaaauuaaucagcauaagggaaaaagggaccgaguauucaggaagcagaagcccaaccgguuaauacuaguuacuaagcuauggcaugcguggcagguaccgucugcagaagcagagaccccccuaggcuuuuuuuuuuuuuuuuaaugggggagggauugaguuguugguggauuaaacacaaauuaacuugaaaauuuggcccaauuccaucccuuauccaggagaacacaacaaacaccuaacggcuuuucccucucuuuugcggggggauccuuccagugauaccuggcaaaggauaugccaggguuauucgagcaagggaguaaaccacauuugccucagauccucagggaagaugucaucgcggccccagggggcgccuaauugguaauacccugcagaagggcucaaaaugagguuuuggaaaucuaaaggcccaagaguugccagcaucucacuuggggcagccugauuuuuuacuucccuuuucccaaacccaagcccgccauggaaaacgcggggaggucagggaagccuccagagaacagagaagaaaaagccugagacguucuaagauucugacgccugaggccaaaacucaaaaacugccucccccgauuuccuaaggcuccggagggccugggcugcagcucgcgcggccaccgagaggaaguacuacccaccuccuuccccuucaaagagccugucgacuauaccacucaacuaaaauggcagcggcgacuacgccacggagccccccgcagcaacgggccugggguccggaggcggcgcugagccucugccacgacgcgucacucgggccauuuugagagaacgcggcagccgcggcuccgcugucuuccucucgcucuacaucauuucucacaggauucccaagucuucacuuacuagguuuuagggucaggauccgacucgguugguucggccgccgccgccgaggcugcuccgcaccucccuggccgccgcucucaagcccgccuccaaugaguagcugguugagacccgccucuagcccagcgccugcucggagacguugcucaggcagccauuaucuuccccauuguuaccaagcagcgacaggaaacgacugcccac

SEQ ID NO: 19122 - RNA, 7178 nt, Homo sapiens
ggacaagaaaaaugucuccugcgagagcaaacaguacaagcacaguuagaggugucaacuacaagacaaagugagaacucaucagacccuggggucaaaaugccaagcucauuagauagugcccuucauuagauauugcccuaccucuccccaacuccaccccaccugucuuaauaagcagcaggcaagaugagaaagguaaacugugaagagucccucugacaagaggucagugaacaaaaccugacaugucagaagcccaucaaguucugacuucugccauauagguagcccaaguuuucacuacaaccaccaaugguagaacugugcacucuggacccugacccagccaaaauggaccacuuucuccuucagagauccauaaagauagcuuacucuccuggaacagagaaggggagagauggagcaaaggaaggauggaggaaaaaaagaggguaagacauaugaauaugugugcaggguuugcauguguguguauacaaauauaugaaaaugagucuagcggccgggcacaguggcucaccugaggucaagaguucgagacgagccugaccaacauggugaaaccccgucucuacuaaaaacacaaaaauuagccgggcgugguggcagacgccuguaaucccagcuacuugggaggcugaggcaggagaauugcuugaacccaggaggcggagguugcagugagccgagauugcaccacugcgcuccagccugggggacagcgcgacacucugucucaaaaaaaaaagaaaagaaaaugagacuaggcuugauggcucaugccuguaaucccagcacuuugggaggccauggcagauggaucacuugagcccagcaguuugagaccagccugggcaucauagugagacccugucucuuuuuuuuuuuuuuugagacagagucuugcucugucacccaggcugcaguacuguggcccaaucuuggcucacugcaaccuccaccucuuggguucaagcaauucucaugccucagccucccagguagcugggauuacaggugcccacgaugggguuucgccauguuggccaggcuggucucaaacuccuggccucaagugauccacccgccucagccucccaaauugcugggauuauaggugugagccacggugcccagcugaccccaucucuuaaaaaaugaauaaauaaauacaggggaaaagcauaaaagauuuaaaaaaaaaaaaagaaaaagaaaaugagauaaagauguuccaagguuuauucccuacagucaauaauccuuaagcucagaauuagcucucaccuuuccggaugggucgauacgcuuccaggaaguacggcuuaagguauaccucgaagagauuaccaguaaugccuuccacugugucaucaaugggcagcacauggauacguuugccguacuucacaucagggcauggcuggaugcugaggaugacaagcagacuccauauuaccaaccacacuucgggcccaagcacuggguguccaaaagggccuggcacagauagcugauaguaagugaaaaagaaaaggcaggauggcuuuaggcgaagagaggaaggagaacaggguggaagugagggcgaaggaacagccccacucacuccuaaucagugagccaaaaucaagagccacacauuuagaaaccccacaaagacaugcagggucuucagggagauauccaaggaugauccccuucuagcuaauacuggugacccaauauuacaagggaaggucuuaagcuaacaauugucagggucagugaaacagaagugaaaaaaacaaaauuaucucagccagguggucagaacaccuugaggaagugacuaagcacucccaagaagaaagcuacaugaaacuuagacuccauucaaaagaaucaaaagccugagaugauccuggccaggugaugguugguuggguaggaguggcuagagaugacuccaagaugggguaaccucuugccuaaaauuaugcaagaacaagcaaaaucacucacauugagagcuaucccaggucuggcuccaacuauuccucucucccggguuaacuuaggggcuuaaaagaccugcuagcagcucaccuuccaugcccauacccccaccucauuccaaccccaacacaagccaucaauuagacauacuagugagaguagugaggagauuauuuggcauauacauacacacccucgagugguauccuaagccaggauauaaguaugauaaauuacaccucuaguaggaaaaaauaaagccaucaagaaaguuacaggaacgccaauuugucucaagggaccugcagaaauggauuuugaagucccagggaggcagaaccaaaaccuaaagacaacccugaagcauaagucuucccaugaccaggaggcuuccugcaucgacaggugccaagaacuugguccugccuguaauacauggguccugccuguaaugcaggcuaucucuggccucccaucccugugaagccaaaaaccccacacacaccugaugacauccccuaggcguacacgaagguuauuccgaacaacucuauucauccgaaucuucucaucagaacaaguaucaucagaaaggacgaugcaaacagcuucucgucucuucuuuccuuucagcaacacugugucaccucggaacaacugcaauucauccaucuugggcugaggaaagaaaguuaaggccuuugggucauugggcugacggggaguaagcagcagcccuggagauugggauucccaguaaaccccacucuaucugcagucacugcaagaaaaaugagaaaagaaaccugggaaaaucccucaaguaagugcaguaaggaaagacuagucuguggccacagcuuaccugggacaaggacaccacacuguuguccucauugauggcuucaucaacaauuaaccgauugggacgguucuucuguuugagaauggcuguugauaggucaucaccuuuugaacuagaaggaggaaauggagucaguagauacuccugccccaagcgccucgccagucucuaaaacucauacuuaggaaagaaacagugaauagaugaagcugucccuagaccagaaagcucagaugaaggaaaggcagccaaggucacgaggagcaguaucuaccauacauauuacaauacccauuccagcagcuccugguauuuugagcgucagugucccagcuauaaggccccaagugagugauccugccccagggucagaaaauaauggccuaagaagaagacauaauagaaauggaggcugaauaguuguuagagaaauaaaaauagucuuagacuuacagaagagugguuaagagcaggaacucuauagucagacccauugggucugaauuccaauuaugccacugcuuaauugugaucuugggcaaguuaccuaaccucugaacuuugauguccuccucuauaaaagaaggaauauaauacuuaucucagaggcuuauugucuuaagggagauaaugaauguaaaaugcuuaacauaauaccuggcacaugguauuaauggucaccaugauuaacaguauagaguaaagcauaagcuaacuuuccagggaauuaaguaagccagacaaccucccuugaggcucagggaggccuuaaguucuaccaagcaagccuggggacaacgaagcagaaucauuggugcuacccuccuuauaggcuaaaccuacugaugccagggcauuccauaguaccaaaggaaugccaagcauaaagaccaucauauuuggaaaaaacacuaacagacaucaaaccgccagaaagaggcucaaggucaaaaggaacuucacaguaauaucugcaaaaguacacaauuccauaaaguuggcucaaaaaaucaaaaccaagaaaugcugagacauggggcaaauccaaaucccucucacccaaaucaaagucgacugggucuacacucaguguuauuuccuagaagcuaggaucauucaccagacagugacaccaacuuauuaccuagcccguuuccagcugucacuuacuagacucagcaagcucccucucccuuuuuuuuuuuuuuuuuuuuuuuuugagauggaguuucgcuuuuguuguccaggcuggaaugcaaugcugcgaucucagcuaacugcaaccuccaccucccggguucaagugauucuccugccucagccucccgaguagcugggauuacaggcaugcgccaccacaccuggcuaauuuugcauuuuuacuagagaugggguuucaccaugguggucaggcuggucucgaacuccugaccucaggugaucugcccaccucggccucccaaaguacugggauuacaggcgugagccacagcacccagcgcucucucuuuuuuaagagcggccucguguuaguaaggcucaggaaaacauaagcauuaaccaaaguaggaaggccagacaaugaaggaagcaaagaaaauaaauuuuuaaaacgaauuucuucauucaacaaauucaugagucucuauuauguaccaggcauuguucuaagggcuggggauacugaagucaacaaaacaagacaaaauaguauucccauuggaaauauccucacaauuugcaagagacaaagaaaaaugcugugcucagcuaggaagccaugggguucuuacaucuuuggguccugauacacccaagagaaaaacaaaccccauucaucuaacaaaaugguaggccuucugcuaacccucacacauaggcugcauuuuuaaccacugccucuaaacuaguuucuaacgacaguuuccucugcucaaauuugcuucccccauuccaaaagucugccacuccaggcacaaugcugcugaguaggcagacucuuccaaugcuuaucaacacacuagaggccaagcaugcucaaugugacaguugagagcaauguaaacccacgagcucucccacuccugucccaucaaaauacucuuccagggacugcccaucuucuugcuugacuuauagaacugggacuggagaaaaauaaaacgccagaugccucuagucaccauaguuuuuuauuuuuugaaacggagucucccucuguugcccaggcuggagugcaguggcgcgaucucccucacugcaaucucugccucccuggguucaagugauucuccugucucagccuccagaguggcugggacuacaggugugcaccaucaccaugccuggcuacuuuuugcauuuuaauagagaugggguuucuccauguugcccgggcuggucucaaacuccugaccucaagugaucugccugccucggccucccaaaaugcugggauuacaggccugagccacugugcccggucaauaguuuguauuuuaaucucaaagcuguauccuaggaaaaccuccauucugccuaccaucccggacucuggcucuggagaugagugguaugcccuuuucuuaagguaaagccucuaauuccccaucuaccuacugagaucagaugugguaaucucuaaaagacugaauuuggccugaccaugggccaacagcaguucuggacacucuuuggggcaauccuccauugucuucuguauaagucaaucccuuuccagaacugcacaggggacuccacgggacuuggaaggguuucagcuaagagucaucaaggugaccaagagguuagaaacagcugaugaugccagguuccaagaauuuuagauuuuuacuuuugaaaauaagaggcugacugcauauaaaccaaaagaauacuuucagaauaagugacucuuuuaaauaagcaacugaguaauacuuuauccgaauucagaaacuugagaaaaaggaacacaccucaaaaaacuaaucucuucaaggaaggaagguaauuugcauagaguuuccuugggcuggcuguguuuuuuuuuuuuuuuuuuuuuuuuuuuuugccucuaaaagcucucuauucuaaauugaaugggcugagguagccaaguuuuaucuaacgcuuuccuaaggauggagguggggucagaaagccccagagcccggguaauuucucaauauagcugguuggggaaaggagugcgcgcacguuuguguuuuugaagaguuagugcaacucuaaacugcacaccacgaaaccuggaaaucuggaaaggcgcacaaaacacgaacugagauuccaacuuuagcaagaaccuaaaauguuaaagaaaaauuccuuucuccccacccacgagucauaacauuaaggaaaacuggcucaaacuuucuaguaugaacaacaggccuaaaguaagaagaccagaagcgaaagguagggcucgcccucucccuaacaguccuucacgacucaggucacacacagaggaugcccaccuccggccccgccgacccggcuccaaaaaggcggcugugagcuucccugagcucggcgggccuuccccgaccccgggcuccgccucgguggcagagcuccugaggccuucacauggcgcaaaguccacgcccaccgggcccggcuggggccucgggcucgcggggccugcucucuccggggaccaaaggcuuucggcgggugguaggccggacggcagacuggcgccccaaagccccggggcgccgcgccggcggagugggccggaagaccuggccaggcccagacguccguucuaagggagccaaucgggcgggccggggccugcaugacacagcacgauccggcccaggcuccgacccggacccaacgcaagccccgccuagggggcgcgcgggugcgcagcuggccccagccgggccugccggguccacggccccucacucgcccccuagcuucccuucccucuuuccuggucuccaccucucugacgcgcccacggccaggccccgccgggccuacccugcgcggcuggucccggugcgcgccgccgcagcaagcgaacggcgcgcgcacacucacucggcuccagaagccauggcgcgcgccucucccggccggcggcuguggcggcccgcggguaacggcuacgagcgguggcaagcgaccgacugggccggggcucggcucuuccaggcggugggcgagcagcggcgacaaacccgcaagcggcuucccucucgcuuccucccaccggcagcgaggcgucgggcgaacaacgcuggcu

SEQ ID NO: 19123 - RNA, 7178 nt, Homo sapiens
agccagcguuguucgcccgacgccucgcugccggugggaggaagcgagagggaagccgcuugcggguuugucgccgcugcucgcccaccgccuggaagagccgagccccggcccagucggucgcuugccaccgcucguagccguuacccgcgggccgccacagccgccggccgggagaggcgcgcgccauggcuucuggagccgagugagugugcgcgcgccguucgcuugcugcggcggcgcgcaccgggaccagccgcgcaggguaggcccggcggggccuggccgugggcgcgucagagagguggagaccaggaaagagggaagggaagcuagggggcgagugaggggccguggacccggcaggcccggcuggggccagcugcgcacccgcgcgcccccuaggcggggcuugcguuggguccgggucggagccugggccggaucgugcugugucaugcaggccccggcccgcccgauuggcucccuuagaacggacgucugggccuggccaggucuuccggcccacuccgccggcgcggcgccccggggcuuuggggcgccagucugccguccggccuaccacccgccgaaagccuuugguccccggagagagcaggccccgcgagcccgaggccccagccgggcccggugggcguggacuuugcgccaugugaaggccucaggagcucugccaccgaggcggagcccggggucggggaaggcccgccgagcucagggaagcucacagccgccuuuuuggagccgggucggcggggccggaggugggcauccucugugugugaccugagucgugaaggacuguuagggagagggcgagcccuaccuuucgcuucuggucuucuuacuuuaggccuguuguucauacuagaaaguuugagccaguuuuccuuaauguuaugacucguggguggggagaaaggaauuuuucuuuaacauuuuagguucuugcuaaaguuggaaucucaguucguguuuugugcgccuuuccagauuuccagguuucguggugugcaguuuagaguugcacuaacucuucaaaaacacaaacgugcgcgcacuccuuuccccaaccagcuauauugagaaauuacccgggcucuggggcuuucugaccccaccuccauccuuaggaaagcguuagauaaaacuuggcuaccucagcccauucaauuuagaauagagagcuuuuagaggcaaaaaaaaaaaaaaaaaaaaaaaaaaaaacacagccagcccaaggaaacucuaugcaaauuaccuuccuuccuugaagagauuaguuuuuugagguguguuccuuuuucucaaguuucugaauucggauaaaguauuacucaguugcuuauuuaaaagagucacuuauucugaaaguauucuuuugguuuauaugcagucagccucuuauuuucaaaaguaaaaaucuaaaauucuuggaaccuggcaucaucagcuguuucuaaccucuuggucaccuugaugacucuuagcugaaacccuuccaagucccguggaguccccugugcaguucuggaaagggauugacuuauacagaagacaauggaggauugccccaaagaguguccagaacugcuguuggcccauggucaggccaaauucagucuuuuagagauuaccacaucugaucucaguagguagauggggaauuagaggcuuuaccuuaagaaaagggcauaccacucaucuccagagccagaguccgggaugguaggcagaauggagguuuuccuaggauacagcuuugagauuaaaauacaaacuauugaccgggcacaguggcucaggccuguaaucccagcauuuugggaggccgaggcaggcagaucacuugaggucaggaguuugagaccagcccgggcaacauggagaaaccccaucucuauuaaaaugcaaaaaguagccaggcauggugauggugcacaccuguagucccagccacucuggaggcugagacaggagaaucacuugaacccagggaggcagagauugcagugagggagaucgcgccacugcacuccagccugggcaacagagggagacuccguuucaaaaaauaaaaaacuauggugacuagaggcaucuggcguuuuauuuuucuccagucccaguucuauaagucaagcaagaagaugggcagucccuggaagaguauuuugaugggacaggagugggagagcucguggguuuacauugcucucaacugucacauugagcaugcuuggccucuaguguguugauaagcauuggaagagucugccuacucagcagcauugugccuggaguggcagacuuuuggaaugggggaagcaaauuugagcagaggaaacugucguuagaaacuaguuuagaggcagugguuaaaaaugcagccuaugugugaggguuagcagaaggccuaccauuuuguuagaugaaugggguuuguuuuucucuuggguguaucaggacccaaagauguaagaaccccauggcuuccuagcugagcacagcauuuuucuuugucucuugcaaauugugaggauauuuccaaugggaauacuauuuugucuuguuuuguugacuucaguauccccagcccuuagaacaaugccugguacauaauagagacucaugaauuuguugaaugaagaaauucguuuuaaaaauuuauuuucuuugcuuccuucauugucuggccuuccuacuuugguuaaugcuuauguuuuccugagccuuacuaacacgaggccgcucuuaaaaaagagagagcgcugggugcuguggcucacgccuguaaucccaguacuuugggaggccgaggugggcagaucaccugaggucaggaguucgagaccagccugaccaccauggugaaaccccaucucuaguaaaaaugcaaaauuagccaggugugguggcgcaugccuguaaucccagcuacucgggaggcugaggcaggagaaucacuugaacccgggagguggagguugcaguuagcugagaucgcagcauugcauuccagccuggacaacaaaagcgaaacuccaucucaaaaaaaaaaaaaaaaaaaaaaaaagggagagggagcuugcugagucuaguaagugacagcuggaaacgggcuagguaauaaguuggugucacugucuggugaaugauccuagcuucuaggaaauaacacugaguguagacccagucgacuuugauuugggugagagggauuuggauuugccccaugucucagcauuucuugguuuugauuuuuugagccaacuuuauggaauuguguacuuuugcagauauuacugugaaguuccuuuugaccuugagccucuuucuggcgguuugaugucuguuaguguuuuuuccaaauaugauggucuuuaugcuuggcauuccuuugguacuauggaaugcccuggcaucaguagguuuagccuauaaggaggguagcaccaaugauucugcuucguuguccccaggcuugcuugguagaacuuaaggccucccugagccucaagggagguugucuggcuuacuuaauucccuggaaaguuagcuuaugcuuuacucuauacuguuaaucauggugaccauuaauaccaugugccagguauuauguuaagcauuuuacauucauuaucucccuuaagacaauaagccucugagauaaguauuauauuccuucuuuuauagaggaggacaucaaaguucagagguuagguaacuugcccaagaucacaauuaagcaguggcauaauuggaauucagacccaaugggucugacuauagaguuccugcucuuaaccacucuucuguaagucuaagacuauuuuuauuucucuaacaacuauucagccuccauuucuauuaugucuucuucuuaggccauuauuuucugacccuggggcaggaucacucacuuggggccuuauagcugggacacugacgcucaaaauaccaggagcugcuggaauggguauuguaauauguaugguagauacugcuccucgugaccuuggcugccuuuccuucaucugagcuuucuggucuagggacagcuucaucuauucacuguuucuuuccuaaguaugaguuuuagagacuggcgaggcgcuuggggcaggaguaucuacugacuccauuuccuccuucuaguucaaaaggugaugaccuaucaacagccauucucaaacagaagaaccgucccaaucgguuaauuguugaugaagccaucaaugaggacaacagugugguguccuugucccagguaagcuguggccacagacuagucuuuccuuacugcacuuacuugagggauuuucccagguuucuuuucucauuuuucuugcagugacugcagauagagugggguuuacugggaaucccaaucuccagggcugcugcuuacuccccgucagcccaaugacccaaaggccuuaacuuucuuuccucagcccaagauggaugaauugcaguuguuccgaggugacacaguguugcugaaaggaaagaagagacgagaagcuguuugcaucguccuuucugaugauacuuguucugaugagaagauucggaugaauagaguuguucggaauaaccuucguguacgccuaggggaugucaucaggugugugugggguuuuuggcuucacagggaugggaggccagagauagccugcauuacaggcaggacccauguauuacaggcaggaccaaguucuuggcaccugucgaugcaggaagccuccuggucaugggaagacuuaugcuucaggguugucuuuagguuuugguucugccucccugggacuucaaaauccauuucugcaggucccuugagacaaauuggcguuccuguaacuuucuugauggcuuuauuuuuuccuacuagagguguaauuuaucauacuuauauccuggcuuaggauaccacucgaggguguguauguauaugccaaauaaucuccucacuacucucacuaguaugucuaauugauggcuuguguugggguuggaaugagguggggguaugggcauggaaggugagcugcuagcaggucuuuuaagccccuaaguuaacccgggagagaggaauaguuggagccagaccugggauagcucucaaugugagugauuuugcuuguucuugcauaauuuuaggcaagagguuaccccaucuuggagucaucucuagccacuccuacccaaccaaccaucaccuggccaggaucaucucaggcuuuugauucuuuugaauggagucuaaguuucauguagcuuucuucuugggagugcuuagucacuuccucaagguguucugaccaccuggcugagauaauuuuguuuuuuucacuucuguuucacugacccugacaauuguuagcuuaagaccuucccuuguaauauugggucaccaguauuagcuagaaggggaucauccuuggauaucucccugaagacccugcaugucuuugugggguuucuaaauguguggcucuugauuuuggcucacugauuaggagugaguggggcuguuccuucgcccucacuuccacccuguucuccuuccucucuucgccuaaagccauccugccuuuucuuuuucacuuacuaucagcuaucugugccaggcccuuuuggacacccagugcuugggcccgaagugugguugguaauauggagucugcuugucauccucagcauccagccaugcccugaugugaaguacggcaaacguauccaugugcugcccauugaugacacaguggaaggcauuacugguaaucucuucgagguauaccuuaagccguacuuccuggaagcguaucgacccauccggaaaggugagagcuaauucugagcuuaaggauuauugacuguagggaauaaaccuuggaacaucuuuaucucauuuucuuuuucuuuuuuuuuuuuuaaaucuuuuaugcuuuuccccuguauuuauuuauucauuuuuuaagagauggggucagcugggcaccguggcucacaccuauaaucccagcaauuugggaggcugaggcggguggaucacuugaggccaggaguuugagaccagccuggccaacauggcgaaaccccaucgugggcaccuguaaucccagcuaccugggaggcugaggcaugagaauugcuugaacccaagagguggagguugcagugagccaagauugggccacaguacugcagccugggugacagagcaagacucugucucaaaaaaaaaaaaaaagagacagggucucacuaugaugcccaggcuggucucaaacugcugggcucaagugauccaucugccauggccucccaaagugcugggauuacaggcaugagccaucaagccuagucucauuuucuuuucuuuuuuuuuugagacagagugucgcgcugucccccaggcuggagcgcaguggugcaaucucggcucacugcaaccuccgccuccuggguucaagcaauucuccugccucagccucccaaguagcugggauuacaggcgucugccaccacgcccggcuaauuuuuguguuuuuaguagagacgggguuucaccauguuggucaggcucgucucgaacucuugaccucaggugagccacugugcccggccgcuagacucauuuucauauauuuguauacacacacaugcaaacccugcacacauauucauaugucuuacccucuuuuuuuccuccauccuuccuuugcuccaucucuccccuucucuguuccaggagaguaagcuaucuuuauggaucucugaaggagaaagugguccauuuuggcugggucaggguccagagugcacaguucuaccauuggugguuguagugaaaacuugggcuaccuauauggcagaagucagaacuugaugggcuucugacaugucagguuuuguucacugaccucuugucagagggacucuucacaguuuaccuuucucaucuugccugcugcuuauuaagacaggugggguggaguuggggagagguagggcaauaucuaaugaagggcacuaucuaaugagcuuggcauuuugaccccagggucugaugaguucucacuuugucuuguaguugacaccucuaacugugcuuguacuguuugcucucgcaggagacauuuuucuugucc

SEQ ID NO: 19124 - RNA, 855 nt, Homo sapiens
ucagacuuacuaguccaaaguaccucuucauaagaaguccauaauuauuugucucuuuugugugaaaaguuggagaaugcagcagugaauauaaaauugcaacugcauuauugucuccgggguuucagguaacauuuacaacuggaaaugcaguuuccuagauaacuguaaacauauuuugacauuuuguuugauaauaguggugacaaaagaauauaagccugucuuuaaacauggucuucucuccauacauuucacuuuaccacccuucagccaaccuaagcgauuuuucaagaauuagggacgcugcaaaaaccaaagcgaagagcuagaaagagugacaaaauuaguaaagaugucuguagucucucugugugugugugugugugugugugugugagacugucccacgagcaacagaccaaaggaaaacugccccaagguuugcgcaacagagaacaaucagcaaaguuaaaguccuuacaggacagaaaagcaguaaaucuuacagcugaagccuccucccaggggaaauuaacgucuguaguuuaaucuuuccuuaauucagaagggagugaagauaagaauaugcauagggaaaauggagagaggggagcgugacauugaguuggaggagguaagagaguauuaugagagacaagaugggguugacagauuuagcagauacaauauuugggacacacgcacgaagagaugauucguuguuuauguaaaauugaaacuuaacuagguaggcauccuguauuucaucuggcaacuccaggaaaagagaaaaauacaguguuacuccaauauucccgguuguguaaggaaaacaaucaaagcucggcccua

SEQ ID NO: 19125 - RNA, 35470 nt, Homo sapiens
agaaugucuccuggaauuuuacauucccauuaauguccucauucaguuggcagaccuaggauguaugguuaacucucaggccauuauguuuuucauggcucauuucccaaacugcauuguugguaggugccuugcuaagcuguaaugcagugaagaagaugguggggcauuuuuaguaauuggaacuguaacauuaauuuacaagauugaaccggggaugucuggaugcugacaagggagagccaaguacuguuaaugccaucaauccucuaggaaggaauuggugguuuuucugaagugugggggaaagggugguuucuugcuggauuucauggccaguaaguaaauuuaaaugcuucauuuuuaauuuggauguuucugcuagagaccuuugauuuggaaauuaguuauuuugcauguuugucaacuguauauguaugaaaauagaaaaaaaccaugcuuuuuguaaaaaccccuaagauuuguauauguucaucuuuaggcuucugaaagggagagaaaucauauuggaaaucaguguugguguucugaaaucugcuuguaaaacucucaucucauuuuacauugauauuaaaacauuuuaacaguguuggcuagcugauuacuugauuaauuauacucccauggccccauaggaagcuguugugggccucuguucaaaagcacagaaaagagcagaaggaaaugucuuagaaagaaucaaagcugaugaaaucagcaaagauugggggaaaggaaggaagccugguguagauuggauuauauuuuuccuuuggggacuagaauacuagaagaacuucaguauauuuuucccuuuauuuuugaauacugucauauaauaaauugagauuaauaaauuacucauauuacaguucuuccauggcaaauguugcuuucaaguuguuacugaaauucucaucuauacuugucaguuaacugucuugauacaguguggauuuuguuuacuccugacuagcagaaguuauaacuaaagcccguuaaagcuagaauuucuaucucccucucccagcacagaugugaaccagcaaauuuagauggagaacagauaugcuugagauuggugcaucaaacuaguugaaaagaugaugccuaccacuauaggaguuaaugcuucuaaauuauugcuuauguuagggcuucaguauuucauuugaggugacuuuccaaaacagcagacaaauuuauauucaaguguagauauaaaaccauauuuuaagcaaauuauuuuuguauuaccagccauuuagauuuaacaugucuuuguuccucgauugauauuuaguugacuacauuugguucccacaugaagggccuagaaugagcaguaggaaguauucaaugaggucauagucgccccugauauuugucuucuaucccucucuagauuucaagaaaauuauaccuauggguuuugaaguuugggucuuuuuagcaaaugaggcauuauuuguaggguuaaucacuugcaggacucugagcgugggacauuuuuuaaguauucuaaauuuaacacaagauuaacagacuauugaaaacaacauuguuuuuaaguaauaugaacuucagaguaguauaaacuuuguauauuccuugcugaagaacacacccuagcacaauaaaaagaacaguccaaucguauaugcagugguucucaaaacuugaaugugcaucagaaucaccuagagggccacagauugcuguggccuaacaaguucccacgagaugcuaacauuguuuuggagaccauauuuugauuuaagacauuucuuuuauaauagaagcauuuaauguuauaaguuuuccuauaaauauugauuuagcuguaccucacaaauuuugauauagaauguuucauuuucauuuauauuaaaauaauugcucauuuuucauuucuucuuugacccaggguuauuuagaaacaugucauuuaauuuccaaauaugggauuuuccagauuucuuucuguuauugcuuucuaauuuaaucccacuguggugagagaauauacuucuuauuauuugaauccuuuuaaauuuauggagacuuguuuuauggcccagaauauagucucuucugguaaaucuuccaugggugcuugaaaacuauguuuuauccugccauuuuuggauagaguguucuaugucaauuagguuaaguugguugauaguguuguucaagucuacuuuacugauuuucucuuuuuucaucugcuccuucugaggcaacuuuauugacuuucugucuacuuauucuaucaguuguugggagagaucgaugaaaucucugacuaaaauuuauauuuguuuguuucuccuuucaguuuuaucaguuuuugcuuuauguauuuugaagcuuuguuguuaggaguguaaacuuuuaggauuguuauguucucuugauaagcugacucauuaucaugaaauauucccuuuuaucccuguuauucuucugaaaucuacuuugccugauguuaauguaaauauucuggcuuucuuuugaauaauacuaacauggcauaucuuuguucauccuuuuacuuuuuuuuuuuuugagauggagucucauucacucugucacccaugcuggagugcaauggcgugaucuuggcucacugcaaccucugccuccuggguucaagugaugcuccugucucagccucccaaguagcugggacuacagacguauacugcuaugccuggauaauuuguauauucuuaguggagacgggguuucaccacauuggccaggcuggacucgaacuccugacaucaagugaucugcccgccucaacuuuucaaagugcuggcauuacaggugugagccaccaugccuggccucauccuuuuacuuuuaacuuaugugugggguuuuuuugagacagggucucaguccaucaccccggccggaaugcaauggcaugaucauagcucacuguaaccuugaacuccuagguuaaagugauccuccugccccagccucccaaguagccaggacuacaggcaugcgucacuacaccuggcuaauuuuuaauuuuucuguagagauggggucuugcuauguugcccaggcugaucuugaacucuuggcaucaagggauccucccacuuuagccucccaaagccaugagaucacauguuugagccaucacacccagcccuauuuguguuuuuauagauuuuuuaaauuaaacauuucaaaauuuuauuucuagagacagagucuugcaauauugcccauguuggacuucaacuccuauuuccugaguagcugggaugacaagcaugugccaccacaccugaauuguuuuuauauuuaaucuggguuucuuauagguaaccuagaguugggccuugcuuuauuuuuccaauuugacagucucugccuucuaaucaggauguuuagaccauuuuuauuuaaugugauuauugauaugauugguuuaaaaucuaccaucuugcuauuugccuucuauuuguucauuauucacuuuuuccucuuuuucuaccuucuuuugcauuauuauuuauuauuccauuuuauccauuuggauuauauuagaugcaauacuuucuucuuuuagugguuccuuuaggguuuauaguauauaacuuuaauuuaucacagcccacuucaagcguaagauaagaacuucauguacuucuauucccccacucgagucuguucccuauuauugucauguuuuacuucuacacauguuaaaccuuauaauacauuguggguuuuuguuuguuuuugauacuuuuaaagugauauaaaaagaaauaagaaaaaagguauuuucauuuuuuuaaauauacuuuaaguucugggauacaugugcagaacgugcagguuuguuacauagguauacaugugccaugguggauugcugcacccaucaaccugucaucuagguuuugaaccccacaugcauuagauauuuguccuaauacuauccuuccccuugcuccccaugccccaacuggcccagugugugauguuacccucccuuuguccauguauucucauuguuuaacucccacuugugagugagaacauguggugucugguuuucuguuccuguguuaguuugcugagaaugauggcuucauccgugucccugcaaaggacaugaauucauucuuuuuuauggcugcauaguauuccaugguguauaugugccacauuuucuuuauccagucuaucauugaugggcauuuggguugguuccaagucuuugcuauuguaaauagugcugcaauaaacauacgugugcaugugucuuuauaguagcaugauuuauaaucuuugggauauacccaguaaugggauugugggucaaaugguauuucugguucuagauccuugaggaaucgccacacugucuuccacaaugguugaacuacuuuacacucccaccaacaguguaaaagcauuccuauuucugcacauccucuccagcaucuguuguuuccugaguuuuuaaugauugccauucuaauuggugugagaugguaucucauugugguuuugauuugcauuucuguaaugaccagugaugaugagcuuuuuuuccaauguuugcugguugcauaaaugucuucuuuugagaagugucuguucauauccuucacccacuuuuugauggggcuguuuuuuucuuguaaauuuguuuaaguuccuuguagauucuggauauuagacauuugucagauagauagauugcaaaaauuuuugcccauucaaaagguagccuguucacucuaaugauaguuuuuuguuuuuuuuuuucugugcagaagcucuuuaguuuaauuagaucccauuugucaauuuuggcuuuuguugccauugcuuuuggcauuuuagucauuaagucuuugcccacgcguauguccugaaugguauuaccuagguuuucuucuaggguuucuaugguuuuaggucuuacauuuuagucuuugauccaucuugaguuaauuuuuauaugagguguaaggaacggguccaguuucaguuuucugcauaugguuagccaguuuuccuaacaccauuuauuaaauagggaauccauuccccauugcuuguuuuucucagguuugucaaagaucugaugguuguaguugugugguauuauuucugaagucucuguucuguuccauuggucuauauaucuguuuugguaccaguaccaugcuguuuugguuacuguagccuuguaguauaguuugaagucagguagggugaugcuuccagcuuuguucuuuuugguuaggauugucuuggcuauacaggcucuuuuuugguuccauaugaaauuuaguuuuuucuaauucugugaagaaagucaaugguagcuugaaggggauagcauugaaucuauaaauuacuuuggguaguauggccauuuucacaauauugauuccuccgauccaugagcauggaauguucuuccauuuguuuguguccucucuuauuuccaugagcagugguuuguaguucuccuugaggaaguccucuacgucccuuuaaguuguauuccuagguauuuuauucucuuuguagcaacugcgaaugggaguucacucaugauuuggcucucuguuugucuauuauugguguauaggaaugcuugugauuuuugcacauugauuuuguguccugagacuuugcugaaguugcuuaucagcuuaaggagauuuugggcugagacaaugggguuuucugaauauacagucaugucaucugcaaacagaaagaauuugacuuccucuguucauauuugaauacccuuuguuucuuucuuuugccugauugcccuggccggaacuuccaauacuauguugaauaggaguggugagauagggcauccuugacuugugccaguuuucgaagagaaugcuuccagcuuuugcccauucaguaugauauuggcuguggguuugucauaaauagcuccuauuauuuugagauauguucuaucaauaccuaguuuauugaguguuuuuaacaugaagauguguugaauuuuauugaaguccuuuucugcaucuauugagaaaaucaugugguuuuuguuguugguuuuguuuaugggacggauuacguuuauugauuaguguauguugaaccagccuugcaucccagggaugaugcccacuugaucaugguggauaagcuuuuugaugugauacuggauuugguuugucaguauuuuauugaggauuuuuguuucaauguucuucagggauauuugccugaaauuuucuuuuuuuuguugugucucugccagucuuugguaucaggaugaugcuggccucauaaaaugaguuagggaggagucccucuuuuucuauuguuuggaauaguuucagaaggaaugguagcagcucuucuuuguaccgcugguagaauucgacugugaauccaucugguccugggcuuuguuuuugguugguaggcuauuaauuacugccucaauuucagaacuuguuauugguauauucagggauucgacuucuuccugguguagucuugggaggguguauguguccaggaauuuuuccauuuuuuucuagauuuucuaguuuauuuguguagagauguuuauaguguucucugaugguaguguguuuuucuguggugucaguggugauauccccuuuaucauuuuuuuauugugucuauuugauucuucucucuuuucuucuuuguuagucuggcuagcagucuauuuuuuuaaucuuuucaaaaaaccagcuccuggauacauuuuuuuugaaccguuuuucccgucucuaucuccuucaguucugcccugaucuuaguuauuucuugucuucugcuagcuuuugaauuuguuugcccuugcuucucuaggucuuuuuauugugacguuaggguguugauuuuagaucuuuucuguuuucuccugugggcauuuaguuguauaaauuucccucuaaacacugcuuuagcuguaucccagagauucugguauguugugucuuuguucucauugguuucaaauaacuuauuuauuucugccuuauuuucguuauuugcccaguacccauucaggagcaggucguuccauuuccauguaguuaugugguuuugagugauuuuuuuuuuuuuuuuuuuuuuuuuugcgauggagucuugcucugucacccaggcuggagugcaguggcgcgauauuggcucacugcaagcuccgccuccuggguucaugccauucuccugccucagccucccuaguagaguagcugggacuacaggcgcccaccaccacaccuggcuauuuuuuuuguauuuuuaguagagaugggguuucacuguguuagccaggauggacaugaucgccugaccuugugaucugccugccuuggccucccaaagugcuguugagugaucuucuuaauccugaguucuaauuugauugcauuguggucuggagagucugguuuuuaugauuucuauuguuuugcauuugcugaggaguguuuuacuuccaauuauguggucaauuuuagaauaagugcgauguggugcugagaagaauguauauuguugauuugggguggagaguucuguacaugucuauuaguucugcuuggugcagagcugaguucaaguccugaauauccuuguuaauuuucugucucaugaucugucuaauacugacagugguguguuaaagucucccacuauuauugugugggagucuaggucucuuuguaggucucuaagaacuugcuuuaugaaucugggugcuucuguauugggagcauauacauuuaggauaguuaacucuucuuguugcauugaucccuuuaccauuauguaaugucccucuuugucuauuuugaucuuuguuggauuaaagucuguuuuaucagagacgaggauugcaaccccugcuuuuuuuuugcuuuccauuugcuucauaaguaccccuccaucccuuuauuuugaaccuaugugugucucugcaugugagaugggucuccugaauacagcacaccaauggguauugacucuuuauccaauuugcccaucugugucuuucauuuggggcuuuuagcacauuuacauuuaaggucaauauuguuaugugugaauuugauccugucaucaugaugcuagcuaguuacuuugcacauuacuugaugcaguuucuucauagugucauuugucuuuauauuuugguauguuuuugcaguggcugguaccaguuuuuccuuucuauauuuagugcuuccuuugguaucucuugucaggcaggccugguggugacaaaaucccucagcauuugcuugucuggaaaggauauuauuucucuuuugcuugugaagcuuaguuuggcuguauaugaaauucuggguugaaauucuuuucuuuaagaauguugaauauuggccccuacccucuucugccuuguaggguuucugcagaggcauccauuguaagacugaugggcuucccuuuguagguaaccugaccuuucuaacuggcugcccuuaacauuuuuuccuucauuucaaccuuggugaaucugacgauuauauuuugggguugcacuucucaaggaguaucuuagugguguucucuguauuuccugaauuugaauguugaccugugauguucucuguauuuccugaauuugaauauuggccugucuuucuagguuuggaacguucuccuggaugucaucaugaaguguguuuuccaacuuguuuccauucucccccucacuuucagguacaccaaucaaucauagguuuggucuuuucacauagucacauauuucuuugaggcuuuguuuguuccuuuucauuacuuuuuucucuaaucuugucuucacgcuuuaucucauuaaguugaucuucaaucuuugauauccuuucuuucgcuugaucgauucggcuauugauacuuguguaugcuucacgaaguucucguacuguauuuuucagcuacaucagaucauuuauguucuucucuaaacugguuauucuaguuagcaguuccuauaacuuuuuaucaagguuccuagcuuccuugcauuggguuagaauauccuacuuuagcuggaaucauuuguuauuaccaaccuucucaagccuacuucugucaauucaucaaacucauucuccauccaguuuugugcccuugcuggcaugagguugugauacuuuggaggagaagaggcauucuggcuuuuggaauuuucagcauuuuugcacuuuuuuuaaaaauuuuuuuauuuuaucaaaauguaauuuaauccaggauuuuaaaaaacaaucuuccuuauuucacaguuuauauuagagaauuucucuaacaugugguucuguuuuucuuuuauuuuacauauaccauguuucugaauuccacgaccacuuauaaaauauaaugauaauuuuuuacuuuacuuaauucugucuuuuuaugagaaauaguguuuuaucuuuuuuuauucuuuuucuuuuuuuuuauauacuuaaaguuuuaggguacaugugcagaacgugcagguuagauacauaugaauacaugugccauguuggugugcugcacccauuaacucgucauuuaacauuagguauaucuccuaaugcuuucucuccccccucccccuaccccacaacaggccccggugugugauguuccccuuccuguguccauguguucucauuguucaauucccaccuaugagugagaauaugcgguguuugauuuuuaguccuugcgauaguuugcugagaaugaugguuuccagcuucauucaugucccuacaaaggacaugaacucauccuuuuuuauggcugcauaguauuccaugguguauauauaccacauuuucuuaauccagucuaucauuguuggacauuuggguugguuccaagucuuugcuauugugaauagugccgcaauaaacauacgugugcaugugucuuuauagcaacaugauuuauaauccuuuggguauauacccaguaaugagauggcugggucaaaugguauuucuaguucuagaucccugaggaaucgccacacugacuuccacaaugguugaacuaguuuacagucccaccaacaguguaaaaguguuccuguuucuccacauccucucuagcaccuguugcuuccgaacuuuuuaaugaucgccauucuaauuggugugagaugguaucucauugugguuuugauuugcauuucucugauggccagugaugaugagcauuuuuucaugugucuuuuggcugcauaaaugucuucuuuugagaagugucuguucauauccuuugccuacuuuuugaugggauuguuuuuucuuguaaauuuguuugaguucauuguagauucaggauauuagcccuucgucagauaaguagauuggaaaaauuuucucccauucuguagguugccuguucacucugaugguaguuucuuuugcugugaagaagcucuuugguuuaauuagaucccaauggucaacuuuagcuucauugccauugcuuuugguguuuuagacaugaagucugugcccaugccuauguccugaaugguauugccuagguuuucuucuaggguuuuuaugguuucaggucuaccauguaagucuuuaauccauauugaauuaauuuuuguauaagguguaaggaagggauccaguuucagcuuucuacauauggcuagccaguuuucccagcaccauuuauuaaauagggaauccuuuccccauugcuuguuuuuuucagguuugucaaagaucagaugguuguagauaugcagcauuauuucugaggguucuguucuguuccauuggucuauaucucuguuuugguaccaguaccaugcuguuuuacuugcgguagccuuguaguauaguuugaagucagguagcaugaugccuccagcuuuguucuuuuggcuuaggacugacuuggcacugugggcucuuuuuugguuccauaugaacuuuaaaguaguuuucuccaauucugugaagaaagucauugguagcuugauggggauggcauugaaucuauaaauuaccuuggacaguauggccauuuucaugauauugauucuuccuacccaugagcauggaauguucuuccauuuguuuguauccucuuuuauuucaucgagcagugguuuguaguucucauugaagagguccuucacaucccuuguaaguuggauuccuagguauuuuauucucuuugaagcaauuaugaaugggaguucacucgugauuuggcucuguuuguuuguuauugguguauaagaaugcuugugauuuuugagcauugaguuuguauccugagauuuugcugaaguugcccaucagcuuaaggagauuuugggcugagacgaagggguuuucuagauauacaaucaugucaucugcaaacagggacaauuugacuuccucuuuuccuaauugaauacccuuuauuuccuucuccugccucauugcccuggccagaacuuccaacacuauguugaauaggaguggugagagagggcauccgugucuuguuccaguuuucaaagggaauacuuccaguuuuugcccauucaguaugauauuggcuguggguuugucauagauagcucuuauuauuuugagauacgucccaucaauaccuaauuuauugagaauuuuuagcaugaaguguuguugaauuuugucaaaggccuuuucugcaucuauugagauaaucauguguuuuuugucuuugguucuguuuauaugcuggauuacguuuauugauuuguguauguugaaucagccuugcaucccagggaugaagcccacuugaucaugguggauaagcuuuuugaugugcugcuggauucgguuugccaguauuuugcugaggacuuuugcaucgauguucaucagggauauuggucuaaauuucucuuuuuuuguugugucucugccaggcuuugguaucaggaugaugcuggccucauaaaaugaguuagggaggauucccucuuuuucuauugauuggaauaguuucagaaggaaugguaccaguuccuccuuguaccucugguagaauucggcugugaauccaucugguccuggacuuuuuuugguugguaagcuauuaauuauugccucaauuucagagccuguuauuggucuauucagggauugaacuucuuccugguuuagucuuuggaggguguaugugucaaggaauucauccauuucuucuagauuuucuaguuuauuugcauagagguguuuauaguauucuuucaugguaguuuguauuucugugggaucgguggugauauccccuuuauuacuuuuuauugcaucuaauugauucuucucucuuuucuucuuuauuagucuugcuaguggucuaucaauuuuguugaucuuuucaaaaaaccagcuccuggauucauuaauuuuuugaaggguuguuuuugucucuauuuccuucaguucugcucugauuuuaguuauuucuugccuucugcuagcuuuugaaaguguuugcucugccuuuucuaguucuuuuaauugugauguuagggugucaauuuuagaucuuuccugcuuucucuugugggcauuuagugcuauaaauuucccucuacacacugcuuugaaugcgucccagagauucugguauguugugucuuuguucuccuugguuucaaaggacaucuuuauuucugccuucauuucguuaugugcccaguagucauucaggagcagguuguucaguuuccguguaguugagugguuuugagugaguuucuuaauccugacuucuaguuugauugcacuguggucugagagacaguuuguuauaaauucuguucuuuuacauuugcugaggagugcuuuacuuccaaguauguggucaauuuuggaauaggugugguguggugcugaaaagaauguauauucuguugauuugggguggagaguucuguagaugucuguuaggucugcuuggugcugagcugaguucaauuccuggauauccuuguuaacuuucugucuuauugaucugucuaauguugacagugugguguuaaaaucucccauuauuauugugugggagucuaagucucuuucuaggucucuaaggacuugcuuuaugaaucugggugcuccuguauugggugcauauauauuuaggauugucagcucuucuuguugaauugaucccuuuaccauuauguaauggccuucuuugucucuuuugaucuuuguugguuuaaagucuguuuugucagagaguaggauugcaaccccugccauuuuuuguuuuccauuugcuugguagaucuuccuccaucccuuuauuuugagccuauaugugucucugcacgugagauggguuuucugaauacagcacacugaugggucuugacucuuuaugcaauuugccagucugugucuuuuaauuggagcauuuagcccauuuacauuuaagguuaauauuguuaugugugaauuugauccugucauuaugauguuagcugcuuauuuugcucguuaguugaugcaguuucuuccuagcuuugacggucuuuacaauuuggcauguuuuuucaguugcugauaccggucguuccuuuccauguuuagugcuuccaucaggagcucuuuuagggcaggccugguggugauaaaaucucucagcauuugcuugucuguaaaguauuuuauuucuccuucacuuaugaggcuuaguuuggcugauaugaaauucuggguugaaaauucuuuucuuuaagaauguugaauauuggcccccacucucuucuggcuuguagauuuucugccuagagaucagcuggcaggcugaugggcuucccuuugaggguaacccgaccuuucucucuggcugcccuuaacauuuuuuccuucauuucaacuuuggugaaugugacaauuaugugucuuggaguugcucuucucgaggaguaucuuuuuggcguucucuuuauuucgugaauuugaauguuggccugccuugcuagauuggggaaguucucccggagaauauccugcaguguuuuccaacuggguuguauucucccugucacuuucaggugcaccaaugagacauagauuuggucuuuucacauaguccuauauuucuuggaggcuuuguucguuucuuuuuauucuuuuuucuguaaacuucucuucucacuucauuucauuaauuugaucuuccaucacugauacccuuucuuccaguugaucgagucggcucuugcggcuugugcauucuucacguaguucucuugccuugguuuucaucuccaucugguucuuuaaggacuucucugcauugguuauucuaguuagccauucgucuaauuuuuuuucaauuuuuuuuaacuucuuugccauggguucaaacuuccuccuuuagcucagaguaguuugaucgugugaagccuucgucucucaacucgucaaagucauucuccauccagcuuuguuccguugcuggugaggagcuguguugcuuuggaggaggagaagcacucugauuuuuagaguuuccaguuuuugugcucuguuuuucccccauauuugugguuuuaucuaccuuuggucuuugaugauggugauguacagaugggguuuugguguggauguccucucuguuuguuaguuuuccuucuaacagucaggacccucagcugcaggucuguuggaguuugcuggagguccccuccagacccuguuugccuggguaucaggaguggaggcugcagaacagcagauacuggugggcaggaaauguugcugccugaucguuccucuggaaguuuugucucagaggaauacccggcccugugagaugucagucugccccuacuggagggugccuccuaguuaggcuacuugggggucagggacccucuugaggaggcagucuguccguucucagaucuccagcugcaugcugggagaaccacuacucucuucaaagcugucagacagggacauuuaagucugcagaggauucugcugccuuuuguuucacuauucccuucuccuagagguggagucuacagaggcaggcaggccuccuugagcuguggugggcuccacccaguucgagcuucccagcugcuuuguuuacccacugaagccuccgcaauggcgcgcaccccucccucgcugccaccuugcaguuugaucucagacugcugugcuagcagugagcaaggcuuugugcgcauaagaccgucugagccaugcgagggauauaaucuccuggugugcuguuugcuaagaccauuggaaaagugcaguauugggugggagugacccgauuuuccaggugccaucugucaccccuuucuuugacuaggaaagggauuucccugacccuuugcguuucccgguugaagcgaugccucgcccugcuucggcucacacacggugcgcugcacccacuguccugcacccacuuuccaacacuccccugugagaugagcccaguaccucaguuggaaaugcagaaaucacccaucuucuaugucgcucacucugggagcucuagacuggagcuguuccuauuuugccaucuuggcuccaccccccaugcuguuuuuuucucaucuuguuccauuuauuuaccuuugaucuuugauacugaugaccuucggaugagguuuuugcaugguuguccuuuuuguuuauguugaugcuaucccuuucuguuuguuaguuuuccuucuaacagucaggucccucuucuguaggucugcugcaguuugcuggacauccacuccagacccuguuuuccugugugucaccagcagagccugcagaacagcaaagauuguugccuccuuuuuuuuucuggaagcuuugucccacuggggcaucugccagaugccagucagagugcuccugugugaggugucuguagaccccuuuugggaguuaucucccagucaggaggcaugggggucaggggcccacuugaggggcagucuaucccuuagcagagcucaagcacugugcugggagaucugcuguucucuucagagcuggcaagcaggaacauuuugucugccgaaggugugccaacagcugcuccuucccucagguguucugucccagggagaugggaauuuuaucuauaagccccugacuggggcugcugccuuucuuuuaggcaugcucugcccaguuaggaggaaucuagagaggcagucuggccgcagugguuuugccgugcugugguggcuuccaccaauuccgaacuuccuggcagcuucguuuacacugugagggaaaacagccuauucaagccucaguaaugauaaacgccccuccccucaccaagcucaagcguuccagguugaguucagauugcugugcuggcagugacaauuucaagucuguggguuuuagcuugcugggcuccaugggggugggacccacuaagcaagaccacuugccucccuggcuucagcccccuuuccaggggagugaaugguucugucucgcugggguuccaggugccacugggguauacaagaaaacuccugcagcuagcucggugucugcccaaacagcuguccagcuuugugcuugaaacccagggcccugguggugugggcacacgagggaaucuccuuguuuguggguugcagaaaccgugggaaaaguguaguauuugggccagauagcacaauaccucacagcuucccuugagggaagguuccugaccccuugcacuucaugggugaggcaacacuccacacuguuucugcuugccccccaugggcugcacccacugucugaacagucccaaugagaugaaguggauaccucaguuggaaaugcagaaaucacccaccuguguuggacuggcugggagcugcagaccagagcuguuccuauucagccaucuugcuagaucucaaaaugucuuucuuauuuaccuacauauuuaccacuuuugguguuuucuguuuguguagauuuagauuuccauuagguauuauuuuucuuauaccugaaggacuuccuauuucuuguagugcacaucucccaguaaugaauuauuucagcuuuugugugucugaaaaguugcaaaaguucaccuauacuuuugaaagacauuucacuguuauagaauccuagguuggcagcauuuuucuuuuaguacuuuaaaaauguuucuucacugucuuuguuggauuucuuugaugauaaaucugcuguuauucuuccauuuauauuuaauauaauuacugccuagguaggauuuacaucugccauuuugcuguuuucuauauaucuuguauuucuauuacugccuucuuuuauguuacuuagauuauuuucuguuguaccuguuuuggugauccccaagaccaacucuaggacucauaguacccagaagucauuauauucaugguuauagcuuauuacagcaaaaagaugcaaggcaguaucagcacagggaauaggcacauguggcacagucuggaggaaaccaggcaggugcaagcuuccaagaguccuuuuccaguggaauuguacaggauucacuuaauuccucuaucuacaauuuauaggaacacaugugaaguguggucuaccugagagcucauuugagccuaagauucaaguuuuuuuagugggguuuggucacauaggcacacagugccugcaugguugauugcaguuaccaaaacagaccacuagaaagaaagcagguguuccccauaagucacauuauuucacagacuauguuuuuuuuuuuaauuuuuuuauuuaaauauauuuugguguacaagucauuguugauuacauagauaaauuguauaguguugaagucugagauuuuaguaaacccaucauucgaguaguguacauuguacugaauacguaguuuuuuuaaucccuuacuccccuuccacccuaccccuucucagucuccaaaguccauuauuccaguguguaugccuuugcauacccauagcuuagcucccacuuauaacugagaacauacaguuuugguuuucuauuccugaguuauuucacuuagaauaauggccucuggcuccauucaaguugcugcaacagacauuauuucauucuuuuuuauggcugaguaguauuccaugguguuguauauguaccacauuuuuuuuugagacagggucucacucuguugugcaggcuggaaugcaguggcaugaucaggccucacugcagccgcuaucccccauaaagugaucaucucagccccuggaguagcaugcaccucacaccuggcuaauuuuuuuuuuuauuuuuuuuggaauuuuaguagagaugaggucuugcuauguugccuaggcuagucuugaacuccuggacucaagugauccucccaccuuggccuucaaaagugcugggauuacagacaugagccacugcaccuagccuacuacauuuucuugaucuacucauuaguggauggacauuuagguugguuccauaguuuugcaauugugaauuuugcuacaauaaacauauacauacaaguguauuuuugauauaauuacuucuuuuucuuuggguagauaugcaguagugggaucacuucauugaaugguagaucuacuacuuuuaguucuuuaagaauuauccauacuauuuuccauacagguuguacuaauuuacauugucaccaacaguguuuaagcauucccucuucaccacauccacaucaacaucucuuauuuuuuaacuuuuuaauaauggccuuucuuguagggguaaggugguaucagauugugguuuuaauuugcauuuuccugaugauuagugauguugaguauuuuuucauguuuuuuggccauuuguauuuuguauaucuucuuuugagaaaugucuguucaugucauuugcccacuuauugaugggacuuuuuuuuuuugcugauuuguuugaguuccuuguauauucuagauauuggaccuuuguuggaugcauaguuugcaaauauuuucuuucauuuuauucauuaucuguuuacugugauuauuacuuuugcugugcagaaacuuuuuaguuuaauuaggucccauuuauuuauuuuuguuuuuguugcauuugcuuuugaggucauauuuguugggaacaggccccaaaaucuggcuaugaacuggcgccaaaacuggccauaaacaaaaucucuguagcacugugacaugcucauggugaccuugacacccacgcuagaagguuguugguuuaccggaaugagggcaaggaacaccuggcccacccagggcagaaaaccacuuaaggcauucuuaaaccacaaacaauagcaugagcuaucugugccuuaaggacauguucaugcugcagauaacuagccagagcccaucccuuuaccucggcccaucccuuuauuucccauaaggaauacuuuuaguuaacuuauaaucuauagaaacaaugcuuaucacuggcuugcugucaauaaauauguugguaaaucucuguucaaggcucugagcucugaaggcugugagaccccugauuucccacuccacaaucuauauuucuguaugugugucuuuaauuccuuuagugccgcuggguuagggucucccugaccgagcuggucuuggcaaguggugcccauacauggggcuugaacccaggucgaaggguugccagagcgacaguuggagaauguggaacuaagcuggaggacacaugaguacucuuaaagcaauccccgcggugaguaagaaagugagcuuggaagcaucaagguaacaaugggacaagugugagcucugguucuuuccaccuuggaaccuuuucacacuaaugaugaggaagaaggaaaguguaaugaguaacagaagaugugacagagcagguuuguuugccagcuaaagcuauagcggcaaaggagggagagguucaucccuacccuucuguacccccuccuuauuuugaagaaaaagaguggccuggcccuccagaucuuucuuuuccagaggauacugggugaaaaguaguugccccagugacuguucgagcagagccucaagcgaccgcucucaguucuauucaggcaggaauucagcgagcuagaugagagggugauuuagaggcuuggcaguucccuguuagaauacaccccccagaucaacagagaaauauuauagcuacauuugagccucuuccuuuuaaauuugggaaacccaugaggggcccgucccuggccccguuccaaaccgaggcauuucuggcucaggccauucccucacgucuguacaaugucugucccccaccacagccaguagugcugcaguagauuuuugcugcacaaaaacugugagccuucugccuggggaacucccacaaaaaguuccaacaggggucuguggacccuugcuagcggggacgauaagauuacuuuuaggaaggucuaguuuaaauuuaaaagggguacaaauacaaacaggagucauugauucagauuacaauggggaaauucaaauuguuauaucuacuucuguucccuguaaagcagagccaggagagcguauagcacagcuccugauugugccguauauggaaacggggaaaagugaaauuaaacuaacaggaggauuuggaagcacaacuaaacaaggcaaagcagcuuacugggugaaucaaauuacugauaaacauccuaccugugaaauaacuauucagggaaagaaauuuaaagguuuuguagauacaggagcggacauuucaauuauuucucuacagcacuggccauccacuuggccaguucaacccacucaauuuaacauaguuggaguugguaaagccccugaaguauauccaaguaguuauauuuugccuugugaagggccugaugaacaaccugggacuauucaaccaauuauaacuucuauaccuauaaauuuauagggaagugauuuauugcaaugcucaguuaugauuucauacaguugaacaacugaugacaaaaacaaaaaagagggagaaacagggauuacaggacagcccauauguaauugaaucuaacauuauuaucuuuaaacuuuuuuuuuuuuuuuuuuuuuuuuuaacucauccauguuucuguuuauauacaggauaacaaauucaggaacaaugggaaaguaauauaugaaaccuuaauaggaaauacaauagagauuacaaaacacuaccauuugauuuuuuaugcaaauacuucaaucuuccaauauuuuuacucacuugcuaaauaaagcacaugacucgaaauccuaaauaauucuguuagucuaaaucuuuuaaagaauaaaauguuggugaaaaaccaaaauuguuuaguaagguauguaugaccuuguuuauuaucuaucacagacaugaagaugaucauaguuaauaccaauuuaagcuuuacagaauacuguuuuaggcccaauauugauauguuaaaugaagguaucagagaaucuuguauuuauggcaucagguuauaaagaucuauucaaaaccauuuuugucaaaguuuaaacacuggagcaaaagucaaauuguuucuaaaugagacacaaaaugauucuugcuaauaauacaaauuuugucccauggguaauacuauugucuuuuucuuuuuuaaaaaaauuuuugauuuuuauuuuagauucagggaacacaugggcaggucuguuagcuggguauacugugugauguugagguuugggguauggaugauccugucacccagguagugagcagaguccccaguagguaguuuuucagcucuugcucccgcuccccaaccuaccuccccagugucuauuauucccauggguccucagguauuacuauuuucaaauuuuuuucuuuacaugaaacuacugaaagcaaaaguaugucaugcuuauaggucacucuguacauuuaucauucuauuaauaaacaucuuaaauaauuauguaguauauuaaggccauaaaccaaaucauuaucuccuaucaaaggacuacuguuauucaaucaucuagaaaauucauuuuaggcaggacucaguggcucacgucuguaaucucagcacuuugggaggcugagguggguggaucaugaagucaggaguucgagaccauccugaccagcauggugaaaccccgccucuacuaaaaauacaaaaauuagcugggcgugguggugugugccuguaaucccagcuacucaggaggcugaggcaggagaaucacuugaacccgggaggcagagguugcagugagcugaaauugcgccauugcacuccagccugggcgacagagagaaacucugucuuaaaaaaaaaauucauuuuaauggguuauguuacaggguugaggucagccuacagacacaaaauagguuaacugaaaauuuuuuuuuuuguaucagguuuuaauuuuuucauugaaacaggauuuggugguggggauacuaaauguggcaggguucaacaaauuuacauuuuaucaaaauaaaguucuuaaagaauacaaugauagcauaugcuuuaacucuuauagcacaaacccacauauuaauugauggucacagaaaaauacuguaaugguuuaaacaaaaguuuuaaaauacaucaaugacacaaguuucaaacaaaaugcagugaucaaaauacuuaacuguccuuucaucaagcuuuuacaaacacaaucagucuucacugucugagcaaaucaguuuuaguuucuucaugguccuccaucugucuuuuaauaugacacuuguccgguuguugaauuuauaaugcaauaguauuuuagaccaguuucccucuccauguuuccucacgccagaucucaaauucuugucuucuucccaaagccaugcuuguuuuuuuuuagcuugauguuuuucaggaguuaccaguugacucuuugaaauagguauucugcuuucaguggcucuucugcuuucuuuuuucuuuuuuguacuuugaagaguuccuacucuccuuucuuucuuauuaaggucuuguugcuggguuccauguugcaacuuagauaagaaaagauucuugugagaccuuuuucuuguauccaaauuagcuucaguuuccauuucaacaucauuaccauuagguuuaucuugagaaauuauuguucuuguucuuuuacuuucuacuacuuuugcugcugccuucauuagaaagguugaugauuuuucacuuagcacauaauucacauaacucuuaauuuucuccaucaugugauuguagcugaaguguugaaaaaaggaaugaaauguaucuuucugagagauuaucauaagcaauuugcuuuugagaggcauauaagaauuuggaucaccaaauauucuuucaaagacuucuucugcuucuguaaaguugucauuuuccauacaaacagcuauagccugaauuuuaauuaaauucuauauuucuucaugaaguuugucauguuccuuuucaauugaaccccaaaucaucagggcugauuccaaggguguaauucguucaucauuuucaaacuguacaucaaggguuuuuccugcugcaaugcuugucaaaaacugacauaugcauauuguucucaacugguaagcuguuagacuggauaguccaugaauaauagccucugcgcuguugcggguccggcagaaguccucagggcggccgucgcggaaagcucagcaaagagagaggcagaggaaaucgagcauccagccagcagccacagccucggccucagccaccaggcccggguccuccuccuccuccucgggggcucccaccugcacccagcacucgagcaguuccuggcacucgaacugcuccucgucguuucucucuguuucugccaucugcuccucaguaggguuggcaucccuaccaucugcacagccccaagggcucggggcccagcuuuaaauuuuuugagccuuccuaaaagccagauguuaucagcagcugaacagcaucuacagaaaccagcugcaaagacagaagcagaacaacugguuugguggaaauauccaauaccaaaaaguugagaaaucgguaaaauaauaacuugggguagagguuaugcuuguguuucuccaggccaaaaucaacacugauuuggauacccucaggacaccugaaaccuuaucaugaaccagaugcugaggaagagauucugggaggaucccgaguaccccccaguugcagucaugucaagacugaugcucaggaggaucccaacugucaugagcaacacccaucgaacacagccauccaccugggaacagaucaagaagcugucacagauggugggagaaaaccugaggaaagcgggacaaccagucacaaugaguaauuuaaugguagcuaugauagcagugaucaccauugccgugaguauuccuucaacaagggcugacacagagaucaguuauacuuauugggcauauuugucaauuuuggcuggcaauaaugccuggauauaaucacuuuaugacacaguuacacaugcuuucuggucucaauauuuaccauaauaagucugcuucuauaauugaggcauaccacccucaaaaaucuauuuguaaacaaaauugaaccuggccagaaaaaaugaauguacuuuuuuaggaagguugcauugcagaacaggcagaggugcugcacaacgaauccuauggaaucauuauugauugguccccuaaggggauguuuagcuugaauugcaccucuuagucugcaugucacagccacacuguguucaacuggucugaacagaauggucagaugguacaaaugguaagacguauggcaagaguuccuauuaucuggaaccauggcaguauaggggcaccucaaccucaaaugauauggcccauuguaggagcuaaacauaaggauuuguggcaacuguuaauagcucuuaauaagaucaaaauuugggaaagaauaaaaaagcaucuagaaggacacucugcaaacuugucuuuggauauugcaaaauauauauauauauuuaaagcaucccaggcacaccugaccuuaaugccagaacuggagugcucgaaggagcugcagacagauuagcagcuaguaacccauuaaaauggauaaaaacacuuagaagcucugugauuucaaugaugauugugcuuuuaaucuguguuguuugucuuuauauagucugcagaugcugaucuugacuccugugagaaguagcucaccgugacaaagcugccuuugcuuuuaucgcuuugcaaaacaaagaagggggacaaguugggaacaggccccaaaaucuggccauaaacuggccccuaaacuggucauaaacaaaaucucugcagcacugucacaugcuugugauagccugacgcccacgcuggaaggcugucgguuuaccggaaugagggcaaggaacagcuggcccacccagggcggaaaaccacuuaaggcauucuuaaaccacaaacaauagcaugagcuaucugugccuuaaggacauguucaugcugcagauaacuagccagagcccaucccuuuaccucggcccaucccuuuauuucccauaaggaauacuuauaguuaaucuauagaaacaaugcuuaucacuggcuugcugucaauaaauauguggguaaaucucuguucaaggcucucagcucugaaggcugugagaccccugauuucccacuccacaaucuguauuucugugugugugucuuuaauuccuguagcgccgcuggguuagggucuccccgaccgagcuggucucggcacauauucauaaauuauuugccugggccaauguccagaagaauuuuucauaguuuuucuacuagaauuuuaauguuuucaugucuuaaauuuaaguauuugauccaucuugaguugauuuuuauaaaaggugagauauagggauccagugucauucuucuacauguggauauccaguuuacccagcaugauuuauuaaauagagugucuuuuucucaauuuauauuuuuguaugcuuuguuggagaucaguagguuguagguguuaggcuuuauuucuggguucucuauucuauuccauuuguguaucuacuuuuaugccaguacugugaugucuugguaacuguagucuuguaguauaauuugaagucagguaauguuauggcuccagauuggcuauuuuugcuuaggacugcuuuggcuguuuguacucuugugguucccuaugaauuuuaggauuaacuuuuuaaaucucuaaaaaauaauguugguauuuugauaagaauuacaucgaaucuguagauugcuuugagcuguauucucauuuccgcuauauugauucuuucaauccaugagcaugggauguguuuucauuuguguccucuacgauuucuuuuaguacuuuuguaguugucauuguagagcucuuuuaccccauugguuaaguauauuccuagguguuuuuuuuuuuuuuuuuuuuuuuuuuuuuuuuuuguagcuauuguaacagggauugagucccugauuuccuucucagcuuggucauugguuauagcagggcuacugauuuguguauacugauuuuguaacuugagacuacugaauucauuuaucaaauauaguugucuuuuggaggagucuuuagggauuucuacauauaaaauccuaucauuggcaaacaggaauauuuucacuccuucuuuuccaauuugaauaaccuuuauuucuuucucuugccugauugcucuggcuaugacuuccaguacuauguuaaauagaaguagugaaaguggccaucauugacuuguuccaguucucagcgggaaugcuuucaacuuuuccugauuuacuaugauaaagucuguggguuugucauauauggcuuuuauaauuuugagguaugucccuucuauacuuaguuuguuaaggauuuuuauauuaaaguuaugcuggaauuuauugaaugcuuucucugaaucuauuaagaugaucauaugguuuuuguuuuaauucuguuuaugugauguaucacauuuauugacugacuuguguuaaaccauuccugcaucccuaggaugaaacccacuuuaccauagcguauuaucuuuuuugaggugcuguuggauucaguuugcuaguauuuuugugagguuguuugcaucuguguccaucagggauauuggucugucauuuuuuuuguuguuuuuauguucuuuacugguuuuuguaucagggugauacugguuucaucaaaugaguuagggaaguuucccuguuaaucuuuuguaauaguuucaguaggauugguaccaauucuucuuugaaugucugguauaauucagcugugaaucaucuggaacugggcuuuauuuuuggcaauuuuuaacuuacugauucagucucgcugcuuguuaauggucguucaggguauauauuucuuccugauuuaaucuaggaaggccauauguuucaaggaauuuauucauuuccucuagauuuucuaguuugugugcauagagguguucacaguaguuucaaaugaucuuuuguauuucuuuggugucaguuuuaaugucuccauuuucauuucuaauugagcuuauuugaaucuucucucuucuuuucuugguuaaucuaccuaaugcucuaucaacuuuuuuaaucuuuccaaauaaucaaguuuucguuuuguugaucuuuuugauuucauuuuauuuuuguuucagugucauuaguuguguucugaucuuuguuauuucuuuucuucugcuggcuuuuaguuugguucauuauuguuuuucuaguuccuugaggugugaccuuagguugucaauuugugauguuucagauuuuuugauguaggcauuuaguacuauagacuuuccuuuuagcacugcuuuugcuguaacucagggauuuugauaaccugugucauuauuauuaaucauuuuaaauaauguuuaaauuuccaucuugauuccauuguuaacccaaaagucagucaggagcagauuguuuaauuuucauguauuuguauaguuuugaggguuccuuucagaguggauugcuaguuuuauuccacuguguucugaaaaguuacuggguaugauuucaauuuauuaaaauguuuugagacuuguggccuauuauaugcucuauuuuggacaauguuuuaugugcugaugaaaagaaaguauauucuguuguucuuggguagaaguucuguaaauaucuguuagguccauuuguucuggagugcagcuuaaauucaguguuucuuuguugacuuucugccuugaggaucuguccagugcugucaguggagugcugaaguuccccacuauuauuguguugcugucuauguuuuuucuuaggacuaguaguaauuguuuuaugaaucuaggaucuccagaguuaggugcauguauauuuaggauuguaauuuuuuuuugugggauugauccuuuuaucauuucaucaugacuuucuuuguauuuuuuuauuguuguugcuuuaaaguuuguuuuaucugauacaagaauagauacuccugcucucuuuugguuuccauuugcauuuaguauauauucuaucccuuguaccuugagucuauaugaguccuuacauauuaggcgagucucuugaagauagcauacauuugguuugugauuuuuaaacucuauucugccaaucuguuaucuuuuaaguggagcauuuaggccauuuauauucaagguuaauguuggagugugaggugcuguucuauucaucauauuaguugauaccuauacuuuguuuucuucauuguguuauuguuucauaggcccucugaguuuuaugcuuucaagagguucuauucuguuggauauugaucuuuuguuucaagauuuagaacuaauuuuagcauuucuuguagagcuggucugguagugauaaauucucucagcauuugucagaaaaagacuauuuaucuuccguguaugaaacuuaguuuugcuggauaccaaauucuugacugacagucauucuguuuaaggaggcuaaagauagggccccauucccuucuggcuuguaaaguuucugcuuagaagccugcuguuagucugauagguuuuccuucuuagguuaccugaugcuuuuaucucacuucucuuugaguuuagaaagccuaaugacuguuugccuuggugauacccuuuuugcaaugagucucucaggauuucucucaggcuucuuguauuuggguaucuaaaucucuaucaagguccgggagcuuuuccucgauuauucccuaaaauaaguuuuccaaacuuuuugcuuucucuucucccucaggaacaccauuccuuuuuagauuuagcccuuuuacacaaucccauguuuuuuggagacuuuguucauuuauuuugauauuuaaaaaaauugucugaguuaauucaaaagccuugucuuugaacugugaaauucauucuucuaccaggucuaguguauucuuaaaacuuuccacuacauuuuguaauucccuaaauguguaauucauuugcaaaaguucugauuguuuuuucuuuaaaauauccaucuuuuagaaaauuuuucauucauauucugauuuuuuuuaacauuucuucagguugguuuuuacauuucuuucguaucuccuuuaguagcuuaacaaucaaccuuuugaauuuuuuaucugguuuuucaaugauuucucuugguuuggauccauucuuggagaguuagugugaauuuuugaggguguuauagaacccuauuuugccacauugccaaaauuacuuuuuugguuccuucucauuuggcuagacuauuuuuucuuuuucuuuuucuuuuuuuuuuuaaguauuuauugaucauucuuggguguuucucagagagggggauguggcagggucauaggauaauaguggagagaaggucagcagauaaacacgagaacaaaggucucugguuuuccuaggcagaggucccugcggccuucggcccuguuugugucccuggguacuugagauuagggaguggugaugacucuuaaugagcaugcugucuucaagcaucuguuuaacaaagcacaucuuucaccgcccuuaauccauuuaacccugaguugacacagcacauguuucagagagcaggggguuggggguaagguuauaguuuaacagcaucccaaggcagaagaauuuuucuuaguacagaacaaaauggagucuccuacguccacuucuuucuacacagacacaguaacaaucugaucucucuuucuuuuccccacauuucccccuuuucuuuucaacaaaaccgccaucaucaucauggcccguucucgauggucacuaucucuucggagcugaugggcacacuucccagauggggcggccuggcagaggcgcuccucacuucccagacggagcggccgggcagaggagcuccucacuucccagacggggcggccgggcagaggcgcuccucacuucccagacggggcagccgggcagaggugcaccucacuucccagaugggguggcggccaggcagaggugcuccucaccucccagaugggguggcagcugggcaaaggcgcuccccacaucccagaugauggguggccaggcagaggugcuccccaccucccagacggggcagcccggcagaggcgccccccacuucccagacggggcggccaggcagaggugcuccucacaucccagauggggcagccgggcagaggcgcuccucaccucccagacgggacggccgggcagaggcgcuccccacuucccagaugaagagcggccgggcagaggugccccccacuucccagauggggcggccgggcagaggcgcuccucacaucccagacggggcuacuggucagaggcgcuccucacaucccagauggggcggcugggcagagaugccccucaccucccagacggggcagccaggcagaggcacccacuuccccgacgcgguggccgggcagaggugcuccccaccucccagaugaagggcggcugggcagaggcacccacuucccagacggggcggcugggcagaggugcuccccaccucccagaugggguggcugggcagaggcacuccccaccucccagaugaagggcagccaggcagaggcgccccucaccucccaggcaggguggccgggcagaggcgccccucaccucccagacagggcggccgggcagagacgccccucaccucccggacggggaggccgggcagaggcacccacuucccagauggggcggccgggcagaggcgcuccccaccugccagaugaagggcggccgggcagaugcgccccucacuucccaggcagggcggccggguagagacacuccucacuucccagaggggguggccaggcagaggcgcuccucacuucccauucggggcagccaggcagaggcgcuccucacuuccucccagacgaggcagccaggcagaggcgcuccucacuuccucccagacggggcggccaggcagaggcgcuccucacuucccauucggggcagccgggcagaggugcuccucacuuccucccagacggggcagccgggcagaggcacuccucacuucccagacggggcggcugggcagaggcacuccucacaucccagaugaugggcagccaggcagagacgcuccucacuuccuagacaggguggcagccuggcagaagcgcuccucaccucucagaugggacggccgggcagaggggcuucucacgucccagacgauggguggccaggcagagacgcuccucacuuccuagacgggguguccgacaggcagaggcuguaauccuagcaccuugggaggccaaggcaggcggcugggagguggagguuguagcgagccgagaucacgccacugcacuccagccugggcaacauugagcauugagugagcgagacuccgucugcaaucccagcaccucgggaggccgaggcgggcagaucaccugaggccaggagcuggagaccagcccggucaacacagcgaaaccccgucuccaccaaaaauacaaaaaccagucaggaguggcggugcgugccuggaaucccaggcacucggcaggccgaggcaggagaaucacuggagcccgaggcagggagguugcagcgagcugagaucauggcggcacaguccaggcucugcaagagagggugaccauagaaagagggagacgagagggagagggagaccguagaaagagggagacgagagggagagggaggacuauuuuuucuaauuauucuugaauugauuuuuuauuaaacuguguuuuaaaaauuucuuucccccuuuaaggauuugaguuuaauguuuacaguuuauuguagccuauucaguucucggugcuuucaaggcugaagacucuguaugaguuccuugguuauagagagucuuuguauguuaacuuccccagaugcuuguuuuaguagcagugugcuugguauaugauuaaguucacuguuuccugugggguuggaguggcagagguaucuuuugaaacuugucucuuuccccuguagucugcacuuuuuuauguauuuauuuuucuucuguauuuuauuuauuggguugaauaguuuacgcuucaagucaguagaggggguguccccagauagaaacuggcugugucuaaaacagguggauaaauagaauaccccauggugggaagaggucccagccuugaaaacaguggcuggaggagcucucaguguaaugcacuaaggucuuaucagggggaagggugggagccaugucagcuccccugccaggcuagccggaaagcaaucccauugccagucacauuccugacucaguguuucagcuauucagaucagacagauaccucuuuuuaucugaaagaauauugauaguccaaguagagaaguauugugacucuacuccucauguaagccugaaccuggagggcacuacuucuguggggauacagucaccuugaaguguuccagaaaagcugucuacagaugcacccaugcugagcucccaugguggaagcccaugcuuugucuucaaugguggaugagugggaaaagaaguccccuucuccaagacccuucacaagcaccagggcugccugacuguuaagguagaaccgcagacuuucccugcugagcccagcaccuuaccuguaccucugcugaaggaaacuucccacaaguagaaauuucuggaaugcaaggccuuccaucuggauuuuuuuuuuuuuuguccuacaagggugcuacuuugaugugguacgcugccacuuccccuaggaguaggagucccugagagccagacuacucugaaugcugccgcuucucugggucuaguugcccaguggagcuggcacauuccaggcuguugcuggggagugucugcuggggauccagugauauggccugucuucaagucucccagcaguggguaccaacaccagcacugaugggggugacaggggagugaugucgacucuuugaauuuccuugguuauaaauagccuuaguaugacagcuuucuguaaugccaguugcaguaguaauuaucuggucauguggacagacucaggaccuccugguuagccaggaugcugcaggcaguggucacagcugaggucacacacaaguuuuuuccuuucuagacacuguuauucuaccuggagaugcuguaguggacuguauugguuggccuccagccaagagauagcgauugcaagagagcaccagcuguggugguaguggugagauuugugcuugcuuuacauuacccaggggagguacuuuggugucucaggcaauggugggaccauagagcucccaaaaguuucugcguuuuguguuaagcugguggaggagcaaaagcaggugugggcuacaucagacuggucugugcucugucuuccacaugcugggcaagaaguggcccucacagacuauguagacaaauugguacacuguggguaaaaguuccaaguaugcaaaacaaucuuauuaguuagaacauuccaagaccucaauuuccaguagcuggacaaggaccauucaugacaauagacccuucugaaaauguacaaguuugagcaacucagaccuacugagucaacuguuuccuguacagucuaccuuccuggcccuaggcucaggcucucuuaaaggaaaacuacuguauuuuauaauagauauauuaauaauauuagcaugagaauguccaacauuuggaggagcuggugcaagauauagacuugaagaaacaauuaauucaccgauaaagccauuguauacaucuucauauuuucuucauauuuuuguaguaauuugauugcuucuucccuuggucuaaugauacuugugcuuuaugauaaacuuaccuauaguuauuuagcauauuaauuagcuggugguuaacuagaucuaguuccucaagccaauaauuuuucacugauaucagauccugaggaggcuuuaauuaaauuucacaauacauauaauuaccauuauuuguauuauaugacuuauuaacauaagguaauagaacccuaccagcaaugcuaauguuauaccauaucgugcaauggcaguaguacaguucuguuucauuccacaagucaguaagaguuauuauaccuuacccaacauaauuggcucuugaccacuuagcagauguucuuagggacagaugucaucacaagggaccaggaugccuuuauuuccagguuccaaguaagauggcaacugauggcuuuaacacagacuggguggcuuuaacagcagaaauuuauuuucucauaguucuggaggcuagaaguccaauauuaagguguugacaggcuuagugucuucugagaucucucuuuggcuugcagguacccaccuucuugguuguccuuacaggaucuuuccucuguguaugugacucugguuuuucuuuguauauccaaauuuucucuucauauaaggacaccagucagauuggauuagggcccauccuaaaaggcuucauuuuaacuaaauugccucuuuaaaggcccuauuuccaaauauagucacauucugagguacuaggaguuagggcuucaacaggaauuuuaggcagggacacaauucagcccauuaauauaugaagacaaaacuagucauauugucaugauuuuacugaaauguuccauuguauacuguuauguacuaucucuuucucaugguaagucugaguguaauucacaaugguuccuauuucugugaacugcauuacaggauacaacuuauuuuaaaccauucuuggagugagggcaggcagaguauaccaauguaaauuacucuuaaccu

SEQ ID NO: 19126 - RNA, 3681 nt, Homo sapiens
aagcagaguacagugagacuagcauucacugcuggccagugccugccuuuuucaccaccucuaauuucagcuucagcaguugcuuggaacuuugguucuggcagcagcagcaacaucauuaccgcuagcggcaguuuugugccgaggcaccuacacaccucccguccucucugccagaucgcgggccugucggugucugcuccuacacgccaacgccggugggcaggaccaugucucugguaagccagaauucgcgccgccgccgccgccgcguugcaaaggcuacugcgcacaacagcagcuggggcgaaaugcaggccccuaaugcccccggucuccccgcugaugugccaggcucagacgucccccagggucccagcgauucccagauccuccagggccucugcgccucugagggcccaagcaccuccguucugcccaccuccgcugagggcccaagcaccuuugugccgcccaccaucucugaggccucaagcgccuccgggcagcccaccaucucugagggaccuggcaccuccgugcugcccacccccagugagggccuaagcaccuccgggccucccaccaucucuaaggggcugugcaccucugugacgcuugccgccucugagggccggaacaccuccaggccgcccacuuccucugaggaaccuagcaccuccgugccgcccaccgccucugagguaccgagcaccucccugccgcccaccccuggugagggaacgagcaccuccgugccgcccacagccuaugagggaccaagcaccuccguggugcccaccccugaugagggaccaagcaccuccgugcugccuacaccuggugagggaccaggcaccuccgugccgcucgccgccacugagggccugagcaccuccgugcaggccacuccugaugagggaccgagcaccuccgugccgcccaccgccacugagggccuaagcacccccgugccacccacccgugaugagggaccgagcaccuccgugccggccacuccuggugagggaccgagcaccuccgugcugcccgccgccucugacggacaaagcaucuccuuggugcccacccgcgguaagggaucaagcaccuccgugccccccaccgccaccgagggccugagcaccuccgugcagcccacugcuggugagggaucgagcaccuccgugccgcccaccccuggugggggacugagcaccuccgugccgcccaccgccacugaggaguugagcaccuccgugccgcccacucccggugagggaccaagcacuuccguacugccaauccccggugagggacugagcaccucugugccgcccaccgccucugauggaucggacaccuccgugccgcccacuccuggugagggcgcaagcaccuuagugcagcccaccgccccugacggaccgggaagcuccgugcugccuaacccuggugagggcccgagcacauuguuuagcucuagugcuucuguggaccggaaccccuccaaguguucccuuguuuugccaagcccuaggguaaccaaggccuccguggacucagauucugaggguccuaagggugcagaaggcccuauagaauucgagguccugagagacugugagagccccaacuccauuaguauuaugggccucaauacuucccggguugcaauuacccugaagccccaagacccuauggaacagaacguagcugagcuguugcaguuccugcuggugaaggaucagagcaaguacccuauccgggagucugaaaugcgggaauauauuguuaaagaauaucgcaaccaguuuccugagauacucaggcgagcagcagcccaccuggagugcauuuuuagguuugaauugagagaacuugacccugaggcacacaccuacauucuguuaaacaaacugggaccugugcccuuugaaggguuagaagagagcccaaaugggccaaagaugggccuccugaugaugauucuaggccaaauauuccugaauggcaaccaagccaaggaggcugagauuugggaaaugcucuggaggaugggggugcagcgggaaaggaggcuuuccauuuuugggaacccaaagagacuucugucuguggaguuuguauggcagcguuacuuagacuacaggccaguaacugacuguaaaccaguggaguaugaguuuuucuggggcccaagaucccaccuagaaaccaccaagaugaaaauucugaaguucauggcgaaaauauauaacaaagauccuauggauuggccagagaaauacaacgaagcucuggaagaagaugcugccagagccuuugcugaggguuggcaggcucucccucacuuuaggaggcccuuuuuugaggaagcugcugcagagguaccauccccugauucagagguuuccagcuauuccucaaaauaugccccacauucauggccugagucaagauuggagagcaaggcaaggaagcuggugcaguuauuucugcuuauggauucaacuaagcugccuauaccaaagaaaggaauucuguacuacauuggccgagagugcagcaaaguguucccugaccuccugaaucgugcugcccgcacccugaaccaugucuaugggacagaacuagugguacuugaucccaggaaucacuccuauacucuguacaaccgaagggagauggaagaaacugaggagaucguagacaguccaaacaggccuggcaacaacuuuuugaugcagguccuaagcuucaucuuuauuaugggcaaccaugccagggagucugcagucugggccuuucugcggggcuuagggguucaagcugggagaaagcaugugauuaccugcagauacuugagucagcgcuauauagacaguuuacggguuccugacagugauccagugcaauaugaguuuguaugggguccuagagcccguuuggaaaccucuaagaugaaagccuugcgauauguggccagaauccacagaaaggaaccacaggacuggccacagcaguacagggaggcaauggaagaugaggccaauagagcugauguugggcacaggcaaaucuuuguucacaacuucagguagaggaaugcauggcagucagaggggccuugcaaggaggggccuuugagccucaguucucauguauugggggguggggguggguacauauuguauuugguauuuguguuccaguuauauuuaugucuuuucauauuuaguucugguguggugucuggaaauguuucaacuguuuuaauauauugucugauuggguaaaugugauugaccacuugcugucucuguuguauuuugguaugaguuuugauagcucuauaaaauguuuuggaaaucuuuccaucuuguugcauuaucuagaaaagaauauagcauauagcuauagauauaggcuuuuccuugaaagcuugaaaaaaauucgccaguaaaauaaucuagcuuaaagugauaaacuaacaaacaaauauaacaacaacugaaaaggcacucuaaauuguggcuggcuucccuuucugucugcuauuguaugaagaauacugauguuuaccuguauuugcuuugcuguacuaaaauguaaugaaaaauaaaagauuaauaaaugaaacauaaugcuaauacacugacuuauucaacugcuuucaua

SEQ ID NO: 19127 - RNA, 1193 nt, Homo sapiens
uucaggguuuagcuuucuuccaaacaguguaaaauacccacaauuccagguaugaagggacacagaugaucuccuuugaaaauuccacaggacaauacaggcgccccagcuguucuucauagagcgacagugcuucuuucagauugacacaguuccccuguguaaaauauuucccauccuguuucaacacuuucauugagaggucaagaaucagucugagaaacucccauguggaaucuucuucuggagacguggagauuggaacagcugucaaaucauuaaucacauaaucaaauucucucccuucuuugguguaucucuucaguaccgggauacagucuucuauuagaaccugauagcagucuccuuuaagauugucuaagacaucgccacacguuuuucgcauguauuucuuacacccaucaaucaucauuuggucagucucuaccauagugaccaucuuugguuuuaguuugacuauuucacacaauaugccucugucuccaccucccagaaugaguacaucuuugccaguguaaucuucuuugccacugcccaugauggcccggguauaugccaaaucacucucugccaaauuaacauccccacuaagaaugagaauauuuccaaacugcuucgaguguagaauuuuuauauuuugauaaggugaaucuucaucauauaccacuucaucuaugucauauucaaccaggcgcccaucggcggugggccaauaucugucgauggcucuccucgcacuaugggugguaaucguuucacccgcccaguacuguccugacucaauucuuucauucuuucuucuacuuuguucaaaauacugucgaucucuucuuugccuugcgcaucaccaucauaacucugaagguccagcaacaccaauccauguggguaaauucucauauuggcaaagcugccauucuuguuuguguagguugcuaaauagccaugguccugccaggugugcaccgacuccgccauccccugcuccuggaaaauggacuggaggccuuuuagaauggucucaccaucagcuuuggcacugagcaugaagucgagcgugcugugccgugcugcugccauagugaggcgaggcccugugccaugccugggggagcggccgcgggagacuggggggccgcgcggcgugucaggcuguggccggcugggagugc

SEQ ID NO: 19128 - RNA, 1079 nt, Homo sapiens
auuaacaauggcaggaaaaucaucacuuuuuaaaguaauucuccuuggagaugguggaguugggaagaguucacuuaugaacagauauguaacuaauaaguuugauacccagcucuuccauacaauagguguggaauuuuuaaauaaagauuuggaaguggauggacauuuuguuaccaugcagauuugggacacggcaggucaggagcgauuccgaagccugaggacaccauuuuacagagguucugacugcugccugcuuacuuuuagugucgaugauucacaaagcuuccagaacuuaaguaacuggaagaaagaauucauauauuaugcagaugugaaagagccugagagcuuuccuuuugugauucuggguaacaagauugacauaagcgaacggcaggugucuacagaagaagcccaagcuuggugcagggacaacggcgacuauccuuauuuugaaacaagugcaaaagaugccacaaauguggcagcagccuuugaggaagcgguucgaagaguucuugcuaccgaggauaggucagaucauuugauucagacagacacagucaaucuucaccgaaagcccaagccuagcucaucuugcuguugauuguuagauuguugaugcauucuaaccaacucacacauauacacaaaaucaacauggggauggagaagagaauuagcguuugcagcaguguaucaucuacuaauaaaauuaaacuaauguugcugcuucauuaguuggugggagaagggacacauccacucuuggaggaauauauuuacucaauaauggcaccuuacauuuauaaauuguaacaguugucuaauaacguuucuuuaauuuaaauauguaaguugcagagcuaauaaaugaaaugaccaagacuuuaauuauaauaaaaauaagaaacuugacuauucuagaaguuauacuuggauuuuuuccugggaaaauggagaacuacuuuuuauauguguauguuuuuaugcaauuagcauuguauucuugguucagggaaauacuuuccuaaagcaauaauguuagauauuaaagauuaaaaucuaaugua

SEQ ID NO: 19129 - RNA, 641 nt, Homo sapiens
agaccacugggacaauucaguauggcaaaggugaccagugagccacagaagccuaaugaagauguggacgaacagaccccaucaaccucaaguaccaaagggaggaagaaggggaagacaccccgucaacgaagguccagaagcggcguuaaggugagaugaucccgaccaaaccccuucucuuugccccacugauuccgccaccccaagacuccuauccuuuccuugccucacucaaacccccuccucaacucacacccuucucaugaagccuauuccuaugcauuucccaccuucuuucccaaaaccaacgcccucuggccugacugugaucucccuguagggccuaaagaccaccaggaaggcgaaaagaccccuucgagggagcucgagccaaaaagccggugaaacuaacaccccugcaggaaaaccuaagaaagcuagaggaccaauacugcguggucguuaucaccggcugaaagaaaaaaugaagaaagaagaggccgacaaagagcaaagcgagaccucaguucugugaugucucuagagguccgccacugaaaagucaucaaucauacagucagugaauucuacaccaacagguuaaaaccaugaaaauaaaaucaaccugaaucgaaagg

SEQ ID NO: 19130 - RNA, 2851 nt, Homo sapiens
agccuaucagauuuucaaaguguuucauucaaaaaaggcuccccucuugcuaucccaguagaaagcagcaacccugucaccuaaccccgacaggagcucuugcauauuucaagaaaaauaaauagaaugaacuaaagcaugcauggcagaauaaauuuggaaauaaauuucgaagcgauuagauuuuagaggacuuguuugugauuagcagagauuaccaauguaaaaucaaauuauagaucauaaaagcgggaaaggcauuuacagaucauccagccaagcuuccucuguaaugagaaggaagcagaucuaaauugauugguuugugagcuaaacaucacaucaaauuggggaaauggcccguguguguguguguguguguguguguguguguguguauucuaagagacacuuuauucaauauggaaagaauuuuaugcagcguucaaguuggucuuaugucgucugcacacauauacauauauauaaguauauuauacacauauacauuuccaagcauguuggugugccaaauauuauguauaaaacaucuaggaaagcaaauaacuugaugauagccuagcauauaggaaagaaaauacuuacauaggauggccauacagauuagugguuaagagugucuggugaaucucggcuccacuacugugggacuuugugucuugguuuccucaucuggaaaauguagguuugucuaccucagagaguguaaagauuaaaugagauaacccggauaaaggauuaguguagugccgagcauauaguaaacucucaauaaauguagguugcuguuauuacuucguuaauaugucaaagaaaaaagagguuggaccaaaagagcauuuucaaaauaaagucaaacuaugucacuagcacuuucaggucaauugggacuaaauuggacccccugcgaaaagguggaggggaucaaaugacgucgaccgccuuagcaacaggcccccaaagaaggugaauuuccguagccaauaagacucugugcuuuggaggagguagccaauggcugacggaaagagaaagagggaggacgcgccaauucuccugccugagccucggcccaacaaaauggcggcggcagcggugucgcuuuguuuccgcggcuccugcggcgguggcagugguagcggccuuugagcuguggggagguuccagcagcagcuacagugacgacuaagacuccagugcauuucuaucguaaccgggcgcgggggagcgcagaucggcgcccagcaaucacagaagccgacaaggcguucaagcgaaaacaugaccgcugagcccaugagguaaaacgcaaccccgucucaugggccccagcggucugggcccaggcaccgucugagucggguguuugggaaggcguucgcuugguggguuaggccuguguguugcuuagccgaaagaggcaucguuuucucuuuaggugagaaggguuucgggguaucggcgcaaggcuccgacggggguggggguggggaugggguggggggagguggggggggcgcggccuaggguauggggcgcuucuugcaaucuccccuaaacggugacgcuuggucgggcuccucuguuuauucuuuggugccugugggauugagaccucgaagucggaggcggucuuugguaucccggucauuuuugcuaaucuuugggccuagaaacugcguggggaagaagcggggggagggugagaagagggggaggggugggcgggcgcgaggaugugagaucccaggacgacuuagaggcguuuagguugcuggagaugggaagcacccgggcccugcgggauuuuuucucugcagccccaggagacaagccuuuuuuugauuggguuguggugcaguuccagguauuuagguaucuuuucuacuccauauccugaaggauauccuuggguuuauuucuaggcgaggggggacuuaacacaggguuuugcuuccagaggacccuaguauacuacuuuuugugauguccagccuuaaugggaccucaaguguuuccccacuuucugggcaaauuucgaggaguaauuaggcccuaucuuuauuuacuuauuuauuccaugaaggaugaagggcagguuaacgugggcugaugcgaaguaagauuuauugcaagggaaaaugccuggcaggccuccucuuaaccaaucaagcacguuuauuagguugaagcuguuuuucugugugcuucugauuugccucuugacgggucugaaaauuuggguagucaauaugaaauguauacacuuuuacccagguggcuggcuggcguuucaguuugacauuugaauuuucaucccacaaugugaauuaaguaauuuuuuuacucggagaugcauccuuggcguccaguggcaaaauaaaauuacaaggagcaugggucagaauugcauuucaaguuggcgaaaugugccuuugaguaacucuuagauuggcauauguuuuuagagcaauuuagcuagaauguagaauugggcaaugagccuaugauacguaugucuguauuucugcaugaacaagcaguagauuauauuuucuuuaccuuggggaaagauaugcuucaguucuuagauuguagaucucuaguuguguacacgauuguggccuugguuucugaauuugucaguaggcucaaauacaacaaaucuuuaucugugggguauuaggcacguaagugguacccaguauaacuuguuggccuguaauuaccaggcacucauguucauaugcauggaugguguaccuuacaguuaaauuaugaccucuagauuuuacuaaguuucacaaagucuacauuugaaacuauaguu

SEQ ID NO: 19131 - RNA, 22077 nt, Homo sapiens
gggaggcgggguguggggcgguagugugggcccuguuccugcccgcgcgguguuccgcauucugcaagccuccggagcgcacgucggcagucggcucccucguugaccgaaucaccgaccucucuccccagcuguauuuccaaaaugucgcuuucuaacaagcugacgcuggacaagcuggacguuaaagggaagcgggucguuaugagguaauucugcacguuugcccgcgugcucucugugcucugucgcaaaccucuuuggccggagccgacuuguucucucgucugcucuaaguucuuuuagcuuuuggcugggccccagggguccuaggcuuggagggcgaggcugcucacggguuuggugguuucuagccgcauuuuccccagcccagaaagcacccgaagucacccuucggggauggaucccacugaggaagggcugagauugccgcugggacccauuuuguccuuuuuccuauuggugaaaugcaguuccguugccuccagcucccagucggcgagaugggacuuaaugcuuauccugcaaaucucuaggcuucaaggaagggaccuugaaaggucauuuuacuuucccuucccccacgcuccuagaccgucgcagccaaaugagaaacggcccacaucucacagguuccugcacaaaaggauauuuuuccaagaggauguugauuuaacuucaggaguagacccccccgccccccgccacuaaagaauuggggugggaggguagggcggggcgaacuggaggaggcccugcagagcuuacguaacaggcgucugcugcccugcagcgcgguaucguuggacucuugggcacaggauuugcaucaggauugugacauacuagguaaugguagagcaggguguggcugcucauacuugcuggccuccaaucucauccccacguguggcuagaaaaguagaauuuuaaaauugggggaaguuuccucgugcacuuugggucucuuacucugcgcauguggaucucuagucacuugccaacacgguuucucucuuaucugccagaauuguugguagagugggcagcuuuuacauuuauccuuuuugucacgugugauauauuugugcauaccaggagcaaggugcaggaggaugagucgguauguaacugauggacuugacuguucauauaccuuaacaggauccaagagugguguuuuugaggggucauaaagguuucuguugauagcauuuugcaaccuugaccuuuuugggaagugguugauugauggguagguauuuauuuggcugguguaaucuagccccuuuuccaauuugggcugguucaaaugagggcuuguguuggauauuaacagacacguaagucaguaggagaucucccuuuacucuaacuuuaaacauaugaggacacguuugaguuagggaacuguauggguacccuaaaaggacauguagcucuccucuucucucuaauuucacuuuggucaauauuuuugcagguaaccgcugcccugcuguggagauagaagaacccaauaauuuauguccaugaaaaauaccugguuuccacauuuccccaaaugacauaggccuuuguaaucuggacaaaguaggagucacagccauguuaguacuagaggagugcccuuucuggcccucauacaauccuaaaaaaaggggauagacccuguaaaaaacaggacagguggacauuggcaugcaacuagcuuuuagguuuuaauuaguuccuugcaucuccccuguguucgacgcugauucuuccagaugcauggaccaacuaacagacaaggagugggacauuaugcugauaaccuuccuguaauugcagucuugggcuuuauuuccucucucucuagggaaacuggcuugaggaagcuagcugggggcgggauuggaggagcugcuuaacuuuucucccucuggaccuaauaaaguuucauuuagcacacgcuaacccaaagccuugaaaugauuggcuaguccuguuuugcugauggaaaaugaccuguucaggguuacugaacuaccaaguugguggcagagcuaggaguagaauuuaggucuccuuggcuaucaacuagauccucugaauauucgagacaaugaccaaggauacguugaaauagaacuuucucccguaaccuggauaccuucuacuuauuuaggcugaggacaggaaguuacaugguucccugauuauuaauguauuucuuuugaacagagagucacauuguaggccuacuuuuuuggaggugcuuaggcagccauguggugucagcucaauuccuuuuuguuucaacguggugguugcuggcgguguuuccggaauggggcuuccugaguaguggcugccucauuugucgucuuuguccugcagaagugaacuaugguauuugcugacucuucugguccacugguuuggauugccaagggaaauugauuuguugagguaacaugggauagccagaaaccucugacuuguuaauuaccagguuccaucuuaguuuuuuaggacuccgcaguugacuuuacagccucuuugaauacacuucugcuuauuuuugugguaauuuccuuucuuucucucauagguugccagucauccuuugccugcuuguaaagcacuuccuuuuugcuugcuccugccuuuuuuuuuaaaccuuacugguuuucuccaacuuguaacuuguaaagaaacugcuuugauguagugggaagagaaacaggaaaaaauugagagcagagaaaaagucacuaagacacccacaauaucccaguuuuccaucuggggcagugaagcauugauggacaugguuccuuugagaguuuuuaauggaacuggaccugggaccugagauuucaggugauagagacuugauauucuuauuccagcuaaaucaguauauuuuuuaauguuuuauuuugaaauaaagauucaugggagguuacaaaguuagagaggucuuguguucaacccauuuucccccaauggaugcaucuuaccuaauuauagaacaauaucaaaaguaggaaauugacauugguauaaaguguguaugguucuaugccauuuuauuacgugcguagauuuguguaaccgccaccacaaucaagauacagaacuauuagaucaccaccaagaucuccuucaugcuaccucuuuauaauaauaaccaccccccuuccugacuccugguaacuacugaucuguccacuguuucuaaaauuuugucacuucaaaaauacuauacagauugaaucacaugguauauaaccuuuugggauuaacuuuuuucacuuagcauaauguccucaaaauuuauccacauugucacauguaucaaaaguucauaccuguguauugcugaguaguauuccauggugugguuguauuauaguuuguuuaacuaucauugaaggauauuaggguuguuucugauuuggggcuauuacaaauacagcugcugugaacauuuguauacaagucuugguauggacauacgcugucauuuuucauggguaaacaccuaggaguggaauugcugggccacguccuuuugagguauccccagacuguuuuccaagguggcugcagcauuucacauuucuaccagcaguauuugaguaaucaguuucucugcuucauuaccagcuauuuuaguuauuuuucguucugauggauauguaguaauaacugacuuugugccugaagcaaagcucagggguguuauaaggaaacgaaaaaaaaaaaaaagaaaauugugcauauuuuauguaaaauggaacaaguagaaucuguaggcaagagcaguuccuguguuggaguccucugaggagaagcuaaaagcagagcuguugugaguguaggagauaaggggagguaauccagagggcauugaggagagaguaucaaccaagucuaauucauuaguaagcugacaccauggcagcuuggauagaugagacaguuucuuaggugucucuguccaaagauauuccucccuguaaggguuggggguagagaguagcacugcaagaaguggcuugugcccauccuuuugccauuaguccuuuugagcauaggccuucugggagguugcaugggggaaaaugacccaugguaaugggauauucucucuucuuuggaauguacuuuaaggcuggcaggcuccuuguucaggauauuuaaagaagacagagaaucaaguggccugaaacaaaguagaguguauuucuuucaucagaggcuuacugccuuuaauuuugaagacuuuaaaacauguuuuacuauagaauuauuuuuccucagccuaccuuuggaaaggcuguucuucagugagguagauuggaguucaggccuaguggauauaggaaauugguggucuucucaguaugucuguaggaguuuguaauugccuuagccuuagagaggaagggguauuuaaaaaggcagaggaaaaagauggaggcuuauaaucaaggauagcagcagucuucuugauuaggucauacuucacuguagucccuuugcaagugauguuagcuguuuuuaguagugguugauuuacuugucaaaucacagaauuacauuuuggagaaacauauaacaacaacacuuuuauggcauuuacugugugucagguacacuucuaagcacuuuacaaauugcugacuuacuaauucucucaguaacuacgagguagauacugucaucccgaugagaaaaaaaucacuuaaaaauaaucauggcaggcacaacucuuaaaccuuaaaaauagcugccauacauuauuguuuucauucacauugaaguaggcugagguuccaaggaguucagaauaauugguucuuaagaaugauaacauaguaaucuguuggguaagagauacugcaguacauuauuuucuugugucgucuugauuacuucccuucuaauuugccuguuugucaggugggcuggggcacaugucccacccucucuucucaggcuuuuugaaagaggcugucuuauguuguguguauugcuugaaggaccccuagucuuaaggccccaggcuuucuccaaaaagaaugauuuucucuuaguguguuuuauuuuuauuuuaauuuuuuucucgagucauguuaguuucacgaggacccagaaauaguaucaagggaauuaggaucaagaugcauuccuuauuauuccucaccccucuagcugcuacccggauacuauugugccaggcccagacagauaucuuuuuagguggaacuagcuuuagcuucccagaucuucagggcuaguuccugugauuuaaguuagguuuuuuuuuuaaaauucuuuuuaaaguaugaauacauaccuaaaagggcacaaaucacaaguucaaagaauuaccacaaaaugagcacauuuguauggucacugagguuaagagauagaacauuaccagaaccccaaagccucuggugucguuaucccagucaccacucccgccauccuccccaugacuaaccacuauuuugacuuuuaaugccacugauuauuuuuaagaugagauuugaauuucugacuuauuuaacugguucauuaaaaaugcaucuccuagucuuugauggaacaguaaguugaucauggucuugcaucuuucuuuuuuagagucgacuucaauguuccuaugaagaacaaccagauaacaaacaaccagagguaaggucccugcuaauccuugggcuggguuuaagauguguguagguacacaggaugaaauguuuuuccuuucauauuguauuauggaacuguagcaacuuaaaacaaaugauuuuggcuuucuaucaacccacucucugaucugcuuucuuauuuaugagaauauacaaauauaagcaaaaucuuaagaaagugauuccccuucccuuguuuuuugaaaauuagaagaauuuggaguucauuuucuuuuuuugagauagggucucacucugucacccagacuggaguguaguggugugaucacgguucacugcagccuuaaccuucugggcucaagcaguccucuggccucagcuucccgaggagcuggaacaacaggugcacaccacuacaccugguuaaauuaaaaaaaaauuuuuuuuuguagagauggggucucacuauguugccuaggcuguucucaaacuccuggacucaagugauccuccugccuuggcuuccuaaagugcugggaccacagguguaagcccccauaccuggcagaguuauucauuuuuaaagaauauaaaaguuggcugggugcgguggcucacaucuguaaucccagcacuuuggaaggccgaggcaggaggauugcuugaggccaguaguucgagaacagccuggccaauauaguaagacaccaucucuauaaaacacacacaaaaaauauaaaaauuuaagguuacuuggcuucucuugcaaaaugaagaacuauguaagagaaggauuuuaaaaguaccaguaguuacuaagguuauauguaguuuuacaagcccccauucaaauggcucagauaagucaauuuuugagaauuuucauuuguuuuugcuuccaaaaaaacaaacaggaaagacuucagaaguacguuuucagucaguuuagcugcuccagugucuuggauccuagauucagaaacaaauuuuaagugagaguacugcucuugcuuuugacuagauuauaaaaggucuuuauuuuugucuuuacuuucuuuuuaauuuuuuuaauuuuuaauuuuuguagauuuuauauauauauauauauggguuacaugagauauuuugauaaaagcaugcaauacauaaucacaucagguuaaaugggguauccaucaagaagguuuuuauuuaauuuuuuuuuuuuuuugagacagggccucguucugucgcccaggcuggagugcaguggcacgaucuuggcucacugcaaucucugccuccugggcucaagcgauccucccaucucagccucccagggagcugagaccacaggcgugggccaccacaccuggcuacuuuuucauauuuuuuuuguagagacagcguuuugcccuuuugcccaagcuggccuugagcuccuggaccccgcccaccuuggccucccaaagugcugggaauacaggcaugagucacugugcuccgccuauuuuaaauuuuaaaugaaggguuuguguuggcaaggugcuuucuaaugaucuagaccagugguaucuaauagaaauacaaugugagccaaauuguguuaauuaaauuaaagggacauuuaacuuuuuugguacuaagucuucaagaucuggcauguguuuuuauacuacagcacaucucaauuugaucuaguuauauaucugguacucaacagacacacaugacuaaaugacugucguaauggacagugcaggucuagcccagaacauuuucagguauugguccuagaauagagccugucauuuugccaagcacaucccugcuguaccauaguggcagggucuuuguauaaggcagaucugaucccgcuugaucuucauuauugugcaacacacagaaacgauuggaaauaugccuaucaaguuauuuuaagaguaaagaaacauguuuggaaaucuuuucauuuccggaaauccauggaguugauuaacaaaaugaagcauuagaaauaauaaaacuugcugauaagggauaguccugaaaacuaauugguuccauugcacaaacuuuguaccugauacagauuuuuaaauuugauauaaaggaguucuuauaucugcuaaauauuaauaacauaagauauuuuaaaaguauaacuuuuuuaaucauuccauucuuugcucagaugucaucauaucagacuuucccuggccauccugucuaaaaaucuccucuaccauuguuccccggucauuuuuguccucaaaaguaggggaacaaaaauggggaacaaugguuuguuuuuuuucuguaucucaccaucugauauauuacauguacgcacacacacauacauguuuauugucucucuccauuagaauuucacuuccaugagaacagagaguuuuuaaaaaaguuuucuguuucauucucagaaccuggaaugaugccuggcacaaaagaagcauucaauaaauauuugaugaauaaauaaaugcuuuucuugaucaauuuuaauuucuuauaaacuggcaaaauggcaaguuaguagcagguuuauaacaaaacuuuuaaauguuuaaagggaguuaauuuuuugauuaauuuauaauguaaugaaugugauacauuauggaaaccaagcucuagacagugcaauuauuuuuuccuacauaaaaaagugacuuaggaucuauuaauaggugcagaaaaguuacuacauguuuuuuauuuuuccccaaauuuccuuugaugguuucaagauuugagaauuuuauguauuuuccauagucauauaagaaguguuuucagggguccccaagaucacccacauaucucaugaugauuugcuaggacucagaguuguucucauggcuaaaguuuauuacagugaaagaaugcaugacaagauuaggaagaggaaaagacaugggggagucuagagaaauccaugggcuuccaguuuccugugaggggacacaucaaguguuuuccuuucuucagcagugaaaaaugcaguaauugucugcaguguuucugccuggagaagcaugcuagagacucagaucccaagauuuuuguugggaacugguaacauagggauccucugccuagcaacuaccaaaauuacaaacuucugcugggugugguggcucacgccuguauucccagcaguuugggaggcugaggccugcagauaacuugagcccaggaguucaagaccagccuggacaacaugguaaaaccccuacaaaaaauacaaaaauuagcugggcaugguggugcauuccuguaguuccagcuacuugggaggcugagguaggaagaugaccuaagccccuggggagguugaagcugcagugagcugagauugugccucuccacuccagccuguugggugacagagugagacccugucucaacaaaaaaaggaaaagaaaaaaaaaauucuagacuucuagaguggggcagguguucagcauaaaucaccauguuuguauagacggucuaggaagagugaauagcccuuguuggucuugucaguuaacuuugaaagccaaguucccagauaccagccaggaucuaaucuugcagacagguccuucuguagauaguagccucaggccugcuguguuaacucuugucugugaaaggggcagauacauaaugagauuguacaauccuagguggaggguuggcauugcauuuaacuucuuaaggaccaccauugaauuacugauaguagauuugaaggaacuuggagaagaaaaggagcuuuaugcuuuaugagguuaucaauaagcuaguucccacuaauuucuaggaguaacuucauucuguuuguugucucucuuugguugcaggauuaaggcugcugucccaagcaucaaauucugcuuggacaauggagccaagucgguaguccuuaugagccaccuaggccggccugauggugugcccaugccugacaaguacuccuuagagccaguugcuguagaacucaaaucucugcugggcaaguaagugccaggcucuggugcugguagacuuuguggcgggggaaguugucaagcacguuguuacugguuuuuaacuuucauacugcucaagugucuucaucucuuccucuucucagggauguucuguucuugaaggacuguguaggcccagaaguggagaaagccugugccaacccagcugcugggucugucauccugcuggagaaccuccgcuuucauguggaggaagaagggaagggaaaagaugcuucugggaacaagguaggaccugugauuuugacauuauugggggugagggccugagucuguaagagacugugguugaagaauagagaaagcucauuuauuuuaacuuagacaccuuuuauugaagcauacaaugccgacacagcuugauggguuaucucaaaguaaacacacuuguguaaccaccacccaggucaaggaauagaauauuaccagcaucccagaagcccuccuucauguucaggugguguuuaaauauguuugaaaaauaugugaacaccuuugaggugaaagaguauucagugaauaugauggucaugaugaugucaccuuggauuuaaggcauuuucuuaagauguguaaaguauguuccuuuaaaucucucuuuaagauagagguacagguaucgacuuauuucauaaagaaacuaagucucaaaaaaaaaaaaacuuaaguuucugaaaggcagucauacgauuaaaguuagaggcaguggugcuguuggucuuuagagcucagcccauucaaucagcaaacuuuuucuauaaauggccagauaguuaauauuuuaggcuuucuguguugugcagucacuuccaucugcauauagucucuguuggaacuacucaccucugccgauguugugcaaaagcagccauagauaacucaccaaacagauuacugugaacugacaaccagaauucaaauauucaaugauaaaacuggcucuuugcagaugauuuugaauuugcccauugacuagaaaggaagcugaaggcauuuuuuaguacuuuccacuauucuggucuuuaguaucucggagaacaagaugcucugagucuagugucucagucuccuuuggcuucucacauuuauuaaggucauugggagugccugcuuucaagcaguuucuuuuuuuagcaccaaagaugcuggucuugccuuauccugcuuuuggcauggucuugcugcaguauuaggagucaaaugcugaccuaaaauuugguguccuuuuaaucuggaacucaugaugcaugaacucuagggcuuagaaguggcaggaggcaaagggcauauugaagcaaaacuuuuuauuuaggaaaugaugagcugacuauguagucuaugacuuuuuuaguaaacugacuugacauucacuaucuaauggcuuuuaauaccugaaauuucaggagucagucccaaguucaaaauggauuaaaaaaacagugaggcugggugcggugccucaugccuguaaucccagcgcuuugggaggccgagguggguggaucacaaggucaggaguucgagaccugccuggccaacauggugaaacccuguuucuacuaaaaauacaaaaaagucgggcaugguggcaagugccuguaauuccagcuacuccggaggcugaggcaggagaauugcuugaacccaggauguggagguugcagugagccaaguuugcagcacugcauuccagccugggcaacagagcaagacucugucucaaaaaaaccacaaaaacaaagugaggauaugaggacauaaacauuuucccuuuauccaaagugcccacauugaucuuuuaagggccuucucuuucuucuaguuauuugcagaucaguaaaugagaaauggguucugauugauauuauuuccauggcaccuuuuuucaugaagagcuuucaauuuacccuguuuuuccuuaaauaucuuuuuaaagagacagggucuuguucuguugcccaugguggagugcaguggcaugacauuaauuauugcagccucaaacuugagggcugaagugauccuccugccucauccuuguagggagcuaggacuacaggcacauaccaccauguccaacugaccuuuacuuuuuuuuuuuuuuccugguagagacggggucuugcuauguugcccaggcucaucucgaacuccugggcuuaagugauccucccauauuggccucccaaaguguugggauuauaggugugagcuacugccccuggccuccuuaaauaguucguaaauggagggguuauuaugccuuuuugauagaagggaaaauuucagagcaacuucccaaaggugacacaaugaauuagugucagagcuggacauagaacucaggucuccuuacauuugagcauuguuaucauuacuacaugugucaucuuccaaucacuaguggcagauguuauuguagucuacagagcuuaugggagugccacaaucuucaauuuuagcauuagugccucugcaauucuuuggaucuuuagggaaaagccccauuuuuuauggcaguccccuucaccuccuugauacauaggagcauaggagugggcagugacuuaaaaugaacaucugcuuugugcuauguacucuucuguguccuguccccuuucaucuggcuugcuuccugugccucuuugcuuaaucuccugccagagacucucugguuugcuuauccucccaucuugcuuucuguccccuuugggguaugccuugauggcaagcugacauuuuaaagcucuauguuuaacuucuacauuuucuuccucucuuuuuguagaaguauauuucuuguuuucucagaugccuagcuuccagagaaggucauaaaauaccuuuuugucaaugugaaguguuucugagguucuuuucuguugucauguuuccaucugccuucucugucccagcuugcccuuguugcuuuuaugaggaauaugugugagagccccuugcacuucgcagaaaggccuugguagccagcagcuugagucaaguaugauacuaucacaaggagaauguuuaaaaugaggaacuaagucaaggagagggaaggauaaucagaaccuugagcugaaggcuggggagaggcuaguggggugugguuaacuucaugugauuagagguaaagccaucguucaggaauauuagguuugcaauuugagggaaguuaagggagagcagaaacaugcagaaaugaccaaaguaucuggaauauuuggaagaaagaacacauccuacugcugguuguaaaaaaucgcugucccaccuacucagggucuuuagagauguucaagaggacucuugguguaugaaaugcuuuuauaguugucuuuggagccaucacauuuucuguuuuuguuuuucucuauagguuaaagccgagccagccaaaauagaagcuuuccgagcuucacuuuccaagcuaggggaugucuaugucaaugaugcuuuuggcacugcucacagagcccacagguaccaagaaccuuguagacuaccacacugagaacaguauuccuauuuacuugaguagcccaagcucuggguuguuuuuggagaguuuuguauuauacuguaauccuuucagcuucucuaauuggaacugccacuauggcucuuguugaguagcucucauccaaagaggaaauaaagguaaaaaaauguugguaauuguagggcuuuuuguggaguuucaggaagagguugcucuuucucaccuuagauauuuuguacagaguuauccuuuuaugaacguuauaagaucagacucucaugcugucaguaggaagcaaauugaggaauccucuucugcuaucaucaaccggccaauuacuuacugugauuugcccuuuggccugccugaagaguguuaacuggguaucuuaaauucuaccuaaguucauuacuuuuuuacucuuucccuuugaccuugcacuauuaguuaaaaaucuuaucuuguaccuaaguguuuuuuguugcaauguagggaugaaaaccaugauuucuugcaguccagaaguagaaauauuuuagugauaaggagcuggccucuaggacuaggaggaaugauagggauugacuagaaucugaaugucuuugaucuuuucuagcuccaugguaggagucaaucugccacagaaggcugguggguuuuugaugaagaaggagcugaacuacuuugcaaaggccuuggagagcccagagcgacccuuccuggccauccugggcggguaugaagaacucuuuaagaucaugcuuuaaguauuguuugccugguaguaggccauaacuugggugguuuauugucauauagcucagucacacuggguaacugaggagaauuuaauaaaggaacuacaggcugggcaugguggcucacaccuguaaucccagcacauugggagggcccaggcaggaagauugcuugagcccaggaguuugagaugggcccagacaacaaagugagaucucaugucuacaaaaaaaaauuagcugggcgguggugguaugcaccuguggucccaguuaccagagaggcugaggugggaggaucacuugagccugggagguagaggcugcagugcacugugaucacgccacugcacuccagccugggugacagagcaagaccguuucuaaauaaauaaauaaauaaauaaauaaacaaacaaacgaacgaacuacauacagagguguggguaggguucagggaaaccacaaagggacaguacaguaauuuggggcuaccaacaggcaucaccauuucuaugccugaagggacaaagggaggggaaugguuaucagaauucagagaggaaaguugguguggagagagcuaucugaugggaacuguagccuuuggucaaaggacacaagaucugguagggagggggagccagggcaauaaauauucugaucuccuuucagucuccugcugcugcacccccucccacccucaauuuggcugaaacccaaauggaagccagagcgcaagaaagcuccuugauguaguccaugcagguccuccuccugugaugcaacaggguagagaaggauagaagauggcucugcagggaagaaugggaaagauccaccauaggugcucauuuagcaauuuugaagugcuugagccuuauaaccuggcaggguauaacuauauaaccuggcaggguauaaccauauaaucuggcaggguauaaccauauaaucuggcaggguauaaccauauaaccuggcaggguauaacuaugaaaaccucuucauauguguuuaauauauaauuuagaccucauuucuccagauuacauaccuauuuuaucuuuucuccuauagggaaaggcagcaaguagauaaugauuuuccaauggguuaguuaaaaauagaaauuucagaauugaggguugagaggaggauaaauuuuaggugagagagcuagcacugcuuggauaagacaauuuccugugacuugguguggugaucuagguagcagucucuuuauggcuggaggcccauuacccuucuaugagcaggguuuuuucccccaggggagugaacauacuaucuccugaugaaaauugacucuggaguugggugucaauuucagguagcauaguugcuuauacuguuuggcucugugucuccacccaaaucucaucucgaauuauccccacguguugugggagggaccuggugauuggaucaagggggcgguucaccccauacuguucuugugauaguguuguuuggcaguuccacccucgcucgccucucucuugccaccauguaagaugugacuugcuuccccuuugccuuccgccacgauuguaaauuuccugaggccucuccagccaugcggaacugugagucaauuuaaccuuucuuuauaaauuaccaagucucagguaguccuuuauagcauugugaaaaugggcuaauacaguugcuuucuaggcuuuaugagcccaguuucagagucuuaaaaauaacucagguagauacagguuguugugucuuguucuuggaaaaagguaucuauuccugggcuuuguucuucaacuuucuguagaccuggaauaugggagugagugccaccuagugcuaccuuaugguuagguuuuuagguucagacugaaauagcuguuacggggaauuggaugugagauuuuuuugccaccuuucuuguaguguaguuucccuaggccauuaacaguuuuugggaaaacuuuuauauuuuauuaaacaaacuuuauuguaagaaacacucauauguauggaaguugagagaauaguguaguaaacucccagguauccauuacccuguuucaacaauuaauugacaguuuugcuaaucuuguuucuuuuauguccuaacucuguuuugucaggaauguacacacacacacacacacauauauauacacacacacacguauauauuccugacaaagugaauacaagugaaauaaauauguguauauauguguguguguguguguacauauauagauauuuuagauauauagacauaucuauauaucuagaucuagaucuauauauagauuuuuuuuuuucugauacagggucucacucugcugcccaggcugaagugcaguggcaugaucacagcucacugcagcuuugaccuuccaggcucaagcgauccucccaccucagccucccuaguaccugggacuacaggcaugcaucaccaugccuggcuaauuuuugaaucuuuuuguagagacagggucucacuguguugcccaggcuggucucgaacucuggggcucaggcgaucugccugccuuggucucccaaaguguugagauuacaggcgugagcuugugcccugcugucaggaauguuuuuaaguuagccuuagacaucauauacuuucacuuacauagguugaguaucuuuuaucugaaaugcuugggaccauaaauguuuuggauuucagauuuauuuuuggauuuuggaauauuugcaugguacuuaccaguugagcauccuaaucugaaaauaugaaaucugaaauguuccaaugauauuuccuuugagcucaaacaguuuugaucuuggaggauuuuagauuuuuggauuagggauacucaaccuguaauacuccuguauacaucuuguaacugcuaagcagauuucuuuuaaauaaucaccauauuauaccuaacaaauuuagcaguuuuguuacuaucauccaauacccaaucuguauucagauguucuugaucaucucagaagugucuuuuuacaguugguuuguuugaauaaggauucaaaugaaguccaugcauugccuuuggcuguuagguaucucuuguaauaaucuccuauuuauuacuuucauucuguugauuuguugaagaaacaggcauuugagcuguaagcuauucuuuagaagaaauugaacuccuuucuaacugcuuucuucccuuuguguguguauguguguguguguguguguguguauuuaaaacaaucuaucuuuacccuuggugguaaccaaucuuuacaacugaaauaaauaguaaauaguuucuugccaucuguucacccacaucacuguuguuucauaccuccuuuucacaaauccuagcauaggguuucucacuggauaggcauuaucuuguuuauugaaugaagaaggaaacagacacaaggugguuuguccacguaagugggauuuaguuauaugggaauguuuauggaaggcaggcuauuacuuuguuucucuuuaguuuggaucuuuuuugucucauagggagaugcaagauacauguguauuuaucuuauuuccauguacuagaaaauaagaucccaaaggguagggaucuuucuguugccuuugcccugugauguuucucaaagaccuagaauagugcuuggcacagaguaggugcccaguaaauguguugaauugggugacccaauaaaaauaaaugccauaaagaaaaugucccaggcugggcaugguggcuuaggcauguaacccuagugcuuuggaaggccaaggcaggaggaucacuugagcuuaggaguuugaaacuagccugggcaacauagugagaccuugucucuacaaaaaaauuuaaaaagaaaaauuauccagggguaguguuguacgccuguggucgcagcuacuugagaggcugaggcaagaggauugcuugagccuaggaguuccagguuacagugagcuaugauuguaccacugcacuccagccucggcaacagagugagacuuuguguugaaaagagagagagaaaaaaaugucccagcaacugagcauaggguaugacuuuaggaauauauauuuuuguucaguauauauuuauuuaguauacaguccagucaaucccugcucuaagguuaggauaauucugaguggcucugggaucccacaauuagcaaucgugcuuagauacaauuagcaaucuugaugcucugaauuuguguguguguguguguguguguguguguguguguguguguguuggggaaugugcaaaauagauguggaacccauaguuuccuuagacaagaguaggucuucugagcccugcuuaaaaaaagaauauggauuuaaaucuguuguccaucagcuucuagguagaauuaaaaaaaaauguauugaugguaaguggggugaggaauuuuuaaaaagauacacugaugucuggagccauaccuuaaaaggauuucuuagaaauggauugaguuuuuggguuggagaaacauagggcaaaguuaggcaguacuuuugucacuuugagacuuucucuguuccugugccuugaaauagaaacucaguuucuauguaauaccacuucucuaguccauucuucuuuaagugaugauucuugcuuucucuuguagagcuaaaguugcagacaagauccagcucaucaauaauaugcuggacaaagucaaugagaugauuauuggugguggaauggcuuuuaccuuccuuaaggugcucaacaacauggagguaggaaacaaaugccaaguggaugugaaauagcucuccaugauaauagcagguuguauaaauguaaaaagaaaacagucuuuugacaugagcccugaaaauucccauuuuuauuuauuuuggcaagucuuucgucuuugcauuguuccuuuauauuguauugugucugguuccugucugcuuugugaggcagucuuguucuuaguauagaugcugaccuccaucauuuuggcuccccuguguagauuggcacuucucuguuugaugaagagggagccaagauugucaaagaccuaauguccaaagcugagaagaauggugugaagauuaccuugccuguugacuuugucacugcugacaaguuugaugagaaugccaagacuggccaagccacuguggcuucuggcauaccugcuggcuggauggugagucacuugaguggguugguagugugagugaacagaaacucuguggugucauuuauucauugauucagccaaucaacaagcauuuuaaaacaaucucuauaggagaucugucagagagggcucugcauguugcagugagucccucauggaagaauccaugggagaaaagcagugcuauuggauuacuggccuucaguaaugcaguaauguguugcaaaacuuuguuguuguuguuuuuuuuuuuuuuuuugagacagagucucgcugugucaccaggcuggagugcaguggcaugaucucggcucacugcaaccucugccucccagguucaagugauucuccugccuaacccuccccaguagcugggacuacaggugugcaccaccaugcccagcuaauuuuuguauuuuucauagagacgggguuucaccauguuggucaggaugaucucaaucucuugaccucaugauccaccugcugcggccucccaaagugcugggauuacaggcgugagccacugugcccggcccauuuuuaguuuuaucuguuuuuucuucaucuguuuaauguguauuaaguacuuacugcguacuggagauagugucauguacuuucaugguuuggguuguuuuggauuauguugcuaucuagaaagcuauauaagaaaacuuucucauaugaaaaaauuaaguauacugauuacaagcagggagaaauguaaguguauauuaaagacuaauauaguugauuuuagggugcuccaaauaucauuuugauugcuguauaaaauuguaucauguuuuuacaugcuaguuugcuuauuuuucuuuucaggcauucacguauuauuuaguucaguguuucucaaaguauguuccuaagaccagcaguaucaguaucauuuuuggaacuuguuaaaaaugcaaguucuugggucccaccccagaccuaccgaaucaggaacugaggguggggccaaacagucuguuugaauaagcccuccuggugauucucaugcauggcaaaguuugaguacuacugaucuaguuuacugucauucccaacacuauugacaucuguuguuuugugggggacuguugaauuguaagguuguuuaaagcauccuuggccacuagaugccaguagcacccucccaaguugcaacaacaauauuucuagacauugccacaugccuaucuauuaugaaggggcagaacugaccugguugagaaccauugaucuaguuuucacuaacauaaauaguguggcuaagaaugucuuuauuaaauaacuuuugagguuuuccguuagacuugaucuuccauacaguagaauuuuugaguauaaagggcaugaacagguuuauaaagacugaaggguacuauuuguuucuagaagaaacuuuggugugcagcccugaguucuggucuugguggaggugguguuuaaguagcuuuucuugauagcucaucuucucuuucaccucuaccccucagggcuuggacugugguccugaaagcagcaagaaguaugcugaggcugucacucgggcuaagcagauuguguggaaugguccuguggggguauuugaaugggaagcuuuugcccggggaaccaaagcucucauggaugagguggugaaagccacuucuaggggcugcaucaccaucauagguaagcgguccuauacaaagcuaauacccauauaagcuggcagaauucugaucagaggaagguggaauggagaacuucuucuaugucucuuuauucuggguaaauguuaagagguaaacagguagguaauuuacagaggagccucuugguaagauagaguuggggguuuaucagcuaccuuuuggguuggggagcacacugccuuacaguuuuggugccaaucccuuuuuuuucuuuucucucuuuucccuuuuuaccuggcuuucauucaacaggugguggagacacugccacuugcugugccaaauggaacacggaggauaaagucagccaugugagcacuggggguggugccaguuuggagcuccuggaaggugagggucuucuguuuuuuggcuuguuugggauaaggguggacugugcagugagagguggguagaauggaguggagaaaguuagaagguaguguugucauuagcagucauuacuaccugggcaguacagaggaacuucagauaaagcuccuggcauccacugaggcggggagggacagauagaaacuuggucugagaguuauggucuaguagaccuggaauccacaauguaaaaguuggccagcuccuggccauauauccuaaaaaagagcuggcauguuauugggaagauaaagugggggaaaucuggcuuacugggcccuauaguaaugcugucuauguaugugugcucucucaaaaacagguaaaguccuuccugggguggaugcucucagcaauauuuaguacuuuccugccuuuuaguuccugugcacagccccuaagucaacuuagcauuuucugcaucuccacuuggcauuagcuaaaaccuuccaugucaagauucagcuaguggccaagagaugcagugccaggaacccuuaaacaguugcacagcaucucagcucaucuucacugcacccuggauuugcauacauucuucaagaucccauuugaauuuuuuagugacuaaaccauugugcauucuagagugcauauauuuauauuuugccuguuaaaaagaaagugagcaguguuagcuuaguucucuuuugauguagguuauuaugauuagcuuugucacuguuucacuacucagcauggaaacaagaugaaauuccauuuguagguagugagacaaaauugaugauccauuaaguaaacaauaaaaguguccauugaaaccguga

SEQ ID NO: 19132 - RNA, 22077 nt, Homo sapiens
ucacgguuucaauggacacuuuuauuguuuacuuaauggaucaucaauuuugucucacuaccuacaaauggaauuucaucuuguuuccaugcugaguagugaaacagugacaaagcuaaucauaauaaccuacaucaaaagagaacuaagcuaacacugcucacuuucuuuuuaacaggcaaaauauaaauauaugcacucuagaaugcacaaugguuuagucacuaaaaaauucaaaugggaucuugaagaauguaugcaaauccagggugcagugaagaugagcugagaugcugugcaacuguuuaaggguuccuggcacugcaucucuuggccacuagcugaaucuugacauggaagguuuuagcuaaugccaaguggagaugcagaaaaugcuaaguugacuuaggggcugugcacaggaacuaaaaggcaggaaaguacuaaauauugcugagagcauccaccccaggaaggacuuuaccuguuuuugagagagcacacauacauagacagcauuacuauagggcccaguaagccagauuucccccacuuuaucuucccaauaacaugccagcucuuuuuuaggauauauggccaggagcuggccaacuuuuacauuguggauuccaggucuacuagaccauaacucucagaccaaguuucuaucugucccuccccgccucaguggaugccaggagcuuuaucugaaguuccucuguacugcccagguaguaaugacugcuaaugacaacacuaccuucuaacuuucuccacuccauucuacccaccucucacugcacaguccacccuuaucccaaacaagccaaaaaacagaagacccucaccuuccaggagcuccaaacuggcaccacccccagugcucacauggcugacuuuauccuccguguuccauuuggcacagcaaguggcagugucuccaccaccuguugaaugaaagccagguaaaaagggaaaagagagaaaagaaaaaaaagggauuggcaccaaaacuguaaggcagugugcuccccaacccaaaagguagcugauaaacccccaacucuaucuuaccaagaggcuccucuguaaauuaccuaccuguuuaccucuuaacauuuacccagaauaaagagacauagaagaaguucuccauuccaccuuccucugaucagaauucugccagcuuauauggguauuagcuuuguauaggaccgcuuaccuaugauggugaugcagccccuagaaguggcuuucaccaccucauccaugagagcuuugguuccccgggcaaaagcuucccauucaaauacccccacaggaccauuccacacaaucugcuuagcccgagugacagccucagcauacuucuugcugcuuucaggaccacaguccaagcccugagggguagaggugaaagagaagaugagcuaucaagaaaagcuacuuaaacaccaccuccaccaagaccagaacucagggcugcacaccaaaguuucuucuagaaacaaauaguacccuucagucuuuauaaaccuguucaugcccuuuauacucaaaaauucuacuguauggaagaucaagucuaacggaaaaccucaaaaguuauuuaauaaagacauucuuagccacacuauuuauguuagugaaaacuagaucaaugguucucaaccaggucaguucugccccuucauaauagauaggcauguggcaaugucuagaaauauuguuguugcaacuugggagggugcuacuggcaucuaguggccaaggaugcuuuaaacaaccuuacaauucaacagucccccacaaaacaacagaugucaauaguguugggaaugacaguaaacuagaucaguaguacucaaacuuugccaugcaugagaaucaccaggagggcuuauucaaacagacuguuuggccccacccucaguuccugauucgguaggucuggggugggacccaagaacuugcauuuuuaacaaguuccaaaaaugauacugauacugcuggucuuaggaacauacuuugagaaacacugaacuaaauaauacgugaaugccugaaaagaaaaauaagcaaacuagcauguaaaaacaugauacaauuuuauacagcaaucaaaaugauauuuggagcacccuaaaaucaacuauauuagucuuuaauauacacuuacauuucucccugcuuguaaucaguauacuuaauuuuuucauaugagaaaguuuucuuauauagcuuucuagauagcaacauaauccaaaacaacccaaaccaugaaaguacaugacacuaucuccaguacgcaguaaguacuuaauacacauuaaacagaugaagaaaaaacagauaaaacuaaaaaugggccgggcacaguggcucacgccuguaaucccagcacuuugggaggccgcagcagguggaucaugaggucaagagauugagaucauccugaccaacauggugaaaccccgucucuaugaaaaauacaaaaauuagcugggcaugguggugcacaccuguagucccagcuacuggggaggguuaggcaggagaaucacuugaaccugggaggcagagguugcagugagccgagaucaugccacugcacuccagccuggugacacagcgagacucugucucaaaaaaaaaaaaaaaaacaacaacaacaaaguuuugcaacacauuacugcauuacugaaggccaguaauccaauagcacugcuuuucucccauggauucuuccaugagggacucacugcaacaugcagagcccucucugacagaucuccuauagagauuguuuuaaaaugcuuguugauuggcugaaucaaugaauaaaugacaccacagaguuucuguucacucacacuaccaacccacucaagugacucaccauccagccagcagguaugccagaagccacaguggcuuggccagucuuggcauucucaucaaacuugucagcagugacaaagucaacaggcaagguaaucuucacaccauucuucucagcuuuggacauuaggucuuugacaaucuuggcucccucuucaucaaacagagaagugccaaucuacacaggggagccaaaaugauggaggucagcaucuauacuaagaacaagacugccucacaaagcagacaggaaccagacacaauacaauauaaaggaacaaugcaaagacgaaagacuugccaaaauaaauaaaaaugggaauuuucagggcucaugucaaaagacuguuuucuuuuuacauuuauacaaccugcuauuaucauggagagcuauuucacauccacuuggcauuuguuuccuaccuccauguuguugagcaccuuaaggaagguaaaagccauuccaccaccaauaaucaucucauugacuuuguccagcauauuauugaugagcuggaucuugucugcaacuuuagcucuacaagagaaagcaagaaucaucacuuaaagaagaauggacuagagaagugguauuacauagaaacugaguuucuauuucaaggcacaggaacagagaaagucucaaagugacaaaaguacugccuaacuuugcccuauguuucuccaacccaaaaacucaauccauuucuaagaaauccuuuuaagguauggcuccagacaucaguguaucuuuuuaaaaauuccucaccccacuuaccaucaauacauuuuuuuuuaauucuaccuagaagcugauggacaacagauuuaaauccauauucuuuuuuuaagcagggcucagaagaccuacucuugucuaaggaaacuauggguuccacaucuauuuugcacauuccccaacacacacacacacacacacacacacacacacacacacacacaaauucagagcaucaagauugcuaauuguaucuaagcacgauugcuaauugugggaucccagagccacucagaauuauccuaaccuuagagcagggauugacuggacuguauacuaaauaaauauauacugaacaaaaauauauauuccuaaagucauacccuaugcucaguugcugggacauuuuuuucucucucucuuuucaacacaaagucucacucuguugccgaggcuggagugcagugguacaaucauagcucacuguaaccuggaacuccuaggcucaagcaauccucuugccucagccucucaaguagcugcgaccacaggcguacaacacuaccccuggauaauuuuucuuuuuaaauuuuuuuguagagacaaggucucacuauguugcccaggcuaguuucaaacuccuaagcucaagugauccuccugccuuggccuuccaaagcacuaggguuacaugccuaagccaccaugcccagccugggacauuuucuuuauggcauuuauuuuuauugggucacccaauucaacacauuuacugggcaccuacucugugccaagcacuauucuaggucuuugagaaacaucacagggcaaaggcaacagaaagaucccuacccuuugggaucuuauuuucuaguacauggaaauaagauaaauacacauguaucuugcaucucccuaugagacaaaaaagauccaaacuaaagagaaacaaaguaauagccugccuuccauaaacauucccauauaacuaaaucccacuuacguggacaaaccaccuugugucuguuuccuucuucauucaauaaacaagauaaugccuauccagugagaaacccuaugcuaggauuugugaaaaggagguaugaaacaacagugaugugggugaacagauggcaagaaacuauuuacuauuuauuucaguuguaaagauugguuaccaccaaggguaaagauagauuguuuuaaauacacacacacacacacacacacauacacacacaaagggaagaaagcaguuagaaaggaguucaauuucuucuaaagaauagcuuacagcucaaaugccuguuucuucaacaaaucaacagaaugaaaguaauaaauaggagauuauuacaagagauaccuaacagccaaaggcaaugcauggacuucauuugaauccuuauucaaacaaaccaacuguaaaaagacacuucugagaugaucaagaacaucugaauacagauuggguauuggaugauaguaacaaaacugcuaaauuuguuagguauaauauggugauuauuuaaaagaaaucugcuuagcaguuacaagauguauacaggaguauuacagguugaguaucccuaauccaaaaaucuaaaauccuccaagaucaaaacuguuugagcucaaaggaaauaucauuggaacauuucagauuucauauuuucagauuaggaugcucaacugguaaguaccaugcaaauauuccaaaauccaaaaauaaaucugaaauccaaaacauuuauggucccaagcauuucagauaaaagauacucaaccuauguaagugaaaguauaugaugucuaaggcuaacuuaaaaacauuccugacagcagggcacaagcucacgccuguaaucucaacacuuugggagaccaaggcaggcagaucgccugagccccagaguucgagaccagccugggcaacacagugagacccugucucuacaaaaagauucaaaaauuagccaggcauggugaugcaugccuguagucccagguacuagggaggcugaggugggaggaucgcuugagccuggaaggucaaagcugcagugagcugugaucaugccacugcacuucagccugggcagcagagugagacccuguaucagaaaaaaaaaaaucuauauauagaucuagaucuagauauauagauaugucuauauaucuaaaauaucuauauauguacacacacacacacacauauauacacauauuuauuucacuuguauucacuuugucaggaauauauacguguguguguguauauauauguguguguguguguguguacauuccugacaaaacagaguuaggacauaaaagaaacaagauuagcaaaacugucaauuaauuguugaaacaggguaauggauaccugggaguuuacuacacuauucucucaacuuccauacauaugaguguuucuuacaauaaaguuuguuuaauaaaauauaaaaguuuucccaaaaacuguuaauggccuagggaaacuacacuacaagaaagguggcaaaaaaaucucacauccaauuccccguaacagcuauuucagucugaaccuaaaaaccuaaccauaagguagcacuagguggcacucacucccauauuccaggucuacagaaaguugaagaacaaagcccaggaauagauaccuuuuuccaagaacaagacacaacaaccuguaucuaccugaguuauuuuuaagacucugaaacugggcucauaaagccuagaaagcaacuguauuagcccauuuucacaaugcuauaaaggacuaccugagacuugguaauuuauaaagaaagguuaaauugacucacaguuccgcauggcuggagaggccucaggaaauuuacaaucguggcggaaggcaaaggggaagcaagucacaucuuacaugguggcaagagagaggcgagcgaggguggaacugccaaacaacacuaucacaagaacaguauggggugaaccgcccccuugauccaaucaccaggucccucccacaacacguggggauaauucgagaugagauuuggguggagacacagagccaaacaguauaagcaacuaugcuaccugaaauugacacccaacuccagagucaauuuucaucaggagauaguauguucacuccccugggggaaaaaacccugcucauagaaggguaaugggccuccagccauaaagagacugcuaccuagaucaccacaccaagucacaggaaauugucuuauccaagcagugcuagcucucucaccuaaaauuuauccuccucucaacccucaauucugaaauuucuauuuuuaacuaacccauuggaaaaucauuaucuacuugcugccuuucccuauaggagaaaagauaaaauagguauguaaucuggagaaaugaggucuaaauuauauauuaaacacauaugaagagguuuucauaguuauacccugccagguuauaugguuauacccugccagauuauaugguuauacccugccagauuauaugguuauacccugccagguuauauaguuauacccugccagguuauaaggcucaagcacuucaaaauugcuaaaugagcaccuaugguggaucuuucccauucuucccugcagagccaucuucuauccuucucuacccuguugcaucacaggaggaggaccugcauggacuacaucaaggagcuuucuugcgcucuggcuuccauuuggguuucagccaaauugagggugggagggggugcagcagcaggagacugaaaggagaucagaauauuuauugcccuggcucccccucccuaccagaucuuguguccuuugaccaaaggcuacaguucccaucagauagcucucuccacaccaacuuuccucucugaauucugauaaccauuccccucccuuugucccuucaggcauagaaauggugaugccuguugguagccccaaauuacuguacugucccuuugugguuucccugaacccuacccacaccucuguauguaguucguucguuuguuuguuuauuuauuuauuuauuuauuuauuuagaaacggucuugcucugucacccaggcuggagugcaguggcgugaucacagugcacugcagccucuaccucccaggcucaagugauccucccaccucagccucucugguaacugggaccacaggugcauaccaccaccgcccagcuaauuuuuuuuuguagacaugagaucucacuuuguugucugggcccaucucaaacuccugggcucaagcaaucuuccugccugggcccucccaaugugcugggauuacaggugugagccaccaugcccagccuguaguuccuuuauuaaauucuccucaguuacccagugugacugagcuauaugacaauaaaccacccaaguuauggccuacuaccaggcaaacaauacuuaaagcaugaucuuaaagaguucuucauacccgcccaggauggccaggaagggucgcucugggcucuccaaggccuuugcaaaguaguucagcuccuucuucaucaaaaacccaccagccuucuguggcagauugacuccuaccauggagcuagaaaagaucaaagacauucagauucuagucaaucccuaucauuccuccuaguccuagaggccagcuccuuaucacuaaaauauuucuacuucuggacugcaagaaaucaugguuuucaucccuacauugcaacaaaaaacacuuagguacaagauaagauuuuuaacuaauagugcaaggucaaagggaaagaguaaaaaaguaaugaacuuagguagaauuuaagauacccaguuaacacucuucaggcaggccaaagggcaaaucacaguaaguaauuggccgguugaugauagcagaagaggauuccucaauuugcuuccuacugacagcaugagagucugaucuuauaacguucauaaaaggauaacucuguacaaaauaucuaaggugagaaagagcaaccucuuccugaaacuccacaaaaagcccuacaauuaccaacauuuuuuuaccuuuauuuccucuuuggaugagagcuacucaacaagagccauaguggcaguuccaauuagagaagcugaaaggauuacaguauaauacaaaacucuccaaaaacaacccagagcuugggcuacucaaguaaauaggaauacuguucucagugugguagucuacaagguucuugguaccugugggcucugugagcagugccaaaagcaucauugacauagacauccccuagcuuggaaagugaagcucggaaagcuucuauuuuggcuggcucggcuuuaaccuauagagaaaaacaaaaacagaaaaugugauggcuccaaagacaacuauaaaagcauuucauacaccaagaguccucuugaacaucucuaaagacccugaguaggugggacagcgauuuuuuacaaccagcaguaggauguguucuuucuuccaaauauuccagauacuuuggucauuucugcauguuucugcucucccuuaacuucccucaaauugcaaaccuaauauuccugaacgauggcuuuaccucuaaucacaugaaguuaaccacaccccacuagccucuccccagccuucagcucaagguucugauuauccuucccucuccuugacuuaguuccucauuuuaaacauucuccuugugauaguaucauacuugacucaagcugcuggcuaccaaggccuuucugcgaagugcaaggggcucucacacauauuccucauaaaagcaacaagggcaagcugggacagagaaggcagauggaaacaugacaacagaaaagaaccucagaaacacuucacauugacaaaaagguauuuuaugaccuucucuggaagcuaggcaucugagaaaacaagaaauauacuucuacaaaaagagaggaagaaaauguagaaguuaaacauagagcuuuaaaaugucagcuugccaucaaggcauaccccaaaggggacagaaagcaagaugggaggauaagcaaaccagagagucucuggcaggagauuaagcaaagaggcacaggaagcaagccagaugaaaggggacaggacacagaagaguacauagcacaaagcagauguucauuuuaagucacugcccacuccuaugcuccuauguaucaaggaggugaaggggacugccauaaaaaauggggcuuuucccuaaagauccaaagaauugcagaggcacuaaugcuaaaauugaagauuguggcacucccauaagcucuguagacuacaauaacaucugccacuagugauuggaagaugacacauguaguaaugauaacaaugcucaaauguaaggagaccugaguucuauguccagcucugacacuaauucauugugucaccuuugggaaguugcucugaaauuuucccuucuaucaaaaaggcauaauaaccccuccauuuacgaacuauuuaaggaggccaggggcaguagcucacaccuauaaucccaacacuuugggaggccaauaugggaggaucacuuaagcccaggaguucgagaugagccugggcaacauagcaagaccccgucucuaccaggaaaaaaaaaaaaaaguaaaggucaguuggacauggugguaugugccuguaguccuagcucccuacaaggaugaggcaggaggaucacuucagcccucaaguuugaggcugcaauaauuaaugucaugccacugcacuccaccaugggcaacagaacaagacccugucucuuuaaaaagauauuuaaggaaaaacaggguaaauugaaagcucuucaugaaaaaaggugccauggaaauaauaucaaucagaacccauuucucauuuacugaucugcaaauaacuagaagaaagagaaggcccuuaaaagaucaaugugggcacuuuggauaaagggaaaauguuuauguccucauauccucacuuuguuuuugugguuuuuuugagacagagucuugcucuguugcccaggcuggaaugcagugcugcaaacuuggcucacugcaaccuccacauccuggguucaagcaauucuccugccucagccuccggaguagcuggaauuacaggcacuugccaccaugcccgacuuuuuuguauuuuuaguagaaacaggguuucaccauguuggccaggcaggucucgaacuccugaccuugugauccacccaccucggccucccaaagcgcugggauuacaggcaugaggcaccgcacccagccucacuguuuuuuuaauccauuuugaacuugggacugacuccugaaauuucagguauuaaaagccauuagauagugaaugucaagucaguuuacuaaaaaagucauagacuacauagucagcucaucauuuccuaaauaaaaaguuuugcuucaauaugcccuuugccuccugccacuucuaagcccuagaguucaugcaucaugaguuccagauuaaaaggacaccaaauuuuaggucagcauuugacuccuaauacugcagcaagaccaugccaaaagcaggauaaggcaagaccagcaucuuuggugcuaaaaaaagaaacugcuugaaagcaggcacucccaaugaccuuaauaaaugugagaagccaaaggagacugagacacuagacucagagcaucuuguucuccgagauacuaaagaccagaauaguggaaaguacuaaaaaaugccuucagcuuccuuucuagucaaugggcaaauucaaaaucaucugcaaagagccaguuuuaucauugaauauuugaauucugguugucaguucacaguaaucuguuuggugaguuaucuauggcugcuuuugcacaacaucggcagaggugaguaguuccaacagagacuauaugcagauggaagugacugcacaacacagaaagccuaaaauauuaacuaucuggccauuuauagaaaaaguuugcugauugaaugggcugagcucuaaagaccaacagcaccacugccucuaacuuuaaucguaugacugccuuucagaaacuuaaguuuuuuuuuuuuugagacuuaguuucuuuaugaaauaagucgauaccuguaccucuaucuuaaagagagauuuaaaggaacauacuuuacacaucuuaagaaaaugccuuaaauccaaggugacaucaucaugaccaucauauucacugaauacucuuucaccucaaagguguucacauauuuuucaaacauauuuaaacaccaccugaacaugaaggagggcuucugggaugcugguaauauucuauuccuugaccuggguggugguuacacaaguguguuuacuuugagauaacccaucaagcugugucggcauuguaugcuucaauaaaaggugucuaaguuaaaauaaaugagcuuucucuauucuucaaccacagucucuuacagacucaggcccucacccccaauaaugucaaaaucacagguccuaccuuguucccagaagcaucuuuucccuucccuucuuccuccacaugaaagcggagguucuccagcaggaugacagacccagcagcuggguuggcacaggcuuucuccacuucugggccuacacaguccuucaagaacagaacaucccugagaagaggaagagaugaagacacuugagcaguaugaaaguuaaaaaccaguaacaacgugcuugacaacuucccccgccacaaagucuaccagcaccagagccuggcacuuacuugcccagcagagauuugaguucuacagcaacuggcucuaaggaguacuugucaggcaugggcacaccaucaggccggccuagguggcucauaaggacuaccgacuuggcuccauuguccaagcagaauuugaugcuugggacagcagccuuaauccugcaaccaaagagagacaacaaacagaaugaaguuacuccuagaaauuagugggaacuagcuuauugauaaccucauaaagcauaaagcuccuuuucuucuccaaguuccuucaaaucuacuaucaguaauucaauggugguccuuaagaaguuaaaugcaaugccaacccuccaccuaggauuguacaaucucauuauguaucugccccuuucacagacaagaguuaacacagcaggccugaggcuacuaucuacagaaggaccugucugcaagauuagauccuggcugguaucugggaacuuggcuuucaaaguuaacugacaagaccaacaagggcuauucacucuuccuagaccgucuauacaaacauggugauuuaugcugaacaccugccccacucuagaagucuagaauuuuuuuuuucuuuuccuuuuuuuguugagacagggucucacucugucacccaacaggcuggaguggagaggcacaaucucagcucacugcagcuucaaccuccccaggggcuuaggucaucuuccuaccucagccucccaaguagcuggaacuacaggaaugcaccaccaugcccagcuaauuuuuguauuuuuuguagggguuuuaccauguuguccaggcuggucuugaacuccugggcucaaguuaucugcaggccucagccucccaaacugcugggaauacaggcgugagccaccacacccagcagaaguuuguaauuuugguaguugcuaggcagaggaucccuauguuaccaguucccaacaaaaaucuugggaucugagucucuagcaugcuucuccaggcagaaacacugcagacaauuacugcauuuuucacugcugaagaaaggaaaacacuugauguguccccucacaggaaacuggaagcccauggauuucucuagacucccccaugucuuuuccucuuccuaaucuugucaugcauucuuucacuguaauaaacuuuagccaugagaacaacucugaguccuagcaaaucaucaugagauaugugggugaucuuggggaccccugaaaacacuucuuauaugacuauggaaaauacauaaaauucucaaaucuugaaaccaucaaaggaaauuuggggaaaaauaaaaaacauguaguaacuuuucugcaccuauuaauagauccuaagucacuuuuuuauguaggaaaaaauaauugcacugucuagagcuugguuuccauaauguaucacauucauuacauuauaaauuaaucaaaaaauuaacucccuuuaaacauuuaaaaguuuuguuauaaaccugcuacuaacuugccauuuugccaguuuauaagaaauuaaaauugaucaagaaaagcauuuauuuauucaucaaauauuuauugaaugcuucuuuugugccaggcaucauuccagguucugagaaugaaacagaaaacuuuuuuaaaaacucucuguucucauggaagugaaauucuaauggagagagacaauaaacauguaugugugugugcguacauguaauauaucagauggugagauacagaaaaaaaacaaaccauuguuccccauuuuuguuccccuacuuuugaggacaaaaaugaccggggaacaaugguagaggagauuuuuagacaggauggccagggaaagucugauaugaugacaucugagcaaagaauggaaugauuaaaaaaguuauacuuuuaaaauaucuuauguuauuaauauuuagcagauauaagaacuccuuuauaucaaauuuaaaaaucuguaucagguacaaaguuugugcaauggaaccaauuaguuuucaggacuaucccuuaucagcaaguuuuauuauuucuaaugcuucauuuuguuaaucaacuccauggauuuccggaaaugaaaagauuuccaaacauguuucuuuacucuuaaaauaacuugauaggcauauuuccaaucguuucuguguguugcacaauaaugaagaucaagcgggaucagaucugccuuauacaaagacccugccacuaugguacagcagggaugugcuuggcaaaaugacaggcucuauucuaggaccaauaccugaaaauguucugggcuagaccugcacuguccauuacgacagucauuuagucaugugugucuguugaguaccagauauauaacuagaucaaauugagaugugcuguaguauaaaaacacaugccagaucuugaagacuuaguaccaaaaaaguuaaaugucccuuuaauuuaauuaacacaauuuggcucacauuguauuucuauuagauaccacuggucuagaucauuagaaagcaccuugccaacacaaacccuucauuuaaaauuuaaaauaggcggagcacagugacucaugccuguauucccagcacuuugggaggccaaggugggcgggguccaggagcucaaggccagcuugggcaaaagggcaaaacgcugucucuacaaaaaaaauaugaaaaaguagccaggugugguggcccacgccuguggucucagcucccugggaggcugagaugggaggaucgcuugagcccaggaggcagagauugcagugagccaagaucgugccacugcacuccagccugggcgacagaacgaggcccugucucaaaaaaaaaaaaaaauuaaauaaaaaccuucuugauggauaccccauuuaaccugaugugauuauguauugcaugcuuuuaucaaaauaucucauguaacccauauauauauauauauaaaaucuacaaaaauuaaaaauuaaaaaaauuaaaaagaaaguaaagacaaaaauaaagaccuuuuauaaucuagucaaaagcaagagcaguacucucacuuaaaauuuguuucugaaucuaggauccaagacacuggagcagcuaaacugacugaaaacguacuucugaagucuuuccuguuuguuuuuuuggaagcaaaaacaaaugaaaauucucaaaaauugacuuaucugagccauuugaaugggggcuuguaaaacuacauauaaccuuaguaacuacugguacuuuuaaaauccuucucuuacauaguucuucauuuugcaagagaagccaaguaaccuuaaauuuuuauauuuuuuguguguguuuuauagagauggugucuuacuauauuggccaggcuguucucgaacuacuggccucaagcaauccuccugccucggccuuccaaagugcugggauuacagaugugagccaccgcacccagccaacuuuuauauucuuuaaaaaugaauaacucugccagguaugggggcuuacaccuguggucccagcacuuuaggaagccaaggcaggaggaucacuugaguccaggaguuugagaacagccuaggcaacauagugagaccccaucucuacaaaaaaaaauuuuuuuuuaauuuaaccagguguaguggugugcaccuguuguuccagcuccucgggaagcugaggccagaggacugcuugagcccagaagguuaaggcugcagugaaccgugaucacaccacuacacuccagucugggugacagagugagacccuaucucaaaaaaagaaaaugaacuccaaauucuucuaauuuucaaaaaacaagggaaggggaaucacuuucuuaagauuuugcuuauauuuguauauucucauaaauaagaaagcagaucagagaguggguugauagaaagccaaaaucauuuguuuuaaguugcuacaguuccauaauacaauaugaaaggaaaaacauuucauccuguguaccuacacacaucuuaaacccagcccaaggauuagcagggaccuuaccucugguuguuuguuaucugguuguucuucauaggaacauugaagucgacucuaaaaaagaaagaugcaagaccaugaucaacuuacuguuccaucaaagacuaggagaugcauuuuuaaugaaccaguuaaauaagucagaaauucaaaucucaucuuaaaaauaaucaguggcauuaaaagucaaaauagugguuagucauggggaggauggcgggaguggugacugggauaacgacaccagaggcuuugggguucugguaauguucuaucucuuaaccucagugaccauacaaaugugcucauuuugugguaauucuuugaacuugugauuugugcccuuuuagguauguauucauacuuuaaaaagaauuuuaaaaaaaaaaccuaacuuaaaucacaggaacuagcccugaagaucugggaagcuaaagcuaguuccaccuaaaaagauaucugucugggccuggcacaauaguauccggguagcagcuagaggggugaggaauaauaaggaaugcaucuugauccuaauucccuugauacuauuucuggguccucgugaaacuaacaugacucgagaaaaaaauuaaaauaaaaauaaaacacacuaagagaaaaucauucuuuuuggagaaagccuggggccuuaagacuagggguccuucaagcaauacacacaacauaagacagccucuuucaaaaagccugagaagagagggugggacaugugccccagcccaccugacaaacaggcaaauuagaagggaaguaaucaagacgacacaagaaaauaauguacugcaguaucucuuacccaacagauuacuauguuaucauucuuaagaaccaauuauucugaacuccuuggaaccucagccuacuucaaugugaaugaaaacaauaauguauggcagcuauuuuuaagguuuaagaguugugccugccaugauuauuuuuaagugauuuuuuucucaucgggaugacaguaucuaccucguaguuacugagagaauuaguaagucagcaauuuguaaagugcuuagaaguguaccugacacacaguaaaugccauaaaaguguuguuguuauauguuucuccaaaauguaauucugugauuugacaaguaaaucaaccacuacuaaaaacagcuaacaucacuugcaaagggacuacagugaaguaugaccuaaucaagaagacugcugcuauccuugauuauaagccuccaucuuuuuccucugccuuuuuaaauaccccuuccucucuaaggcuaaggcaauuacaaacuccuacagacauacugagaagaccaccaauuuccuauauccacuaggccugaacuccaaucuaccucacugaagaacagccuuuccaaagguaggcugaggaaaaauaauucuauaguaaaacauguuuuaaagucuucaaaauuaaaggcaguaagccucugaugaaagaaauacacucuacuuuguuucaggccacuugauucucugucuucuuuaaauauccugaacaaggagccugccagccuuaaaguacauuccaaagaagagagaauaucccauuaccaugggucauuuucccccaugcaaccucccagaaggccuaugcucaaaaggacuaauggcaaaaggaugggcacaagccacuucuugcagugcuacucucuacccccaacccuuacagggaggaauaucuuuggacagagacaccuaagaaacugucucaucuauccaagcugccauggugucagcuuacuaaugaauuagacuugguugauacucucuccucaaugcccucuggauuaccuccccuuaucuccuacacucacaacagcucugcuuuuagcuucuccucagaggacuccaacacaggaacugcucuugccuacagauucuacuuguuccauuuuacauaaaauaugcacaauuuucuuuuuuuuuuuuuucguuuccuuauaacaccccugagcuuugcuucaggcacaaagucaguuauuacuacauauccaucagaacgaaaaauaacuaaaauagcugguaaugaagcagagaaacugauuacucaaauacugcugguagaaaugugaaaugcugcagccaccuuggaaaacagucuggggauaccucaaaaggacguggcccagcaauuccacuccuagguguuuacccaugaaaaaugacagcguauguccauaccaagacuuguauacaaauguucacagcagcuguauuuguaauagccccaaaucagaaacaacccuaauauccuucaaugauaguuaaacaaacuauaauacaaccacaccauggaauacuacucagcaauacacagguaugaacuuuugauacaugugacaauguggauaaauuuugaggacauuaugcuaagugaaaaaaguuaaucccaaaagguuauauaccaugugauucaaucuguauaguauuuuugaagugacaaaauuuuagaaacaguggacagaucaguaguuaccaggagucaggaaggggggugguuauuauuauaaagagguagcaugaaggagaucuugguggugaucuaauaguucuguaucuugauugugguggcgguuacacaaaucuacgcacguaauaaaauggcauagaaccauacacacuuuauaccaaugucaauuuccuacuuuugauauuguucuauaauuagguaagaugcauccauugggggaaaauggguugaacacaagaccucucuaacuuuguaaccucccaugaaucuuuauuucaaaauaaaacauuaaaaaauauacugauuuagcuggaauaagaauaucaagucucuaucaccugaaaucucaggucccagguccaguuccauuaaaaacucucaaaggaaccauguccaucaaugcuucacugccccagauggaaaacugggauauugugggugucuuagugacuuuuucucugcucucaauuuuuuccuguuucucuucccacuacaucaaagcaguuucuuuacaaguuacaaguuggagaaaaccaguaagguuuaaaaaaaaaggcaggagcaagcaaaaaggaagugcuuuacaagcaggcaaaggaugacuggcaaccuaugagagaaagaaaggaaauuaccacaaaaauaagcagaaguguauucaaagaggcuguaaagucaacugcggaguccuaaaaaacuaagauggaaccugguaauuaacaagucagagguuucuggcuaucccauguuaccucaacaaaucaauuucccuuggcaauccaaaccaguggaccagaagagucagcaaauaccauaguucacuucugcaggacaaagacgacaaaugaggcagccacuacucaggaagccccauuccggaaacaccgccagcaaccaccacguugaaacaaaaaggaauugagcugacaccacauggcugccuaagcaccuccaaaaaaguaggccuacaaugugacucucuguucaaaagaaauacauuaauaaucagggaaccauguaacuuccuguccucagccuaaauaaguagaagguauccagguuacgggagaaaguucuauuucaacguauccuuggucauugucucgaauauucagaggaucuaguugauagccaaggagaccuaaauucuacuccuagcucugccaccaacuugguaguucaguaacccugaacaggucauuuuccaucagcaaaacaggacuagccaaucauuucaaggcuuuggguuagcgugugcuaaaugaaacuuuauuagguccagagggagaaaaguuaagcagcuccuccaaucccgcccccagcuagcuuccucaagccaguuucccuagagagagaggaaauaaagcccaagacugcaauuacaggaagguuaucagcauaaugucccacuccuugucuguuaguugguccaugcaucuggaagaaucagcgucgaacacaggggagaugcaaggaacuaauuaaaaccuaaaagcuaguugcaugccaauguccaccuguccuguuuuuuacagggucuauccccuuuuuuuaggauuguaugagggccagaaagggcacuccucuaguacuaacauggcugugacuccuacuuuguccagauuacaaaggccuaugucauuuggggaaauguggaaaccagguauuuuucauggacauaaauuauuggguucuucuaucuccacagcagggcagcgguuaccugcaaaaauauugaccaaagugaaauuagagagaagaggagagcuacauguccuuuuaggguacccauacaguucccuaacucaaacguguccucauauguuuaaaguuagaguaaagggagaucuccuacugacuuacgugucuguuaauauccaacacaagcccucauuugaaccagcccaaauuggaaaaggggcuagauuacaccagccaaauaaauaccuacccaucaaucaaccacuucccaaaaaggucaagguugcaaaaugcuaucaacagaaaccuuuaugaccccucaaaaacaccacucuuggauccuguuaagguauaugaacagucaaguccaucaguuacauaccgacucauccuccugcaccuugcuccugguaugcacaaauauaucacacgugacaaaaaggauaaauguaaaagcugcccacucuaccaacaauucuggcagauaagagagaaaccguguuggcaagugacuagagauccacaugcgcagaguaagagacccaaagugcacgaggaaacuucccccaauuuuaaaauucuacuuuucuagccacacguggggaugagauuggaggccagcaaguaugagcagccacacccugcucuaccauuaccuaguaugucacaauccugaugcaaauccugugcccaagaguccaacgauaccgcgcugcagggcagcagacgccuguuacguaagcucugcagggccuccuccaguucgccccgcccuacccucccaccccaauucuuuaguggcggggggcgggggggucuacuccugaaguuaaaucaacauccucuuggaaaaauauccuuuugugcaggaaccugugagaugugggccguuucucauuuggcugcgacggucuaggagcgugggggaagggaaaguaaaaugaccuuucaaggucccuuccuugaagccuagagauuugcaggauaagcauuaagucccaucucgccgacugggagcuggaggcaacggaacugcauuucaccaauaggaaaaaggacaaaaugggucccagcggcaaucucagcccuuccucagugggauccauccccgaagggugacuucgggugcuuucugggcuggggaaaaugcggcuagaaaccaccaaacccgugagcagccucgcccuccaagccuaggaccccuggggcccagccaaaagcuaaaagaacuuagagcagacgagagaacaagucggcuccggccaaagagguuugcgacagagcacagagagcacgcgggcaaacgugcagaauuaccucauaacgacccgcuucccuuuaacguccagcuuguccagcgucagcuuguuagaaagcgacauuuuggaaauacagcuggggagagaggucggugauucggucaacgagggagccgacugccgacgugcgcuccggaggcuugcagaaugcggaacaccgcgcgggcaggaacagggcccacacuaccgccccacaccccgccuccc

SEQ ID NO: 19133 - RNA, 39984 nt, Homo sapiens
uuuuguauucaauguuguuuauugaggagugaaugagagacuacugccagacaugccaaugacacuucacauucaagggcuggaagcuggaaagcuucccgacugagucacuguauaagccuucugggaaaaagaaccaaagugacaucaaauaugccaucuucaugcuuguugucugucaucaguuuuuuucaacuuuugggucuacugguuugcuggguaggaggcuucuuucuacccuacagaaagacucacacucccaauucacaaugaacacugaaugcagagcaauuugugugaacacacaucuacgcugaguaacuguucuuaaagcuguuuuuccuuaaauuuccuuaugucuaacgagaaaaauuaauuugauuucccuuuccccuucaggugggcggguuauaccaauagaaaaauagucuucagugcuagcuaccgcagggcuuccaggaacuccuucaguggucugguagaaauccauggaaacuccauucugcaacacagcgcugcucuuccugcuuguggcucuccagaagaauggccuacacacaacacuaccgaucucuuuugcucaaaaacaaaacaaagaaaccuaaaggaaaggguaagcguuuauuuggaguuaguuuucuggugggugacauuaaggcccuucacgcagaguucaggagcuccugaauggcggccugcugcucaggacugagcugugcuaugcacucaguccacaguccuccagaagucuagggaaagaaacauuuucacagacuuaggacgaaaugcucauuuggaaggauuuuaaucaucaucauagguaaacuguaaucauggcaaaauaccuucucccuagguacauuauuuugaugaguaucauuguaaaagcaagaaaucuguucauuuuuuuaaaguucauuucauuuccaguaaguuuucuucauuuuugcacugaaaaagcuacacuaagcagguaacaucuuaaaguaacccauauaccacaugaauauaggaaguaaaaaucauauaaaguuuuuuggcagaugacaaguuauuauuaaaucuuguuuuuuuuucuuaagauaggcagaaaaacuacacauaagcuuguguuaagcaccaacugguaagcucaaaauguccuaagaugaagguuuuaauucuaauaaauaauaaguacauacggauggauuacauuaaguauaauccauuugaggcuuggagacaagagacuaugaaaauauaaaaauaaaauuccuuagcucauuagauuucuaguuucuucucauagaggacuacaaagaaaaaaagguuuuaucucccccuccccaauucaaccaaaucagcuuaccuguacuuggcgaacgacauuggccagacguuuggcacaaggaucuucauguuuaauugccucgugcauuucuccuuccgcaauuauacuaaauauuuugggcagauugguauuguuugggccaagaacaauuggaugauuacugacaaaugagaagaaaaccuuaguaagugaaauuuauaaggagaaauaugauuauguguucacuaaaaucaauggccuuuuaaauucaguaggaagaaaaccagccaaucuuauauaugaacucuuuaguuucuuucuacauaaauuagaaaaaaaaaauacugggcucaucucucaggauuguuuuaagggccaaacaacagaaugcucuaaauaccuuauaaauaauuugugauguguuaaaaaaaauguuuuguauuauuaaaaauaaguuuaacacaaguuuuauuuugcuacuacaaaauagcuucuaaaauaacucugaaguucaaaaaaauuauauaaacauuucaagaauaaacugggaaauaaacucaggcaaguuuaaugggaaaaaaccugauagcgaauuuaagaauucuagucuuugucacuaagagaauuucagaguagucguuuccaaggaagaugaucaaauagcaugauuaagaccuggucauuucagauguaggagcaggucaggaguauguagucugcaggauggcuguuacauuccuuaaugauauggucaguggaagacucaaacccauuucuuaugugaaccugaacuuaaacaaguauggagaauauaccuguuggccuauugcuacaauaguggcagugguuguagcccuugaauuuauucauaaccuaaaaauaauaauagcgacagagcuuagaucugacugauauuuggggggaacuuggacuuagaaaacagacacuaaacaacauucccuuaggcuggguuugguggcucaugccuguaaucccagcacuuugggaggcugaggugggaggaucucuugaggccaagaguuugcgaccugccugugcaaaacaguuaagaccuugucgcuaccaaaaaaauuuaaaaacaaagaaauaaauaauuaaagugccucaucuguugaaucuaauuucauaaagaauaacucaaaauuagaccuuauuauaagggcaauguuaacugugauaugguuucuuaauaugauuuauaaagacagcacuauuauaaaccuauacaacugaggacugugcagagaucaugugguuaaaccuuaaaagacugauguuaggcaagaaaaaccaggaagcacuguggaggagaaggaaauaaggucacagucugcuuuccuaccuuucaaucaggucacacagauaauugaaagucugaacagcuucuucuuuaucuucauguaguggaagccaagacaaccaguguggaaggaccucuucaacguuuacacagucaggcuugaacuucaugauuuucccuacugcugagaugcaguucucuguagcauugacauuuucuuuggucuuagaauccgcagacugaauaacucuuaccagcaggggaagugcuucuaaaauaagcauuugaaagaaguucagcuaaaaccucacauuuucaugcaaaugaauauauguauuuuuguauuugguucagauauugauuaugguaaagaaauguuaaaguguaugggaaguguugucuucuuggcuaugucauuacagaauggcaacagaggggggacugccccagcauggacaggagcacuagcccucuacuaacuuagagacccagagagauuaguggccuccagauuuacaguacucaucacaucacccgaggguccuuaaacuuuaaaagcugccuaacuauauuccccaguaaguuuuaaaaguccuauucugccaggugugguggcucacgccuguaaucucagcacuuugggaggcugaggugggccgaucacgaggucaggagaucgagaccauccuggcuaacauggugaaaccccaucucuacuaaaaauagaaaaaauuagccaggcgugguggcaugcgccuguagucccagcuacucaggaggcugaagcagaauugcucgaacccgggaggcggagguugcagugagccgagaucaugccacugcacuccagccugggccucaauuaaagaaaaaaaaaaaaguccuauucuaaggcuguuguauauugccaaaacgcaaagagaaaugcacccuggaaggcugggggcaggggaugucuuugauucuauuucuaugagaauaaaucaucuuuuuaucaucuaaaauccuaaaugcuacagaugagaugucugaaaacagacuacagcagaaauaggcaaauaauguuugggagugugguaaagagaguaaaguagggauucacaggaugucuggaaugaaaugcacguaacggaauaagcaaacguaccuguacaaaaagggcgauaauuaucuccaccguacugugccaugacucccaggccauaugcagcugcuugccugacuucugggcuguugucacauacauauuggagcauuggucuuaagaaauauucugcguauuuaaaugaggcuggacuacaguguucuaugacaucaucaaagaugcauaauccccauugucugucuggccauggucuauguggacacuacaaaagaaauucucuuuuaagcuucaaauacugguguacacaaagaauguaaagaaauauucacuauagacuaucugcuuacauugauauuccucauacaggcaaaagaaaaaagaaaacauaguaacaaccacuucuugugaccaacgauauucaaucaaauacacagauuuaauaaaauuuagguuucaaagacuuguaugauuuguuacagaacucuacaaucugacacuaucacacagaagaacugacaguggaagcauuguauauaaauuuacuuuguaaaaaagacaaugguaaugcuacauuaaaaaaauacaauaauaauaaaagcugcaaagaucuuaacuuauagcauuuauucaacaggcuaagucaugugugcccgaaucuuuuaaaaaauguacugcacuacuuaauacaauaaaaugcaaaauugaaagccaaaaagaaaaauuccaaacaucugaugauagcugcuaauuuauaauauauuuuuuaaaaaccgaauacacagccaggcgagguggcucacgccuguaaucccagcacuuuaggaggccaaagugggcggaucacaaggucaggagguugagaccagucuggccgauauggugaaaccccaucucuacuaaaaacccaacaaaaaaacacaacuaaaaauacaaaaaaacaaaacaaacaaaaaaacugaauacacauaggccauuauaugauguguugauguagguccauaacagaaacacauguaucuacuacugugaugggggguguuaauggugcugaggccaugcacgcacaggggcagaggcacaugggaaaucucuguaccuccuguucaauuugguugugaaucuaaaacugcuuuaaaauaggaagcguaggccugggcgcaguggcucaugccuguaaucccagcacuuugggaggccgaggcggguggaucacuaggucaggaguuggagaccagccuggucaacauggugaaaccccaucucuacuaaaauacaaaaaauucgucgggugugguggcgugcgucugaauugcuugaacccagaaggcggagguugcagugagccgagauugcaccacugcacuccagccugggcgacagagcaagacuccaucuugagaaaaacaaacaaacaaacaaacaaaaagaagucuauaaaacauuuuaaaaaaaucaaauauaagggugagagaagguaaaaaaaaaauacauauauauauauauaugcccauuauccauaauccaugauugcugguaguacauaacaaagauaauugaauuaucuaugguccacuaaaaaagaaguaaccauucuguuuccuuuuauuaauuuaggagggcacagauaaucugaaauaauaaaaaaaaucacuuauauaucuuucagauguguuagaacugaauuggccuauggaaaaccaaguuaggaaucuucaagcauauaaugaaugagaaaauauccaggguaaugcagucaacuugauaaaaucaaagauguacaauggaaacaaucauuucugagacccauuuuaacuucaagcauuagauuuuacguugcagugaaaagaauuccagguaaacuacgcaaaacaacuauuaagagagguaacacuuacaaugagguugacaauuaauggaagcagcuguucaaaccaugguaacaccuuuucuuuguagcuacugaauauugaguguaaaauaucugacacuuuggucagaauauaaacaucauuaucauccuaaaaaaaacauacacauaaacacucauauggauuaaaaaguauauuuucuauuaucaauaguaacauuuauaaaaaccuuaaaaaaugcagaaaaucaauuucucauuccuguuuuaaggguaaaucaagagucuagagaccggaguaacccucaaguguggguuaucaugucucuuacuaaucaaaggccagucuuaccucgaaagacaaagguguguggcaagaacuguauuuauugcaaagauuuuccuuggaacauacuuaaaauagauggguugaaaaauuaucucuaauuucuacauucugaaacaaagguguuuucacuauuuuuacuuuguuuucagcagaauaauccucauuucgggguggaugguggggagaauggggucucgcuguuaguggcaauuugggccuacaagcaugugggcaccuucaggaagcugguacuaccuacacgguagcacuggcccaccaaguggccacauaugagaugcuggacucuaaacacacaaugaaguaugcuugacaguccuaggugguuugaugagagaacuaaguaacauggugaaaaaggccccagaccgucaacagugugacucuaggcaaucauuuaacacuggaauuuuagguuacucaucuuuaauauagugaaagcaccacaaaauacaaaugguuguugugagcaguauguaaaugaacuagguaaaccucaagguguuuuguugagugagguauuacaacaaaaugcacauagcaccgaaagacauaucaguuuaauuucaaauuacuuauucauaaauuaagagaggaaauauaucugacuccucugcuaaagacugauaauuacaucagaaugacaagucacauaaaucagaaauugaggcauuuacaagucuuucagaugcaaguggucacguaaguaaguuccaaagggaauaacuuaccucaucuuguagugacucuucgaccuguucaucauagucuucaucuugucuuuuaacuaaaacacacccaaauaaauguuuuaaaugauugccaagauggucaaggauuauauucagaaauaaaagcauggaaaacuuaccuugucguaauucuugauuuuuaaaauguucuucaagcuuugcuuucaauauaccucccaguucuucaaaguguucauuauuaaggcauccaucucccauuacuucaaugcacuaaugagguugaggaaagaaagcaauccauaagauuugggguguuuggaguccaaaguuaaacuccacuaagaaucauauggaaaaaugaacacaguucaguauccuggaagauuauuuacauaugcuuagcuuguauuuguuagaaugacagcauuuuagagauuggaguuagaaaaaaauauuuucuuuugaacacuacugagcauaccuaggugccaggcaucaugcuugguacugaggauucaaagauggaaaacacacacacacacacacacacacacacaaccagcuccuaaggaacacaauugcuauauccauacuccguacacacaacauacaagaacacugaaggaagggcauuagagguagaagaaauaaaauauaggcaaagguauggaagcaugcugucuuuggaaaaucagaagcaauucugaauuacaggaguguaaauaaggacauauaaagaugcugagaaacuguaaaucuucaaucaagauuggagcaaacuagaguugugcaaaaugggagugacacuguaugagaaaggaagugacucaaugaagaggaaggcagugcuugaggaaaggagaaugaacugagaggaaaagaaaggagacaucuggaguagcccaagugaggcuauuucaauggcaugaaaaagagauggggcaaugaaaaaaaaaaaaaagagaagaauugaggaaaguguaaagaacagaaacuggagaugauacccaagcuucuauaguuggauuauuaagugcaagacuaaaauacuagaguauucagaauuucuucucuuuuuccaaagaaugcaugcuuccaugcugcugcccauaucauucccucuaccuauacugcccuuccaaggcaaauuuacccucuuuaaaacaaacauaauaauaccaaaauauuaaaacaaaaaauuuaacauuuuuauuuuuuaacaaaucauacacuauagcauauaaaaauuuauuuagcugccuuacaucugcaaucccagcacucugggaggccgagguggaucaccugaggccaggaguuugagaccugaggaacaucuacuaaaaauacaaaaaguagccaggugugguggugcaugccuauaaucccaacuacuuggaaggaugaggcaugagaauugcuugaacccaggagguggagguugcagugagcugcgauugcgccacugcacuccagccugggugacagagcaauacccugucucaaauuuuuuuuuuuuacuuuuagcaagacuaauaaaugaacauacaaccuuauacauauuuuuuaagagaaaaauauucaccuuugcaaaagaaugcauuauuucugagaggacgucugaaucugguucuguaccaauggccuuaauuagagcaucacacauaaaaugccacaucugugugagauacucaggaccacggacucuugcacacuccaggagaagaggcauggauuccgcugcugccacucgaacacguuucauuguuaaggaaccucaaaagacuguuuauuauuuugcuuaaauguuaaaggguucaaugcacuaaaaggagugcuaggcaacuucuguuuaucuaagauacccaagagcuuguguuaaauauaaagcauguauaaaaauagaaaagacauaccuccugucuccucugucaccuguaauaguggcaggaaugaguccagcagcagugaagggcugccuauugcucaaauguaaaccaaaauacaaaaaugacuauggaaggacccaugaccauuagcaugccuuaagcuguaccuaccucaaaaccuuagguacuaucuguuucuaauaaaagcaacugaaguauuucccugaaaaagaccaccgaggaccucuuccuaugcuggccuuuucaguuuuuaauaaagauuaaauugccuuucccuaucuaaucucauuuauaaaauaaggucuugauaacuuccucuuaaaagcaaucccgcuuuguccucuggcauccugggaaguuaagucuuuguuggguaaaagcugucuucuguaaaggauaccacuauaggauaccguaaaaggaaugaugacaaacgggcuuuggagucagacagaucuggguuugugucugucuaccacucucguguguaaaggcauaaaaauguacuggaaaauauuaauuacggcuaucauuauguugagaaagauauuggaacgcagauguggguggaucaccugaggucaggaguucgagaccugccuggccaacguggugaaagcccgucucuacuuaaaaacaaaaacaaacaaacaaaaaauacaaaaaauuagcugggcaugguagcgcaugucugugaucccagcugcucaggaggcugaggcagaagaaucgcuugaacuugggagguggagguugcagugagcuaagaucgugccaugcacucuagccugggcaacagagugagacccugugucaaaaaagaaugcagaugugccaagugauguuuccccgcaaaggugcuauccacauuugaaauguaggguucucacugcuacagaaagcugaccaucuaucagugguucucuaaucuauuaagacaggucuugccaggcacagugcucagguguguaaucccauaacuuuguggggccaaggcaggaggacugcuugagcccaggaguuugagaccagccugggcaacauaggcagaccuuaucucuuaaaaaaaaaaaaaaaaaaaaaaaaaaucaaaucuagcugggcuugguguugugcaccugggucccagcuacuugggaaguugugguuucagugcguccugaucacgccacugcacuccagccuaggugacagagugagacaccaucucuuaaaauaaaagucuuauuuucuuaacguuuaccaaaagauauuuggggaaaguagcaacuauauauaauuguaaucauuugcuaauuauccuuaaauccuuaagugggccacagaaagcugacaaacauaggauaggucacguuuucuuuuucauguuuuggcacaaguggaaacaaaggcacaugcagagaaccgaguuuaucaccuaagaguacacuuagugcaaauacaaacaaucauggugaagucuacuucagucaacacugucuaauacuccaagaaacuacaaguuuacuaaaucuagacauguuuuguauucagaaguuguaggauaucaucguggaaauaaaauuucaguaaagggaccaucaguuugacaaccuguucgguguacuccacaaagccuuccuuuaacuccuuagcauagcaaaccuguaaccaaaguauugggaggaaauaaagauucauguuagucuucaagcauuaauauuaacaaacagcaaaaucauaaggaccacaggagguuguauuuugacuagaacuacauuuaaaguugcauguagaacugucaaauuagucuuccaacuaaaaagagucuuaaaagaagggucaugaaaugauuguaguauuggugagugacaaaaagaaaaaaaaaaaggaaauuauugucguauauauugucccuucaaaggcuggaaucauucguauuccauucagcaaguuucagcaauacaucaaacaaaauguaucacuuaauugaggaaaaaucauucuaaaagauacaaaaaacccugaaaccaucaguuaauugaagcauuuacuuuguaaaucuguagaaaacgcuucuguuauuuuguauuuuuaaaaaaucauggcugggcacgguggcucaugcuuguaaucccagcacuuugggaggcugaggcugguagaucacgaggucaggaguucgagaccagccuggccaacacagugaaaccccgucucuacuaaaaauacaaaaauuagccaggcaugguggcgggcaccuguaaugccagguacuugggaggcugaggcaggagaaucgcuugaacccaggagguggagguggcagugagccgggauggcaccacuauacuccagccuggcugacagaguuagacggaucacgaggucaggaguucaagaccagccuggccaacauggugaaaacccgucucuacuaaagauacaaaaaauuagccaggcaugguggcgugcaccuguaauccuagcuacucgggagguuaaggcaggagaaucacuugaacccaggagacggaggcugcagugagcugagaucaagccacuguacuccagccugagcgacagaguaagacucuguuucaaaaagcaaaacaaacaaacaaacaaacaaaaaaaaccccaaaaacccaauuguuucauucucuucuacuacaucuaaagauuaauucuguuuaaagauguuauuauuuguauuugcuuuccaguugagagaaaaaacccacaaaaauccaaaguguuuauaauuuauagauacuaaguauugaagaugacaauaagaaauacauuaauuucuaaaaucuaacuuuaaaaguaaguauuggccaggugcaguggcucaugccuguaaucccaggucauggcaggcggaucaccugaggucaggaguuggaaaccagccuggccaaaauggugaaaccucaucucuacuaaaaauacaaaaaguagccagcugugguggcaggcgccuguaaucccagcuacucgggaggcugaggcaggagaaucaacugaacgccagagguggagguugcagugagucgagaucgugccacugcacuccagccugggugaaaaagagagacuccaccucaaaaaaaaaaaaaaaaaaggauuauccuucacuuuaaaacgcaugcucauaaagaaaacaaaaagaaaacuaggaacuaaacaugcauaugcacaccacaaacaccauaagggauaauaaccgaacauuuugauuuuccugccauaucuguuuuuuuacacaauugaaaucauacaaguuuuguuucacauuaaauagcaugaacacacuucuguucauuuguuuaaaaaacauuccauggccaccuacuauagacuaagaacaaaaccaacaaaaauccuucccucauguagcuuauaaacuuuuuguaauggcuguauauuacuccaaggcacaguaauucaucuucccacuaacaggaauuugggcuauuuguuguuuuuugcuauuuaaaacagcacugauaaugaaagguuuauccauacgauuucuuuaaaauggaaagaaaacuuuacuuuuuaaggaacauauuacuggcucuccaaaguaauuucuuuagcagcuauuaaaagcacucauaugaaauguauauaagauguaaaauaaaaguuuaguaaaaacagugcucucuuaccaacaucuggcaagcaguugauuuuucuucuaguccugcaguuuuaauaccaaagcuuugcugaucuccaagguucacaaauucccaaccaucaucaucacucauauucuccaugucuugggcuauuaacggagaagaaaacaaaugcauaugaaaaauaauaacaaagagagaacuauuauaaccgauagcuccuucuaaagacaccuacuaucuaaaagggcuacuucgggcuuaauugaagccgucuucauuaaaggccccauaaccacuggaagguauugcugaaauucuuuuccaaggauuuugcacauucuggcccaugcugagaucauguaagagaucuggggaaaaauuuuaaaauuaaaauagauuaaaaaacaauggguaaacgugauaaagaaagccauuuccuuauuucauagaaacaauguuuuauugauauguucacaguacuuuaagcaguaagagcauuucuaaagguuauguacuuaaaagguucagaaucaauaaugaaaucccugugaacucacuacacugggauauggacagcaggugaggcaaaacacaaagaccagaaccuuggguauuucuuucuacuuucaguaagugauaaugguuuucuuucuuagcaucugaaucaucuaaaugaaacuaaucaccuaaacaaaaccaaacacuucaucaacucccaguuacaaauuuuuugaagacagaaauguauuuuaucugacucuguaucccuauugccugccacuccauucauuaaacauuuauuaaaacccaagaaacaaaacauccuuuucucuuagcuguuauaauuuucucauaaguggcugaguauauuuaaaacaccucuucuccuauuacuguguuuacacagacuuuaucaucugcaaauuaccuagagaaucugguuccauucaccaccccugcaaccuagaaagugauucuuauccccugauaucugucauccaccuaccuauuuaucuauugagcaugcauggacacaugccccaccucuuaaugauuuuauauguaaaaguccacccgcucuucagauagguacuggguguuucucacaugccaggcauuaaacuauaugcuggcugauacaaaggugagcaacacgccucguccuuaccaccccucccuacagcuuacaguccccucagucucccuacugucagcagucugcuaaguaucccuccugccuguuaucucuguacauacaaaacauacauguauauuugcauaucauuuugcaaagaaagcaaacaacaacaaaacaugcuuucuuugcaaaaugguauguuuuccuauuuaaacuauuacaguguggcaauguaaagucaaaauuuaauucaacaauuauuuauugagugccuuguuauauguuaggcauugggaauaccaucaagauaugacaaacauuuaugauguuacuauaacaguguuggaacugcccaccauugagacugagcagaucaggaaaaucuuguaaaggaugagaacugugagcaagcguuagcuggguauguauaccuauguguguaugugcgugugugucgagaggcagggguuccuccuaaugaaaugccuuugucuguucguuggcggagaggcaagcaguguguccugagauucuuggguucuguauuuucugccaggggagggagaucaugcagccuucaaagggcuaggagacacccaaauggagaugucuauuacauguuggauaaaugaaucuucaauucugaagaucugaaaguugcaagcacacagaggaaaccggaagccaugucugugagugacacugcuccacaggagugagaagagagccuuggauagaacccacaaacaccaaaacuugagugagagucacagaaagcaagagcaaccuacaacagacugagaaaaaguagcuugagaaacagaaggaaaaucagugaagaaugucucugcuagcagggguugauaguaugucaagaaaccuaucacuccuuuuguuuuaaauauauugaaccaugugcuguccacaacucauuagcggaucaaagcaaaugcauuaagaccacuuaccugaggaucaucaucuuccauaucauugaagucugucugggucuuuaacaaaagcugcaucacaucugaugcauccugcaugaacuagaggaaaauauguagagacacacuuguugauaccgaauuuuguuucuuguguaauuagcaaagcuuugccaaaaaaucgacuacauugcccacauaggucauaacuuucauagauaaacuaucauauugaaaaauucucaucuauauugugacagauuuaguucacuuucuagaaaaauauauuuuccacugaagggcagggaacuacaguauaaagguacuucuaauggcaucagguguuagucuauggcuuacgcauuucaagcaguaaaacugaauucaaauucagaaagaaaauuuuagauuguuuauagaauucacugcauaaaauuuugucuaugauuuucacuuaacucuuugcaguucugguaaucuccauuguauaaacaggcagcguuuuaaagagacauugaaagccagauauauagaguaugggacauacaaauauuuuauugguaaaaaacauaccaauguuuuaguggucagcgucucacagaaaccaguuccaaauauaaauuaauacugaugcugguuuugaagaaggcaagacagagcuucucuguugauaauucucagggucagaacaugaggauucaaugacagagaaacuucuuuugcauuagcuugaacaauucugagauguuggcugagaaacacacuggccaaugguccuugguaauuauuuucugaagaucuauaugcauagauuucucucuuagaacacuugaugcauuuuagauuaauaggaaagcaagugacauguuuccaagcacauauuuaaagggaacgaacauggauacugacuuccacacaccucccacgagaugcacugugugugguggggaaaggaggaggcaucaggagcacagcugagcuaaaaagaaaccuuaauauuaacaaugaaaagacgggcugggcgcgguggcucacaccugugagcagacugcuugaggucaggagaucagggcuagccuggccaacacagugaaaccccaucucuacuaaaaaaaaaaaauacaaaaaucagcugggagugguggcaggugccuguaaucucagcuaccugggaggcugacgcaggagaaucgcuugaacccaggaggcagagguugcagugagccaggaucaugccacugcacuccagccugggugauagagugagacuuggucucaaaaaaaaaaaaaaaaacaccaaaccaaacaaacaaacaaugaaaagaugaaggcaagaauuuguauauaaaacaggagcaaugugaaaggaguaaggaaaaaaacaagcauccagaaaaccauuuuucagaaggaaaaaaucccucuaguacucucaaugccuccacagccaaguuagguacaguaaauuuaacauaauagaaauuacaggccgggcacaguggcucacgccuguaaucccagcacucugggaggccgaggcgggcggaucacgaggucaggagauugagaccauccuggcuaacacagugaaaccuugucucuacuaaaaauacaaaaaauuagccgggcgugguggcgggcgucuguagucccagcuacucgggaggcugaggcaggagaauggcaugaaccugggaggcagaguuugcagugagccgagaucgugccacugcacuccagccugggugacagagcgagacucugucucaaaaaaaaaaaaaaaaaaaaaaaaaaaaaaaaaaaauuacuuacuuuuuccuucccaacagccagaccaaugaggcuaaugcauucaauaguuuuuccucucagaagucucaguucuuuuugaaccgcauucucaacgaugugcuucagugauggcauaaauaaaucauaguaggggacaaauuuuucuucugcaguaucggcaacugaugcaauggaugucacaacuuguuccaaaacuaacuuggugccuuucugaaucagcuagaaggaagacacaaauuauuaccucaaaggaaaacuggaagaaguauuuaaauuuacaauuacuacucccuucaaguucuugaaugcuuuucugaaacagcagaaugagaccaccucuccagaagcagagacuguagguuuuggaggaaauuucuauaaaaagaaucuauguugaacuauuuaugugagauuuuuuuuuucucucuucuauuaacacaacaccucuaacucauguuagucucaucucaaagcacagcuaauucuugaguacagauacggaaucaaaauuuuuguguucaucaacuuuaaugccuacacuucauccucauuuuuuucuucacugauuuccucuacuuaugauuauauuuugugcugucuuacuacgucauaaagaaaauucccucuuuggccccuuccuuuaucuucuaacccccucuccccagaagaucgcacgaaggaacccugcugccuucucuugcaucugucuugcugaaacagaugagaugaccuuuuucucugcaccaaagaucugguguucucugacccagcuaguaacaaaugcuuacuaacuauuugcugcugggcccguccugucaccagcaauauuuuaaaauaauucuucuguaaucccaggacucugggaggcugaggcaggcggaucaccugagucaggaguucaaaaccagccuggccaacauggugaaacccugucucuacuaaauaaauaaauaaauaaauaaauaaauaaauaaauaaauaaaaauuagccaggugugguggcacaccccuguaaucccauuacuccggaagcagaggaaggagaauugcuugaacuggggaggcagagguugcagugagccgagauugcgccacuacaucccagcuggguugacaagagcaagacucugucuggggaaaaaaaaaaaaagaagccaggcacggugacucacaccuguaaucccagcacuuugggaggcccaggugggcggaugacuugaggucagguguucaagaacagacuggccaacauggugaaacccugucuccacucaaaauacaaaaauuagccggguguggugggugcacgucuguaaucccagcuacucggcaggcugaggcaggagaauggcuugaacccgggagacggcgguugcggugagcagagagugcguuaucgcacuccagccugggcgagacuccaucucaaaauaaaaauaaauaaauaaauaaauaaaauaaaauaaaauaaaauauuaacucauaugaaccugagccaguuacuacuccagauuuucauaauuccccacgucaauuacacccacacucucagcagaguucuuuaacuuguguuacacauucaacuaugucuugagaaagccaucuuacuuucugcuucuguaccucaaccucugcuccauguuuaguguggacugugcugcuggccccagaggaaaugucuuuccuccucugcuaggcuaccuucucuucguacaacucuuccucgugaacacuguccuccuaccaucccaucccaacaacuccuuccacuuaucuuuaaaaacccauauagugccucacugcaggaaggaagggcagggguacacacagacuaucauaccacagccauccacccaaaccuguaaagucauguuggauccauccauuacugauuuaaccaaccaaccaaucugccuucaacuuggguccaccucggucugccuucgggcacacgaauguuuccuuuaucauauucuuagucugcugucaucugauacugagcacuugggccuuuguuuauaaguccucugucuuuggcuucugagacauugcauuucuuguuuaucuugcucucugaccaauugccagugcuaugcaaacugugguuuguuaacuauuugcuaccaguucauauuaaguauaggaauugagggcauuagaaacuuuuauagcaauuugagagcagguuuaucuuuuauuuucuaugccuucuauucauuucauuuuuauaguaguaauccauuuucauugcauuugacaauaaacauuugacaauaaacugggcuaaaauccuugcuuuucgcaucuacaucucucacacacugugcuggacuaacaucauucaauuguuuucagguugcaucccuuauuucagcuguaacuauaaucauuuuuacuuggauacucaaaaaugauguugcuucuacaacuucuguauuucugccacucugguuagaauacucaauguuuuuuaauuucuucucuuucaucuuuuuuuuuuugaaacagaauuuugcucuuguugcccagguugaagggcaguggcaccaccucagcucacugcaaccucugccucccggguucaagugauucuccucuuagccucccgaguagcuggaauuacaggcgugcaccaccacacccggcuaauuuuguauuuuuaggagagaugggauuucaccauguuggccaggcuggucucgaacuccugaccucaggugauccaccugccucagccucccaaagugcugggauuacggggaugagccaccgugccgggcccuuucaucuuuuaaaauucaaacugccagaaacaaacuguuaaugcuucccaugaaaugucuuuuagaaucaccucuuccacuauuacuaucuaagcucccuggacgaugacaguaugauggucuugccuuaaaucuucucccuuuuuuguguaugccucacccaaugcuaccacacuaauuuuuuaccauaugauaauuuccugcagcauuuaagaacacagaaugguuuuucacacuuuacauaaaucagaguucaaaaacuucucugccuuauuuucagggugauccauauacacugauuuuaccugaccuuuagcuguaucuuucccaauuccaauuaucagcccacauuuuggucaaucugaauuucucuacucaucauuccacaacuccgaauagccuccucaguuuuuguacuuuauauucuuuauggucaugcugcaagucccucuuucuccaguucuuacccaucaaaucaacccaaauuaaucuacaaacagaaagcagccuacagaucuuaaaacuuaccucuugaagcuucaguaccauaauggaaugcagauguuucaccaaauuauccaaguauggaauaaguagugacuugggacagucuucaguaaaguuaaugagggcagcagcugcaugggccugcacacguugauugccuuggucuuccauggucugcagcagagcugcaaucaccugugaaaugaaaccaaaugggcacacauguugaaauguccacccuucuuccuaaagucugauuuaaguguuugaggacuuguuacuuaccuucucaugaaauuucuuuuggaaaccaggugcaaaaucuguagccaucugucccacggcauuacaggcugcauaccuuacucuuggaugcuggaaaauguucccuuucauuaguaaaagcaagaagguuuccacaugaagcuacacuaaucauuuugaaucaaauauuuacugguacuuacaggauccuggagaaaaaguaaaacaaaauuuacgaucucauuuagaauuccuuccauuugcugguggcacccuucaccaauggcagauaaggccaucaauccugcaugccgguauuuccagucagcuaccgaaaaaaauuacagauggaauagcaauuacacacuauaaacaugucauucugguagagggagauguauaaaaguucuuauuuggaaaagaguaacaaaacuuuuuugaaaaggguauauguauauauaauauaaaaacauuuguauaggccgggcgcgguggcucgcgccuguaaucccagcacuuugggagucugaggcgggcggaucacaaggucaggagaucgagaccauccugguuaacguggugaaaccccgucucuacuuaaaaauacaaaaaauuagccgggcacgguggcaggcgccuguauucccagcuacucgggaggcugaggcaggagaauggugugaacccgggggggcggagcuugcagugagccgagaucgcgccacugcacucuggucugggcgaaagagcgagacucugucucaaaaaaaaaacagaaacaaacaaacaaaaaaaacaaaaaacaaaacauuuguauauuuacuuuuuagaaaaaugaacagaaaaagugcgugacuacuugauucuaaaaguauguaucaggccaggcgcgguggcucacaccuguaaucccagcacuuugggagguugaggcggguggaucacuuaaagucaggaguucaagaccagccuggccaacauggcgaaaccccgucucuacuaaaaauacaaaaauuaggccgggugcaguggcucaugccuguaaucccagcauuuugggaggccagggugggcggaucacuugagguuaggaguuugagaccagccuggccaacauggagaaacuccaucuccacuaaaaguacaaaaauuagcuggguguggugguguaugccuguaaucccagcuacuugggaggcagagacaggagaauugcuugaaacugggaggugaacauuguagugagccaagauugcaccacugcacuccagccuguuugacagagugggauucugucucgaaauagcugggcgugguggcaugugccuguagucccagcuacucaggaggcuagggcaggagaaucgcuugaauccaguggguggaggcugcggugagcugagaucacauuacccugggcaacagagcgagauuccaccaaaaaacaaacaaauuucuaacuuaauacuucugaauuuuaauuuaacaaaagaacacauuaacuuuauaauuaaaaaacacaaaugaaaauaaaacacauacaacaauaaacuuugggauugauauauauauuacagguacaaagguaacugaaauauucauagaaauaaaaaggaaggauggccaggugugguagcucaugccuauaaucuaagcacucugggaggcugaagcaggaggacugcuugaggccaggaguuugagaccagccugggcaacauggcgaaauccugugucaacaacaacagcugcccuccagggcaggugggcuuccaccaucaccuccgucaggggcaaaaacagaaagaaagaagugguuucucuuuugauaacauuagauagaguuucuucuuuuaaaaauaaaagauauugggugaaagaagaguauaugauucaaacauucuaauauuccauaaaaauucaaauaauaacaucauuuucaaauucaaaucuaaauacuuuuggcuaggaaguaaaucuguacauuuucuuugggauugacaauuuuaucgguaaaauaaaugaauuggguuaaauauggaugauaaaaagacaaagauuaauuuuuaacagucuaaacauaucuuagaauuuaagcuuuagaaagggcacaacuucacucuucuagcauuugaaggacacagcuuacgauuuugaagcauuugcauaauguguuccuugaucaucggcagaacgagcuuuccaccaaguccgcaagccauucgaucuagagcacucucgccugcaacugcauugcuaaacacauaaacagaauuauguacucaauauaucugaaacacaaaagaaauaguauacucuacagacauacuucuaaccauauuauuauuaaacuaagacugagaaagaauucaagcugucuuuaaauguggaauugaaauuagggguuaaaaacucugcagcuuagaaaagaaaaaagaguaaauguuuuuaucaugauccaccauaguuuagaaagucaugccugauucuuauuuuucuuuuuuuuuuuugagacagagucucgcucugucacccaggcuggagcgcaguggcacgaucucggcucacugcaagcuccgccucccagcuucaugcuauucuccuaccucagccucccgaguagcugggacuacaggugcccgccaccacgccuggcuaauuuuuuuguaguuuuaguagagacgggguuucaccauguuagccaggauugucuugaucuccugacuuugugaugcgcccgccugggccucccaaaaugcuaagauuacaggcgugagccacugugcccagccugaaucuuauuuuucaagaccacccccacccgcuacuggcuaaaaacuguucucagaaauagcuucugacacuuucaacacuccaguaaaagcaguauugaaagagccucauguauuucauuuccuagaaauacagucuucaaaccuaucaaugaacagaacauagaaaacugaaaagggugcagagaauguauaaucuuccccacugugaguuuauucacccuuaaaggggugcaaacugcacugccaaaaacuaugcauagcuaugugaaacucaauucuauugucuucucugaaagccaaaggaaugugggcauaaaagcauuuggacuuauccuggcuuagaacuggaggaucaguaguguauuucaugugcauuaucuuuacuauguaaagacaauacuauaaaaaugaaacuauaaauuaucuucagaacagguuuuuagacuuaaaaaaaucucacccugaaaauauauuuaugcuguuucacaaaugagaaaaucuuauucaucuaguuuagaaaacaaaguuucuuaaacuguauaaauuuaagugccauuugcagggcaaaugaaaggacagguagcagcacauuacaguaacugaaccaaaaaggaaauucgaccuagcccuggucuucucuucagccguuaucaggugauuuccagugaaagauuacuuucauauacuucaagacaguauuaaagccagaaaucagucauuuuuaacaaugggauuaagucucaaaaaugcauauauauucuaaagccaaaaaucuuuaauuuuuacuuuuauuaaccuaguaguuuauacugacuccaagucuuucaggagaauaauuucagcuuuuuauuuuuuuugagauggagucuugcucuguugcccaggcuguagcgcaaugacgugaucucagcucacugcaaccuccaccucccagguucaagagauucuccucgcuuagcuucccgaguagcuggcauuauaggugucugccaccaggcccggcuaauuuuuguauuuuuaauagagacgggguuucaacauguuggucaggcuggucucgaacuccugaccucaggugaucugccugccucugcccaccaaagugcugggauuacaggugugagccacugcacccagccaauuucagcuuuuuuaaagaaaaggugguaguauaaugcacugggaagaaugaaaacaaugguaauuaaccccaguccauuaacuggcuacauaaccucagacaaaucacucaaucuucaaucucccuuucugcaacuguaauauaauacaccucugggacugcuaauaaaguugauuaaaguaacagagcucagaggugcuauguuucacauacauguaaggggccaucauuacuacugcacagugaauacagauuuugguugacuuuuccuguauucaugggacuuccuaagcugaaauaaauaaguacaauaguaauacucuacccaguugacucucaucuuuucaccacuggaugcugccuauccuaaaguuaaacugcuuuuuacuaggaaaauaugauguguauugcagggaauuuuguugaaacaauuauucuaagggaagucucugccuguaaaagcauuuaucacaaaaaagcugcuuuauacacguuuuaaaagauauucaaacuaaaaacaaaaacaaaaacaacaaaaaacuuggaaauaauuuagaguacgacaguuaaaaacauagauacuuggccaggugcgguggcucacgccuguaaucccagcacuuugggaggccgaggcgggcggaucaugaugucaggagaucgagacuauccuggcuaacauggugaaaucccgucucuacuaaaaauacaaaaaauuagcuggacgugguggcaggugccuguagucccagcuacucgggaggcugaggcaggagaauggcgugaaccccggaggcggagcuugcggugagccgagaucgcgccacugcacuccagccugggcgacacagcgagacuccgucucaaaaccaaacaaaaaacauagcuacuuuauuugcuguuuucaugucauacuuuuuuuuaaaaaagaaaaacuuccuuguuuguuguuguagguaucuuucaguuccugauuauaaaauacaacuuuauguauuaacuauuaaaauauuuuuaugaacuuccaagaaacauaaauuuuauuaauauaaauuauacaugaaaacuaaagaaaauacuacuuauaacaugugacacagcaauaaauacaacagcaaggcaaagugccccauauuccaggcuuaaaaguuuaccuucagguuacagggugcaauagugaagagauggaccguggagcccuagggcuuucacugccacccuggacacaauguuugauuaccugucaaaaucaucaucuucuaguucaucugcauuugcccaguccucaucuucuuccaaaucaaccaucauugcuaacaucugaggaacuaaaguaaacaauuauuucauacccgaagacugugacuuuaucuuauccauaucacuauuuauaaacaagaauuuuaagauuuuacuuugccuguaagagaacaagacaaaacaauuauuugucugugcccccaaaaccugguuuguuaaauuuuaaccuuguuauauuugcuuuuaucguuucuuuaaaaagcaacauucauuaagucaaacccuccuaugaaauucccaaauccgauuacauucuccccaucaccagagguaagaagcaacaucacaaauguuucucauuccgcaauuguuuuuucacacuugaacuacagauuuccauaucucuauacaaaauuauaguacuauuucaagauuugauuuuuuauauaauaaaugguuucauaauauauguaccucggcaauuugcuuuuuucucaacacauaaggauuucaguuuauuuaauagcauuccauuauauaaacauacuacccacugucuagcugauaaacauuuugguuguuuccaauuuuuuccuccuauaaaauuugcuuugaugagauuauuacaucuuuucuuugacaagcaugagucuaggcaugaaauuguuauuacuaucuucaaauaguacuaaaaaauuaucaaacaagucuaggcgcgguggcuuaugccuguaaucccagcacuuugggaggcugaggcaggcggaucacgaggucagaagaucgagaccauccuggcuaacauggugaaaccccaaaaacaaaaaaauuagccgggugugguggcgagcaccuguaguccuagcuacucaggaggcuuaggcaggagaauggcgugaaccugggagguggagcucgcugugagccaagaucacaccacugcacuccagccuggacgacagagcgagacucugucuaaaaaaagaaaaaaagaaaauuaccaaacaagcugcgcucugcacagcuguugcauaaacuaugugaaguuuaaguggaggucuccguuauuucacaaaaaugugugaagugcccuggggguggaauaagcguccucucaguuccacaucuuuuauuaacaauugauacugucaaacuucuggacaacuuguauuccacaauuacacuuguuuuuauugagacuuagcaggguucauuagcuauuucagaucccucuuuuacgaauuuccugacugggccugcuggugcacaccuguuaucccagcacuucgggaggcuuaggugggaggaucccuugagcccaggaguucaagaccagccugggcaacaugguaaaacccuaucucuaccaaaaaacacaaaaauuagccaggugugguagugcgugccuguagucccagcuacuugggaggcugcagugagcugagaucaugucacugcacucuagccuggaugacagagcaagaccccaucuuaaagaagaaaaaagcaaugaauuuccucuucucagccuuuguguauucucuagauaacaaaacuguugauugugugcacuguaauuauuuucuuccaguuuguggcuuauuuuuucaguucauuuaugguguaucugauuggucaaaaaauuguuuucgcauuugccaauuuggcaauguuuacaucaaugguuugugauucagucuuagaaaauuaucuacuauuaagcauuacuuguaaaauauaucuguaauauuuagcccuuaacuuuuuuaacuaguuccagcgugcaagguaauauucaggucuugaguagaccccaaauuauuauuauuauuauuauuauuuuugagacagagucuugcucuguugcccaggcugcagugcaguggcgguaucucggcucacugcaagcucugccucccgggucacgccauucuccugccucggccucccgagaagcugggacuacaggcgcccgccaccacgcccggcuaauuuuuugcauuuuuuaguagggacgggguuucacaguguuagccaggauggucuugaucuccugaccucgugauccaccugccucggccucccaaagugcugagauugcaggugugagccaccgcgcccggccuguuuuuuuaauaagcugucuagaguuggaauuuuuuuccccauagaaauaaccaguuauauucucaacucauaagugggagcugagcuaugaggaugcaaagguguaagaaugauacaacggacuuuggggacucaggggaaagggugggaggggagugagggauaaaagacuacacaauggguacaguguacacugcucccguaaugggugcaccaaaaucacagaaaucaccacuaaaccaaacaccaccuguuccccauaaaccuauuaaacaaacaaaaaaaaaaaaaacaaagaaagaaagaaugaaagaaagauaucccagaaacuuuuuuuuuuuuuuuuugagacagggucucacuccgucacccaggccggagugcaauggugcaaucuuggcucacggcagccuugaccucuugggcucaagcaauccuccaucucagccuccugaguagcuggaaccacaggcgugugccaccaugcccgacuaauuuuuguauuuuuggcagagaaaggguuucgucaugucgcccaggcuggucucaaacucagcagcucacauaauuuacccaccuuggcuuuccaaauugcuggaauuacaggccugagccaguaugccuggccccaagaacuuuugaucaauuaucuuuuuaaaaauggcuuuguucccaugugagcggaucuucuccuacacucuacccuuuguuccauccgauccauugucaacaccugcaucaucaaugcauucuaaauucacagaguugaugaaacaagaucuccacuuuauucgucaaaauugucuuggcuacuccaggcccuauguucuuucagaagaauuucaggauuguucuaucauaacccuagauuaauuugagaacugauaauuuguucuucuauuagucuuucaauauguuauucaacuuucccauaugucuuguacaucuuuugauuuauucccaguuacuauaacucaugccuauaaaauuuucuaaaugauuauuaugaauaauggaacacuuacaauaaaauguucucauaucuaaggaucuugcuuaacccuuugauuagcaguuuaucuguugagucuuuaaaacuuuuuguagacaauaaccacauagccuacaaauaagcaauauuuuuguuuucuaauucuuuuuuuugagacgaguuucgcucuuguugcccaggcuggagugcaauggcauggucugggcucacugcaaccuccaccucccggguucaagcaauucuccugccucagccucccgaguagcugggauuaccggugugcaccaccacaucuggcuaauuuuuuguauuuuuaguagaaacgggguuuuagcauguuagccaggcuggucuugaacuccugacuucaggugaucugcccgccucggccucccaaaguguugggauuacaggcaugagccacugcacccagccauuguuucuaaugcuuauaacuuauuuuuaucucuuaaugcaucagcuggggcagucaguacaacaugaacagugauaaaggagauauuuuucuuguuccugacuuaaaugggaauguuucuaaaauuccaaccacuaccucaguguaagacaaaagguagguaccacuacaaaauaaaucuggugacguauuuacccucuaaauuaaguguucaaguacucauuagcucauuaagaaauggcuaggccagaaaaugaucagguuaguucucaaguccuuaucccagcacaaugaaacuuaaaguaguauuuccauagcacaauagccauuuaaguuucugcugcaacgagggucuauaaaacaaaagcaauguaauauagugaacagagccaugacuaguguuagaccuuguucuucuaaucuuggcuucacugguaagcaagacaugcuauuuugguuuguaguucgcuacugugcaucuauauauccccgcugaauuguuuuugacucuauuaacugugcccaauauuaacauauaaaugauagagucugucacacuccacucuagaaauguuauuuuuaacaccagauuucagggugucugcaaagucuuaaaggcauaaccacaauguggggguccacgcuugcauguauugagaugcauuuucccaaauucaucugauucuaaaaggauauucauuauauucucaacaaucugagaaaucacacaacccucagcaaauuuauccaaaaauuuggccacaauacacauaaacuaucugaagaccauugacuuacuagucugugcaacaauauugguauguuuucuuaacauagcagcugcagucucagagagggugacgaucacuucaagggcaagcuggcguugcauauuguugaggcuagugucuccacacaacuacaaagaagacauauuuguauacauuuaauaauuuagauuagucccugaaaauaacaaacagaacguuuacuaacguacuuaauuuaccuuuagacuuagcuguagaguugcuuccaagugaggacgcaaauacuuuggaacaguaucugcaaucucaacgagggauuuuaggacagaaucaucauucugguagcacgagucauuuaccgccuagaaaagaugaaacagaaagucggugcugaagauucacuuuauaaugccucauuagccaaaagauuccuaagaugcugacaauagagaaauauuacuaaacuauuuuucacuaaauaauuuagcaaucuauauuaugcaaauguucuaccugcaggcacauguauaccuuccuucugauggauguuaacuagaaacauucaaaacagauuuacaucuaagucaaaaugaaaaucagugaaacuauaauaaccauuacaauacuuaaggcuaccaaggaauuacuuuuuuuuauaaccaggagucccuuuccuuuguccuuuuauuuuuucagugauaaggucucgcucugucgcccaggcuggagugugguggcacaaucauagcucacaguacccuccaacucuugugccucagacuccugaguagccaggacaacauguguggccaccacaccuggcucuucuguccuuucuuauauccaugcccuaguuuuucucauacgcauaguaaguacuagaaccuguaauacauuuaaaguguccaauauuacccauuuuauuuaucuuggauguuaagucuggucacugugguauuaaaguaugcauuuuguguuuaucauuaucuauuucagaauaacaacucuuaaaaguugugguaaacauuuuaacuuacucuaaauccagaggaagaaaaccgggauuagauuucaacaguaacuagagauuucagauaauaaacuacuaaagcaauaguauguuacaauuuauguucugucacgaaacuaucuuuucauugugauagcagggggagagaaguuucacuaaauccuuuaaauaacuuaucauguggaaaccuucaauuuuagcuccucuaaauccucucuaacucagugguucucaagaggaaugguuuucacccaggagauauuucuugauggucacacgauugaggaugggcaaaggccauggauacuaaauguccugcaccugugacacaagcacaagggacuuacaugaucuucucauuaugcauuucacauuauuacaaaucccagacauuuauaaaaaggagaaaacucuuuauaaugaucugaaccuagaaacuaacucacaaauuauuuuuugccugguuuuaacaacuguuaucccccccuccaauguaacuacuguaucaaucaagaauggauacauacagguggaacaucccaaauccaaaaugcucugaaauccucaacuuuuugaacacagacacgucacucaaaggaaaugcgcauuugaguauuucggauuucugacuugagaugcucaacugguaaguauaacacaaauacaguguuucaaaauuugaaaagauuuugagauccgaaacacuucuacucccaagcauucugaauaagagacacucaaccucuacuuugcuuuguucagaaccuuacuauuuuaggaaaucuuaucaccaauucuaaugggaacugugguguuugacuugccaauaucuuugcuauuaguccaguuuuagcuauugcauuuguacagaucacuuggaagccaccuagucuauuaugucuuccaguguagucuugucugaccauuuacauaaggagaagcaagccauuuuauuauacguuucuuugcauuucuuuuuuguauuaaggccauauauuaauauucuaaaaaauuaugcauauauauuacauuacuuaugcauuucauuuuuagaagaguacaugaaaaauuacuaaaagauugccauaaaaaaggaguuuggagucugacaagguugggaaccacuaacuuguccaaucuuuuaaauuuuaauuaauauaaaauuuuuuuccccaggagcauagauucaaguugcccugaauauaugcucuaucuugucucaucuuauuuugcuuucugauuaaagcagaaaguauucuuaaaaauuaacauccuuaacgauaaugugaauuaaccauaaacuuacauuauaauacaaacuauuacacacccuguaauuaagaguaguuucuccuuauguaaaaugggcauuaaaucucacagguuauuugguugauuuaauggaaauaaucuacaugaccauaaauucaacaauaagcauauaauugcuuacaacauuuacauuacagaaaaauuuuauaacuauaaauauuguaagagacuaaaaaugucuuucaaaggcaguaaacauaagcuuaauggagacugagauuugcauguuuuguucacugcuguaugccuagcgccagaacauaauaggcaauaugaauuuauugcauaaaugauugaaugcauuaaagaaccaaauaagauauaauuaugauuuauucuauauugcuuucauaccuguaggaaucccgguagcaagucugcaaaauguuugaacagagcaacauuaugcucauuugcaaguauaaaugcagcuguagcucuagcagauaacguccugaucuaaaaucaagaggaaaaaaugucaaacaugagaaauuuuugauaaacgcaaauucaaguuuucuuacucaagaucaaauuauucuuuaucaguaaaacugguguuuguauuuuaaaguauaaaagugaaaacaaccuccuaauauacuaauuucuuucgcaaauuagauuaaaauagaugguuauauuaauaggauugaaauuauuuaccgacggguguuccugaucuugcauacacugaacuaacauucguuugaugacaucuaaauaguguuguugcugguucccaaaaauuccaggaaaguuccuaaaagauaauccaaacauucuuuaaaaacuacauuauauuaauaucuugguaaaguaugagcuagaaucucuaaugaacuguuuguuuaccugacucaguacgcauuaauccauagguugaacaucaucuacccauucucuaagcaauccuguuuuuggguuaagugaaugaaaacauacuggagaagucugggcugggaguagaggcuacucagcagcccauucccagcuacaugcuuuuauccuuauuacucugucucagucgaaagcugaccuggagugcaggaugggacaagagcaaccacagguuuucagaugaaaacuacaagaacuaugcucuccggccaucugcauucucuaaucugaauuacugauauaaacaaagauauauaugacaacuaaaguacaaaaugauacaaagccuaaaauguguaugaucuugagcacauuuuagguguaguaaaaaaauauagcacaguggggcaaagaauaaucacuuaauucuaaacuuagacuauuugguuauaaauauacagguuucuuaacauauuauaaaauugggucacacaagacccagaaaacauaauggggauucaccugcauucuccuucuccucuucaagacaccauuauuaauguggcuuuugaaaagcuacauccaguauuguguuaaucuccaaauaaaggagaggaaacuguucaauaaaacuuucagaaucauaaaagacaaagagaaagcaagcaagcuguagagaaccuuuguguacaaaaaagaucauaaugugaaauaaaaggcccuuuuaaaaaaaauugcuuccaauacaaauacaaacaaaacuuauguaaaggcauuauuaucauuuuaaguauaagguuaaauuaggcuaaaauaaucaguuaaaagguguuuagggcauucauuaaaucaaaugucucaaaaaacuagauuaauguauauaccagaaaaugugaagggcagcuucccgcagucccacauuuugagagcugacugaaucaaaaaggaacuucaaaccuucgggccacugguuauugccauccucaucugaaaguaaagaaauccagacauaaaguuguguaagucagaacuucaauauacuaggaguaaauccuuucauuucauaagccucauucaaaccuggaguagugaaaaaugucacuuuugcuauuuuuaaaaacuccacaaaauucuguccuuuagccauaaaaauggcaucacaaucauguuaaaaaaaaaaaaagaccaaacaaaccaacaaaccaaacaacucuguauuuggguuagauaaucagauauuaacagagguucuucuuuuuuuuagauggaguuucacuuuuuuacccaggcuggagugcaauggcgcgaucucgguugacugcaaccucugccuccaggguucaagcaauucuccugccucagccucccgaguagcugggauuacaggcgccugccaccaugccugacuaauuuuuguauuuuuaguagagacgagguuuggccaugauggccaggcuggucucaaacuccugaccuugggugauccacuugccuuggccuuccaaaguacuaggauuacaggcgugagccaccgcaccuggcuggcagagguuauuucuaaggaguggaauuugaagagaaggcagcacuuuuaacuguacaaauaucugauugacugacuccuuuauauauaccauugcuauuaaagaguugaaaaaguaggcaaagcuaguauuugguggcaaggucuugaaaccaaaguaacaacuacuuuggaacuugagaagacaucaggguuagaaucucaggacccauacagggugcucacacuuugcaguuugguucaaauagugccagaggauguuauuaauauguuuacuauuuaacaagauuaagagauuuuaaauaauacuuuauaauaaaaaugagugaccacaaaaaucuacugugccacuuauaagacucugguuauauugucacaaagaccuuaagaguuauacaacuuacagaugaauuacagauguuuucuuuuuaaacgucccccgauauuugaacuuuugugaaaugacaauugugcugcuaagcugacauuaaauguuucuucaaccuaaagaugaugcuuugaggggaaauaaaauagcagcuuaaaaaaaaaaaaucuaugagagcacuuugaauacuuuggaaagguuugcauuguuaaguguuucugaaugagaaaugaugucaccuauaacaauuccuaucugcauacuuaaaacuggaaaguagaauuuucuaaacaauuuaaaaauauucaaaauuagggcugggcgcuguggcucaugccucuaaucucagcacuuugggaggccaaggugggcagaccauuugaggucaggcauuugagaccaggcuggcaaacagggugaaacccaguuggcuccaucucuacuaaaaaaauacaaaaauuagcugggcgugugggaggcugaggcaggagaaucaccuaaacuugggagguggaggcugcgguaagccaugaucacaccacuguacucaagccugggcaacagaacaaaacugucuaaaaaaauuaauuugaacucaucuaaaauauaaagaauugacacauuccccauuaguuucuaagaaaugguugacauaagaaaggauacaaucugcuagcugaauugaacaaggacuuacuguauuacugguugaugagauuuuaaaauuagugucauaauguaguaagcucaaucaauaguaaucucccauguaaccuugaucuucauuucaacuauuaaaaaugccaucuaaacaagcugcgcuuacaaccacacuuauaaaucccugucuaaaaaaaaaaaaaaagugguggcuacacucucuucuacgagcaggaaguaugaagaugagugggacaaaacccaagacaccauggaagcugucauggcccuggagaagaacuuguaccaggaaccaggcccuguuggaucuucaugcccuggguucugccugcacagauccccaucucugugacuucuuggagagccacuuccuagaugaggaagugaaacucauuaagaugggugaccacgugaccaaccuccgcaggcuaguuggcuccuauguugagcugggcaagugucucuucaaaaggcucaucaucaaacaacacuaaaagcccagugaccucugagggucccccucaauguaucagagcuucugccugacccucucccuccagccauuagguagcuuuuuaaccaagcuggagcccucucccaggcacuagaccaaauggaaauaaagcuuuuugcagcaagauaaaaaaguagcauguucaauuacauuacuauuauuuuuaguugacuaaaaaggauuuuuaccuuuaguaaaaugcauuuuuuuaugauguuugccuuuuaccucacuuaaaaaaauauuuuuugggcauuaaaaauguacauaguaggccaggcgcaguggcucaugccuguaaucccaucacuuugggaggccgagaugggcagaucaccugaggccaggaguuccagaccagccugaccaacauggagaaacccuaaaaauacaaaaaaaauuagcugggugugguggcgcaugccuguaauuccagauacuugguaggcugaggcaggaaaaucacuugaaccugggaggcggagguugcggugagccaagauugcaccacugcacuccagccuaggcaauaagagcgaaacuccgucucaaaaaaaaaaaauauauauauacauaguauagcuacguaacaguauauguauauauuugucaccacacauauacaacagcaaaagcacuggagucucugauuuuuaguucaacuggcaaguuuaauguacaaaguaggucauaccauuaauuagccugugcuucuaaaacauuauagauuuaggagaaaauguaacugccaauuuucaagcaaauuacaaaauuauuuuuccacauggauuuuuuuuuuccuuuuuuugagacauagucuugcuuuguugcccaggcuggagugcaguagcgugaucaccgcuuacuguagucuccagcuucuggggcucaggugauucucccauuucagccucccaaguaacugggacuacaggugcacaccaucacgcccacuaauuuuuuguagaaacgggguuuugccauguugcccagguucguccugaacugcuagacucaagcgaugugcccaccucggccuccuaaagugcugagauuacaggugugagccacugugccuagccucacauggguauuuugaauaccaauaggugaguccuaugacuggauuucacaaacaucuaucuguaauuucuggcucuaaaugcaaaauccauaagcacauucauuuuaaacagaauaaaugguacucagguacuuaugaaucuuacucuaaaagauuccauuaaaaaaaaaaaaaaggaaggauauacccauguucuugguaacaugagugcaccugcauacacaccuauuaaauuccuggccaguucugccgcaauaucacaaacuuuuuuccucaugcuagauuguguuuccaucugaauaaucaugaguagcucacucuugauggcagucugaacaucagagggaagugcuggauagacuucaucaaaugcagaggacaagagacgucuuaggagaacggcggccauuugucuagccuauaaacagauaacauuguuaauaacuagauucacucugccauugauguauuucacuguuguauuuuuauauuucaaaagcgccuaauuuucuaaagaaguaaauauauaacucuuucuaauuacauuagucuauuauacagacuuauuuuguuagugccacaaaauaagccauuuguacuuaaggugaggagaacuucuaaucacauuacaauucaauuaggaacacauauuuuagcaaugauaaaccugucuuuaaucccuguuuuuaacacauuauuugggagaaaaacaaaucuuaaauuguaaacccuauaaugaaugcucuuuuccuaccucucugucuggucucauucuagaauaucaagcgccuuucccacccaaccuuaggcucccagccugaccuaacuuguuacauaaccgcccuuucauuagcaucuuagauaaaaugcuucuuucaugcaaacaaacauuacgaguucccgauaccuaaaaagugcuaauccaucucaacauguguauucuuggauuuucauuuucaaaucuguguaauuaaguuuggcauuuucuguauaacauuucuugagauuaucaaaagaaaagcuaagacaaaugccauucuaaaauuuuaucaaaucaagccaauaagcuauugggaauauugaaccuaaucuuuccugcucucgauuuccccaagcugauguuacucauuaucacuauaauuacuuugggaauuugaccaaaaaaaauguuaagcuauacaaauaaaauuggcuauuuuuuuccuccauuacuuuucaccgagaaaucuuuuuacugaaacauuuaugguagguagaaaccuuuacaaauauuuaacauguucuagaaagaauucaaaaugguuacaauucuuauaaaagugguuaaaacucaugugcaauucuucucacacauauaccaaaaacuauaaagccacaaucaagaugcugucacuaauucacaacaaucaucuaauucuuaaaucuaguuaagauuuaaauaaggcuuaauacaaguuauuaaaaaaauucaguauucuuggcuuuaaaauuuguuuacuaacuugcacuaaucuucaagaauuaaaacagucaucuguuuuuagugauagaaguuacccuaggccgggcgcgguggcucacgccuguaaucccagcacuuugggaggccgaggcgggcggaucacgaggucaggagaucgagaccaucccggcuaaaacggugaaaccccgucucuacuaaaaauacaaaaaauuagccgggcguaguggcgggcgccuguagucccagcuacuugggaggcugaggcaggagaauggcgugaacccgggaggcggagcuugcagugagccgagaucccgccacugcacuccagccugggcgacagagcgagacuccgucucaaaaaaaaaaaaaaaaaaaaaaaaaaaaaaagaaguuacccuauauaggguucuucauauuugacauccauuuugaguuacagaaaagaacagguuacaaaagcaaagaaguaccucuugucaucuagaaaaaaaaaaauugggauacuuuuauauggcuuuuaaagugguugagagaacaugaaguugcuagucuaaacugacugacuggaagaagucaggugaaacauaauguaaaaguuuagugugacuuauuuccaucaaggauaagcauuuuauauacaguuugcuagcaaaaaaagucuuacacuacaaacucuaaauguaauguuuuguagguagaauaguuuucuagacuuggguauuuuuauaccuuuuccaaaguaaacagauauucaauggcauucaauauuuaugaggauauuaacuuauaaucggggggacggugggggggggggguggaauuagcuacaaaaugccucaaucaguaguaggaaacuauaaaauccuaggaaauagccuuguuuuuaccauagggaaaaguaauucuuaaaauuaaaacaaauuugaauuugguauaggaacuagguaauuagcuaaaaaccaugauucuaauaaaauauucuagaaaaugucucuguuccuaaguauaucuuuaguacauacacuucauccagagaugguuauaagcauaaauuuuuaaagaugggaaaaaaauauuuuuucaaaacauugauaacacaucaaaacacugaacuaauuuacuucuuuagaauaaauuguuucaaggaaagaaaacuuuuagcugcaaaaagcacuuaaauuaggcugggcguggcggcucaugccuguaaucccagcacuuucggaggcugaaggggguggaucacuugaggucaggaguucgagaccagccuggccaacauggcaaaaccccaucucuacuaaaaauacaaaaauuagccaggugugguggcgcacgccuguaaucccaguuacucgggaagcugaggcaggagaacugcuugaacccaggaggcagagguugcagugggccgagauggugccagugcacucaagccugggcagagugaaacuccaucucaaaaucaaucaaucaaaucaaaucacuuuaauuuaauaauucuuaugcaauuacuuauaaaaccauuaaucuucaucuacccuggacacauuaucuuaugcggaaaaaaggcaacucucauucuuaauacaaaguacuucaaaaaauuacauuauaacuccuaaguagcuuuuagcaaauaauaaguacaaaguucuaguaaagucuaugugguuaaucacaauucucauuucucuaauuucuacuaugaucaucaucuaauaacuuauuuucuaagaauguaauagucacaaauauuaagguaguaccucuucagcagcuguuguauuucugauggcuuguaagaggaaugugaucuuugacuggccugggauauucucauagguuuccu

SEQ ID NO: 19134 - RNA, 31580 nt, Homo sapiens
ggagaagaggcauggauuccgcugcugccacucgaacacguuucauuguuaaggaaccucaaaagacuguuuauuauuuugcuuaaauguuaaaggguucaaugcacuaaaaggagugcuaggcaacuucuguuuaucuaagauacccaagagcuuguguuaaauauaaagcauguauaaaaauagaaaagacauaccuccugucuccucugucaccuguaauaguggcaggaaugaguccagcagcagugaagggcugccuauugcucaaauguaaaccaaaauacaaaaaugacuauggaaggacccaugaccauuagcaugccuuaagcuguaccuaccucaaaaccuuagguacuaucuguuucuaauaaaagcaacugaaguauuucccugaaaaagaccaccgaggaccucuuccuaugcuggccuuuucaguuuuuaauaaagauuaaauugccuuucccuaucuaaucucauuuauaaaauaaggucuugauaacuuccucuuaaaagcaaucccgcuuuguccucuggcauccugggaaguuaagucuuuguuggguaaaagcugucuucuguaaaggauaccacuauaggauaccguaaaaggaaugaugacaaacgggcuuuggagucagacagaucuggguuugugucugucuaccacucucguguguaaaggcauaaaaauguacuggaaaauauuaauuacggcuaucauuauguugagaaagauauuggaacgcagauguggguggaucaccugaggucaggaguucgagaccugccuggccaacguggugaaagcccgucucuacuuaaaaacaaaaacaaacaaacaaaaaauacaaaaaauuagcugggcaugguagcgcaugucugugaucccagcugcucaggaggcugaggcagaagaaucgcuugaacuugggagguggagguugcagugagcuaagaucgugccaugcacucuagccugggcaacagagugagacccugugucaaaaaagaaugcagaugugccaagugauguuuccccgcaaaggugcuauccacauuugaaauguaggguucucacugcuacagaaagcugaccaucuaucagugguucucuaaucuauuaagacaggucuugccaggcacagugcucagguguguaaucccauaacuuuguggggccaaggcaggaggacugcuugagcccaggaguuugagaccagccugggcaacauaggcagaccuuaucucuuaaaaaaaaaaaaaaaaaaaaaaaaaaucaaaucuagcugggcuugguguugugcaccugggucccagcuacuugggaaguugugguuucagugcguccugaucacgccacugcacuccagccuaggugacagagugagacaccaucucuuaaaauaaaagucuuauuuucuuaacguuuaccaaaagauauuuggggaaaguagcaacuauauauaauuguaaucauuugcuaauuauccuuaaauccuuaagugggccacagaaagcugacaaacauaggauaggucacguuuucuuuuucauguuuuggcacaaguggaaacaaaggcacaugcagagaaccgaguuuaucaccuaagaguacacuuagugcaaauacaaacaaucauggugaagucuacuucagucaacacugucuaauacuccaagaaacuacaaguuuacuaaaucuagacauguuuuguauucagaaguuguaggauaucaucguggaaauaaaauuucaguaaagggaccaucaguuugacaaccuguucgguguacuccacaaagccuuccuuuaacuccuuagcauagcaaaccuguaaccaaaguauugggaggaaauaaagauucauguuagucuucaagcauuaauauuaacaaacagcaaaaucauaaggaccacaggagguuguauuuugacuagaacuacauuuaaaguugcauguagaacugucaaauuagucuuccaacuaaaaagagucuuaaaagaagggucaugaaaugauuguaguauuggugagugacaaaaagaaaaaaaaaaaggaaauuauugucguauauauugucccuucaaaggcuggaaucauucguauuccauucagcaaguuucagcaauacaucaaacaaaauguaucacuuaauugaggaaaaaucauucuaaaagauacaaaaaacccugaaaccaucaguuaauugaagcauuuacuuuguaaaucuguagaaaacgcuucuguuauuuuguauuuuuaaaaaaucauggcugggcacgguggcucaugcuuguaaucccagcacuuugggaggcugaggcugguagaucacgaggucaggaguucgagaccagccuggccaacacagugaaaccccgucucuacuaaaaauacaaaaauuagccaggcaugguggcgggcaccuguaaugccagguacuugggaggcugaggcaggagaaucgcuugaacccaggagguggagguggcagugagccgggauggcaccacuauacuccagccuggcugacagaguuagacggaucacgaggucaggaguucaagaccagccuggccaacauggugaaaacccgucucuacuaaagauacaaaaaauuagccaggcaugguggcgugcaccuguaauccuagcuacucgggagguuaaggcaggagaaucacuugaacccaggagacggaggcugcagugagcugagaucaagccacuguacuccagccugagcgacagaguaagacucuguuucaaaaagcaaaacaaacaaacaaacaaacaaaaaaaaccccaaaaacccaauuguuucauucucuucuacuacaucuaaagauuaauucuguuuaaagauguuauuauuuguauuugcuuuccaguugagagaaaaaacccacaaaaauccaaaguguuuauaauuuauagauacuaaguauugaagaugacaauaagaaauacauuaauuucuaaaaucuaacuuuaaaaguaaguauuggccaggugcaguggcucaugccuguaaucccaggucauggcaggcggaucaccugaggucaggaguuggaaaccagccuggccaaaauggugaaaccucaucucuacuaaaaauacaaaaaguagccagcugugguggcaggcgccuguaaucccagcuacucgggaggcugaggcaggagaaucaacugaacgccagagguggagguugcagugagucgagaucgugccacugcacuccagccugggugaaaaagagagacuccaccucaaaaaaaaaaaaaaaaaaggauuauccuucacuuuaaaacgcaugcucauaaagaaaacaaaaagaaaacuaggaacuaaacaugcauaugcacaccacaaacaccauaagggauaauaaccgaacauuuugauuuuccugccauaucuguuuuuuuacacaauugaaaucauacaaguuuuguuucacauuaaauagcaugaacacacuucuguucauuuguuuaaaaaacauuccauggccaccuacuauagacuaagaacaaaaccaacaaaaauccuucccucauguagcuuauaaacuuuuuguaauggcuguauauuacuccaaggcacaguaauucaucuucccacuaacaggaauuugggcuauuuguuguuuuuugcuauuuaaaacagcacugauaaugaaagguuuauccauacgauuucuuuaaaauggaaagaaaacuuuacuuuuuaaggaacauauuacuggcucuccaaaguaauuucuuuagcagcuauuaaaagcacucauaugaaauguauauaagauguaaaauaaaaguuuaguaaaaacagugcucucuuaccaacaucuggcaagcaguugauuuuucuucuaguccugcaguuuuaauaccaaagcuuugcugaucuccaagguucacaaauucccaaccaucaucaucacucauauucuccaugucuugggcuauuaacggagaagaaaacaaaugcauaugaaaaauaauaacaaagagagaacuauuauaaccgauagcuccuucuaaagacaccuacuaucuaaaagggcuacuucgggcuuaauugaagccgucuucauuaaaggccccauaaccacuggaagguauugcugaaauucuuuuccaaggauuuugcacauucuggcccaugcugagaucauguaagagaucuggggaaaaauuuuaaaauuaaaauagauuaaaaaacaauggguaaacgugauaaagaaagccauuuccuuauuucauagaaacaauguuuuauugauauguucacaguacuuuaagcaguaagagcauuucuaaagguuauguacuuaaaagguucagaaucaauaaugaaaucccugugaacucacuacacugggauauggacagcaggugaggcaaaacacaaagaccagaaccuuggguauuucuuucuacuuucaguaagugauaaugguuuucuuucuuagcaucugaaucaucuaaaugaaacuaaucaccuaaacaaaaccaaacacuucaucaacucccaguuacaaauuuuuugaagacagaaauguauuuuaucugacucuguaucccuauugccugccacuccauucauuaaacauuuauuaaaacccaagaaacaaaacauccuuuucucuuagcuguuauaauuuucucauaaguggcugaguauauuuaaaacaccucuucuccuauuacuguguuuacacagacuuuaucaucugcaaauuaccuagagaaucugguuccauucaccaccccugcaaccuagaaagugauucuuauccccugauaucugucauccaccuaccuauuuaucuauugagcaugcauggacacaugccccaccucuuaaugauuuuauauguaaaaguccacccgcucuucagauagguacuggguguuucucacaugccaggcauuaaacuauaugcuggcugauacaaaggugagcaacacgccucguccuuaccaccccucccuacagcuuacaguccccucagucucccuacugucagcagucugcuaaguaucccuccugccuguuaucucuguacauacaaaacauacauguauauuugcauaucauuuugcaaagaaagcaaacaacaacaaaacaugcuuucuuugcaaaaugguauguuuuccuauuuaaacuauuacaguguggcaauguaaagucaaaauuuaauucaacaauuauuuauugagugccuuguuauauguuaggcauugggaauaccaucaagauaugacaaacauuuaugauguuacuauaacaguguuggaacugcccaccauugagacugagcagaucaggaaaaucuuguaaaggaugagaacugugagcaagcguuagcuggguauguauaccuauguguguaugugcgugugugucgagaggcagggguuccuccuaaugaaaugccuuugucuguucguuggcggagaggcaagcaguguguccugagauucuuggguucuguauuuucugccaggggagggagaucaugcagccuucaaagggcuaggagacacccaaauggagaugucuauuacauguuggauaaaugaaucuucaauucugaagaucugaaaguugcaagcacacagaggaaaccggaagccaugucugugagugacacugcuccacaggagugagaagagagccuuggauagaacccacaaacaccaaaacuugagugagagucacagaaagcaagagcaaccuacaacagacugagaaaaaguagcuugagaaacagaaggaaaaucagugaagaaugucucugcuagcagggguugauaguaugucaagaaaccuaucacuccuuuuguuuuaaauauauugaaccaugugcuguccacaacucauuagcggaucaaagcaaaugcauuaagaccacuuaccugaggaucaucaucuuccauaucauugaagucugucugggucuuuaacaaaagcugcaucacaucugaugcauccugcaugaacuagaggaaaauauguagagacacacuuguugauaccgaauuuuguuucuuguguaauuagcaaagcuuugccaaaaaaucgacuacauugcccacauaggucauaacuuucauagauaaacuaucauauugaaaaauucucaucuauauugugacagauuuaguucacuuucuagaaaaauauauuuuccacugaagggcagggaacuacaguauaaagguacuucuaauggcaucagguguuagucuauggcuuacgcauuucaagcaguaaaacugaauucaaauucagaaagaaaauuuuagauuguuuauagaauucacugcauaaaauuuugucuaugauuuucacuuaacucuuugcaguucugguaaucuccauuguauaaacaggcagcguuuuaaagagacauugaaagccagauauauagaguaugggacauacaaauauuuuauugguaaaaaacauaccaauguuuuaguggucagcgucucacagaaaccaguuccaaauauaaauuaauacugaugcugguuuugaagaaggcaagacagagcuucucuguugauaauucucagggucagaacaugaggauucaaugacagagaaacuucuuuugcauuagcuugaacaauucugagauguuggcugagaaacacacuggccaaugguccuugguaauuauuuucugaagaucuauaugcauagauuucucucuuagaacacuugaugcauuuuagauuaauaggaaagcaagugacauguuuccaagcacauauuuaaagggaacgaacauggauacugacuuccacacaccucccacgagaugcacugugugugguggggaaaggaggaggcaucaggagcacagcugagcuaaaaagaaaccuuaauauuaacaaugaaaagacgggcugggcgcgguggcucacaccugugagcagacugcuugaggucaggagaucagggcuagccuggccaacacagugaaaccccaucucuacuaaaaaaaaaaaauacaaaaaucagcugggagugguggcaggugccuguaaucucagcuaccugggaggcugacgcaggagaaucgcuugaacccaggaggcagagguugcagugagccaggaucaugccacugcacuccagccugggugauagagugagacuuggucucaaaaaaaaaaaaaaaaacaccaaaccaaacaaacaaacaaugaaaagaugaaggcaagaauuuguauauaaaacaggagcaaugugaaaggaguaaggaaaaaaacaagcauccagaaaaccauuuuucagaaggaaaaaaucccucuaguacucucaaugccuccacagccaaguuagguacaguaaauuuaacauaauagaaauuacaggccgggcacaguggcucacgccuguaaucccagcacucugggaggccgaggcgggcggaucacgaggucaggagauugagaccauccuggcuaacacagugaaaccuugucucuacuaaaaauacaaaaaauuagccgggcgugguggcgggcgucuguagucccagcuacucgggaggcugaggcaggagaauggcaugaaccugggaggcagaguuugcagugagccgagaucgugccacugcacuccagccugggugacagagcgagacucugucucaaaaaaaaaaaaaaaaaaaaaaaaaaaaaaaaaaaauuacuuacuuuuuccuucccaacagccagaccaaugaggcuaaugcauucaauaguuuuuccucucagaagucucaguucuuuuugaaccgcauucucaacgaugugcuucagugauggcauaaauaaaucauaguaggggacaaauuuuucuucugcaguaucggcaacugaugcaauggaugucacaacuuguuccaaaacuaacuuggugccuuucugaaucagcuagaaggaagacacaaauuauuaccucaaaggaaaacuggaagaaguauuuaaauuuacaauuacuacucccuucaaguucuugaaugcuuuucugaaacagcagaaugagaccaccucuccagaagcagagacuguagguuuuggaggaaauuucuauaaaaagaaucuauguugaacuauuuaugugagauuuuuuuuuucucucuucuauuaacacaacaccucuaacucauguuagucucaucucaaagcacagcuaauucuugaguacagauacggaaucaaaauuuuuguguucaucaacuuuaaugccuacacuucauccucauuuuuuucuucacugauuuccucuacuuaugauuauauuuugugcugucuuacuacgucauaaagaaaauucccucuuuggccccuuccuuuaucuucuaacccccucuccccagaagaucgcacgaaggaacccugcugccuucucuugcaucugucuugcugaaacagaugagaugaccuuuuucucugcaccaaagaucugguguucucugacccagcuaguaacaaaugcuuacuaacuauuugcugcugggcccguccugucaccagcaauauuuuaaaauaauucuucuguaaucccaggacucugggaggcugaggcaggcggaucaccugagucaggaguucaaaaccagccuggccaacauggugaaacccugucucuacuaaauaaauaaauaaauaaauaaauaaauaaauaaauaaauaaaaauuagccaggugugguggcacaccccuguaaucccauuacuccggaagcagaggaaggagaauugcuugaacuggggaggcagagguugcagugagccgagauugcgccacuacaucccagcuggguugacaagagcaagacucugucuggggaaaaaaaaaaaaagaagccaggcacggugacucacaccuguaaucccagcacuuugggaggcccaggugggcggaugacuugaggucagguguucaagaacagacuggccaacauggugaaacccugucuccacucaaaauacaaaaauuagccggguguggugggugcacgucuguaaucccagcuacucggcaggcugaggcaggagaauggcuugaacccgggagacggcgguugcggugagcagagagugcguuaucgcacuccagccugggcgagacuccaucucaaaauaaaaauaaauaaauaaauaaauaaaauaaaauaaaauaaaauauuaacucauaugaaccugagccaguuacuacuccagauuuucauaauuccccacgucaauuacacccacacucucagcagaguucuuuaacuuguguuacacauucaacuaugucuugagaaagccaucuuacuuucugcuucuguaccucaaccucugcuccauguuuaguguggacugugcugcuggccccagaggaaaugucuuuccuccucugcuaggcuaccuucucuucguacaacucuuccucgugaacacuguccuccuaccaucccaucccaacaacuccuuccacuuaucuuuaaaaacccauauagugccucacugcaggaaggaagggcagggguacacacagacuaucauaccacagccauccacccaaaccuguaaagucauguuggauccauccauuacugauuuaaccaaccaaccaaucugccuucaacuuggguccaccucggucugccuucgggcacacgaauguuuccuuuaucauauucuuagucugcugucaucugauacugagcacuugggccuuuguuuauaaguccucugucuuuggcuucugagacauugcauuucuuguuuaucuugcucucugaccaauugccagugcuaugcaaacugugguuuguuaacuauuugcuaccaguucauauuaaguauaggaauugagggcauuagaaacuuuuauagcaauuugagagcagguuuaucuuuuauuuucuaugccuucuauucauuucauuuuuauaguaguaauccauuuucauugcauuugacaauaaacauuugacaauaaacugggcuaaaauccuugcuuuucgcaucuacaucucucacacacugugcuggacuaacaucauucaauuguuuucagguugcaucccuuauuucagcuguaacuauaaucauuuuuacuuggauacucaaaaaugauguugcuucuacaacuucuguauuucugccacucugguuagaauacucaauguuuuuuaauuucuucucuuucaucuuuuuuuuuuugaaacagaauuuugcucuuguugcccagguugaagggcaguggcaccaccucagcucacugcaaccucugccucccggguucaagugauucuccucuuagccucccgaguagcuggaauuacaggcgugcaccaccacacccggcuaauuuuguauuuuuaggagagaugggauuucaccauguuggccaggcuggucucgaacuccugaccucaggugauccaccugccucagccucccaaagugcugggauuacggggaugagccaccgugccgggcccuuucaucuuuuaaaauucaaacugccagaaacaaacuguuaaugcuucccaugaaaugucuuuuagaaucaccucuuccacuauuacuaucuaagcucccuggacgaugacaguaugauggucuugccuuaaaucuucucccuuuuuuguguaugccucacccaaugcuaccacacuaauuuuuuaccauaugauaauuuccugcagcauuuaagaacacagaaugguuuuucacacuuuacauaaaucagaguucaaaaacuucucugccuuauuuucagggugauccauauacacugauuuuaccugaccuuuagcuguaucuuucccaauuccaauuaucagcccacauuuuggucaaucugaauuucucuacucaucauuccacaacuccgaauagccuccucaguuuuuguacuuuauauucuuuauggucaugcugcaagucccucuuucuccaguucuuacccaucaaaucaacccaaauuaaucuacaaacagaaagcagccuacagaucuuaaaacuuaccucuugaagcuucaguaccauaauggaaugcagauguuucaccaaauuauccaaguauggaauaaguagugacuugggacagucuucaguaaaguuaaugagggcagcagcugcaugggccugcacacguugauugccuuggucuuccauggucugcagcagagcugcaaucaccugugaaaugaaaccaaaugggcacacauguugaaauguccacccuucuuccuaaagucugauuuaaguguuugaggacuuguuacuuaccuucucaugaaauuucuuuuggaaaccaggugcaaaaucuguagccaucugucccacggcauuacaggcugcauaccuuacucuuggaugcuggaaaauguucccuuucauuaguaaaagcaagaagguuuccacaugaagcuacacuaaucauuuugaaucaaauauuuacugguacuuacaggauccuggagaaaaaguaaaacaaaauuuacgaucucauuuagaauuccuuccauuugcugguggcacccuucaccaauggcagauaaggccaucaauccugcaugccgguauuuccagucagcuaccgaaaaaaauuacagauggaauagcaauuacacacuauaaacaugucauucugguagagggagauguauaaaaguucuuauuuggaaaagaguaacaaaacuuuuuugaaaaggguauauguauauauaauauaaaaacauuuguauaggccgggcgcgguggcucgcgccuguaaucccagcacuuugggagucugaggcgggcggaucacaaggucaggagaucgagaccauccugguuaacguggugaaaccccgucucuacuuaaaaauacaaaaaauuagccgggcacgguggcaggcgccuguauucccagcuacucgggaggcugaggcaggagaauggugugaacccgggggggcggagcuugcagugagccgagaucgcgccacugcacucuggucugggcgaaagagcgagacucugucucaaaaaaaaaacagaaacaaacaaacaaaaaaaacaaaaaacaaaacauuuguauauuuacuuuuuagaaaaaugaacagaaaaagugcgugacuacuugauucuaaaaguauguaucaggccaggcgcgguggcucacaccuguaaucccagcacuuugggagguugaggcggguggaucacuuaaagucaggaguucaagaccagccuggccaacauggcgaaaccccgucucuacuaaaaauacaaaaauuaggccgggugcaguggcucaugccuguaaucccagcauuuugggaggccagggugggcggaucacuugagguuaggaguuugagaccagccuggccaacauggagaaacuccaucuccacuaaaaguacaaaaauuagcuggguguggugguguaugccuguaaucccagcuacuugggaggcagagacaggagaauugcuugaaacugggaggugaacauuguagugagccaagauugcaccacugcacuccagccuguuugacagagugggauucugucucgaaauagcugggcgugguggcaugugccuguagucccagcuacucaggaggcuagggcaggagaaucgcuugaauccaguggguggaggcugcggugagcugagaucacauuacccugggcaacagagcgagauuccaccaaaaaacaaacaaauuucuaacuuaauacuucugaauuuuaauuuaacaaaagaacacauuaacuuuauaauuaaaaaacacaaaugaaaauaaaacacauacaacaauaaacuuugggauugauauauauauuacagguacaaagguaacugaaauauucauagaaauaaaaaggaaggauggccaggugugguagcucaugccuauaaucuaagcacucugggaggcugaagcaggaggacugcuugaggccaggaguuugagaccagccugggcaacauggcgaaauccugugucaacaacaacagcugcccuccagggcaggugggcuuccaccaucaccuccgucaggggcaaaaacagaaagaaagaagugguuucucuuuugauaacauuagauagaguuucuucuuuuaaaaauaaaagauauugggugaaagaagaguauaugauucaaacauucuaauauuccauaaaaauucaaauaauaacaucauuuucaaauucaaaucuaaauacuuuuggcuaggaaguaaaucuguacauuuucuuugggauugacaauuuuaucgguaaaauaaaugaauuggguuaaauauggaugauaaaaagacaaagauuaauuuuuaacagucuaaacauaucuuagaauuuaagcuuuagaaagggcacaacuucacucuucuagcauuugaaggacacagcuuacgauuuugaagcauuugcauaauguguuccuugaucaucggcagaacgagcuuuccaccaaguccgcaagccauucgaucuagagcacucucgccugcaacugcauugcuaaacacauaaacagaauuauguacucaauauaucugaaacacaaaagaaauaguauacucuacagacauacuucuaaccauauuauuauuaaacuaagacugagaaagaauucaagcugucuuuaaauguggaauugaaauuagggguuaaaaacucugcagcuuagaaaagaaaaaagaguaaauguuuuuaucaugauccaccauaguuuagaaagucaugccugauucuuauuuuucuuuuuuuuuuuugagacagagucucgcucugucacccaggcuggagcgcaguggcacgaucucggcucacugcaagcuccgccucccagcuucaugcuauucuccuaccucagccucccgaguagcugggacuacaggugcccgccaccacgccuggcuaauuuuuuuguaguuuuaguagagacgggguuucaccauguuagccaggauugucuugaucuccugacuuugugaugcgcccgccugggccucccaaaaugcuaagauuacaggcgugagccacugugcccagccugaaucuuauuuuucaagaccacccccacccgcuacuggcuaaaaacuguucucagaaauagcuucugacacuuucaacacuccaguaaaagcaguauugaaagagccucauguauuucauuuccuagaaauacagucuucaaaccuaucaaugaacagaacauagaaaacugaaaagggugcagagaauguauaaucuuccccacugugaguuuauucacccuuaaaggggugcaaacugcacugccaaaaacuaugcauagcuaugugaaacucaauucuauugucuucucugaaagccaaaggaaugugggcauaaaagcauuuggacuuauccuggcuuagaacuggaggaucaguaguguauuucaugugcauuaucuuuacuauguaaagacaauacuauaaaaaugaaacuauaaauuaucuucagaacagguuuuuagacuuaaaaaaaucucacccugaaaauauauuuaugcuguuucacaaaugagaaaaucuuauucaucuaguuuagaaaacaaaguuucuuaaacuguauaaauuuaagugccauuugcagggcaaaugaaaggacagguagcagcacauuacaguaacugaaccaaaaaggaaauucgaccuagcccuggucuucucuucagccguuaucaggugauuuccagugaaagauuacuuucauauacuucaagacaguauuaaagccagaaaucagucauuuuuaacaaugggauuaagucucaaaaaugcauauauauucuaaagccaaaaaucuuuaauuuuuacuuuuauuaaccuaguaguuuauacugacuccaagucuuucaggagaauaauuucagcuuuuuauuuuuuuugagauggagucuugcucuguugcccaggcuguagcgcaaugacgugaucucagcucacugcaaccuccaccucccagguucaagagauucuccucgcuuagcuucccgaguagcuggcauuauaggugucugccaccaggcccggcuaauuuuuguauuuuuaauagagacgggguuucaacauguuggucaggcuggucucgaacuccugaccucaggugaucugccugccucugcccaccaaagugcugggauuacaggugugagccacugcacccagccaauuucagcuuuuuuaaagaaaaggugguaguauaaugcacugggaagaaugaaaacaaugguaauuaaccccaguccauuaacuggcuacauaaccucagacaaaucacucaaucuucaaucucccuuucugcaacuguaauauaauacaccucugggacugcuaauaaaguugauuaaaguaacagagcucagaggugcuauguuucacauacauguaaggggccaucauuacuacugcacagugaauacagauuuugguugacuuuuccuguauucaugggacuuccuaagcugaaauaaauaaguacaauaguaauacucuacccaguugacucucaucuuuucaccacuggaugcugccuauccuaaaguuaaacugcuuuuuacuaggaaaauaugauguguauugcagggaauuuuguugaaacaauuauucuaagggaagucucugccuguaaaagcauuuaucacaaaaaagcugcuuuauacacguuuuaaaagauauucaaacuaaaaacaaaaacaaaaacaacaaaaaacuuggaaauaauuuagaguacgacaguuaaaaacauagauacuuggccaggugcgguggcucacgccuguaaucccagcacuuugggaggccgaggcgggcggaucaugaugucaggagaucgagacuauccuggcuaacauggugaaaucccgucucuacuaaaaauacaaaaaauuagcuggacgugguggcaggugccuguagucccagcuacucgggaggcugaggcaggagaauggcgugaaccccggaggcggagcuugcggugagccgagaucgcgccacugcacuccagccugggcgacacagcgagacuccgucucaaaaccaaacaaaaaacauagcuacuuuauuugcuguuuucaugucauacuuuuuuuuaaaaaagaaaaacuuccuuguuuguuguuguagguaucuuucaguuccugauuauaaaauacaacuuuauguauuaacuauuaaaauauuuuuaugaacuuccaagaaacauaaauuuuauuaauauaaauuauacaugaaaacuaaagaaaauacuacuuauaacaugugacacagcaauaaauacaacagcaaggcaaagugccccauauuccaggcuuaaaaguuuaccuucagguuacagggugcaauagugaagagauggaccguggagcccuagggcuuucacugccacccuggacacaauguuugauuaccugucaaaaucaucaucuucuaguucaucugcauuugcccaguccucaucuucuuccaaaucaaccaucauugcuaacaucugaggaacuaaaguaaacaauuauuucauacccgaagacugugacuuuaucuuauccauaucacuauuuauaaacaagaauuuuaagauuuuacuuugccuguaagagaacaagacaaaacaauuauuugucugugcccccaaaaccugguuuguuaaauuuuaaccuuguuauauuugcuuuuaucguuucuuuaaaaagcaacauucauuaagucaaacccuccuaugaaauucccaaauccgauuacauucuccccaucaccagagguaagaagcaacaucacaaauguuucucauuccgcaauuguuuuuucacacuugaacuacagauuuccauaucucuauacaaaauuauaguacuauuucaagauuugauuuuuuauauaauaaaugguuucauaauauauguaccucggcaauuugcuuuuuucucaacacauaaggauuucaguuuauuuaauagcauuccauuauauaaacauacuacccacugucuagcugauaaacauuuugguuguuuccaauuuuuuccuccuauaaaauuugcuuugaugagauuauuacaucuuuucuuugacaagcaugagucuaggcaugaaauuguuauuacuaucuucaaauaguacuaaaaaauuaucaaacaagucuaggcgcgguggcuuaugccuguaaucccagcacuuugggaggcugaggcaggcggaucacgaggucagaagaucgagaccauccuggcuaacauggugaaaccccaaaaacaaaaaaauuagccgggugugguggcgagcaccuguaguccuagcuacucaggaggcuuaggcaggagaauggcgugaaccugggagguggagcucgcugugagccaagaucacaccacugcacuccagccuggacgacagagcgagacucugucuaaaaaaagaaaaaaagaaaauuaccaaacaagcugcgcucugcacagcuguugcauaaacuaugugaaguuuaaguggaggucuccguuauuucacaaaaaugugugaagugcccuggggguggaauaagcguccucucaguuccacaucuuuuauuaacaauugauacugucaaacuucuggacaacuuguauuccacaauuacacuuguuuuuauugagacuuagcaggguucauuagcuauuucagaucccucuuuuacgaauuuccugacugggccugcuggugcacaccuguuaucccagcacuucgggaggcuuaggugggaggaucccuugagcccaggaguucaagaccagccugggcaacaugguaaaacccuaucucuaccaaaaaacacaaaaauuagccaggugugguagugcgugccuguagucccagcuacuugggaggcugcagugagcugagaucaugucacugcacucuagccuggaugacagagcaagaccccaucuuaaagaagaaaaaagcaaugaauuuccucuucucagccuuuguguauucucuagauaacaaaacuguugauugugugcacuguaauuauuuucuuccaguuuguggcuuauuuuuucaguucauuuaugguguaucugauuggucaaaaaauuguuuucgcauuugccaauuuggcaauguuuacaucaaugguuugugauucagucuuagaaaauuaucuacuauuaagcauuacuuguaaaauauaucuguaauauuuagcccuuaacuuuuuuaacuaguuccagcgugcaagguaauauucaggucuugaguagaccccaaauuauuauuauuauuauuauuauuuuugagacagagucuugcucuguugcccaggcugcagugcaguggcgguaucucggcucacugcaagcucugccucccgggucacgccauucuccugccucggccucccgagaagcugggacuacaggcgcccgccaccacgcccggcuaauuuuuugcauuuuuuaguagggacgggguuucacaguguuagccaggauggucuugaucuccugaccucgugauccaccugccucggccucccaaagugcugagauugcaggugugagccaccgcgcccggccuguuuuuuuaauaagcugucuagaguuggaauuuuuuuccccauagaaauaaccaguuauauucucaacucauaagugggagcugagcuaugaggaugcaaagguguaagaaugauacaacggacuuuggggacucaggggaaagggugggaggggagugagggauaaaagacuacacaauggguacaguguacacugcucccguaaugggugcaccaaaaucacagaaaucaccacuaaaccaaacaccaccuguuccccauaaaccuauuaaacaaacaaaaaaaaaaaaaacaaagaaagaaagaaugaaagaaagauaucccagaaacuuuuuuuuuuuuuuuuugagacagggucucacuccgucacccaggccggagugcaauggugcaaucuuggcucacggcagccuugaccucuugggcucaagcaauccuccaucucagccuccugaguagcuggaaccacaggcgugugccaccaugcccgacuaauuuuuguauuuuuggcagagaaaggguuucgucaugucgcccaggcuggucucaaacucagcagcucacauaauuuacccaccuuggcuuuccaaauugcuggaauuacaggccugagccaguaugccuggccccaagaacuuuugaucaauuaucuuuuuaaaaauggcuuuguucccaugugagcggaucuucuccuacacucuacccuuuguuccauccgauccauugucaacaccugcaucaucaaugcauucuaaauucacagaguugaugaaacaagaucuccacuuuauucgucaaaauugucuuggcuacuccaggcccuauguucuuucagaagaauuucaggauuguucuaucauaacccuagauuaauuugagaacugauaauuuguucuucuauuagucuuucaauauguuauucaacuuucccauaugucuuguacaucuuuugauuuauucccaguuacuauaacucaugccuauaaaauuuucuaaaugauuauuaugaauaauggaacacuuacaauaaaauguucucauaucuaaggaucuugcuuaacccuuugauuagcaguuuaucuguugagucuuuaaaacuuuuuguagacaauaaccacauagccuacaaauaagcaauauuuuuguuuucuaauucuuuuuuuugagacgaguuucgcucuuguugcccaggcuggagugcaauggcauggucugggcucacugcaaccuccaccucccggguucaagcaauucuccugccucagccucccgaguagcugggauuaccggugugcaccaccacaucuggcuaauuuuuuguauuuuuaguagaaacgggguuuuagcauguuagccaggcuggucuugaacuccugacuucaggugaucugcccgccucggccucccaaaguguugggauuacaggcaugagccacugcacccagccauuguuucuaaugcuuauaacuuauuuuuaucucuuaaugcaucagcuggggcagucaguacaacaugaacagugauaaaggagauauuuuucuuguuccugacuuaaaugggaauguuucuaaaauuccaaccacuaccucaguguaagacaaaagguagguaccacuacaaaauaaaucuggugacguauuuacccucuaaauuaaguguucaaguacucauuagcucauuaagaaauggcuaggccagaaaaugaucagguuaguucucaaguccuuaucccagcacaaugaaacuuaaaguaguauuuccauagcacaauagccauuuaaguuucugcugcaacgagggucuauaaaacaaaagcaauguaauauagugaacagagccaugacuaguguuagaccuuguucuucuaaucuuggcuucacugguaagcaagacaugcuauuuugguuuguaguucgcuacugugcaucuauauauccccgcugaauuguuuuugacucuauuaacugugcccaauauuaacauauaaaugauagagucugucacacuccacucuagaaauguuauuuuuaacaccagauuucagggugucugcaaagucuuaaaggcauaaccacaauguggggguccacgcuugcauguauugagaugcauuuucccaaauucaucugauucuaaaaggauauucauuauauucucaacaaucugagaaaucacacaacccucagcaaauuuauccaaaaauuuggccacaauacacauaaacuaucugaagaccauugacuuacuagucugugcaacaauauugguauguuuucuuaacauagcagcugcagucucagagagggugacgaucacuucaagggcaagcuggcguugcauauuguugaggcuagugucuccacacaacuacaaagaagacauauuuguauacauuuaauaauuuagauuagucccugaaaauaacaaacagaacguuuacuaacguacuuaauuuaccuuuagacuuagcuguagaguugcuuccaagugaggacgcaaauacuuuggaacaguaucugcaaucucaacgagggauuuuaggacagaaucaucauucugguagcacgagucauuuaccgccuagaaaagaugaaacagaaagucggugcugaagauucacuuuauaaugccucauuagccaaaagauuccuaagaugcugacaauagagaaauauuacuaaacuauuuuucacuaaauaauuuagcaaucuauauuaugcaaauguucuaccugcaggcacauguauaccuuccuucugauggauguuaacuagaaacauucaaaacagauuuacaucuaagucaaaaugaaaaucagugaaacuauaauaaccauuacaauacuuaaggcuaccaaggaauuacuuuuuuuuauaaccaggagucccuuuccuuuguccuuuuauuuuuucagugauaaggucucgcucugucgcccaggcuggagugugguggcacaaucauagcucacaguacccuccaacucuugugccucagacuccugaguagccaggacaacauguguggccaccacaccuggcucuucuguccuuucuuauauccaugcccuaguuuuucucauacgcauaguaaguacuagaaccuguaauacauuuaaaguguccaauauuacccauuuuauuuaucuuggauguuaagucuggucacugugguauuaaaguaugcauuuuguguuuaucauuaucuauuucagaauaacaacucuuaaaaguugugguaaacauuuuaacuuacucuaaauccagaggaagaaaaccgggauuagauuucaacaguaacuagagauuucagauaauaaacuacuaaagcaauaguauguuacaauuuauguucugucacgaaacuaucuuuucauugugauagcagggggagagaaguuucacuaaauccuuuaaauaacuuaucauguggaaaccuucaauuuuagcuccucuaaauccucucuaacucagugguucucaagaggaaugguuuucacccaggagauauuucuugauggucacacgauugaggaugggcaaaggccauggauacuaaauguccugcaccugugacacaagcacaagggacuuacaugaucuucucauuaugcauuucacauuauuacaaaucccagacauuuauaaaaaggagaaaacucuuuauaaugaucugaaccuagaaacuaacucacaaauuauuuuuugccugguuuuaacaacuguuaucccccccuccaauguaacuacuguaucaaucaagaauggauacauacagguggaacaucccaaauccaaaaugcucugaaauccucaacuuuuugaacacagacacgucacucaaaggaaaugcgcauuugaguauuucggauuucugacuugagaugcucaacugguaaguauaacacaaauacaguguuucaaaauuugaaaagauuuugagauccgaaacacuucuacucccaagcauucugaauaagagacacucaaccucuacuuugcuuuguucagaaccuuacuauuuuaggaaaucuuaucaccaauucuaaugggaacugugguguuugacuugccaauaucuuugcuauuaguccaguuuuagcuauugcauuuguacagaucacuuggaagccaccuagucuauuaugucuuccaguguagucuugucugaccauuuacauaaggagaagcaagccauuuuauuauacguuucuuugcauuucuuuuuuguauuaaggccauauauuaauauucuaaaaaauuaugcauauauauuacauuacuuaugcauuucauuuuuagaagaguacaugaaaaauuacuaaaagauugccauaaaaaaggaguuuggagucugacaagguugggaaccacuaacuuguccaaucuuuuaaauuuuaauuaauauaaaauuuuuuuccccaggagcauagauucaaguugcccugaauauaugcucuaucuugucucaucuuauuuugcuuucugauuaaagcagaaaguauucuuaaaaauuaacauccuuaacgauaaugugaauuaaccauaaacuuacauuauaauacaaacuauuacacacccuguaauuaagaguaguuucuccuuauguaaaaugggcauuaaaucucacagguuauuugguugauuuaauggaaauaaucuacaugaccauaaauucaacaauaagcauauaauugcuuacaacauuuacauuacagaaaaauuuuauaacuauaaauauuguaagagacuaaaaaugucuuucaaaggcaguaaacauaagcuuaauggagacugagauuugcauguuuuguucacugcuguaugccuagcgccagaacauaauaggcaauaugaauuuauugcauaaaugauugaaugcauuaaagaaccaaauaagauauaauuaugauuuauucuauauugcuuucauaccuguaggaaucccgguagcaagucugcaaaauguuugaacagagcaacauuaugcucauuugcaaguauaaaugcagcuguagcucuagcagauaacguccugaucuaaaaucaagaggaaaaaaugucaaacaugagaaauuuuugauaaacgcaaauucaaguuuucuuacucaagaucaaauuauucuuuaucaguaaaacugguguuuguauuuuaaaguauaaaagugaaaacaaccuccuaauauacuaauuucuuucgcaaauuagauuaaaauagaugguuauauuaauaggauugaaauuauuuaccgacggguguuccugaucuugcauacacugaacuaacauucguuugaugacaucuaaauaguguuguugcugguucccaaaaauuccaggaaaguuccuaaaagauaauccaaacauucuuuaaaaacuacauuauauuaauaucuugguaaaguaugagcuagaaucucuaaugaacuguuuguuuaccugacucaguacgcauuaauccauagguugaacaucaucuacccauucucuaagcaauccuguuuuuggguuaagugaaugaaaacauacuggagaagucugggcugggaguagaggcuacucagcagcccauucccagcuacaugcuuuuauccuuauuacucugucucagucgaaagcugaccuggagugcaggaugggacaagagcaaccacagguuuucagaugaaaacuacaagaacuaugcucuccggccaucugcauucucuaaucugaauuacugauauaaacaaagauauauaugacaacuaaaguacaaaaugauacaaagccuaaaauguguaugaucuugagcacauuuuagguguaguaaaaaaauauagcacaguggggcaaagaauaaucacuuaauucuaaacuuagacuauuugguuauaaauauacagguuucuuaacauauuauaaaauugggucacacaagacccagaaaacauaauggggauucaccugcauucuccuucuccucuucaagacaccauuauuaauguggcuuuugaaaagcuacauccaguauuguguuaaucuccaaauaaaggagaggaaacuguucaauaaaacuuucagaaucauaaaagacaaagagaaagcaagcaagcuguagagaaccuuuguguacaaaaaagaucauaaugugaaauaaaaggcccuuuuaaaaaaaauugcuuccaauacaaauacaaacaaaacuuauguaaaggcauuauuaucauuuuaaguauaagguuaaauuaggcuaaaauaaucaguuaaaagguguuuagggcauucauuaaaucaaaugucucaaaaaacuagauuaauguauauaccagaaaaugugaagggcagcuucccgcagucccacauuuugagagcugacugaaucaaaaaggaacuucaaaccuucgggccacugguuauugccauccucaucugaaaguaaagaaauccagacauaaaguuguguaagucagaacuucaauauacuaggaguaaauccuuucauuucauaagccucauucaaaccuggaguagugaaaaaugucacuuuugcuauuuuuaaaaacuccacaaaauucuguccuuuagccauaaaaauggcaucacaaucauguuaaaaaaaaaaaaagaccaaacaaaccaacaaaccaaacaacucuguauuuggguuagauaaucagauauuaacagagguucuucuuuuuuuuagauggaguuucacuuuuuuacccaggcuggagugcaauggcgcgaucucgguugacugcaaccucugccuccaggguucaagcaauucuccugccucagccucccgaguagcugggauuacaggcgccugccaccaugccugacuaauuuuuguauuuuuaguagagacgagguuuggccaugauggccaggcuggucucaaacuccugaccuugggugauccacuugccuuggccuuccaaaguacuaggauuacaggcgugagccaccgcaccuggcuggcagagguuauuucuaaggaguggaauuugaagagaaggcagcacuuuuaacuguacaaauaucugauugacugacuccuuuauauauaccauugcuauuaaagaguugaaaaaguaggcaaagcuaguauuugguggcaaggucuugaaaccaaaguaacaacuacuuuggaacuugagaagacaucaggguuagaaucucaggacccauacagggugcucacacuuugcaguuugguucaaauagugccagaggauguuauuaauauguuuacuauuuaacaagauuaagagauuuuaaauaauacuuuauaauaaaaaugagugaccacaaaaaucuacugugccacuuauaagacucugguuauauugucacaaagaccuuaagaguuauacaacuuacagaugaauuacagauguuuucuuuuuaaacgucccccgauauuugaacuuuugugaaaugacaauugugcugcuaagcugacauuaaauguuucuucaaccuaaagaugaugcuuugaggggaaauaaaauagcagcuuaaaaaaaaaaaaucuaugagagcacuuugaauacuuuggaaagguuugcauuguuaaguguuucugaaugagaaaugaugucaccuauaacaauuccuaucugcauacuuaaaacuggaaaguagaauuuucuaaacaauuuaaaaauauucaaaauuagggcugggcgcuguggcucaugccucuaaucucagcacuuugggaggccaaggugggcagaccauuugaggucaggcauuugagaccaggcuggcaaacagggugaaacccaguuggcuccaucucuacuaaaaaaauacaaaaauuagcugggcgugugggaggcugaggcaggagaaucaccuaaacuugggagguggaggcugcgguaagccaugaucacaccacuguacucaagccugggcaacagaacaaaacugucuaaaaaaauuaauuugaacucaucuaaaauauaaagaauugacacauuccccauuaguuucuaagaaaugguugacauaagaaaggauacaaucugcuagcugaauugaacaaggacuuacuguauuacugguugaugagauuuuaaaauuagugucauaauguaguaagcucaaucaauaguaaucucccauguaaccuugaucuucauuucaacuauuaaaaaugccaucuaaacaagcugcgcuuacaaccacacuuauaaaucccugucuaaaaaaaaaaaaaaagugguggcuacacucucuucuacgagcaggaaguaugaagaugagugggacaaaacccaagacaccauggaagcugucauggcccuggagaagaacuuguaccaggaaccaggcccuguuggaucuucaugcccuggguucugccugcacagauccccaucucugugacuucuuggagagccacuuccuagaugaggaagugaaacucauuaagaugggugaccacgugaccaaccuccgcaggcuaguuggcuccuauguugagcugggcaagugucucuucaaaaggcucaucaucaaacaacacuaaaagcccagugaccucugagggucccccucaauguaucagagcuucugccugacccucucccuccagccauuagguagcuuuuuaaccaagcuggagcccucucccaggcacuagaccaaauggaaauaaagcuuuuugcagcaagauaaaaaaguagcauguucaauuacauuacuauuauuuuuaguugacuaaaaaggauuuuuaccuuuaguaaaaugcauuuuuuuaugauguuugccuuuuaccucacuuaaaaaaauauuuuuugggcauuaaaaauguacauaguaggccaggcgcaguggcucaugccuguaaucccaucacuuugggaggccgagaugggcagaucaccugaggccaggaguuccagaccagccugaccaacauggagaaacccuaaaaauacaaaaaaaauuagcugggugugguggcgcaugccuguaauuccagauacuugguaggcugaggcaggaaaaucacuugaaccugggaggcggagguugcggugagccaagauugcaccacugcacuccagccuaggcaauaagagcgaaacuccgucucaaaaaaaaaaaauauauauauacauaguauagcuacguaacaguauauguauauauuugucaccacacauauacaacagcaaaagcacuggagucucugauuuuuaguucaacuggcaaguuuaauguacaaaguaggucauaccauuaauuagccugugcuucuaaaacauuauagauuuaggagaaaauguaacugccaauuuucaagcaaauuacaaaauuauuuuuccacauggauuuuuuuuuuccuuuuuuugagacauagucuugcuuuguugcccaggcuggagugcaguagcgugaucaccgcuuacuguagucuccagcuucuggggcucaggugauucucccauuucagccucccaaguaacugggacuacaggugcacaccaucacgcccacuaauuuuuuguagaaacgggguuuugccauguugcccagguucguccugaacugcuagacucaagcgaugugcccaccucggccuccuaaagugcugagauuacaggugugagccacugugccuagccucacauggguauuuugaauaccaauaggugaguccuaugacuggauuucacaaacaucuaucuguaauuucuggcucuaaaugcaaaauccauaagcacauucauuuuaaacagaauaaaugguacucagguacuuaugaaucuuacucuaaaagauuccauuaaaaaaaaaaaaaaggaaggauauacccauguucuugguaacaugagugcaccugcauacacaccuauuaaauuccuggccaguucugccgcaauaucacaaacuuuuuuccucaugcuagauuguguuuccaucugaauaaucaugaguagcucacucuugauggcagucugaacaucagagggaagugcuggauagacuucaucaaaugcagaggacaagagacgucuuaggagaacggcggccauuugucuagccuauaaacagauaacauuguuaauaacuagauucacucugccauugauguauuucacuguuguauuuuuauauuucaaaagcgccuaauuuucuaaagaaguaaauauauaacucuuucuaauuacauuagucuauuauacagacuuauuuuguuagugccacaaaauaagccauuuguacuuaaggugaggagaacuucuaaucacauuacaauucaauuaggaacacauauuuuagcaaugauaaaccugucuuuaaucccuguuuuuaacacauuauuugggagaaaaacaaaucuuaaauuguaaacccuauaaugaaugcucuuuuccuaccucucugucuggucucauucuagaauaucaagcgccuuucccacccaaccuuaggcucccagccugaccuaacuuguuacauaaccgcccuuucauuagcaucuuagauaaaaugcuucuuucaugcaaacaaacauuacgaguucccgauaccuaaaaagugcuaauccaucucaacauguguauucuuggauuuucauuuucaaaucuguguaauuaaguuuggcauuuucuguauaacauuucuugagauuaucaaaagaaaagcuaagacaaaugccauucuaaaauuuuaucaaaucaagccaauaagcuauugggaauauugaaccuaaucuuuccugcucucgauuuccccaagcugauguuacucauuaucacuauaauuacuuugggaauuugaccaaaaaaaauguuaagcuauacaaauaaaauuggcuauuuuuuuccuccauuacuuuucaccgagaaaucuuuuuacugaaacauuuaugguagguagaaaccuuuacaaauauuuaacauguucuagaaagaauucaaaaugguuacaauucuuauaaaagugguuaaaacucaugugcaauucuucucacacauauaccaaaaacuauaaagccacaaucaagaugcugucacuaauucacaacaaucaucuaauucuuaaaucuaguuaagauuuaaauaaggcuuaauacaaguuauuaaaaaaauucaguauucuuggcuuuaaaauuuguuuacuaacuugcacuaaucuucaagaauuaaaacagucaucuguuuuuagugauagaaguuacccuaggccgggcgcgguggcucacgccuguaaucccagcacuuugggaggccgaggcgggcggaucacgaggucaggagaucgagaccaucccggcuaaaacggugaaaccccgucucuacuaaaaauacaaaaaauuagccgggcguaguggcgggcgccuguagucccagcuacuugggaggcugaggcaggagaauggcgugaacccgggaggcggagcuugcagugagccgagaucccgccacugcacuccagccugggcgacagagcgagacuccgucucaaaaaaaaaaaaaaaaaaaaaaaaaaaaaaagaaguuacccuauauaggguucuucauauuugacauccauuuugaguuacagaaaagaacagguuacaaaagcaaagaaguaccucuugucaucuagaaaaaaaaaaauugggauacuuuuauauggcuuuuaaagugguugagagaacaugaaguugcuagucuaaacugacugacuggaagaagucaggugaaacauaauguaaaaguuuagugugacuuauuuccaucaaggauaagcauuuuauauacaguuugcuagcaaaaaaagucuuacacuacaaacucuaaauguaauguuuuguagguagaauaguuuucuagacuuggguauuuuuauaccuuuuccaaaguaaacagauauucaauggcauucaauauuuaugaggauauuaacuuauaaucggggggacggugggggggggggguggaauuagcuacaaaaugccucaaucaguaguaggaaacuauaaaauccuaggaaauagccuuguuuuuaccauagggaaaaguaauucuuaaaauuaaaacaaauuugaauuugguauaggaacuagguaauuagcuaaaaaccaugauucuaauaaaauauucuagaaaaugucucuguuccuaaguauaucuuuaguacauacacuucauccagagaugguuauaagcauaaauuuuuaaagaugggaaaaaaauauuuuuucaaaacauugauaacacaucaaaacacugaacuaauuuacuucuuuagaauaaauuguuucaaggaaagaaaacuuuuagcugcaaaaagcacuuaaauuaggcugggcguggcggcucaugccuguaaucccagcacuuucggaggcugaaggggguggaucacuugaggucaggaguucgagaccagccuggccaacauggcaaaaccccaucucuacuaaaaauacaaaaauuagccaggugugguggcgcacgccuguaaucccaguuacucgggaagcugaggcaggagaacugcuugaacccaggaggcagagguugcagugggccgagauggugccagugcacucaagccugggcagagugaaacuccaucucaaaaucaaucaaucaaaucaaaucacuuuaauuuaauaauucuuaugcaauuacuuauaaaaccauuaaucuucaucuacccuggacacauuaucuuaugcggaaaaaaggcaacucucauucuuaauacaaaguacuucaaaaaauuacauuauaacuccuaaguagcuuuuagcaaauaauaaguacaaaguucuaguaaagucuaugugguuaaucacaauucucauuucucuaauuucuacuaugaucaucaucuaauaacuuauuuucuaagaauguaauagucacaaauauuaagguaguaccucuucagcagcuguuguauuucugauggcuuguaagaggaaugugaucuuugacuggccugggauauucucauagguuuccu

SEQ ID NO: 19135 - RNA, 7093 nt, Homo sapiens
gcgucauaaguaucccagaccucggcuugcaguaguguuagacugaagauaaaguaagugcuguuugggcuaacaggaucuccucuugcagucugcagcccaggacgcugauuccagcagcgccuuaccgcgcagcccgaagauucacuauggugaaaaucgccuucaauaccccuaccgccgugcaaaaggaggaggcgcggcaagacguggaggcccuccugagccgcacggucagaacucagauacugaccggcaagguagcugucccagggcgggaugggggaggggugggcgaaagaaagaaggcugguagcagaggagaaaauguagcuucccugggagggccccucuugcuccucuuacgcugucucugggguuuacccggucgccucgguucugucuccuugcggcaccuucugcuuaccgcacccucugucacucugcauucccgcgugucgugccauguucugucuguuccagcucacaccagcuguccuggagggaggucagagagaguuugaggagaugcccugggacuccuugucauugucucuuggguaacguguagggaccuggggaucaaggaggggcaugucgcccaguccccaccuccaggggcgcgcauagucuccccagggacagaggggacacaggggggugagcaagaccgggagauuuaacauuucuuucuuuccuuuugguguggaugaaguucuaagacuaaaucuuucuaugaucucugaguguucguggagguggggugagcagcaaagggcacuuuuaacuccaagcaguauggguuggggcaaguggucugcuugagcgcgcgaauauuuuccguuucucucuggucauagguggcuuuaaacauuagauaaagaagcugucaaaauugagguggaucuuaaugccaguguuggguguucacugugcccuuuuacugcaagagccuuguauauuuuuagagugguauuuccuaaagaaaacacucuucucuuguaaaaauaaauuugaggauacuuuucaauuauuuuuaaauuuuuuucuuguugaacaacauccccuucccucuauuuagagaucugaagcagguccaguguuguaauuuaaacuacuagcuuugacaggaacuggggaagcucuuccccaaaauguuauccauuauuuauuuaguccuauuucuacuucuuuuaaacaccuacuauguuuucaggguucguauacuacuccucaguauaaucucaauuuuaaagggcaauaguauugucuucguguucuaugaaaucuggaaaguguuggcgcuugcagaucuguccugacuugucuuguucucuauauaguuuuaacuucuguguucaaaguggagauauaaaaaguccuuugaguuaaaugagaauccauguaguaaaaguugauuguacacacaauuugaaauguuaaugugcuuauccagcuuuuuauuauggaaacuuucaauauuaaauccugcaguaaaacuagcuuuuguguguuauacauuuuagagcucaaaaguaacacccucuugcauuguugagguuuugauuaaaugacagaggucaaauauguaauuguucuccugcuuaguuuguagguuaaacauggucagauuuuuugggaggucuaauuagaggccaguaguuaaauauagccacacaguaauccuuuuuuuuuuuuucuucaccgccaagcauuucaugacuuguagauagauucaguuaauaugcaagcaauacuucugccaggauugugggugcgaugaggaauaagcaaaacugagcauuugcacuuugauuauacuuugcuguuacguuuuggagaaaacuuaacaggauccuuaccuggccacuauaggacacugauaauaauauuugacauauuguguuguaauacauugaucagcuagcucauuagagguugagcaugacaaauaugaugucagacauaguguacaaucacuucgaaagaguuccaagagaaauuagcuaugguaauugauggcucacaccaaccuaaaguccaauaaauguaaaugaaaacaaaaaauccuuauuucuaggauguaacaucuuaugaaauugaaauucuaauacuuaggccuugcuuaauaaacuuccugaauuauugaaagaauaaaugaaauuacagugcaaacuguucuucucaugucucaguagcaagaaaaaauaaauuuauuucucuuagaauuucaaauuaagcuauuaugugacuuaugagcaaguuacuuuaucuuuaugaaacucauuuuagucaucuaaaauauaauuuuaagucuccaguucuagauuauuguacaguaauuccaaaucaaaauuuauaguucuaucuuuguagugcuaaucuuaguuuagguuuuuuuuuuuaauaaaaauaauuaaaaguuccugaaaauuacugggacacagaaaagccuucaagguuuauagaguacuaauuaguggaggguuugaacuuaaauaaauuuaguuaagaaaaugggaaucucaaauuucuuugaccuucaaagaaaaauauuuuuggaaaaauaaacauuuaacaaaugauuguccuuucaucuucugcauuaacuugaaaucuaugcauuuguuuucaccaaaugaauuuaagguuaguuagcucugauaaacauugcaguaguuguccugaaaaagagcuaaugaccuaaaagacuaaaacaauucgauuuauauacacguuugaaugauuuacucuuuaaugaucagggccuagauuugcuuacuucauuuauucaguccuugaguaacaaugcugcuuaggauguauugugacauacaaaaaugggauuagaaagauuggaguccacugcccugggaagggcacaaucaguugcuuguuugcuuuggaucuuucuuguuucaaucccgaagcaaaauauugauuuaacaaaauauuacagucacuguuaccacacagacaacuuuugugucuagcuaucgcaaaugcuacacuucaaaaucaaguguuucacccaggacguggaaaauauuucauucaugcaauacacaguuauagaauauugaucgauauuaagaaacuuuuauuucucgauuaaauuaggaacauuaaauuuauaucucucccuucaauauuuuaauuucuaaaauauggggaaaauggcauauaccuuauagaacuccuaccuuuaaaaccuaauuuucaaaaaucagcuuuuugaaaaaucaguuaauaaauuaaucaaaggauacuaauucucuuuuaaguugacaaacugauuuggaaaaaauaaugaagaaacagaaccauaucccagaaaguuagugauuauaucaguguacuaguucaaaaaguaauuacuucuguuuacugaguauaauuucuagagaucggcucuacugcauugugccuauuguuaauacuauauuauacauuuaaaaauguguuaagagucaaugucguguuaaguguucuuagcacaguaaaaaagaauaugacauugcauaaauaaaugguaauuuuaauuugauucuugaugcauguauuuugaaauaauuucauaucgauauuuggguuuagaaaugccaaauggaagguuaauauaaucagagacauuuuuuaacaucuauuagauucagaaauugucuugaaauaaauucagacuacaauuaaaaugaguuaacauuuaaaaaaauaucuuggguuucaagggagguaaauuguacacaaaaucaacuaugugucuaaaaguacaaucugguuuuguuuuugguuuugcuuuuuaauaaauaggagcuccgaguugccacccaggaaaaagagggcuccucugggagauguaugcuuacucucuuaggccuuucauucaucuuggcaggacuuauuguugguggagccugcauuuacaaguacuucaugcccaagguaauaauaauaauuauaauuauuauacuuuggauuacuacuugcuagacauuuaguagcaacuuaaaaaauucuguaguggugacuagagaaaagaagauuuagggaaaguuuucaaguugccuuucaguucauaaaauugauuugucuucauugugauaacuguagucaacaagccucggcuuaacacauaguacaaugaauugauaugagugugaaaagccauucaaauaucaugauagugauuauuagaagguuguaauuuucccuuuuugucuuuuagagcaccauuuaccguggagagaugugcuuuuuugauucugaggauccugcaaauucccuucguggaggagagccuaacuuccugccugugacugaggaggcugacauucgugaggaugacaacauugcaaucauugaugugccuguccccaguuucucugauagugacccugcagcaauuauucaugacuuugaaaaggugggcuucucauucuuauaaauauuccaggauuuuuuuucucucucucucucuuuuuuacuucauuggcagguauuaaauucauucaugaaugcacauguuuuugaggcaaagccuuuucauucuuuuguuguugaauacacauuaguugauuuugaaaggauguagccgcuuaaucuaaugguaguuggaaaauucgcaauguuaaugccuucugugucuuaccugacuuuuuuccccuaccuaacagggaaugacugcuuaccuggacuuguugcuggggaacugcuaucugaugccccucaauacuucuauuguuaugccuccaaaaaaucugguagagcucuuuggcaaacuggcgguauguauuuuggaagucaaauuuuuauauaagcauuuccaaguaauuuuacuuccuuguuuuuuaaaaaaauaaugaauuuguccaaaacauuuuauuuuauugaaauaauuuugaaauaaaaaacguugugaaccuaaaacugcucuagaaaauaaagauuauuuuuuacagucauuaucugguguaggaaaggauuuaaauaguguccuuaagaauuugggcaaaugacaugaacagacauuuuccaaaagaagacauacaugcgggccacaaacaugaacaaaagcugagcaucacugaacauuagauaaaugcaaaucaaaaucacaaugagauaccaucucacaccagucagaguggcuauuacuaaaaagucaaaaaauaacagaugcuggugagguuguggagaaaaaggaaugcuuauacaccauugguguugguguaaauuaguucagccauuauggaagaugcuguggugauuucucagaccuagacagaaauacuauuagacccagcaaucgcauuacuggguguaugcccaaagaaauauaaauaauuuuauuauaaagacacaugcacaaguauguucauugcagcaauauuuauaauagcaaagacaugguaucagccuaaauguccaucaaugauagaguggauaaagaaaaugcgauacauacacaccaugguauaguaugcagccaaaaaaaaaaaaaaaucacaaaaaaaaaacaagaucauguccuuugcagagacauggauaaagcuggaggccauuauccuuacaaacuaacacagcaacagaaaaccaaauaccguauguucucacuuaagugagagccaaaugcaaagaacacauggucacauagaggggaauaacacacacuggggccuuucagaggguggaagaugggggaagggacaggaucaggaaaaauaaccaguagguacuaggcuuaauaccugggugauuaaauaaucucuacaacaaaccccaugacacaacuuuacuuaaguaacaaacuugcacuuuuacuccugaacuucaaaguuaaaaaggaaaaagaauuucucauuucaaucuuugcuuuugauuuuuagaguggcagauaucugccucaaacuuaugugguucgagaagaccuaguugcuguggaggaaauucgugauguuaguaaccuuggcaucuuuauuuaccaacuuugcaauaacagaaaguccuuccgccuucgucgcagagaccucuugcuggguaaguaacuaauguauuccuuccuucacccuguguuacacaguggaagaaaguggagguagaauacaggaaaaaguggggaacaagucuggauauauuuucauuuccacaaaaauuucaaaagccacuuuuuuugcacauuuccuuacagguuucaacaaacgugccauugauaaaugcuggaagauuagacacuuccccaacgaauuuauuguugagaccaagaucugucaagaguaagaggcaacagauagaguguccuugguaauaagaagucagagauuuacaauaugacuuuaacauuaagguuuaugggauacucaagauauuuacucaugcauuuacucuauugcuuaugcuuuaaaaaaaggaaaaaaaaaaacuacuaaccacugcaagcucuugucaaauuuuaguuuaauuggcauugcuuguuuuuugaaacugaaauuacaugaguuucauuuuuucuuugaauuuauaggguuuagauuucugaaagcagcaugaauauaucaccuaacauccugacaauaaauuccauccguuguuuuuuuuguuuguuuguuuuuucuuuuccuuuaaguaagcucuuuauucaucuuaugguggagcaauuuuaaaauuugaaauauuuuaaauuguuuuugaacuuuuuguguaaaauauaucagaucucaacauuguugguuucuuuuguuuuucauuuuguacaacuuucuugaauuuagaaauuacaucuuugcaguucuguuaggugcucuguaauuaaccugacuuauaugugaacaauuuucaugagacagucauuuuuaacuaaugcagugauucuuucucacuacuaucuguauuguggaaugcacaaaauuguguaggugcugaaugcuguaaggaguuuagguuguaugaauucuacaacccuauaauaaauuuuacucuauacaaccacuguuucuuuuauuucaucacuugagauauagucaaugugaauaauuaauauuacuuauuuagcuuuugguguaccuguaacagaucuaaaauuaugaggccaacuuug

SEQ ID NO: 19136 - RNA, 1095 nt, Homo sapiens
ggcagcguaagcgcugccaaagccgagggagcugcagccuugccgccuccgccuccugucuccccgcccgcccucacccucgcacccgcagcgggugaggagggaccggcgccucugucugagacuggggcucccggcugcuccggcucccggcccccugagcuggagccagagcgcagccugggccgcuucagaggccgcuucgaggauaaggacgagcaguuggaagaagaagaggagcuagaggaggaagaagaggaggaggaggaggaggacaugagucacuucucguugaggcuggagggaggccggcaagacucggaggacgaggaggagcgccugauuaaucucucugagcugaccccauauaucuuguguuccauuugcaaagguuacuuaauagaugcaacuaccaucacagaauaucuuuauaccuuuuguaaaagcugcgucguaagacauuuuuacuacagcaacagauguccaaaaugcaauauagcaguacaucagacacaaccucuuuauaagguuggaccgacaguuacaagacauaguguacaaauuagugaucaaucuagaggaaagagaaaaaaagcaaaugcaugauuucuaucaagaaagaggucuagaaguaccuaaaccugcuguuccacagccagucccuucaagcaaaggaagaucuaaaaaaauccgagaaucaguguuuccuauuccaccugaacuugauaugucuuuauuacuggaguucauuggugcuaaugaaggcacgggacauuuuaagccauuggaaaagaaguuuguucgaguuucaggagaagcaacuauuggacauguagaaaaauucuucagaagaaaaaugggucuugauccagcuugucagguagauaucaucuguggugaucaccuguuggagcaguaucaaacucuaagggaaauccgacgugcaauaggugaugcagcaaugcaggauggucugcuuguccuucauuauggucuuguaguuucuccucugaagauaacuugaagauucuaggcacauuaugaggagggaaacaaaggaggcuucugcaggacugcaucucaccaaagauuucc

SEQ ID NO: 19137 - RNA, 1851 nt, Homo sapiens
caugucuaccaacgagaaugcuaauauaccaguugcccgacuuaacagauucaagaacaagugaaaagacaguacagaaaugaggugucgcagaauagaagucaaugugaagcugaggaaagcuaagaggaaugaccagaugcugaagaggagaaaugcaagcucauuuccugauguugcugcuucuccgcuggagaaaaaccgcaaaaaccagggcacuguaaauuggucuguugaugacauugucaaaggcacaaauagcaacaauauggaaagucagcuccaagcuacucaagcugccaugaaacuacuuucuagagaaaaacagccccccauaggcaacauaaucugggcugguuugauuccaaaauuuguguccuucuugggcagaacugauuguagucccauucaguuugaaucugcuugggcacucgcuaacauugcuucugggacaucagaauaaaccaaggcugugguagauggaggugccaucccagcauucauuucucuguuagcaucuccccaugcucacaucagugaacaagcuguaugggcucuaggaaacauugcaggugaugguuuaguuuuccgagacuugguuauuaaguauggugcaguugacccacucuuggcucuucuugcaguucccgauaugucaucuuuaguaugugguuacuuaugucaucuuaccuggacacuuucaauccucugcugcuacaagaauccugcaccccaguuagaugcuguugagcaaauucuuucuaccuuaguuuggcuccugcaucaugaugauccagaaguauuagcagauagcuguugggcuauuuccuaccuuacugaugguccaaauaaacgaacugacauguucuugaaaauaggaguuuugccccaacuugugaagcuucuaggagcuucugaauugccaacugugacuccugcacuaagacccauagggaauauugucacugguacagaugaagagacucagguugugaucgaugcaggagcucuugcugucuuucccaaccugcucaucaacuccaaaacuaacuuucagaaggaagguacauggacaaugucaaacaucacagcugacccucaggaugagauacagcaaguugugaaucauggauuagucccguuccucacaauguucucucuaaggcagauuuuaaagacacaaaaggaagcuguauggggccaugaccaacuauaccagugguggaacaguugaacaggcuguauaccucauucauuguggccuaauaaaaccauugaugaaucucuuaacuucaaaagauaccaagguuauucugguuauccuggaugccauuucgaacaucuuucaggcugcugagaaacuaggugaaacugagaaacuuaguauaaugauugaagaauguggaggcuuagacaaaauugaggcucuacaaaaccaugaaaaugagucuguguauaaggcuuuguuaagcuuaauugagaagaauuucuugguagaggaagaggaagaucaaaaugcugugccagaaacuaacucugaaggcuguaccuuccaaguucagaaugggacuccuggaacguuuaacuuuuagaucauguagcugagguauguauuuguuguguacuauauuugguauuuugucuuacuguuucucuacuaagaacucuuuuuaaaugugguugguuauuguagcacuuuuuacacugaaacuauacuugaacaguuccaacuguacauacuguaggaagcuuguccucugaauggguuucuuauuucuguguggaauuucuuaucuugcagcauccuauaaauaaacaauaaaguccacccuuuacuucaaaaaaaaaaaa

SEQ ID NO: 19138 - RNA, 468 nt, Homo sapiens
uuauucugacuuuaagguaacaucacauggcauacuucugaguccauucccgagauauucuguuguacuuaucucugucuguuuuauagauccgugcaaucucuggcacuaggggaucaucuggguuuggaucacauagcagugaacaaauggauaaaagaacuuuagaaaguguuaaagcaggcgaccacugugaucuuagaaugucaagaaaaaugcugccauuacuguuaauauuugggugauaaauucuuguuguaaaugcaaccuuagaugguuugaagggguagucuguaggaaaacgaauuguccaaaagaauacaccgccuugauauggucugucaugaggucccauaauuguggcuugccagugaaacauaucauccccaacuggaccugcagaacauugugcuggagggucacgggccaaaucacuaaguuccuuauuaauccguuucagcgccauag

SEQ ID NO: 19139 - RNA, 495 nt, Homo sapiens
ucaacuuuuuuuuuuuuuuuuuaacaagcacuggcaaauuuuauuaaagggaaauuuugcaugguuuauuuuucaccagucuguucuggcaugcuucuaauggugucagaaucaccuggaucaaugauagccagugugcauacucuguaguauuuuccucaugcugcgcccaguucaauauuauugccacuguagugauggacaccaguuuugaccaacauugcauaguacuccauuucugauuucuucaaaguuggacaguuguuacagagaaugaccaauuuugcuuugccuugucugaucaucuucagagucugcuuguaccccagcacaugcuucucacuuuuuauaacaaguuagagccuagaauugaucaacuccagcgacuuuuuugucuucuuugcagccaccaucuuucugccuuaggugugggauggcccccaaccaggagcugcugcuaagauggcccgggagcgagaaaggccauugucaacu

SEQ ID NO: 19140 - RNA, 495 nt, Homo sapiens
aguugacaauggccuuucucgcucccgggccaucuuagcagcagcuccugguugggggccaucccacaccuaaggcagaaagaugguggcugcaaagaagacaaaaaagucgcuggaguugaucaauucuaggcucuaacuuguuauaaaaagugagaagcaugugcugggguacaagcagacucugaagaugaucagacaaggcaaagcaaaauuggucauucucuguaacaacuguccaacuuugaagaaaucagaaauggaguacuaugcaauguuggucaaaacugguguccaucacuacaguggcaauaauauugaacugggcgcagcaugaggaaaauacuacagaguaugcacacuggcuaucauugauccaggugauucugacaccauuagaagcaugccagaacagacuggugaaaaauaaaccaugcaaaauuucccuuuaauaaaauuugccagugcuuguuaaaaaaaaaaaaaaaaaguuga

SEQ ID NO: 19141 - RNA, 1201 nt, Homo sapiens
gcugagcacaggguacuuuauugaugguauaugacaagguggggcucccuaggccccuccccucuucaaggggucuacauggaaacugugaggaggggagauucaguguggugggggacugaguguggcagggacuccccagcagugagggucucucucuuccucuugugcucuuacuggggcuggugguccaggggucuuacuccuuggaggccaugugggccaugagguccaccauccuguugcuguagccaaauucauugucauaccaggaaaugagcuugaaaaagugguuguugagggcaaugacagccccagcauugaagguggaagaguggguguugcuguugaagucggaggagaccaccuggugcucaguguagcccaggaugcccuugagggggcccuccgaugccugcuucaccaccuucuuggugucaucauauuuggcagguuuuuccagacggcaggucagguccaccacugacacggcaguggggacacagaaggccaugccagugagcuucccguucagcucagggaugaccuugcccauagccuucgcagugccaguagaggcagggaugauguucuggagagccccguggccaucacgccacaguuucccggaggggccauccacagucuucuggguggcagugauggcguggacuauggucaugaguccuuccacgauaccaaaguugucauggaugaccuuggccaggggugcuaagcaguugguggugcagaaggcacugccgacaaucuugagguuguugucauacuucucaugguucacacccaugacaaacauuggggcaucagcagagggggcagagaugaugacccuuuuggcuccccccugcaaaugaggcccagccuucuacaugguggugaagacgccaguggacuccaugacguacucagcgccagcaucgccccacuugauuuuggagggaucucgcuccuggaagauggugaugggauuuccauugaugacaagcuucccauucucagccuugacggugccauggaauuugcuauggguggagucauauuggaacauguaaaccauguaguucaggucaaugaaggggucauugauggcaacaauauccacuuuaccagaguuaaaagcagcccuggugaccaggcgcccaguacgaccaaaucuguugacuccgaccuucaccuuccc

SEQ ID NO: 19142 - RNA, 1124 nt, Homo sapiens
ccaggaagugugguuagcaagaugaauaugagagcagagauuaaccaaaaguugacagaaaccggaguaagagaacgccugaaagagcugcugagcuaaauuaauugaauguggcugaaaggaugaguugauaaagauaauguaaagauaaugauuuuaagugauauguuuuuugcuuuugcauuaagagguaauuaaagagaaaggacuagaacacguuauugucgaugacuugguggcugaaaucacuccaaaaggcagagcccuaguacuugacaguuuaaagaaggagcuccuacaaaaaaauaaaaacauuccuugcucagccugucagucuuuaagauugaccuagauuguguuguucugugguauuauuuuugaaaguaauaucugccauaaauuagaaaaccauucccaaaauaaaauucauuuuuuagccgggcaugguggcucacgccuguaaucccagcacuuugggaggccaaggcaggcggaucaccugaggucaggaguucaagaccaacauggagaaaccccgucucuaauaaaaauacaaaaaauuagccgggcguggugaugcaugccuguaaucccagcuacucgggaggcugaggcaggagaauugcuugaaccugggaggcaaagguugcagugagccgagaucgcaccauugcacucuagccugggcaacaagagugaaacuccaucucaaaauaaaauaaaaauuuuaaaaaucuuuuuuuugagacagaaucucacuuuguugcccaggcuggagugcaguggcgugaucucggcucacugcaaccugggccucccagguucaggagauucuugugucucagccucccagguagcugggccuacaggugcacaucaccacgcccagcuaauuuuuguauuuuaauagaguugggguuucccuauguuggccaggcuuaucucgaacuccuagccuuaauugaccugcccaccucggcccccgaaggugcugggauaauaaugagccaccaugccuggccaaaaucccuuuuuguaugaugauauaugguuuucaguagugaugucuauguuguauugauuuuuucccccaaauguguuauuuuaauaaauaucucaugaau

SEQ ID NO: 19143 - RNA, 1289 nt, Homo sapiens
uuuuuuuggcugagcacaggguacuuuauugaugguauaugacaagguggggcucccuaggccccuccccucuucaaggggucuacauggaaacugugaggaggggagauucaguguggugggggacugaguguggcagggacuccccagcagugagggucucucucuuccucuugugcucuuacuggggcuggugguccaggggucuuacuccuuggaggccaugugggccaugagguccaccauccuguugcuguagccaaauucauugucauaccaggaaaugagcuugaaaaagugguuguugagggcaaugacagccccagcauugaagguggaagaguggguguugcuguugaagucggaggagaccaccuggugcucaguguagcccaggaugcccuugagggggcccuccgaugccugcuucaccaccuucuuggugucaucauauuuggcagguuuuuccagacggcaggucagguccaccacugacacggcaguggggacacagaaggccaugccagugagcuucccguucagcucagggaugaccuugcccauagccuucgcagugccaguagaggcagggaugauguucuggagagccccguggccaucacgccacaguuucccggaggggccauccacagucuucuggguggcagugauggcguggacuauggucaugaguccuuccacgauaccaaaguugucauggaugaccuuggccaggggugcuaagcaguugguggugcagaaggcacugccgacaaucuugagguuguugucauacuucucaugguucacacccaugacaaacauuggggcaucagcagagggggcagagaugaugacccuuuuggcuccccccugcaaaugaggcccagccuucuacaugguggugaagacgccaguggacuccaugacguacucagcgccagcaucgccccacuugauuuuggagggaucucgcuccuggaagauggugaugggauuuccauugaugacaagcuucccauucucagccuugacggugccauggaauuugcuauggguggagucauauuggaacauguaaaccauguaguucaggucaaugaaggggucauugauggcaacaauauccacuuuaccagaguuaaaagcagcccuggugaccaggcgcccaguacgaccaaaucuguugacuccgaccuucaccuuccccauggugucucagggaugugguuuggcugacgaugcaaaagaagaugcggcugacuguagaacaggaggagcagagagcc

SEQ ID NO: 19144 - RNA, 2801 nt, Homo sapiens
uuuuuuuauuuuuuuuauuuuuuuuuuuuuaucugugaaaaacauuuauucugagaaucuaaaaucuggacaaaguacuggacuuuagaaaaagccuacacaaaauugucucauucuucccuaauacauuaauaaucuaagaauaaggaggugaaaaaaaacccuuuaaaaauaacauugcuccaguuugucugcagguaugugauuuaaaauaucccuguuuuauugagguauaggcugcaaacuuugguaaaauuagaaaaauuaacaaacccuuucaaaaaaaaaauacaaaaacaaaaacaaccaaacccuaacguuauaucuuucuugguacauauacaguaacuacaaaaaaauucauuuagaaaauguguucauuaagagaaaaaaaaauuaaaaaaaaaacccucuuguaaguucucacuugcugaguuaaaaaaauugaauguaaaugaucuauaaggcucaaacgguucccaagcacccauccggugucaggaagaacuggaugaccgcaguuucuagaaucugguugacauuuucaauaauucagugcuaacaacaaagacugucgucuuuagaaagaaggaacgaaucaaaggcacuugcacgugacuucaugugcuggcguccguccguggccgccuucgucggacagcgucagccacacgccuggccccacguggagcggaguccccuugaggccauuucugcguggccccaacucccugcucucgugggcagaggacuuuucacgcggaucucagacgcuaagcagucuggugggggauggcuuugaggcaaagguuugaacuaggcccgagauguuuccucuuuuccuugcaacaacuucaacagacagcugagccacgccaugccacgggcugccacgggccaccacggggaaccaugucacuggacuuuagaugacaaaaugcugucaggaagaugcuugcucugaccuugggggccagaacccgagagaaggacugauccugucgccuucuuaaagaguugguggcagcaacuucugagaacuugacaccagaaacaucaacagccuccacaccacguaguuucugauuccaucuuuaaaaaaucuuguguuguuuugucgagaaauugcaggcuuuuauguuuucaaagaacuaaacacaauacugagaaguccaacuuuuagccagaauacauaaauuccugaaaauguauagauuugaaaaauaaaaauaaaaaaaaaaaaaggaagacaaaccuuuuuagggaacggaggaaacacuaccuguuuaaguuaagcccacuaagaacaaaaucagugccgaugaacgagcccuccgacacguuuucagcaaaacgccugucgagaagugcuuggagaucaccggccauugccguagccggggaagagcugguugaggacggucugcagaggcugguucaccugcauggcauagcugcggcccaggucguagcggcaggcagggcagcugaacaccugugcccgaaaggaucuguccaggcaguccuugcacacguugugcuggcacacggucgugaugggccggaacaccagcuccugacagcagauacacuggaacgucuccuccacuuuacucaggaacaacuggaacgggcugccgcucgccggccgguccuugagugacgccaggaccucauuccacagcuuggcguugcucuuguccucucugaugaggcugcucugcugggccgugagacuguagggcuccaccuugguuuucuuggauguccggcgcggggacccggcccugcucgggccaccuccugccgacuuccgcuuccacuugcccuugcccguccugggggacgcgaagccccccuccugcugcuccuccuccucccucuugcuguucuccuucucucgcucucgguuggccagggcuuccagguagccuucuggauacugcauggucagccccagcuucuugauccgguccuuccccuccuucguccaagggccgggcucaucaucgucccuccgcagaagguagcgccacacgagaaacccggacuuccccuucucgggccaguauuucacaaccuuguagaugccaucguagcgguugcccucagcgggggcguacuugcuauucuugccacccuugacauugcgcaccacccugaccggcuuccccgaccgccaguccuuggccucggccccuucuuggucauugaugggagcaaagcaguugagagccagcgcccuguugguguuggugaguuucugaucacaagacuguuccgcgguccucuuguugccggaaagcucucgaccaccacuacccguguaugugaaaaaauucccaugguccacgucauccucguagccccccgccaggacuagggaguacgcuccgucguugcuccggccauggaugccagccacguggggccgauggacacccgacucgcugaccuggacucggaaccgccacauggugcccacggggauccccgggauggguccguagugguuggacgggaugaugguacauuccuuggugcggcccacacaggccaugcccuugucccagucccgcugugaggacgauguggccgaggccaucuucgccuucuucuugcucucucucagccgcucucccgccaguaccaccucgcuggcaucauuccggcacucagggcaguaccacucguccucgcugggaacacugcugaggggcggguccaggcaguagauguggaaggccaugucgcacucaucgcacaugagcugcuugucgggguccugccggcccccgcac

SEQ ID NO: 19145 - RNA, 18157 nt, Homo sapiens
gaccaguuuggacaacauauaaaaucagauguacacuugaauuuuuauguuuauuaugguccugaucguauuagagaaccggccuuacuuucaaaacaggauauuguuuugacuacguauaauauuuuaacucaugacuauggaguaaguauuguugauacuuaacagaucuuuuaaagauugaauguaagaaauaugccacagguuucuagaguguuccaaaauucaggcuuuauacuuuuuuuuucucuuuagauacuuaacgauauauagaaaaauaaaugguuuuuuuuuuugacuuuuugcgugaaaggguugcauuuuauuuagaugcuaauuuaggaguauuuuucuuuucuccacuccuccccucccccucccucucgauggaguuuugcucuuguugcccaggcuggaauauaauggugugaucucagcucacugcaaccucugccuccugguuucagaugauucuccugccucagccucccaaguagcugggauuacaggcaugcaucaccacacucagcuaauuuuuguuauucagcagagaugagguuucaccaucuuggucaggcuggucuugaacuccugaccucaggugauccacccaccuuggccucccaaagugcugggauuacaggcgugugccaccacacccagacaggaauauuuuucauuuagaacauuuuaaguuaagauuuuaaauuuggauuguaaguauaugaagcaauuuguaaaugaauuuuauuuucuuuuuuaauauucuggaaaauuguuuucuaucacaaugauuugauuaauaucucaguuugaagguaugcuuuuuuuguaguuacaguucauaaguuuuccaguuagucuaauuguuuuuuaccuuuauaauuccaauuguucaaaaguuaaaacuuuuugaaaaauaccuugcuaucaaaauuucagucuucuaguaaaaauauuaccuuuuauauaaaagaaaguaauguugaauucaaguaauucuuacaacugccauuuucuauaucauugcuauguuuuaauccgagguagaacaguucaguguauugaccagugacucaacagagagcuagacugcugcuuggguuugaaugcuaguucugccaccuguggugcuuuggguaacauacuuacuuagcaguuugugcuucaguuuucuuaucuguaaaauuaggugugcuaauaaguacuuauuuuauaaacuugugaguauucaauaauuaauguagugcuuaaagcaguaccuagcacauaguaaauuugauauuaaauaaugauaacaacuaguuagcaaaucauauuaaguacuauuuuacuuuccuguguuuuuuaauucauauaaaacauuuauuucagacuaaaggagauaguccauuacauagcauaagguggcuaagagugauccuggaugaaggacaugccauacgaaauccaaaugcucagcagacaaaagcuguacuugacuuagaaucagaaagaagauggguuuugacagguaaucauagcauuaaacuuacuaaaaccuuaaaucucuaaaauauaucauuauguaaguuaguaaaguaacuuuguaaacuuaaaguggguguaaauucugccccaaaauuaaucauauaaauaauuuaaucaaauguuuugaguuguucuucauaauugcccgugauauaacaacauuugacuuauugauaauuuauggaacagucacuagacuuauucuugaaccuuggaaauggaguagacacucuaguggaaauggaguagacacucuagucauccagucauaaucuugauuucuguuucccauccucaaaccuguuugccauucacaguaccuuuacuagaagguaaggaaaagaauguaaacuuaaacuaguugcuuuuuccuucugcuagugcugcugcuuuaaaaacuaaauaagcagauguacuugauaaggagaaaguugaauuuuccagucuuuuucuuggcuagugugucaugugagagcuaaaaauuagagcaaaacuguaucuugagauguguauauuuuuaauaaaugauuauagucaacacuugauaguuuaauuuaauugauaaugaugagccugguacagagugcccauuuucaauuguugucuucucugauugggccaaauagauacucuuacuggauacucugguuaaagaguuauaacaguuuccuguuauuucuagguacuccaauccagaauucuuuaaaggacuuguggucucuucuuuccuuuuuaaaacuuaaaccauuuauugauagagaaugguggcauagaacaauacagcguccugucacaaugggagaugaaggaggacuuagguaaguacuuucagacagugauuaauauuaguuacaaauaacuguuaguagcuugaaccaguuggcacuuucuuuacuauuuuaacuugacucuuaacuuuuccuucuaaaaaguguuuauggcucaguaccuuugucuuucagaaccuagugaugcuuguuuggaaagacaaagauuucuaauugucgauaacuacccuuccccuguuguggcuaaacugaaaggaaagacauaacuguuuuuuguguguugcuaagccccaaagccccaaaaccagcauuaacagauuuagcaggaaacaucguauauccuuugaggaucuaauaugcauuaaguuuucauaucuuauauagcuuuauuuauuuauuuauguauuuauuuauuugagauggagucuugcucugucguccaugcuggagggcaguggcgcgaucuuggcucacugcaaccuccgccuccuggguucaagcgauucuccugucucagccucccaaguagcugagauuacaggucugcgccagcaugccccgcuaauuuuuguauuuuuaguagagaugggguuucgccauguuggccaggcuagucucaaacuucugaccucagguuauccucuugccucgaccucccaaagugcugggauuacaggcaugagcuaccacaccuggccuuacauagcuuuauauagugaaugaugugagguaccaugaccuuagcaaaaguuguauaggaaaguuuuaugugguuguuucugguggagauagauaaaaguugagaacauaaauuaaaacucagugauagccauuuugcaagauguaaugugguucaacuuuuuggcuaaagcaccgguuuauagacugaagauuugagagcuauuagugggauauaaaaucauuauaaaggugguagccagcauuuaaaaagacaaugaaauagagaagagauuaguaaauaucggagugcaugauacauaguaaguauuauuuugugaaauauuuguuucuuuuguauguguuuguauauuuuugcuggauagaauguguuucuuacugugaguuauagugagaaagcuucaagagccacuaaccuaguuggcaguacuauccacuugauuccucaaaaccaacuauuuaaacuccaggaaauuguauuuauauuucaauguugggaaaaaacaagaauugauacaucucuuuuuuuccaguacugagaaagaaauguaaagauuguggaaccuguaaagcauuuuucuguguucugaauuaccauauuaucuuuuuauuuugggggcacucauuacuuuauacaauuacuuauuuauauacuuuugauuuuaauauuacagaauguaguaucuuacccauauuuguauucuuacaacauuuaauucagugccuggcacuuaauagauacuuagaauuugaguguugacuauucggugauggaguugacaggacaguugagaaguaaaagaguuagugauuggaacaaaaauggggaacagaacuuacgaaaauaaggacaggauauaaaaagauuaaacuauguuagguauugaggggaaauuuccauacauuuguuuuaauaauuuuauuuuuguagaauacuucugugauuaucagauugguuaaaaucccaaauaagggauuuuaaaaacacuuuuacagaagcuauaaaacaguaacaaauuaaaauguucuguuucguucuucuuggaucaauuuauguagaaauuaaaaguuacauaauuauuuguuuuauucugauuaggcguuuacagucccuaauuaaaaauauuacacuuagaagaacaaagacaagcaaaauuaaaggaaaaccuguuuuggaguuaccagaacguaaaguauuuauucagcacauuacacuuucagaugaagagagaaagauuuaucagucugugaaaaaugaaggcagagccacuauuggaagguauggagaaagaaaaccauguuaaaaauuaguuuuuguuuacuuuguuucccauucacugaaugacauuauuuagauguguuagcaauaguuugaaguauacugaaagauaauuugcuucuaugaauuacaguguuuuuuacaaaucaauaaagugaaugaaauaauaguauaauucaccagguaaguaauuuuuuaaguuaggaaauaauuuaaagcuuacuuuaaaugacaaguucucaauugcuagccagaagauuuugcuugcuucuauuuccaaaaucguauggaaaucuggaaauaggaacugaugaaauagguuuaacaagaagauuaaggauugguagaagguaugaaauucugguccaagcaagaucagguuuaaugugagcccacagggaacagaaugaauaagagacaagugaaagcagaauaggacugugaaaggggaaucuucaaaacauaaaaacuucagugagguagguacaaagcagguuugauaggaauuagagagagugggaaagauuguucuaagcagcagauuucugaguucaaaaucuucuuucuuuucauauucuuucaacaaaaauuuauuaagugcccacugugugccaggcacuuauacccauugggauacagcagaauaaaacagacaaaaaugccugcacucgaggaauuuauauuuuaaugggaagaaacagauaauuuaaaaacaugauuaaguuuuaaggaauaaagcaacgaaaggggauggggaaugccaaagcuguuuuaguaggguauuaaggaagaccucacugagaagaugauauauagguaaagaucuaaaggagauugggauuaagggguguuucagccagaaggaagagcaaguguagaugcucccaguugggaacaugccuggugagcuugaagaauaacagagaagcaaguguggcuggauaguaugaacgagagaaaauagucaugauaucagagauuuauuggaauggggguauguaacgcauaugucaaggacuuuggcuuuuacuuuuuaugacaggaaaccuuaaaggguuuugagccaggagagggacguaaucugauuuauauuuuuaaaagaucacucuggcugcugugcucagauuuagguuauuugaauaggaauaaggucagaaguagggagaccaguggcagucaaagcaagagaugauggugguuuuuaccauaguagugauaaagggagugagaaaugauuagauucuguuaaauugugaacguagaaccaacagaacuugcugguugauauguuauggcaugugaaagaggaaucaaagauaacuucaagccuuuuuaccugcauaaguggaaggcuggaauugcuguuuaccaagacaggucuaugggaagagcagagauuuuuuuaagcuaagaucagaagcucaguuuuggacacauugaucauaggaugcccgugaauuuuccaaguagagauaucaaauaauuaguuggauaggagagucgaguucaaagucagcuauguguggaugguaauuaaagccaugagaucaccaagggagugaguaaagugaaagagaucuaacugugaagauagcaauggcuggugaaauaggaggaaggaagcuucuaauauuuagcacaugguaggcacucaaaagagaucucuuaaauugaaaugcugaguaucaguaagauaugaccaugccagggaauaauuaguguuaguaaagguuauucuauuugaaaaaguugaaaaagauuaacuuuauugaaacuguucucagaaaauaaguuauuuuuaaaguauucuuuuuaauaggcuauauauuuacuaacauuuauuuagcacucacuagguguuauacauugaucuuagugcuuuaaauguauucacagcaauccuauuaggucaguauaauuauccacaucuuauaagugaggaaacugaggcacagagcaguuuaggugacuuacacuguugucacacagcuagugagugacaggacagauuaacucuggcacuuugguuuagagcuuguaaguuuaaucuuuguauuauuuugccuauuccuugcauucuugaauauucagaaauguuuguugccauaauacuaccaguacuaauacuagcaacagauucauguauagcacuuaauauaguccaggcacuauuuuaaauacuuuacauguauuaaauuaaauaacaguaguuguaugagguagguacuuuuacaaugccacuguuagaacugaggaagcucaagacauagguuaagcaaccuguccaagguuacauaauuaaauuggcacagccagguuuugaauucaugaccagcuagcucuaaaaauuuguacucuuagccguuaggcuauauuucuucuguugccuuaaaauacuuaaauaucagauggccugguuauauaauuuuuggaucacccauuuccuuaagaaucuauguugucauuguaccacuguauuuuguauagaauguuucuguggggaagccugguuuuuuuuuuuuuuuuuuuuuucccucugaaguucagcaacuucuuuguugacuuuccccugggacaugugauauuauuuaaaucuuuagauuccaggcuuuuccccccuucucuuuccuggaaagcuuucuuuaaauauuguuuucuguuccauuauuuuauuucucucuguguauguuagaugucuuuuaucuguguuccauagguaucauuuuauuucugaucuuuuacauuuuuuuguuuaauuuugauuuucucaguccuguuuccuacauccuuuucuauguuuuuaucagugacuagucuuuuuuuauauuggcuuauauugguuucagugugacuuucauuucucugaugauucacuguuuucuuucacuuucuugagccauaccagcucaucuuucaucucuuccuguucucuugccauauuuuuucaaagcucuuugucuuugcuuuaagauuuuuuuuuuuuggaggaauuguuuuauugagugguguuaaauugugacaguauccuuggucauaauuuuuauuugcucuguggcaacauuuuucugcugaguuuucuuucacugccauguguccccuaccuuugcucucugcugauuauuacuuauauuugaauaucuugaguucuucuuggacuagcuauuugcuaguccagauauacaaaagggaaaggucacaaucauguccccgaccagcaggaaauaacccaauuuacuuaagacucaggguuacauguugaguuacuuuagguuuuauuaguacacauaaacagagaucagaaacuuuaggggugcuuggaguguagagugcugugcccauagucuuuuuuugaaaauacagugcaccuguauguuucuguauucaguuuaccuucccucuuuuuuugauauaaauuucuccauggaagcucaagucaccaagcaugcacccuguuccuguuucugcacaugagagguauugauuuuccccucagggcaugccauccauuuuaaagaauuguguuuuggcagcucuguuugagaucugcagucaucccucucagcaucuuccuaucugacuuagacugcaauuggcagccauuucucauauauugugccuuauuguuauagaucucucuugguuuuauuagaguugcuuuucugcuuuucauucuuguuuuggaguaauuucuagagaagaaaagaaaaaugccauuuuacucugcuguuuuagaauaggaaguuauuauuguuuagcggacuuaauaauauuugacauuuuaaucucuagguauuuuaaugaagggacuguccuggcacauuaugcagauguccugggucuuuugcuuagacugcggcaaauuuguugccauacuuaccuucuuacaaaugcagugucuuccaauggccccucagguagguaaauuugauugcuucauaucauuguauuugucagagauacuuaaauaagagugauaaauuuuuuuuauguggcauacauuuaguuuauuuuguucugucaaauggagauugcuuuuagugugagacucagcuaggaauacauccaauaauuuuuuuaccaaugaaauggaauuauaaugaggucuuuccaggaauuccggugauagauacccuuugaugaaagauucauauuggaucugccuuuuauuguguggugguauguuauugucauguuauaaugaugcuucucuaugagguauauuaugugaguuggcuacuauuuuggcuucugaauguuucuuaaauuucaaauuuaaauuaugcuuuuugccuauggcagaaaaugaugagagacuuucccuacuggcaagcgaaacuuuuccuuauaagauagauuaacuugucauauuacaaaccuugcucugaaauuaauuuuucagccuuuucucuaggaaaugauacaccugaagaacugagaaagaaguuaauaaggaagaugaaguuaauucugagcucagguucagaugaggaaugugcaauuugccuggauucuuuaacaguuccugugauaacacauugugcacauguauuuuguaaacccuguauuugccaagucauucagaaugagcagguuaguuuuuugcucaguacagguucaguguuugauagaguaguguaccugucuuuaauauaauaaaagauaguauauggaguuuugcacuuggauuuaauaauauaccuuugauaguuaauuauuccaguauuuuaauaggugauauauuucuucuaaugcaacauuugcaacauaaaaagauguucacagucaauaucuuaauuccgcuguuuauaucauugcuguucaauaaauggauugauaaugugagacacaaagauaauuuucaguuuucuaguagucauacucuuaaguaaaaagaaacauuaagcuaauuuuaauacauuuguauuuaacccaauauaucuaaaauauaaaaaguauuaaugugcuuuuuacaaaaaacuaaaucuucagaauuugguggugguguauacuuacagcacaccucaauuuggcuuagccacauuucaaggacguaauugccccaugugauuauuggcuauuguguuggauaagguaggucuagauucuuuugugugguagaauuuuuuugaaguugacuagucuguuaagcagucauucagcugggguagaauuuuuuuaaacauuuuaaauugauauauaacauauguagaaaaaauguauaaauucauaauuaaauagcucagucaauuaugagguaaacauauuccuguaucugcugccuagguccccuuguggccccucccaaccauuuacccucucccucuuccccaaaaguaaccccacuguauugacuuuuaaauaauuuuagcuucagaauuauuuaauuguaaugguguuuuauauauaguuauuuaagauauaaucuuauuuuauuaacagguucaaacggguacaacagauguugcuuuggaaugaacuugauaggauuuaacagauccuaguagcuuuauaagcuauuauaagcuuuauaagcuuaauagcuuuauaagccauuaagauggauuuuuuuuuaaagaauaguacuaaauaguguagcuguauuguauuuagguucaauaaauuguuauucauagauuuuuuuuuuaaacuugcuuacaauguuauaauuuuugguuucuugcucuugcuucuagcuaguccagaucacauacuuuugcucccuccuuuauccguucuacuuaccacauuaugucuggaguucagcauguucagaugucucuuaaauggaugaaauccauuaaaagguuuaauaaaauguuagcuaugagagauacagauuuuagcauacauuuaaaaauuuuuaggcauauuuauauuuguucuucuguuaaguguugcucauacuucguucuuucuuauauagccacaugcuaaaugcccuuuaugcagaaaugauauacaugaagauaauuuauuagaauguccuccagaagaauuagcacgugacagugagaaaaagucugauauggaauggacauccaguucaaagguaaaguacucaugugcaaauauuugaguauuuguuuuaccuuuauauaaggaaauauacacaguauaucaaaaucguaauucugcuuucauuccugucauuuuaguguucuguuguugaccacuggcuuuuuauuuuuaguggugaauuugaggggaaauggaauggguucagauuauuagaguguucuuucagucuuaauuuuuuguuuuaaaugaguagucuuuugcauuuuagggaaauaacauuucaggaccuuuucuuuaugauaaaaacuuuuagacuaauuuuacugauuuaaaauggaaucuaauggacaucuuaauauuuuuugcagauuaaugcgcuaaugcacgcauugacugacuuaagaaagaagaaucccaacauaaaaaguuugguuguuucucaguuuacaacauuccugucuuuaauagaaauaccacuuaaguaaguuccacaguguuuuucacuuucaguaaaaggauuuuauauaaucauauugauuuggauagcaaaaaaaaaaacuuaauuuguuuugccaguuuuagucauuuuaucugaaagauauucagagucacaauagagaauacuuccuggcagcacaagaauuuaaagauuaaguccugaauuuaucagaaaaugacugacucagugccuagcauauuaauaaguguucaauaaacauuuguuaaaauaaaugagugaaagaauuuauugaagagauuuguaguuacuuaacuuuguuuuauuuuuauaauaauaguguuuguuacuugucucuuuucuuccccccuuuagagccucuggauuuguguuuacucguuuggaugguuccauggcccaaaagaaaagaguugaaucaauucaguguuuucaaaacacugaagcaggaucuccaacuauaaugcuucuguccuuaaaagcagguggaguugguuugaaucugucugcagcuucucgaguguuuuuaauggauccaguaaguaguucuguaaauuuuuucagaaucuuaguacuucuuucaaaaaaauaagacaaaaaacuauuugguaaauaccuucauaguuauaauuaacugugaaaauucuuaggcaaacuuuagaaauaaauaacaaaaacuuaguaaauguggauuaagagcuuucucuuaagcacuuuacugaaauccucacaacauccuuaugagguagauaccauuauuaaaugcucuguuuuggccaggugcuguggcacaugccuguaaucccagcacuuugggaggccaaggugaauggauugccugagcucaggaguuugagagcagccuaggcaacauggcaaaaccccaucucuacaaaaaaaaguaccagaaaaguuacucugguguagugguuugugcuuguagucccagcuacuugcagggcuaagucggaaagauugauugcuugggcccaggagguugaaguuucagugagccaugcuccugucacugcacuccagccugggugacagagcaagaacccgucucugaaagaaaaaaaagaaaaaaaaugcucuguuuuacugaagaggcaacugaagcacagaaaaguaaauaaugugcccaguaucauacaguuaguaauaggcaaaaccagaaucauaguccauguaaauauuuaaguacuauuaugcuaugcuauucuacuuuucuucuauaauaaauauuaacuguaaugcuuuuuaggguagugguucauucagccagcaaauaaugagauccugcuuugcgucaguuuuuauaggcacugggaaucuaacuauaaacaagauagacaaaaugauuaccaucacgguucuaguagucuuaagcuuuaaugugcauaagaauuagguaaaaugcaauuuccuuugcauucaacguagagacuuaggaguucuaggauuagacccaggaagcugcauuuuuagcauauaucauaggugauugagguacagguggucuaggaucacaauuugagaaacaaauuaucauuaauggaauguucugaguacguuuuaaugccuaauauagugcagucaguugugguuguguaguacaggcaugaagguagaacagaggcuaaaauucacuuugaacuuuacucaccaagcugugugaccuggacgugcauucacauaggagcguguuuuucuacguguacaaaggggcuguuuggccugagaggaccuuggacuaauucaguuucuaauuugcacuggguacuaugugggcuaaaggcaacccucugcuguuucugugcauucagacuuaagauuugugguuguaacuuguuaccugaaacucagaagauuuuuaacauguaggaauucuacugagauacauguaggaauacuacugagauauaaauuuuaguuacuugggugaggcuaccuuguugaugcauauauguuuacucaggcuuccuuuuuccucccucaacugacgguauccuucucaguaagauuauaacuagggucaucauacuuaggccuucaugggugaauaucauggauaugguauggucuguuguauuuucuuuuuucuuuuuuuuuuuuuuuugagacagagucuugcucugucgcccaugcuggagugugguggcacaaucuuggcucacugcaaccuccaccuccuggguucaagcgguucacugccucagccuccugaguagcugggauuacaggcaccugccaccacgcguggcuaauuuuugcauuuuuaguagagacgggguuuuaccauguuggccaggcuggucuugaacuccugaccucaugauccaccugccucagccucccaaagugcugggauuacaggcaugagccaccgcgcccagccggucuguuguauuuucuugccuuuguacuguggaugaaguuugaaaucuuuguuugcaguauuuuauggcuacuauaaaaaauauuuguaacuauagauuguugaauauuaauuaauccagugauaauucuagaagcugauuuuuagaacaaaucccaaauuuuauuuuucuugcuuauaaucuuaguaccaaagagguuaauaccaaaauaauuaguaugaaaaaguugaucagagacuaaacguguuaacaguuuuuaaaaauuuacagaacguuuuagcaguuuuauaguaaguugaguguucuucauugaacauaucaagcuuuccaauguuguuucuaacuuaaaagucagguccgagaaacauaaugauucaauaaaaaaauaaaaauuugcucaugaaagucuuuuaccauuaaauuuuuuuuucuuuuuuuaagagacagggucuuccucuuuugcccaggcuggucucaaacuccugagcucaagcaauccucccucagccucuugaguagcugggauuacaggcauauggcacugugcccagcuuucuuuuaccuuuucauugaacauuguauaaguauugggguaauauggccuggcgcggaggcucaugccuguaaucccagcacuuugugggaggccgaggugggcggaucaugaggucaagagauugagaccaucuuggccaacauggugaaaccccgucucuacuaaaaauacaaaaauuagcggggcaugguggcaagcgccuguaaucccagcuacuugggaggcugaggcaggagaaucgcuugaacccaggagguggagguugcacugagcugagaucgugccacugcacuccagccuggugacagagcgagacuccaucucaaaaaaaaaaccucauaguuuuaauuuaaaauuuaaugauccuuauccaaacaauucaugauacuauuuaaaaaccacuuaccaggggucuauaucuuuuugguuauucuucccuuuucauuguugcaccauuuuauugcuguuguuguguuuuuuguuuuuuguuuuuuuuugagauguagucucgcucugucgcccaggcuggagugcaguggcgcgaucucggcucacugccagcuccgccuccuggguucacgccauucuccugccucagccucccgaguagcugggacuacaggcgccugccaccacgcccggcuaauuuuuuguauuuuuaguagagaugggguuucaccguguuagccaggauggucucgaucuccugaacucgugaucugccugccucggccucccaaagugcugggauuacaggcgugagccacugugccggacccaucauuuuauuuuuuagcuuaaaacaguucucaugaucaugucuguguuaauuagcuaaugguacuuuuuuuagcucagcuuuaaagucaaacuaacgucaaauacugauacagaaaauagcaucaacaaaaaaauaauuuuuaggacuuacugacucuuaaaacccccuuuuuuuuuuuuuuuuuuuuuuuuuuugagacggagucucgcugucgcccagucuggagugcaguggcgcgaucucggcucacugcaggcuccgccucccgggguucaggccauucuccugccucagccuccugaguagcugggacuacaggcgcccgccaccucucccggcuaauuuuuucuauuuuuaguagagacgggguuucacuguguuagccaggagaaacccuuuuuuuauacuuuuauuucaugaacagaggaaagugaaagaaaaccagaaaagggggagaaaacuaaauaggcccaagaauugugucuuuucucauauaaauuaagucauuuaagaggauguauaaccuuuuucugcuguuaagcacacauagauucuuuuaaaaaugaaaaaaaaaaccaaauugauuaaucaacaaauacuuauuuugggugcugauacauaugucggggccuguauuagguauuagaaguaguaguagggggaggaugccuaucaucauagugauugggaggguggauuuuuccccagaguauuugugauguuaguaucugacuucaggcagaaaacuuucagucagaaaaagaugaaugaauacuagugaaaugaaaggacaaaugcaaaacacugaaagaucagggcaguaguaaaguaacucauccauguucuuguuaggccuggaauccugcugcugaagaucagugcuuugacagaugccauagacuuggucagaagcaagaaguuaucaucacaaaagugaguuuuuaaacaaacuauuuuaagacuagguugauacgauuuuuacaauuaagcaaguaaugcaugaauauauuauuaugauugaguguaauuaugcagagcaaaauauaagucaccuuuuuccuccuucaucaauaauuuaauauaugcuguuuaaggggccuuucucugcaccuacauuuauaguuauguguacaucuccuuaaaaacauucuuuuaaagauaaauggaauuauacuuuauucuacaacauauuuguuucccuuaaaacuauacauuggagacuaccucauaaguacauuuagaugaacacuuuuuuuaaauagugguaaaauacaaaauuuaccauuuugaaguauacaguuuagaugcauuaaguacauucauguuguugugcaacagccaucacaaucauccaucuccagaacuuuuucaucaucuuaaacugaaacuguguauccauuaaauaauaacuucccauuccucuccccccagccccuggcaacuaccauucuacuuucuuucucugaauuugacuacucuacaaaaccauauagauauaucguaauauauuuaacccauuaaguuuuuugcuaauaaaaacagugccauaaugagcauuauuauauauaaaucuuuucacauagaugcaaguaauucuuugggauaaguuaagaaaacuagaauucuggauuuagaauuuuuaucaacuaucgaguugguuucaaaauaggauuuauaugaaaauuguuaauuuaugcuucuguggccaaaaaagugcuguucuaauuugcauuuaccuaaaaccuugaguauauuucacauaucuuguuuauuaacauuuuuucugugaauuauuuauaucuucuguccaguucucauaguuaugguacaaauaguuuuauaguauaaaggacucccugauacagucugacuugaaaucuuuuguuuauguauguugaaaaugguuuaucccauacucuuccuugucuuuaaacugcauuuuuuuggucaugaaaaagcuuuaaaauuuuuaugauuuaaaacgucagccuuuuuuauacguucuagguuuuaaggucuuaccuaggacagaaggcuuuauuuucacauuuuuucaacuauucuguauuuacuucugguucuuuuggaagauuuuauuuuuuguuuuaugauuugugacaugagucuaagcuuauuauuuuaucagaugaagaacgauuuguucugucacaucauuuuuuuucuuugaaaauuccaacuuuuucccuacuaguaugaaaugucacuuucaucauaaacuaauuuauauauauuacuugggucuuuuucuagacuauucuguuccauugaucucuuuuccuuuucuuagggcaguauuacucuuauaacaacuaugguuuccuaaaguaaguuuugauaccugauaggguaaaauguucugaugacccuuuuugaaaauuguauuggugguuauuauuauugcucuugaauugaacuuuagauuuuaguuauaaaaucccauuuaagauaucuugagauuuauugaauuuauuauuacuuucgagaacuaucuuucuuuauaaguaacgaauguuuccauacaggaacauaguauccuuucuccauuuauguagaucuuauauguauuucaguaaaauuuuauuauauagcuuuaguuauugcaguaauugggucuucuuaaacaauguuaaauaguagcagauagugaccauucuugacuuguuucuguuuuguuguagaauacuuuuauuguuucacauuaaauauguaagguugagacauucauuccuaguugggguauuuuaaaaucaaguuuuuaucaggaaugagaugaucacguuuuauuuuucucuuuguuaguguugugaauuauacuaaagauucauucuugaauuucugggaauaguuuuuuguuuuuuuuuuuuuuuuuuuugagacgucgcucugucacccaggcuggagugcaguggcgcaaugucggcuuacugcaagcuccgccucccggguucacaccauucuccugccucagccucccgaguagcugggacuacaggcgcccaccaccaugcccggcuaacuuuuucuauuuuuuaguagagauggcauuucaccguguuagccaggauggucucgaucuccugaccucaugaucugcccgccucggccucccaaagugcugggauuacaggugugagccaccgugcccggccagaauggccuuuuuaauacaaugcugaagucauuuugccagaguugccuauauaguuugcuuuuuuuuucuuuauugcuuugcuuaucuugugaucuguaacuucuauucguacagccauauucuuuauauaagaaaaccauauuggguaaggaaagcaaaguucaguucuauuaaauaguuauuauaguuuggugcaaaaguaauugcgguuuuugccauuaggcaaaucuuucauuuaguuuuuuuaauaaagauuuuaaauacuaugccuuaaaaacuacuuaacuuuuuuuuuucuuuuuaaaguucauuguaaaggacucuguugaagaaaauaugcugaaaauacaaaacaaaaagagagaacuugcagcaggagccuuuggaacuaaaaaaccaaaugcugacgaaaugaaacaagccaaaauuaaugaaaucagaacauuaauugacuuauaau

SEQ ID NO: 19146 - RNA, 2729 nt, Homo sapiens
ggaacgaaauuaacgggaggucugacugcaaggggagggggcucgcgaucuaaaacgagaagagaucucggggucucauacugcgccauucggcugcgguacaucucggcacucuagcugcagccgggagaggccuugccgccaccgcugucgcccaagccuccacugccgcugccaccucagcgccggccucugcauccccagcuccagcuccgcucugcgccgcugcugccaucgccgcugccaccuccgcagcccgggccuccgccgccgccacucaagcauccgugagucauuuucugcccaucucuggucgcgcggucucccugguagaguuuguaggcuugcaagauggcagaagcagauuuuaaaauggucucggaaccugucgcccaugggguugccgaagaggagauggcuagcucgacuagugauucuggggaagaaucugacagcaguagcucuagcagcagcacuagugacagcagcagcagcagcagcacuaguggcagcagcagcggcagcggcagcagcagcagcagcagcggcagcacuagcagccgcagccgcuuguauagaaagaagaggguaccugagccuuccagaagggcgcggcgggccccguugggaacaaauuucguggauaggcugccucaggcaguuagaaaucgugugcaagcgcuuagaaacauucaagaugaaugugacaagguagauacccuguucuuaaaagcaauucaugaucuugaaagaaaauaugcugaacucaacaagccucuguaugauaggcgguuucaaaucaucaaugcagaauacgagccuacagaagaagaaugugaauggaauucagaggaugaggaguucagcagugaugaggaggugcaggauaacaccccuagugaaaugccucccuuagagggugaggaagaagaaaacccuaaagaaaacccagaggugaaagcugaagagaaggaaguuccuaaagaaauuccugaggugaaggaugaagaaaaggaaguuccuaaagaaauuccugagguaaaggcugaagaaaaagcagauucuaaagacuguauggaggcaaccccugaaguaaaagaagauccuaaagaagucccccagguaaaggcagaugauaaagaacagccuaaagcaacagaggcuaaggcaagggcugcaguaagagagacucauaaaagaguuccugaggaaaggcuucaggacaguguagaucuuaaaagagcuaggaagggaaagccuaaaagagaagacccuaaaggcauuccugacuauuggcugauuguuuuaaagaauguugacaagcucgggccuaugauucagaaguaugaugagcccauucugaaguucuugucggauguuagccugaaguucucaaaaccuggccagccuguaaguuacaccuuugaauuucauuuucuacccaacccauacuucagaaaugaggugcuggugaagacauauauaauaaaggcaaaaccagaucacaaugaucccuucuuuucuuggggaugggaaauugaagauugcaaaggcugcaagauagacuggagaagaggaaaagauguuacugugacaacuacccagagucgcacaacugcuacuggagaaauugaaauccagccaagagugguuccuaaugcaucauucuucaacuucuuuaguccuccugagauuccuaugauugggaagcuggaaccacgagaagaugcuauccuggaugaggacuuugaaauugggcagauuuuacaugauaaugucauccugaaaucaaucuauuacuauacuggagaagucaaugguaccuacuaucaauuuggcaaacauuauggaaacaagaaauacagaaaauaagucaaucugaaagauuuuucaagaaucuuaaaaucucaagaagugaagcagauucauacagccuugaaaaaaguaaaacccugaccuguaaccugaacacuauuauuccuuauagucaaguuuuugugguuucuugguagucuauauuuuaaaaauaguccuaaaaagugucuaagugccaguuuauucuaucuaggcuguuguaguauaauauucuucaaaauauguaagcuguugucaauuaucuaaagcauguuaguuuggugcuacacaguguugauuuuugugauguccuuuggucauguuucuguuagacuguagcugugaaacugucagaauuguuaacugaaacaaauauuugcuugaaaaaaaaaguucaugaaguaccaaugcaaguguuuuauuuuuuucuuuuuuccagcccauaagacuaaggguuuaaaucugcuugcacuagcugugccuucauuaguuugcuauagaaauccaguacuuauaguaaauaaaacaguguauuuugaaguuugacugcuugaaaaagauuagcauacaucuaaugugaaaagaccacauuugauucaacugagaccuuguguaugugacauauaguggccuauaaauuuaaucauaaugauguuauuguuuaccacugagguguuaauauaacauaguauuuuugaaaaaguuucuucaucuuauauuguguaauuguaaacuaaagauaccguguuuucuuuguauuguguucuaccuucccuuucacugaaaaugaucacuucauuugauacuguuuuucauguucuuguauugcaaccuaaaauaaauaaauauuaaaguguguuauacuauaaaaaucu

SEQ ID NO: 19147 - RNA, 499 nt, Homo sapiens
uuuuuuuuuuuuugugagccaaagauuuauuucuucauuucuugcauuugaaauacucuucgaugacauccuuggccugagacuccuugccauaguccuuaacuacuacacaacuguaaccaaccacuuuaugggguuuccccucucugucaauuuuacagaggccuacccauucuccuaguuucuuguugucaucaaccuuaauuagguugauuugguguucagcacaaagggccuccaccaacuugacauacauaggcucaucacaguuggaugcaagcacacaaagaugggcuuggcgcuugucuaagacuuuggcagcuucgcgaauuccacgugcuaggccaucguggaugagggcggucuucagcaccucuuguaaagcaguauuaaccuccauuacaccuccagcagcaaugccuuccucggccauggcaguggguuacgggugaaccugaaucuugaacgcacccaagccuccgccuccgcgcgacucggc

SEQ ID NO: 19148 - RNA, 511 nt, Homo sapiens
uuuuuuuuuuuuuugugagccaaagauuuauuucuucauuucuugcauuugaaauacucuucgaugacauccuuggccugagacuccuugccauaguccuuaacuacuacacaacuguaaccaaccacuuuaugggguuuccccucucugucaauuuuacagaggccuacccauucuccuaguuucuuguugucaucaaccuuaauuagguugauuugguguucagcacaaagggccuccaccaacuugacauacauaggcucaucacaguuggaugcaagcacacaaagaugggcuuggcgcuugucuaagacuuuggcagcuucgcgaauuccacgugcuaggccaucguggaugagggcggucuucagcaccucuuguaaagcaguauuaaccuccauuacaccuccagcagcaaugccuuccucggccauggcaguggguuacgggugaaccugaaucuugaacgcacccaagccuccgccuccgcgcgacucggcggcaggaggga

SEQ ID NO: 19149 - RNA, 1397 nt, Homo sapiens
auuuaacguauaucuuaacuuuauugaauaaguaaguagccauuacauauagauugcaagucauucuugguccugcuuagagauagguguuuauuccaaggugaaaugacagcacaaauccacaguucuacugcaagugaaauacuucuucaggguggcuugguauggacacaaucucccucaauacccauucaaagcagucuuugcuuucaccucucccuuuaggugagggauucacgguauguaaaauaagcuuguaaagaacccuucuguaucagagguaguuuugugccugcacugugaaccauagaaggcauuuggucaaaggugucauaaaaggggcagaagagguacaucagagcacagaguugggaucgauuauuuuuuucaaguuaauugcccauaguagcaaaaguaucaaccaaaauuuagaauagccuguccauccauuuaacaacagagcaugcagcagccugugcagacaauagcuuuuagagacaaacuucgaucugguuugagcaccaagaaugcaucuuaaaaagugaaaaauucauuugugugcaaugaauaguguagugagcugcauggugcccccuccccaaaaaagauauucaauauccuacucccuggaaccugugauaguaccuuauuuggaaaaaagguccuuucagauauaauuaagaaucuuggaauaagggaauuaucauggguaaucuggaugggcccuaagucccgucacaaguguccuuauaagagagaggcagagguagauuauauauacagaggggaagugaugugaagacagaggagagggagaugcagucacaaaccaaggaaugauggcagccacaagaaacuggaagacacgggaagaguguuucccuuagagucuccagaagacguucagcccugccaaccccucaauuuuggacuuuuggccuccaaaacaacaagauaauaaauuucuauuguuuuaagccacugggcuagaggguaauuuguuacagcagccaugggaaucuaaugcagauuguggaacugggacggauuggguacuucuguaacaaaugucuuaaaaugugaaaaaggcuuuggaauuggauaauggguagagacuagaagaauuuugguggcugugauagaaaaaacuagauugccuuuaccagaugguaguaguaugaauguuaaaggcauuucuagugaugguuuagaaggaaaugaagauuuuauuggaaaauggaagaaagggaauccuugucauauaguggcaaaaaguuuaucuaucuaaauugucuacuacaguagugugaaaaguugaauaaaugaugaacuuggauguuuagcugaggaaauuuucaagucuaguguuagagauauagcuuaguuucuucuuagug

SEQ ID NO: 19150 - RNA, 7806 nt, Homo sapiens
uguacaguguuuccggcccuucucaguuguggacgcucguaaguuuucggcaguuuccggggagacucggggacuccgcgucucgcucucuguguuccaaucgcccggugcgguggugcagggucucgggcuagucauggcguccccgucucggagacugcagacuaaaccagucauuacuuguuucaagagcguucugcuaaucuacacuuuuauuuucugggugagagacgaaggcgccuggggccggcaggggaucccgggcuuuuaguuguggggggugugacccugagcggcgggagcucaggucgggaacggugugggguuugggcggccaucgcgccugggaccccgacgccggcgaccagugacugggccccgaacaaagagcucaggcaucucgccggcgcuggggucggagugcgggacgaaggcagccgagaggcugagcugggacccagacguaccagcguucgaguucgauacgggaggcgagguggggccuuaagcccccagagcacgcagacggugacccuggaccuuugcaaaggcaagcaaggcuugcccggccccuuugagggcucacuugcauaauagugucuuucuuuucacugcuucguaagagaggaguguuucgcagguaaguaugguaugccuccacucccgccagucuauccuugggcuugcuuuuguguaccaguccuuuguacccugugcccaucccuaccuggagaggacgggggaaguuucuggaacucauaaaaucacguuuuuuuuuuccccuucaagguuuucuuccuaagguuggaguaagauaguuaaggaaguuuugaucccuagggcaaauaugccaugggcuuguguuuacacacaaaaagaugaauuuuaagaauuuugauaagauaccugguccacagccugcucuugugugcagaucccccccuaaccccuucuacucuucccccuugucugccguaucccagcauauuacaccuauugugccuuaaauaccucaugcguugugauuugaagaugcugcuguacacagugcguaacuguuuguauucucugaauucccacauagaucacuggcguuauccuucuugcaguuggcauuuggggcaaggugagccuggagaauuacuuuucucuuuuaaaugagaaggccaccaauguccccuucgugcucauugcuacugguaccgucauuauucuuuugggcaccuuugguuguuuugcuaccugccgagcuucugcauggaugcuaaaacuggugaguccuuguuuucauuagaauugauucuugguuuuagaaaaguuuuguauguuauagaauuccuuuguuggaacuggccauggcccuuuacaauuuuuccuguuccuuauggaaacuuaucaaguaacaguucagcugccaguuuccacuuucaaaauagacauguuguuauuuucccugcccuuuucaaugaaaacaugaugaacuaauugagaagacgaccauuauuuuuucuuugacucccuuugcaguugugcuauaucuuauuuaugcugacuuggacuuucuuucuuauccugcaguaugcaauguuucugacucucguuuuuuuggucgaacuggucgcugccaucguaggauuuguuuucagacaugagguaagccugaauuagggaagcuuagcauguuacauuuauccucugagagauaaaaauggauuuauuaaaguagaagagucagaccucuguauuuaaaccuguagcugacaauaauggccuucuuguaaaaauucugguccacuucuaauuuaaaagaaaauuuagaaaauuguaaagacugauagucaccagaagaaaauuacuuacuuauauucccugucguuuuucuguguauaaauaccuauuaaaacggagauaguacaauuuauaacuuugcugauaggaaaauauucaaagcacaaaauugauaaccuucuuaugccuugcauuuugaaaagauuggauauacuuaaugcaaaucaucagaaguuuaauauugggccgggcgcguuggcucacgccuguaaucccagcacuuugggaggccgaggcagguggaucacgaggucaggggaucgagaccacccuggcuaacacggugaaacugucucuacuaaaaauacaaaaaaaaacaaaaaauuagccgggcguggugguaggugccuguagucccagcugcucgggaggcugaggcaggagaauggcaugaacccgggagauggagcuugcagugagccgagaucgcgccacugcacugcagccugggcagcagagcgagacuccaucucaaaaaaaaaaagcuuaauacugaauuagaaaacagguaaacuugggguuguucaaauaacauucggugaguagcaaaggcucauuaaugagaguucucauaaagugguagcacagccucccaaaguaagguuuuguagcuuacaaauuccauaggcaucgaauuugaacucaguuuaaaguggagaaaaauuagcagggugcagaauacagcaauacugcauugccacucagauaaauacauauucccacagcacuuugaacuuguagugguucucaucauauauuuuaauguuuugcuuaguaguccccucagcuaaccuauaccccuuagaggacaggacuguaccauggaaguuaauuacuauacauguugcugcugucaaagauaugaccauuggucagauucgagaacuuauuugaccugaaaccaaaaacuuucuagaggauuuucuuacugacauuguguuucuuugcuauagauuaagaacagcuuuaagaauaauuaugagaaggcuuugaagcaguauaacucuacaggagauuauagaagccaugcaguagacaagauccaaaauacgguaagugguaaccaccaccuagaggggaacacauucccuguugccucagagaaaagagcagagucuggcuacuagauguuauccaccuguaggggaaagaagugugacguguuucauuuuccucacaugugcaccuguucucuuccuuccccacuuacaucauaguccagguacaguuaguaccaacuauagcaggaaaguaaggccaauacaaaacugucaugcauggugcuaaucagggacccagugcucaucucuugaaucaauugaggagagagaucauugagauuaguaaauguuuugagcacaaauugcaauagaggauauuagguuaaauguuugacuacaaaguuguaauauaaacuguaaaugcuuuuguuggguuuuucaguugcauuguuguggugucaccgauuauagagauuggacagauacuaauuauuacucagaaaaaggauuuccuaagaguugcuguaaacuugaagauuguacuccacagagagaugcagacaaaguaaacaaugaaguaaggugccuuuuaaaauuuucuauuuggcaauauuugaagacuuaacugaaugcaaaauugacccaguuuuuaauuuuuuuuuugagauagagucuugcucugucgcccaggcuggagugcaguggcgcguucucggcucacugcaagcuccgccuuccagguucacgccauucuccugccucagccucucgaguagcuggaacuacaggugcccaccaccacgccuggcuaauuuuuuguauuuuuuaguagagacgggguuucacuguguuagccaggauggucucaaucuccugaccuugugauccaccugacuuggccucccaaagugcugggauuacaggcgugagccacugcaccuggccaguuuuuaauuuuuaaauauaagcugaaauagauagggcggguaagaauugaguucagacggccagcaaguaacacuuuuuuguuuauuuauuauuuaguauuuuuuuuuaaagacagugucucucucugucacccagucugaaguacaguguugugaucauagcucacuggagccuugaacuccuggguucaagugaaguaacacuuuuaaauauauaauccagaagguggaaauaauugggaauaauuauuuguucuguugagaacauauggaagagaauagauuucaauaaaaugacaaucaaaggcuaugauacauacaucuuucugcagagguauaugaucaaaguauuuauuaccauaaauauaucuuucugcagaguuauaugaucgaaguauuuauuaccauaaagaaaagcacaggcugcuugugcuguauuuaaucuuuguuuuuuuccucccauuaggguuguuuuauaaaggugaugaccauuauagagucagaaaugggagucguugcaggaauuuccuuuggaguugcuugcuuccaaguaaguuuuuguaguuacuuaggaaauauuucaucccucuuguagguguaagcuagaagauuuucacuuuuuuuuuuuugagauggagucuugcucgguugccaggcuggaaugcaguggcgucaucucagcucccugcaaccuccacuuccuggguucaagcgauucucccaccucagccuccugaguagcuagaauuacaggugugcgccaccaugccuggcuaauuuuuuuguauuuuuaguagaguugggguuucaccauguuggccaggcugaucuugaacaccugaccucaagugauccgcccuccucggccucccaaagugcugggauuacaggcgugagccacugcaugcagcgagauuuucacuuuuaaggcuuauaaguuuuugcuucaggggacuggauagugaggacauuuuuagggaagucgcauuuucacaaaacucucaguuacuggucacaguauaaaaauacuuuauuuaggagaaauaccuaauguagaugauggguugaugggugcagcaaaccaccauggcacguguauaccuauguaaccugcacguucugcacauguaucccagaacuuaaaguauaauuaaaaaaaagaagaaaaaaaguaagauuuagaauuaacuuguagcagugcauaucuuuugaaagcaguuaacuguggaaagacucagugcccucuuaguuauggcaacuuuccaguaucauagcucaugaaacaaaacauuagauaggaaccuugguucucucugcggucagucaagauucuaaaauguuauuaggaucuuuucugggcugcaacugccugaugaguuguauacaaguuccaaccuauuaaaauuuagaugaugccacccccacauuccuuaugcaccaguuguuugggguugauuccacguuguagaucaaauuguguuucccaaguuguguuucccacuguagcaugaaguuuguuuuguggcucugaacguuuuuuuuuauauuaaacacuagaaauaagacuaauucaaguuucgucuuaauauauuuuuaaaguaguaagcaaagcuauaucuaaaucuaugcuaaugcaguagccacuagccaccuuugaauuguuauaaauuauuaaauaaaauuaaaaccucaguuugcuggagauuugaaauacuuaguagccauguggcugcugccuacuauaucggacaguacagggauucuagaacauuuucauuauuguagcauugcuguggaucuuuccagggaaaucucugcccucguugauggagauuucacuuguuaagauacuuauugaaaaccauguauuuguuuuuucugggaaaugagaguaagaaaaguuucuucaaaacucgugacugaauuuuccuugagugaguuugcuggauuuuccuuuggugagaguugugaaauucugggucacaguggcaauaaaacuucacuuagauucuuugaaugugaucuagaugcugcagaguauuaaacauaacucuagaaaaacucaaggacgaaaauuauaagcgaauuacaagugagaggagaauauagucugagguguucaaguucuuuuguguauguauuuaauuuuguuccuauuuuauuucuagcugauuggaaucuuucucgccuacugccucucucgugccauaacaaauaaccaguaugagauaguguaacccaauguaucugugggccuauuccucucuaccuuuaaggugcguucauuuugguccucagcucuguuaguguugauauuuauucuagccuguguaugugaugcauggacuaaguuugccaagaacgucuugucuaguaauauauuuaaaucuagcuggugcuauguaaacccuguguaggcagguuaggucucuauacacagggcauggucagaaaguaaugacuuagcuacagcuuaucuaugcaugcucucuacaguuaugcaacagaagacuccccguguggguuuauauauuuacauacacaugucagccuaaagaucauaaguggucccuuuuuuaacauguuuuggccuggagagaggagaaacaaagaaucccaagaaugaccuuauucgugagguucccuggcaggugcacucugcuccucaccaauauugacauuuuccuuaguccuuuucguaguuuucauuuaccacaaucuuaaucaguuguugagaguguggcuuucuugguaaaaagauguuuuuggugggcuuuuguuaaaaccguaaacucaucuggucuaauaaggaaccagauuuugggaagacauguguuucaauggcguuaguauuugacugguaaaauacugugagaacuguuguuggcugaauugaucccuagggcacacuuugcauuuuacuugagccacugacuaggaacacauaggaaggucuucauuagcaggaauagauuagaauguauguaagcaaauacagauguugaaauuuggguaacaaguacauuaacuuuuuuucuuuaauuuuaggacauuuaggguccccccugugaauuagaaaguugcuuggcuggagaacugacaacacuacuuacugauagaccaaaaaacuacaccaguagguugauucaaucaagauguauguagaccuaaaacuacaccaauaggcugauucaaucaagauccgugcucgcagugggcugauucaaucaagauguauguuugcuauguucuaaguccaccuucuaucccauucauguuagaucguugaaacccuguaucccucugaaacacuggaagagcuaguaaauuguaaaugaaguaauacuguguuccucuugacuguuauuuuucuuaguagggggccuuuggaaggcacugugaauuugcuauuuugauguaguguuacaagauggaaaauugauuccucugacuuugcuauugauguagugugauagaaaauucaccccucugaacuggcuccuucccagucaagguuaucugguuugauuguauaauuugcaccaagaaguuaaaauguuuuaugacucucuguucugcugacaggcagagagucacauuguguaauuuaauuucagucagucaauagauggcaucccucaucaggguugccagauggugauaacaguguaaggccuugggucuaaggcauccacgacuggaagggacuacugauguucugugauacaucagguuucagcacacaacuuacauuucuuugccuccaaauugaggcauuuauuaugauguucauacuuucccucuuguuugaaaguuucuaauuauuaaauggugucggaauuguuguauuuuccuuaggaauucaguggaacuuaucuucauuaaauuuagcugguaccagguugauaugacuugucaauauuauggucaacuuuaagucuuaguuuucguuugugccuuugauuaauaaguauaacucuuauacaauaaauacugcuuuccucuaaaaa

SEQ ID NO: 19151 - RNA, 2932 nt, Homo sapiens
cuagcucuucaguaguuucugaacaucuagacgguaggauguagaauagguaaguagaaaugcaaagcagauauugcaguaauugacuaaagggcuggguuaaugggagugaguguguaguuaagacaguuaugguguuagagaaagaggugaggaaggagggacuuuuuacugaguugggauugaacuggauauucaguagaagcagaaaguaugagugaaguugagggugggcagggacuagggaauaggacuuguuuaauugggggguugaucauacugaccugguacagagcagaaaauucacauuggaaaagcaguaggaaaucaguugagauuguauugggaugaggggcuugguagggauggagggaggcuggagguggcacaagggaggucugacuuaacagugagcccuuguuuaugucauuucccuugccugaugucuagcaaugaaaaacauuuacaccuaaucuugaagguuacaggaaauuaauugggaaggggggcuacuaaauguuccauguaaaacaagcaguaacaauacuuaaaguauuuuccuuuuuuccuacauuguuggcaucaaauuguguuucugugcucagaaagagggagaaauuaagagguugaacaagaaaaaguacugaacucucugccuuaccacucuggggcagguaggguuacuuccuagguggcugggcuauuggagugaaggcaaaagccaaacucaaccaaaaaaccccaagugcaaggcagaauuggggcaaucauugagguucuuaagcuucagaggcuccgaggaguccuuguuuuagguuaaaugucugugcaacagcagucuuuacucagguuacucugcgcagaggcagcuguacguacaacagcagcuauguuucaucacaaagugggccccauuucugaugaaagacacagaaguugcccagguuuaguccuaggcagcuuacuuggucucuuucaaccuguuucuucaucuguaaaaugaaggugcuaggugugucaaccucauaauaggguucuugugaugugugcauacgagguaauguguaucaagcucuuagcaauagugguugguauacagucaauacuuauuaucacagucauuauuaauacuuuaaagaauacauuuaucuaguggccuagggaaauacuucuuaaauugccuuaaacgggauuagaugccccuuuggucuggguuuguacccaaacccaggccuagguuugaacuaaauugaauuucucgguuugguggcauuguggggguggggagauggaaguggguguagcagaguaggaggcaauggugcaagguguuguagccauaggaauaugaauuuccaugucagcauuugguuuaauuuggcaccgaguguuauucaaacaaagcagcguugugagugguagaggaagggagaggaggaaagucaacacauucuuggaaauaagauguggcuuuugcuuugcuauuuuguuuuuucuucagcuacagacauauuucuuugcucuugggcucacacuguaaaucccuuucaguacauaucuaaguuucagagaaacuucucuuuaagaugacaagaaguuaucaagacuucccuugauccuuguuuuuaguauaagaacccuucaguuggggucauuuagccuagggagaaaucuuugcauauacuuagacaccccccuccaccauguugaauauuugguauuuccuaacgacuuuaccucaaaguguuugaagguguauguagauguaucguuuauccauucucuccauguauuuguguauuaggccuuucaaauuuuaguaaaaauuuuaguauaaagccuggcaaugcaauaauuaauuuuccaacaguugcugccuugcaccucagacgucuggcaagauguuauaggaacugguccuaggucaauauucgaagcacagggaagcucugugugaccaagucaauggaacuuuccuguguucugguccugagguguauguuuaaagcaacguuucaagcagaaaaguuugaguauucaucucuccuccacaaaugcaggucuuuuugcaauggcaauagaguaaauagccacuugugauauuaagcuugugucaaugaugaaggguuggauugcauagggaacugauacagccuucuaaccccguuccucuagagauaacacaaacucacuuaacacucagucucugccuucaaagagcugacgcuuuaguugagaaaucagaccuuaacgcaccuccuguguuguaacaacauagaccaauauauucacaauauauaacauuagguuuuaaucucucuguaaucagcuggguuuugaugggaaaaaccagguggcuggaauguacagugccuuucuguuuuaacauuuaagaggaggucacacucaccagggauuuuuccauugcacucucucuuuuuaaaaguuuacagcgaauagcugaacuuacauuucacuauuauguaaaaauacuuucccucaacuuuccaauuacuuaggggauaaaaaaggagaggaauacugggguuuugcaaaguccugcagguaaauucuaaagucauuauuaucuuuaauaccuagcuuagaaauucuuucaacaaguggugauuauuuuccuccauucacaucuccccuuccuaacccauaaaacaauguucacaaauugaaaagcacacaagugagaaaaaaaucagccuaauuccaccagagguaaauuucacuguuccuuucaguuuuugucuaagcacacgugacuguauguauugcuuugcaauccgcuuucuuuuugcaaauauauuucuuguggguauuuucccauguauuuucuuaggucgcuuuuaaccucuucauucuuuuccuucucucuagggcaccaggggccagggaggcccaaucucagagcgcugcgggc

SEQ ID NO: 19152 - RNA, 27828 nt, Homo sapiens
cacuauauucacaggcuuggagccagugccauucacacuucccccucuucugcagcagacggacugaguuccucuaaucccuguguuccuucucccccaucuuucuaaaacccuucucugagagaggaauaacuauagcuucagggauaauauagcuuuaaggaaacuuuuggcagauguggacgucguaacaucugggcaguguuaacagaaucccggaggccgggacagaccaggagccacucguucuaggaauguuaaaguagaagguuuuuuccaauugaugagaggagcagagaggaaggagaaagaggaggagagagaaaaagggcacaaaauaccauaaaacagguaagaucugcaacuaaccccuccacacuccacuaccccaauucacaauugugaaggggauaaggagacccagaacuugggcaacauggcuggggguggaggucggggggaaguucuuuuaugaagcuggaucauaugcugcuuuucauuugugccgugaccugacugcaaacacauguucccagcaacuucucagcccacagcagagggaugggaugguugacucuggugagucaaguauuaagccugagauuggggagaagcugggcagguacgaggucacagguucagggaucugaaaaaggaaugccucugcuccagaacgaaggaacuggauggaggcuagaugugggagaggggucagugauuaguuaucuaauguucacuuccuggaccucucuuuaaucuccucuuucugcuccuuuuguugccucuuucugcguuuaucuaucucuuuccuucagcucugucagauuuucuuuccuuccuucccacaucuuucuacuucccuugccuccuucguuuacucucacuuuuucuccguccugcuucccugucacuuucuagacaaaaucugaagccaaguagcaaugaacuaaaaaauacacuuuucccuuucuugggcuuugcaugucccuuagggacucuggccagaaucuaccacauuuuuguuucucuauuucuaggacugacuccuccccugagcauggcauuucauugaaagcccgugagugaaugggugcuugcugaaaugcccaguggccaauuuauaccaaugggcagcaaguuuuaauacugucauuuacaaaguauuugcccgcugggaaccacaaaacucucgucccauuagggugaggacaggggaggaagugagagggcaauuggagcuuguucacccucuccucauguaccucagcagguccuccucuaccucgcugacuuccugcuggcucagcaagguaaaacuagaggguuaggcuggacuugaaagccagaagccacuaccaaaccaccaagccuuaaaacccaaagcuaagaacagagccagaguccaguuacugccugggacacuagagaagggaaacauucaguccuguccaauacaaaguugguaauaauauugucuaauauauaaauuacuucccuauaugacagacaauaaucaauucaugagguagacaguauuauuauucccauuuuauagaugaggaaaccgaggcuuagagaaguuaaaaaauuuguccaagacccuauagcuaauaggugacagaauuggauucacauccagaccuguguaacuucaguguucaaauucuuagaccacauaugcuaacgcuuucccagauuaguggcuaggaaauguuaguugaaugaaugaaaccuaauggcagccuuuaggucaccagguucccuccugguucuguguaacuucauguuggccuuuuccuggucucaguacuucaaugucccucucuauaacuuggaccaugaagcauuugcaucugaucccaccagagucagaugaagauugguuguuuuacauccuccuccuccugggaggaaaagggaccauaaauaacaaacagagucuuguuauucuauaacaugaaagauccuuaugagggagauaauauaaaaggcauucauuaauuauaaaaucucucuucuuccucacagaucccauauuucugcuuccccucacuuuuagaaguuaauugauggcugacuucugaaagucacuuuccuuugcccugguacuucaggccauauacaucuuuucuugucuccauaauccucccuuucaaggauggccagucagcuaacucaaagaggagcucucuuucugcuguucuuccuaacuccggcagugacaccaacaugguaugcagguaaguucuaggagcuguugccuauuauuuccaggaaggauagguccuagaccaagacuuggagaaggaagaguuagacuacaaaaagagacacuuauuuucuauacagagaaguauuaaaggacaauaaagaugguuaaacauggcaacagacuaccaagggaggcuuuuaaggcagccuaacaagagcuauuugaaauaggugaaauaggccacacuaguacaaacaugagaagguuggacaucaccuuugaggccauugucucaccugcuugugcacuuagcuuccugaaaaccauuuucuaacaugaaauccuuuaugagucaaaucuuuauuaauauuaauucuuuuaugagucaaauacucuugucaagaccacaaaaauggacuuagaccacauaccucauuuggaaaaaauaaggggggcaggcaaucuauucaagugaaaugagaauccaucagacuucuucccacccucucugaucuuauuuauaaaaugagauuuuuuauagcccuuuuaugccaaagcuguuaguggcaauacagaucacauccuuuuaaucaggaauuucccaguuucuucucauuuguucuuuacuucagaagggauggagauuucuggauuccugaauauuucacucuucacccagagagccagagaacaaacucagugagaagagggaaaggggagggggaagggaugagggcaggauaaugaaguggcauacagagguuuuauauggggcccagcuggcauuccaagugcuaagaauauucuguggccugcagugucugcccucacaggggcccguggggaguagugggggaaggagacagacccaaccaaugggguuaggaaaauauccagagaugaguaaauaacaaacugcucccaucacagccacagucccugcagcuaaaauuuuccacaugcccuuagcuccugguggaggccuuuggcaguagcucuguuugucuggaacagcugcaucaagcuuucaaacaaauaugcaaacuucuuccccuuuuuggcuuaaccuggcuuuguagggggugaagcacaaggacugacauugagaugaaaaaauucaagucaagcccuuggcagagcauauccuguuugggguuaaaggugccucaagucuccaggagauaaauaugcaacuguccuccccaaccuccccuugcuucaguucauuuacagagaccaaaauccagccaaagaccacaggacuaaaggaguggagauuagauggcucgaagcccaauucugaacaccuguaugaaaccucauggcaugcaaaggucuuuaccuuucccaaaacagaagccugagcuguuggaggcgugagcacagagcaguuuuuuaaaaguuagauucaguugagguucucaaagggcuauuugcaaagguggaacaccccacuuccacgugaaucacaagucaccacuccugagaagcucagauuggugaggccucugccagcccugcaauuccacucauucuucccucuucuauccuuaggaggccacaugaugagagacauuuccccuacacugcuagcucagcuguugggcuugccuucaugccuuuguucauucauuccuucaacaaauauuuauugaggacucuuuaugcauccaggacaguuuuguuuacuuguacagccuugucuucaaaugggcauggcacagaauagcagccaaauguggauccagggcuaaucagaaaaaggguccaggaauaaucagcaguggcugggaaaaguuaagaauauaaauaaagcaaagaauggguuaaaaguguguucuggcauaucugugcagcccagaaagucagacuguauuugucaucauaagccaaggauuaauaugaaucuuaagauagucuuuuaacuaucaauuacaugucuaacuauacuuuugugaagggcagugcuuagagggccugacuguacuauggagguuggaggaacccaguaacagaccacacaguaaccaagcacugauugaucuaaaggaacugaggaaugcuccccaaguccuucccccagggcugaagagggacaagcagacagaauaauguaggaaauguuccccuuuaauuucauucuuauacccaucuuaguauuccaccauuugcaaaaaagaaaaaaaacucaaagauaggcaaagaggggaaaugggaaaauggaaagguuuaaaguggcaagauggucugaacccuuucuccacacaaagcauaguuggcacugguccagcuacuuccgcacccugauggagacuguaauuaucuuauugagucuuccccacaguuuuccuacaucccuuguaauucuggaaugauguaaaaugcuugguggccuucgaucccacacacacaguaaaaaagcuggauugcaaaagagauuuuggacuuuuaccccaguuggacauuaucaaaagcucuucccuaaucaccaucuucaguggagugucugaguuugguaucuagggggucaagcagaccugggcuggaaugcccacucugcugcuuacuagcugggagaccuugguucucuugguuccucaagccuguuucuucggcuuuauauuggagcacauuaguaguaccuacccugcugacauguuauggugacauaaugaacuaacauauguaaugugcuuaacacagaauaugagcugagagauguuagcagucauugucguaguuguucuuguuguuguuacuguuaccaagccacagggcucugacacuccugacacuccuguuuucucuucuguuaaacaguccuuugcucccugcugagcaugucuucaaaagcuggcucuguaaccggagcaggaagaccuaauacuuuagggaaucacccacaucuggccuccuguuuacaggaccuauaaagcuuugaggcuaauacugaacugaaacagcugacaaaaauuccaugacccgccccccgacucccccgcacccaccaaagaaaccucccauuaugggaaaaaagagagcaggggagaugaggucugagaagaaaucaacggaagccagaagaagaacugaaaugggaaaacagaaaaaaagaaaaaggggaaaaagaaaaaaugaacucuuuccucuggaaugagggcaaaccaacgaggacaugauuucauaaggcaaacuuucaauugauucauucccuuguucaccaaguuggacugguuucccaauaccucaccucccccaccccuagucugggccuguggggaauggaggagcuucaucaucuggcccucugcuccgcccuucagugcagggggcccugugccucuucccaagaggaggaggcgagcuuguggccugaguauuuacacaggccaaagggcuccagcacuaaaacccagcccuguccuggaagcacacccucuccuggaaauagggaauugucucuugacuccaaaacagcuggcuacccuauuccugugcaugcauuagggcucagggaggcuggaaggagggcuuccggaaacuucacuccggaaaggaccaaguuguuuuccaauuaguucguauucaugaccgauuuccugccgucugguggaacauacuguuuagucucccagacagccgcagaccugccuccacuagggacugggccacuuaacuggauggagauagauuaggaauguucucuagcucagcagcucccuguuaaaguuccuucugauuagagaaacaggaaauuuauccgaaggacucugccuucucuguucuccaaaccagggcaaagugcucacaaaacugcuuucauuuccucuugccuuuuaagucaucccucucggccuuggcaugccacccccagcaaugguaauccgguaauccgaugacaaaaaggccugugcccugugggcuaguggaagccugaguaauuguuuuuuuuugaggaccauaagcagggcugucacuagggggaagacacagguucuguuuuugccuccuaucagggaccacaguccauucucagagauuaguccccagugucuuaccaagacucauguguugcuucaaggaaaugggucauuuauaguccagauugacaggauugauguauggucagguucaauuuuuuucuuuuagauggagucuuccagugcucgcaguaacuggccaccacaacuaugagccugcccucuaugcaacugaggugcugagauucacccacaguaguucugcugccuuacaaugcaggauuucccccacuaaauauccaccuggcuccccacccauggaaugccauguccuaaggaagugacaaaguuggaugagagggggaagguugggaaggaauugagugagaaaucaagacaccauuuugauauugucuuccuuauucuagguucuggcuacuauccggaugaaagcuacaaugaaguauaugcagaggaggucccacaggcuccugcccuggacuaccgagguaaucuacccugcuucucaagcccagaaaaucucuuuucuggccucagaccuaggcccuucccugaagcauccccaucaggcuuggcucacaugugucaaaacuguagcacagggaaucaggggcugugauuucucaucaugaacuugguuacugacuuacugugugaccucaccucuccagccugaagguucuccauguauuauuaaucauuaaguauugacuaguuacucaaugccuaauccugugcaagguaagccuguggguaauacaaggucucagauaggguuuuguccccaucauguagcuuauauucuguugggggugauggggggguauaaaguuagcacauguagggcaaguaagugugaagcuaugucauagcaguaaaugcaauaggguuuaagaaaaagaagucaggaaaagggucaugaaagaugacauuuaggcuaagcuuagaaugauaggugggauuuugagaaccagaaaggggaggggagagcauucagcaaagcagauggcuaaaaauacggaaguaagaacaaaccugguagaggagggagcuaagaagaaaccagccugauuggaggaaauggaauauggagggaguaguaucaaagaagguuaaauauaggccaagugcaguggcucaugcuuguaaacccagcauuuugggaggccgagauagguggaucacuugaggucaggaguucgagaccagccuggcgaauauggugaaaccucaucuccaacaaaacuacaaaaaauuagccaggcaugguggcaugugccuauaaucccagcuacucagguggcugaagcaggagaaucacuugaaccugggagguggagguugcagugagccgagagcugagauggcaccacugcucuccagccugggugacaaagcaaggcucugucucaaaaaaaaaaaaaaaaaaaaguuaaauauaaagagugagaccaaauuaggaaagacuccaugaucuagggacaauacuaaugagaagcaugaaaauuaucugugaugaaugcugcauagugaguaauuccugcauuaaaagggaaguuaggccaggugguaucuaauaucccuucuauuucugauucuuuguuucuuugcuuugcaagccauguggaagaguuuagcuguuguacuaggaucuauagggagcccaucacauguuuuugcacagaggcaugacacaguaaauugucauuuuagaacauuaaccugauuauucuaugcagaaauagggguucagugguuaagucugagucagggagacucuccaggaaccagcuacaguaauguuggcuagagaugacugauggugguggcaaagaaauggaggguacagaugaaccccauaaauguuucaaagaaagagaugacaagacuuaguacagacuugauguaccaagaggcuaagaaacaaacugaugucugaaagcacucagucuguacaccuggaagaaauaagaccccucucagaaagacaaugucaaaaaagaaaacugguuugguaaagaugcccuacaggcggcggaaggaugaaguugugugagucaucagcuuagauagauggguugucugagggagcagaaggccagggucagagcuuuagaagacaucuguagacaugaguaggagaagaggaaccagcaaggggaaaaaaagagaauuaguggucagucauguaggaagauaucugggcaguaccugucauauuacagaagccacaggagaagagaguuuuaaggaaaggaagggguaagagauaaauugugucaaauauugcaaagaaaucaaauugaggguaaaggaaagauguuaucuggcaagaaggagguaaauggugaccuuuaagaaaaauaguuucaacugagaaauucucagagcuuugagcuccucugagcaucuuuguagcuaccuucuacgcacguucuucucccugccaaauggugcauacccacugccucucuccucagcacccacuaacuccuaaacucucuacagucuguuucucgcccacucacaaaucuacaaccugaaaugacaucucuugaagaaaaaaguucucucccaugagagaaccaauucccaugacccuuucuugagcuugucucucagucucuccagcagcagugagcaccuuccuuucuucuuaaucccccuuccuuggucuccauggcauuucacaauucuggucagagcugaaacugggaaaggagguggacucucugguggugacaauagagagaaugagacugggaucugaacuugggucaacccugaccugucuccugagcugguggacuacaucuccaacugcugcuacacacuuccauuuggagauaucuaaaacaaaaguauuuccucucuccugaaaaauguucuaccuacugaccuuccuacuucugauaacacuaccaucauucucuuaguuacucggacuucaaaauaccucaaugucaccucuaauagguccugucaccuuuaacagcccccuuuuccucaucacuuccugccagucagucaccaagaccugucauuucuuuauuaauccaugggauuaaaacuuugaccucacacauggauaauacaguugccucuaacuggauuaucugacucauguuucccccucccccaaaccuacuggcccacaaugaccauuuuaaaucagaaucuggccuuggucuagcuucccagacugacaacuuccuaccuguucuccccacaugaaaucugugcuuuggucaggcuguguucaguacuguguucccaacugcuuuagcccacacugagcuuucucucgcccauuuauucuuucaucgaauauuuauugaauacuuauuagguaccucuucugaaauaaauguuuacugucuagacacacucauuuggccuucauuaugcacugccucuuugguuaacuuuuuauuacccucaagaaaauaguucuguauuuaacuguauuuagcuauauuucuguauuugacuguauuuaacuguauuuguguauuuaacuguuuuuaacuguauuuaacuguuuuaacuguauuccuguauuuaacuguuuuuaacuguauuuguguauuuaacuguauuuaaggaaucauguguguuacucucacagagccaugguaaaaaguagaugcugaccacuagcauccugggagcagaagccagauuaugggagacuauaguuuggagagguggcuaguaaaaagcaacagaugcagaagguacuuucauggagucugcagcccuauuauuaacauuaaccuucuucacugguucuucuuaaaugagcagaaagcccuuuagagaaauacaagcugcauaagggccuuugguuuggagguguagugucucauagcucuuuuuaggacuuagucucagggcauaaaaugaauugagugaaguuagcaaugaugagggggagggaguggccaggaaaaguacaaccugaggccccagccucccagguaaagucuuugugaccuuauaaucaauaggucugcaacuguagugcuaaaugacuucccguaauuugaagauggugucuccagauggcaguagugugucucagucacaugcucaaaacgaaugcugggaaccacagcauguugcugcuuuaggaaagaugggacacuggcucagacccagacacugacuuagggaaaaucauucacaggguugaauauuuuacacaugaaauuucauuugguucucacaacagcccuauggaacgguuuauuaucccccauuuuaccaaccaggaaacuaagcucagggaaguuuuagauucagagagucacagagaauuuaaacucagaucugucugacucuaaagccaugcuuaauucaucucuuucaucaaaaauuaacucauuguucuaaaaaagaagaccagaaaaaaaagaacaaccaaaucauuauuuuagagcaaauuggcaugucauuugcuaucauuuucacucaucuugcacuuucuaucauucccuuaucccaacuccuagcuuggagucagcuggggcugcugcuuuccuugcagcuugccucaucccugagcaagcuagucacacugccuggguuaucugaagauaauagaagacaacagagaaggcccuuucaaaacucucgucagcacuuuauuuucugcauacaccuuaaaaagagauagacagaugaauagcuacagaaagcggagacaaugggccugaguucaaaccuccgcuucucccccuuccagcucuuggacucuggacaaacaccuauuaugugccagucacugugcuauguauuuuauaaauguuauuucauuuaaauaaauugcacacuugcuauguagugauauggaaagaucucuaaauacacuguuaaguuuaccaaacaagcaauggagggaagagugggcauaauaugcuacucuauguauuaaaaaggaaggaaaaauaagaagcuauaccaacauuugcuuuauaggcacaaagaaacuauuaaaaguaguuauuugggaggggacuaagucggggugggcaugggagcagggguugggggaagacauuuuacuuuguaacuuuuuauacuuuugagguuuugagucaugcggauauauuaucuauucaacaaggucaguguuuacuucaaaauaguagccuauuuuauaucugcaguggcagacacugcaauuacauaggacauggaguuuggagcagacaaagccuggguucaaauuucagcucuaccccuuacuugcuuagggauccugggcaauuuacuuccucaucugcaaaagagggauaaacaccugcauaccuuacagggcuguugggagaacuguauaagaugauauaugugaaaaggaaaacauguagcauggugccuagaacacaggagauacacaauaaagacuuacacacuuccuaccagacaauuuugcuauacaguauuuuugggguuuuuuuagguggggugggggaguuuuuuuuuuuuuuuuuuuuuuuuuaagacaaaguuucgcucuuguugcccaggcuggagugcaacggcacaaucuuggcucacuucaaccucugccucccagguucaagcaauucuccugccuccgccucccaaguagcugggauuacaggcgcacacuacggcacccggcuaauuuuguauuuuuaguagacccgguuuuaccauguuggacaggguggucucaaacuccugaccucaggugauccgccugccucggccucccaaagugcugggauuacaggggugagccaccacgcccagccagccauacaguauuuaaccacauucuuuuuucuuuuauugguacauaauacuuuacauauuuauggggcacauguugagugucacacgcauagacuguggacuaaucaagucaggguauuugcgguauccaucaccuucaguauuuauuauuuuuauguguugguaucaaguccucucuucuacuuacuuugaaauauacaaaacauuguugcuaaguauagucacccuauucugcuaucaaacauuagaauuuauuuccucuaacuauagauuuguauccauaacaaaacucucuucauccccucugccacccacuuaccccucccagucucucguaucuaucauucuauucucuauguccaugagauuaacuuuuuagcacccacaauuaaaugagaacaugcaguauuugucuuuuugugccuggcuuauuuugcuuaacauaaugucuuccaguuccauccauguugcugcaaaugacaggauuucauucuuuauuauggccaaauacuauucuauuauguauauguaccacauuuuauuuauccauuaguccacugauggauacuuagguugauuccauaucuuugcuauugugaauagugcugugauaaacacacgaaugcagaucccuuugauaucuugauuucuuuuccuuuaaauagguacccaguagugggacugcugaaucauacgguagugcuaguucccucccucccuuccuuccuuccuuuccuuccuucuccuuccuucuccuuccuuucuuccuuccuuccuuccuucgagauggagccucauucuuguugcacaggcuggagugcaguggcgccaucucggcucacugcaaccucugccuccuggguucaagcgauucuccugccucagccuccccaguagcugggauuacaggcacccgccaccacgcccagcuaauuuuuguauuuuuaguagagacgggguuucaccauguuggccaggcuggucucgaacuccugaccucaggugauucaccugucuugaccuuccaaagugcugggauuacaggugugagccaccacgccuggcuaguuuucauuuuuuaagaaauuuccauacuguuuuccauagugguuauauuaauuuacauucucaucaacaauguaugguucccuuuucucugcauccuggccggcaucuguuauuuaugucuuuuuuuuuuuuuuuuuuugagacagagucucacucugucccccaggauggagugcaauggcaugaucucggcucacugcaaccucuaccuccuggguucaagcaauccuucugccucagcuucccaaguugcugggauuacaggugcccaccaccaugcccagcuaauuuuuggauuuuuaguagagacgggauuucaucauguucgccaggcuggucucaaacuccugaccucaaaugauccgccugcggaggccucccaaaguccugggauuacaggcaugagccacugugccuggccuuuuuaauaauagccauuuuaacuggggugagaugauaucucauugugugguuuugauuugcauuucccugaugauuagugauguugagcauauuuucacauaucuguuggccauuuguguguccucuuuugagaaauaucuguucauguccuuugcccaauauuuuguuuuuguuuuuuguuuuuguuuuggagacggagucuccugaccucguaauccgcccaccuuggccucccaaagugcugggauuacaggcgugagccacugcgcccagccccuuugcccaauauuuuaauggaauuauuuguuuuucuacuguugaguuguucgaguuccuuguauauacuggacauuauuaguccccugauggauaaguaguuugcaaauauuuucucccauucaagaggcugucucuucacucaguuguuuguuguuguuuugcugugcaggagcuuuuuaguuuaauauagucuuccuggucuauuguuguuuuuguuuccuggcuuuugaggucuuaaccauaaaauuguugccuagaccaauauccugaggaguuuucccuauguuuucuucuaguaauuuuauacuucugggucuuacauuuaaguuuuuacuccaccuugaguaaauuuuuggauaugagagauggguguccaauuucauuauucuguauaagguuaucuaguuuucucagcaccauuuauugaagagaguguccuuuccccaguguauguucuugauggccuugucaaagaucaguuggcuauaaauaugugaauuuauuucuggguuugcuauucuguuccauugaucuauauaucuauuuuuauaccaauacuguguuguuuugguuacuauagccuuacaauauauuuugaagucagguaaugugaugccucuagcuuuguucuuuuugcuugagauugcuuuggcuauucuggcucuuuuuuaguuccacauuaauuuuaggauugcuuuuuauauuucugugaaaaaugauguugguauuuugauagaaagugcauugaaucuguagauugcuuugagcaauauggucauuuuaacaauauuaauucuucugauccaugaacacgggauaucuauuuuuguguccucuuuaauuucuuucaucgauguuuuauaguuuucaguguaaagguuuucacuucuuugguuaaguuuauuucuagauuucuuuguagcuauuguaaauggaauugccuucuugauuucuuuuaaccacauccucguuucaguuucccaugggcauucuuuggguacaguugcucagccacuuaugaauuuuuaaccauauugucaccucuccuguauuacaucucauccacaucaaugacaugaaaagcauugucacaugccucacuuacuuccacauaguguauccaccauuuccccugcucuaccagucuggugacccuacccaaacaggaaauuaggucagucuggaauuacuuguuccagaggguuccuggagaucacuauuucucuggguaacugccauacgccuuauguuuaaauauucuagaacacuaugcuaucagugcugucagugucacuaggcuauaguucccagagacuucuuccuuauuugaaaacagauuguguuugcucuucuccagccuuucaacguuuuugucuuuaugccaggauuuuuucugggucggaaaauuugaacuuauuuacaauagcuggggccucuccuacugucucagcauuuagaccgaccuuuauauuucccuuuaccauucuuacuuauucuaccgauuccaaucugauguguauuuuccuugacagacuaugggagcgauauagaaugggagugauuguugaggucccagccugccaaauaaggucuuugugauauguguuguggccuuauaaucaacagcucugcaacuguagugcuuaaaagacuuucuguaauuuggagauggugucuccagauggcagccaugugucacugccacaggcucaaaaguaaugcuggaagccccaagaguaguguuuacugaagaaaagauuucucacugucaucugucuucauucuccaguugcacucagaaagaggcucuagccuuucuuuguuccuuuggugucucaucuacuucuuuuuuuuuuuuuucaaagcuuuuuuuuuuucccccuuaggaugugggaacugagucaacucacauggggcuuuagccuucccaacccuaggccaacagacccgugccaugcugugugugugcauccuugggcaggcggcccucugcuuguuuauaugugccccuuuaaacucugaacccacuaaagagucauuuauuuuguauagccugugaggcaucuuuaugaugccuuuaugauuuaacagccuuauaaccuuuugugcucaguacugaacugggauuggacuuuaauuccuaagaagccuucuuccuucuuugaugucacauucccuuccucucucuaguuuacauuuuuguauuauccuuuaaauuuuuauuuuaaacauacauacagaaaaacucacucuuuuugguguacaguucugugaguuuugacaacugcauagggucacauaacucccaccacaguaugagacaguuccaucacuucaaaaucuugcccagugcuuccccuuugauguuauucccuaccucuaccccuaaucucuggcaaacacugaucuguacucugucacuguauuuuugccuaugucccuauauuuuuguuauauaaauggaacucuacaguauguaguuuuucaaguguggcuucuuucacgucccaaaauaaauuugagauugauugauguuguugcauguaucagcacuucauucuuuuguaugaauacaccacaguuaguuuagccauucacccauagaaagacauuugaggcugggcgcgguggcucaugccugugaucccagcacuuuaggaggccaaggcgagcagauuaagaagucaagagaucgagaccauucuagccaacaaggugaaaccccgucucuacuaaaaauacaaaaauuaaauacaaaaauuagcugggcgugguggcaggcgccuguagucccagcuacucgggaggcugaggcaggagaaucaagcuugaacccaggagguggagguugccgugagccgagauugcaccacugcacuccagccuggugacagagggagacuccgucucaaaaaaaaaaaaagaaaagagaagaaagaaagacauuugagauuugaguuguuuccagcuuuuggcaauuaugaauaaagcuacuuuuaacucucguguacaggauuuuguguggacacagguuuuuauuucacuggcauaaauaccuuuaagugggauugcagagucguaugguaaguguaccuuucuuuauaagaagguagguguuaccuuuauaagaaauagccaaaauauuuuccaaaguggcuguauuuuugcauuuccaccagccauauaugagaauuccaguuucucuccaucuucacaaacacuugguauuaccaguuuuuuuuaaggauacccucccugauggauauauaaguaguaucucauuaugauuuuaacuugcauuucccaaaugauuaaugaugcugaacaucuuuucaugugcuuauuugccaucgguguagccuauucagugccaugugugcuuauaucuuuuguccauguucuaacuggauuguuugcuuuuucaauguuuugagaguucuuucuauauuuuaaauacuagucccuuuuauggcuuugucuuuucacagagcaauuuuuaauuuugacaagguccaauuuguuaauucauuaauuuauuuauuaaaauuuaauucuucuggccgggcgcaguggcucacgccuguaaucgcagcacuuuggaaggccgaggcaggaggaucacaaggucaggagaucgagaccauccuggcuaacacagugaaaucucgucucuacuaaaauacaaaaacuuagccaggcaugauggcaggcgccuguagucccagcuacucaggaggcugaggcaggagaauggcgugaacgugggaggcggagcuugcagugagcugagauuacgccacugcacuccagccugggcgagagugagacuccgucucaaaaaaacaaauuuuaauuuuucuuuuauuaauucugcuguuggugucauaccucagaccacuuugcuuagcccuaaaucccagugaccuucuccuguuuuuucaaguccaugaucccauuugaguuaauuuuuguauaaggugugagacuuaggucgaggugggguuuuuuuuuuuuuuuuuuuuuuuuuugcauauggaaguacaagugcuccagcaccguuuguuugaaggcuaucuuucuuccacuuaauuguuuuugcacuuuugucaaaaaucauuucaacacaccuguguggguuuacuucugggcucucuauuuuuuuccauugaccuauuugucuuuucaccaacaccacacugucuugauuacuauacuucuagcuugccuuucuucuauugcuacagucccccgaugguguuauacauuaaauauccaggauggagaagccacaugcuacucaccgaagggaggaaauuaucacagcagccugggcacgcguugugagcucuccugugaccggggcuuucgauugauuggaaggaggucggugcaaugccugccaagccgucguuggucuggaacugccuacugcaggcguaaguugugugugugcauaugcugauguauguaugcgagagaagccagccagccagcugcugaggguauaugcccggagguguuacuaauaugcccuucucucaaguacaaauugagaauauuccauaagccccccagcagggccuuuccccauucuaacauucgaguuccauuucucuggguuacugcccaggcaauaugagcauuuaacuagcaacaagcucuucugucucggggagcccaggagugcacagccagagcuaaggcuugggccugaggucuguuguggaccuagaucuucuucuggagcuccuaaggauguguggucuuagacucuuuuccacuuguggucaacugcuguaauuccuggccuguagccuuagaagaccuuggcaguggagcugugaaacaugugcuauucuuaauuuucuucuggaagucagaagaaaaaucccuaagucuagaaugugaaagugcugauauacacacauuccaaaucacgucccccuucagcuuccaaaucucuaccucuuacucaaguuccauagccuuuuagcagcugaacuuuuccuguccauauguccauggcagaacaccacuuguaggacacccauguaugcgcagcccuguauuggucacuuccuguguuacucaauucuucaaguacucccaggcugcuuauagaugaaugggauagaaacacaaaugugugcacaucagugugguguaacuggaugcagaagugcugagcauucauauagaaauggggcuggucagagaagacgcuguagacgagaaaagaagcuugauagccagaaagcaggcagucaccacaccccucucggugacuggaauuaaauuguuucaggacuuagaccccaacauuuucaacaggaauuugaaucggucugacacaauugaaaaauauaggucuguaaaguacaagugaacacaaaaccaauuaaaauaauggugacauacauauuuccaggugccuacaaugagucaauuacuacauuugagcacugaaucuagcuuugacuuuccucauaagagacaaaagggcaaaugcuuuggaucuaucauuuuuccugucauaugauacuaagcaaacacauucaucugaagagacaaaucuuuugcccugauuucaaaaaggucauuuuugcauaggucuuuacaaagggacacuggaaaacagaaaaugcaauaaucuuuaagucugguuugccaagcaacaaaaugaacauagcuuauacagaucuuuauucaaagcuccaacaauugaacuuaggcaggacuagaaguuagacaaccuaaaggaauauauggccuccuucucucaaguaucagguaucuccaacaauacuuuggcaagcauaggcucacaauuaauccauggugacaggcuccaccucugccacacgugguguccaaggcacauggauuccucuuuuaccaaauaccacaccuggcccuccaggcacuggucugacuuguauucuugcccagacagagagucagcccaaguuggcauguaagugagccucagcugagcaguaccuaugggagccccaaaauuauauugaguaugccuggaggagaaaagaagcuuugaacgugcucaagggcaucuagcauuugaggaauaagagacaaaaauuaacaguugcuaaggcccuaaaugagcccagaggauauaugcauugucuuuuuuaauuuauacaacaauccuaugagguauccacauuucacugaagaaaacacugagacucaaagagaugaggcaacuucuuaaaguuacagagcuaguaagagguagaacugggaugcaaagucaggucugauuuuuuuuuuuuuuuuacucuugauaaguuguuuuccuucccccucuaaaauagauucuauuuguuuagagaaguuuuaaguucacagcaaaauugaaugaaagauacagauauuucccauuuauccccagcacccacacauguacagccuccccuguugucaacaucccccaccagagugguacauuuuuuacaguugacgaacauaaauuaauacaucauugucaccugaauuccauagauuauauuaaggcccacucuuguuguauauucuauggauuuugacaauguacaguguuaggucugauuuugaagucuauaugcuuggacaaguaauuuacuuuuuugacaccccccugcccaagggugcugcuauacuuuaugaaaauacaaagacaauuagggaaaaaggcaguuaggcacaaaaauguaagggcaguucagguaggguuucuguauuuucugcucuuucugauguuucucccugugcuagaugcccaggcaucaccuccagauagucgcacaagccacugagcuugccacuugguuuucucuuagagaugagaugccacgcacuaccauucaucacuaguggcacuuacaccugcacaaauggagugcuucuugacucucgcugugacuacagcuguuccaguggcuaccaccuggaaggugaucgcagccgaaucugcauggaagaugggagauggaguggaggcgagccuguauguguagguaaaugcugguugcucccaguuguccuggugcaaagagccaccccagcauuauaucgacaaaagauguggaauucucaccacagaaggcauuccucuuagcuaugaggguggcacccuggguauuugcuaaacaaaaugaucuucuccccugaaguugcgcuuccuuccccaguuuccuugagcaccuugaacuuuuuaucuacccagugguguguggcauugcuucaguggauucccuccagggaaagcaaggggcccacgagucagcacuugauuuuucaucuuggcagacauagauccccccaagauccgcuguccccacucacgugagaagauggcagagccagagaaauugacugcucgaguauacugggacccaccguuggugaaagauucugcugaugguaccaucaccaggugagccugaauaauggaugccccuuaugccuucccucggcuucucucagucauucaggcuggucacauugaaacugcacaggcuaaggugacaguggggaugugccucagacuucaauucuaagggucucuuuccucaguguuuauuucacccugucccaugcagggugacacuucggggcccugagccuggcucucacuuucccgaaggagagcaugugauucguuacacugccuaugaccgagccuacaaccgggccagcugcaaguucauugugaaaguacaaggucagaaagaauuauuuaguuuccauauuguucauuaauccugcucuacccugacccaccccaugucucuccucucuaugccuggaagagacacaccucauuuauacugggagaggagaaaaacaaguucaccaaacaggcuuauuuaggaagccagcguuacaugugcauacauauguuucugaaaccuugacucuccaacaagacucucaucaacaagacucucauuauccuaaauccagauaaaauccacaaggauauucuuuauccauuucuuuucuuagacuucaaaaugaucacauguaaucagccaucauucugucguucaccucugauaaaacuggugguguuggcugccugauucuuccucuuugcuuuguguuguauuguuuuguuuugcuuuucucauuauaaaaauaauucaugcuuauuguugaacauuugauaaauaaagaaauauauaaagggggaaaaucuauuaccccaucauccagaggcaacugcuauuaacuuuuugguauuuuccuuccagucuuuuuucuauacauacuuuaaaaaauauauaguugagauuguacuguacauccauaaaucauccuuuucacuuuucauuaacaaaguaauuuucccauguuauuuaaaaauucuucagaaauauuuuuaaugacagcauaauauucuacucuaaaaauauaucguaauuugcuuaacccuucucccaccaaugaacauuuaagauuccuccaacuuauuucuguuauuaagaggaauucugcaagguagucaucuuuacacagcauguccauaaagucuggaaacagaugguaauauuuucuuuuaaagauugucagucuuuugauaacaacauguauauucaccuguguuuccagacuuuacaaaccuuugucugcauuucagauuuaauuccuuaagaaaggaaaauuccagcucuauccccagccaguggaaauacagaaaagccauuuuucugaucauccuaagucuucugaucuagaaagcccagcaugggcacccucuuagccuuuccuucuuauaagaaacaccauaacuucuaacuugagcuccucccugacagugagacgcugcccaacucugaaaccuccgcagcacggcuaccucaccugcaccucagcgggggacaacuauggugccaccugugaauaccacugugauggcgguuaugaucgccaggggacacccucccgggucugucaguccagccgccaguggucagguucaccaccaaucugugcucgugagugaaaccggggaauggggcaaguggauguggugaucaggggaacuuuggaggaucuuccucauggacagggguccaauaacaauguauaugaugugggaaagggggguucugggaugugucuaauuuaaaggccaacauucccccguagacuacuccuaccccaagaagaaggguuuaaaaucucuaaguguucuuuuaggauuucccccaagggaugggagaaacagccagagagagguaaccugaaagacuggaacaccucaagauguuagguuaccuaagcugggauggaggagaaagccguacucugacuggucaccugcuucugcccuagcuaugaagauuaacgucaacgucaacucagcugcuggucucuuggaucaauucuaugagaaacagcgacuccucaucaucucagcuccugauccuuccaaccgauauuauaaaaugcagaucucuaugcuacagguaaggcccacuccccuaaagagggcuuagcuccuguaaauuaucccuuaccuuuuccaaaucagaguuguucucugcagcacaaaccuuaccuacuuccugaaacuuuuuguggauagcauuugaucaguuuuaccauagacauauuuagcacauuuaaaaaacuguuuuuacugaaaaggcaauaaagucacuggagugguggcugugacuugcagggagcugggugaaagaugggaagggaguguggcaaagcacucugaagagacuugcaagacagcuaugaucaaauguaaauguugggaauuaaguacauuuauguuuucaaggaauaacagcgcuaacaaacacuuaugcaguaagugcuauguagcuauccaguacugaucuauggguuuuacacauauucauccaauucucacaacaacccuuuggagguggauacuaucguuauccccauugaauaggugaggaaacugaugcauagagauuaagucacuugcccaaggucacuagcuaguaagugguggagcugggauugaacacagggagucuggcugcagaaucuguccucuuagccacuaccaguagcaaaaaagaaggaaaagcguuaugauaucucaaaguaaaaugagagaguugcauggcaguuuuuaacauaagagauaccuagccaaagccacugguagggagaggucgauaggacagaauaaauaugauuauggggacuuauaaaagaacaggcuagguuacugaagauaauucaggaugugcugacaagacuaagagaagcagcucuggggagcuacaaggggcuggauacccacgugggagaaaaagcuacuuaggaggcuucuaaagauugaaucuuagaaguugccuagugaauauucagaggcccaggauggaagcaguuuuacaaaaaaaaaaaaaaagaaaaaaaaaaaaaaaaggacccuggagggucuagaccaaaaagagggccuuauucaucuagagauccaaaaagacugacaaaggcaacaguuccuuuggaagcaagggaguaagaacaagaaaaggaaccugucagcaagcauagugacucugaggguaaggacuagaggggaagcccaaagaugaaacagagguggggugccggggaguauucaaggccucuuuaaaccucacccugguaaauggcuagcaggugauccugcaagacaaggcaggacagagaucugggguaggacugcaagcugcacugcccagugcaaggaagguaacaagggguaaugaaaagagcacugggcacaauuuuggagaaauccuggagaccgagcgaaggcccuggccagguagccuauugguaaagagcacacgcuugggcagggggcaucaguccucaguuugaaucuuggcucagcauguuauugucaccaccuggcuugugagggguguugugaagauuagauuaugucuacaaagcauuagguuuguguauucaauaaacaacagccauuaucauaucacauuggcuauccaucaagaacuuauguaauuuaaaaccuaugcaaagcuaaaugauuauguuccugcaauuuacucauugcauuucucuucucuaccccacuuuguguaacugguuucaguagaaugaaggaaacacuguuggggcaaguacuucaggaaugacagagggaacagguuguuguagaccccacagugugauugcgugaucauugggggagaaggagcuccuuucccacacugcuucauauggucccaggaggaaucagccaaguagccuuagguuugaacgcacagcucuguugcauaaaauguucugucucccucccagcaauccaccuguggacuggauuugcggcaugugaccaucauugaacuggugggacagccaccucaggagguggggcgcauccgggagcaacagcugucagccaacaucaucgaggagcucagguccaggcugggaggcugccaaacuuggggggagggggggcuggggcggggggagaaacccuaggcaggacacuggcaaaagcggacuauggggaaaccaucagacacuacucucuugcggcacuucuugcguuugaacucuuauggaugcauuagguaagaccagagaguaguuucuuuacuuugguagaacaucagaaucaaaugagggcuuaaaauacagaugaccaggccccauccuaaaccaccuuaggaaugugcuuuuacaaaggcaccugaggggacucugaagcacagccagggcugagacaguaaacccaaacuugacucagauaagccccugcucuuguuuucuggccucaucucuuugccuucagucuccaaaggagcaaaagccaucuuuuuuuuuuuuuuuuuuuugagacacaguuuugcucuugucgcccaggcuggagugcaauggcacgauuucagcucacugaaaccuccaccucccagauucaagugauucuccugccucagccucccgaguagcugggauuacaggugugcaccaccacacccagcuaauuuuuguauuuuuaguagagacagguuucgccauauuggccaggcuggucucaaacuccugaccucaggugaucugcccaccuccgccucccaaccugcugggauuacaggcaugagccaccaugccuggccgcaaaaggcaucuuuaagcacugaaaucugaguaagaucuaucaaauccuggggaagagaacauuagaggugacaggugauggaagaagugggucuuucucauuaucuauccaguaucacccuucuaaugccuucacauauauucagggccaauaaagccaucacugcucuguuuuagagcagugccucuaaaugauagagaaacuauaccugccucuagggcacagucucaguggggacagaaagauucaguccuaguuagagaagagacuagaaaacccucagagggagacugcagacuugcagcuacagauggaagaguuaaccagaagguauuuaucaaccuaagggcugccauguaugaugugcauacacagcacagucucugcagcggguggccccuggagucacccugugcagccugcacagcaauaugugauagcccugcuuaaaggggccuacaaugaaagcaccgccuguuaauaacaaaguuguugcagcugaggugaggaagggacagcuuagcagaacuagaugcauagaggcagcaagaguagaaucugaacacagaaaaacaaagcgacuugagacaggaaguagagggaauggggaccagggaugagguggggaaggaauuaguccaugaguggagcugcaaaaagucagaggguaguagagccuguggggaugggugcccagacaaggucucauaccucccugggcuguucucucuaggcaauuucagcgccucacucgcuccuacuucaacaugguguugauugacaagcaggguauugaccgagaccgcuacauggaaccugucacccccgaggaaaucuucacauucauugaugacuaccuacugagcaaucaggaguugacccagcgucgggagcaaagggacauaugcgagugaacuugagccagggcaugguuaaagucaagggaaaagcuccucuaguuagcugaaacugggaccuaauaaaaggaggaaauguuuucccacaguucuagggacaggacucugaggugggugaguuugacaaauccugcgguguuuccaggcauccuuuuaggacuguguaauaguuucccuagaagcuagguagggacugaggacaggccuugggcaguggguuggggguagaaguucuuccuuuccuaacccgggccccugcccagcucuccaaagucuuucagaaaaguaaauccuaaauucagugaugaacuggcuguuuuaacugguuccucuacccugaggugacagcagagggcagcacgagcacaacagaaaccagcuuacacuuuaagcaaguguagcuggauuuuccuuacaggaugagggguggguagcaggguacaaaacauccuuuuuuuuuuuuuuuugagacggagucuugccuugcgcccaggcuggagugcaguggcgcgaucuuggcucaccgcaagcuccgucuccuggguucaugccauucuccugccucagccucccgagaagcugggacuacaggcgcccaccaccacacccggcuaacguuuuguauuuuuaguagagacggguuuugaccauguuagccaggauggucucuaucuccugaccucgcgauccacccgccucggccucccaaagugcugggauuacaggcgugagccaccacgcccagcccaaaacauucuugaacuuguuugucauuuccccuucuagggcacugggcagcaaauguuaucugaaccauugcuucacuguuagaaaaacccugcagugggagagagcuugguaagauguauccaaucagagcagaauguucucuggggcccuccagcuggcucacgggcaagaaccccuucuuccugaggccucccguuucuguagcagaaggcaaacgauucucucccuuccucagaggaguccccagcuugu

SEQ ID NO: 19153 - RNA, 23443 nt, Homo sapiens
gggcucugcguccguuccgcccaggcccuuccggcucacgcgccguacggaagcgugcucagcgcugggcuugugcuccguacggaagugugcuuuggcgcaccggaagccgacucaacagagcuauggcggguuugacugugagagacccagcgguggaucguucucuacguucuguguucggugagaggaauucguuguagucaagcuucggggagggacuccccucugcaccuucuaucucaugaaucgcuaccggagccgcugacgguucggacgugcaguucucccugcuuauccuguagggcguccaaccugguggacucaugagcaaagagauauucccauucugccgaggucucguaggcuuuccgcaauaucaguggggaaguuagacuagcguucagcuucugugcguuucuccuuucaugagcuucaauuauucucuagaggagaaggcucacgguaacagcuccucacugucccguacuacuucucauccucugccccagaauacagacuauaugcugaggguauagauccuaguguccacuuacuguccucuccuaaggacuuucauccuuugcuuuuuaucuguaacauuuuagugcaucaauagugguagcggccaccugguguccugagauggcuuguaagugaaugaaugaaugaacuauuaagaucuccucagaggaauuuuaaaaaggaucgaaacgauucugaauuaucuuuuuggcugaaauaaguuguuuuuaaaaauacgugugauuauuuuagaguaccauuugaaagggacaugacaaaguaguucagaauacuuuuuaaacaucuuucacuacauucaucgucauucucccuuaaauguuguauguguggaaauacauaggaaccuguuuuaaaaauuauauuaaauaacauugauauuuuuuguagucacugaugagacuugcagaucuuuagguaaauaccagugccaaaguauuuauuugcaccaaaguuaaggaaaaucuaacacgugucagaucagucugagaacuaacauuugagaguaccuacacauuuuguauuuaguuucagugguauauuuccuuuguuaagaggucugaagaaauacaauggaauugggauuggagaacacuauuuugagucuuauauuugaugauauaaguuuacuuucucacuaaagaucuauguuauaaacucagaauuuuaauguuaccuauuuucuuccuuaguggggaacauuccuuaugaagcuacugaagagcaguugaaggacaucuuuucugagguuggaccuguuguuaguuucaggugagauccccuuuuccuucauggugggagcuucuuaaaaaucaccacagauuuggcucuuaguaauaauggcagguuuucuuuacuggugacuuuucacauacauuuuguucuuguaacagcuuuauugagauauaauugauacacuauacaauugacauuuauucuuaccuaaaauauguuuuuuucguuaaaaauguuuuuuaggcagggcauagugacucaagccuguaaucccagcacuuugggaggccgaggcaggcggaucaccuggggucaggaguucgagaccagccugaccaauguggugaaaccuugucucuacuaaaaauacaaaaauuagccgccgugguggcccaugccuguagucccagcuacucaggaggcugagacaggagaauugcuugaacccgggaggcagagauagcagugagccaagaucaugccacugcacuccagccugggcaacagagcaagacuccaucucaggaaaaaaaaaaaaaaaguuuuaaaaaauauuucugugaggcugucagagauauaagguuauuuauguuacagugggcccaauuaaagcauggcaauguuagcaggaacccuguauguguguaacauuuguuccugacacuugguucugcucuccagauugguauacgauagagagacaggaaagccaaaggguuauggcuucugugaauaccaagaccaagagacagcacuuagugccaugcggaaccugaaugggcgcgaauucagugggagagcacuucgaguggacaaugcugccagugaaaagaacaaagaagagcugaagagugaguacaaauccaacuuggaugcaguaugaguuaguaaagauguaacaaugaagauuuuccauuucugauauguuuuagaauaugcugaaaugguuagccacgcagcuuguuuauuacuugacugaccugaugugccugaguuaggcaaguauuauauauaucuuuuuaaaaacuuuuuauaaauuuuuuuucaaguaauugucugaaauuucuauacccuugcucuggauggagcagggcaaggccucaaaccguuucaaaacuguucuggcaagcacuguagggaugcauagggucacugcagaccuaagcaugcuggaggcuugcuaguaaguguauaucuuuaagaaacagauaaaguugacauuagaaauucuucaguugcuccagccugggcgacagagugagacucugucucaaaaaaaaaaaaaaaaaaaagaauuuccauugcuaaggaguuauuuccaguuaaagaugaauucaaauucaucaagccauuaguaguacuaacuguggcauuagucauuccugucacucuuuucaggaauuuuugaaguuagcguauuuuucucuuuuaaccuuuuguuucugaaaugacuuguuaaaagaagucaaugugccuaguucucuaacuuagguuaacauuguccuuccaugugaucaugauccccagcuuuccucugagaacagaaaauacacucucacuuuccuccacagaaacaagaggcuuucacaucauuuauuucucagcucuggagaaucuaaaauuaucagcugguucuuacagcagcccugaaaaguagauauuugaaaugauuuagcuuuuuguuuugccucccuaacuuucuuguacuuucuucuugauuaggccuuggcacuggugccccugucauugagucaccuuauggagagaccaucaguccugaggaugccccugaguccauuagcaaagcaguugccagccuuccaccagagcagauguuugagcugaugaaacaaaugaaggugggaggaggcauuagguuaugaauaaagcaaaucacaucagguuuucaaggaguuacuugaauuaguucccugagcucaaauagaaauugucuguagaccaccauuucuugcaccuucaauauucuguauguacacaguauauuuuacauuuuguacaaagagcuuucuauuuuuguacacaaacacagcuauccaaacaauccagcuggaguuuuguggcccauagaugucagauguagauauuaaaauuuggcuuuuuuccuaaaugauaauaucacaguauuugaaaugccucuuucuucucuugccugccaugaccaagguuuuuuugugccaugcaaaaacuaaugauaaagagccucuugaauauuacauuucucagaggggaauggcucuaaaucacuaucaguuucuaagucauaaguauuaaaccugaaucugcuuaucuucucagcucuguguccagaauaguccccaggaggcacggaacauguuacuucagaacccucaacuggcuuaugcuuugcugcaagcacagguagugaugagaauuguggauccggaaauugcccuggugagugcuucugguucuuuuauggaaauggucggguaaaccuugaaugggauaggaacuaccugauugcuuuguuaaacagacagcucauagguuugucuuuucacuuuuuagaaaauucugcaucgccagacaaauaucccaacgcugauugcaggcaacccucagccaguccauggugcugggccuggcucaggauccaaugugucaaugaaccagcagaauccucaggccccucaggcccagucuuugguagggcuuuaucccuuaacauuuuuuuguaucugucuuagaaugucauuuucuuuuuaggagaauauauugaaagaagaauggucaggaaccagagaugauaauuucaauuuccaggcauaaaagcaauuuccagguugcagagcacaugacaucugaaugaauauagauucgauuccaaguuuguaaaacaaagagauccuucccguaugcccuuuucuuauaagcuaacuuuguguguaugugcaugccuggcacugugguuggcacuucguuauuccauaugcauuaucucauuuaauccucaaagcaauuguaugagguuggcacucuuauuaucuccauucuuacugaugaaaaaaguaaagcuugcuuucaaagcaugacacaaaaccuuaaagccauaaaaaauugauacauuugaaaacuaaaaaauuucuauauaaagaaaaaaauaaguaucaaagacaugacaaauugagaaaaaguauuuaccacacaugugauggaaaacagacuaauaaagagcccauagucauucacaagaauguuuauugccuuagagugaaaaauuggaaauguccuaaauguacgucaguggaagaauggagaaaaugugugguacauucauccagugaaauacuguacaacaguuaaauaaacuacacguaucaacaugaaugacuuugaaaaacauaauuccauacagcaguuaagaugaacuaggauacauaauaucaacacaacuccaaaacagugacauacggacaugaaacuaagugaauauggaugcauucccgaaauguaggauauauguuucugcauaaauccccaaaauauguggaaugaguugcaaaauaauauauugaguauguaaugauucauauaaaauuuugaaacauuaagaagacgucuuaguggucaucaaaggagaagagagcacaggaugcaauuggggaagaccguacaggccauugguuuauuuuauuuacuuauuuauuuccuaagcuggguggcuauuuuauuuucuauaugauuuguauaucuguaauuuuucauaauaaauuuuaaaaggccuccuauaaauuaguaagaaaauuuccaauaacccaguagaaaaaugggaaauagacauaaauauuucacaaaaggagaaauauaaauauauaaaaauuuauucaacuucaaaauaagauaauguaauaaauuaucauuuauauauguaauguuauaagauaauguaaauagaaacuacaauaagcuaccauuuuucaucucucagguuggcagagguacagggcagggaccagcaaacauuuuucuguaaaugaucagacaguaaauauuuuuggcuuugcaagucacaggaucugccacagcuacucugccaugguaguaugaaaucagccauaggcaauaagugaacaagugugugugguuguguuccguuaaaaguuuguuuauaaaaccaggcagugagcccgauuuggcccaugggucauaguuugccaaccccugcucuaaauaaauaaauacauuuucagagauagaaaaaaaaagcuaaggcccagagagguuagcugguccaaaaauugacacaauuauaaguggcagaucuauuucugaaccugguuuuaucugaccucacagccaguuuucucuuaacuacuuuccuauacagcucuuccuuuucuuuuguagaguuuuguguuccuuaaacguauaugugauuuuuuuuauauaacuuggcuuuuauucuuuauuuauugagcuguuucuaauucaagggacuacucaguuuuuuggggaaugcacagaugaaaagaugacauucucuuuuucucaacgaguuuuaauguagcauuuaaaaaaauauauuucacauucccccaaaaccagaauuauaucuaaggacaggagugagaaaagauugguuaaauuaaaaaaaaaauuuaauuuuaaaaauguggacuaccagcaguuguuuuuuuuaaaagagucccagucuccuuuuauguuucuuggguuuagggcuuuuuuuuuuuuuuuuuuuuacucuuauuggcagccccaaucaugaaguuaacaguagguguuaugugcugccuugccacacagauaagacuugucaaucucuacauugagaauauguuccaucuuaaccguguuccauauaaccaggcucaugacguauauugcuucuguggaguuuaaagugugugacaaaucuaaugcugcauaagacaugccauacaaaaaggauguuuaguaguguauuuggggcuguucauuugaagaggacuuuuaaggucguagacuuaguauauugaguauccacagaggcauauacauacucuguuuuuuuugcuuggucaggguggaaugcaugucaauggcgcaccuccucugaugcaagcuucuaugcaggguggaguuccagcaccagggcaaaugccagcugcugucacaggaccuggcccugguuccuuagcuccuggagguaaguuucauuuagucuucaccauuucaguacuugcuaaaguuuugucauagccacuguugcagugcagccaaauaugauaaugggauccuuagguaaaauuaauacacagcuagaaaguauauaucuuagguggaggaaauaguagauuucuuacguuaaauccuguaugucuaauuauaagaacagggaaagggacaguaaagugaaagagcauaguaaaacuuccaaguuaacaagggggaaaauggaaugaguggaaacaaaaucaagccagcaaaaauagagaagaggaaaaaaguaagagacaguguaaaauaaguaauaauaaauguagaguaagauggaaggaauaaaaacuaauguaguuguuacucugcuaaauaugaaugaacugucagauuagguucaaaagcucaugaagaaaacagacaaaaaaauacaaggucacauuuguuauagcauauuaaacugacauaaaauuguauuuuaacaaacauaaucagaacaaacaacaaaagggaaaaagagaaauuuaaaagcuauguacauuuauugaaaauguauagaucggcaauuaauaagaguauugcucauauacuuguaacuguuccuuguucaacaauuguaacuaagaagauugagugaaauaaugauuccccauaugaaacaucuguaugaacacaugauguauuaccaauauuuaaaguuuuuuuauguaacaaacuugguuuuuguuaauuuaucuaaucuaggguagguugaguacaacacuacucauggagaaugauuuaauucuaaauuguucuguucuguagagaauccagucugcagagcuaaguugaugaggaauggaagaagagauuuuuugaagaaauuucugcaaacucaggaauuuuuuguaucuacuuuaggauuguuauguaucuacuuuauccuaauagaguuauacuuguauuuaaauuaucuuucaugacaggagguccauggguaagugacauuguuuuccuguauuauagaagagcuuccugccaagaguuugguaaccaaugaaaugaauuauucuuauugaacucacuauucugucacugaaacauaaaguacaaauuguaaauauacuaacaaaccccaucuucucucucauugcauuguugaauaucuuccuuuguagguuucugcuuguggagcagaaugaggaaauuuguaaacucagccacuguucuaauuuuucuuuuccgcuguucuaauugguguuuuuucuugucugcccuuuaucuucuaggaggaaugcaggcucagguuggaaugccaggaaguggaccaguguccauggaacgggggcaagguaaauaaauauuaaugucugacuaauguuaauuggucauggaaguguuccacauccacaguaucuaauauggcagccacuaaccacccauggcuauuucaauauuaaguuaauuaaaauuaaguaaaauuuaaaacucaguuccucagucacaauagccacauuccaagugcucaguggccacaggugacuaguggauaccauacaggacauuacagauauagaacauuucuaucaucguaaaaagaucuauuggacagugcuggucuagacuuuccaccuggugauucagaguccagcucuacaagaauugauaaugaagcaaguggaucguuuguuuccugauuccuagucuaauaauuccacugacauguucucucucccuguauggauaucuguugacugaguaaggaauuuuaauaaugagcauguaaauauguggcuggguauguagaagacuagauuuaaaccccagagaaaacugggagggaaucauaggucuguaacgccuacuuaaugaacauauguuguaccguggcuguacugcuauauacaacaguagcugcugcuccaaaaucuccauguuguuucuucauguuacuggaguuugaaggacaagaaagugcagugguucaguuggaaacaauguuaggaggagagaucguaagaaaagagaaggaacugagugcauacuauaugccaggcacuuuaauuuucauaaauaaucuugugaguuagguggcagcaccucaguuuuacaggcaaagaguuggaagcucagaauaaguuacuuucucaaggggacaagguaaguaaauauuaauguaugaguaauguggacuggauuuggugcucuuauuuucucuuccaacuaguaaguggcagagcuaagauucagaagucuuugacuccagaaucuguccucuuucugucacuccacacugccucuguuaacuuccaagcauauucuucagugucuucuacucuuauuccuugggaauaaaaugaugggaaagacugcuuuggacaagcauagagaagcuuaagguuuuuucuuuuguagcauaugguuuauaaguggaacccauuuaaaaagcaaaauauuggccaggcgcaguggcucaugccuguaaucccagcacuuugggaggcugagguggguggauugcuugagcucagagguuugaaacuagccuagacaacauggcaaaaccccgucucuauaaaaaauacaaaaacuaguugggcaaugguggugugcacuuguggucccagcuacuugggaggccgaaguggaaggaucacuugagcccaacagguugagacugcagugagccauaaucgggcaccacugcacuccagccugggcaacagagcaagacccugucucaaagaauauauauauauacacacacacacacauauauauacacacauacauacauaaacauuaauauacaagccugugguuuuuacacugggguugguugcugaagugacagaauuaacuuuuucuuguuagaagucugacagcaggacaaacucccuggccaaauaucucauauuuucucuaagcauccaaugcuuuugugcuauuguacaucccucuauccccaccgcaccacugucaauagaucauauauguuccccagaguauuucugcaguaaugagaagguauuaggguuucagucauacuucugccugucauggggccagcccucaauccaucagguuuuagcuguuuaacgcauacuugcacaagacaucuuccuauuauaguuaucuucaccuuuuugucagaaauuggcaaagggaagugacucauguuuugaggguauuuccaggaugucuucaugcagagacuaagugagaugagcuuucuuuuauaguuuccuucaguacccagcagaggaagcaagagucuuuucgugugugccuaguuugucuuacuuuuccugaaauccaugcugcuuuuaaugcugaaaggagauggagauguuugagaagauacuucuugcuucccugccauguuuguuuagugucgguucccaugucaucucauuagucuuuguuugcuguugucaugauguuuauuaucaaagacuugcuguggcagaguauuucuuguggagugauauucucuuucaucauguaaaguucauucacugcauuuccccaucugauacauuuuugacagcagaaauuuuugugcuuuaaaaugugacaaaaauagaauugccguacuucaguuauggccguuucagaaugaaucuugccuuccagauucagugcaguuucuuuuauguuuugcuucugaaacuacauuuauguucuuugcauaacuagaagauucaaaacuauccuuuuuauauauuuuuuuccuaaugauuucauaaggagaccuaacggaaaacuaguagcagaggugaaaaucgaaaaugucagguuauucccaccuagaucaaaccagugcccccaugggauucccuuucaaaagcuaucuggucaaaauggaacuauuucagagacccaaaggagcuaguguaguuuagggagauuuuguagccuggagcaagccgaugaacucuuggcuuuuuaacuuauauauguaaaucucaaucuccauguguguguguuucugcguguguaugcaagcuauuuuaagugucugcucuuucuccuuuugaacuuacugcuuaccuaggaacccuacagcacucgcccgugggacccgccgggccugcaucaauugagcgaguucaagguacccauuguaucuguggguuuccuuuugcuugugguguucagggugggacguugagaggaaaagagcugcguggcagucauccucgcguucagaacccaaaaggguaguguuuuuggguuuuuguuuuuuuaauuuuuuccuguugaggccacaagccuaagauugaccucuucacacagggcagagaacauggaugauaugggcaucuguccgaggcuguacucccucccuacuggugucaggaggcuuggauggaauagcagucuguaaggagacagcggguucuugcagagccauggcaguguucacauaugccaagacucuaccucuguuuugugacucugguccuugaacuaagauugauuagaaggaaaaccaggagcauaaguuucuccaggucgcagugcuaguccuuggcagguugcuccccaguuugcucuuuauauaauuccauccauaccucugacauggcacagauucugccuacacccugcuucuguucuugagcugcaagaggauucugcuguggugagguuucacccacucuaaggugucugaauuauguugucagugguauauagagucauuucuuguuugcuuaugugucuuucacagcaguaacuccccguuuguuucccugucagugccgaugcaagaccccagagcagcuaugcagcggggauccuugccugcgaaugucccaaccccucgaggcuuguuaggagaugcuccgaaugauccacggggaggcacuuuacuuucuguaacuggagagguagagccuagguaagcacuaacauagaaggaaacaguugaagaaaucagaauugucccuucuucccugagaacaaaaucuuucuguaccaguuguaccuguuugccuacuucaaaagguagaucaauauucauggccacuguccaaggguaagcacuucuccuaaggcagaacuauguacuugaguaugucauuuugagcuauuauauuuuuagaaauuggaaauuuuaguauacauacuugaacagggaaauuuauaguaguggaaauauuaauaauagcaauaauaggccgggugcaguggcugacgccuauaaucccaguacuuugggaggccaagguggguggaucacuugaggucaggaguucgagaccugccuggccuacauggugaaaucccaucucuacuaaaaauagaaaaauuagccgggcgugguggcgggcgccuauaauuacagcuacuggggaggcugaggcaggagaaucgcuugaacccaggagguggagguugcagugagccgaggucaugccacugcacuccagccugggcaacaagagugaaacuccauuucaaaaguaaauaaauaaauaaaauaaugauaguaauaauaauugacauuaauggggaucaugccucugacucugcucugaguacuuuacuuagaucaucuuauuaaauccacaagauccugugagauggauaccauuauuagucccauuuuacacgugaaacugauguguggaaaaguuaaauaauguguccaauaucacacagcuaauaagugauagagccuagauuugaacccauacagucugaauccagagcucauguucuuaugcauuguucugcaaacucauacauauaaugaauauucguugauuccucccuaauuaugaaccaaauaacgaaauucuagaauacauggauuuauaucucuguagcuuuucuuccaucuauuugguguuauuuucuuguuaguauucauagacuacaucagcucuuuguuggauguuuacuuacugaucugguugguacuuuguuguuguuuuguucuauuuuaaaauacaacguuuuucuccaucuccagagguuacuugggaccaccucaucaggguccacccaugcaccaugucccuggccaugagagccgaggaccacccccacaugaacugaggggagggccauuacccgagcccagaccucuaauggcagaaccaagaggacccaugcuagaucagagggguccacccuuggauggcagagguaaggggagaucacauugcaaaugccauaaugaacucaacugucuuaggcucuaaucugggauaaagaaugcuggaacaguagguuugcaagcaucuuuaagguuuauccacaaaucugagaaacuggggaggagacaauagucucauauguuaauagcugaggggacaaaugugacuagaagagauuucuaucuuucuuggauuguucaucauucuugcaguacaugcaaguagcuacauaaugguuuuguuacauuuuucuuuauagguggaagggauccccgaggaauagaugcacgagggauggaggcccgagccauggaggcaagaggguuagaugccagaggauuagaggcccgugcaauggaggcccgugcgauggaagcucgugcaauggaggcccgagcgauggaggcccgugcaauggaaguccgagggauggaggccagaggcauggauaccagaggcccagugccuggccccagaggaccuauaccuaguggaaugcagggucccaguccaauuaacaugggggcgguugucccccagggauccagacagguauguguaacacugacuucuggcauccaagugaaaucuugaucuauucaggaauugauuauugagccuaauuauuacugccuucugacuugggcuguuucuuagcuuguuagaaagggaagacuuggaucucccuguagcuucucugucccuuaggguggugauuuucuggcuaucaggauuguaguucaaaaaaaaacaaccuuaucccacaauaaauagcuauucauuuggagcagagccccugaaaauuuagggguuagaaaguagucuugauugggguacaaaccaacaucauguacacgguuuuuuccaagauauacuugcccggaucucauccgagguauaacucagaaucucuuauuaguaggaucugagcauggauaguuugaaaaacuucccccaaaugauucuaaugugaacccugacugggaaccacuggguuagaguauaugaagagcuguuaguggccauuuagauaaucuuagguuuagagagaccuguguuaauuuauugucaucacauagccuaagugaacaguggaaugugaaaggcaguuuauuaauaaucaccuuaaaagguguggaaccgaagucuugucuccucucuuuuauuuggaucucucugccuguguguacaugcucccucuucaucucgacuugguuguggagaggugguauguguguuucuuccgugaguuuuuauaugcuggcaccuucauuucccucuaacugcuccaccuuccuuuuccccccuuccucugcguacuucucucuucuuuuuuuaugugucuuccuccccaugucuguguguaugagagagagaaagauaauggcagagcuggaauggaauacaucaaucaucuaauucccucaguuuauagauuuggaaauuaaggcccaagaauucaggugacuugaccaaauucacaugacuaaaaaguggcagagcaaggaacagaagccacuacuuuuuccacuuuacuacucuguccuguuaucugcacauuuguguguguguauauguguggauaugugucuacccccuccucuguaauaugaaauacaaauagaggguuuuuuugcuauguguagaauaaaacuguucucuauuguguuugaaguguuugugggccuugauuuuuauuguacucucuauggucaguagccuaguaacagaaaugguuuuuaugcauucauucugucacucagcaaauauuuauugagcaccuacuauguaccaaacauagaucuagguacgggggauacugcagugugaacagaacaaagccccuucccccaugggcuuacauucuaguugggaagacagauaacaaacaaauaacuacauaaugcgcuuacauaauuuuacugguaguucuaugaugcaagacauugcaaguaaggguuggaagaacauuucuggauaauauuuugcuccuuucucucugcugguacuugaacuuauuacccuaauacuagguuuauaccauuuuuauuaguagauucgauaaagccaauuagaucugaggcaagagaaaauacaaauuuuaucuucaaaccuuuaaaaaaauuuuaaauuaauauauuaacuuauaaauauauauauucguucaucuauaaaagauauauguauuaagaacuucaagccaggcauggugacaugcaccuguagugccagcacucuggaggcuggggcaggaagaccauuuaagucuaggaacuugaggcuguggugcauucugaucgcaccugugacuagccacugcacuccagccugggcagcauauuagacucccaucuuuaaaaaaaaaaaaaaagccaggguagaauccuguagucccagcuacucuggaggcuaaggcaggaggaucaguagagcccaggaguuggaggcccgccuacacaagauagugagaccacaucuuaaacuaaaaggaaccuugcuuccucuccuaugcuugucuccccuguggcccucuagguccuguagauaaucacuuuuauuagauuuuucauguuacuuucuggaaaacaugaauauauauuauuuuuccccuuucacuguucuauaccuuuuuuuuuuuuaacuuaacaacauguccuuaauucauacuuuuaaauuagauuuuaaaauuaacucuaguccacuuaguuagaaacuugugggcaaaaggcuuauuauuacuagggugauuauauaauuuaucaucuaaaggagaacaugaaagaaagugcuguuacuuuacuuggaggcaaaaacauaaacugggacuaucuuagggaaaccaagauguauggucacuuuugcuaguacuugucugccuagaacaagcacaccuagaaacuuaaaauggccguuauugagugguuagaucacaauuacaguaccucagauuaaagcuucaaaaagauuauacucaauuccgaauugugcugcuauaaacucaugugaccaaacaccaccuguuccccaauaaccuauggaaauaaaaaauuuuaaaaaaaaagauuauacucauagguguuucagacccauaauagcucguuaauguucagacuggucucuggaaacuugucucugguuucaguauugauaaugaacagaacagugauaauauucuagcagucuauacaaaucuguacuaauguuucaucuauccauugucuuugggaaaugaguuaaugcauguaagugaauguuccagauaauagaacuauucuaccaaguuuuuuaacuuuuuuaauaaaaaauuauaaaaaguauuugauauuuccuuucuugaacaggauacaaaaaaauaguuuaaucaguuuugacuacucaaggucaucauugaauagauucauuauugucuauaccguaauauaaaacauaguuaucuccuguuugguuucuggucuccuucacugucaggccgucaccuggcucuucauauuacugaagugguaucugcuccuaacaguuauuuauccguauuucuuuuauguuuugcugcuucuaaucugcuggguaagcagguaacaaguuuguuaacaauauguguuuauuaagagaguaccuaagcucugggugaaugccugagugugaacauaaugcuuguauagggacauucuaacaguuagauuugguacucaagaggucuuuuccuuggguucugguagucuugcaaaggguugaacucauugaagaucuuaaguaccaguaaguaugauaucacuguacuugguuuuuucacuccagucagucauauuuuuuggucuacauuuagcagaaagcaucugccauauguucucuauggaaagcuauaaacagcaaauguugggcuaauagcagucuuuuuccuggaggccuucccauugccuuucugccucucugacauuaugaacaucucugccucacuugugggauagggcccuuugggacaaacuaccuguaucugauugaacuaggguaggggguggcccugugaauguaacuuccccaguggaccagcauacauuuucucuagacucuguuggcuuucauuuguauuuccagugagcacuaguuuccaggguguucucaguuuucacugugcuuauuuggcugaauuuugauuaauucagugguauccaguugugcuguguaauauuuguugaugaugcuggagguguuguaagcaaguaugucgaacuugcuaguugaucucuggcuaaacccugccuucugcuauugcuaacaguagaaaaugaucuucagagucauugauuugcuuuuuuuacucauaucuguauagagaucauaauuugucacauuauuacugaauucagguuaccuauacauuaaaaaugccaaaaaucucucuuuucucuuuguacacauaggucccagucaugcagggaacaggaaugcaaggagcaaguauacaggguggaagccagccuggcggcuuuagucccgggcagaaccaagucacuccacaggaucaugagaagguaagcaacacugucugacugccuccuuaugcacaauucuagccuuuuugauuccucuuuucacaguuaccaugugacgauccugggucuucaaagucccuuuggaggugauguuuauucuaacuuagaacucuuuuaugaucuuguuaccugaaaauuugugagucugguccugaaguuccuaauggaugugaaguucuuaaguggauguaaauggcagcuuauuuuauauuucacacucaucugccaauagcagguuuuucuuguucaggccagauugaccugaaaauccacacccuuuuuccuucccuuucuacuuuaucccuaaaaacaauaguagauuccccaugauuauaucuuucuguuuuuauauuugaccauuguggggagcuuaugucugauggaaaggcuaaaauuugugaaaaagagagacuuucaaaacaggauuaaaacuugaaggauuuccagggcucacagauaccaucuuagucuccaggaacuuugaguucaugaaguugucuguuuugaaucgucuaaucuuagguauuuuaauuuauacuuguucuuuucauuguaccuuuucucaccaguuuuuuuuuauuuuuuauuuuuuuuggaggggggcuguugguuuuuuucugugugaaauguucuuccuuuuuccauuuugcuucauaucccacuacaguagcuuuuuggacagaagcuggugguggguuuuuuguuuuguuuuguauuuuuuagcugccaucauuaaaacucacuaccuuuuuuuuuuccucugcacaggcugcuuugauuaugcagguucuacaacugacugcagaccagauugccauguugccuccugagcaaaggcagaguauccugauuuuaaaggaacaaauacagaaauccacuggagcaccuugauaggugagcaaacuuaauccccaucugaguaggacuagcuccuugucuauucuggguauauacuuuuaaccuuaaccaacaagauuguucucucagcggcccucaauccacucagcuagacucuucuuuacccuucaguaggucagcuccuguagggauagaguaaggcuauacaauguuuguucaguuguugaauugcuuauaaucuuuccuaaugacaaagguaauguaugaucaguuuaacaaaaguaaucauauacagaaauguagaaggugaaagguaaaaagcccuguuuccucaaucucauuccccagacaaaaccucuaaauauaguuugguguguauccuucuacaaucaauuguauuauuuuauuccaaacuguccugucaaaauggaaaaauacaaagcauuucaauaaaauguguaaauauuuuguuucuuguauuuauuuuauagggaauauuuugauguugaacuauaguagcacauaauuuaagguaguaaauguccgucaucaccaucaguuucuauauauuuuggagaucgcuguacccugcuacccuuauuuuucuugcucaucauuuaggcagaaagaauccaggggccaagcacaguggcugagcccuguaaucucagcuuuggcaggcugagguggaaggauuacuugagaccaggaguucaagaccagccuaagcaacauagugagaccccaucuuuacaaaaauuuuuuaaaaaauuagccaggcauggugagaugcgccuauaguuccagcuacuugugaggccgaggugggaggacugguugaguccaggaggucagggcugcaguaagccaugauuaugccacugcacucuagccugggucacagagugagacucugugucaaaaaaaaaaaaaaaaaaggauccagguaaccugcuucauaaauaaucaugugacaacuugauuacacauacauguaucaguguuucuuuuuuaaaaaaaauuuccccagcauuuuguauuuuauaaacaguucuuuuuucuaaaaacaguuuaaaauucauguugccccacuaucagguaggacagcacaauuuaaauuucuacuuuuuaccccauccauauuauaauuccuauucuuauguuauauaauagugaacucauuuaacuauuaauaauuaccacucuuacaaaauauaucauuuuaauccauacuugugaugucuuuaaacauuuaaacugcgacuaugcaucauauauguauuuagaccuuaaaugaauuaaugagaagcuaucauagauagaaggcucaguagacuuuugguaccuuaacguuuuauuccacaaaccccacauauucuuuuuuuuuaguaaaaguauagacuaccuauuacauucagaggaauaaauaaaaauuauuucuuuuacuaauuuacuuaagccagagaaggcauucccuacaaugugagaaaauuacuccuuacuguuucuggauaguagagguagaaauguuucugaaauuucuuucauuauaguuuugcuuauaggauguuuaauuuaaggccuugcauauuaaccacaaggcaaaguuuuugucuauuuuuuuaccuuuuauuuuuaaauaaucauagacucaaggaaaguuggaaaaauaguacaaggagucucauguacccuucacccaguguagugcaaaaccaagaaauugacauuggcacauuacuguuaacuugacugcaaacucaguuuucaccauuuuaaaaaaacuaucaugauuuguguauauguaugugugguucuaugcaauuuuaugugggcaagauuuuauugugugucuacugguguuugugcauaccauggcuaaaguguuggguuuuccuccauccuauaccuagcuaguugugauccaucucugccaucauggacaggcuucuauacuguugucauuagagaugaaugguucucaaacaagggcaguuuugcccccuaggugacauugucuugagacguuuuuggucaucacaacuuuagggaguauggcaugcuacuggcauucaguggguagaggccagagauacugcuaaacaucccauaaugcacaggauggucccccucacccacuucccaauagcaacuaguacuccagcccaaaaugucaguagugcugagguugagaaacccugcugcaagggcugauugcuuugaggagucaggaggcaggagacagauacuuugcaaaucuguccuggugauuugauuauaugccuguccucccuccccuagccuuuuuauuuuuuuuccugaaguuuuuccggaagagagcuuugucuucacuucuaauggcuuuguccuaacuucuucuuacagguuuucaaaaauaccuggcaagaaaucuggaaauucuauaauuuuguugaaauauugaaaaaagaugaccugcauccuaacccuugaaugacucaaaucagugccagguggaggacucccaucaccuucucucagaacaaaaucacuucauuuuauugucuuaguuuguauauuuucugugacuugaaauaaacuuugaacacaauuuuaguacacugcaaauugauacacaugaccuuuuugcuuuuaaaaagcuuaacacuaagggugaaaccuuagauguguuuucuacccuuacugcaguauuguacuuuaacauauugccauaguuuuguuuuuaaguuaaccacuuauucuucuugaugauauuugagaauuucucagaagcaauguuuucuggaacuugguuuuuguuuaguuugcuuccaguaagaauuauuauaaggcuuugcccucugaaaauauucuagcacuucggagucuucuaggagaaaauaucacaugcuuagagcuauaaaauggucagaaggcuaacagagcaaagagccuagcacagcuguguguuuaguuuagaaaaauccaaauaucaaaaugcauuuguuucaauagcaggucugaacauguauaauucagaguuaagacaaaaauuguuuuagcacugguuugagugugucagcaacacaagagacuguugacauuuacuuguguguucuuaaacuuaucagucuaggcagucaacuuugaaaguuuaaaaagccacugauuuuucacaugcucaagaugaaauaaaaacagaaaucaaaugaacaaaauacauuucauccuaucuuccaggcagucccuaaccugcagcccuacccuguaacuacguuuauucugggaacuuacaacacagaaaacccuaaaacuuguacauucuucucauuuuaaguggaccaaauguagagcacagucagauugcucauuaggucugcuccugccugcuuccuugcggauagguaugaacauaauuagugccauuagcucuaaucuaugggucuuauugccuaguauuucucucucucgccgcgccgccgccuccuccucuccccccaccccaaccccaucucucucguaguggcauuaaggaggaacaugguuucucucuaucaggccaaccucaagagguuaagaguugccuuaauaaucaguaaaguucuacuggaacuacuuuugagccaauuuauauucuuggaauucuauccccuggguuaggauuauggucaggugaauuaaaagccuggcauaggcuuagagaauguaauagcauauugcuuacaugucaagcaaaagaaugcaaagauaaucaacuuuuugagugacaaugaaauugagggauuuucuacucauauaaacauuuauaagaaauuuguugauuaagguauuucauauuacaacuuugcaagaaaaacuugcucaaagcaggugaggagcuuucuguguauccugcucauccccaguucaacuuggauguuggcuaugcauaggauuuauuauauucauuaccaugaauauaaucacgaauuuaugccuacucccauaaauauucaagccuugggauauugauuuuggcagccaucauaucuugaagugagugugucaauauauuuagacauggagaccaagagugaugccuuucucauuaggaacucguuguaaguuucaagauuccaaaucaaggucauugaagaugaaguugucauuuggucaguaguugucuaauaagaaucaugucuucaagguuucauugugcauuuucccaaagccuuauuaaaccugaauuagcugaaauccgggugaacaaauuggcaacagcagugguaucccucccuauguaaacaaccaucaguauuguuuuacuguuguaauaaaugaaacaugauuagccaccaugaguucaugaccuaccuuuauugugcucagacuagugacaaaaaaaaaccaaaaacaguuuuaucccucaagccguagagguuccuaaacuauuagaaacaaccauuuguucauucguggucacuuaaugguagaaaaaauagauaauauaaugcuaauucaguacaaccauucuucuaaucuauaaugaguugaauugucugggcacaaugaagugugagguuucucucuuaagagcccugggcuucucuccuucuagggauucacugugacgacuaacaucccagagccagugugguccuuguaggccgagguuggguagauggcagaaauaaaaagcauucugauagagaaugaaggcauuuugcuuauguuauuagcugaaugauuccuuagcgauauagguaggaguccacaaaaaucuaugaaaauuauaaauuguuauuuuuuaaacuagacauuaauaaacucccuuaauagugauaaagagcuccucuugacuaaauaagucauccuaacauggaguucaaguuuucacaaucgcuuuuaacagaauaauacaagaugacaguauagcugacuugcaauuauaauacaauuucaauuacaaugagcauacuuucuagauuuucuuucccaaauggagagcccaaaaagaaguaacaaaagacucauucaucaagugaagaagaaaauccuuuauuuuuugaugagcaaaaauaagaauaaauugcuguucacacuggauaagaccauaucaaaagugacaguaaacauguacacuguugguguuauauggggaugggguucucgguaauuuuguuuauuauuuauguuuauuauuauguuuuaucauuaauuauucaauaaauuuuuauuuaaaaagucacccuacuuagaaaucuucugugggggugggagggacaaaagauuacaaaccaaaacucaggagaugguaacacuggaauugauaaaaucaccugggauuaguuguauaacucugaaccaccaaaccucugcuaucaagccuugcuacagucauggcuguccagaaagauuuacaguuauuuuucugagaaaggauccaug

SEQ ID NO: 19154 - RNA, 23443 nt, Homo sapiens
cauggauccuuucucagaaaaauaacuguaaaucuuucuggacagccaugacuguagcaaggcuugauagcagagguuuggugguucagaguuauacaacuaaucccaggugauuuuaucaauuccaguguuaccaucuccugaguuuugguuuguaaucuuuugucccucccacccccacagaagauuucuaaguagggugacuuuuuaaauaaaaauuuauugaauaauuaaugauaaaacauaauaauaaacauaaauaauaaacaaaauuaccgagaaccccauccccauauaacaccaacaguguacauguuuacugucacuuuugauauggucuuauccagugugaacagcaauuuauucuuauuuuugcucaucaaaaaauaaaggauuuucuucuucacuugaugaaugagucuuuuguuacuucuuuuugggcucuccauuugggaaagaaaaucuagaaaguaugcucauuguaauugaaauuguauuauaauugcaagucagcuauacugucaucuuguauuauucuguuaaaagcgauugugaaaacuugaacuccauguuaggaugacuuauuuagucaagaggagcucuuuaucacuauuaagggaguuuauuaaugucuaguuuaaaaaauaacaauuuauaauuuucauagauuuuuguggacuccuaccuauaucgcuaaggaaucauucagcuaauaacauaagcaaaaugccuucauucucuaucagaaugcuuuuuauuucugccaucuacccaaccucggccuacaaggaccacacuggcucugggauguuagucgucacagugaaucccuagaaggagagaagcccagggcucuuaagagagaaaccucacacuucauugugcccagacaauucaacucauuauagauuagaagaaugguuguacugaauuagcauuauauuaucuauuuuuucuaccauuaagugaccacgaaugaacaaaugguuguuucuaauaguuuaggaaccucuacggcuugagggauaaaacuguuuuugguuuuuuuuugucacuagucugagcacaauaaagguaggucaugaacucaugguggcuaaucauguuucauuuauuacaacaguaaaacaauacugaugguuguuuacauagggagggauaccacugcuguugccaauuuguucacccggauuucagcuaauucagguuuaauaaggcuuugggaaaaugcacaaugaaaccuugaagacaugauucuuauuagacaacuacugaccaaaugacaacuucaucuucaaugaccuugauuuggaaucuugaaacuuacaacgaguuccuaaugagaaaggcaucacucuuggucuccaugucuaaauauauugacacacucacuucaagauaugauggcugccaaaaucaauaucccaaggcuugaauauuuaugggaguaggcauaaauucgugauuauauucaugguaaugaauauaauaaauccuaugcauagccaacauccaaguugaacuggggaugagcaggauacacagaaagcuccucaccugcuuugagcaaguuuuucuugcaaaguuguaauaugaaauaccuuaaucaacaaauuucuuauaaauguuuauaugaguagaaaaucccucaauuucauugucacucaaaaaguugauuaucuuugcauucuuuugcuugacauguaagcaauaugcuauuacauucucuaagccuaugccaggcuuuuaauucaccugaccauaauccuaacccaggggauagaauuccaagaauauaaauuggcucaaaaguaguuccaguagaacuuuacugauuauuaaggcaacucuuaaccucuugagguuggccugauagagagaaaccauguuccuccuuaaugccacuacgagagagaugggguugggguggggggagaggaggaggcggcggcgcggcgagagagagaaauacuaggcaauaagacccauagauuagagcuaauggcacuaauuauguucauaccuauccgcaaggaagcaggcaggagcagaccuaaugagcaaucugacugugcucuacauuugguccacuuaaaaugagaagaauguacaaguuuuaggguuuucuguguuguaaguucccagaauaaacguaguuacaggguagggcugcagguuagggacugccuggaagauaggaugaaauguauuuuguucauuugauuucuguuuuuauuucaucuugagcaugugaaaaaucaguggcuuuuuaaacuuucaaaguugacugccuagacugauaaguuuaagaacacacaaguaaaugucaacagucucuuguguugcugacacacucaaaccagugcuaaaacaauuuuugucuuaacucugaauuauacauguucagaccugcuauugaaacaaaugcauuuugauauuuggauuuuucuaaacuaaacacacagcugugcuaggcucuuugcucuguuagccuucugaccauuuuauagcucuaagcaugugauauuuucuccuagaagacuccgaagugcuagaauauuuucagagggcaaagccuuauaauaauucuuacuggaagcaaacuaaacaaaaaccaaguuccagaaaacauugcuucugagaaauucucaaauaucaucaagaagaauaagugguuaacuuaaaaacaaaacuauggcaauauguuaaaguacaauacugcaguaaggguagaaaacacaucuaagguuucacccuuaguguuaagcuuuuuaaaagcaaaaaggucauguguaucaauuugcaguguacuaaaauuguguucaaaguuuauuucaagucacagaaaauauacaaacuaagacaauaaaaugaagugauuuuguucugagagaaggugaugggaguccuccaccuggcacugauuugagucauucaaggguuaggaugcaggucaucuuuuuucaauauuucaacaaaauuauagaauuuccagauuucuugccagguauuuuugaaaaccuguaagaagaaguuaggacaaagccauuagaagugaagacaaagcucucuuccggaaaaacuucaggaaaaaaaauaaaaaggcuaggggagggaggacaggcauauaaucaaaucaccaggacagauuugcaaaguaucugucuccugccuccugacuccucaaagcaaucagcccuugcagcaggguuucucaaccucagcacuacugacauuuugggcuggaguacuaguugcuauugggaagugggugagggggaccauccugugcauuaugggauguuuagcaguaucucuggccucuacccacugaaugccaguagcaugccauacucccuaaaguugugaugaccaaaaacgucucaagacaaugucaccuagggggcaaaacugcccuuguuugagaaccauucaucucuaaugacaacaguauagaagccuguccaugauggcagagauggaucacaacuagcuagguauaggauggaggaaaacccaacacuuuagccaugguaugcacaaacaccaguagacacacaauaaaaucuugcccacauaaaauugcauagaaccacacauacauauacacaaaucaugauaguuuuuuuaaaauggugaaaacugaguuugcagucaaguuaacaguaaugugccaaugucaauuucuugguuuugcacuacacugggugaaggguacaugagacuccuuguacuauuuuuccaacuuuccuugagucuaugauuauuuaaaaauaaaagguaaaaaaauagacaaaaacuuugccuugugguuaauaugcaaggccuuaaauuaaacauccuauaagcaaaacuauaaugaaagaaauuucagaaacauuucuaccucuacuauccagaaacaguaaggaguaauuuucucacauuguagggaaugccuucucuggcuuaaguaaauuaguaaaagaaauaauuuuuauuuauuccucugaauguaauagguagucuauacuuuuacuaaaaaaaaagaauaugugggguuuguggaauaaaacguuaagguaccaaaagucuacugagccuucuaucuaugauagcuucucauuaauucauuuaaggucuaaauacauauaugaugcauagucgcaguuuaaauguuuaaagacaucacaaguauggauuaaaaugauauauuuuguaagagugguaauuauuaauaguuaaaugaguucacuauuauauaacauaagaauaggaauuauaauauggaugggguaaaaaguagaaauuuaaauugugcuguccuaccugauaguggggcaacaugaauuuuaaacuguuuuuagaaaaaagaacuguuuauaaaauacaaaaugcuggggaaauuuuuuuuaaaaaagaaacacugauacauguauguguaaucaaguugucacaugauuauuuaugaagcagguuaccuggauccuuuuuuuuuuuuuuuuuugacacagagucucacucugugacccaggcuagagugcaguggcauaaucauggcuuacugcagcccugaccuccuggacucaaccaguccucccaccucggccucacaaguagcuggaacuauaggcgcaucucaccaugccuggcuaauuuuuuaaaaaauuuuuguaaagauggggucucacuauguugcuuaggcuggucuugaacuccuggucucaaguaauccuuccaccucagccugccaaagcugagauuacagggcucagccacugugcuuggccccuggauucuuucugccuaaaugaugagcaagaaaaauaaggguagcaggguacagcgaucuccaaaauauauagaaacugauggugaugacggacauuuacuaccuuaaauuaugugcuacuauaguucaacaucaaaauauucccuauaaaauaaauacaagaaacaaaauauuuacacauuuuauugaaaugcuuuguauuuuuccauuuugacaggacaguuuggaauaaaauaauacaauugauuguagaaggauacacaccaaacuauauuuagagguuuugucuggggaaugagauugaggaaacagggcuuuuuaccuuucaccuucuacauuucuguauaugauuacuuuuguuaaacugaucauacauuaccuuugucauuaggaaagauuauaagcaauucaacaacugaacaaacauuguauagccuuacucuaucccuacaggagcugaccuacugaaggguaaagaagagucuagcugaguggauugagggccgcugagagaacaaucuuguugguuaagguuaaaaguauauacccagaauagacaaggagcuaguccuacucagauggggauuaaguuugcucaccuaucaaggugcuccaguggauuucuguauuuguuccuuuaaaaucaggauacucugccuuugcucaggaggcaacauggcaaucuggucugcagucaguuguagaaccugcauaaucaaagcagccugugcagaggaaaaaaaaaagguagugaguuuuaaugauggcagcuaaaaaauacaaaacaaaacaaaaaacccaccaccagcuucuguccaaaaagcuacuguagugggauaugaagcaaaauggaaaaaggaagaacauuucacacagaaaaaaaccaacagccccccuccaaaaaaaauaaaaaauaaaaaaaaacuggugagaaaagguacaaugaaaagaacaaguauaaauuaaaauaccuaagauuagacgauucaaaacagacaacuucaugaacucaaaguuccuggagacuaagaugguaucugugagcccuggaaauccuucaaguuuuaauccuguuuugaaagucucucuuuuucacaaauuuuagccuuuccaucagacauaagcuccccacaauggucaaauauaaaaacagaaagauauaaucauggggaaucuacuauuguuuuuagggauaaaguagaaagggaaggaaaaaggguguggauuuucaggucaaucuggccugaacaagaaaaaccugcuauuggcagaugagugugaaauauaaaauaagcugccauuuacauccacuuaagaacuucacauccauuaggaacuucaggaccagacucacaaauuuucagguaacaagaucauaaaagaguucuaaguuagaauaaacaucaccuccaaagggacuuugaagacccaggaucgucacaugguaacugugaaaagaggaaucaaaaaggcuagaauugugcauaaggaggcagucagacaguguugcuuaccuucucaugauccuguggagugacuugguucugcccgggacuaaagccgccaggcuggcuuccacccuguauacuugcuccuugcauuccuguucccugcaugacugggaccuauguguacaaagagaaaagagagauuuuuggcauuuuuaauguauagguaaccugaauucaguaauaaugugacaaauuaugaucucuauacagauaugaguaaaaaaagcaaaucaaugacucugaagaucauuuucuacuguuagcaauagcagaaggcaggguuuagccagagaucaacuagcaaguucgacauacuugcuuacaacaccuccagcaucaucaacaaauauuacacagcacaacuggauaccacugaauuaaucaaaauucagccaaauaagcacagugaaaacugagaacacccuggaaacuagugcucacuggaaauacaaaugaaagccaacagagucuagagaaaauguaugcugguccacuggggaaguuacauucacagggccacccccuacccuaguucaaucagauacagguaguuugucccaaagggcccuaucccacaagugaggcagagauguucauaaugucagagaggcagaaaggcaaugggaaggccuccaggaaaaagacugcuauuagcccaacauuugcuguuuauagcuuuccauagagaacauauggcagaugcuuucugcuaaauguagaccaaaaaauaugacugacuggagugaaaaaaccaaguacagugauaucauacuuacugguacuuaagaucuucaaugaguucaacccuuugcaagacuaccagaacccaaggaaaagaccucuugaguaccaaaucuaacuguuagaaugucccuauacaagcauuauguucacacucaggcauucacccagagcuuagguacucucuuaauaaacacauauuguuaacaaacuuguuaccugcuuacccagcagauuagaagcagcaaaacauaaaagaaauacggauaaauaacuguuaggagcagauaccacuucaguaauaugaagagccaggugacggccugacagugaaggagaccagaaaccaaacaggagauaacuauguuuuauauuacgguauagacaauaaugaaucuauucaaugaugaccuugaguagucaaaacugauuaaacuauuuuuuuguauccuguucaagaaaggaaauaucaaauacuuuuuauaauuuuuuauuaaaaaaguuaaaaaacuugguagaauaguucuauuaucuggaacauucacuuacaugcauuaacucauuucccaaagacaauggauagaugaaacauuaguacagauuuguauagacugcuagaauauuaucacuguucuguucauuaucaauacugaaaccagagacaaguuuccagagaccagucugaacauuaacgagcuauuaugggucugaaacaccuaugaguauaaucuuuuuuuuuaaaauuuuuuauuuccauagguuauuggggaacaggugguguuuggucacaugaguuuauagcagcacaauucggaauugaguauaaucuuuuugaagcuuuaaucugagguacuguaauugugaucuaaccacucaauaacggccauuuuaaguuucuaggugugcuuguucuaggcagacaaguacuagcaaaagugaccauacaucuugguuucccuaagauagucccaguuuauguuuuugccuccaaguaaaguaacagcacuuucuuucauguucuccuuuagaugauaaauuauauaaucacccuaguaauaauaagccuuuugcccacaaguuucuaacuaaguggacuagaguuaauuuuaaaaucuaauuuaaaaguaugaauuaaggacauguuguuaaguuaaaaaaaaaaaagguauagaacagugaaaggggaaaaauaauauauauucauguuuuccagaaaguaacaugaaaaaucuaauaaaagugauuaucuacaggaccuagagggccacaggggagacaagcauaggagaggaagcaagguuccuuuuaguuuaagauguggucucacuaucuuguguaggcgggccuccaacuccugggcucuacugauccuccugccuuagccuccagaguagcugggacuacaggauucuacccuggcuuuuuuuuuuuuuuuaaagaugggagucuaauaugcugcccaggcuggagugcaguggcuagucacaggugcgaucagaaugcaccacagccucaaguuccuagacuuaaauggucuuccugccccagccuccagagugcuggcacuacaggugcaugucaccaugccuggcuugaaguucuuaauacauauaucuuuuauagaugaacgaauauauauauuuauaaguuaauauauuaauuuaaaauuuuuuuaaagguuugaagauaaaauuuguauuuucucuugccucagaucuaauuggcuuuaucgaaucuacuaauaaaaaugguauaaaccuaguauuaggguaauaaguucaaguaccagcagagagaaaggagcaaaauauuauccagaaauguucuuccaacccuuacuugcaaugucuugcaucauagaacuaccaguaaaauuauguaagcgcauuauguaguuauuuguuuguuaucugucuucccaacuagaauguaagcccaugggggaaggggcuuuguucuguucacacugcaguaucccccguaccuagaucuauguuugguacauaguaggugcucaauaaauauuugcugagugacagaaugaaugcauaaaaaccauuucuguuacuaggcuacugaccauagagaguacaauaaaaaucaaggcccacaaacacuucaaacacaauagagaacaguuuuauucuacacauagcaaaaaaacccucuauuuguauuucauauuacagaggaggggguagacacauauccacacauauacacacacacaaaugugcagauaacaggacagaguaguaaaguggaaaaaguaguggcuucuguuccuugcucugccacuuuuuagucaugugaauuuggucaagucaccugaauucuugggccuuaauuuccaaaucuauaaacugagggaauuagaugauugauguauuccauuccagcucugccauuaucuuucucucucucauacacacagacauggggaggaagacacauaaaaaaagaagagagaaguacgcagaggaaggggggaaaaggaagguggagcaguuagagggaaaugaaggugccagcauauaaaaacucacggaagaaacacacauaccaccucuccacaaccaagucgagaugaagagggagcauguacacacaggcagagagauccaaauaaaagagaggagacaagacuucgguuccacaccuuuuaaggugauuauuaauaaacugccuuucacauuccacuguucacuuaggcuaugugaugacaauaaauuaacacaggucucucuaaaccuaagauuaucuaaauggccacuaacagcucuucauauacucuaacccagugguucccagucaggguucacauuagaaucauuugggggaaguuuuucaaacuauccaugcucagauccuacuaauaagagauucugaguuauaccucggaugagauccgggcaaguauaucuuggaaaaaaccguguacaugauguugguuuguaccccaaucaagacuacuuucuaaccccuaaauuuucaggggcucugcuccaaaugaauagcuauuuauugugggauaagguuguuuuuuuuugaacuacaauccugauagccagaaaaucaccacccuaagggacagagaagcuacagggagauccaagucuucccuuucuaacaagcuaagaaacagcccaagucagaaggcaguaauaauuaggcucaauaaucaauuccugaauagaucaagauuucacuuggaugccagaagucaguguuacacauaccugucuggaucccugggggacaaccgcccccauguuaauuggacugggacccugcauuccacuagguauagguccucuggggccaggcacugggccucugguauccaugccucuggccuccaucccucggacuuccauugcacgggccuccaucgcucgggccuccauugcacgagcuuccaucgcacgggccuccauugcacgggccucuaauccucuggcaucuaacccucuugccuccauggcucgggccuccaucccucgugcaucuauuccucggggaucccuuccaccuauaaagaaaaauguaacaaaaccauuauguagcuacuugcauguacugcaagaaugaugaacaauccaagaaagauagaaaucucuucuagucacauuuguccccucagcuauuaacauaugagacuauugucuccuccccaguuucucagauuuguggauaaaccuuaaagaugcuugcaaaccuacuguuccagcauucuuuaucccagauuagagccuaagacaguugaguucauuauggcauuugcaaugugaucuccccuuaccucugccauccaaggguggaccccucugaucuagcauggguccucuugguucugccauuagaggucugggcucggguaauggcccuccccucaguucaugugggggugguccucggcucucauggccagggacauggugcauggguggacccugaugagguggucccaaguaaccucuggagauggagaaaaacguuguauuuuaaaauagaacaaaacaacaacaaaguaccaaccagaucaguaaguaaacauccaacaaagagcugauguagucuaugaauacuaacaagaaaauaacaccaaauagauggaagaaaagcuacagagauauaaauccauguauucuagaauuucguuauuugguucauaauuagggaggaaucaacgaauauucauuauauguaugaguuugcagaacaaugcauaagaacaugagcucuggauucagacuguauggguucaaaucuaggcucuaucacuuauuagcugugugauauuggacacauuauuuaacuuuuccacacaucaguuucacguguaaaaugggacuaauaaugguauccaucucacaggaucuuguggauuuaauaagaugaucuaaguaaaguacucagagcagagucagaggcaugauccccauuaaugucaauuauuauuacuaucauuauuuuauuuauuuauuuacuuuugaaauggaguuucacucuuguugcccaggcuggagugcaguggcaugaccucggcucacugcaaccuccaccuccuggguucaagcgauucuccugccucagccuccccaguagcuguaauuauaggcgcccgccaccacgcccggcuaauuuuucuauuuuuaguagagaugggauuucaccauguaggccaggcaggucucgaacuccugaccucaagugauccacccaccuuggccucccaaaguacugggauuauaggcgucagccacugcacccggccuauuauugcuauuauuaauauuuccacuacuauaaauuucccuguucaaguauguauacuaaaauuuccaauuucuaaaaauauaauagcucaaaaugacauacucaaguacauaguucugccuuaggagaagugcuuacccuuggacaguggccaugaauauugaucuaccuuuugaaguaggcaaacagguacaacugguacagaaagauuuuguucucagggaagaagggacaauucugauuucuucaacuguuuccuucuauguuagugcuuaccuaggcucuaccucuccaguuacagaaaguaaagugccuccccguggaucauucggagcaucuccuaacaagccucgagggguugggacauucgcaggcaaggauccccgcugcauagcugcucuggggucuugcaucggcacugacagggaaacaaacggggaguuacugcugugaaagacacauaagcaaacaagaaaugacucuauauaccacugacaacauaauucagacaccuuagagugggugaaaccucaccacagcagaauccucuugcagcucaagaacagaagcaggguguaggcagaaucugugccaugucagagguauggauggaauuauauaaagagcaaacuggggagcaaccugccaaggacuagcacugcgaccuggagaaacuuaugcuccugguuuuccuucuaaucaaucuuaguucaaggaccagagucacaaaacagagguagagucuuggcauaugugaacacugccauggcucugcaagaacccgcugucuccuuacagacugcuauuccauccaagccuccugacaccaguagggagggaguacagccucggacagaugcccauaucauccauguucucugcccugugugaagaggucaaucuuaggcuuguggccucaacaggaaaaaauuaaaaaaacaaaaacccaaaaacacuacccuuuuggguucugaacgcgaggaugacugccacgcagcucuuuuccucucaacgucccacccugaacaccacaagcaaaaggaaacccacagauacaauggguaccuugaacucgcucaauugaugcaggcccggcgggucccacgggcgagugcuguaggguuccuagguaagcaguaaguucaaaaggagaaagagcagacacuuaaaauagcuugcauacacacgcagaaacacacacacauggagauugagauuuacauauauaaguuaaaaagccaagaguucaucggcuugcuccaggcuacaaaaucucccuaaacuacacuagcuccuuugggucucugaaauaguuccauuuugaccagauagcuuuugaaagggaaucccaugggggcacugguuugaucuaggugggaauaaccugacauuuucgauuuucaccucugcuacuaguuuuccguuaggucuccuuaugaaaucauuaggaaaaaaauauauaaaaaggauaguuuugaaucuucuaguuaugcaaagaacauaaauguaguuucagaagcaaaacauaaaagaaacugcacugaaucuggaaggcaagauucauucugaaacggccauaacugaaguacggcaauucuauuuuugucacauuuuaaagcacaaaaauuucugcugucaaaaauguaucagauggggaaaugcagugaaugaacuuuacaugaugaaagagaauaucacuccacaagaaauacucugccacagcaagucuuugauaauaaacaucaugacaacagcaaacaaagacuaaugagaugacaugggaaccgacacuaaacaaacauggcagggaagcaagaaguaucuucucaaacaucuccaucuccuuucagcauuaaaagcagcauggauuucaggaaaaguaagacaaacuaggcacacacgaaaagacucuugcuuccucugcuggguacugaaggaaacuauaaaagaaagcucaucucacuuagucucugcaugaagacauccuggaaauacccucaaaacaugagucacuucccuuugccaauuucugacaaaaaggugaagauaacuauaauaggaagaugucuugugcaaguaugcguuaaacagcuaaaaccugauggauugagggcuggccccaugacaggcagaaguaugacugaaacccuaauaccuucucauuacugcagaaauacucuggggaacauauaugaucuauugacaguggugcgguggggauagagggauguacaauagcacaaaagcauuggaugcuuagagaaaauaugagauauuuggccagggaguuuguccugcugucagacuucuaacaagaaaaaguuaauucugucacuucagcaaccaaccccaguguaaaaaccacaggcuuguauauuaauguuuauguauguauguguguauauauauguguguguguguguauauauauauauucuuugagacagggucuugcucuguugcccaggcuggagugcaguggugcccgauuauggcucacugcagucucaaccuguugggcucaagugauccuuccacuucggccucccaaguagcugggaccacaagugcacaccaccauugcccaacuaguuuuuguauuuuuuauagagacgggguuuugccauguugucuaggcuaguuucaaaccucugagcucaagcaauccacccaccucagccucccaaagugcugggauuacaggcaugagccacugcgccuggccaauauuuugcuuuuuaaauggguuccacuuauaaaccauaugcuacaaaagaaaaaaccuuaagcuucucuaugcuuguccaaagcagucuuucccaucauuuuauucccaaggaauaagaguagaagacacugaagaauaugcuuggaaguuaacagaggcaguguggagugacagaaagaggacagauucuggagucaaagacuucugaaucuuagcucugccacuuacuaguuggaagagaaaauaagagcaccaaauccaguccacauuacucauacauuaauauuuacuuaccuuguccccuugagaaaguaacuuauucugagcuuccaacucuuugccuguaaaacugaggugcugccaccuaacucacaagauuauuuaugaaaauuaaagugccuggcauauaguaugcacucaguuccuucucuuuucuuacgaucucuccuccuaacauuguuuccaacugaaccacugcacuuucuuguccuucaaacuccaguaacaugaagaaacaacauggagauuuuggagcagcagcuacuguuguauauagcaguacagccacgguacaacauauguucauuaaguaggcguuacagaccuaugauucccucccaguuuucucugggguuuaaaucuagucuucuacauacccagccacauauuuacaugcucauuauuaaaauuccuuacucagucaacagauauccauacagggagagagaacaugucaguggaauuauuagacuaggaaucaggaaacaaacgauccacuugcuucauuaucaauucuuguagagcuggacucugaaucaccagguggaaagucuagaccagcacuguccaauagaucuuuuuacgaugauagaaauguucuauaucuguaauguccuguaugguauccacuagucaccuguggccacugagcacuuggaauguggcuauugugacugaggaacugaguuuuaaauuuuacuuaauuuuaauuaacuuaauauugaaauagccaugggugguuaguggcugccauauuagauacuguggauguggaacacuuccaugaccaauuaacauuagucagacauuaauauuuauuuaccuugcccccguuccauggacacugguccacuuccuggcauuccaaccugagccugcauuccuccuagaagauaaagggcagacaagaaaaaacaccaauuagaacagcggaaaagaaaaauuagaacaguggcugaguuuacaaauuuccucauucugcuccacaagcagaaaccuacaaaggaagauauucaacaaugcaaugagagagaagaugggguuuguuaguauauuuacaauuuguacuuuauguuucagugacagaauagugaguucaauaagaauaauucauuucauugguuaccaaacucuuggcaggaagcucuucuauaauacaggaaaacaaugucacuuacccauggaccuccugucaugaaagauaauuuaaauacaaguauaacucuauuaggauaaaguagauacauaacaauccuaaaguagauacaaaaaauuccugaguuugcagaaauuucuucaaaaaaucucuucuuccauuccucaucaacuuagcucugcagacuggauucucuacagaacagaacaauuuagaauuaaaucauucuccaugaguaguguuguacucaaccuacccuagauuagauaaauuaacaaaaaccaaguuuguuacauaaaaaaacuuuaaauauugguaauacaucauguguucauacagauguuucauauggggaaucauuauuucacucaaucuucuuaguuacaauuguugaacaaggaacaguuacaaguauaugagcaauacucuuauuaauugccgaucuauacauuuucaauaaauguacauagcuuuuaaauuucucuuuuucccuuuuguuguuuguucugauuauguuuguuaaaauacaauuuuaugucaguuuaauaugcuauaacaaaugugaccuuguauuuuuuugucuguuuucuucaugagcuuuugaaccuaaucugacaguucauucauauuuagcagaguaacaacuacauuaguuuuuauuccuuccaucuuacucuacauuuauuauuacuuauuuuacacugucucuuacuuuuuuccucuucucuauuuuugcuggcuugauuuuguuuccacucauuccauuuucccccuuguuaacuuggaaguuuuacuaugcucuuucacuuuacugucccuuucccuguucuuauaauuagacauacaggauuuaacguaagaaaucuacuauuuccuccaccuaagauauauacuuucuagcuguguauuaauuuuaccuaaggaucccauuaucauauuuggcugcacugcaacaguggcuaugacaaaacuuuagcaaguacugaaauggugaagacuaaaugaaacuuaccuccaggagcuaaggaaccagggccagguccugugacagcagcuggcauuugcccuggugcuggaacuccacccugcauagaagcuugcaucagaggaggugcgccauugacaugcauuccacccugaccaagcaaaaaaaacagaguauguauaugccucuguggauacucaauauacuaagucuacgaccuuaaaaguccucuucaaaugaacagccccaaauacacuacuaaacauccuuuuuguauggcaugucuuaugcagcauuagauuugucacacacuuuaaacuccacagaagcaauauacgucaugagccugguuauauggaacacgguuaagauggaacauauucucaauguagagauugacaagucuuaucuguguggcaaggcagcacauaacaccuacuguuaacuucaugauuggggcugccaauaagaguaaaaaaaaaaaaaaaaaaaagcccuaaacccaagaaacauaaaaggagacugggacucuuuuaaaaaaaacaacugcugguaguccacauuuuuaaaauuaaauuuuuuuuuuaauuuaaccaaucuuuucucacuccuguccuuagauauaauucugguuuugggggaaugugaaauauauuuuuuuaaaugcuacauuaaaacucguugagaaaaagagaaugucaucuuuucaucugugcauuccccaaaaaacugaguagucccuugaauuagaaacagcucaauaaauaaagaauaaaagccaaguuauauaaaaaaaaucacauauacguuuaaggaacacaaaacucuacaaaagaaaaggaagagcuguauaggaaaguaguuaagagaaaacuggcugugaggucagauaaaaccagguucagaaauagaucugccacuuauaauugugucaauuuuuggaccagcuaaccucucugggccuuagcuuuuuuuuucuaucucugaaaauguauuuauuuauuuagagcagggguuggcaaacuaugacccaugggccaaaucgggcucacugccugguuuuauaaacaaacuuuuaacggaacacaaccacacacacuuguucacuuauugccuauggcugauuucauacuaccauggcagaguagcuguggcagauccugugacuugcaaagccaaaaauauuuacugucugaucauuuacagaaaaauguuugcuggucccugcccuguaccucugccaaccugagagaugaaaaaugguagcuuauuguaguuucuauuuacauuaucuuauaacauuacauauauaaaugauaauuuauuacauuaucuuauuuugaaguugaauaaauuuuuauauauuuauauuucuccuuuugugaaauauuuaugucuauuucccauuuuucuacuggguuauuggaaauuuucuuacuaauuuauaggaggccuuuuaaaauuuauuaugaaaaauuacagauauacaaaucauauagaaaauaaaauagccacccagcuuaggaaauaaauaaguaaauaaaauaaaccaauggccuguacggucuuccccaauugcauccugugcucucuucuccuuugaugaccacuaagacgucuucuuaauguuucaaaauuuuauaugaaucauuacauacucaauauauuauuuugcaacucauuccacauauuuuggggauuuaugcagaaacauauauccuacauuucgggaaugcauccauauucacuuaguuucauguccguaugucacuguuuuggaguuguguugauauuauguauccuaguucaucuuaacugcuguauggaauuauguuuuucaaagucauucauguugauacguguaguuuauuuaacuguuguacaguauuucacuggaugaauguaccacacauuuucuccauucuuccacugacguacauuuaggacauuuccaauuuuucacucuaaggcaauaaacauucuugugaaugacuaugggcucuuuauuagucuguuuuccaucacaugugugguaaauacuuuuucucaauuugucaugucuuugauacuuauuuuuuucuuuauauagaaauuuuuuaguuuucaaauguaucaauuuuuuauggcuuuaagguuuugugucaugcuuugaaagcaagcuuuacuuuuuucaucaguaagaauggagauaauaagagugccaaccucauacaauugcuuugaggauuaaaugagauaaugcauauggaauaacgaagugccaaccacagugccaggcaugcacauacacacaaaguuagcuuauaagaaaagggcauacgggaaggaucucuuuguuuuacaaacuuggaaucgaaucuauauucauucagaugucaugugcucugcaaccuggaaauugcuuuuaugccuggaaauugaaauuaucaucucugguuccugaccauucuucuuucaauauauucuccuaaaaagaaaaugacauucuaagacagauacaaaaaaauguuaagggauaaagcccuaccaaagacugggccugaggggccugaggauucugcugguucauugacacauuggauccugagccaggcccagcaccauggacuggcugaggguugccugcaaucagcguugggauauuugucuggcgaugcagaauuuucuaaaaagugaaaagacaaaccuaugagcugucuguuuaacaaagcaaucagguaguuccuaucccauucaagguuuacccgaccauuuccauaaaagaaccagaagcacucaccagggcaauuuccggauccacaauucucaucacuaccugugcuugcagcaaagcauaagccaguugaggguucugaaguaacauguuccgugccuccuggggacuauucuggacacagagcugagaagauaagcagauucagguuuaauacuuaugacuuagaaacugauagugauuuagagccauuccccucugagaaauguaauauucaagaggcucuuuaucauuaguuuuugcauggcacaaaaaaaccuuggucauggcaggcaagagaagaaagaggcauuucaaauacugugauauuaucauuuaggaaaaaagccaaauuuuaauaucuacaucugacaucuaugggccacaaaacuccagcuggauuguuuggauagcuguguuuguguacaaaaauagaaagcucuuuguacaaaauguaaaauauacuguguacauacagaauauugaaggugcaagaaaugguggucuacagacaauuucuauuugagcucagggaacuaauucaaguaacuccuugaaaaccugaugugauuugcuuuauucauaaccuaaugccuccucccaccuucauuuguuucaucagcucaaacaucugcucugguggaaggcuggcaacugcuuugcuaauggacucaggggcauccucaggacugauggucucuccauaaggugacucaaugacaggggcaccagugccaaggccuaaucaagaagaaaguacaagaaaguuagggaggcaaaacaaaaagcuaaaucauuucaaauaucuacuuuucagggcugcuguaagaaccagcugauaauuuuagauucuccagagcugagaaauaaaugaugugaaagccucuuguuucuguggaggaaagugagaguguauuuucuguucucagaggaaagcuggggaucaugaucacauggaaggacaauguuaaccuaaguuagagaacuaggcacauugacuucuuuuaacaagucauuucagaaacaaaagguuaaaagagaaaaauacgcuaacuucaaaaauuccugaaaagagugacaggaaugacuaaugccacaguuaguacuacuaauggcuugaugaauuugaauucaucuuuaacuggaaauaacuccuuagcaauggaaauucuuuuuuuuuuuuuuuuuuuugagacagagucucacucugucgcccaggcuggagcaacugaagaauuucuaaugucaacuuuaucuguuucuuaaagauauacacuuacuagcaagccuccagcaugcuuaggucugcagugacccuaugcaucccuacagugcuugccagaacaguuuugaaacgguuugaggccuugcccugcuccauccagagcaaggguauagaaauuucagacaauuacuugaaaaaaaauuuauaaaaaguuuuuaaaaagauauauauaauacuugccuaacucaggcacaucaggucagucaaguaauaaacaagcugcguggcuaaccauuucagcauauucuaaaacauaucagaaauggaaaaucuucauuguuacaucuuuacuaacucauacugcauccaaguuggauuuguacucacucuucagcucuucuuuguucuuuucacuggcagcauuguccacucgaagugcucucccacugaauucgcgcccauucagguuccgcauggcacuaagugcugucucuuggucuugguauucacagaagccauaacccuuuggcuuuccugucucucuaucguauaccaaucuggagagcagaaccaagugucaggaacaaauguuacacacauacaggguuccugcuaacauugccaugcuuuaauugggcccacuguaacauaaauaaccuuauaucucugacagccucacagaaauauuuuuuaaaacuuuuuuuuuuuuuuuccugagauggagucuugcucuguugcccaggcuggagugcaguggcaugaucuuggcucacugcuaucucugccucccggguucaagcaauucuccugucucagccuccugaguagcugggacuacaggcaugggccaccacggcggcuaauuuuuguauuuuuaguagagacaagguuucaccacauuggucaggcuggucucgaacuccugaccccaggugauccgccugccucggccucccaaagugcugggauuacaggcuugagucacuaugcccugccuaaaaaacauuuuuaacgaaaaaaacauauuuuagguaagaauaaaugucaauuguauaguguaucaauuauaucucaauaaagcuguuacaagaacaaaauguaugugaaaagucaccaguaaagaaaaccugccauuauuacuaagagccaaaucuguggugauuuuuaagaagcucccaccaugaaggaaaaggggaucucaccugaaacuaacaacagguccaaccucagaaaagauguccuucaacugcucuucaguagcuucauaaggaauguuccccacuaaggaagaaaauagguaacauuaaaauucugaguuuauaacauagaucuuuagugagaaaguaaacuuauaucaucaaauauaagacucaaaauaguguucuccaaucccaauuccauuguauuucuucagaccucuuaacaaaggaaauauaccacugaaacuaaauacaaaauguguagguacucucaaauguuaguucucagacugaucugacacguguuagauuuuccuuaacuuuggugcaaauaaauacuuuggcacugguauuuaccuaaagaucugcaagucucaucagugacuacaaaaaauaucaauguuauuuaauauaauuuuuaaaacagguuccuauguauuuccacacauacaacauuuaagggagaaugacgaugaauguagugaaagauguuuaaaaaguauucugaacuacuuugucaugucccuuucaaaugguacucuaaaauaaucacacguauuuuuaaaaacaacuuauuucagccaaaaagauaauucagaaucguuucgauccuuuuuaaaauuccucugaggagaucuuaauaguucauucauucauucacuuacaagccaucucaggacaccagguggccgcuaccacuauugaugcacuaaaauguuacagauaaaaagcaaaggaugaaaguccuuaggagaggacaguaaguggacacuaggaucuauacccucagcauauagucuguauucuggggcagaggaugagaaguaguacgggacagugaggagcuguuaccgugagccuucuccucuagagaauaauugaagcucaugaaaggagaaacgcacagaagcugaacgcuagucuaacuuccccacugauauugcggaaagccuacgagaccucggcagaaugggaauaucucuuugcucaugaguccaccagguuggacgcccuacaggauaagcagggagaacugcacguccgaaccgucagcggcuccgguagcgauucaugagauagaaggugcagaggggagucccuccccgaagcuugacuacaacgaauuccucucaccgaacacagaacguagagaacgauccaccgcugggucucucacagucaaacccgccauagcucuguugagucggcuuccggugcgccaaagcacacuuccguacggagcacaagcccagcgcugagcacgcuuccguacggcgcgugagccggaagggccugggcggaacggacgcagagccc

SEQ ID NO: 19155 - RNA, 3343 nt, Homo sapiens
uucucaaucacagaguugaaucuuauauagcuuuuauuucagugaucagaagaaugcaguaaauggaaucuacacuaacuaacauuaggcaugcaccucuaccugaaacugcuguuagcuucugauuggccuaaaucuuuauaacuuauuuaggcacaucacugaauuuuuuguacccugauauacaggguaaguuaauuucuuccuuguggcagucuaguaauaagaauuauguucacuggcuagauuccuuuauaacuaaaggccucuagacucucaggcugccuacccuaccuugagacuuacuuaauauggauauuuaagcaaaucaucauauaggaaagggagaucaagauaacugaaguguacuguauaaacacucuuacagauauuuuucuccagcauugacaaucaaacacuagauaaggauaccaaauuauucuuccccuacuucugcccuuucugauaaacacaaggaucuccccugaaaucagaaaugacuccacacaaaugagagauuuuuacguauguggucccacuaucaaaauuauaggaagcaguuaauggggcuuugagaaaagcauagucccauguacaguaauaugcaucuaaauagaguuuucuuucgccugucaauuauuuucacaagauuagcauuaaaaaauacaagcaaacauaugacccuuaagcuucacacacaaaaaauuggucuuuguucauucucagaugacaggaugucccaagaguaacaaaagaugggagccaauccucucauagcuguuucuucaaucaucccaucaacagcucuucauuucuugaacuaccuuccuuuuccaaagagguaaugcugagaucagucagaaaggcuuucugagaaaacuggcuuggauuucugggucuguuccagucgauucaagaugaacuggcuuguaucaaugaagcgcucaacgcaguucacaaaacaggccucagcccgacuguccaacuuuggcccaggcuuguccaugcacuucuccugcucaggacaagauacagaaucacaaagggaacuuggaaagaaaaagacgguugggggcaggggucccuuuuuguugcuuagagaaaaaaaaacuuuaccuaaaaauaauaucugauauguuacugauaguucacauuuggcagcugaccaaguauauagcaauguucucuagccuuacauuaaauucuuacaacaauacuauggaauagauacuauuauaaauccucauuuuacaaagaggaaaacuguggcacagagauacuuuacccaaaaucauagggccagaaaauggcagagcugggauauuccagagcaagaaaauggcaaaauauaagugaaguaaccuuucaaugaauuugguuuuaacuccacaaugcuguuugaacuaaaugccuuuaaguuaacuacagaauaaaagggugaaaggauaaaucauuucagcaagguacccuaaaaccuaccaaagaagaaaaaaaauaugacuugagauucuauaaccuugucuacuuaagcuagagauucuugaauccugucaugaugaauggaaaauugaaugcauuuuccuaagggguucaucauagcuuacaguuuuuuuuccuuucuuuucuuuucuuuuuuuuuuuugagacagagucuggcucugucacccaggcuggagugcaguggcaugaucucacuguaaccuccgccagguucaagccauucucgugccucagcuuccugaguagcugggauuacaggcgggugccaccccgcccagcuaauuuuuucuauuuuuaguagagacagggcuucgccguguugcccagacuggucucgaacuccugaccucaagugauccacccgccucccaaagugcugggauuacaggcaugagccaccgcgccgggcagcuuacagauucuugcaauaguacuuaaccacacgcccuccuagccccaaaguaacgaaucacagauauuuuuaaaaaagaaucaaagcacucugguccaaggcagaccagaguuaaguaagcaucugguaggugucauaguccagcaauacuguaaguuuaugggaaagggccuauggaaaccaaugacuguauauaguucaaguuaagugguucaaaaauuucguucauuauucucugccauguacacaagccucagacccucuaauuccaaggaaaauuauccuuggccucugaauucugugaauuguguacauuaagggagaucuguccuuggcaagcagaacacguuguuggcaagcugcaaauaccuuccacccuuuugccaaaguccccucacagggcaggcucaauuccucaaccuucagacccaaaacggcuugguauuacacaacaauccaacaagaaagcaaauaaguauguacguuggaagagauuacaccacuuuuauaguuacugggcuggagccacucauuuuucagcggagaggguuagaacuggguaaugaagguaaaucccgaggaguccaggaauagcagauucacugauucacugacucucugggacucgggcugccaaaaauaaaaucccaguacugggggcuccgaucagucuuggugaccagcacuaggcagcuucaaccucgggugccugaaagugcuggguguccaguggcauaagucuucuuugauacccaguccucuacaccaacaaagccgagguccggaaugacaguccccagagaagcggagucacccuucucccauccggcuaggccacaggaaccugagaaaaucaaggguugcugccaggugcccgccccccaccccgaauccccgacguugucgcgagucccgcgguacaaggacagagggaaaguagguacaguguucaggucccagccccaggcuccucacccaacaaaguucagucaucuggugcaccagcugcuggaagcgcugcuuuugagucucuaccucgaugaaaugcugcaacugcggguccacugcacccaaacccgccgcggaggaagaggaggaggaauccaucccagggcgaccaagcuugcagagacgaacuccgcaccgaccuucacgugucuccgcgacggaaccggaaccacagcuagcugccucugggaccgcccccgugagugcacugcgucggcgcgaggcaggcguccaacuccaccccgccgccucccacaccuuggcgccggugcuucguucccggagucggcggguuccacuccccggaccccgcaaucccguaaccccgcaacccugccguugcgcccagccuugcgccuugagaucgcagggcuuacagcccagagccgaggugccguugagauguuacuccaaaaagaaaag

SEQ ID NO: 19156 - RNA, 3343 nt, Homo sapiens
cuuuucuuuuuggaguaacaucucaacggcaccucggcucugggcuguaagcccugcgaucucaaggcgcaaggcugggcgcaacggcaggguugcgggguuacgggauugcgggguccggggaguggaacccgccgacuccgggaacgaagcaccggcgccaaggugugggaggcggcgggguggaguuggacgccugccucgcgccgacgcagugcacucacgggggcggucccagaggcagcuagcugugguuccgguuccgucgcggagacacgugaaggucggugcggaguucgucucugcaagcuuggucgcccugggauggauuccuccuccucuuccuccgcggcggguuugggugcaguggacccgcaguugcagcauuucaucgagguagagacucaaaagcagcgcuuccagcagcuggugcaccagaugacugaacuuuguugggugaggagccuggggcugggaccugaacacuguaccuacuuucccucuguccuuguaccgcgggacucgcgacaacgucggggauucgggguggggggcgggcaccuggcagcaacccuugauuuucucagguuccuguggccuagccggaugggagaagggugacuccgcuucucuggggacugucauuccggaccucggcuuuguugguguagaggacuggguaucaaagaagacuuaugccacuggacacccagcacuuucaggcacccgagguugaagcugccuagugcuggucaccaagacugaucggagcccccaguacugggauuuuauuuuuggcagcccgagucccagagagucagugaaucagugaaucugcuauuccuggacuccucgggauuuaccuucauuacccaguucuaacccucuccgcugaaaaaugaguggcuccagcccaguaacuauaaaagugguguaaucucuuccaacguacauacuuauuugcuuucuuguuggauuguuguguaauaccaagccguuuugggucugaagguugaggaauugagccugcccugugaggggacuuuggcaaaaggguggaagguauuugcagcuugccaacaacguguucugcuugccaaggacagaucucccuuaauguacacaauucacagaauucagaggccaaggauaauuuuccuuggaauuagagggucugaggcuuguguacauggcagagaauaaugaacgaaauuuuugaaccacuuaacuugaacuauauacagucauugguuuccauaggcccuuucccauaaacuuacaguauugcuggacuaugacaccuaccagaugcuuacuuaacucuggucugccuuggaccagagugcuuugauucuuuuuuaaaaauaucugugauucguuacuuuggggcuaggagggcgugugguuaaguacuauugcaagaaucuguaagcugcccggcgcgguggcucaugccuguaaucccagcacuuugggaggcggguggaucacuugaggucaggaguucgagaccagucugggcaacacggcgaagcccugucucuacuaaaaauagaaaaaauuagcugggcgggguggcacccgccuguaaucccagcuacucaggaagcugaggcacgagaauggcuugaaccuggcggagguuacagugagaucaugccacugcacuccagccugggugacagagccagacucugucucaaaaaaaaaaaagaaaagaaaagaaaggaaaaaaaacuguaagcuaugaugaaccccuuaggaaaaugcauucaauuuuccauucaucaugacaggauucaagaaucucuagcuuaaguagacaagguuauagaaucucaagucauauuuuuuuucuucuuugguagguuuuaggguaccuugcugaaaugauuuauccuuucacccuuuuauucuguaguuaacuuaaaggcauuuaguucaaacagcauuguggaguuaaaaccaaauucauugaaagguuacuucacuuauauuuugccauuuucuugcucuggaauaucccagcucugccauuuucuggcccuaugauuuuggguaaaguaucucugugccacaguuuuccucuuuguaaaaugaggauuuauaauaguaucuauuccauaguauuguuguaagaauuuaauguaaggcuagagaacauugcuauauacuuggucagcugccaaaugugaacuaucaguaacauaucagauauuauuuuuagguaaaguuuuuuuuucucuaagcaacaaaaagggaccccugcccccaaccgucuuuuucuuuccaaguucccuuugugauucuguaucuuguccugagcaggagaagugcauggacaagccugggccaaaguuggacagucgggcugaggccuguuuugugaacugcguugagcgcuucauugauacaagccaguucaucuugaaucgacuggaacagacccagaaauccaagccaguuuucucagaaagccuuucugacugaucucagcauuaccucuuuggaaaaggaagguaguucaagaaaugaagagcuguugaugggaugauugaagaaacagcuaugagaggauuggcucccaucuuuuguuacucuugggacauccugucaucugagaaugaacaaagaccaauuuuuugugugugaagcuuaagggucauauguuugcuuguauuuuuuaaugcuaaucuugugaaaauaauugacaggcgaaagaaaacucuauuuagaugcauauuacuguacaugggacuaugcuuuucucaaagccccauuaacugcuuccuauaauuuugauagugggaccacauacguaaaaaucucucauuuguguggagucauuucugauuucaggggagauccuuguguuuaucagaaagggcagaaguaggggaagaauaauuugguauccuuaucuaguguuugauugucaaugcuggagaaaaauaucuguaagaguguuuauacaguacacuucaguuaucuugaucucccuuuccuauaugaugauuugcuuaaauauccauauuaaguaagucucaagguaggguaggcagccugagagucuagaggccuuuaguuauaaaggaaucuagccagugaacauaauucuuauuacuagacugccacaaggaagaaauuaacuuacccuguauaucaggguacaaaaaauucagugaugugccuaaauaaguuauaaagauuuaggccaaucagaagcuaacagcaguuucagguagaggugcaugccuaauguuaguuaguguagauuccauuuacugcauucuucugaucacugaaauaaaagcuauauaagauucaacucugugauugagaa

SEQ ID NO: 19157 - RNA, 433 nt, Homo sapiens
cugucuacaggcacucagaaugguccagcguuugacauacauuguaggcuuuccuacaauacagccucuaacaaaacuaggcugucccgaaccaaaacuaggcugucccgaaccccugguaauagaauuguuuaucuuuauaccaagaaguuugggaaagcaccaaaaucugcauguggcaugugcccaggcagacuucaagugguuccugcuguaagaccuaaaguucuuaugagauuguccaaaacaaaggaacaugucagcagggccuguggugguuccaugugugcuaaauguguucgugacaggaucaagcaugcuuuccuuacugaggagcagaaaaucguugugaaaguguugaaggcacaagcacaaagucagaaaacgaaauuaaaaaaugaaacuuuuuugaguaauaaaaaugaaaagacuu

SEQ ID NO: 19158 - RNA, 2047 nt, Homo sapiens
aagggccggcggccagucaccaggaacuccccccuccuccacuccgcacgcacagacauccccguucucuggucugugcucggugccccagugcgcacgcguugucacucaucuccguccucuccaaucugagggcccacaaguggcaucaucgccuugugguuggaguuuacccaucuucaguuacaggggagggucugcaucccccuacccacucccggcccuuggcuguggccuuuuauguuucuucuuugaguaaucacuuauuucucucuuagacuauaagaccagcacuccccacccgcccccuacacgaccugcccucucuaaguacaaugccugcaccaaaugggcuguggaaggggguaucaggaaggaaagcagaaggugcaaguagagcuuuaauuuucuuuuucguguuccuuuuuuuucuuuuaauaugacauucuuuucuaauauuguaaucagaaaauacaguauagccauuuucauuugacacaaaaaauauucaggguguaaaaauaacaaaagacucauucuuuuguuuacauuauuuugugccacauuuuaaaaugucuucuguuacugcaaacuauuuuacagcuuucaaaauugacuaguaauucuugacauuuuaaauacaaaauuguccuaaacaaaaccagcacguauucaauaugaucuauaaguuaaucuuuggaaagacauuucguuuucuaauauugacaauuuuacacaggugauuuguaacuuuugaaguucuggcugaacucagcaucuuuuuucaggugucuaagaccuucuucagagaagacuucuagaggauauauuuaagacccaacuccugaugagccuagugcuuuacuagugacuuaccaaauuaaccugcuuuacuagugacuucccaaauuaaccuguuuuccauucaaggggcuuuauuuggauuuuacauaagcauguaaucagaucagccucaccacacccauggaacaaccaacugcuagagcuuggauggaaaggagacuuaacagguggaauuuucauccgucguaacacuugagaucucgccggugucugccauucauguacuacauacuacccuagcaguggcgaguguucaauauuuuccaguggagaugguggugagggucuguggaugacugugaaucacugcaacacaccugauguccgugucauuauuuuuuucccucacaaguggaagggcaauguacaggaucccaagcaauugccaagaaaaagaaguuuuuucauguccugccuuguguuacaacuucacugcaccucccauacaagccccucagaauaaucccaaaacucagggaccaaauaugcagaaguuaguccccacgcauccaccuguccccgcugaggagucauacuccaaauauagacccuccaggcagccucuuucuuagaacauugaaauaggacaccccagagggaggggcuccacugugaggggccccuguguggaggaggcccuuucaggagccaagaaaggaaguccuagugccuuacaaucuuacuaauggcuuuucagaacucaauugaaagugacgaacuuacuuucuccaccaaaggaaaauauugauaaauuaauugcauacaaauuuuaaacuuugguaaaguaaaaaaaaaaaaccauaaacauugacugucaaaaggcuaacuuguaauaaucuaaaagcucuuacagaucauuaguaaaaugauaaacaacccaauagaaaaaugugccaaaagacaugaacagauuuguucacagaaaagaaauagauuacuaauaaacauaugaaaagaugcucaaacaaagaaaugcaaaucaaagcaacuaugccuuaccauguuucaaguaugauuuucucaaaguuuagaaacuugauaauauuguugacugguuugucaagaaaugggcacuccucuacucuguuggaggcagauauugaugcaagcuuuuuauauagggcaauuuggcaaacucuauuaaaugauaacuauaauauuucacaaauucuuugacccaaua

SEQ ID NO: 19159 - RNA, 3297 nt, Homo sapiens
uggcaagaguccucacacucugggcucuucccuugguaaauuuguaaauguaguagcaggugccagcccagaucaccaguccugcagucacccagcccacuuccugaaugcggcccauguaaucaccccugcuaaaagcacgaacaagguaugguagagcgcacucgggcugggguaaagagagugguaguuguggguguaggccugugagggugcuggucuucagccacucaaaggccacuacagcugccucuggagguggaccuagaaguggaggaaggaaauggacuaaaauuucucuucugauuuuguugcaucauacagauagauacacagaggaacagaaaaugguagaaccaugugcuugguggaagagaggaugauuagcagccucuccauuccucuuauuucaucuucucuccaccuuccccaaugcccaauaauuuucuuccaagauacuucuauacacauuucuauacaccaaaugaacaguggaaaggaugguaggaggucugacgauaaaugggagcaaccaagaagucccagacuuugauuucuacuggaccuacucuggucaccugucuacagggccccacccucauaccaaccuguaaugauccgaggcaguucccuccucuccucuugcuucucuuggcaguacacccuaaaguagauacauaaauucaugagaucucuggaccuagagacagacagacagauggagggacagaugggaguagagaguuuguucuugaugggacagacauauuauuagcaaacuaccuuucuacguuucucaguccaccccacucccuaagacacugucacacucuuuucccuguaccagaauuaaggugaggguauggaguaaaugacagggauggugggaaagguggcuggaaaaggagagacugaggauccucauccuccagacuggucacugguccuuacuggaugcacacuggucuccaccaacccacucuagaggucuacccaggcaguccccacacucuuaccagucuauacugaucaggagcaaucuccucuuuguuucuuugcuuccagugaucuuaagcccugcagcagacaugcaggcagaucuauggacaaguaaacaaacaguagguaauggaaaccgagucccugguagaacagacaagcaaccugaucccugaccccaaugucugccucgccagagcccagguucuauauacuaauguguaccaucucaugguccccccaucaagucuucccccagucauacuccagcccacccuuacccccauauuccuaucauuuccugcacugaaauccacaggaggcauggcagcacuguggcaauccagcacuccacugagacccucuuaaaucucacccaccuccuaugcccacccucucuugucauccccagagacuacccccacuucacaccaaccuccaugcuucuagauugaucuccuccucuuucccuugcuuccaaugguaaacagcccuacugcaggccuaugggaagaccuuggaacagauggagaaaaagaagagaguggauguuaaguacuugugacacuuaccaucuaagacauaggucccuguaccugccugccuggauuuagagacccauuugcuggcagaaaaaaaaaaaaaaaaaagccuggggcuuccccagcacugaaaugggaaggauggaaaagggaggcaggaaaaguaaaaggcaacagacagaggcacguuauuuuauuuuauuuuauuuuauuuuauuuauuuuauuuuuuauuuauuuugagacagagccccacucugucacccaggcuggauugcaguggcaagaucauggcucaccacagucucgaccucccaggcucaaaagauccucccaccucagccucccaaguagcaggaacuacagacugugccaccauacccagcuaauuuuuaaauuauauguagagaugaagucucgcuauguugcccaggcuggucuugaacaccugagcucaagcaauccucuugcuugggucucucaaagugcugggauuacaggcaagagcuacuaggcccaacaaggcaaauuauuuuaaaaccaccuguaggguucuagggauuuccccaaaagcccaccauuuccuucaccaagauggucagguagguagagggaucuggaaaacugaaggauggcaggagagaugggagaccccagaucccauacucuagaaccacaaccuacugcuguccacgucccuuucaaccuaucucuaggagucuccagcagaagagaaaagcuauaggggaagccuuuugcuucuacaaaaucacuauccuuccccaccaaaggcuaucuaaaaaauaauaauaauaauaauauucuuuaauauaauuuaucuuuuucucaauauuaucugaaaugcaaauaaaagcaucuguagaaaaguuugcugucuucauuggucuucaacauacaauuuaaaaguccuaagcuugguaaguaaaaugcaguuuagggaaaguccccaagcuagccccaccccacaucccauucagacagccgcaccuaaguuccugucauagaauucauauggaacuccaaugguuuagauagugucuguacucacacuaaccuccuugauccagugcaguuuucuccucuccuuccuuucuccucgccgcaaacagugcuacaccgaacuacuguccgacagacaggagagaguaaaaccacuuaguguuggucuagagcccaggacauagaucccaauacucgccuuuccggguucaggaaccugguuaucaaacgucccuccccacagucugagacaccacccuuaccaaccccaccguccagucucuaaggcccaccauuuucucugcaaacgccaccguggcgcaucccuuccacuaaauugagcaggaagcgagcggacauguguggccagugauuagagcgaugggcaucucaaucucuguauuucccucuggcagagacaaucuccccacaaaucaaagcccacgguucgccugcacagauguaggcgggggcaagggggcuagggagaaucagaggcaaaggcuccucgaacuugaggcagcauagaccaccgcccccucaagccccguaaccgcugccggggucagugagcuucugccggccuggccagggcgcgcgggccccagggcccuuaccugcuccgcuuuccccgggcccgaugccagcccgccgagcgcagggcagcggggagcugguagccagaugcgagugacgacugcaacgaaggcugcguagcucugcagcuccgggucacg

SEQ ID NO: 19160 - RNA, 4189 nt, Homo sapiens
aacacuagcuggaugcccagccccaguccaggacccuccauuggccugguccacaaucccaacuaagaauccuccacugauuugguccccagaguuagcccaugaccuuccacuggacuggucuucaggccccaccuuggacccuccaccagccuggccaccagccccagcccaagacccuucuucuguggucugauuuucaaaucuaggcuuggacccaccaccagacugaucaagugucccagcccaggccccaccacuggacugaucuacguggcccagccuagacccuccacuggcuuggucugcagugucagcccaagaccuuccacuggacugguccucaggccccaacauugacccuccacuagccuggccaccagccccagcccaggacccuucuccacuggcuugauccucaaaucuaggcuuggacccaccaccagauugaucacuagucccagcccaggacccuccaccggccugauccacaaccccagcccaguaugaaacacuacucauauucccagccccagcuccagcccaagacccuucacuggcuugguucucagccccaguccaggacccuccaauggccucuuccccaacccaggacaccccacuggccugucccccaggccaggacccaucacuggccugacccgcagcccaaagcucuccaauggccugauucccagcgagagcccaagaccccccacuggccugguucucagccccaguccaggcuccuccacuggccuuguccccagcccagguccccucacuagucugacccccagcccagagcccuccacuggccugcuccccagcucuagcccaagucccaauaccaaccacauucucagcccuggccccagcccaggacuuaacacuggucucaucacaagccacagcccaagaccgaauaaucccagccuuaucacuagccccacuccaggacccaauacuggcuucauucucaucaucagcccaggacacgcuauuuucccagucuccauccauggucugaaaccuaaauuugauccaccgcucagcagcaauccagucuucaacaccaaucccauuccaguaguagucauggauguuaggcugagucuuucugcaggcuugagugccugacccacccucacucucagaagugggcauggccucagccucaggcuuugcauaggccucaucuucugcuguggcuucugccucagaaguggacauagacuugucccuugccccaggcaaggucucacccugggaaccggccacaaucugaggcugggcagagugccuugugccugccccagucccugcuuuaggcacagcaaugguauugcccuugaccuuauuccuggcaccaagcaaggucucacucugggaauuagcgacagcuuggggcugggcagagcccacuguaucugccccagccucugccuuaggcacagcauuggaauugccccugaccuuauuuuuggccccaggcaagaccucacccugaaaacuggccacaaccuggaccuggacagagcccauuaugccugccccagccucugccuuagaaauagcauuggaauugcccuugaccuuauuccuggcaccaggcaaggucucacgcugggaguuggccacaaccugaggcugggcagagcccauuguaucuucucuggccccugccuuagacacaacauuggaauugcccuugaccuuauuccuggcaccaggcaaggucucacgcugggagcuggccaaaaccugaggcuggguagagcccacuguaucuucucuggccccugccuuagacacgacauugggauugcccuugaccuuauucuuggcaccaggcaagacuucacccugggaauuggccacagccuggggcugggcagagccccuuguauccaucccagccccugccuuagacacagcauuccaauuuccccugaccuuauucuuggcaccaggcaaggucucacaaugggaauuagccacagccuggggcuggacagagccuguugcacccaucccagcuucugccuuagacacagcauuaagauuggccuugaccuuauuuuuggcaccaggcaagaccucacccugagaauuggccacagccuggagccgggcagagucuguuguauauggcccaaccccugaauuaggcacaguagugggauugccucugaucuuauucuuggcaccaggcaagaccucacccugggaauuggccacaaucuggggcuggacagagccuguuguaucugucccagccccugccuuagacacagcauuggaauuacccuugaccuuauucuuagaaucaagcaaggccucacccuuggaacuggccauaaucugaagcugggcagugcccauugcaccuuccccaacuucugccuuaagcacaacauugggauuacccuuaacuuuauucuuggugccaagcaaggccucacccuggaaacugaccacugccucaggcugggcagagucuguuguaccuucuccagcccccaccuuaagcacaguauggggauugcccuugacuuuauucuuggcaccaggcaaggccucacccuggggauuggccacaaccaggggcugaccacagacccucuggucugccuuagucccggcuuuagaaguggcauuaggauugccccuaccaucaacccuggaaucaagcaaggccucagcuggggucuugaccccagccugagguuguguacagguuuucauguccaucccaggcccugucuuacacuuggcuuuggcuuugccccuagccuuaccucuaguauuagguaaggcuucacccuggcucugggccauaccuugagccuucauauccaccccagcuccuuccuuaggcaugguauugacauugccccugaccuuaauuuugccaucagacaagguaucagccugaacacuggccacaagcugaggcuguguacaggacaacaugucugucccaucccccaccuuagccauaacauugggauugccucugcucuuaucccuggcaucaggcaaggccucaaccugggaauuggcccucaaguuugccuuggccccugcuuuagucauggcauugggauugccucuguucuuaaccuuagcaucagacauggccucagcgugaguacuggcaacagcuugaggcugagcagcagcucucaugucagcuccaguuauugccuuagauaugacauugguauuuccccuaccaucaacccuggcaccagacgucaccucagccuguuucuuggccacagucugagguuguauacaagcucucacaucugccccugcccccaccuuacacauggcauugguguuacccccggcaucaaucuuugccccaggaauggccucagucuggguuuuggcaaaaauuugaggcugagcagaagcccucgugucugccccagacucugcccuagacaugguuuuacaauuccccauguccucaaccccaguaccaggcaugucaucacccuggaucuuggucacagccugagacugugcacaggacuucauguccacuccagccaccucccuggacaugccauugggauuuccccuagcaucaacuguggcaccaggccuggccucagacugagucuuagccacacucacagucucuuccagagcucuugucuugguuucauccacaauuccagucuuguucguggcccccaucuuggccacuucccuggguacugccaaggucucacucuguguaaccauuacucuguuaaucucugucucuuuuucagccaauauaugaguuucagcuuuggucugggucauugcuucucucuuggccucugucuuggcaaccagcgcccaagcuuuagccuuggucugugucacugcuucuuucuuaacuauuuugccagccucagcaucaguuugggucacugcuucuuucauggccacuucccuggcuuuggccuugaccucagucagagucacugccucugucaugaccaguguuccagccaccacuuuggacucagauugagucucuggcucugccccaaccauugccuuggccugagaguuggcucuguguauggcuauagcaguggccuuggucucuacuucagcccuaggcccacuucuugcuccaguuucugcuccaaucucgacuugggguuuagucuuaaucucu

SEQ ID NO: 19161 - RNA, 4199 nt, Homo sapiens
augguugacguggcccucacgugagcuggagccgacgcgugcagacguccuucuaauccuagucuucguuugguccgguugcacucuuccuauagcccagagggcgagagggccuguggccugggggaaggaggacgagguucugccuggaucccagcagguuuguguguggaugggcguugccaggggaucccugcggcgcgggcagugaaccguggaggccgaagggggagcacaguucacuuucuccaaacccuugcaguaucccuugcccuuucuagaacaaaaaugguagaccuuggggccggauuccaggggcgaccccagacucgggcgucgugggaccuuuaacauccagggccuugaaucagggagggcggauauucggauucauguccugugugcuggcccaucuaccaagccagaaucuuggggcugugcgucugacagucauaccccuuuucuuucaguaggacgcugugccauuugggaacaaaggaauagucugccuggaaucccugcaggucaguguaaagcuggagcugucccgcggcgcccagaaggacugggaugacugagguccuugccuuaacuugggcccuuuaccgacucucaagcaaucuuccugccauuuuuuuuuucuucaguaaaagaggauguaacaguggcugcaggaaaagugcuugugauugcggguagggugcguuggggagaggaauagaagagaucgguugguuuuguuuuucuccucggauuuuccauauccccccucgccccgccccgcuuccagugguuugaaaggggugugguuuugcugggaaaauggccgaccgcuggggcugcgggagggagugagggccgggggcggggacggggguaggggaacacuaccaagcgacagggcuggugucagcggaguccagagaagugaggguagggugagaaacaaaaagguaaaauccauugacagccaggacccugaauuaggagaaguggauauugggacuccccgaagugcuuuucuguccgcugagccuucaguuucugccuuguugccugugucugcagaucuuggggccggaggccaguccaacccuuggagcaggaagaaacgcaaaguugucaagaaccaaguaggucauaauaagggugauggcauuauuuggggguggagcaugguggcgacugcaacucgaaugggcccguggaccccuuccauaucccccuccuucccucuuaucuacaccauuucggagcuugcaaaagaaauuguucugcaaguacaagacagggaagaaaauagcugagaaggggugggcgucaagagaguccagggguugggaggacguuacuccaaauuacuguuugggguacaggguccuugguguugguccgucgaccaagcacucacuucugaaguuugucagucuugaagguuuaguggaagcggaaaccgaggugagggagguaagaaauugcuccggagcagagguaguugguauaaugacacgggguggggggggggggcggcgguguccugguacauuugagauggaggaguuggcggaggcaagggcggaguuggagaccuuuaggcauuucacgccaguacggcuuuuagauauucucacuucauuuuguuacaaggaaaauguuaacgaugaaaauguguggcgacaucuucggaggaugccaaugaugggaguagggguggagguggaauggaggguuagaggaaucaucgaaggaggaagagggagggagauaaugaauuccaaagccgcagcucugugaggagaggaggguaaccgaaggcgggaaacauugggcaaggcaguuguaaagggcuaggaauucagaagagggaugugugccccgucccgggugagaucuauauguacccagagcucucaguaccccucuccccgcgcccuuggucugcagguuugcacgaagcagugcacuuggaagcaagaaagagaaggaaaaaaaacugccuggaccucugugggugcaugugagggcgccacuguucacaggacaucuggaagggcagggguggcagggaacuuuaacguucuaggguggggugguggaacgugagguuggagagucuuuaagcggggaaaauuuccaaacuuagcuuccggguggaagaaaggaaucagugaucuagauaucaagccccgagucucugccaguaucucuguauuuuuguacguuuguuuguuuuguuguuguuucagucuguuugcguucaaagacacaaaaaggagccugaaaucugaaaugcauccuuuauuccuaggucgagcugccucagagccggcccgcaguagcugcagacuccgcccgcgacgugugcgcgcuucucugggccagagcgagccuguuuugugcucggguuaagagauuugucccagcuauaccaugggccgcacucgggaagcuggcugcguggccgcuggugugguuaucggggcuggugccugcuacuguguauacagacuggcuuggggaagagacgagaacgagaaaaucugggacgaagacgaggagucuacggacaccucagagauugggguugagacugugaaaggagcuaaaacuaacgcuggggcagggucuggggccaaacuucagggugauucagaggucaagccugaggugaguuugggacucgaggauuguccggguguaaaagagaaggcccauucaggaucccacagcggagguggccuagaggccaaggccaaggcccuuuucaacacgcugaaggaacaggcaagugcaaaggcaggcaaaggggcuaggguggguaccaucucugggaacaggacccuugcaccgaguuuacccugcccaggaggcagggguggaggcugccaccccaccaggaguggaucuagggccgggggcagggcaaguggaaaauccaagggaaaggcccgaaguaagagcaccagggcuccagcuacaacauggccuguccggagaggcaaguucaacuuuccuuauaaaauugaugauauucugagugcucccgaccuccaaaagguccucaacauccuggagcgaacaaaugauccuuuuauucaagaaguagccuuggucacucuggguaacaaugcagcauauucauuuaaccagaaugccauacgugaauuggguggugucccaauuauugcaaaacugauaaaaacaaaagaccccauaauuagggaaaagacuuacaaugcccuuaauaacuugagugugaacgcagaaaaucagggcaagauuaagacguacaucagucaagugugugaugacaccauggucugucgcuuggacucagcugugcagauggcugggcuaagacuguuaaccaacaugacugugacuaaucauuaccaacauuugcuuuccuauucuuuuccagacuuuuuugcuuuguuauuccugggaaaucacuucaccaagauacagauuaugaaacuaauuauaaacuuuacugaaaauccagccaugacaagagagcuggucaguuguaaaguaccaucagaauugauuucccucuuuaauaaagaaugggauagagagauucuucuuaauauccuuacccuauuugagaauauaaaugacaacauaaaaaaugaagggcucgcaucauccaggaaagaauucagcagaaguucacuuuuuuucuuauucaaagagucuggaguuuguguuaagaaaaucaaagcacuagcaaaucacaaugaucugguggugaaaguaaaaguccugaaaguauuaaccaaacucuaauuuggagucugucccaaacaauauugagauauuugcaguugguacgaugugauuuguaaauucuuuguuuuucauugugcguauaugguaaagagaucuuuucagcugcuauuuuggaauaaugacuaucauauaucauaacagugacugauguugguuguaaugguuggguuuaggaugaaccauuuuaaggaugccaaaugaaauauuaguauuuguacacagaaagaauuuauugauuugaucuuauuaccuagauugagauuuuuuaaucuuuccucuaccuaaacugacaaugaauugguuauacaucaugcauaagcuacacuuuuauauuaguuuauauuuguuauucuaagacuuguguuucaucaauaaaguuguguuuuaagcagcagaaaaaaaaa

SEQ ID NO: 19162 - RNA, 4199 nt, Homo sapiens
uuuuuuuuucugcugcuuaaaacacaacuuuauugaugaaacacaagucuuagaauaacaaauauaaacuaauauaaaaguguagcuuaugcaugauguauaaccaauucauugucaguuuagguagaggaaagauuaaaaaaucucaaucuagguaauaagaucaaaucaauaaauucuuucuguguacaaauacuaauauuucauuuggcauccuuaaaaugguucauccuaaacccaaccauuacaaccaacaucagucacuguuaugauauaugauagucauuauuccaaaauagcagcugaaaagaucucuuuaccauauacgcacaaugaaaaacaaagaauuuacaaaucacaucguaccaacugcaaauaucucaauauuguuugggacagacuccaaauuagaguuugguuaauacuuucaggacuuuuacuuucaccaccagaucauugugauuugcuagugcuuugauuuucuuaacacaaacuccagacucuuugaauaagaaaaaaagugaacuucugcugaauucuuuccuggaugaugcgagcccuucauuuuuuauguugucauuuauauucucaaauaggguaaggauauuaagaagaaucucucuaucccauucuuuauuaaagagggaaaucaauucugaugguacuuuacaacugaccagcucucuugucauggcuggauuuucaguaaaguuuauaauuaguuucauaaucuguaucuuggugaagugauuucccaggaauaacaaagcaaaaaagucuggaaaagaauaggaaagcaaauguugguaaugauuagucacagucauguugguuaacagucuuagcccagccaucugcacagcugaguccaagcgacagaccauggugucaucacacacuugacugauguacgucuuaaucuugcccugauuuucugcguucacacucaaguuauuaagggcauuguaagucuuuucccuaauuauggggucuuuuguuuuuaucaguuuugcaauaauugggacaccacccaauucacguauggcauucugguuaaaugaauaugcugcauuguuacccagagugaccaaggcuacuucuugaauaaaaggaucauuuguucgcuccaggauguugaggaccuuuuggaggucgggagcacucagaauaucaucaauuuuauaaggaaaguugaacuugccucuccggacaggccauguuguagcuggagcccuggugcucuuacuucgggccuuucccuuggauuuuccacuugcccugcccccggcccuagauccacuccuggugggguggcagccuccaccccugccuccugggcaggguaaacucggugcaaggguccuguucccagagaugguacccacccuagccccuuugccugccuuugcacuugccuguuccuucagcguguugaaaagggccuuggccuuggccucuaggccaccuccgcugugggauccugaaugggccuucucuuuuacacccggacaauccucgagucccaaacucaccucaggcuugaccucugaaucacccugaaguuuggccccagacccugccccagcguuaguuuuagcuccuuucacagucucaaccccaaucucugagguguccguagacuccucgucuucgucccagauuuucucguucucgucucuuccccaagccagucuguauacacaguagcaggcaccagccccgauaaccacaccagcggccacgcagccagcuucccgagugcggcccaugguauagcugggacaaaucucuuaacccgagcacaaaacaggcucgcucuggcccagagaagcgcgcacacgucgcgggcggagucugcagcuacugcgggccggcucugaggcagcucgaccuaggaauaaaggaugcauuucagauuucaggcuccuuuuugugucuuugaacgcaaacagacugaaacaacaacaaaacaaacaaacguacaaaaauacagagauacuggcagagacucggggcuugauaucuagaucacugauuccuuucuuccacccggaagcuaaguuuggaaauuuuccccgcuuaaagacucuccaaccucacguuccaccaccccacccuagaacguuaaaguucccugccaccccugcccuuccagauguccugugaacaguggcgcccucacaugcacccacagagguccaggcaguuuuuuuuccuucucuuucuugcuuccaagugcacugcuucgugcaaaccugcagaccaagggcgcggggagagggguacugagagcucuggguacauauagaucucacccgggacggggcacacaucccucuucugaauuccuagcccuuuacaacugccuugcccaauguuucccgccuucgguuacccuccucuccucacagagcugcggcuuuggaauucauuaucucccucccucuuccuccuucgaugauuccucuaacccuccauuccaccuccaccccuacucccaucauuggcauccuccgaagaugucgccacacauuuucaucguuaacauuuuccuuguaacaaaaugaagugagaauaucuaaaagccguacuggcgugaaaugccuaaaggucuccaacuccgcccuugccuccgccaacuccuccaucucaaauguaccaggacaccgccgccccccccccccaccccgugucauuauaccaacuaccucugcuccggagcaauuucuuaccucccucaccucgguuuccgcuuccacuaaaccuucaagacugacaaacuucagaagugagugcuuggucgacggaccaacaccaaggacccuguaccccaaacaguaauuuggaguaacguccucccaaccccuggacucucuugacgcccaccccuucucagcuauuuucuucccugucuuguacuugcagaacaauuucuuuugcaagcuccgaaaugguguagauaagagggaaggagggggauauggaagggguccacgggcccauucgaguugcagucgccaccaugcuccacccccaaauaaugccaucacccuuauuaugaccuacuugguucuugacaacuuugcguuucuuccugcuccaaggguuggacuggccuccggccccaagaucugcagacacaggcaacaaggcagaaacugaaggcucagcggacagaaaagcacuucggggagucccaauauccacuucuccuaauucaggguccuggcugucaauggauuuuaccuuuuuguuucucacccuacccucacuucucuggacuccgcugacaccagcccugucgcuugguaguguuccccuacccccguccccgcccccggcccucacucccucccgcagccccagcggucggccauuuucccagcaaaaccacaccccuuucaaaccacuggaagcggggcggggcgaggggggauauggaaaauccgaggagaaaaacaaaaccaaccgaucucuucuauuccucuccccaacgcacccuacccgcaaucacaagcacuuuuccugcagccacuguuacauccucuuuuacugaagaaaaaaaaaauggcaggaagauugcuugagagucgguaaagggcccaaguuaaggcaaggaccucagucaucccaguccuucugggcgccgcgggacagcuccagcuuuacacugaccugcagggauuccaggcagacuauuccuuuguucccaaauggcacagcguccuacugaaagaaaagggguaugacugucagacgcacagccccaagauucuggcuugguagaugggccagcacacaggacaugaauccgaauauccgcccucccugauucaaggcccuggauguuaaaggucccacgacgcccgagucuggggucgccccuggaauccggccccaaggucuaccauuuuuguucuagaaagggcaagggauacugcaaggguuuggagaaagugaacugugcucccccuucggccuccacgguucacugcccgcgccgcagggauccccuggcaacgcccauccacacacaaaccugcugggauccaggcagaaccucguccuccuucccccaggccacaggcccucucgcccucugggcuauaggaagagugcaaccggaccaaacgaagacuaggauuagaaggacgucugcacgcgucggcuccagcucacgugagggccacgucaaccau

SEQ ID NO: 19163 - RNA, 1128 nt, Homo sapiens
ccucuccaagugucuuuucauucagggaaaacuguuguuugccgagcccaaggaugcgggcuuuccauuuagccaggauaucaauagccauuuggccagccucucaauggcuagaaacacgagccccacuccagaccccacuguuagagaggcuuugugugccccggauaacuuaaaugcgaguauugaaagucagggccagauuaagauguacaucaaugaagugugucgggagacugugucacguugcugcaacucauuucugcagcaggccggauuaaauuuguuaauaagcaugacaguuauuaauaacaugcuugccaaguccgcuucagacuugaaguuuccuuugauaucagagggaaguggaugugcuaagguucagguuuugaaaccgcugauggguuugucugaaaagccagucuuggcgggggaguuagucggugcccagaugcucuucucauucaugucccucuuuaucagaaauggaaacagagagauucuccuggaaaccccugccccauaaacggcccucucgaacacaaugggacggaauccacccacaacgcgcuugguuugcagaugucaaagaaucugcagagggugcuacugaagauccagccuuagccaaucaccaccucauugggugaaaguuccagggcucaauccaggaccacacucuuauuggccaggcaggggcucccacagagcuuugaguaacuucuugguugugcagucugcaggcaauguuggcauuguaaauuccucccuugcagccuccuucauguggugaggggaucacuucagcugccugcuguggacaaagaacaucaaauuacagcaucacgagugcuauuguugccugugguggucucccuguccaagcgggaccgcuuugcagagaccagaggcauaucgcggcuugagcugaaaaugcauuuguugcagcuuagguugaauuauuuuucguuugcucuuucuucuacacgcgccugauggauagugaaccuauucaucaaaaaagugcacugcucuucugucuauuguaccgacuuaaccucuuccacccaaguccgcaucuguguguaucaucaauaaaguugugugcuuugauuggcagaaaagagu
